United States Patent 11,725,251 (METHYLATION MARKERS AND TARGETED METHYLATION PROBE PANEL) - sequence listing, part 6

SEQ ID NO: 57270 - DNA, 54 bp, Homo sapiens; identical to SEQ ID NO: 36654
  misc_feature 1..54: note = chr17:48637706-48637760
  misc_feature 1..54: note = hyper
  source 1..54: mol_type = genomic DNA

SEQ ID NO: 57271 - DNA, 30 bp, Homo sapiens; identical to SEQ ID NO: 36655
  misc_feature 1..30: note = chr17:48712444-48712474
  misc_feature 1..30: note = hyper
  source 1..30: mol_type = genomic DNA

SEQ ID NO: 57272 - DNA, 527 bp, Homo sapiens
  misc_feature 1..527: note = chr17:50235952-50236479
  misc_feature 1..527: note = hyper
  source 1..527: mol_type = genomic DNA
gactctccaggtcgcgcgcgcccttcctgctcctctgctattttcctgaactccccagaacccccagttgcctggcttccatcgcccgcaactagcgccgctgtcgagattttccgcaatacaactgcaggggtcgttatttcctcgcctacggatccctacgcttcccaactcagagaggaggaggacaggtgggggcgggagggggaggaggagaaggaggcttggccaggtgagcgtcctcgccgccgccgggcgtcccagcgtcagctccgcagcccggcacccgggggcggaggcaggaggcccgggcggggaggtgaggctgagcgcggccatgaggaggaggaggaggaggctgggtgtcacagcttcaggccaccttggccgccgcctcggccccagtccctggcagccgcctccgcactccgccccgccctggctgcctctgttaccctccaggattttcgagtttctcttcttaaaaagaacttcgtgctgcgggttcggcgcgggagacccaggca

SEQ ID NO: 57273 - DNA, 60 bp, Homo sapiens; identical to SEQ ID NO: 36657
  misc_feature 1..60: note = chr17:50236690-50236750
  misc_feature 1..60: note = hyper
  source 1..60: mol_type = genomic DNA

SEQ ID NO: 57274 - DNA, 30 bp, Homo sapiens; identical to SEQ ID NO: 36658
  misc_feature 1..30: note = chr17:50237251-50237281
  misc_feature 1..30: note = hyper
  source 1..30: mol_type = genomic DNA

SEQ ID NO: 57275 - DNA, 25 bp, Homo sapiens
  misc_feature 1..25: note = chr17:53341227-53341252
  misc_feature 1..25: note = hyper
  source 1..25: mol_type = genomic DNA
cgtcccactgaaaaacggttttctt

SEQ ID NO: 57276 - DNA, 87 bp, Homo sapiens; identical to SEQ ID NO: 36660
  misc_feature 1..87: note = chr17:53342183-53342270
  misc_feature 1..87: note = hyper
  source 1..87: mol_type = genomic DNA

SEQ ID NO: 57277 - DNA, 48 bp, Homo sapiens
  misc_feature 1..48: note = chr17:53342828-53342876
  misc_feature 1..48: note = hyper
  source 1..48: mol_type = genomic DNA
aatttgagtgcatcgcgatggagaaaatgtcccgaccgctccccctga

SEQ ID NO: 57278 - DNA, 558 bp, Homo sapiens
  misc_feature 1..558: note = chr17:53343089-53343647
  misc_feature 1..558: note = hyper
  source 1..558: mol_type = genomic DNA
ctgatgaaattgaggagctcacccagcacccttcctccccttcctcctcctccatgaaaggggagggacccctcctgagctacatttaaaagagcttcgggcacccggcctccctgggtcccgctcctgcggcgcgggtgggaggtgtaacttgacaggtcaggatcgttccctagaacgaggcacacccgcacgcagagcgagcccgcctgcggagggcagagcctcccgggctggggaggagaaaccctggggcctggttctgtgcggggcagggggcgggggtcggcttgagggagggggtttcactgcgtagcctgggttttggggttgtgttacagcttctgttactggttagtatttggaactcacgaggtgtgagagaagactcgttttcttctggtgaagggtagctgagaaagcggggtgggggctggggccggtggggggagtggtctctcggcgggaagccgtgcacgcctccagcgttgacactttcccggtgcactttttctggtgggaggggagagcggagcaggctcacgtgtaaccgcgcag

SEQ ID NO: 57279 - DNA, 216 bp, Homo sapiens
  misc_feature 1..216: note = chr17:53922790-53923006
  misc_feature 1..216: note = hyper
  source 1..216: mol_type = genomic DNA
cccaggacggcgtccgcgggcctcagcgactctgcggagggtttccgcgggatgctcaagggggcagtgtggtcctgccgaagagggccgcctcgcctcgaggaacgccttggccattttcacaggaaaatgtttaccctggaaattaaattatatttgggattttgggtttcccctcccccaccccgccgtgggaggtttcggaaagttactgtg

SEQ ID NO: 57280 - DNA, 30 bp, Homo sapiens; identical to SEQ ID NO: 36664
  misc_feature 1..30: note = chr17:54671575-54671605
  misc_feature 1..30: note = hyper
  source 1..30: mol_type = genomic DNA

SEQ ID NO: 57281 - DNA, 343 bp, Homo sapiens; identical to SEQ ID NO: 36665
  misc_feature 1..343: note = chr17:54671992-54672335
  misc_feature 1..343: note = hyper
  source 1..343: mol_type = genomic DNA

SEQ ID NO: 57282 - DNA, 155 bp, Homo sapiens; identical to SEQ ID NO: 36666
  misc_feature 1..155: note = chr17:54673918-54674073
  misc_feature 1..155: note = hyper
  source 1..155: mol_type = genomic DNA

SEQ ID NO: 57283 - DNA, 248 bp, Homo sapiens
  misc_feature 1..248: note = chr17:54674738-54674986
  misc_feature 1..248: note = hyper
  source 1..248: mol_type = genomic DNA
aaactttctgtgccccgggccaatatttttttagacagagtttcacttgcgaggggcggaggtggtggggagtggggaagaggaggggtcttatgcgaggggggcgaaagcaagaattttcatgcctggtaaacacgcgaattatgcgaagagagttattcccagctgggcgggcagccaaaactcggagagcgcgccgaggccagcgcccccacccccacgttggcaatgtcattggattacaatgc

SEQ ID NO: 57284 - DNA, 37 bp, Homo sapiens
  misc_feature 1..37: note = chr17:54675272-54675309
  misc_feature 1..37: note = hyper
  source 1..37: mol_type = genomic DNA
tcctggaacattgtgcctaatgcgcagctggttacct

SEQ ID NO: 57285 - DNA, 20 bp, Homo sapiens
  misc_feature 1..20: note = chr17:54755949-54755969
  misc_feature 1..20: note = hyper
  source 1..20: mol_type = genomic DNA
taaccccccaggaagcgctc

SEQ ID NO: 57286 - DNA, 33 bp, Homo sapiens; identical to SEQ ID NO: 36670
  misc_feature 1..33: note = chr17:54756362-54756395
  misc_feature 1..33: note = hyper
  source 1..33: mol_type = genomic DNA

SEQ ID NO: 57287 - DNA, 134 bp, Homo sapiens
  misc_feature 1..134: note = chr17:56234271-56234405
  misc_feature 1..134: note = hyper
  source 1..134: mol_type = genomic DNA
tttagaaagttatctcgccctccctcctcccccacaaaaaaagtttgagtcgccgctgcgggttgctagcggagtcgcgcgtcgggagctacgtagggcagggaaggcatggcttctgttttcgtccaatgaga

SEQ ID NO: 57288 - DNA, 97 bp, Homo sapiens
  misc_feature 1..97: note = chr17:56234743-56234840
  misc_feature 1..97: note = hyper
  source 1..97: mol_type = genomic DNA
acgtgagccctaccacctgcaccctgagaaaacacaagaccaatccgaagccgcgcacagcctttaccacgtcccagctcctcgctctggagggcaa

SEQ ID NO: 57289 - DNA, 128 bp, Homo sapiens
  misc_feature 1..128: note = chr17:56326821-56326949
  misc_feature 1..128: note = hyper
  source 1..128: mol_type = genomic DNA
gcgtcccctccgcctcgagcagaggctccttcccccatggggtcctgggctttggagccccggagccggcctgccgaagctcagcgaggatcgtgctggtttcaggaggaagcctgcgctgggcgccg

SEQ ID NO: 57290 - DNA, 49 bp, Homo sapiens
  misc_feature 1..49: note = chr17:56327222-56327271
  misc_feature 1..49: note = hyper
  source 1..49: mol_type = genomic DNA
cccggagcccggccacgtggcggtcacgttctggccgccgcaggccaga

SEQ ID NO: 57291 - DNA, 181 bp, Homo sapiens; identical to SEQ ID NO: 22588
  misc_feature 1..181: note = chr17:56832946-56833127
  misc_feature 1..181: note = hyper
  source 1..181: mol_type = genomic DNA

SEQ ID NO: 57292 - DNA, 336 bp, Homo sapiens
  misc_feature 1..336: note = chr17:56833221-56833557
  misc_feature 1..336: note = hyper
  source 1..336: mol_type = genomic DNA
ggcaacctagtgctgatcgctcgtgccggtgcggccgttaaccgcccttgccggagccctaggctcaaaagcagccccttacccttcctgggcttcccccaacccctttcccggtctgccctggggcatgagcagcgatggccggctgcatccctgaggagaaaacttaccggcgcttcctggagctattcctgggcgagtttcgcggaccgtgcggcggcggcgagccggagccggaacccgaacccgaacccgaacccgaacccgagtccgagcccgagcccgaacctgaactggtagaagctgaggcggccgaggcttcggtagaggaacccg

SEQ ID NO: 57293 - DNA, 59 bp, Homo sapiens
  misc_feature 1..59: note = chr17:56834247-56834306
  misc_feature 1..59: note = hyper
  source 1..59: mol_type = genomic DNA
cagtctgtcttttcccgggctgagtgccttgttgtttggcggcagagacgcgactcctt

SEQ ID NO: 57294 - DNA, 718 bp, Homo sapiens; identical to SEQ ID NO: 36677
  misc_feature 1..718: note = chr17:58212587-58213305
  misc_feature 1..718: note = hyper
  source 1..718: mol_type = genomic DNA

SEQ ID NO: 57295 - DNA, 48 bp, Homo sapiens
  misc_feature 1..48: note = chr17:58216565-58216613
  misc_feature 1..48: note = hyper
  source 1..48: mol_type = genomic DNA
cgaggactagcagcagatctggtgtgcagaaccctggattcgagtccc

SEQ ID NO: 57296 - DNA, 73 bp, Homo sapiens
  misc_feature 1..73: note = chr17:58217551-58217624
  misc_feature 1..73: note = hyper
  source 1..73: mol_type = genomic DNA
tgttcagtcccaggcagtgcgggacaggtgggcgaagctcgaaccccatgctctgtcccggcactggcaggaa

SEQ ID NO: 57297 - DNA, 117 bp, Homo sapiens
  misc_feature 1..117: note = chr17:58218648-58218765
  misc_feature 1..117: note = hyper
  source 1..117: mol_type = genomic DNA
aggccaaggctggcccgcttagggaccgcgctcgggctggacgtcgcgctcagcgcgcagggcccccatggacgtcgcgccgctgacctagctgtcagacatcgccacgaggagttg

SEQ ID NO: 57298 - DNA, 64 bp, Homo sapiens; identical to SEQ ID NO: 22594
  misc_feature 1..64: note = chr17:58218993-58219057
  misc_feature 1..64: note = hyper
  source 1..64: mol_type = genomic DNA

SEQ ID NO: 57299 - DNA, 270 bp, Homo sapiens; identical to SEQ ID NO: 22595
  misc_feature 1..270: note = chr17:58227104-58227374
  misc_feature 1..270: note = hyper
  source 1..270: mol_type = genomic DNA

SEQ ID NO: 57300 - DNA, 210 bp, Homo sapiens; identical to SEQ ID NO: 36683
  misc_feature 1..210: note = chr17:58228164-58228374
  misc_feature 1..210: note = hyper
  source 1..210: mol_type = genomic DNA

SEQ ID NO: 57301 - DNA, 31 bp, Homo sapiens
  misc_feature 1..31: note = chr17:58499314-58499345
  misc_feature 1..31: note = hyper
  source 1..31: mol_type = genomic DNA
agcccgtaggcactggcggggatctttatac

SEQ ID NO: 57302 - DNA, 91 bp, Homo sapiens; identical to SEQ ID NO: 36686
  misc_feature 1..91: note = chr17:59467463-59467554
  misc_feature 1..91: note = hyper
  source 1..91: mol_type = genomic DNA

SEQ ID NO: 57303 - DNA, 92 bp, Homo sapiens; identical to SEQ ID NO: 22598
  misc_feature 1..92: note = chr17:59474741-59474833
  misc_feature 1..92: note = hyper
  source 1..92: mol_type = genomic DNA

SEQ ID NO: 57304 - DNA, 44 bp, Homo sapiens; identical to SEQ ID NO: 22599
  misc_feature 1..44: note = chr17:59475100-59475144
  misc_feature 1..44: note = hyper
  source 1..44: mol_type = genomic DNA

SEQ ID NO: 57305 - DNA, 53 bp, Homo sapiens; identical to SEQ ID NO: 36689
  misc_feature 1..53: note = chr17:59475357-59475410
  misc_feature 1..53: note = hyper
  source 1..53: mol_type = genomic DNA

SEQ ID NO: 57306 - DNA, 283 bp, Homo sapiens
  misc_feature 1..283: note = chr17:59476127-59476410
  misc_feature 1..283: note = hyper
  source 1..283: mol_type = genomic DNA
gaagagggggcttcaatcacaggtgctcgcagacaccccaactccctcacgcgttactcagcactccttaacttaggagacgtgcgcttccgagagatgagaagaaactaaaaaagtggttggcagggcgaagagaggaagccggtatttcggaagaaggagactttcgtctccggtaccggatagggcgaaaattcgttgggtcgcgggtggagaatccggggtccgcccgcgcggtgccgccctgtgctcagcgaaaggtgcgctcaccttcctggccccg

SEQ ID NO: 57307 - DNA, 1512 bp, Homo sapiens
  misc_feature 1..1512: note = chr17:59476635-59478147
  misc_feature 1..1512: note = hyper
  source 1..1512: mol_type = genomic DNA
gccgcccgagcctcccgactcgcccgcccaccggcctcgctttccagtgcctgctgtctctttccggggcgcagggacccccaggcggcgccacgacccggagctgggtcggaggccaggctggggctcgggccagagcggccgggcctctgggcgcgggagaaggagggcgccccctctccgctcggggtcgtgtcaatgctttgcacttggggccggcgtgcggctgcgggtccttccccaaggccccgggacccgggctcccctcgcctcaggccctttcggcgggtcaggtcggccctccgcgctctccagtccggcgcaggcagccgcaggcgcgggcgggcggtgggggccggggcaggaggaggggtctcggggcccggcggcccgtcattggttaatattttattctgttgacatgttttcttactgctgaggcttccgacaccttctcccaggccccccctcccggccggagcttggcctgagctgtcaaaaccccgcccccggagacccacaattggtccaaaaagcgtaaaatcagcaatcaaggggggcctggctcgttagcgcaggggatccgagctgggcaggacatgtgagatagtcacagttttccagagatcacgacaagatctaaccagtcgcgcgtggtccccggcgccggagcgggccagctcagcccggcccagcccggccccgcgcagagcccccgccgcccccgcgcacagagccgggtgccccttgcggtgcgccggacgggaagccccgaggagcagctgctgcgcccgccacccgggtcgtccgtccaccgcgcgcgccgccgcccgggccgggggtccgagccgcgcgcccccggccccggccccggcccccgggcgcctgggccggatgtcccgatgagagagccggcgctggcggccagcgccatggcttaccacccgttccacgcgccacggcccgccgacttccccatgtccgcctttctggcggcggcgcagccctccttcttcccggcactcgcgctgccgcccggcgcgctggccaagccgctgcccgacccgggcctggcgggggcggcggccgcggcggcggcggcggcagcagcggccgaggcggggctgcacgtctcggcactgggcccgcacccgcccgccgcgcatctgcgctccctcaagagcctggagcccgaggacgaggtggaggacgaccccaaggtgacgctggaggccaaggagctgtgggaccagttccacaagctaggcacggagatggtcatcaccaagtccgggaggtagggctgccggccggctggaaggcgcgcgggcgggcgggcgggctggggcacgggactgcacggatcagagcagagctggggactcccggctcccggctcccggctccaggttctggccctgacgccacgcttcgctcccacggacaaccaagttgacttttctcgtttggcaccggagcgatttttttttaaaacaaaaacgctaaaatcct

SEQ ID NO: 57308 - DNA, 76 bp, Homo sapiens
  misc_feature 1..76: note = chr17:59478602-59478678
  misc_feature 1..76: note = hyper
  source 1..76: mol_type = genomic DNA
atcaggctctgtagcccagttcccaatacaaacaccctccagatttatttctgggagcttccgtcccaagtgggta

SEQ ID NO: 57309 - DNA, 368 bp, Homo sapiens; identical to SEQ ID NO: 36693
  misc_feature 1..368: note = chr17:59488634-59489002
  misc_feature 1..368: note = hyper
  source 1..368: mol_type = genomic DNA

SEQ ID NO: 57310 - DNA, 72 bp, Homo sapiens; identical to SEQ ID NO: 36694
  misc_feature 1..72: note = chr17:59490147-59490219
  misc_feature 1..72: note = hyper
  source 1..72: mol_type = genomic DNA

SEQ ID NO: 57311 - DNA, 195 bp, Homo sapiens; identical to SEQ ID NO: 22605
  misc_feature 1..195: note = chr17:59534556-59534751
  misc_feature 1..195: note = hyper
  source 1..195: mol_type = genomic DNA

SEQ ID NO: 57312 - DNA, 41 bp, Homo sapiens
  misc_feature 1..41: note = chr17:59535096-59535137
  misc_feature 1..41: note = hyper
  source 1..41: mol_type = genomic DNA
gcctctctgcctcctcgggcgtcagtgccacctcccttcgc

SEQ ID NO: 57313 - DNA, 48 bp, Homo sapiens; identical to SEQ ID NO: 22606
  misc_feature 1..48: note = chr17:59535219-59535267
  misc_feature 1..48: note = hyper
  source 1..48: mol_type = genomic DNA

SEQ ID NO: 57314 - DNA, 21 bp, Homo sapiens
  misc_feature 1..21: note = chr17:59539215-59539236
  misc_feature 1..21: note = hyper
  source 1..21: mol_type = genomic DNA
gtccccagggacctccgagaa

SEQ ID NO: 57315 - DNA, 110 bp, Homo sapiens
  misc_feature 1..110: note = chr17:59539601-59539711
  misc_feature 1..110: note = hyper
  source 1..110: mol_type = genomic DNA
cctgtttcatgatcagaggagaagccccgggctttcatctcctcccgggccggcgagcaggcggcttgtttattcccctggcggagccgtttccgcgtgtgccgtgggga

SEQ ID NO: 57316 - DNA, 301 bp, Homo sapiens; identical to SEQ ID NO: 36704
  misc_feature 1..301: note = chr17:60705635-60705936
  misc_feature 1..301: note = hyper
  source 1..301: mol_type = genomic DNA

SEQ ID NO: 57317 - DNA, 90 bp, Homo sapiens; identical to SEQ ID NO: 36705
  misc_feature 1..90: note = chr17:61600708-61600798
  misc_feature 1..90: note = hyper
  source 1..90: mol_type = genomic DNA

SEQ ID NO: 57318 - DNA, 165 bp, Homo sapiens; identical to SEQ ID NO: 36706
  misc_feature 1..165: note = chr17:61777909-61778074
  misc_feature 1..165: note = hyper
  source 1..165: mol_type = genomic DNA

SEQ ID NO: 57319 - DNA, 27 bp, Homo sapiens
  misc_feature 1..27: note = chr17:61926145-61926172
  misc_feature 1..27: note = hyper
  source 1..27: mol_type = genomic DNA
aaaaaaacaagactttttgcaaattat

SEQ ID NO: 57320 - DNA, 22 bp, Homo sapiens
  misc_feature 1..22: note = chr17:61926603-61926625
  misc_feature 1..22: note = hyper
  source 1..22: mol_type = genomic DNA
atcaggaaaaccgctctccggc

SEQ ID NO: 57321 - DNA, 54 bp, Homo sapiens; identical to SEQ ID NO: 36710
  misc_feature 1..54: note = chr17:62776217-62776271
  misc_feature 1..54: note = hyper
  source 1..54: mol_type = genomic DNA

SEQ ID NO: 57322 - DNA, 275 bp, Homo sapiens; identical to SEQ ID NO: 36711
  misc_feature 1..275: note = chr17:62776523-62776798
  misc_feature 1..275: note = hyper
  source 1..275: mol_type = genomic DNA

SEQ ID NO: 57323 - DNA, 270 bp, Homo sapiens; identical to SEQ ID NO: 36712
  misc_feature 1..270: note = chr17:62777021-62777291
  misc_feature 1..270: note = hyper
  source 1..270: mol_type = genomic DNA

SEQ ID NO: 57324 - DNA, 141 bp, Homo sapiens; identical to SEQ ID NO: 36713
  misc_feature 1..141: note = chr17:64825634-64825775
  misc_feature 1..141: note = hyper
  source 1..141: mol_type = genomic DNA

SEQ ID NO: 57325 - DNA, 229 bp, Homo sapiens; identical to SEQ ID NO: 36714
  misc_feature 1..229: note = chr17:64831214-64831443
  misc_feature 1..229: note = hyper
  source 1..229: mol_type = genomic DNA

SEQ ID NO: 57326 - DNA, 60 bp, Homo sapiens; identical to SEQ ID NO: 36715
  misc_feature 1..60: note = chr17:64961565-64961625
  misc_feature 1..60: note = hyper
  source 1..60: mol_type = genomic DNA

SEQ ID NO: 57327 - DNA, 45 bp, Homo sapiens; identical to SEQ ID NO: 12865
  misc_feature 1..45: note = chr17:64961987-64962032
  misc_feature 1..45: note = hyper
  source 1..45: mol_type = genomic DNA

SEQ ID NO: 57328 - DNA, 169 bp, Homo sapiens; identical to SEQ ID NO: 22613
  misc_feature 1..169: note = chr17:66596302-66596471
  misc_feature 1..169: note = hyper
  source 1..169: mol_type = genomic DNA

SEQ ID NO: 57329 - DNA, 459 bp, Homo sapiens
  misc_feature 1..459: note = chr17:66596525-66596984
  misc_feature 1..459: note = hyper
  source 1..459: mol_type = genomic DNA
ggcctgcaacttggagctcgacccgctgtggctgccgccagccggttcagtccggggctcggttcgggaaaagttgtgcacgatcgtgccggggtccgaggcagctgcggccgagtcccgcgccagggaggaggcgcggccggtgcacgggcacccccgcgggcgctcccgaggccgcagctggcgctgtacttggggccagaggtggaagtagaggtcggcggagagcagcgcgcccagcagcagcagagtcagtaggcggtcccggcgcagccccggcatggcgtgctggccaagggggacgccgggggcaggccggctgtctccggggtcccgggaggggtcgcggggtgcgggcagaagaggtgcctggagtcccgcgggtgggccggggtcagtgagaccggaatgctccccgcgcgggctagtcccctgtggaggggtgtcgctcctcaactt

SEQ ID NO: 57330 - DNA, 494 bp, Homo sapiens
  misc_feature 1..494: note = chr17:66597021-66597515
  misc_feature 1..494: note = hyper
  source 1..494: mol_type = genomic DNA
cagcgggcgtcgcttctccgcgccgagtgagccgagggaatggggttcccggggtgcccgcttcttgcgccttttctcccgtgcgcccgcccgcccggacgctcgcggcaggtgaagggccccggggcgccggcgccggctgccaccgcgggcggacgggcgacggggcggggggcgaccgcggagggcggacggaggccgccggctgcaaagcccggggcgtctctcctgaggatgctgtcgctcggcggcggctgctagtgctcccgcgactcctcctgcgggcggcggagacgccagtgccggcggctggcacgggcggcgcgagtggggagttggcgaagcaggagcggctccggggagcttgtctgtgcgcctggactcctagaggcagaggtagcgcggggcctccccgagcctggcctggcgccggcacccccacccactctccgctggcacctgcctctggcgcagctgacggccaactcccgatc

SEQ ID NO: 57331 - DNA, 749 bp, Homo sapiens; identical to SEQ ID NO: 36718
  misc_feature 1..749: note = chr17:68165237-68165986
  misc_feature 1..749: note = hyper
  source 1..749: mol_type = genomic DNA

SEQ ID NO: 57332 - DNA, 30 bp, Homo sapiens; identical to SEQ ID NO: 36720
  misc_feature 1..30: note = chr17:70026970-70027000
  misc_feature 1..30: note = hyper
  source 1..30: mol_type = genomic DNA

SEQ ID NO: 57333 - DNA, 100 bp, Homo sapiens
  misc_feature 1..100: note = chr17:70112816-70112916
  misc_feature 1..100: note = hyper
  source 1..100: mol_type = genomic DNA
aaattttccgcagggcgttctagggatgagttgagggaagccgcatgacgcgcggctccccggtgccacagctaaggacagatattttcgcaaaacccag

SEQ ID NO: 57334 - DNA, 30 bp, Homo sapiens; identical to SEQ ID NO: 36724
  misc_feature 1..30: note = chr17:70115315-70115345
  misc_feature 1..30: note = hyper
  source 1..30: mol_type = genomic DNA

SEQ ID NO: 57335 - DNA, 16 bp, Homo sapiens
  misc_feature 1..16: note = chr17:70215667-70215683
  misc_feature 1..16: note = hyper
  source 1..16: mol_type = genomic DNA
ccagggcagcagacac

SEQ ID NO: 57336 - DNA, 59 bp, Homo sapiens; identical to SEQ ID NO: 36727
  misc_feature 1..59: note = chr17:70588893-70588952
  misc_feature 1..59: note = hyper
  source 1..59: mol_type = genomic DNA

SEQ ID NO: 57337 - DNA, 30 bp, Homo sapiens; identical to SEQ ID NO: 36728
  misc_feature 1..30: note = chr17:71160848-71160878
  misc_feature 1..30: note = hyper
  source 1..30: mol_type = genomic DNA

SEQ ID NO: 57338 - DNA, 256 bp, Homo sapiens; identical to SEQ ID NO: 36729
  misc_feature 1..256: note = chr17:71161183-71161439
  misc_feature 1..256: note = hyper
  source 1..256: mol_type = genomic DNA

SEQ ID NO: 57339 - DNA, 917 bp, Homo sapiens; identical to SEQ ID NO: 36730
  misc_feature 1..917: note = chr17:71161499-71162416
  misc_feature 1..917: note = hyper
  source 1..917: mol_type = genomic DNA

SEQ ID NO: 57340 - DNA, 61 bp, Homo sapiens; identical to SEQ ID NO: 36731
  misc_feature 1..61: note = chr17:71639405-71639466
  misc_feature 1..61: note = hyper
  source 1..61: mol_type = genomic DNA

SEQ ID NO: 57341 - DNA, 62 bp, Homo sapiens; identical to SEQ ID NO: 36732
  misc_feature 1..62: note = chr17:71639789-71639851
  misc_feature 1..62: note = hyper
  source 1..62: mol_type = genomic DNA

SEQ ID NO: 57342 - DNA, 30 bp, Homo sapiens; identical to SEQ ID NO: 36733
  misc_feature 1..30: note = chr17:71640237-71640267
  misc_feature 1..30: note = hyper
  source 1..30: mol_type = genomic DNA

SEQ ID NO: 57343 - DNA, 265 bp, Homo sapiens; identical to SEQ ID NO: 36734
  misc_feature 1..265: note = chr17:71640832-71641097
  misc_feature 1..265: note = hyper
  source 1..265: mol_type = genomic DNA

SEQ ID NO: 57344 - DNA, 179 bp, Homo sapiens
  misc_feature 1..179: note = chr17:71641365-71641544
  misc_feature 1..179: note = hyper
  source 1..179: mol_type = genomic DNA
gggggcagcgtgagccggggacgagcgcggcggaggcggagacgcggagaggggggccgagcgctaccccgtggccgcgactggagagcagcctgcgcgccgggaggggcggcggcggcggcggcggccccgagccaggcccgggagcgagccccgcagaaatacaatccgactgcgcg

SEQ ID NO: 57345 - DNA, 62 bp, Homo sapiens; identical to SEQ ID NO: 36736
  misc_feature 1..62: note = chr17:71897979-71898041
  misc_feature 1..62: note = hyper
  source 1..62: mol_type = genomic DNA

SEQ ID NO: 57346 - DNA, 70 bp, Homo sapiens; identical to SEQ ID NO: 36737
  misc_feature 1..70: note = chr17:71898345-71898415
  misc_feature 1..70: note = hyper
  source 1..70: mol_type = genomic DNA

SEQ ID NO: 57347 - DNA, 49 bp, Homo sapiens; identical to SEQ ID NO: 22622
  misc_feature 1..49: note = chr17:71948390-71948439
  misc_feature 1..49: note = hyper
  source 1..49: mol_type = genomic DNA

SEQ ID NO: 57348 - DNA, 124 bp, Homo sapiens
  misc_feature 1..124: note = chr17:71948863-71948987
  misc_feature 1..124: note = hyper
  source 1..124: mol_type = genomic DNA
ggcgctccccgcccgccaacctccaacctccaacctccgccctccaccctccaccctccttgctctgtccgcgtggacgcagcccccggttcagacactagcgggtgcgcggggccgcccagga

SEQ ID NO: 57349 - DNA, 109 bp, Homo sapiens; identical to SEQ ID NO: 36739
  misc_feature 1..109: note = chr17:71949194-71949303
  misc_feature 1..109: note = hyper
  source 1..109: mol_type = genomic DNA

SEQ ID NO: 57350 - DNA, 251 bp, Homo sapiens; identical to SEQ ID NO: 36740
  misc_feature 1..251: note = chr17:72208417-72208668
  misc_feature 1..251: note = hyper
  source 1..251: mol_type = genomic DNA

SEQ ID NO: 57351 - DNA, 97 bp, Homo sapiens; identical to SEQ ID NO: 36741
  misc_feature 1..97: note = chr17:72209140-72209237
  misc_feature 1..97: note = hyper
  source 1..97: mol_type = genomic DNA

SEQ ID NO: 57352 - DNA, 112 bp, Homo sapiens
  misc_feature 1..112: note = chr17:72270174-72270286
  misc_feature 1..112: note = hyper
  source 1..112: mol_type = genomic DNA
gtaggcttggataagcgccttggcaacgcccctacaaatattcatgatcattattagtatgttaccaacctattggttaattcttctcctaactcaggagacctccaaaaag

SEQ ID NO: 57353 - DNA, 43 bp, Homo sapiens
  misc_feature 1..43: note = chr17:72270415-72270458
  misc_feature 1..43: note = hyper
  source 1..43: mol_type = genomic DNA
agcaccggagccgcgaccgtggattgaacgcttccccagagac

SEQ ID NO: 57354 - DNA, 53 bp, Homo sapiens
  misc_feature 1..53: note = chr17:72322310-72322363
  misc_feature 1..53: note = hyper
  source 1..53: mol_type = genomic DNA
ccccctgccccgcctcgggtcggcgtccttagccgctggcgcgttgttggttt

SEQ ID NO: 57355 - DNA, 15 bp, Homo sapiens
  misc_feature 1..15: note = chr17:72322611-72322626
  misc_feature 1..15: note = hyper
  source 1..15: mol_type = genomic DNA
cgccaccccactgag

SEQ ID NO: 57356 - DNA, 96 bp, Homo sapiens; identical to SEQ ID NO: 36746
  misc_feature 1..96: note = chr17:72427312-72427408
  misc_feature 1..96: note = hyper
  source 1..96: mol_type = genomic DNA

SEQ ID NO: 57357 - skipped

SEQ ID NO: 57358 - DNA, 23 bp, Homo sapiens
  misc_feature 1..23: note = chr17:72428381-72428404
  misc_feature 1..23: note = hyper
  source 1..23: mol_type = genomic DNA
tgatgtaacggtgatgcaggctc

SEQ ID NO: 57359 - DNA, 37 bp, Homo sapiens
  misc_feature 1..37: note = chr17:72667300-72667337
  misc_feature 1..37: note = hyper
  source 1..37: mol_type = genomic DNA
gtgagctcctgggaccgcaatgccctgagaacgcagc

SEQ ID NO: 57360 - DNA, 181 bp, Homo sapiens; identical to SEQ ID NO: 36749
  misc_feature 1..181: note = chr17:72838924-72839105
  misc_feature 1..181: note = hyper
  source 1..181: mol_type = genomic DNA

SEQ ID NO: 57361 - DNA, 30 bp, Homo sapiens; identical to SEQ ID NO: 36750
  misc_feature 1..30: note = chr17:72848653-72848683
  misc_feature 1..30: note = hyper
  source 1..30: mol_type = genomic DNA

SEQ ID NO: 57362 - DNA, 190 bp, Homo sapiens; identical to SEQ ID NO: 36751
  misc_feature 1..190: note = chr17:72856276-72856466
  misc_feature 1..190: note = hyper
  source 1..190: mol_type = genomic DNA

SEQ ID NO: 57363 - DNA, 97 bp, Homo sapiens; identical to SEQ ID NO: 22629
  misc_feature 1..97: note = chr17:72856941-72857038
  misc_feature 1..97: note = hyper
  source 1..97: mol_type = genomic DNA

SEQ ID NO: 57364 - DNA, 316 bp, Homo sapiens
  misc_feature 1..316: note = chr17:72857368-72857684
  misc_feature 1..316: note = hyper
  source 1..316: mol_type = genomic DNA
ggccaggttcttgagggtccgggtcctccagccgccccctccttgagccccgagagtcctgcgtgggtccaaccccccgggtgtcccgcctctgtctccgccgtccttgctcgcgcgccgcgggaacccagccccaagttggcggcgaagttggtgcccctcgcccgccgctcgccacttaccgaggggaaggggcgctgcgcccgcgacgagagcccgcgccggccgcctccctcgcggtgtctgtcccagagcctcggccccggagggctggcgcgctcagtctcagctccgcgggcgccggagcccgggcgcg

SEQ ID NO: 57365 - DNA, 67 bp, Homo sapiens; identical to SEQ ID NO: 36753
  misc_feature 1..67: note = chr17:72857958-72858025
  misc_feature 1..67: note = hyper
  source 1..67: mol_type = genomic DNA

SEQ ID NO: 57366 - DNA, 23 bp, Homo sapiens
  misc_feature 1..23: note = chr17:72889334-72889357
  misc_feature 1..23: note = hyper
  source 1..23: mol_type = genomic DNA
ctccatccttgggtgcggggccc

SEQ ID NO: 57367 - DNA, 380 bp, Homo sapiens; identical to SEQ ID NO: 36755
  misc_feature 1..380: note = chr17:72889430-72889810
  misc_feature 1..380: note = hyper
  source 1..380: mol_type = genomic DNA

SEQ ID NO: 57368 - DNA, 40 bp, Homo sapiens; identical to SEQ ID NO: 36756
  misc_feature 1..40: note = chr17:72890033-72890073
  misc_feature 1..40: note = hyper
  source 1..40: mol_type = genomic DNA

SEQ ID NO: 57369 - DNA, 30 bp, Homo sapiens; identical to SEQ ID NO: 36757
  misc_feature 1..30: note = chr17:72920550-72920580
  misc_feature 1..30: note = hyper
  source 1..30: mol_type = genomic DNA

SEQ ID NO: 57370 - DNA, 42 bp, Homo sapiens
  misc_feature 1..42: note = chr17:72921032-72921074
  misc_feature 1..42: note = hyper
  source 1..42: mol_type = genomic DNA
gctccgaggtgccaggggaggtgggggcgaggtagggtgggc

SEQ ID NO: 57371 - DNA, 75 bp, Homo sapiens; identical to SEQ ID NO: 36759
  misc_feature 1..75: note = chr17:72932011-72932086
  misc_feature 1..75: note = hyper
  source 1..75: mol_type = genomic DNA

SEQ ID NO: 57372 - DNA, 258 bp, Homo sapiens; identical to SEQ ID NO: 36760
  misc_feature 1..258: note = chr17:72932356-72932614
  misc_feature 1..258: note = hyper
  source 1..258: mol_type = genomic DNA

SEQ ID NO: 57373 - DNA, 235 bp, Homo sapiens; identical to SEQ ID NO: 36761
  misc_feature 1..235: note = chr17:73073449-73073684
  misc_feature 1..235: note = hyper
  source 1..235: mol_type = genomic DNA

SEQ ID NO: 57374 - skipped

SEQ ID NO: 57375 - DNA, 428 bp, Homo sapiens
  misc_feature 1..428: note = chr17:74071017-74071445
  misc_feature 1..428: note = hyper
  source 1..428: mol_type = genomic DNA
gggaggctggcaccccgaggcggtcatcgtgcccctgctcttcgcgctcatcttcctcgtgggcaccgtgggcaacacgctggtgctggcggtgctgctgcgcggcggccaggcggtcagcactaccaacctgttcatccttaacctgggcgtggccgacctgtgtttcatcctgtgctgcgtgcccttccaggccaccatctacaccctggacggctgggtgttcggctcgctgctgtgcaaggcggtgcacttcctcatcttcctcaccatgcacgccagcagcttcacgctggccgccgtctccctggacaggtgagccagcgccttggcctccctgggagatgggcatccacgcgggggatggagcgggaggcgggactggggaccaagaagggacgcgcagagtgggacaggacactaagaag

SEQ ID NO: 57376 - DNA, 208 bp, Homo sapiens
  misc_feature 1..208: note = chr17:74071481-74071689
  misc_feature 1..208: note = hyper
  source 1..208: mol_type = genomic DNA
aggaataagaatgggggaccgtggtgtccctcggttagatgcgtcctggggcctggaagcctggagaatgtggctctccagcgccgcccgtgcctgacaacgcgcagcgtttcccagtacgacgcgtttgtgcgcgttcatctcgcttgagcttaatgccctccgtgagggtgggataggacaaagtgcccaatatacagaagagttg

SEQ ID NO: 57377 - DNA, 103 bp, Homo sapiens; identical to SEQ ID NO: 36765
  misc_feature 1..103: note = chr17:74072477-74072580
  misc_feature 1..103: note = hyper
  source 1..103: mol_type = genomic DNA

SEQ ID NO: 57378 - DNA, 233 bp, Homo sapiens
  misc_feature 1..233: note = chr17:74073036-74073269
  misc_feature 1..233: note = hyper
  source 1..233: mol_type = genomic DNA
ccaagcgcaaggtgacacgcatgatcctcatcgtggccgcgctcttctgcctctgctggatgccccaccacgcgctcatcctctgcgtgtggttcggccagttcccgctcacgcgcgccacttatgcgcttcgcatcctctcgcacctggtctcctacgccaactcctgcgtcaaccccatcgtttacgcgctggtctccaagcacttccgcaaaggcttccgcacgatctgc

SEQ ID NO: 57379 - DNA, 21 bp, Homo sapiens
  misc_feature 1..21: note = chr17:74073433-74073454
  misc_feature 1..21: note = hyper
  source 1..21: mol_type = genomic DNA
catcctcgagccctgtcctgg

SEQ ID NO: 57380 - DNA, 63 bp, Homo sapiens; identical to SEQ ID NO: 36767
  misc_feature 1..63: note = chr17:74117965-74118028
  misc_feature 1..63: note = hyper
  source 1..63: mol_type = genomic DNA

SEQ ID NO: 57381 - DNA, 146 bp, Homo sapiens; identical to SEQ ID NO: 36768
  misc_feature 1..146: note = chr17:74136296-74136442
  misc_feature 1..146: note = hyper
  source 1..146: mol_type = genomic DNA

SEQ ID NO: 57382 - DNA, 149 bp, Homo sapiens; identical to SEQ ID NO: 36769
  misc_feature 1..149: note = chr17:74136570-74136719
  misc_feature 1..149: note = hyper
  source 1..149: mol_type = genomic DNA

SEQ ID NO: 57383 - DNA, 30 bp, Homo sapiens; identical to SEQ ID NO: 36770
  misc_feature 1..30: note = chr17:74378928-74378958
  misc_feature 1..30: note = hyper
  source 1..30: mol_type = genomic DNA

SEQ ID NO: 57384 - DNA, 15 bp, Homo sapiens
  misc_feature 1..15: note = chr17:74533543-74533558
  misc_feature 1..15: note = hyper
  source 1..15: mol_type = genomic DNA
caccgccttcctctc

SEQ ID NO: 57385 - DNA, 143 bp, Homo sapiens; identical to SEQ ID NO: 36772
  misc_feature 1..143: note = chr17:74533674-74533817
  misc_feature 1..143: note = hyper
  source 1..143: mol_type = genomic DNA

SEQ ID NO: 57386 - DNA, 53 bp, Homo sapiens; identical to SEQ ID NO: 22639
  misc_feature 1..53: note = chr17:74534310-74534363
  misc_feature 1..53: note = hyper
  source 1..53: mol_type = genomic DNA

SEQ ID NO: 57387 - DNA, 46 bp, Homo sapiens; identical to SEQ ID NO: 36774
  misc_feature 1..46: note = chr17:74534387-74534433
  misc_feature 1..46: note = hyper
  source 1..46: mol_type = genomic DNA

SEQ ID NO: 57388 - DNA, 322 bp, Homo sapiens
  misc_feature 1..322: note = chr17:74581221-74581543
  misc_feature 1..322: note = hyper
  source 1..322: mol_type = genomic DNA
tatccagacacggcgagcggaagccggggagaagggagcgggcgcggggcggacagagaccgcagcgggcgggaaaggcgactggccgcggcccgacggagggtccccgcgaagttggaaaccggagacttgggcccctgcccaaaaagcagaatctgacgttaccgagggagagttcccgacaaaaaaggaagtttttatctgcttcggggacccagccagatttcgacaatagaaagtgtacttatcaggccggggaggacttcaccaacaaggggcaccggggcgggtcgccagtgcacaggggcgaggtcttccttgg

SEQ ID NO: 57389 - DNA, 384 bp, Homo sapiens
  misc_feature 1..384: note = chr17:74864669-74865053
  misc_feature 1..384: note = hyper
  source 1..384: mol_type = genomic DNA
ggaggcgctggggaccggggcgcgggcccggggccgcctttagccggcaccgagggcgcggggccggggatgagggcgcccgccgcggggagcccgtctgcgcgccgcggcaccttcccgcccagcgagcgagcccgagcaggcagacgcgcggccggcggtctgggggcgcgccgcctcccggtccccaaaatgtgaagcggggagggcggagacgcagagacggcccggccgggcgccctcgccgccctccggcagccgcgccgctccctccgctgcacgcccaggcctgagcagcgaggccaccgggccgcgcgctcccagcttcgctcggacgcggcttcggcccgcagagggttcgtggcccggacgcggcgagagctg

SEQ ID NO: 57390 - DNA, 63 bp, Homo sapiens
  misc_feature 1..63: note = chr17:74865192-74865255
  misc_feature 1..63: note = hyper
  source 1..63: mol_type = genomic DNA
ctggttggttttttccccaggggggcgccgggtggaggtgggcgaggtcggttcctgcgaacg

SEQ ID NO: 57391 - DNA, 145 bp, Homo sapiens
  misc_feature 1..145: note = chr17:74865553-74865698
  misc_feature 1..145: note = hyper
  source 1..145: mol_type = genomic DNA
aaagttagtgtgcggcgccttggagctccccctccggtccctcccgtcccgcccgtctgcccctaggtcggctaccccccaacccctccgcctgtgccaccctctccccagcctttggtggcactgctctcctccccgcggggct

SEQ ID NO: 57392 - DNA, 58 bp, Homo sapiens
  misc_feature 1..58: note = chr17:74866243-74866301
  misc_feature 1..58: note = hyper
  source 1..58: mol_type = genomic DNA
gtggtccccctgccggctccagacggggatgggggcggggagacggtggctcacctgg

SEQ ID NO: 57393 - DNA, 30 bp, Homo sapiens; identical to SEQ ID NO: 36779
  misc_feature 1..30: note = chr17:74965579-74965609
  misc_feature 1..30: note = hyper
  source 1..30: mol_type = genomic DNA

SEQ ID NO: 57394 - DNA, 20 bp, Homo sapiens
  misc_feature 1..20: note = chr17:75368715-75368735
  misc_feature 1..20: note = hyper
  source 1..20: mol_type = genomic DNA
gccgtgttccatccccgccc

SEQ ID NO: 57395 - DNA, 202 bp, Homo sapiens
  misc_feature 1..202: note = chr17:75369238-75369440
  misc_feature 1..202: note = hyper
  source 1..202: mol_type = genomic DNA
gactgtcccccagcggccactcgggccccagccccccaggcctggccttgacaggcgggcggagcagccagtgcgagacagggaggccggtgcgggtgcgggaacctgatccgcccgggaggcgggggcggggcgggggcgcagcgcgcggggaggggccggcgcccgccttcctcccccattcattcagctgagccagggg

SEQ ID NO: 57396 - skipped

SEQ ID NO: 57397 - DNA, 26 bp, Homo sapiens
  misc_feature 1..26: note = chr17:75370316-75370342
  misc_feature 1..26: note = hyper
  source 1..26: mol_type = genomic DNA
gggcctgcgtgcgggcagggagagta

SEQ ID NO: 57398 - DNA, 30 bp, Homo sapiens; identical to SEQ ID NO: 36785
  misc_feature 1..30: note = chr17:75370646-75370676
  misc_feature 1..30: note = hyper
  source 1..30: mol_type = genomic DNA

SEQ ID NO: 57399 - DNA, 88 bp, Homo sapiens; identical to SEQ ID NO: 36786
  misc_feature 1..88: note = chr17:75447639-75447727
  misc_feature 1..88: note = hyper
  source 1..88: mol_type = genomic DNA

SEQ ID NO: 57400 - DNA, 45 bp, Homo sapiens
  misc_feature 1..45: note = chr17:75524591-75524636
  misc_feature 1..45: note = hyper
  source 1..45: mol_type = genomic DNA
accccctctcgtggtcgccagggtaggggtgggaggaatctggaa

SEQ ID NO: 57401 - DNA, 98 bp, Homo sapiens; identical to SEQ ID NO: 36789
  misc_feature 1..98: note = chr17:75953838-75953936
  misc_feature 1..98: note = hyper
  source 1..98: mol_type = genomic DNA

SEQ ID NO: 57402 - DNA, 76 bp, Homo sapiens; identical to SEQ ID NO: 22644
  misc_feature 1..76: note = chr17:76227773-76227849
  misc_feature 1..76: note = hyper
  source 1..76: mol_type = genomic DNA

SEQ ID NO: 57403 - DNA, 18 bp, Homo sapiens
  misc_feature 1..18: note = chr17:76254836-76254854
  misc_feature 1..18: note = hyper
  source 1..18: mol_type = genomic DNA
cgccggggaggctgctgc

SEQ ID NO: 57404 - DNA, 146 bp, Homo sapiens; identical to SEQ ID NO: 36793
  misc_feature 1..146: note = chr17:77178726-77178872
  misc_feature 1..146: note = hyper
  source 1..146: mol_type = genomic DNA

SEQ ID NO: 57405 - DNA, 102 bp, Homo sapiens; identical to SEQ ID NO: 4505
  misc_feature 1..102: note = chr17:77178962-77179064
  misc_feature 1..102: note = hyper
  source 1..102: mol_type = genomic DNA

SEQ ID NO: 57406 - DNA, 32 bp, Homo sapiens; identical to SEQ ID NO: 22647
  misc_feature 1..32: note = chr17:77179081-77179113
  misc_feature 1..32: note = hyper
  source 1..32: mol_type = genomic DNA

SEQ ID NO: 57407 - DNA, 52 bp, Homo sapiens; identical to SEQ ID NO: 22648
  misc_feature 1..52: note = chr17:77179278-77179330
  misc_feature 1..52: note = hyper
  source 1..52: mol_type = genomic DNA

SEQ ID NO: 57408 - DNA, 75 bp, Homo sapiens; identical to SEQ ID NO: 4507
  misc_feature 1..75: note = chr17:77179380-77179455
  misc_feature 1..75: note = hyper
  source 1..75: mol_type = genomic DNA

SEQ ID NO: 57409 - DNA, 27 bp, Homo sapiens
  misc_feature 1..27: note = chr17:77179456-77179483
  misc_feature 1..27: note = hyper
  source 1..27: mol_type = genomic DNA
gcaggggggcgcccggcggcggctctg

SEQ ID NO: 57410 - DNA, 13 bp, Homo sapiens
  misc_feature 1..13: note = chr17:77179617-77179630
  misc_feature 1..13: note = hyper
  source 1..13: mol_type = genomic DNA
cgcgcctctgccc

SEQ ID NO: 57411 - DNA, 429 bp, Homo sapiens; identical to SEQ ID NO: 36800
  misc_feature 1..429: note = chr17:77179799-77180228
  misc_feature 1..429: note = hyper
  source 1..429: mol_type = genomic DNA

SEQ ID NO: 57412 - DNA, 114 bp, Homo sapiens; identical to SEQ ID NO: 36801
  misc_feature 1..114: note = chr17:77188779-77188893
  misc_feature 1..114: note = hyper
  source 1..114: mol_type = genomic DNA

SEQ ID NO: 57413 - DNA, 34 bp, Homo sapiens; identical to SEQ ID NO: 36802
  misc_feature 1..34: note = chr17:77216439-77216473
  misc_feature 1..34: note = hyper
  source 1..34: mol_type = genomic DNA

SEQ ID NO: 57414 - DNA, 129 bp, Homo sapiens; identical to SEQ ID NO: 36803
  misc_feature 1..129: note = chr17:77290796-77290925
  misc_feature 1..129: note = hyper
  source 1..129: mol_type = genomic DNA

SEQ ID NO: 57415 - DNA, 233 bp, Homo sapiens; identical to SEQ ID NO: 36804
  misc_feature 1..233: note = chr17:77772557-77772790
  misc_feature 1..233: note = hyper
  source 1..233: mol_type = genomic DNA

SEQ ID NO: 57416 - DNA, 16 bp, Homo sapiens
  misc_feature 1..16: note = chr17:77776550-77776566
  misc_feature 1..16: note = hyper
  source 1..16: mol_type = genomic DNA
ggaccggttgggccac

SEQ ID NO: 57417 - DNA, 148 bp, Homo sapiens; identical to SEQ ID NO: 22654
  misc_feature 1..148: note = chr17:77776679-77776827
  misc_feature 1..148: note = hyper
  source 1..148: mol_type = genomic DNA

SEQ ID NO: 57418 - DNA, 219 bp, Homo sapiens
  misc_feature 1..219: note = chr17:77777056-77777275
  misc_feature 1..219: note = hyper
  source 1..219: mol_type = genomic DNA
atcagaaacctccagccccaacccctgcctggagatgcccggggcgcgctgactctgttctcgcatcaccccgggccctggctcaacgcgtgagcagcctgtggttccagataccccgagtggagagtttgaccccagattctgcctgcactgacaggcttggcctggcggttacgagccacggttgatgagcgcccctcctcccgtgacccagctcat

SEQ ID NO: 57419 - DNA, 83 bp, Homo sapiens
  misc_feature 1..83: note = chr17:77777502-77777585
  misc_feature 1..83: note = hyper
  source 1..83: mol_type = genomic DNA
gctccagggactcctcggactccgcctggcgcttcccgttttttcatttcctaccccacccccatgcagaaggaattgaagtg

SEQ ID NO: 57420 - DNA, 34 bp, Homo sapiens
  misc_feature 1..34: note = chr17:77777961-77777995
  misc_feature 1..34: note = hyper
  source 1..34: mol_type = genomic DNA
ccccggtacagggcttcctcggtgcacccctagc

SEQ ID NO: 57421 - DNA, 270 bp, Homo sapiens
  misc_feature 1..270: note = chr17:77778673-77778943
  misc_feature 1..270: note = hyper
  source 1..270: mol_type = genomic DNA
gaaatgtgatgttcacgctgagtttctgtatttttctagtttcaacctcagagcttactttttggccaaacggatgaaggggtaagccaccgtggaagtcccagcagatacccccaccatcgccccatccatcctgggaggttcggtggccctcgaggcagagacatggactgtggctggggtattgggggcagatgttcaatgtgttggggtgtggagagggtagattggcagcctactgaggattaaaggggtgtcctgcaaaccagc

SEQ ID NO: 57422 - DNA, 304 bp, Homo sapiens; identical to SEQ ID NO: 36812
  misc_feature 1..304: note = chr17:77786467-77786771
  misc_feature 1..304: note = hyper
  source 1..304: mol_type = genomic DNA

SEQ ID NO: 57423 - DNA, 112 bp, Homo sapiens; identical to SEQ ID NO: 36814
  misc_feature 1..112: note = chr17:77814794-77814906
  misc_feature 1..112: note = hyper
  source 1..112: mol_type = genomic DNA

SEQ ID NO: 57424 - DNA, 30 bp, Homo sapiens; identical to SEQ ID NO: 36815
  misc_feature 1..30: note = chr17:77815150-77815180
  misc_feature 1..30: note = hyper
  source 1..30: mol_type = genomic DNA

SEQ ID NO: 57425 - DNA, 133 bp, Homo sapiens; identical to SEQ ID NO: 36816
  misc_feature 1..133: note = chr17:77815455-77815588
  misc_feature 1..133: note = hyper
  source 1..133: mol_type = genomic DNA

SEQ ID NO: 57426 - DNA, 30 bp, Homo sapiens; identical to SEQ ID NO: 36817
  misc_feature 1..30: note = chr17:77815905-77815935
  misc_feature 1..30: note = hyper
  source 1..30: mol_type = genomic DNA

SEQ ID NO: 57427 - DNA, 176 bp, Homo sapiens; identical to SEQ ID NO: 36818
  misc_feature 1..176: note = chr17:77904151-77904327
  misc_feature 1..176: note = hyper
  source 1..176: mol_type = genomic DNA

SEQ ID NO: 57428 - DNA, 159 bp, Homo sapiens; identical to SEQ ID NO: 36819
  misc_feature 1..159: note = chr17:78045491-78045650
  misc_feature 1..159: note = hyper
  source 1..159: mol_type = genomic DNA

SEQ ID NO: 57429 - DNA, 30 bp, Homo sapiens; identical to SEQ ID NO: 36820
  misc_feature 1..30: note = chr17:78449436-78449466
  misc_feature 1..30: note = hyper
  source 1..30: mol_type = genomic DNA

SEQ ID NO: 57430 - DNA, 30 bp, Homo sapiens; identical to SEQ ID NO: 36821
  misc_feature 1..30: note = chr17:78449720-78449750
  misc_feature 1..30: note = hyper
  source 1..30: mol_type = genomic DNA

SEQ ID NO: 57431 - DNA, 880 bp, Homo sapiens; identical to SEQ ID NO: 36822
  misc_feature 1..880: note = chr17:78449963-78450843
  misc_feature 1..880: note = hyper
  source 1..880: mol_type = genomic DNA

SEQ ID NO: 57432 - DNA, 454 bp, Homo sapiens
  misc_feature 1..454: note = chr17:78451477-78451931
  misc_feature 1..454: note = hyper
  source 1..454: mol_type = genomic DNA
gcggggctcggctcccgagatcgcggtccgggttccggcgccgggctgggggctcaggaccagggctggcgcagccgccccgccccgccccgccccggggctatcagagcggtcaaagcctcggaaatccctccgtccacgctcccgtggtacagagaaggaaactgaggctccgagactgcggggccgggctacagccgtggccccccgacccctccccgccgcccccggcttctctggtctctgcgttctgcagcctttccctgcgcgcagccgggggctgggggtccccagccagcagggacccacgggcagtcccgggtgccgggatcgggcgtccgcccctcgggcgggagcagaggccggctcgatggagacctttttgagaaatggcggcctctacccgccccccagcccccgagcgcccgccgtctgcgttcagcatctcagcttt

SEQ ID NO: 57433 - DNA, 188 bp, Homo sapiens; identical to SEQ ID NO: 22659
  misc_feature 1..188: note = chr17:78452108-78452296
  misc_feature 1..188: note = hyper
  source 1..188: mol_type = genomic DNA

SEQ ID NO: 57434 - DNA, 132 bp, Homo sapiens
  misc_feature 1..132: note = chr17:78452549-78452681
  misc_feature 1..132: note = hyper
  source 1..132: mol_type = genomic DNA
agcggcctggcacctcggcacagaggagcgtgtcccccttccgcagaggaagggagtggacggcgtcagaaagggaggggagcctggggcggtgtctggggctagcgggacctctgggcactgtggggcccc

SEQ ID NO: 57435 - DNA, 113 bp, Homo sapiens
  misc_feature 1..113: note = chr17:78452833-78452946
  misc_feature 1..113: note = hyper
  source 1..113: mol_type = genomic DNA
ctcggcctccccagtgttctgaaagtatctgagagggagggagcaggaaaacgaagggccgccctgcccaaactcatcggggtgtctggttactaggtcggaagaggggggat

SEQ ID NO: 57436 - DNA, 45 bp, Homo sapiens; identical to SEQ ID NO: 36826
  misc_feature 1..45: note = chr17:78978134-78978179
  misc_feature 1..45: note = hyper
  source 1..45: mol_type = genomic DNA

SEQ ID NO: 57437 - DNA, 81 bp, Homo sapiens; identical to SEQ ID NO: 36827
  misc_feature 1..81: note = chr17:78978379-78978460
  misc_feature 1..81: note = hyper
  source 1..81: mol_type = genomic DNA

SEQ ID NO: 57438 - DNA, 66 bp, Homo sapiens; identical to SEQ ID NO: 36828
  misc_feature 1..66: note = chr17:79316947-79317013
  misc_feature 1..66: note = hyper
  source 1..66: mol_type = genomic DNA

SEQ ID NO: 57439 - DNA, 57 bp, Homo sapiens; identical to SEQ ID NO: 36829
  misc_feature 1..57: note = chr17:79317833-79317890
  misc_feature 1..57: note = hyper
  source 1..57: mol_type = genomic DNA

SEQ ID NO: 57440 - DNA, 15 bp, Homo sapiens
  misc_feature 1..15: note = chr17:79615121-79615136
  misc_feature 1..15: note = hyper
  source 1..15: mol_type = genomic DNA
cgaacctggctgcct

SEQ ID NO: 57441 - DNA, 121 bp, Homo sapiens; identical to SEQ ID NO: 12933
  misc_feature 1..121: note = chr17:79761692-79761813
  misc_feature 1..121: note = hyper
  source 1..121: mol_type = genomic DNA

SEQ ID NO: 57442 - DNA, 376 bp, Homo sapiens; identical to SEQ ID NO: 36832
  misc_feature 1..376: note = chr17:79761833-79762209
  misc_feature 1..376: note = hyper
  source 1..376: mol_type = genomic DNA

SEQ ID NO: 57443 - DNA, 164 bp, Homo sapiens; identical to SEQ ID NO: 36833
  misc_feature 1..164: note = chr17:79762474-79762638
  misc_feature 1..164: note = hyper
  source 1..164: mol_type = genomic DNA

SEQ ID NO: 57444 - DNA, 86 bp, Homo sapiens; identical to SEQ ID NO: 36834
  misc_feature 1..86: note = chr17:79859940-79860026
  misc_feature 1..86: note = hyper
  source 1..86: mol_type = genomic DNA

SEQ ID NO: 57445 - DNA, 185 bp, Homo sapiens; identical to SEQ ID NO: 36835
  misc_feature 1..185: note = chr17:79860488-79860673
  misc_feature 1..185: note = hyper
  source 1..185: mol_type = genomic DNA

SEQ ID NO: 57446 - DNA, 34 bp, Homo sapiens; identical to SEQ ID NO: 36836
  misc_feature 1..34: note = chr17:79918595-79918629
  misc_feature 1..34: note = hyper
  source 1..34: mol_type = genomic DNA

SEQ ID NO: 57447 - DNA, 41 bp, Homo sapiens; identical to SEQ ID NO: 36837
  misc_feature 1..41: note = chr17:79988475-79988516
  misc_feature 1..41: note = hyper
  source 1..41: mol_type = genomic DNA

SEQ ID NO: 57448 - DNA, 82 bp, Homo sapiens; identical to SEQ ID NO: 36838
  misc_feature 1..82: note = chr17:80188720-80188802
  misc_feature 1..82: note = hyper
  source 1..82: mol_type = genomic DNA

SEQ ID NO: 57449 - DNA, 426 bp, Homo sapiens
  misc_feature 1..426: note = chr17:80329283-80329709
  misc_feature 1..426: note = hyper
  source 1..426: mol_type = genomic DNA
cctgccccccacctgcgcgcgggcgggtccagggcttggtggacacggagaatcccaggctccgtgccctgcaaacacgggcgtgaggggcgcaggggtgaacgctggaggcggagaacccaagaggggctgcggggtcagccttggggcagccgggctggaggcagcttcgctccgcagacgcagacgcgagacccgcctgggaccctccgccgaccccgctgcggccccgcgacccccgcgtcttcccggcgccgcgcggtcagcgccgccccctagacacccggcgccgtcccctccgcgcgcctgctgcccgctggggttattttaataccgggccctggcgcggggcgcggcgcattcccagctggcggcgggcaggtggcggcggcgcagagacccggcgcggggcggggggcgcggctt

SEQ ID NO: 57450 - DNA, 45 bp, Homo sapiens; identical to SEQ ID NO: 36840
  misc_feature 1..45: note = chr17:80330164-80330209
  misc_feature 1..45: note = hyper
  source 1..45: mol_type = genomic DNA

SEQ ID NO: 57451 - DNA, 177 bp, Homo sapiens; identical to SEQ ID NO: 36841
  misc_feature 1..177: note = chr17:80333064-80333241
  misc_feature 1..177: note = hyper
  source 1..177: mol_type = genomic DNA

SEQ ID NO: 57452 - skipped

SEQ ID NO: 57453 - DNA, 525 bp, Homo sapiens; identical to SEQ ID NO: 22667
  misc_feature 1..525: note = chr18:500738-501263
  misc_feature 1..525: note = hyper
  source 1..525: mol_type = genomic DNA

SEQ ID NO: 57454 - DNA, 96 bp, Homo sapiens; identical to SEQ ID NO: 36843
  misc_feature 1..96: note = chr18:903748-903844
  misc_feature 1..96: note = hyper
  source 1..96: mol_type = genomic DNA

SEQ ID NO: 57455 - DNA, 88 bp, Homo sapiens
  misc_feature 1..88: note = chr18:904374-904462
  misc_feature 1..88: note = hyper
  source 1..88: mol_type = genomic DNA
ttcatgaataaaaatcggagcgcaacagtgcaacaaaatattctgtacttaaaggcaacaggcaggcagatgttgacaaagagggctc

SEQ ID NO: 57456 - DNA, 84 bp, Homo sapiens
  misc_feature 1..84: note = chr18:904648-904732
  misc_feature 1..84: note = hyper
  source 1..84: mol_type = genomic DNA
cgggctagccgcccgccctctcccttgccttcctccccttcttttctgactttccctctttcccttaatcgcctgcttcttcct

SEQ ID NO: 57457 - skipped

SEQ ID NO: 57458 - DNA, 76 bp, Homo sapiens
  misc_feature 1..76: note = chr18:905030-905106
  misc_feature 1..76: note = hyper
  source 1..76: mol_type = genomic DNA
cagctctcctggcagcgggaggagttgaagggtaagggagggaaaatcttaccaaagcgaccggctcactcgactg

SEQ ID NO: 57459 - DNA, 177 bp, Homo sapiens; identical to SEQ ID NO: 36846
  misc_feature 1..177: note = chr18:905713-905890
  misc_feature 1..177: note = hyper
  source 1..177: mol_type = genomic DNA

SEQ ID NO: 57460 - DNA, 663 bp, Homo sapiens
  misc_feature 1..663: note = chr18:906208-906871
  misc_feature 1..663: note = hyper
  source 1..663: mol_type = genomic DNA
cagccctgcctggcccgggatggaggaaccttggcttttttcttaaccccgggtttctaaccggcaggcgcggcccaggttcccggaggcagccccagagtcgcggaccgatgtgccaggctgtggatgagccctgggtaggggagggttcgtaccagcggcgcctggggcagcgaggagcgcgcgttctgcctgcgaagctgccttctccgagccccgcccaggaacattagctctggggggccgctgatcattgatttggacggagagatgggttctgggttctgtattaggattccagcatctgggctcgaggcagggcaatatccagaaagaccccagggttcggggtacccgggccagggctgaggcgcatcgccgagcaaaggctgggtgcgaggcgtgcggaatgatgcgcttgccttgcccgggcctctccaaggatggagaaaaggcgagtgaagcagcgaagtacgactccaaccccgcccagagagtgctactagcgctggctgcacgccaagtctctccaggggtccaaagcgagagggatttgttttaacccatctctacccgtcctgtgtcaagaacggaggctgtagagggcgactgcgaagtcgccaggcactcgctggatctcggtccccctcctcgtgctctggg

SEQ ID NO: 57461 - DNA, 158 bp, Homo sapiens; identical to SEQ ID NO: 22673
  misc_feature 1..158: note = chr18:907314-907472
  misc_feature 1..158: note = hyper
  source 1..158: mol_type = genomic DNA

SEQ ID NO: 57462 - DNA, 100 bp, Homo sapiens
  misc_feature 1..100: note = chr18:907594-907694
  misc_feature 1..100: note = hyper
  source 1..100: mol_type = genomic DNA
ggatcctcgccgagctggggaggaacttgcactgaccacaccttctgtccccggccaccccgcaggccagaggaagaggcgtacggcgaggacggaaacc

SEQ ID NO: 57463 - DNA, 191 bp, Homo sapiens
  misc_feature 1..191: note = chr18:907721-907912
  misc_feature 1..191: note = hyper
  source 1..191: mol_type = genomic DNA
cgccgggcgcagggagccccgcctccgcgccgcgcgccgccgccgcctggtaccgcccggccgggagaaggtgagattcgcgcggcctcgcgcacacccgcggctgggagctcgggactgcggtgacgggaggggcagtgtggtgacccacccaggatttttttttttttcccgtgaaagtcctcaagcct

SEQ ID NO: 57464 - DNA, 22 bp, Homo sapiens
  misc_feature 1..22: note = chr18:908432-908454
  misc_feature 1..22: note = hyper
  source 1..22: mol_type = genomic DNA
gcggcggtgggtgcccgtgggg

SEQ ID NO: 57465 - DNA, 15 bp, Homo sapiens
  misc_feature 1..15: note = chr18:909070-909085
  misc_feature 1..15: note = hyper
  source 1..15: mol_type = genomic DNA
actttctctgtatgt

SEQ ID NO: 57466 - DNA, 106 bp, Homo sapiens; identical to SEQ ID NO: 12949
  misc_feature 1..106: note = chr18:909183-909289
  misc_feature 1..106: note = hyper
  source 1..106: mol_type = genomic DNA

SEQ ID NO: 57467 - DNA, 169 bp, Homo sapiens; identical to SEQ ID NO: 22677
  misc_feature 1..169: note = chr18:909318-909487
  misc_feature 1..169: note = hyper
  source 1..169: mol_type = genomic DNA

SEQ ID NO: 57468 - DNA, 145 bp, Homo sapiens; identical to SEQ ID NO: 22678
  misc_feature 1..145: note = chr18:909587-909732
  misc_feature 1..145: note = hyper
  source 1..145: mol_type = genomic DNA

SEQ ID NO: 57469 - DNA, 221 bp, Homo sapiens; identical to SEQ ID NO: 36854
  misc_feature 1..221: note = chr18:961763-961984
  misc_feature 1..221: note = hyper
  source 1..221: mol_type = genomic DNA

SEQ ID NO: 57470 - DNA, 372 bp, Homo sapiens; identical to SEQ ID NO: 36855
  misc_feature 1..372: note = chr18:2846451-2846823
  misc_feature 1..372: note = hyper
  source 1..372: mol_type = genomic DNA

SEQ ID NO: 57471 - DNA, 190 bp, Homo sapiens; identical to SEQ ID NO: 36856
  misc_feature 1..190: note = chr18:2847026-2847216
  misc_feature 1..190: note = hyper
  source 1..190: mol_type = genomic DNA

SEQ ID NO: 57472 - DNA, 601 bp, Homo sapiens; identical to SEQ ID NO: 36857
  misc_feature 1..601: note = chr18:2847537-2848138
  misc_feature 1..601: note = hyper
  source 1..601: mol_type = genomic DNA

SEQ ID NO: 57473 - DNA, 89 bp, Homo sapiens; identical to SEQ ID NO: 36858
  misc_feature 1..89: note = chr18:2906054-2906143
  misc_feature 1..89: note = hyper
  source 1..89: mol_type = genomic DNA

SEQ ID NO: 57474 - DNA, 30 bp, Homo sapiens; identical to SEQ ID NO: 36859
  misc_feature 1..30: note = chr18:2906366-2906396
  misc_feature 1..30: note = hyper
  source 1..30: mol_type = genomic DNA

SEQ ID NO: 57475 - skipped

SEQ ID NO: 57476 - DNA, 42 bp, Homo sapiens; identical to SEQ ID NO: 36861
  misc_feature 1..42: note = chr18:4453666-4453708
  misc_feature 1..42: note = hyper
  source 1..42: mol_type = genomic DNA

SEQ ID NO: 57477 - DNA, 42 bp, Homo sapiens
  misc_feature 1..42: note = chr18:4453922-4453964
  misc_feature 1..42: note = hyper
  source 1..42: mol_type = genomic DNA
taaccccttgccctccgcacatcctccccttctctagcagaa

SEQ ID NO: 57478 - DNA, 65 bp, Homo sapiens
  misc_feature 1..65: note = chr18:4454163-4454228
  misc_feature 1..65: note = hyper
  source 1..65: mol_type = genomic DNA
agggtcttcatcgccgcgggccctccgaaggtgcctctcccagctgcagccgcccctcaatgaaa

SEQ ID NO: 57479 - DNA, 24 bp, Homo sapiens
  misc_feature 1..24: note = chr18:5196235-5196259
  misc_feature 1..24: note = hyper
  source 1..24: mol_type = genomic DNA
agagacagcgtcggacgttcacaa

SEQ ID NO: 57480 - DNA, 412 bp, Homo sapiens; identical to SEQ ID NO: 22683
  misc_feature 1..412: note = chr18:5197347-5197759
  misc_feature 1..412: note = hyper
  source 1..412: mol_type = genomic DNA

SEQ ID NO: 57481 - DNA, 175 bp, Homo sapiens; identical to SEQ ID NO: 36867
  misc_feature 1..175: note = chr18:5542983-5543158
  misc_feature 1..175: note = hyper
  source 1..175: mol_type = genomic DNA

SEQ ID NO: 57482 - DNA, 270 bp, Homo sapiens; identical to SEQ ID NO: 36868
  misc_feature 1..270: note = chr18:5543899-5544169
  misc_feature 1..270: note = hyper
  source 1..270: mol_type = genomic DNA

SEQ ID NO: 57483 - DNA, 77 bp, Homo sapiens; identical to SEQ ID NO: 36869
  misc_feature 1..77: note = chr18:5544170-5544247
  misc_feature 1..77: note = hyper
  source 1..77: mol_type = genomic DNA

SEQ ID NO: 57484 - DNA, 85 bp, Homo sapiens
  misc_feature 1..85: note = chr18:5628082-5628167
  misc_feature 1..85: note = hyper
  source 1..85: mol_type = genomic DNA
cactggagcccaccccgctcctacgccgcaaagcagcacaattacagcctgggaggggcaagtcttgcggggcccgtcggtaact

SEQ ID NO: 57485 - DNA, 579 bp, Homo sapiens; identical to SEQ ID NO: 36871
  misc_feature 1..579: note = chr18:5628792-5629371
  misc_feature 1..579: note = hyper
  source 1..579: mol_type = genomic DNA

SEQ ID NO: 57486 - DNA, 112 bp, Homo sapiens; identical to SEQ ID NO: 36872
  misc_feature 1..112: note = chr18:5629372-5629484
  misc_feature 1..112: note = hyper
  source 1..112: mol_type = genomic DNA

SEQ ID NO: 57487 - DNA, 205 bp, Homo sapiens
  misc_feature 1..205: note = chr18:5629569-5629774
  misc_feature 1..205: note = hyper
  source 1..205: mol_type = genomic DNA
cgaggttcgcaccttcccggaaggcccccccctcccccgcgtttccccagggcgagcaaggtctagcttctgagactccgctctctgggctagcggttcgagctgcaggggggcggggacggattcggagggagcactagagagagagcccgcgctcactcctgccctcctcgcaaagaactggccagccccactcgcgtccagc

SEQ ID NO: 57488 - DNA, 56 bp, Homo sapiens
  misc_feature 1..56: note = chr18:5630256-5630312
  misc_feature 1..56: note = hyper
  source 1..56: mol_type = genomic DNA
cgctttctcccccatcgacctcgagccaagggcaggcggcccgcacccgcgcccct

SEQ ID NO: 57489 - DNA, 293 bp, Homo sapiens
  misc_feature 1..293: note = chr18:5630362-5630655
  misc_feature 1..293: note = hyper
  source 1..293: mol_type = genomic DNA
gaaaggcgctcacctgagtcaccgaagccttcctttggggcccctcccggagcttgttcgcagcccgcaggcacaaccttccttggagaaaaaaagtagcgcaagggcagagagaggtagggctgctcacaggtccctccgcaggggctctttccttcgaattctccggggtccagtctcgggctcggcggcgggaaagagctcctggaggctggaaggggccgccagacccgggctcctcccgcagctgcggtggcggcacctccaagttgccacctgcagcgcgcttcggg

SEQ ID NO: 57490 - DNA, 105 bp, Homo sapiens; identical to SEQ ID NO: 36875
  misc_feature 1..105: note = chr18:5630693-5630798
  misc_feature 1..105: note = hyper
  source 1..105: mol_type = genomic DNA

SEQ ID NO: 57491 - DNA, 85 bp, Homo sapiens; identical to SEQ ID NO: 36876
  misc_feature 1..85: note = chr18:5891336-5891421
  misc_feature 1..85: note = hyper
  source 1..85: mol_type = genomic DNA

SEQ ID NO: 57492 - DNA, 32 bp, Homo sapiens; identical to SEQ ID NO: 36877
  misc_feature 1..32: note = chr18:5891443-5891475
  misc_feature 1..32: note = hyper
  source 1..32: mol_type = genomic DNA

SEQ ID NO: 57493 - DNA, 88 bp, Homo sapiens; identical to SEQ ID NO: 36878
  misc_feature 1..88: note = chr18:5894858-5894946
  misc_feature 1..88: note = hyper
  source 1..88: mol_type = genomic DNA

SEQ ID NO: 57494 - skipped

SEQ ID NO: 57495 - DNA, 322 bp, Homo sapiens
  misc_feature 1..322: note = chr18:5895205-5895527
  misc_feature 1..322: note = hyper
  source 1..322: mol_type = genomic DNA
gtccccgccggcgctgtggcgggagccatttccaagagtttccaagaagtgtcaggtcctccgcatcccgcatcccgcatcccgcctcggagccctcctctccgccgctcatcctccagctcccggcgtcccctagcgcggcgctcccgggcgggcccctgcggccgcgccgccggccctcgcgcctcttttgtgtggctgcggcgcgccgggctccgccgggtggagttgagcccgcggcggcggctcggggcggccggactggcggctgttgctaagagaccggagccatgacacagggaaattgcggcagggtggcggt

SEQ ID NO: 57496 - DNA, 236 bp, Homo sapiens
  misc_feature 1..236: note = chr18:5895739-5895975
  misc_feature 1..236: note = hyper
  source 1..236: mol_type = genomic DNA
ccgcggggcagggggcgcggggtgcctcctcggcctcggctctccccgccccggggcgccccgagaccgccgcctgcctccgcgggcagctttgttcttctttcctccaactacctgtctgagccgcgggccccagaggccccaaagagaggcccggagggtctccccagcagcatccgaggggcgctctcggggagctaggggccagagtccgcggtccctccgtgcctgcctcc

SEQ ID NO: 57497 - DNA, 173 bp, Homo sapiens; identical to SEQ ID NO: 36881
  misc_feature 1..173: note = chr18:6414507-6414680
  misc_feature 1..173: note = hyper
  source 1..173: mol_type = genomic DNA

SEQ ID NO: 57498 - DNA, 130 bp, Homo sapiens; identical to SEQ ID NO: 36882
  misc_feature 1..130: note = chr18:6730009-6730139
  misc_feature 1..130: note = hyper
  source 1..130: mol_type = genomic DNA

SEQ ID NO: 57499 - DNA, 32 bp, Homo sapiens; identical to SEQ ID NO: 36883
  misc_feature 1..32: note = chr18:7116490-7116522
  misc_feature 1..32: note = hyper
  source 1..32: mol_type = genomic DNA

SEQ ID NO: 57500 - DNA, 170 bp, Homo sapiens; identical to SEQ ID NO: 36884
  misc_feature 1..170: note = chr18:7117059-7117229
  misc_feature 1..170: note = hyper
  source 1..170: mol_type = genomic DNA

SEQ ID NO: 57501 - DNA, 21 bp, Homo sapiens
  misc_feature 1..21: note = chr18:7117615-7117636
  misc_feature 1..21: note = hyper
  source 1..21: mol_type = genomic DNA
cgcctgcgggggacagggacc

SEQ ID NO: 57502 - DNA, 224 bp, Homo sapiens; identical to SEQ ID NO: 36886
  misc_feature 1..224: note = chr18:7117867-7118091
  misc_feature 1..224: note = hyper
  source 1..224: mol_type = genomic DNA

SEQ ID NO: 57503 - DNA, 46 bp, Homo sapiens; identical to SEQ ID NO: 12973
  misc_feature 1..46: note = chr18:7118131-7118177
  misc_feature 1..46: note = hyper
  source 1..46: mol_type = genomic DNA

SEQ ID NO: 57504 - DNA, 174 bp, Homo sapiens; identical to SEQ ID NO: 36888
  misc_feature 1..174: note = chr18:7566582-7566756
  misc_feature 1..174: note = hyper
  source 1..174: mol_type = genomic DNA

SEQ ID NO: 57505 - DNA, 263 bp, Homo sapiens; identical to SEQ ID NO: 36889
  misc_feature 1..263: note = chr18:7567072-7567335
  misc_feature 1..263: note = hyper
  source 1..263: mol_type = genomic DNA

SEQ ID NO: 57506 - DNA, 29 bp, Homo sapiens
  misc_feature 1..29: note = chr18:7567754-7567783
  misc_feature 1..29: note = hyper
  source 1..29: mol_type = genomic DNA
ccctccgccctcgcgcgcccacccaccgc

SEQ ID NO: 57507 - DNA, 139 bp, Homo sapiens; identical to SEQ ID NO: 36891
  misc_feature 1..139: note = chr18:7568400-7568539
  misc_feature 1..139: note = hyper
  source 1..139: mol_type = genomic DNA

SEQ ID NO: 57508 - DNA, 96 bp, Homo sapiens; identical to SEQ ID NO: 36892
  misc_feature 1..96: note = chr18:7568540-7568636
  misc_feature 1..96: note = hyper
  source 1..96: mol_type = genomic DNA

SEQ ID NO: 57509 - DNA, 14 bp, Homo sapiens
  misc_feature 1..14: note = chr18:8608968-8608982
  misc_feature 1..14: note = hyper
  source 1..14: mol_type = genomic DNA
gaaaacatgtgcat

SEQ ID NO: 57510 - DNA, 101 bp, Homo sapiens; identical to SEQ ID NO: 36895
  misc_feature 1..101: note = chr18:9708380-9708481
  misc_feature 1..101: note = hyper
  source 1..101: mol_type = genomic DNA

SEQ ID NO: 57511 - DNA, 549 bp, Homo sapiens; identical to SEQ ID NO: 36896
  misc_feature 1..549: note = chr18:9708821-9709370
  misc_feature 1..549: note = hyper
  source 1..549: mol_type = genomic DNA

SEQ ID NO: 57512 - DNA, 16 bp, Homo sapiens
  misc_feature 1..16: note = chr18:9771753-9771769
  misc_feature 1..16: note = hyper
  source 1..16: mol_type = genomic DNA
tcgatggtggtgttct

SEQ ID NO: 57513 - DNA, 456 bp, Homo sapiens; identical to SEQ ID NO: 36898
  misc_feature 1..456: note = chr18:10454714-10455170
  misc_feature 1..456: note = hyper
  source 1..456: mol_type = genomic DNA

SEQ ID NO: 57514 - DNA, 228 bp, Homo sapiens
  misc_feature 1..228: note = chr18:11148741-11148969
  misc_feature 1..228: note = hyper
  source 1..228: mol_type = genomic DNA
cgagggcacgctcccggggctcttggccgcccctcgcccaccgggctctgggtagcccctcaccaggctcttggcggccacctagcccggcgcccggccccctgcggccggcccatttagtgtgaatcctggatccggcagcggcggcggcttcttcaggggtagctgatgccggggccttggagagggacgctttgggagggtcctgggaggcggcgcggcgagcaa

SEQ ID NO: 57515 - DNA, 49 bp, Homo sapiens; identical to SEQ ID NO: 22707
  misc_feature 1..49: note = chr18:11149045-11149094
  misc_feature 1..49: note = hyper
  source 1..49: mol_type = genomic DNA

SEQ ID NO: 57516 - DNA, 141 bp, Homo sapiens; identical to SEQ ID NO: 36900
  misc_feature 1..141: note = chr18:11149115-11149256
  misc_feature 1..141: note = hyper
  source 1..141: mol_type = genomic DNA

SEQ ID NO: 57517 - DNA, 104 bp, Homo sapiens
  misc_feature 1..104: note = chr18:11149888-11149992
  misc_feature 1..104: note = hyper
  source 1..104: mol_type = genomic DNA
cccaaacccagggaaccgtttaaggtccgagggaaacgcacaggcccggcaggagagaagccaggggcttggagagtcctgtgcgaccccgacttctgctgggt

SEQ ID NO: 57518 - DNA, 63 bp, Homo sapiens; identical to SEQ ID NO: 12986
  misc_feature 1..63: note = chr18:11751569-11751632
  misc_feature 1..63: note = hyper
  source 1..63: mol_type = genomic DNA

SEQ ID NO: 57519 - DNA, 226 bp, Homo sapiens
  misc_feature 1..226: note = chr18:11752379-11752605
  misc_feature 1..226: note = hyper
  source 1..226: mol_type = genomic DNA
attgctttttgcgcacattcctaacttcctgacgtccatcccagcgggcaggcatggggtgtttgggcggcaacagcaagacgacggaagaccagggcgtcgatgaaaaagaacgacgcgaggccaacaaaaagatcgagaagcagttgcagaaagagcgcctggcttacaaggctacccaccgcctgctgctcctgggtaaggccgaggggcgcgcggcggctcc

SEQ ID NO: 57520 - DNA, 60 bp, Homo sapiens; identical to SEQ ID NO: 22711
  misc_feature 1..60: note = chr18:11752640-11752700
  misc_feature 1..60: note = hyper
  source 1..60: mol_type = genomic DNA

SEQ ID NO: 57521 - DNA, 39 bp, Homo sapiens
  misc_feature 1..39: note = chr18:11752730-11752769
  misc_feature 1..39: note = hyper
  source 1..39: mol_type = genomic DNA
aggaacccgcgtgtaggaaatccccgtgctgggggagga

SEQ ID NO: 57522 - DNA, 142 bp, Homo sapiens; identical to SEQ ID NO: 36906
  misc_feature 1..142: note = chr18:11947249-11947391
  misc_feature 1..142: note = hyper
  source 1..142: mol_type = genomic DNA

SEQ ID NO: 57523 - DNA, 35 bp, Homo sapiens; identical to SEQ ID NO: 12991
  misc_feature 1..35: note = chr18:12253812-12253847
  misc_feature 1..35: note = hyper
  source 1..35: mol_type = genomic DNA

SEQ ID NO: 57524 - DNA, 43 bp, Homo sapiens; identical to SEQ ID NO: 12992
  misc_feature 1..43: note = chr18:12254104-12254147
  misc_feature 1..43: note = hyper
  source 1..43: mol_type = genomic DNA

SEQ ID NO: 57525 - DNA, 16 bp, Homo sapiens
  misc_feature 1..16: note = chr18:12254578-12254594
  misc_feature 1..16: note = hyper
  source 1..16: mol_type = genomic DNA
ccgccccactggtgcc

SEQ ID NO: 57526 - DNA, 159 bp, Homo sapiens; identical to SEQ ID NO: 36910
  misc_feature 1..159: note = chr18:12287804-12287963
  misc_feature 1..159: note = hyper
  source 1..159: mol_type = genomic DNA

SEQ ID NO: 57527 - DNA, 337 bp, Homo sapiens
  misc_feature 1..337: note = chr18:12307751-12308088
  misc_feature 1..337: note = hyper
  source 1..337: mol_type = genomic DNA
gaagaggccctaagaacgtgtgcccggggtgcgaccggggggtggggggcagggggcagagaccctgaaaagctccaccgccgaaccccagggcagtgtcccggcttggctggactgggcgcgggcggctgcaatgctcccgggcgcggcgctgggaccccgcgggccacgtcggctccgctgccccgacgccagggcccgactcgcgtctccctctggcggggcaccacaaggggcagcgaaacggtggtgggggcgggcgccgcgctccttcccgtctcctccccgccagctccgggcccgtccttttccgcccggctcccggcaagggtccccc

SEQ ID NO: 57528 - DNA, 30 bp, Homo sapiens; identical to SEQ ID NO: 36912
  misc_feature 1..30: note = chr18:12308897-12308927
  misc_feature 1..30: note = hyper
  source 1..30: mol_type = genomic DNA

SEQ ID NO: 57529 - DNA, 105 bp, Homo sapiens; identical to SEQ ID NO: 36913
  misc_feature 1..105: note = chr18:12911116-12911221
  misc_feature 1..105: note = hyper
  source 1..105: mol_type = genomic DNA

SEQ ID NO: 57530 - DNA, 143 bp, Homo sapiens; identical to SEQ ID NO: 22717
  misc_feature 1..143: note = chr18:13868570-13868713
  misc_feature 1..143: note = hyper
  source 1..143: mol_type = genomic DNA

SEQ ID NO: 57531 - DNA, 307 bp, Homo sapiens; identical to SEQ ID NO: 36915
  misc_feature 1..307: note = chr18:13868946-13869253
  misc_feature 1..307: note = hyper
  source 1..307: mol_type = genomic DNA

SEQ ID NO: 57532 - DNA, 58 bp, Homo sapiens; identical to SEQ ID NO: 36916
  misc_feature 1..58: note = chr18:14450734-14450792
  misc_feature 1..58: note = hyper
  source 1..58: mol_type = genomic DNA

SEQ ID NO: 57533 - DNA, 91 bp, Homo sapiens; identical to SEQ ID NO: 36917
  misc_feature 1..91: note = chr18:15198009-15198100
  misc_feature 1..91: note = hyper
  source 1..91: mol_type = genomic DNA

SEQ ID NO: 57534 - DNA, 100 bp, Homo sapiens; identical to SEQ ID NO: 36919
  misc_feature 1..100: note = chr18:18821813-18821913
  misc_feature 1..100: note = hyper
  source 1..100: mol_type = genomic DNA

SEQ ID NO: 57535 - DNA, 478 bp, Homo sapiens
  misc_feature 1..478: note = chr18:18821914-18822392
  misc_feature 1..478: note = hyper
  source 1..478: mol_type = genomic DNA
agggctccacaggctgggcggggggcgtcgttggaggggggtaggggagaaatgcgcgcccaccaccctcacagagggcgagggacccccaaaagccactcgcggacgccgaggcagcgggaaggcgcgaggcggggcggggggagggggcgcgggggtccccgctgcggaggccagggcgggcgggaggggcagcacctgaggaatccgcctccggctgcggcggccgccgcctcgctccgccccggggaactgagcgcgcggaccgcgcgcctgccagagagacgccagccgccggcggcgctagcacctcggagtcgggcggccggagcagcggagcgcagcgcggcgcagggaacggcactgggggtggggagaccagcccggccgagccgagggccaccccctggtcctctgccctcgcgccccgctagggccaggtgagcggccgcggggactccggggcgcgggcaggagg

SEQ ID NO: 57536 - DNA, 212 bp, Homo sapiens
  misc_feature 1..212: note = chr18:18823274-18823486
  misc_feature 1..212: note = hyper
  source 1..212: mol_type = genomic DNA
gccgctgcctctaaccgaggctgcgggtcctggagaaactcctcagtcttgcccctttctccggtgaacgtgacggttccaaggtccttatcctccccacccactcctctggccccggctgagaggatagaaaccacattttaatttctgcttttcacaccgtaaggtgtttttttccgcctccccccgcctcgaggcgggaatccctgctt

SEQ ID NO: 57537 - DNA, 88 bp, Homo sapiens; identical to SEQ ID NO: 36922
  misc_feature 1..88: note = chr18:19748288-19748376
  misc_feature 1..88: note = hyper
  source 1..88: mol_type = genomic DNA

SEQ ID NO: 57538 - DNA, 60 bp, Homo sapiens; identical to SEQ ID NO: 36923
  misc_feature 1..60: note = chr18:19749864-19749924
  misc_feature 1..60: note = hyper
  source 1..60: mol_type = genomic DNA

SEQ ID NO: 57539 - DNA, 78 bp, Homo sapiens; identical to SEQ ID NO: 36924
  misc_feature 1..78: note = chr18:20716572-20716650
  misc_feature 1..78: note = hyper
  source 1..78: mol_type = genomic DNA

SEQ ID NO: 57540 - DNA, 88 bp, Homo sapiens; identical to SEQ ID NO: 36925
  misc_feature 1..88: note = chr18:21977137-21977225
  misc_feature 1..88: note = hyper
  source 1..88: mol_type = genomic DNA

SEQ ID NO: 57541 - DNA, 116 bp, Homo sapiens
  misc_feature 1..116: note = chr18:22928965-22929081
  misc_feature 1..116: note = hyper
  source 1..116: mol_type = genomic DNA
aatgctcagaagctgcgagtgaacaaaactgccaatcgtgcaaactttaataaacttttttttttttgaaaagaaaaatccctcccaaattccttcacggggtttcagaagcttct

SEQ ID NO: 57542 - DNA, 231 bp, Homo sapiens; identical to SEQ ID NO: 22724
  misc_feature 1..231: note = chr18:22930559-22930790
  misc_feature 1..231: note = hyper
  source 1..231: mol_type = genomic DNA

SEQ ID NO: 57543 - DNA, 100 bp, Homo sapiens
  misc_feature 1..100: note = chr18:24128030-24128130
  misc_feature 1..100: note = hyper
  source 1..100: mol_type = genomic DNA
gggtccagctcggagccgtccccgggcggcccaccgcgggcccggggcgccagcagtcgcggcggcgcctcgggctccagcgcggcgctctggtccatat

SEQ ID NO: 57544 - DNA, 307 bp, Homo sapiens
  misc_feature 1..307: note = chr18:24764644-24764951
  misc_feature 1..307: note = hyper
  source 1..307: mol_type = genomic DNA
acaccctggaggacccgacagactggcagcagaaactaaagactgttcctgccgtcctctttccaacctctgcatgccccaagaggggtctgaccccggaatcctggagtccagggtgccccgccggggcgcaggaaggaaactcaggtagctgacaagttcaggcggccgtccttctccagcgccccctcaaagtcaggatcccctcctgctcccgccccccacctcccgccatgcgtccactgaagtgaagggaagtgggttggaatactggaggtaggggagatagaaaaaggaagaagcctcc

SEQ ID NO: 57545 - DNA, 37 bp, Homo sapiens; identical to SEQ ID NO: 36934
  misc_feature 1..37: note = chr18:24765383-24765420
  misc_feature 1..37: note = hyper
  source 1..37: mol_type = genomic DNA

SEQ ID NO: 57546 - DNA, 53 bp, Homo sapiens; identical to SEQ ID NO: 13011
  misc_feature 1..53: note = chr18:25755399-25755452
  misc_feature 1..53: note = hyper
  source 1..53: mol_type = genomic DNA

SEQ ID NO: 57547 - DNA, 257 bp, Homo sapiens; identical to SEQ ID NO: 22728
  misc_feature 1..257: note = chr18:25756729-25756986
  misc_feature 1..257: note = hyper
  source 1..257: mol_type = genomic DNA

SEQ ID NO: 57548 - DNA, 335 bp, Homo sapiens; identical to SEQ ID NO: 22729
  misc_feature 1..335: note = chr18:25757452-25757787
  misc_feature 1..335: note = hyper
  source 1..335: mol_type = genomic DNA

SEQ ID NO: 57549 - DNA, 148 bp, Homo sapiens; identical to SEQ ID NO: 22730
  misc_feature 1..148: note = chr18:25757824-25757972
  misc_feature 1..148: note = hyper
  source 1..148: mol_type = genomic DNA

SEQ ID NO: 57550 - DNA, 346 bp, Homo sapiens
  misc_feature 1..346: note = chr18:25758141-25758487
  misc_feature 1..346: note = hyper
  source 1..346: mol_type = genomic DNA
gagggaagcctagagtgcgccgagcaccgccccggcaggtggaggggctgcgggaaataaaataacttgggcaggaacttgattggtagcaggttcatctttggtccgcggtagggaatctaatggagatgaagaatggtggggaagggggggcggtgtctccttgggagcctaacgtacgcttctttattttgtcattctttggagatgggtaatctttcctggcaggggcagacacagcaaactaaggacgcaggccaagctcatcctagctattgttgtctgaggcgctcgccgggagccacctgcgggcgggggagggcggaggccgcggctcctctctgga

SEQ ID NO: 57551 - DNA, 68 bp, Homo sapiens; identical to SEQ ID NO: 22732
  misc_feature 1..68: note = chr18:28620831-28620899
  misc_feature 1..68: note = hyper
  source 1..68: mol_type = genomic DNA

SEQ ID NO: 57552 - DNA, 71 bp, Homo sapiens; identical to SEQ ID NO: 22733
  misc_feature 1..71: note = chr18:28621097-28621168
  misc_feature 1..71: note = hyper
  source 1..71: mol_type = genomic DNA

SEQ ID NO: 57553 - DNA, 162 bp, Homo sapiens
  misc_feature 1..162: note = chr18:28621474-28621636
  misc_feature 1..162: note = hyper
  source 1..162: mol_type = genomic DNA
gaagcagtaagaatccgcgagaccagactcggctcactgccgacgcgggtatagacctcgctcccatcggaccccatgcgcatccatggatgcgggtaagtcgcgggtccgcggctcctttctgggcgtgcggaatgaaactctgttgaagcctgaagcttc

SEQ ID NO: 57554 - DNA, 92 bp, Homo sapiens
  misc_feature 1..92: note = chr18:28621932-28622024
  misc_feature 1..92: note = hyper
  source 1..92: mol_type = genomic DNA
ttcgcgcccccggcacatcccgcccccagctgggtggctggcgggggtggaccgcttgggtgagcttctgaataccctttaggggagatacc

SEQ ID NO: 57555 - DNA, 93 bp, Homo sapiens; identical to SEQ ID NO: 36943
  misc_feature 1..93: note = chr18:28622025-28622118
  misc_feature 1..93: note = hyper
  source 1..93: mol_type = genomic DNA

SEQ ID NO: 57556 - DNA, 295 bp, Homo sapiens
  misc_feature 1..295: note = chr18:28622488-28622783
  misc_feature 1..295: note = hyper
  source 1..295: mol_type = genomic DNA
tccgtgcagcgtccagggcggatccacccccgtccccaccccagccctatccggcgagatctggcttaccacgagggtcagcagcagatgcaggcagacggctccgcgcacggagcgccggggcccagcggcggccatcgggatgccgggcagggccaggagaacgcgggcgccgggagggtgccgagagcgagacctgccgaggtgcagggcgcgggaggtgcttttctcgccgctgcttgtttttaagtgtatttggcctctctcaggcttgcctgcccgggagcaacttcac

SEQ ID NO: 57557 - DNA, 66 bp, Homo sapiens; identical to SEQ ID NO: 36945
  misc_feature 1..66: note = chr18:29078189-29078255
  misc_feature 1..66: note = hyper
  source 1..66: mol_type = genomic DNA

SEQ ID NO: 57558 - DNA, 81 bp, Homo sapiens; identical to SEQ ID NO: 36946
  misc_feature 1..81: note = chr18:29599743-29599824
  misc_feature 1..81: note = hyper
  source 1..81: mol_type = genomic DNA

SEQ ID NO: 57559 - DNA, 324 bp, Homo sapiens; identical to SEQ ID NO: 36948
  misc_feature 1..324: note = chr18:30350080-30350404
  misc_feature 1..324: note = hyper
  source 1..324: mol_type = genomic DNA

SEQ ID NO: 57560 - DNA, 319 bp, Homo sapiens; identical to SEQ ID NO: 36949
  misc_feature 1..319: note = chr18:30350720-30351039
  misc_feature 1..319: note = hyper
  source 1..319: mol_type = genomic DNA

SEQ ID NO: 57561 - DNA, 30 bp, Homo sapiens; identical to SEQ ID NO: 36950
  misc_feature 1..30: note = chr18:30352193-30352223
  misc_feature 1..30: note = hyper
  source 1..30: mol_type = genomic DNA

SEQ ID NO: 57562 - DNA, 97 bp, Homo sapiens
  misc_feature 1..97: note = chr18:31020398-31020495
  misc_feature 1..97: note = hyper
  source 1..97: mol_type = genomic DNA
ggaattgttttcaaacgcgcggggcaaggactccccaccgcctctggaaggggtgaagaactagtcgactctaactccctcagggtggccagggaat

SEQ ID NO: 57563 - DNA, 36 bp, Homo sapiens; identical to SEQ ID NO: 36952
  misc_feature 1..36: note = chr18:31158511-31158547
  misc_feature 1..36: note = hyper
  source 1..36: mol_type = genomic DNA

SEQ ID NO: 57564 - DNA, 173 bp, Homo sapiens; identical to SEQ ID NO: 22738
  misc_feature 1..173: note = chr18:31739469-31739642
  misc_feature 1..173: note = hyper
  source 1..173: mol_type = genomic DNA

SEQ ID NO: 57565 - DNA, 80 bp, Homo sapiens
  misc_feature 1..80: note = chr18:31802052-31802132
  misc_feature 1..80: note = hyper
  source 1..80: mol_type = genomic DNA
tcttgtgaagaaaatcgacgctgctgcggctccccagccccactggcttctgcagcgtgaggctgagatgcattgggctc

SEQ ID NO: 57566 - DNA, 214 bp, Homo sapiens
  misc_feature 1..214: note = chr18:31802167-31802381
  misc_feature 1..214: note = hyper
  source 1..214: mol_type = genomic DNA
tttgtggccatgagactagagccaccccagaaaaaggaacaaatacacacaccattcgatagcgcctaaacccatctttctttgttgttcatcttctagctgcggctttatttgtggaagagggaagtgaggaagggaatgggggggcggggaggaggaatctccaggaccttatctacaatctcaacagtcgcggcaacgatctctgggagtg

SEQ ID NO: 57567 - DNA, 263 bp, Homo sapiens
  misc_feature 1..263: note = chr18:31802675-31802938
  misc_feature 1..263: note = hyper
  source 1..263: mol_type = genomic DNA
ggaagctcctgcagccggtccgggaacccgaggcggggagggaggccagctctggaggtgcgctgccgctttaaaataaaggaccacaaagactgtacagtggggaaaacgcgcctggctaatgcgagtggggacgacttggggagggggttgaggaaggtagggggcacacgagccaacggcggctcacggctccccctctctcccgcctctctccttcctccctccccgccgggctgctccggcagacaaataacagagga

SEQ ID NO: 57568 - DNA, 120 bp, Homo sapiens; identical to SEQ ID NO: 22741
  misc_feature 1..120: note = chr18:31802968-31803088
  misc_feature 1..120: note = hyper
  source 1..120: mol_type = genomic DNA

SEQ ID NO: 57569 - DNA, 128 bp, Homo sapiens
  misc_feature 1..128: note = chr18:31803310-31803438
  misc_feature 1..128: note = hyper
  source 1..128: mol_type = genomic DNA
agggatgcgaggtcccggccgcagcgggagcctgctttgggtgggggaagggatgggaagaggggaggagggtccggttgggcaccagcaatcaatgccccgtgctaccaagtctggtccattcgtaa

SEQ ID NO: 57570 - DNA, 24 bp, Homo sapiens
  misc_feature 1..24: note = chr18:31803472-31803496
  misc_feature 1..24: note = hyper
  source 1..24: mol_type = genomic DNA
cttagcggtcggtctctttaatat

SEQ ID NO: 57571 - DNA, 35 bp, Homo sapiens; identical to SEQ ID NO: 36957
  misc_feature 1..35: note = chr18:31804992-31805027
  misc_feature 1..35: note = hyper
  source 1..35: mol_type = genomic DNA

SEQ ID NO: 57572 - DNA, 381 bp, Homo sapiens; identical to SEQ ID NO: 36959
  misc_feature 1..381: note = chr18:32073450-32073831
  misc_feature 1..381: note = hyper
  source 1..381: mol_type = genomic DNA

SEQ ID NO: 57573 - DNA, 132 bp, Homo sapiens; identical to SEQ ID NO: 36961
  misc_feature 1..132: note = chr18:33878418-33878550
  misc_feature 1..132: note = hyper
  source 1..132: mol_type = genomic DNA

SEQ ID NO: 57574 - DNA, 15 bp, Homo sapiens
  misc_feature 1..15: note = chr18:34833539-34833554
  misc_feature 1..15: note = hyper
  source 1..15: mol_type = genomic DNA
caggcccatttctgc

SEQ ID NO: 57575 - DNA, 572 bp, Homo sapiens; identical to SEQ ID NO: 36963
  misc_feature 1..572: note = chr18:34833958-34834530
  misc_feature 1..572: note = hyper
  source 1..572: mol_type = genomic DNA

SEQ ID NO: 57576 - DNA, 30 bp, Homo sapiens; identical to SEQ ID NO: 36964
  misc_feature 1..30: note = chr18:34973974-34974004
  misc_feature 1..30: note = hyper
  source 1..30: mol_type = genomic DNA

SEQ ID NO: 57577 - DNA, 190 bp, Homo sapiens
  misc_feature 1..190: note = chr18:35064882-35065072
  misc_feature 1..190: note = hyper
  source 1..190: mol_type = genomic DNA
acccacaggagagaccgcgcagacccttgacccgaagaatacttcttattttatggtgatgaactagcctcgataatagccatggctgatatcacacccagttaggggggccataaataattctcttctcccccgcacagaagctataaaccagggccgaggcgcgatagtttatcaaagacgagggctg

SEQ ID NO: 57578 - DNA, 171 bp, Homo sapiens; identical to SEQ ID NO: 36966
  misc_feature 1..171: note = chr18:35065516-35065687
  misc_feature 1..171: note = hyper
  source 1..171: mol_type = genomic DNA

SEQ ID NO: 57579 - DNA, 61 bp, Homo sapiens; identical to SEQ ID NO: 36967
  misc_feature 1..61: note = chr18:35067550-35067611
  misc_feature 1..61: note = hyper
  source 1..61: mol_type = genomic DNA

SEQ ID NO: 57580 - DNA, 29 bp, Homo sapiens
  misc_feature 1..29: note = chr18:35104522-35104551
  misc_feature 1..29: note = hyper
  source 1..29: mol_type = genomic DNA
aggtaaattttcggccggcggggcagccc

SEQ ID NO: 57581 - DNA, 44 bp, Homo sapiens; identical to SEQ ID NO: 13033
  misc_feature 1..44: note = chr18:35104934-35104978
  misc_feature 1..44: note = hyper
  source 1..44: mol_type = genomic DNA

SEQ ID NO: 57582 - DNA, 25 bp, Homo sapiens
  misc_feature 1..25: note = chr18:35144820-35144845
  misc_feature 1..25: note = hyper
  source 1..25: mol_type = genomic DNA
tctctcccttttagacggctgcgct

SEQ ID NO: 57583 - DNA, 133 bp, Homo sapiens
  misc_feature 1..133: note = chr18:35145465-35145598
  misc_feature 1..133: note = hyper
  source 1..133: mol_type = genomic DNA
gaatggtcgacgggttccccgggctgtggcttaatccgttcatgtgcccggcactgcccgggctgctgccgagcccgttggtactgaggcttgcgttgtcagcctgtccgtttgctaacgtggccatctttat

SEQ ID NO: 57584 - DNA, 55 bp, Homo sapiens; identical to SEQ ID NO: 13038
  misc_feature 1..55: note = chr18:35146710-35146765
  misc_feature 1..55: note = hyper
  source 1..55: mol_type = genomic DNA

SEQ ID NO: 57585 - DNA, 195 bp, Homo sapiens; identical to SEQ ID NO: 36974
  misc_feature 1..195: note = chr18:35146895-35147090
  misc_feature 1..195: note = hyper
  source 1..195: mol_type = genomic DNA

SEQ ID NO: 57586 - DNA, 78 bp, Homo sapiens; identical to SEQ ID NO: 36975
  misc_feature 1..78: note = chr18:35147091-35147169
  misc_feature 1..78: note = hyper
  source 1..78: mol_type = genomic DNA

SEQ ID NO: 57587 - DNA, 235 bp, Homo sapiens
  misc_feature 1..235: note = chr18:35147569-35147804
  misc_feature 1..235: note = hyper
  source 1..235: mol_type = genomic DNA
ggggcggcggggctgagcggctggcctaacccccgccggccctcggctagccactttcgggtttcagggtttctcttttcttgccctcggattacattacgttactagaggatatgtctgcaattttaattaaagaaatgagaccccagctgcctgcaaacccaggccaaccccatttggtacaagcacaatacggagctctccagcgccggaggaggcccggaggcccgaggtt

SEQ ID NO: 57588 - DNA, 15 bp, Homo sapiens
  misc_feature 1..15: note = chr18:35147834-35147849
  misc_feature 1..15: note = hyper
  source 1..15: mol_type = genomic DNA
cgcctctctctgagg

SEQ ID NO: 57589 - DNA, 30 bp, Homo sapiens; identical to SEQ ID NO: 36978
  misc_feature 1..30: note = chr18:40857392-40857422
  misc_feature 1..30: note = hyper
  source 1..30: mol_type = genomic DNA

SEQ ID NO: 57590 - DNA, 189 bp, Homo sapiens; identical to SEQ ID NO: 36979
  misc_feature 1..189: note = chr18:43913431-43913620
  misc_feature 1..189: note = hyper
  source 1..189: mol_type = genomic DNA

SEQ ID NO: 57591 - DNA, 56 bp, Homo sapiens
  misc_feature 1..56: note = chr18:43914155-43914211
  misc_feature 1..56: note = hyper
  source 1..56: mol_type = genomic DNA
gccgcccgcgcccgcgccccggagccgcgccacaaagggcccgcgcgcagccgccg

SEQ ID NO: 57592 - DNA, 348 bp, Homo sapiens
  misc_feature 1..348: note = chr18:43914278-43914626
  misc_feature 1..348: note = hyper
  source 1..348: mol_type = genomic DNA
tggctctgtgcgaaacagaggtatcgctttttcctttcggggtctgcttcggagcgtggatcgccgcaggcaccggggcgggggcgggcgccgcgggcggccgggggctcagggcacacccgcgaggacgcagggcgagcggtggcttccccccaccccattttagggggacccccgagggtgggggcggccgccctcgtgggagcttttgtagtgaagttagggtttggcgaatttgggtcccttcctccccagccccattttttattttttgcggcggacgtggttcccccaaatcacagccccttcccctaatacctagccctgtatgatcgaaaggagaaagat

SEQ ID NO: 57593 - DNA, 140 bp, Homo sapiens; identical to SEQ ID NO: 36982
  misc_feature 1..140: note = chr18:43914882-43915022
  misc_feature 1..140: note = hyper
  source 1..140: mol_type = genomic DNA

SEQ ID NO: 57594 - DNA, 139 bp, Homo sapiens; identical to SEQ ID NO: 36984
  misc_feature 1..139: note = chr18:44337012-44337151
  misc_feature 1..139: note = hyper
  source 1..139: mol_type = genomic DNA

SEQ ID NO: 57595 - DNA, 83 bp, Homo sapiens; identical to SEQ ID NO: 22758
  misc_feature 1..83: note = chr18:44772977-44773060
  misc_feature 1..83: note = hyper
  source 1..83: mol_type = genomic DNA

SEQ ID NO: 57596 - DNA, 126 bp, Homo sapiens; identical to SEQ ID NO: 22759
  misc_feature 1..126: note = chr18:44773466-44773592
  misc_feature 1..126: note = hyper
  source 1..126: mol_type = genomic DNA

SEQ ID NO: 57597 - DNA, 19 bp, Homo sapiens
  misc_feature 1..19: note = chr18:44774387-44774406
  misc_feature 1..19: note = hyper
  source 1..19: mol_type = genomic DNA
gcccttgctgggcaccggg

SEQ ID NO: 57598 - DNA, 36 bp, Homo sapiens
  misc_feature 1..36: note = chr18:44775554-44775590
  misc_feature 1..36: note = hyper
  source 1..36: mol_type = genomic DNA
ctccgccgcagaaccccgggccgagccctacaggtc

SEQ ID NO: 57599 - DNA, 30 bp, Homo sapiens; identical to SEQ ID NO: 36991
  misc_feature 1..30: note = chr18:44776834-44776864
  misc_feature 1..30: note = hyper
  source 1..30: mol_type = genomic DNA

SEQ ID NO: 57600 - DNA, 19 bp, Homo sapiens
  misc_feature 1..19: note = chr18:44777331-44777350
  misc_feature 1..19: note = hyper
  source 1..19: mol_type = genomic DNA
cgcgcggctggccagccgg

SEQ ID NO: 57601 - DNA, 42 bp, Homo sapiens
  misc_feature 1..42: note = chr18:44777750-44777792
  misc_feature 1..42: note = hyper
  source 1..42: mol_type = genomic DNA
acctctgggtgtctttaggcgtgtggctgccggcccatcttc

SEQ ID NO: 57602 - DNA, 187 bp, Homo sapiens
  misc_feature 1..187: note = chr18:44777862-44778049
  misc_feature 1..187: note = hyper
  source 1..187: mol_type = genomic DNA
cgcgaagatccgggctctggcccgagcgaatggcgctcaaaccccggcctggggagaatgacggcctgaattgcggcggggcgtcccctccaccgcagaaagtgtgggtacgcagaaacccgcggcaggagagccccaagtggagcgcagtctgacagcgtctgtctctgaactcgtgtcggaccga

SEQ ID NO: 57603 - DNA, 330 bp, Homo sapiens
  misc_feature 1..330: note = chr18:44780673-44781003
  misc_feature 1..330: note = hyper
  source 1..330: mol_type = genomic DNA
caatgctttcctcttcgagctgacatgcattttacacgtcaggactctcctcagccggctaattgattcaaattgttttattggttaaactggtgtcacccattttcatgatctatcaccacatggaggagagcatttccactcccatctccgttccgggcggctgcggttcacccaggccaaggacaggtaaaggagcccagacgcgggacccagaggaaaaccacaaaccgagctggcctcctcataactggagaggcgacgtctggaagtaagaggaggaggccggcacagcagcgcatatgggcttccagctacaaatttaaactg

SEQ ID NO: 57604 - DNA, 161 bp, Homo sapiens
  misc_feature 1..161: note = chr18:44781041-44781202
  misc_feature 1..161: note = hyper
  source 1..161: mol_type = genomic DNA
tttcctccacctgggacacagtcggtttccgagccggcgttgaactccgcggtataggaggccacaacaaaacccgggtgggaactgtccgcggtgctgacgagatgcatcgttccaaagcacagcgaatcctactgtgttcaagtcgggaagaagcctcc

SEQ ID NO: 57605 - DNA, 264 bp, Homo sapiens; identical to SEQ ID NO: 36996
  misc_feature 1..264: note = chr18:44786883-44787147
  misc_feature 1..264: note = hyper
  source 1..264: mol_type = genomic DNA

SEQ ID NO: 57606 - DNA, 80 bp, Homo sapiens
  misc_feature 1..80: note = chr18:44787701-44787781
  misc_feature 1..80: note = hyper
  source 1..80: mol_type = genomic DNA
gtttagggtgagggtcggtctctcctcgcgccctgcttctcggcttagcttgctcagatccgcacccccccactccccac

SEQ ID NO: 57607 - skipped

SEQ ID NO: 57608 - DNA, 86 bp, Homo sapiens
  misc_feature 1..86: note = chr18:44789786-44789872
  misc_feature 1..86: note = hyper
  source 1..86: mol_type = genomic DNA
ggaggatgaatggggcgctcgccgcggctcatggcgccccctaggagcggcaggaaacttctcctgcagggcagcgcgggccgggc

SEQ ID NO: 57609 - DNA, 26 bp, Homo sapiens
  misc_feature 1..26: note = chr18:44789937-44789963
  misc_feature 1..26: note = hyper
  source 1..26: mol_type = genomic DNA
ctaggacatgccgggggctgtttgct

SEQ ID NO: 57610 - DNA, 30 bp, Homo sapiens; identical to SEQ ID NO: 37000
  misc_feature 1..30: note = chr18:44790732-44790762
  misc_feature 1..30: note = hyper
  source 1..30: mol_type = genomic DNA

SEQ ID NO: 57611 - DNA, 53 bp, Homo sapiens
  misc_feature 1..53: note = chr18:45058240-45058293
  misc_feature 1..53: note = hyper
  source 1..53: mol_type = genomic DNA
atcctggctgggcaccagagctgcacgcacgccgcatccatcttccggccgcc

SEQ ID NO: 57612 - DNA, 140 bp, Homo sapiens; identical to SEQ ID NO: 37002
  misc_feature 1..140: note = chr18:45058307-45058447
  misc_feature 1..140: note = hyper
  source 1..140: mol_type = genomic DNA

SEQ ID NO: 57613 - DNA, 123 bp, Homo sapiens; identical to SEQ ID NO: 37003
  misc_feature 1..123: note = chr18:45275551-45275674
  misc_feature 1..123: note = hyper
  source 1..123: mol_type = genomic DNA

SEQ ID NO: 57614 - DNA, 90 bp, Homo sapiens; identical to SEQ ID NO: 37004
  misc_feature 1..90: note = chr18:45662989-45663079
  misc_feature 1..90: note = hyper
  source 1..90: mol_type = genomic DNA

SEQ ID NO: 57615 - DNA, 110 bp, Homo sapiens; identical to SEQ ID NO: 37005
  misc_feature 1..110: note = chr18:45663423-45663533
  misc_feature 1..110: note = hyper
  source 1..110: mol_type = genomic DNA

SEQ ID NO: 57616 - DNA, 30 bp, Homo sapiens; identical to SEQ ID NO: 37006
  misc_feature 1..30: note = chr18:45935031-45935061
  misc_feature 1..30: note = hyper
  source 1..30: mol_type = genomic DNA

SEQ ID NO: 57617 - DNA, 202 bp, Homo sapiens; identical to SEQ ID NO: 37007
  misc_feature 1..202: note = chr18:47087502-47087704
  misc_feature 1..202: note = hyper
  source 1..202: mol_type = genomic DNA

SEQ ID NO: 57618 - DNA, 67 bp, Homo sapiens; identical to SEQ ID NO: 37008
  misc_feature 1..67: note = chr18:47088061-47088128
  misc_feature 1..67: note = hyper
  source 1..67: mol_type = genomic DNA

SEQ ID NO: 57619 - DNA, 125 bp, Homo sapiens; identical to SEQ ID NO: 37009
  misc_feature 1..125: note = chr18:47339606-47339731
  misc_feature 1..125: note = hyper
  source 1..125: mol_type = genomic DNA

SEQ ID NO: 57620 - DNA, 339 bp, Homo sapiens; identical to SEQ ID NO: 37010
  misc_feature 1..339: note = chr18:47792640-47792979
  misc_feature 1..339: note = hyper
  source 1..339: mol_type = genomic DNA

SEQ ID NO: 57621 - DNA, 30 bp, Homo sapiens; identical to SEQ ID NO: 37011
  misc_feature 1..30: note = chr18:49866847-49866877
  misc_feature 1..30: note = hyper
  source 1..30: mol_type = genomic DNA

SEQ ID NO: 57622 - DNA, 31 bp, Homo sapiens
  misc_feature 1..31: note = chr18:49867272-49867303
  misc_feature 1..31: note = hyper
  source 1..31: mol_type = genomic DNA
cgtcgcacccccttccgtaccccacttccct

SEQ ID NO: 57623 - DNA, 61 bp, Homo sapiens
  misc_feature 1..61: note = chr18:52989220-52989281
  misc_feature 1..61: note = hyper
  source 1..61: mol_type = genomic DNA
tacgcgagatcgattcaacttttccgaggggtttttattagttcctcgaataatgccgatt

SEQ ID NO: 57624 - DNA, 71 bp, Homo sapiens
  misc_feature 1..71: note = chr18:52989882-52989953
  misc_feature 1..71: note = hyper
  source 1..71: mol_type = genomic DNA
catgggcccagagcctacggaggggctggggcgctgctcccctcgctggcgctgggcgccccaagggcgca

SEQ ID NO: 57625 - DNA, 1404 bp, Homo sapiens; identical to SEQ ID NO: 37016
  misc_feature 1..1404: note = chr18:53254613-53256017
  misc_feature 1..1404: note = hyper
  source 1..1404: mol_type = genomic DNA

SEQ ID NO: 57626 - DNA, 195 bp, Homo sapiens; identical to SEQ ID NO: 22773
  misc_feature 1..195: note = chr18:53256942-53257137
  misc_feature 1..195: note = hyper
  source 1..195: mol_type = genomic DNA

SEQ ID NO: 57627 - DNA, 118 bp, Homo sapiens
  misc_feature 1..118: note = chr18:53257204-53257322
  misc_feature 1..118: note = hyper
  source 1..118: mol_type = genomic DNA
gggtaggcgtcgcgcgtggggcggcactgtgggagttcccgaggccgaggtcgttcgcaggccccatttccctgcgctcttattcgtgttgccgcttcttggccgtccttgctctttg

SEQ ID NO: 57628 - DNA, 104 bp, Homo sapiens; identical to SEQ ID NO: 22775
  misc_feature 1..104: note = chr18:53446866-53446970
  misc_feature 1..104: note = hyper
  source 1..104: mol_type = genomic DNA

SEQ ID NO: 57629 - DNA, 39 bp, Homo sapiens; identical to SEQ ID NO: 22776
  misc_feature 1..39: note = chr18:53447816-53447855
  misc_feature 1..39: note = hyper
  source 1..39: mol_type = genomic DNA

SEQ ID NO: 57630 - DNA, 38 bp, Homo sapiens
  misc_feature 1..38: note = chr18:54789032-54789070
  misc_feature 1..38: note = hyper
  source 1..38: mol_type = genomic DNA
ctgggagtgcatgtgcgttgctgagcgtggcctgagcc

SEQ ID NO: 57631 - DNA, 31 bp, Homo sapiens
  misc_feature 1..31: note = chr18:54789256-54789287
  misc_feature 1..31: note = hyper
  source 1..31: mol_type = genomic DNA
atgcattggtagctggcgcctttagtcgggt

SEQ ID NO: 57632 - DNA, 54 bp, Homo sapiens
  misc_feature 1..54: note = chr18:55019653-55019707
  misc_feature 1..54: note = hyper
  source 1..54: mol_type = genomic DNA
atcctgtgcttagatcgaactgtaacattattccaatcacatttatcttgcagg

SEQ ID NO: 57633 - DNA, 216 bp, Homo sapiens
  misc_feature 1..216: note = chr18:55020439-55020655
  misc_feature 1..216: note = hyper
  source 1..216: mol_type = genomic DNA
aaagcccctagaagccgctgtccaaatcgatgtgattgcatttctcgtattcttcctcagcatcccttccctcatttcagaaatgggggttgggggaggctttcaggagggtgagggtggagggaaagacggtgtgtttgttcgggagggggcggcgagcagagatggacaggcgtgaggggagcgccctccccgcgccctgtccgcagactccgc

SEQ ID NO: 57634 - DNA, 141 bp, Homo sapiens; identical to SEQ ID NO: 4552
  misc_feature 1..141: note = chr18:55020804-55020945
  misc_feature 1..141: note = hyper
  source 1..141: mol_type = genomic DNA

SEQ ID NO: 57635 - DNA, 113 bp, Homo sapiens; identical to SEQ ID NO: 22780
  misc_feature 1..113: note = chr18:55020965-55021078
  misc_feature 1..113: note = hyper
  source 1..113: mol_type = genomic DNA

SEQ ID NO: 57636 - DNA, 154 bp, Homo sapiens
  misc_feature 1..154: note = chr18:55021242-55021396
  misc_feature 1..154: note = hyper
  source 1..154: mol_type = genomic DNA
tttctccaaaaacaattctatggggctgcaaaggcgtagcgggtcaggctggcggggcggccgctgtccgcggtgctgattccctggtcctcgcagcgccgcgggctccagccctgcgcccggcgtgcgccctgctctccgcatgacggccatt

SEQ ID NO: 57637 - skipped

SEQ ID NO: 57638 - DNA, 32 bp, Homo sapiens; identical to SEQ ID NO: 13074
  misc_feature 1..32: note = chr18:55105140-55105172
  misc_feature 1..32: note = hyper
  source 1..32: mol_type = genomic DNA

SEQ ID NO: 57639 - DNA, 264 bp, Homo sapiens
  misc_feature 1..264: note = chr18:55105464-55105728
  misc_feature 1..264: note = hyper
  source 1..264: mol_type = genomic DNA
aatgtccaggtcccccgctgggaaggacacactataccctatggcaagccagggtgggcgacttcccatggatcgggtggaggggggtatctttcaggatcggcgggcggtctaggggaacaattcgtggtggcgatgatttgcatagcgcgggtcttgggatgcgcgcggttccgagccagcctcgcacagctcgcttccggagctgcgagctcaggtttccacccccgatcccccgggctttcctcgcaccgctgagcccag

SEQ ID NO: 57640 - DNA, 231 bp, Homo sapiens
  misc_feature 1..231: note = chr18:55105830-55106061
  misc_feature 1..231: note = hyper
  source 1..231: mol_type = genomic DNA
ttcctttgccgtctgctggtggattcctattcccagtcggtaatcgccccgcagtgttgatctaagaaggtaaagaaaactaggtttccctgcaaagagcctcccccaaatcggcggactccggatactttgagtggatttagaaatttatgtaatctttctcctttagtttatttttcatcctctcctacagttttctctgatttgctgttggttcggggcaagataaag

SEQ ID NO: 57641 - DNA, 46 bp, Homo sapiens; identical to SEQ ID NO: 13078
  misc_feature 1..46: note = chr18:56887753-56887799
  misc_feature 1..46: note = hyper
  source 1..46: mol_type = genomic DNA

SEQ ID NO: 57642 - DNA, 170 bp, Homo sapiens; identical to SEQ ID NO: 37030
  misc_feature 1..170: note = chr18:56888013-56888183
  misc_feature 1..170: note = hyper
  source 1..170: mol_type = genomic DNA

SEQ ID NO: 57643 - DNA, 150 bp, Homo sapiens
  misc_feature 1..150: note = chr18:56888404-56888554
  misc_feature 1..150: note = hyper
  source 1..150: mol_type = genomic DNA
ttcgccctttcccctcgctcctttcccattccctctgcaacaggtcctgctctctaggcaccggcttggaggctccctcgccatggcccctagaacccaggcggagaggacggccgcgctgcgggtgcggagggcgcctgcgggtggggt

SEQ ID NO: 57644 - DNA, 13 bp, Homo sapiens
  misc_feature 1..13: note = chr18:56888623-56888636
  misc_feature 1..13: note = hyper
  source 1..13: mol_type = genomic DNA
gctcacccagcat

SEQ ID NO: 57645 - DNA, 135 bp, Homo sapiens
  misc_feature 1..135: note = chr18:56931583-56931718
  misc_feature 1..135: note = hyper
  source 1..135: mol_type = genomic DNA
ggtgccctcaccgtacgccgaccgtgtggggaacacgctctctggaagctgagttgggggtcctggtctctcttgccgccccctgcccccagcttcctgcgcgtgggctccagcggtctccgcaaagactttcag

SEQ ID NO: 57646 - DNA, 30 bp, Homo sapiens
  misc_feature 1..30: note = chr18:56932322-56932352
  misc_feature 1..30: note = hyper
  source 1..30: mol_type = genomic DNA
gacacgccgccctcgcgcgcagagactgct

SEQ ID NO: 57647 - DNA, 22 bp, Homo sapiens
  misc_feature 1..22: note = chr18:56932645-56932667
  misc_feature 1..22: note = hyper
  source 1..22: mol_type = genomic DNA
gccagagcgacaccctgtctct

SEQ ID NO: 57648 - DNA, 136 bp, Homo sapiens; identical to SEQ ID NO: 37035
  misc_feature 1..136: note = chr18:56932957-56933093
  misc_feature 1..136: note = hyper
  source 1..136: mol_type = genomic DNA

SEQ ID NO: 57649 - DNA, 86 bp, Homo sapiens
  misc_feature 1..86: note = chr18:56934924-56935010
  misc_feature 1..86: note = hyper
  source 1..86: mol_type = genomic DNA
agcttccagtgtcaacggtggatatcgagcacgctcaggcgggagtccgggactctccttcttcagagagtctcaggagattgtga

SEQ ID NO: 57650 - DNA, 88 bp, Homo sapiens
  misc_feature 1..88: note = chr18:56935319-56935407
  misc_feature 1..88: note = hyper
  source 1..88: mol_type = genomic DNA
cttggtgaactgagaggagtccttaggagagcggggacgccaggggccgggggacacttcgctctcgccctagggaaggtggtcttga

SEQ ID NO: 57651 - DNA, 140 bp, Homo sapiens; identical to SEQ ID NO: 37037
  misc_feature 1..140: note = chr18:56935479-56935619
  misc_feature 1..140: note = hyper
  source 1..140: mol_type = genomic DNA

SEQ ID NO: 57652 - DNA, 77 bp, Homo sapiens
  misc_feature 1..77: note = chr18:56935927-56936004
  misc_feature 1..77: note = hyper
  source 1..77: mol_type = genomic DNA
aggctccagcgcctgcggtgatgggagcggcgtggccagcggggcccggcagcctgttgccctccagctgcagggct

SEQ ID NO: 57653 - DNA, 383 bp, Homo sapiens; identical to SEQ ID NO: 37039
  misc_feature 1..383: note = chr18:56936333-56936716
  misc_feature 1..383: note = hyper
  source 1..383: mol_type = genomic DNA

SEQ ID NO: 57654 - DNA, 50 bp, Homo sapiens
  misc_feature 1..50: note = chr18:56939373-56939423
  misc_feature 1..50: note = hyper
  source 1..50: mol_type = genomic DNA
ccccaaaggggagctcgtactacaaactggaacagactgcttgaagggcg

SEQ ID NO: 57655 - DNA, 233 bp, Homo sapiens; identical to SEQ ID NO: 22790
  misc_feature 1..233: note = chr18:56940722-56940955
  misc_feature 1..233: note = hyper
  source 1..233: mol_type = genomic DNA

SEQ ID NO: 57656 - DNA, 401 bp, Homo sapiens
  misc_feature 1..401: note = chr18:56941788-56942189
  misc_feature 1..401: note = hyper
  source 1..401: mol_type = genomic DNA
acccctcaaatctgaggcgagacccgaggcgagcgcttggccttccctgaactggtggcctgaaccgtgaattaaaatgctttcctataaaagctcaaggacctagaggacaatatccctaaaatctccttttcagtaggcgctctgatctccacagcaggggtgtcttctttatcccgcttgcgttcagacaagcgtttgctgcgtccctttagagggcaaggcaaccgtcgagggccacgtcgtgggcatcaaacaaattgggaaaggccagggccgttggcctggtggagtttaacgtccagtctggaagacaagacaaaggaagagggaaaacacacatcctcagatccccaacctttaaattggtgttagaaggatgtttgcggaggacaagtcaa

SEQ ID NO: 57657 - DNA, 30 bp, Homo sapiens; identical to SEQ ID NO: 37044
  misc_feature 1..30: note = chr18:57069866-57069896
  misc_feature 1..30: note = hyper
  source 1..30: mol_type = genomic DNA

SEQ ID NO: 57658 - DNA, 210 bp, Homo sapiens; identical to SEQ ID NO: 22792
  misc_feature 1..210: note = chr18:57364448-57364658
  misc_feature 1..210: note = hyper
  source 1..210: mol_type = genomic DNA

SEQ ID NO: 57659 - DNA, 289 bp, Homo sapiens
  misc_feature 1..289: note = chr18:57364691-57364980
  misc_feature 1..289: note = hyper
  source 1..289: mol_type = genomic DNA
tttgcaccacctgcacggggagcaggggtccggaatattatggggctggggggaaaatgaggctaggagttggggtatcggatgcaaacccagcagagaagcaggtaaagggggtacctgcggtgtccggctggcgcgagggccctgaggttcaagttgtctcgtcgggacgttcacgtccgattgacagacttgctggactcggcttggggctgcgccctcgcctcttccctctccctcctctgggagaagcgcgcagggtggggaaagcgggcggttgtttgcattt

SEQ ID NO: 57660 - DNA, 159 bp, Homo sapiens; identical to SEQ ID NO: 22794
  misc_feature 1..159: note = chr18:59000829-59000988
  misc_feature 1..159: note = hyper
  source 1..159: mol_type = genomic DNA

SEQ ID NO: 57661 - DNA, 279 bp, Homo sapiens; identical to SEQ ID NO: 22795
  misc_feature 1..279: note = chr18:59001022-59001301
  misc_feature 1..279: note = hyper
  source 1..279: mol_type = genomic DNA

SEQ ID NO: 57662 - DNA, 28 bp, Homo sapiens
  misc_feature 1..28: note = chr18:60263895-60263923
  misc_feature 1..28: note = hyper
  source 1..28: mol_type = genomic DNA
accccgggcgcaccgccctccaggggtg

SEQ ID NO: 57663 - DNA, 135 bp, Homo sapiens; identical to SEQ ID NO: 37050
  misc_feature 1..135: note = chr18:60264219-60264354
  misc_feature 1..135: note = hyper
  source 1..135: mol_type = genomic DNA

SEQ ID NO: 57664 - DNA, 21 bp, Homo sapiens
  misc_feature 1..21: note = chr18:60985733-60985754
  misc_feature 1..21: note = hyper
  source 1..21: mol_type = genomic DNA
tgtgcccgggctgggaggaga

SEQ ID NO: 57665 - DNA, 137 bp, Homo sapiens; identical to SEQ ID NO: 37053
  misc_feature 1..137: note = chr18:63417736-63417873
  misc_feature 1..137: note = hyper
  source 1..137: mol_type = genomic DNA

SEQ ID NO: 57666 - DNA, 64 bp, Homo sapiens
  misc_feature 1..64: note = chr18:67067494-67067558
  misc_feature 1..64: note = hyper
  source 1..64: mol_type = genomic DNA
ttcagtcctagttaacgaaaacgcatgcataaatcaaccactcgggtcggtcggtcttctccac

SEQ ID NO: 57667 - DNA, 44 bp, Homo sapiens
  misc_feature 1..44: note = chr18:67067907-67067951
  misc_feature 1..44: note = hyper
  source 1..44: mol_type = genomic DNA
gaccggggagccgggtggggagcgggcctcggggcgcccggcgg

SEQ ID NO: 57668 - DNA, 17 bp, Homo sapiens
  misc_feature 1..17: note = chr18:67068698-67068715
  misc_feature 1..17: note = hyper
  source 1..17: mol_type = genomic DNA
ggggcccacacctgccg

SEQ ID NO: 57669 - DNA, 184 bp, Homo sapiens
  misc_feature 1..184: note = chr18:67069032-67069216
  misc_feature 1..184: note = hyper
  source 1..184: mol_type = genomic DNA
ggctgtagtttagggcgccttcgccgtggccgagggcggctcccgcgccccgcaagtgctcccctacccggggacccgcgcccgcgtgcaggcaggtgtgtgccccgcgcccgcccgcggtcactgctccgtgacggcaaagttgatggagacctttccctattcttgagagatgcgctgcctg

SEQ ID NO: 57670 - DNA, 181 bp, Homo sapiens; identical to SEQ ID NO: 22798
  misc_feature 1..181: note = chr18:70209205-70209386
  misc_feature 1..181: note = hyper
  source 1..181: mol_type = genomic DNA

SEQ ID NO: 57671 - DNA, 440 bp, Homo sapiens; identical to SEQ ID NO: 37059
  misc_feature 1..440: note = chr18:70209493-70209933
  misc_feature 1..440: note = hyper
  source 1..440: mol_type = genomic DNA

SEQ ID NO: 57672 - DNA, 89 bp, Homo sapiens; identical to SEQ ID NO: 37060
  misc_feature 1..89: note = chr18:70210724-70210813
  misc_feature 1..89: note = hyper
  source 1..89: mol_type = genomic DNA

SEQ ID NO: 57673 - DNA, 258 bp, Homo sapiens; identical to SEQ ID NO: 37061
  misc_feature 1..258: note = chr18:70211036-70211294
  misc_feature 1..258: note = hyper
  source 1..258: mol_type = genomic DNA

SEQ ID NO: 57674 - DNA, 127 bp, Homo sapiens
  misc_feature 1..127: note = chr18:70211499-70211626
  misc_feature 1..127: note = hyper
  source 1..127: mol_type = genomic DNA
gaactgtccggttcccgcagggctagaagaggggcctccggcccgggtctgtgtgtctgctcctctggacctcggactggtggagcggctggcgcttgcgcttatttattaaattgcggtgtccgcg

SEQ ID NO: 57675 - DNA, 18 bp, Homo sapiens
  misc_feature 1..18: note = chr18:70211666-70211684
  misc_feature 1..18: note = hyper
  source 1..18: mol_type = genomic DNA
ctgcgcctggagctcggc

SEQ ID NO: 57676 - DNA, 66 bp, Homo sapiens
  misc_feature 1..66: note = chr18:70534216-70534282
  misc_feature 1..66: note = hyper
  source 1..66: mol_type = genomic DNA
catccctgaactgcacgctatcctccacccccggggggttcctgcgcactgaaagaccgttctccg

SEQ ID NO: 57677 - DNA, 153 bp, Homo sapiens
  misc_feature 1..153: note = chr18:70535220-70535373
  misc_feature 1..153: note = hyper
  source 1..153: mol_type = genomic DNA
cggaaagaggagcgggtgggtgggcgtctgggaggcgggctggagggcggtgcaggggagcggggcggccggggggggggccggggggcggggaagggagggaggagaaaggagccggaagagggcagagttaccaaatgggctccttagtca

SEQ ID NO: 57678 - DNA, 86 bp, Homo sapiens
  misc_feature 1..86: note = chr18:70535582-70535668
  misc_feature 1..86: note = hyper
  source 1..86: mol_type = genomic DNA
agaggatgcagccgcaaatcccgagccggatcctcgtgccggacggaaggcgtggaagcgggaggggccttcgtgtgaaaatccct

SEQ ID NO: 57679 - DNA, 101 bp, Homo sapiens
  misc_feature 1..101: note = chr18:70535909-70536010
  misc_feature 1..101: note = hyper
  source 1..101: mol_type = genomic DNA
ttactcctgcaaagacgcgggcttcttgcaattgagccccccacctcgaggtatttaaaaccaccccaaggcacacacggacccccgttcccccgcgccac

SEQ ID NO: 57680 - DNA, 229 bp, Homo sapiens; identical to SEQ ID NO: 22804
  misc_feature 1..229: note = chr18:70536604-70536833
  misc_feature 1..229: note = hyper
  source 1..229: mol_type = genomic DNA

SEQ ID NO: 57681 - DNA, 154 bp, Homo sapiens; identical to SEQ ID NO: 22805
  misc_feature 1..154: note = chr18:70536871-70537025
  misc_feature 1..154: note = hyper
  source 1..154: mol_type = genomic DNA

SEQ ID NO: 57682 - DNA, 33 bp, Homo sapiens; identical to SEQ ID NO: 13107
  misc_feature 1..33: note = chr18:70537332-70537365
  misc_feature 1..33: note = hyper
  source 1..33: mol_type = genomic DNA

SEQ ID NO: 57683 - DNA, 378 bp, Homo sapiens; identical to SEQ ID NO: 37070
  misc_feature 1..378: note = chr18:72123440-72123818
  misc_feature 1..378: note = hyper
  source 1..378: mol_type = genomic DNA

SEQ ID NO: 57684 - DNA, 15 bp, Homo sapiens
  misc_feature 1..15: note = chr18:72124175-72124190
  misc_feature 1..15: note = hyper
  source 1..15: mol_type = genomic DNA
aacccatgtccccgg

SEQ ID NO: 57685 - DNA, 48 bp, Homo sapiens; identical to SEQ ID NO: 13109
  misc_feature 1..48: note = chr18:72124237-72124285
  misc_feature 1..48: note = hyper
  source 1..48: mol_type = genomic DNA

SEQ ID NO: 57686 - DNA, 97 bp, Homo sapiens
  misc_feature 1..97: note = chr18:73167832-73167929
  misc_feature 1..97: note = hyper
  source 1..97: mol_type = genomic DNA
gggccgggcacccgggaacccgcgagcgcggggctgggctctgggctgcgtccgggggccccgacttggttattgatcggcccaagcgcaggagaac

SEQ ID NO: 57687 - skipped

SEQ ID NO: 57688 - DNA, 114 bp, Homo sapiens; identical to SEQ ID NO: 37075
  misc_feature 1..114: note = chr18:73628494-73628608
  misc_feature 1..114: note = hyper
  source 1..114: mol_type = genomic DNA

SEQ ID NO: 57689 - DNA, 24 bp, Homo sapiens
  misc_feature 1..24: note = chr18:74962147-74962171
  misc_feature 1..24: note = hyper
  source 1..24: mol_type = genomic DNA
ttccacctgcgcggctgcagccgg

SEQ ID NO: 57690 - skipped

SEQ ID NO: 57691 - DNA, 250 bp, Homo sapiens; identical to SEQ ID NO: 37080
  misc_feature 1..250: note = chr18:74962692-74962942
  misc_feature 1..250: note = hyper
  source 1..250: mol_type = genomic DNA

SEQ ID NO: 57692 - DNA, 70 bp, Homo sapiens; identical to SEQ ID NO: 37082
  misc_feature 1..70: note = chr18:74963720-74963790
  misc_feature 1..70: note = hyper
  source 1..70: mol_type = genomic DNA

SEQ ID NO: 57693 - DNA, 81 bp, Homo sapiens
  misc_feature 1..81: note = chr18:75362850-75362931
  misc_feature 1..81: note = hyper
  source 1..81: mol_type = genomic DNA
caggaccctgcaggacgcgggccgaggctcccagctgccggccatgccctcggctcctctcccgacacgcgccagcactgc

SEQ ID NO: 57694 - DNA, 111 bp, Homo sapiens
  misc_feature 1..111: note = chr18:75362985-75363096
  misc_feature 1..111: note = hyper
  source 1..111: mol_type = genomic DNA
gaagaagccgggaccgcgagcagctggacgctttctccctggggctcagccacacattttagtcacagttacagactacgggggatttgaagccttcgctttagtttttat

SEQ ID NO: 57695 - DNA, 256 bp, Homo sapiens
  misc_feature 1..256: note = chr18:75611969-75612225
  misc_feature 1..256: note = hyper
  source 1..256: mol_type = genomic DNA
tctccagctgagccccgaggaggccgctgctccgtgtcctggactctgagcaaagccgcgggccttagaccctccccagcctcaggcgagccccagtgccgacacctgctaagagacggtgcattgcgggctaaacccgcagacactgagcggggacgccacttccgacggcgtaaggcacctaaagtagccacagaggaaactgggggtgcaggagctgcaggagccccggcggcctgcaggggcggtggcgcgg

SEQ ID NO: 57696 - DNA, 145 bp, Homo sapiens; identical to SEQ ID NO: 22814
  misc_feature 1..145: note = chr18:75612286-75612431
  misc_feature 1..145: note = hyper
  source 1..145: mol_type = genomic DNA

SEQ ID NO: 57697 - DNA, 332 bp, Homo sapiens; identical to SEQ ID NO: 37085
  misc_feature 1..332: note = chr18:77153184-77153516
  misc_feature 1..332: note = hyper
  source 1..332: mol_type = genomic DNA

SEQ ID NO: 57698 - DNA, 166 bp, Homo sapiens; identical to SEQ ID NO: 37086
  misc_feature 1..166: note = chr18:77159847-77160013
  misc_feature 1..166: note = hyper
  source 1..166: mol_type = genomic DNA

SEQ ID NO: 57699 - DNA, 132 bp, Homo sapiens; identical to SEQ ID NO: 37087
  misc_feature 1..132: note = chr18:77547916-77548048
  misc_feature 1..132: note = hyper
  source 1..132: mol_type = genomic DNA

SEQ ID NO: 57700 - skipped

SEQ ID NO: 57701 - DNA, 170 bp, Homo sapiens
  misc_feature 1..170: note = chr18:77557912-77558082
  misc_feature 1..170: note = hyper
  source 1..170: mol_type = genomic DNA
cgccggagtccgggatgccggctccagagacgccgcgctccgccccgaggaggccgccggccgggtaagcggagcccggagctcgcggagtctggaccgcaggtaaagttgagcgcgccgtggggccgggggtggggggtccgcggcgaaggagccggggccgcagtggg

SEQ ID NO: 57702 - DNA, 39 bp, Homo sapiens; identical to SEQ ID NO: 22819
  misc_feature 1..39: note = chr18:77558358-77558397
  misc_feature 1..39: note = hyper
  source 1..39: mol_type = genomic DNA

SEQ ID NO: 57703 - DNA, 415 bp, Homo sapiens; identical to SEQ ID NO: 22820
  misc_feature 1..415: note = chr18:77558416-77558831
  misc_feature 1..415: note = hyper
  source 1..415: mol_type = genomic DNA

SEQ ID NO: 57704 - DNA, 212 bp, Homo sapiens; identical to SEQ ID NO: 22821
  misc_feature 1..212: note = chr18:77558930-77559142
  misc_feature 1..212: note = hyper
  source 1..212: mol_type = genomic DNA

SEQ ID NO: 57705 - DNA, 74 bp, Homo sapiens; identical to SEQ ID NO: 37092
  misc_feature 1..74: note = chr18:78005084-78005158
  misc_feature 1..74: note = hyper
  source 1..74: mol_type = genomic DNA

SEQ ID NO: 57706 - DNA, 78 bp, Homo sapiens; identical to SEQ ID NO: 37093
  misc_feature 1..78: note = chr19:496464-496542
  misc_feature 1..78: note = hyper
  source 1..78: mol_type = genomic DNA

SEQ ID NO: 57707 - DNA, 102 bp, Homo sapiens
  misc_feature 1..102: note = chr19:591263-591365
  misc_feature 1..102: note = hyper
  source 1..102: mol_type = genomic DNA
agagcgagaccggcgcgtgtccccgtgggctgtgtgtgaacaggggcccgtgaccgcggcggggttcccggggcgcgagcctgtggccggagaggtgtgtct

SEQ ID NO: 57708 - DNA, 115 bp, Homo sapiens
  misc_feature 1..115: note = chr19:591416-591531
  misc_feature 1..115: note = hyper
  source 1..115: mol_type = genomic DNA
tattttggtgggacgtgtggtttgtgtgtgttgggaccaggtggcgggcgtgcgcgtgtacgcccggggccggtgtgcaccggtgggcagtagtgtgagccgcaggcaggtctca

SEQ ID NO: 57709 - DNA, 89 bp, Homo sapiens; identical to SEQ ID NO: 37095
  misc_feature 1..89: note = chr19:639980-640069
  misc_feature 1..89: note = hyper
  source 1..89: mol_type = genomic DNA

SEQ ID NO: 57710 - DNA, 103 bp, Homo sapiens; identical to SEQ ID NO: 37096
  misc_feature 1..103: note = chr19:661158-661261
  misc_feature 1..103: note = hyper
  source 1..103: mol_type = genomic DNA

SEQ ID NO: 57711 - DNA, 61 bp, Homo sapiens; identical to SEQ ID NO: 37097
  misc_feature 1..61: note = chr19:822595-822656
  misc_feature 1..61: note = hyper
  source 1..61: mol_type = genomic DNA

SEQ ID NO: 57712 - DNA, 42 bp, Homo sapiens
  misc_feature 1..42: note = chr19:1401710-1401752
  misc_feature 1..42: note = hyper
  source 1..42: mol_type = genomic DNA
ggcaccgcagccccgcgcccggggacgcgaacctgcaggctg

SEQ ID NO: 57713 - skipped

SEQ ID NO: 57714 - DNA, 197 bp, Homo sapiens; identical to SEQ ID NO: 37099
  misc_feature 1..197: note = chr19:1446633-1446830
  misc_feature 1..197: note = hyper
  source 1..197: mol_type = genomic DNA

SEQ ID NO: 57715 - DNA, 246 bp, Homo sapiens
  misc_feature 1..246: note = chr19:1450073-1450319
  misc_feature 1..246: note = hyper
  source 1..246: mol_type = genomic DNA
attggctgtctcacccgcatccctcatcccgcatcctcccccgctcgcggtggtctcgcccagcgctaggagcggcagcgccgcctgcccaggcccggaccgggctttgtccgccccggagcccctgcccgcgccgcggagaccccggagcccgcgcgctccgaggccaccccgggccgggatttccggtggggcccgcggagccgcgcagagggaggaggccccagacccaggcgccccgccagc

SEQ ID NO: 57716 - DNA, 42 bp, Homo sapiens; identical to SEQ ID NO: 22826
  misc_feature 1..42: note = chr19:1450390-1450432
  misc_feature 1..42: note = hyper
  source 1..42: mol_type = genomic DNA

SEQ ID NO: 57717 - DNA, 77 bp, Homo sapiens; identical to SEQ ID NO: 37101
  misc_feature 1..77: note = chr19:1523753-1523830
  misc_feature 1..77: note = hyper
  source 1..77: mol_type = genomic DNA

SEQ ID NO: 57718 - DNA, 102 bp, Homo sapiens
  misc_feature 1..102: note = chr19:1524447-1524549
  misc_feature 1..102: note = hyper
  source 1..102: mol_type = genomic DNA
ccgtgggttgcgtgtccggggtgtgggcgtgcggctcggcctcgggatgcgacgctgtgttgcccctgggtgtgtgtgcgagcctggcgagggtctgagtgt

SEQ ID NO: 57719 - DNA, 49 bp, Homo sapiens; identical to SEQ ID NO: 37103
  misc_feature 1..49: note = chr19:1718861-1718910
  misc_feature 1..49: note = hyper
  source 1..49: mol_type = genomic DNA

SEQ ID NO: 57720 - DNA, 30 bp, Homo sapiens; identical to SEQ ID NO: 13129
  misc_feature 1..30: note = chr19:1719137-1719167
  misc_feature 1..30: note = hyper
  source 1..30: mol_type = genomic DNA

SEQ ID NO: 57721 - DNA, 180 bp, Homo sapiens; identical to SEQ ID NO: 37105
  misc_feature 1..180: note = chr19:1725554-1725734
  misc_feature 1..180: note = hyper
  source 1..180: mol_type = genomic DNA

SEQ ID NO: 57722 - DNA, 61 bp, Homo sapiens; identical to SEQ ID NO: 37106
  misc_feature 1..61: note = chr19:1726021-1726082
  misc_feature 1..61: note = hyper
  source 1..61: mol_type = genomic DNA

SEQ ID NO: 57723 - DNA, 415 bp, Homo sapiens; identical to SEQ ID NO: 37107
  misc_feature 1..415: note = chr19:1749776-1750191
  misc_feature 1..415: note = hyper
  source 1..415: mol_type = genomic DNA

SEQ ID NO: 57724 - DNA, 36 bp, Homo sapiens; identical to SEQ ID NO: 37108
  misc_feature 1..36: note = chr19:1752836-1752872
  misc_feature 1..36: note = hyper
  source 1..36: mol_type = genomic DNA

SEQ ID NO: 57725 - DNA, 670 bp, Homo sapiens
  misc_feature 1..670: note = chr19:1753502-1754172
  misc_feature 1..670: note = hyper
  source 1..670: mol_type = genomic DNA
ccacatcctggtggccgcgctcgcagccgggccgggccgtgcgccgcgcagcctggcagcctcgcgcgcagccaccggggagcgggcgggagtcatgcagcggccttgagcactaggggccggcgctgaggagcgcgcgcggcgggagggcagccgagcatggagctgagcctggagagcctggggggcctgcacagcgtggcccacgcgcaggcgggcgagctgctgagcccgggccacgcgcgctcggcggcggcgcagcaccgcggcctggtggcgcccgggcgcccgggcctggtggccggcatggcgagcctgctggacggcggcggcggcggcggcggtgggggcgccgggggcgcgggcggcgcgggcagcgcgggcggcggcgcggacttccgcggggaactggcgggcccgctgcacccggcaatgggcatggcctgcgaggcgccgggcctgggcggcacctacacgacgctcacgcccctgcagcacctgccgccgctcgcggccgtggccgacaagttccaccagcacgcggcggccgcggccgtggccggggcgcacggcggccatccccacgcgcacccgcacccggcggccgcgccgcccccgccacccccgccgcagcgtctggcggccagcgtgagcggcagcttcaccctca

SEQ ID NO: 57726 - DNA, 485 bp, Homo sapiens
  misc_feature 1..485: note = chr19:1754254-1754739
  misc_feature 1..485: note = hyper
  source 1..485: mol_type = genomic DNA
gctgtcgccgctgcccaacgcgctgccgcccgcgctgcacggcgccccgcagcccccgccgccgccaccacccccgccgctggccgcctacggcccgccaggccacctggctggggacaagctgctgccgcccgccgccttcgagccgcacgccgcgctgctgggacgcgcggaggacgcactggcccgcgggctgcccggaggcggcggcggcacaggcagcggcggagcgggcagcgggagcgccgcggggctgctggcgccgctgggcgggctggcggcggccggggcgcacgggccgcacgggggaggcggcggccccggcgggagcggcggcggccccagcgcgggcgcagcggccgaggagatcaacaccaaggaggtggcgcagcgcatcacggcggagctgaagcgctacagcatcccgcaggcaatcttcgcgcagcggatcctgtgtcgctctcagggcacgctctccgacctgc

SEQ ID NO: 57727 - DNA, 78 bp, Homo sapiens
  misc_feature 1..78: note = chr19:1754804-1754882
  misc_feature 1..78: note = hyper
  source 1..78: mol_type = genomic DNA
tggctgcaggagccagagttccagcgcatgtcggcgctgcgcttggcaggtaggagcgtggcgcgcagggccagaccc

SEQ ID NO: 57728 - DNA, 111 bp, Homo sapiens
  misc_feature 1..111: note = chr19:1757305-1757416
  misc_feature 1..111: note = hyper
  source 1..111: mol_type = genomic DNA
tggggaaacaggctccgtttgtgcctcgccttcctgacttgtgacaatgacaaacagtctcagctctgggagtctgggtttcctgtcgaggaagggagagttagaacagtc

SEQ ID NO: 57729 - DNA, 447 bp, Homo sapiens
  misc_feature 1..447: note = chr19:1757615-1758062
  misc_feature 1..447: note = hyper
  source 1..447: mol_type = genomic DNA
cctgtcgcgtctcaggtgccctgggggccgcgtctacaccaccggactccgcctggggcgtaagaggtggcgggggcgagggccgcggggtcactaggctccggcccaggcctttagttccggtcgctgcgcaaatgaaaagcggttaagtggcggcaaatcgcggcggttagggggagacggccggatgcgtccccatctccacctaacacggcgacgccccaacgctggtgctcggaaagggaactctgcccccgccccgcccccgcaccatttcaaccccgcagcagaggactcgccgccctttctactccggcatccccattccccgctccgcgagcaccgcgggcctccccaggcctcctccaaggagaactttgcgccccgggtctcccgtcgcgcttgcccggctcggggcgggccacgcgtttccgcaggtgccgagtg

SEQ ID NO: 57730 - DNA, 33 bp, Homo sapiens; identical to SEQ ID NO: 37112
  misc_feature 1..33: note = chr19:1758771-1758804
  misc_feature 1..33: note = hyper
  source 1..33: mol_type = genomic DNA

SEQ ID NO: 57731 - DNA, 302 bp, Homo sapiens
  misc_feature 1..302: note = chr19:1762172-1762474
  misc_feature 1..302: note = hyper
  source 1..302: mol_type = genomic DNA
ccatctggagaccctcgtgctggctgctgggggtcctgcgtgccttccgcgcgcccccagctgcgcccgccagccctccaaccctcctgccctcctgccctcctgccctcctctctgggagtcgggacagaagctgctgggctctcctccctggagctggggctttgggaaggtcgagtagaccctcagtgagtgggatgcgcgagttggggacgctagttgcggggcagcaggggtccacgcatttccaagcgccctttcccgtccaaggacctgctggggggatgactgtgcctcagttt

SEQ ID NO: 57732 - DNA, 169 bp, Homo sapiens; identical to SEQ ID NO: 13138
  misc_feature 1..169: note = chr19:1762627-1762796
  misc_feature 1..169: note = hyper
  source 1..169: mol_type = genomic DNA

SEQ ID NO: 57733 - DNA, 24 bp, Homo sapiens
  misc_feature 1..24: note = chr19:1764269-1764293
  misc_feature 1..24: note = hyper
  source 1..24: mol_type = genomic DNA
gcccccaccccatggcggcccagc

SEQ ID NO: 57734 - DNA, 300 bp, Homo sapiens; identical to SEQ ID NO: 37116
  misc_feature 1..300: note = chr19:1765665-1765965
  misc_feature 1..300: note = hyper
  source 1..300: mol_type = genomic DNA

SEQ ID NO: 57735 - DNA, 30 bp, Homo sapiens; identical to SEQ ID NO: 37117
  misc_feature 1..30: note = chr19:1768342-1768372
  misc_feature 1..30: note = hyper
  source 1..30: mol_type = genomic DNA

SEQ ID NO: 57736 - DNA, 230 bp, Homo sapiens; identical to SEQ ID NO: 37118
  misc_feature 1..230: note = chr19:1769737-1769967
  misc_feature 1..230: note = hyper
  source 1..230: mol_type = genomic DNA

SEQ ID NO: 57737 - DNA, 41 bp, Homo sapiens; identical to SEQ ID NO: 37119
  misc_feature 1..41: note = chr19:1775395-1775436
  misc_feature 1..41: note = hyper
  source 1..41: mol_type = genomic DNA

SEQ ID NO: 57738 - DNA, 117 bp, Homo sapiens; identical to SEQ ID NO: 22842
  misc_feature 1..117: note = chr19:1776259-1776376
  misc_feature 1..117: note = hyper
  source 1..117: mol_type = genomic DNA

SEQ ID NO: 57739 - DNA, 169 bp, Homo sapiens
  misc_feature 1..169: note = chr19:1776534-1776703
  misc_feature 1..169: note = hyper
  source 1..169: mol_type = genomic DNA
acgccgaggaaggtggattccgcttgctccattttttgccaaaaatatttacaaatgggaagggtcggaaatgaagatgagcgcccccctcccaccccgcgctctcccccgctcctctcatctggtctgggtgacctccgagactggccggccgcgggatcccaggagc

SEQ ID NO: 57740 - DNA, 21 bp, Homo sapiens
  misc_feature 1..21: note = chr19:1776990-1777011
  misc_feature 1..21: note = hyper
  source 1..21: mol_type = genomic DNA
agtgccaccccttcccgaacc

SEQ ID NO: 57741 - DNA, 391 bp, Homo sapiens; identical to SEQ ID NO: 37122
  misc_feature 1..391: note = chr19:1856988-1857379
  misc_feature 1..391: note = hyper
  source 1..391: mol_type = genomic DNA

SEQ ID NO: 57742 - DNA, 17 bp, Homo sapiens
  misc_feature 1..17: note = chr19:2251135-2251152
  misc_feature 1..17: note = hyper
  source 1..17: mol_type = genomic DNA
accccttcctggagacg

SEQ ID NO: 57743 - DNA, 81 bp, Homo sapiens
  misc_feature 1..81: note = chr19:2251715-2251796
  misc_feature 1..81: note = hyper
  source 1..81: mol_type = genomic DNA
gacctaccaggccaacaattgccagggcgtgtgcggctggcctcagtccgaccgcaacccgcgctacggcaaccacgtggt

SEQ ID NO: 57744 - DNA, 326 bp, Homo sapiens; identical to SEQ ID NO: 22844
  misc_feature 1..326: note = chr19:2252658-2252984
  misc_feature 1..326: note = hyper
  source 1..326: mol_type = genomic DNA

SEQ ID NO: 57745 - DNA, 416 bp, Homo sapiens
  misc_feature 1..416: note = chr19:2289837-2290253
  misc_feature 1..416: note = hyper
  source 1..416: mol_type = genomic DNA
tgaaaaacagtcctgcggttgggcgtctacaaaaaaaggggaagttctgcctggggagcgccgtgcagccgtccccttcccctccgggaaatgcataggtggacacgcgagcggccggcccgcgggggaggggaggggagggtccgccctggggacccctcagatcatcttcatgttgaacttgcgcgcgcctccctggcccgccgcggcggccggcccatccaccttgcggaaggagtactccaccgagaagttgtttttgtgctgcccgcggccgcggctccacacgaacagcagcacgaagcagaagaggaccacgcccaggaaggtgatgcagcccatggcggtggacaccaggatggtggtgaggtcgagcggcgcgcgcagggccgccagcgtctcgttgtgggcctcgc

SEQ ID NO: 57746 - DNA, 234 bp, Homo sapiens
  misc_feature 1..234: note = chr19:2302559-2302793
  misc_feature 1..234: note = hyper
  source 1..234: mol_type = genomic DNA
ccccagcaaggggcacgtcccaccaggcccggactgcccgtctgcccctgcagggcccctcgctctggtggcgggctcggtgagctctgctgcccggtctcgggagtctgggggagcgcggcgtcgacccctgtggagggaggactcgtgtttcaaggacagagcctcattaccatgcacgaccagccgcagctgaggccgcagaggcctttggcaggggggccgggccggcgg

SEQ ID NO: 57747 - DNA, 33 bp, Homo sapiens; identical to SEQ ID NO: 37130
  misc_feature 1..33: note = chr19:2308140-2308173
  misc_feature 1..33: note = hyper
  source 1..33: mol_type = genomic DNA

SEQ ID NO: 57748 - DNA, 106 bp, Homo sapiens; identical to SEQ ID NO: 37131
  misc_feature 1..106: note = chr19:2478809-2478915
  misc_feature 1..106: note = hyper
  source 1..106: mol_type = genomic DNA

SEQ ID NO: 57749 - DNA, 30 bp, Homo sapiens; identical to SEQ ID NO: 37132
  misc_feature 1..30: note = chr19:2703070-2703100
  misc_feature 1..30: note = hyper
  source 1..30: mol_type = genomic DNA

SEQ ID NO: 57750 - DNA, 30 bp, Homo sapiens; identical to SEQ ID NO: 37133
  misc_feature 1..30: note = chr19:3244155-3244185
  misc_feature 1..30: note = hyper
  source 1..30: mol_type = genomic DNA

SEQ ID NO: 57751 - DNA, 30 bp, Homo sapiens; identical to SEQ ID NO: 37134
  misc_feature 1..30: note = chr19:3270512-3270542
  misc_feature 1..30: note = hyper
  source 1..30: mol_type = genomic DNA

SEQ ID NO: 57752 - skipped

SEQ ID NO: 57753 - DNA, 15 bp, Homo sapiens
  misc_feature 1..15: note = chr19:3585992-3586007
  misc_feature 1..15: note = hyper
  source 1..15: mol_type = genomic DNA
ggggccccctttgca

SEQ ID NO: 57754 - DNA, 53 bp, Homo sapiens
  misc_feature 1..53: note = chr19:3785596-3785649
  misc_feature 1..53: note = hyper
  source 1..53: mol_type = genomic DNA
ccacgtgtactcacacgcatacggatgcatgcacacgcacagaaacacacagg

SEQ ID NO: 57755 - DNA, 103 bp, Homo sapiens; identical to SEQ ID NO: 37139
  misc_feature 1..103: note = chr19:3786583-3786686
  misc_feature 1..103: note = hyper
  source 1..103: mol_type = genomic DNA

SEQ ID NO: 57756 - DNA, 139 bp, Homo sapiens; identical to SEQ ID NO: 37140
  misc_feature 1..139: note = chr19:3821971-3822110
  misc_feature 1..139: note = hyper
  source 1..139: mol_type = genomic DNA

SEQ ID NO: 57757 - DNA, 88 bp, Homo sapiens
  misc_feature 1..88: note = chr19:3822203-3822291
  misc_feature 1..88: note = hyper
  source 1..88: mol_type = genomic DNA
acacagaacagccgcacgcgcaccaggcacgaggcggggtgggatgtgagatgctaccgctgccaggtcgcggcggagccttcctcct

SEQ ID NO: 57758 - DNA, 210 bp, Homo sapiens; identical to SEQ ID NO: 37142
  misc_feature 1..210: note = chr19:3868851-3869061
  misc_feature 1..210: note = hyper
  source 1..210: mol_type = genomic DNA

SEQ ID NO: 57759 - DNA, 85 bp, Homo sapiens; identical to SEQ ID NO: 37143
  misc_feature 1..85: note = chr19:3869118-3869203
  misc_feature 1..85: note = hyper
  source 1..85: mol_type = genomic DNA

SEQ ID NO: 57760 - DNA, 304 bp, Homo sapiens; identical to SEQ ID NO: 37144
  misc_feature 1..304: note = chr19:3880484-3880788
  misc_feature 1..304: note = hyper
  source 1..304: mol_type = genomic DNA

SEQ ID NO: 57761 - DNA, 59 bp, Homo sapiens; identical to SEQ ID NO: 37145
  misc_feature 1..59: note = chr19:3881573-3881632
  misc_feature 1..59: note = hyper
  source 1..59: mol_type = genomic DNA

SEQ ID NO: 57762 - DNA, 106 bp, Homo sapiens; identical to SEQ ID NO: 37146
  misc_feature 1..106: note = chr19:3933108-3933214
  misc_feature 1..106: note = hyper
  source 1..106: mol_type = genomic DNA

SEQ ID NO: 57763 - DNA, 257 bp, Homo sapiens; identical to SEQ ID NO: 37147
  misc_feature 1..257: note = chr19:3933461-3933718
  misc_feature 1..257: note = hyper
  source 1..257: mol_type = genomic DNA

SEQ ID NO: 57764 - DNA, 81 bp, Homo sapiens; identical to SEQ ID NO: 37148
  misc_feature 1..81: note = chr19:4077899-4077980
  misc_feature 1..81: note = hyper
  source 1..81: mol_type = genomic DNA

SEQ ID NO: 57765 - DNA, 197 bp, Homo sapiens; identical to SEQ ID NO: 37149
  misc_feature 1..197: note = chr19:4198002-4198199
  misc_feature 1..197: note = hyper
  source 1..197: mol_type = genomic DNA

SEQ ID NO: 57766 - DNA, 92 bp, Homo sapiens; identical to SEQ ID NO: 37150
  misc_feature 1..92: note = chr19:4279567-4279659
  misc_feature 1..92: note = hyper
  source 1..92: mol_type = genomic DNA

SEQ ID NO: 57767 - DNA, 70 bp, Homo sapiens; identical to SEQ ID NO: 13159
  misc_feature 1..70: note = chr19:4304487-4304557
  misc_feature 1..70: note = hyper
  source 1..70: mol_type = genomic DNA

SEQ ID NO: 57768 - DNA, 35 bp, Homo sapiens; identical to SEQ ID NO: 37152
  misc_feature 1..35: note = chr19:4380549-4380584
  misc_feature 1..35: note = hyper
  source 1..35: mol_type = genomic DNA

SEQ ID NO: 57769 - DNA, 32 bp, Homo sapiens; identical to SEQ ID NO: 37153
  misc_feature 1..32: note = chr19:4597471-4597503
  misc_feature 1..32: note = hyper
  source 1..32: mol_type = genomic DNA

SEQ ID NO: 57770 - DNA, 182 bp, Homo sapiens
  misc_feature 1..182: note = chr19:5292630-5292812
  misc_feature 1..182: note = hyper
  source 1..182: mol_type = genomic DNA
tggggtccacaggcccgagaggagcggaaacaaatggatggaggtaaacttcctgcgattttcgggggtggctaagagcagggattcctgccatgcaccccccaccgctacctgccccctctgcggtcctgttgcctcctccgccttctgcgaagtccccagtcacagctcccccgggctgg

SEQ ID NO: 57771 - DNA, 71 bp, Homo sapiens; identical to SEQ ID NO: 13161
  misc_feature 1..71: note = chr19:5293067-5293138
  misc_feature 1..71: note = hyper
  source 1..71: mol_type = genomic DNA

SEQ ID NO: 57772 - DNA, 27 bp, Homo sapiens
  misc_feature 1..27: note = chr19:5293155-5293182
  misc_feature 1..27: note = hyper
  source 1..27: mol_type = genomic DNA
cggctcggagatcgggcccaggccccg

SEQ ID NO: 57773 - DNA, 175 bp, Homo sapiens; identical to SEQ ID NO: 37157
  misc_feature 1..175: note = chr19:5293462-5293637
  misc_feature 1..175: note = hyper
  source 1..175: mol_type = genomic DNA

SEQ ID NO: 57774 - DNA, 122 bp, Homo sapiens; identical to SEQ ID NO: 37158
  misc_feature 1..122: note = chr19:5294020-5294142
  misc_feature 1..122: note = hyper
  source 1..122: mol_type = genomic DNA

SEQ ID NO: 57775 - DNA, 30 bp, Homo sapiens; identical to SEQ ID NO: 13164
  misc_feature 1..30: note = chr19:5338746-5338776
  misc_feature 1..30: note = hyper
  source 1..30: mol_type = genomic DNA

SEQ ID NO: 57776 - DNA, 30 bp, Homo sapiens; identical to SEQ ID NO: 37161
  misc_feature 1..30: note = chr19:5339394-5339424
  misc_feature 1..30: note = hyper
  source 1..30: mol_type = genomic DNA

SEQ ID NO: 57777 - DNA, 352 bp, Homo sapiens; identical to SEQ ID NO: 37162
  misc_feature 1..352: note = chr19:5340451-5340803
  misc_feature 1..352: note = hyper
  source 1..352: mol_type = genomic DNA

SEQ ID NO: 57778 - DNA, 38 bp, Homo sapiens; identical to SEQ ID NO: 37163
  misc_feature 1..38: note = chr19:5436741-5436779
  misc_feature 1..38: note = hyper
  source 1..38: mol_type = genomic DNA

SEQ ID NO: 57779 - DNA, 214 bp, Homo sapiens; identical to SEQ ID NO: 13167
  misc_feature 1..214: note = chr19:5437029-5437243
  misc_feature 1..214: note = hyper
  source 1..214: mol_type = genomic DNA

SEQ ID NO: 57780 - DNA, 63 bp, Homo sapiens; identical to SEQ ID NO: 37165
  misc_feature 1..63: note = chr19:5567596-5567659
  misc_feature 1..63: note = hyper
  source 1..63: mol_type = genomic DNA

SEQ ID NO: 57781 - DNA, 432 bp, Homo sapiens; identical to SEQ ID NO: 37166
  misc_feature 1..432: note = chr19:5827883-5828315
  misc_feature 1..432: note = hyper
  source 1..432: mol_type = genomic DNA

SEQ ID NO: 57782 - DNA, 30 bp, Homo sapiens; identical to SEQ ID NO: 37167
  misc_feature 1..30: note = chr19:5962276-5962306
  misc_feature 1..30: note = hyper
  source 1..30: mol_type = genomic DNA

SEQ ID NO: 57783 - DNA, 56 bp, Homo sapiens; identical to SEQ ID NO: 37168
  misc_feature 1..56: note = chr19:6393996-6394052
  misc_feature 1..56: note = hyper
  source 1..56: mol_type = genomic DNA

SEQ ID NO: 57784 - DNA, 44 bp, Homo sapiens; identical to SEQ ID NO: 37169
  misc_feature 1..44: note = chr19:6501870-6501914
  misc_feature 1..44: note = hyper
  source 1..44: mol_type = genomic DNA

SEQ ID NO: 57785 - DNA, 53 bp, Homo sapiens; identical to SEQ ID NO: 37170
  misc_feature 1..53: note = chr19:6502724-6502777
  misc_feature 1..53: note = hyper
  source 1..53: mol_type = genomic DNA

SEQ ID NO: 57786 - DNA, 45 bp, Homo sapiens; identical to SEQ ID NO: 37171
  misc_feature 1..45: note = chr19:6531154-6531199
  misc_feature 1..45: note = hyper
  source 1..45: mol_type = genomic DNA

SEQ ID NO: 57787 - DNA, 345 bp, Homo sapiens
  misc_feature 1..345: note = chr19:6590478-6590823
  misc_feature 1..345: note = hyper
  source 1..345: mol_type = genomic DNA
cccctcccccacccggagcgagtggctggggccatcccgtcctaggaggccccaggaagcccccacgcccagccttgtgaagcccccagcagcctctgagtcagcctgccgggggaacaccagagccgagtcatcttccatttccatgtgtgcctacctttcccatcccgggatctccctgtacctcctggcagggctgcctgtctcgtagcccctacaccgggcagcctggtccccgcctcgcctccctgttctggtctctgtctctgccctaccagatcttcctctctggcctctttgtacccatctcattctgtcttttcggtcacgcgcctctctatgttt

SEQ ID NO: 57788 - DNA, 123 bp, Homo sapiens; identical to SEQ ID NO: 37173
  misc_feature 1..123: note = chr19:7197100-7197223
  misc_feature 1..123: note = hyper
  source 1..123: mol_type = genomic DNA

SEQ ID NO: 57789 - DNA, 270 bp, Homo sapiens; identical to SEQ ID NO: 37174
  misc_feature 1..270: note = chr19:7565964-7566234
  misc_feature 1..270: note = hyper
  source 1..270: mol_type = genomic DNA

SEQ ID NO: 57790 - DNA, 103 bp, Homo sapiens; identical to SEQ ID NO: 22868
  misc_feature 1..103: note = chr19:7794909-7795012
  misc_feature 1..103: note = hyper
  source 1..103: mol_type = genomic DNA

SEQ ID NO: 57791 - DNA, 152 bp, Homo sapiens; identical to SEQ ID NO: 37176
  misc_feature 1..152: note = chr19:7795540-7795692
  misc_feature 1..152: note = hyper
  source 1..152: mol_type = genomic DNA

SEQ ID NO: 57792 - DNA, 50 bp, Homo sapiens; identical to SEQ ID NO: 37177
  misc_feature 1..50: note = chr19:7795734-7795784
  misc_feature 1..50: note = hyper
  source 1..50: mol_type = genomic DNA

SEQ ID NO: 57793 - DNA, 43 bp, Homo sapiens
  misc_feature 1..43: note = chr19:7852985-7853028
  misc_feature 1..43: note = hyper
  source 1..43: mol_type = genomic DNA
tgtacatctttgggccgtttgcagtcacgcgtgtgcacatggc

SEQ ID NO: 57794 - DNA, 204 bp, Homo sapiens
  misc_feature 1..204: note = chr19:7853157-7853361
  misc_feature 1..204: note = hyper
  source 1..204: mol_type = genomic DNA
agggaaggatttccgagtccctggccttgcctgcaggagcctctctccgcagcctccacggagcgcgcggcgctgctcggctgccaggacctgctgaggacaaacggtgtgtgcagagccgggcgcctgggcgcccggggcgtgtgcggcgggagcgtctgagaccccagagatggagtcctgggtgcgtgggggccctgtggt

SEQ ID NO: 57795 - DNA, 11 bp, Homo sapiens
  misc_feature 1..11: note = chr19:7853460-7853471
  misc_feature 1..11: note = hyper
  source 1..11: mol_type = genomic DNA
gcagacggcgg

SEQ ID NO: 57796 - DNA, 60 bp, Homo sapiens; identical to SEQ ID NO: 13177
  misc_feature 1..60: note = chr19:7853543-7853603
  misc_feature 1..60: note = hyper
  source 1..60: mol_type = genomic DNA

SEQ ID NO: 57797 - DNA, 110 bp, Homo sapiens; identical to SEQ ID NO: 37180
  misc_feature 1..110: note = chr19:7853873-7853983
  misc_feature 1..110: note = hyper
  source 1..110: mol_type = genomic DNA

SEQ ID NO: 57798 - DNA, 30 bp, Homo sapiens; identical to SEQ ID NO: 37181
  misc_feature 1..30: note = chr19:7926920-7926950
  misc_feature 1..30: note = hyper
  source 1..30: mol_type = genomic DNA

SEQ ID NO: 57799 - DNA, 95 bp, Homo sapiens; identical to SEQ ID NO: 37182
  misc_feature 1..95: note = chr19:7927441-7927536
  misc_feature 1..95: note = hyper
  source 1..95: mol_type = genomic DNA

SEQ ID NO: 57800 - DNA, 261 bp, Homo sapiens
  misc_feature 1..261: note = chr19:8115276-8115537
  misc_feature 1..261: note = hyper
  source 1..261: mol_type = genomic DNA
gaaggtagggggcagtgagccgtagcggagaggctggccccagcccgccacgccgcttccccacgctcgcagccacgcggagccgcgtcctggtccagcctcacccacccagagcaagaggcggaggaactggaacagcgccccggcccgtgggctgccactggccgcagcaacgggacgggtgagagcacctgcccccgacgcgtcttaactgctctggtggggcggggctgaccgtgcaagccccgccccagtctaagc

SEQ ID NO: 57801 - DNA, 96 bp, Homo sapiens; identical to SEQ ID NO: 37184
  misc_feature 1..96: note = chr19:8428705-8428801
  misc_feature 1..96: note = hyper
  source 1..96: mol_type = genomic DNA

SEQ ID NO: 57802 - DNA, 126 bp, Homo sapiens; identical to SEQ ID NO: 37185
  misc_feature 1..126: note = chr19:8429231-8429357
  misc_feature 1..126: note = hyper
  source 1..126: mol_type = genomic DNA

SEQ ID NO: 57803 - DNA, 145 bp, Homo sapiens; identical to SEQ ID NO: 37186
  misc_feature 1..145: note = chr19:9434811-9434956
  misc_feature 1..145: note = hyper
  source 1..145: mol_type = genomic DNA

SEQ ID NO: 57804 - DNA, 20 bp, Homo sapiens
  misc_feature 1..20: note = chr19:9517771-9517791
  misc_feature 1..20: note = hyper
  source 1..20: mol_type = genomic DNA
gtttccaggcatgagggcaa

SEQ ID NO: 57805 - DNA, 106 bp, Homo sapiens; identical to SEQ ID NO: 37189
  misc_feature 1..106: note = chr19:9517879-9517985
  misc_feature 1..106: note = hyper
  source 1..106: mol_type = genomic DNA

SEQ ID NO: 57806 - DNA, 17 bp, Homo sapiens
  misc_feature 1..17: note = chr19:9609036-9609053
  misc_feature 1..17: note = hyper
  source 1..17: mol_type = genomic DNA
accgaaggtcccaatgg

SEQ ID NO: 57807 - DNA, 290 bp, Homo sapiens
  misc_feature 1..290: note = chr19:9903623-9903913
  misc_feature 1..290: note = hyper
  source 1..290: mol_type = genomic DNA
tggtgcaggggaaaccgttggttcagctgcggttcctgggaagggggtgccgctctgatcacgcgcacttctgattcccctctcggggctcggaagcggctgagggctctggacccggtctccgaggcgtgaggcggtgggagggtcggcggccgcgtcctccacgaccctggggagaagtcccagtttccgcgcagccgacaacggttggaccccgtccctccggcttcactgggcaccgtgggggcagaacccggcggcggcttggggtgggggcgggaccacgatgg

SEQ ID NO: 57808 - DNA, 191 bp, Homo sapiens; identical to SEQ ID NO: 37193
  misc_feature 1..191: note = chr19:10024331-10024522
  misc_feature 1..191: note = hyper
  source 1..191: mol_type = genomic DNA

SEQ ID NO: 57809 - DNA, 55 bp, Homo sapiens; identical to SEQ ID NO: 37194
  misc_feature 1..55: note = chr19:10121131-10121186
  misc_feature 1..55: note = hyper
  source 1..55: mol_type = genomic DNA

SEQ ID NO: 57810 - DNA, 64 bp, Homo sapiens; identical to SEQ ID NO: 37195
  misc_feature 1..64: note = chr19:10197697-10197761
  misc_feature 1..64: note = hyper
  source 1..64: mol_type = genomic DNA

SEQ ID NO: 57811 - DNA, 118 bp, Homo sapiens; identical to SEQ ID NO: 37196
  misc_feature 1..118: note = chr19:10347133-10347251
  misc_feature 1..118: note = hyper
  source 1..118: mol_type = genomic DNA

SEQ ID NO: 57812 - DNA, 30 bp, Homo sapiens; identical to SEQ ID NO: 37197
  misc_feature 1..30: note = chr19:10397660-10397690
  misc_feature 1..30: note = hyper
  source 1..30: mol_type = genomic DNA

SEQ ID NO: 57813 - DNA, 135 bp, Homo sapiens
  misc_feature 1..135: note = chr19:10398074-10398209
  misc_feature 1..135: note = hyper
  source 1..135: mol_type = genomic DNA
cgcctacagtgagggacaggggctcggtcccggctggggtgaggggagggggctggaagaggtgggggaagggtagttgacagtcgctctatagggagcgcccgcggacctcactcagaggctcccccttgcctt

SEQ ID NO: 57814 - DNA, 181 bp, Homo sapiens
  misc_feature 1..181: note = chr19:10398285-10398466
  misc_feature 1..181: note = hyper
  source 1..181: mol_type = genomic DNA
caggtgttcccggtgggctacttggtggtgaccctgaggcatggaagccgggtcatctattccgaaagcctggagcgcttcaccggcctggatctggccaacgtgaccttgacctacgagtttgctgctggaccccgcgacttctggcagcccgtgatctgccacgcgcgcctcaatctcg

SEQ ID NO: 57815 - DNA, 313 bp, Homo sapiens; identical to SEQ ID NO: 37199
  misc_feature 1..313: note = chr19:10400448-10400761
  misc_feature 1..313: note = hyper
  source 1..313: mol_type = genomic DNA

SEQ ID NO: 57816 - DNA, 173 bp, Homo sapiens; identical to SEQ ID NO: 37200
  misc_feature 1..173: note = chr19:10400989-10401162
  misc_feature 1..173: note = hyper
  source 1..173: mol_type = genomic DNA

SEQ ID NO: 57817 - DNA, 30 bp, Homo sapiens; identical to SEQ ID NO: 37201
  misc_feature 1..30: note = chr19:10402001-10402031
  misc_feature 1..30: note = hyper
  source 1..30: mol_type = genomic DNA

SEQ ID NO: 57818 - DNA, 81 bp, Homo sapiens; identical to SEQ ID NO: 37202
  misc_feature 1..81: note = chr19:10402409-10402490
  misc_feature 1..81: note = hyper
  source 1..81: mol_type = genomic DNA

SEQ ID NO: 57819 - DNA, 62 bp, Homo sapiens; identical to SEQ ID NO: 22881
  misc_feature 1..62: note = chr19:10406349-10406411
  misc_feature 1..62: note = hyper
  source 1..62: mol_type = genomic DNA

SEQ ID NO: 57820 - DNA, 82 bp, Homo sapiens; identical to SEQ ID NO: 37207
  misc_feature 1..82: note = chr19:10530397-10530479
  misc_feature 1..82: note = hyper
  source 1..82: mol_type = genomic DNA

SEQ ID NO: 57821 - DNA, 452 bp, Homo sapiens
  misc_feature 1..452: note = chr19:10531512-10531964
  misc_feature 1..452: note = hyper
  source 1..452: mol_type = genomic DNA
accctgaagcctcccccgcagcacctgtggcggcagcctcggacccccatccgtatccagcagcgcggctactccgacagcgcggagcgcgccgagcgggagcggcagccgcaccggcccatagagcgcgccgatgccatggacaccagcgaccggcccggcctgcgcacgacccgcatgtcctggccctcgtccttccatggcactggcaccggcagcggcggcgcgggcggaggcagcagcaggcggtaagactccccgcggcggatgcgcgcggaacggatgggcgcgcagggaggaggcaactcgagctgccggccgcagggggcgctaggatgcgggtggggtcggtttggctggcgggggcggagggaattcggctgcgggggcgtctgggacctggcccctggttgtgcgctctacgggaggcttcctgctgaagcccatcctgg

SEQ ID NO: 57822 - DNA, 203 bp, Homo sapiens; identical to SEQ ID NO: 13192
  misc_feature 1..203: note = chr19:10616329-10616532
  misc_feature 1..203: note = hyper
  source 1..203: mol_type = genomic DNA

SEQ ID NO: 57823 - DNA, 12 bp, Homo sapiens
  misc_feature 1..12: note = chr19:10624739-10624751
  misc_feature 1..12: note = hyper
  source 1..12: mol_type = genomic DNA
cgcgtggcgcag

SEQ ID NO: 57824 - DNA, 202 bp, Homo sapiens
  misc_feature 1..202: note = chr19:10625465-10625667
  misc_feature 1..202: note = hyper
  source 1..202: mol_type = genomic DNA
gagcaggaacatgggagcgtggaagcgcgggtggcgtccgagcaccaacaacacggctagattctctagcacgatgaaggcgcacaccgccaggcacaccacggcgtcggcgcgcaggccggcacccggctggtagcgcgcaccgcggagcttgccggtgtagttgtaatgcaggacgatgacctcgctcaccggcgccggc

SEQ ID NO: 57825 - DNA, 45 bp, Homo sapiens; identical to SEQ ID NO: 37212
  misc_feature 1..45: note = chr19:10625744-10625789
  misc_feature 1..45: note = hyper
  source 1..45: mol_type = genomic DNA

SEQ ID NO: 57826 - DNA, 19 bp, Homo sapiens
  misc_feature 1..19: note = chr19:10628995-10629014
  misc_feature 1..19: note = hyper
  source 1..19: mol_type = genomic DNA
tccgcggctcaagccatcc

SEQ ID NO: 57827 - DNA, 190 bp, Homo sapiens; identical to SEQ ID NO: 37214
  misc_feature 1..190: note = chr19:10629393-10629583
  misc_feature 1..190: note = hyper
  source 1..190: mol_type = genomic DNA

SEQ ID NO: 57828 - DNA, 118 bp, Homo sapiens; identical to SEQ ID NO: 37215
  misc_feature 1..118: note = chr19:10691879-10691997
  misc_feature 1..118: note = hyper
  source 1..118: mol_type = genomic DNA

SEQ ID NO: 57829 - DNA, 30 bp, Homo sapiens; identical to SEQ ID NO: 37216
  misc_feature 1..30: note = chr19:10806164-10806194
  misc_feature 1..30: note = hyper
  source 1..30: mol_type = genomic DNA

SEQ ID NO: 57830 - DNA, 544 bp, Homo sapiens; identical to SEQ ID NO: 37217
  misc_feature 1..544: note = chr19:11529608-11530152
  misc_feature 1..544: note = hyper
  source 1..544: mol_type = genomic DNA

SEQ ID NO: 57831 - DNA, 275 bp, Homo sapiens; identical to SEQ ID NO: 37218
  misc_feature 1..275: note = chr19:11531328-11531603
  misc_feature 1..275: note = hyper
  source 1..275: mol_type = genomic DNA

SEQ ID NO: 57832 - DNA, 17 bp, Homo sapiens
  misc_feature 1..17: note = chr19:11532425-11532442
  misc_feature 1..17: note = hyper
  source 1..17: mol_type = genomic DNA
cacgaggcccagcaggt

SEQ ID NO: 57833 - DNA, 35 bp, Homo sapiens; identical to SEQ ID NO: 37220
  misc_feature 1..35: note = chr19:11533057-11533092
  misc_feature 1..35: note = hyper
  source 1..35: mol_type = genomic DNA

SEQ ID NO: 57834 - DNA, 30 bp, Homo sapiens; identical to SEQ ID NO: 37221
  misc_feature 1..30: note = chr19:11533564-11533594
  misc_feature 1..30: note = hyper
  source 1..30: mol_type = genomic DNA

SEQ ID NO: 57835 - DNA, 78 bp, Homo sapiens
  misc_feature 1..78: note = chr19:11590953-11591031
  misc_feature 1..78: note = hyper
  source 1..78: mol_type = genomic DNA
ggccgaggcccggggcgcgcgatccgacgccacccgctttcccagggctctcggggacgctttgtcgctttggcttgg

SEQ ID NO: 57836 - skipped

SEQ ID NO: 57837 - DNA, 51 bp, Homo sapiens; identical to SEQ ID NO: 37223
  misc_feature 1..51: note = chr19:11591537-11591588
  misc_feature 1..51: note = hyper
  source 1..51: mol_type = genomic DNA

SEQ ID NO: 57838 - DNA, 30 bp, Homo sapiens; identical to SEQ ID NO: 37224
  misc_feature 1..30: note = chr19:11591796-11591826
  misc_feature 1..30: note = hyper
  source 1..30: mol_type = genomic DNA

SEQ ID NO: 57839 - DNA, 39 bp, Homo sapiens
  misc_feature 1..39: note = chr19:11592671-11592710
  misc_feature 1..39: note = hyper
  source 1..39: mol_type = genomic DNA
aggcgttgggggtggcgcagcctcctttggtgcgcgggc

SEQ ID NO: 57840 - DNA, 272 bp, Homo sapiens; identical to SEQ ID NO: 22889
  misc_feature 1..272: note = chr19:11592750-11593022
  misc_feature 1..272: note = hyper
  source 1..272: mol_type = genomic DNA

SEQ ID NO: 57841 - DNA, 226 bp, Homo sapiens
  misc_feature 1..226: note = chr19:11593159-11593385
  misc_feature 1..226: note = hyper
  source 1..226: mol_type = genomic DNA
gcgatggtctgttccccaccccgtgttcctcccggtttccgtcatcggaaactgagctaggaggggggctgctcctgggcgcgcggaccccgctgcggttcccatggaaacctgccggctccggcagtgcggggagagtggaggggacctgcctcgcggggggagggagctcgcgggggcggccccagcggccggactcgctcatccttgccgattcttctgtccc

SEQ ID NO: 57842 - DNA, 136 bp, Homo sapiens; identical to SEQ ID NO: 37226
  misc_feature 1..136: note = chr19:11650677-11650813
  misc_feature 1..136: note = hyper
  source 1..136: mol_type = genomic DNA

SEQ ID NO: 57843 - DNA, 139 bp, Homo sapiens
  misc_feature 1..139: note = chr19:11689321-11689460
  misc_feature 1..139: note = hyper
  source 1..139: mol_type = genomic DNA
tctgcaggccctccacgggaccgcagcctgggagggcaggaggccctgcacctgcggccggtctgacctgctcctcacctccctgcctgcctcctccgtgctgggcgccgccgcgacacgtcccgcggacattcaggag

SEQ ID NO: 57844 - DNA, 171 bp, Homo sapiens; identical to SEQ ID NO: 37228
  misc_feature 1..171: note = chr19:11805426-11805597
  misc_feature 1..171: note = hyper
  source 1..171: mol_type = genomic DNA

SEQ ID NO: 57845 - DNA, 278 bp, Homo sapiens; identical to SEQ ID NO: 37229
  misc_feature 1..278: note = chr19:11909455-11909733
  misc_feature 1..278: note = hyper
  source 1..278: mol_type = genomic DNA

SEQ ID NO: 57846 - DNA, 158 bp, Homo sapiens; identical to SEQ ID NO: 37230
  misc_feature 1..158: note = chr19:11909793-11909951
  misc_feature 1..158: note = hyper
  source 1..158: mol_type = genomic DNA

SEQ ID NO: 57847 - DNA, 333 bp, Homo sapiens; identical to SEQ ID NO: 37231
  misc_feature 1..333: note = chr19:11959427-11959760
  misc_feature 1..333: note = hyper
  source 1..333: mol_type = genomic DNA

SEQ ID NO: 57848 - DNA, 151 bp, Homo sapiens; identical to SEQ ID NO: 22896
  misc_feature 1..151: note = chr19:11959761-11959912
  misc_feature 1..151: note = hyper
  source 1..151: mol_type = genomic DNA

SEQ ID NO: 57849 - DNA, 30 bp, Homo sapiens; identical to SEQ ID NO: 37233
  misc_feature 1..30: note = chr19:11960297-11960327
  misc_feature 1..30: note = hyper
  source 1..30: mol_type = genomic DNA

SEQ ID NO: 57850 - DNA, 30 bp, Homo sapiens; identical to SEQ ID NO: 37234
  misc_feature 1..30: note = chr19:11998469-11998499
  misc_feature 1..30: note = hyper
  source 1..30: mol_type = genomic DNA

SEQ ID NO: 57851 - DNA, 342 bp, Homo sapiens; identical to SEQ ID NO: 37235
  misc_feature 1..342: note = chr19:11998761-11999103
  misc_feature 1..342: note = hyper
  source 1..342: mol_type = genomic DNA

SEQ ID NO: 57852 - DNA, 62 bp, Homo sapiens; identical to SEQ ID NO: 13209
  misc_feature 1..62: note = chr19:12075756-12075818
  misc_feature 1..62: note = hyper
  source 1..62: mol_type = genomic DNA

SEQ ID NO: 57853 - DNA, 20 bp, Homo sapiens
  misc_feature 1..20: note = chr19:12076359-12076379
  misc_feature 1..20: note = hyper
  source 1..20: mol_type = genomic DNA
tcgtgcgtgggaggagcagt

SEQ ID NO: 57854 - DNA, 392 bp, Homo sapiens; identical to SEQ ID NO: 37238
  misc_feature 1..392: note = chr19:12146632-12147024
  misc_feature 1..392: note = hyper
  source 1..392: mol_type = genomic DNA

SEQ ID NO: 57855 - DNA, 281 bp, Homo sapiens; identical to SEQ ID NO: 37239
  misc_feature 1..281: note = chr19:12163055-12163336
  misc_feature 1..281: note = hyper
  source 1..281: mol_type = genomic DNA

SEQ ID NO: 57856 - DNA, 12 bp, Homo sapiens
  misc_feature 1..12: note = chr19:12163881-12163893
  misc_feature 1..12: note = hyper
  source 1..12: mol_type = genomic DNA
tgacagcagaag

SEQ ID NO: 57857 - DNA, 89 bp, Homo sapiens
  misc_feature 1..89: note = chr19:12163923-12164012
  misc_feature 1..89: note = hyper
  source 1..89: mol_type = genomic DNA
gcgactggttctggccacactttccaaggtcagctccctccctccctcccacctttacttcgaatatttgccttcggccaaacttgctc

SEQ ID NO: 57858 - DNA, 310 bp, Homo sapiens; identical to SEQ ID NO: 22902
  misc_feature 1..310: note = chr19:12175504-12175814
  misc_feature 1..310: note = hyper
  source 1..310: mol_type = genomic DNA

SEQ ID NO: 57859 - DNA, 146 bp, Homo sapiens
  misc_feature 1..146: note = chr19:12176005-12176151
  misc_feature 1..146: note = hyper
  source 1..146: mol_type = genomic DNA
gtcatgggggcaatcccgccttgggtgtggggctcgtgcgggaggagctgcgctgtgaggccctcagtgccccctttctcctgttaaaacttaaacaggcccggtgctgggaatagaggcgtgagccaccgcgcctggcctagcgt

SEQ ID NO: 57860 - DNA, 15 bp, Homo sapiens
  misc_feature 1..15: note = chr19:12203013-12203028
  misc_feature 1..15: note = hyper
  source 1..15: mol_type = genomic DNA
tcagggctctgaagg

SEQ ID NO: 57861 - DNA, 36 bp, Homo sapiens
  misc_feature 1..36: note = chr19:12266983-12267019
  misc_feature 1..36: note = hyper
  source 1..36: mol_type = genomic DNA
ggggactggggaccccgcagcccaccgctcctccca

SEQ ID NO: 57862 - DNA, 32 bp, Homo sapiens
  misc_feature 1..32: note = chr19:12267667-12267699
  misc_feature 1..32: note = hyper
  source 1..32: mol_type = genomic DNA
acaaggcccggcagaaccgaaatgacctgttc

SEQ ID NO: 57863 - skipped

SEQ ID NO: 57864 - DNA, 234 bp, Homo sapiens; identical to SEQ ID NO: 37249
  misc_feature 1..234: note = chr19:12475809-12476043
  misc_feature 1..234: note = hyper
  source 1..234: mol_type = genomic DNA

SEQ ID NO: 57865 - DNA, 30 bp, Homo sapiens; identical to SEQ ID NO: 37250
  misc_feature 1..30: note = chr19:12476667-12476697
  misc_feature 1..30: note = hyper
  source 1..30: mol_type = genomic DNA

SEQ ID NO: 57866 - DNA, 131 bp, Homo sapiens
  misc_feature 1..131: note = chr19:12750856-12750987
  misc_feature 1..131: note = hyper
  source 1..131: mol_type = genomic DNA
cagggcaccctactccgctcacctgcgacggcagcagccagtccccacgggcggaggggacctcatgcgacattcagcccgcgagattctcagagactgctcgcccgcaacacgcagtaacgatctcagga

SEQ ID NO: 57867 - DNA, 54 bp, Homo sapiens; identical to SEQ ID NO: 22905
  misc_feature 1..54: note = chr19:12751056-12751110
  misc_feature 1..54: note = hyper
  source 1..54: mol_type = genomic DNA

SEQ ID NO: 57868 - DNA, 180 bp, Homo sapiens; identical to SEQ ID NO: 37252
  misc_feature 1..180: note = chr19:12936457-12936637
  misc_feature 1..180: note = hyper
  source 1..180: mol_type = genomic DNA

SEQ ID NO: 57869 - DNA, 101 bp, Homo sapiens; identical to SEQ ID NO: 37253
  misc_feature 1..101: note = chr19:12945480-12945581
  misc_feature 1..101: note = hyper
  source 1..101: mol_type = genomic DNA

SEQ ID NO: 57870 - DNA, 30 bp, Homo sapiens; identical to SEQ ID NO: 37254
  misc_feature 1..30: note = chr19:12949855-12949885
  misc_feature 1..30: note = hyper
  source 1..30: mol_type = genomic DNA

SEQ ID NO: 57871 - skipped

SEQ ID NO: 57872 - DNA, 98 bp, Homo sapiens; identical to SEQ ID NO: 37257
  misc_feature 1..98: note = chr19:12978444-12978542
  misc_feature 1..98: note = hyper
  source 1..98: mol_type = genomic DNA

SEQ ID NO: 57873 - DNA, 38 bp, Homo sapiens; identical to SEQ ID NO: 37258
  misc_feature 1..38: note = chr19:12996096-12996134
  misc_feature 1..38: note = hyper
  source 1..38: mol_type = genomic DNA

SEQ ID NO: 57874 - DNA, 152 bp, Homo sapiens; identical to SEQ ID NO: 37259
  misc_feature 1..152: note = chr19:12996701-12996853
  misc_feature 1..152: note = hyper
  source 1..152: mol_type = genomic DNA

SEQ ID NO: 57875 - DNA, 30 bp, Homo sapiens; identical to SEQ ID NO: 37260
  misc_feature 1..30: note = chr19:13030286-13030316
  misc_feature 1..30: note = hyper
  source 1..30: mol_type = genomic DNA

SEQ ID NO: 57876 - DNA, 88 bp, Homo sapiens; identical to SEQ ID NO: 37261
  misc_feature 1..88: note = chr19:13213616-13213704
  misc_feature 1..88: note = hyper
  source 1..88: mol_type = genomic DNA

SEQ ID NO: 57877 - DNA, 19 bp, Homo sapiens
  misc_feature 1..19: note = chr19:13616677-13616696
  misc_feature 1..19: note = hyper
  source 1..19: mol_type = genomic DNA
ctggaagaggggaggcgga

SEQ ID NO: 57878 - DNA, 209 bp, Homo sapiens; identical to SEQ ID NO: 22907
  misc_feature 1..209: note = chr19:13617256-13617465
  misc_feature 1..209: note = hyper
  source 1..209: mol_type = genomic DNA

SEQ ID NO: 57879 - DNA, 43 bp, Homo sapiens; identical to SEQ ID NO: 37264
  misc_feature 1..43: note = chr19:13617489-13617532
  misc_feature 1..43: note = hyper
  source 1..43: mol_type = genomic DNA

SEQ ID NO: 57880 - DNA, 234 bp, Homo sapiens; identical to SEQ ID NO: 37265
  misc_feature 1..234: note = chr19:13617846-13618080
  misc_feature 1..234: note = hyper
  source 1..234: mol_type = genomic DNA

SEQ ID NO: 57881 - DNA, 132 bp, Homo sapiens
  misc_feature 1..132: note = chr19:13618381-13618513
  misc_feature 1..132: note = hyper
  source 1..132: mol_type = genomic DNA
agagaggggagcgtcgcatggttgggaggcagggaggggggaattggggtgcttcctcctcccctgggaggaaagcctgttttccaccccgttccatttcggttgcagacagccggacgctccccagcatct

SEQ ID NO: 57882 - DNA, 365 bp, Homo sapiens; identical to SEQ ID NO: 37267
  misc_feature 1..365: note = chr19:14320287-14320652
  misc_feature 1..365: note = hyper
  source 1..365: mol_type = genomic DNA

SEQ ID NO: 57883 - DNA, 334 bp, Homo sapiens; identical to SEQ ID NO: 37268
  misc_feature 1..334: note = chr19:14583182-14583516
  misc_feature 1..334: note = hyper
  source 1..334: mol_type = genomic DNA

SEQ ID NO: 57884 - DNA, 107 bp, Homo sapiens; identical to SEQ ID NO: 13230
  misc_feature 1..107: note = chr19:14583613-14583720
  misc_feature 1..107: note = hyper
  source 1..107: mol_type = genomic DNA

SEQ ID NO: 57885 - DNA, 82 bp, Homo sapiens
  misc_feature 1..82: note = chr19:14584775-14584857
  misc_feature 1..82: note = hyper
  source 1..82: mol_type = genomic DNA
gaagaccatgcagccgcccaggaagtggcaggccccgccggccggagcgcgccccgcagtgtacagacgcagcaccagcgcg

SEQ ID NO: 57886 - DNA, 186 bp, Homo sapiens; identical to SEQ ID NO: 37272
  misc_feature 1..186: note = chr19:14667548-14667734
  misc_feature 1..186: note = hyper
  source 1..186: mol_type = genomic DNA

SEQ ID NO: 57887 - DNA, 47 bp, Homo sapiens; identical to SEQ ID NO: 37273
  misc_feature 1..47: note = chr19:14886822-14886869
  misc_feature 1..47: note = hyper
  source 1..47: mol_type = genomic DNA

SEQ ID NO: 57888 - DNA, 111 bp, Homo sapiens
  misc_feature 1..111: note = chr19:15090061-15090172
  misc_feature 1..111: note = hyper
  source 1..111: mol_type = genomic DNA
ggggaggtggggagacgggcagggagacccggggataactaaggggataggaaactcaccagaacgaccaggagaaaagcggtggcaacggctctaaggggcaagcaggag

SEQ ID NO: 57889 - DNA, 230 bp, Homo sapiens
  misc_feature 1..230: note = chr19:15090499-15090729
  misc_feature 1..230: note = hyper
  source 1..230: mol_type = genomic DNA
ctatgctgcgggagggatccgggccggccctgcgctcacgtgggtgtgggggcaccgagcggccgggggagggggcgggatcccctccgcgatgccctccgcctcccccgcgcccagcccaggctccgcagccgtgtgggagaagggggacagcgtgcttgcgaagggagggggactgggggtgggcgggggtgagtggcctctccggcatccagcccccgccccctgct

SEQ ID NO: 57890 - skipped

SEQ ID NO: 57891 - DNA, 120 bp, Homo sapiens; identical to SEQ ID NO: 37276
  misc_feature 1..120: note = chr19:15090747-15090867
  misc_feature 1..120: note = hyper
  source 1..120: mol_type = genomic DNA

SEQ ID NO: 57892 - DNA, 44 bp, Homo sapiens
  misc_feature 1..44: note = chr19:15121641-15121685
  misc_feature 1..44: note = hyper
  source 1..44: mol_type = genomic DNA
gcgtgttggtacccccggctgagcgcagccaggacacacgcgtt

SEQ ID NO: 57893 - DNA, 86 bp, Homo sapiens
  misc_feature 1..86: note = chr19:15121894-15121980
  misc_feature 1..86: note = hyper
  source 1..86: mol_type = genomic DNA
gccgccgccaggcgagggcgtcacgctgtggaagggcaagatgaagccgcccgcctggtacgcccgcctgccgctacccttgcacc

SEQ ID NO: 57894 - DNA, 295 bp, Homo sapiens; identical to SEQ ID NO: 37278
  misc_feature 1..295: note = chr19:15217958-15218253
  misc_feature 1..295: note = hyper
  source 1..295: mol_type = genomic DNA

SEQ ID NO: 57895 - DNA, 215 bp, Homo sapiens
  misc_feature 1..215: note = chr19:15288218-15288433
  misc_feature 1..215: note = hyper
  source 1..215: mol_type = genomic DNA
gcacagagaaacagacggggcaagtggatgggcaggtggaaagagaggcagggcccacggacaaacagactgggatggatgcatagacagacggatcgatcgggtggatgggctcacttgcaagtgcgctcgcggccaccggcgtggcagtcgaagttgtcgtagaggcaggcgggcgagctgcaggcggggtcgcagcggctgttgttgaagag

SEQ ID NO: 57896 - DNA, 45 bp, Homo sapiens
  misc_feature 1..45: note = chr19:15288856-15288901
  misc_feature 1..45: note = hyper
  source 1..45: mol_type = genomic DNA
ccggcaggagcgcgccacccgctcgcaacgcggaccccagaacgg

SEQ ID NO: 57897 - DNA, 164 bp, Homo sapiens; identical to SEQ ID NO: 37280
  misc_feature 1..164: note = chr19:15333656-15333820
  misc_feature 1..164: note = hyper
  source 1..164: mol_type = genomic DNA

SEQ ID NO: 57898 - DNA, 120 bp, Homo sapiens; identical to SEQ ID NO: 37281
  misc_feature 1..120: note = chr19:15334731-15334851
  misc_feature 1..120: note = hyper
  source 1..120: mol_type = genomic DNA

SEQ ID NO: 57899 - DNA, 147 bp, Homo sapiens; identical to SEQ ID NO: 22921
  misc_feature 1..147: note = chr19:15342587-15342734
  misc_feature 1..147: note = hyper
  source 1..147: mol_type = genomic DNA

SEQ ID NO: 57900 - DNA, 178 bp, Homo sapiens
  misc_feature 1..178: note = chr19:15343929-15344107
  misc_feature 1..178: note = hyper
  source 1..178: mol_type = genomic DNA
gggccaatgagctgacggtaggccggggagggggcggtggggtggggtgggcaatgggcaatgagacggagggcggggccgggacctaatatggcgggtcaggagggtctggaagacgaagaagagggacaggcaatgccaggtctaggactaggagggaggcgcgggcggtattagc

SEQ ID NO: 57901 - DNA, 208 bp, Homo sapiens; identical to SEQ ID NO: 13242
  misc_feature 1..208: note = chr19:15619208-15619416
  misc_feature 1..208: note = hyper
  source 1..208: mol_type = genomic DNA

SEQ ID NO: 57902 - DNA, 300 bp, Homo sapiens; identical to SEQ ID NO: 37285
  misc_feature 1..300: note = chr19:15695292-15695592
  misc_feature 1..300: note = hyper
  source 1..300: mol_type = genomic DNA

SEQ ID NO: 57903 - DNA, 131 bp, Homo sapiens; identical to SEQ ID NO: 22925
  misc_feature 1..131: note = chr19:17007662-17007793
  misc_feature 1..131: note = hyper
  source 1..131: mol_type = genomic DNA

SEQ ID NO: 57904 - DNA, 100 bp, Homo sapiens; identical to SEQ ID NO: 37288
  misc_feature 1..100: note = chr19:17008419-17008519
  misc_feature 1..100: note = hyper
  source 1..100: mol_type = genomic DNA

SEQ ID NO: 57905 - DNA, 296 bp, Homo sapiens; identical to SEQ ID NO: 37290
  misc_feature 1..296: note = chr19:17137063-17137359
  misc_feature 1..296: note = hyper
  source 1..296: mol_type = genomic DNA

SEQ ID NO: 57906 - DNA, 65 bp, Homo sapiens; identical to SEQ ID NO: 37291
  misc_feature 1..65: note = chr19:17137395-17137460
  misc_feature 1..65: note = hyper
  source 1..65: mol_type = genomic DNA

SEQ ID NO: 57907 - DNA, 139 bp, Homo sapiens
  misc_feature 1..139: note = chr19:17392502-17392641
  misc_feature 1..139: note = hyper
  source 1..139: mol_type = genomic DNA
cagaccctgcttgagcgcctccgggtgtcaagggcccctgaggacactaaagctctcgaaccccgatgtggacccccgtgcggcgcggggcagcctggctgggaaccctgctcggccctggagaggggccccccgagcc

SEQ ID NO: 57908 - DNA, 222 bp, Homo sapiens
  misc_feature 1..222: note = chr19:17392866-17393088
  misc_feature 1..222: note = hyper
  source 1..222: mol_type = genomic DNA
gcagtagaggagctgctgcgctgcggcgcggaccctaatttggtgctagaggacggcgcagcggctgtgcacttggcggccggagcccggcacccgcgcggcctgcgttgcctcggggccctactgcgccaaggcggggaccccaacgctcggtaagatagagcctgggtccggggcggggtctccccaagccgaagtctgggaatccgggaaggggcgccc

SEQ ID NO: 57909 - DNA, 490 bp, Homo sapiens; identical to SEQ ID NO: 37293
  misc_feature 1..490: note = chr19:17501171-17501661
  misc_feature 1..490: note = hyper
  source 1..490: mol_type = genomic DNA

SEQ ID NO: 57910 - DNA, 129 bp, Homo sapiens; identical to SEQ ID NO: 37294
  misc_feature 1..129: note = chr19:17559138-17559267
  misc_feature 1..129: note = hyper
  source 1..129: mol_type = genomic DNA

SEQ ID NO: 57911 - DNA, 499 bp, Homo sapiens
  misc_feature 1..499: note = chr19:17716787-17717286
  misc_feature 1..499: note = hyper
  source 1..499: mol_type = genomic DNA
ccaaggcgcaagccccgtccctccccgcccagcgccctccgcgcaggcgcagtgccgctcggccgaccgcccgcgctaaggcgcaggcgcggcaccgccctcctcggcggagcgcgtgtccgacttgagcttcacgaactccttggccacctcgtcgttgctgcgctgcgagaggattcgcagcaccgtgaggcccgtgtcgtccatgtggatgcggcggccgagcggcagccagcaggcggcgctcccgcgctgggccagctcacgcagctgcagcacggccagccccaccgtgcggtcctcgcgcgcgaagcagtagtccttgacgcacacctgcagctcatagcactcgggacccgcgtcggcgctcagcgtgctgcgtggggaggggcggaacgtgagacaggccacacctactgtgatgccccgcccacggccccgtccccaccgcatttgcgggccacgcccacaccggggtgcccacacctgtcacctccca

SEQ ID NO: 57912 - DNA, 209 bp, Homo sapiens
  misc_feature 1..209: note = chr19:17717315-17717524
  misc_feature 1..209: note = hyper
  source 1..209: mol_type = genomic DNA
acttgacctacaaccctgtgcttggccgcgcccacagcagctgaccccgagctgggccacgcccacgcctgttcttcccatttttccacccaccgaaaaatgaccgcatagttttacatccagctcccgcccctcagacaccgccctgcaaggccatgctcccaccctgagatacccgcgcctgtgccctctgccggctgaactgctgc

SEQ ID NO: 57913 - DNA, 156 bp, Homo sapiens
  misc_feature 1..156: note = chr19:17791026-17791182
  misc_feature 1..156: note = hyper
  source 1..156: mol_type = genomic DNA
tctccctgtcttccccggtcagtaaatggtccctgagtcaccgtcttcgtcgtcacatcccgccacctccccgcctgcgccgggttgctgtatcagggtcagcggggcggaagcgccacccttccccagcgggcttcgggtcacacgcatgaggct

SEQ ID NO: 57914 - DNA, 192 bp, Homo sapiens
  misc_feature 1..192: note = chr19:17791211-17791403
  misc_feature 1..192: note = hyper
  source 1..192: mol_type = genomic DNA
ggaggcgcgccggcggacaggggggcggggatgaggggggtgcccactgctgtccccagcgacgagcgggtgaagacaccgcgtcatgcggcctcaaaggtctttggggcccccagaagcgctgactgatgaatgtagtggccgtacccggggaggctgaggcaggagttcaggctgcgggacacccctgca

SEQ ID NO: 57915 - DNA, 37 bp, Homo sapiens; identical to SEQ ID NO: 37297
  misc_feature 1..37: note = chr19:17798697-17798734
  misc_feature 1..37: note = hyper
  source 1..37: mol_type = genomic DNA

SEQ ID NO: 57916 - DNA, 92 bp, Homo sapiens; identical to SEQ ID NO: 37298
  misc_feature 1..92: note = chr19:17798977-17799069
  misc_feature 1..92: note = hyper
  source 1..92: mol_type = genomic DNA

SEQ ID NO: 57917 - DNA, 52 bp, Homo sapiens; identical to SEQ ID NO: 37299
  misc_feature 1..52: note = chr19:17906008-17906060
  misc_feature 1..52: note = hyper
  source 1..52: mol_type = genomic DNA

SEQ ID NO: 57918 - skipped

SEQ ID NO: 57919 - DNA, 149 bp, Homo sapiens; identical to SEQ ID NO: 13255
  misc_feature 1..149: note = chr19:17983002-17983151
  misc_feature 1..149: note = hyper
  source 1..149: mol_type = genomic DNA

SEQ ID NO: 57920 - DNA, 132 bp, Homo sapiens
  misc_feature 1..132: note = chr19:17983405-17983537
  misc_feature 1..132: note = hyper
  source 1..132: mol_type = genomic DNA
gccagcttctgaactcggtcctcaccgccctgctcttcatgcccgtcttctaccgcctgggcctcaccagcacctacgaggtaccggacagaggcccgggggtaggacctgccccactggcagtgctgggac

SEQ ID NO: 57921 - DNA, 285 bp, Homo sapiens; identical to SEQ ID NO: 37303
  misc_feature 1..285: note = chr19:17984627-17984912
  misc_feature 1..285: note = hyper
  source 1..285: mol_type = genomic DNA

SEQ ID NO: 57922 - DNA, 40 bp, Homo sapiens; identical to SEQ ID NO: 37304
  misc_feature 1..40: note = chr19:18062522-18062562
  misc_feature 1..40: note = hyper
  source 1..40: mol_type = genomic DNA

SEQ ID NO: 57923 - DNA, 188 bp, Homo sapiens; identical to SEQ ID NO: 37305
  misc_feature 1..188: note = chr19:18077737-18077925
  misc_feature 1..188: note = hyper
  source 1..188: mol_type = genomic DNA

SEQ ID NO: 57924 - DNA, 136 bp, Homo sapiens; identical to SEQ ID NO: 37306
  misc_feature 1..136: note = chr19:18078136-18078272
  misc_feature 1..136: note = hyper
  source 1..136: mol_type = genomic DNA

SEQ ID NO: 57925 - DNA, 30 bp, Homo sapiens; identical to SEQ ID NO: 37307
  misc_feature 1..30: note = chr19:18336422-18336452
  misc_feature 1..30: note = hyper
  source 1..30: mol_type = genomic DNA

SEQ ID NO: 57926 - DNA, 30 bp, Homo sapiens; identical to SEQ ID NO: 37308
  misc_feature 1..30: note = chr19:18336877-18336907
  misc_feature 1..30: note = hyper
  source 1..30: mol_type = genomic DNA

SEQ ID NO: 57927 - DNA, 241 bp, Homo sapiens; identical to SEQ ID NO: 22937
  misc_feature 1..241: note = chr19:18343569-18343810
  misc_feature 1..241: note = hyper
  source 1..241: mol_type = genomic DNA

SEQ ID NO: 57928 - DNA, 42 bp, Homo sapiens; identical to SEQ ID NO: 22938
  misc_feature 1..42: note = chr19:18343879-18343921
  misc_feature 1..42: note = hyper
  source 1..42: mol_type = genomic DNA

SEQ ID NO: 57929 - DNA, 45 bp, Homo sapiens
  misc_feature 1..45: note = chr19:18714507-18714552
  misc_feature 1..45: note = hyper
  source 1..45: mol_type = genomic DNA
gaggtggggtggacacggttcttgggccggccctgatgattttcc

SEQ ID NO: 57930 - DNA, 35 bp, Homo sapiens; identical to SEQ ID NO: 37312
  misc_feature 1..35: note = chr19:18715047-18715082
  misc_feature 1..35: note = hyper
  source 1..35: mol_type = genomic DNA

SEQ ID NO: 57931 - DNA, 78 bp, Homo sapiens; identical to SEQ ID NO: 37313
  misc_feature 1..78: note = chr19:18716735-18716813
  misc_feature 1..78: note = hyper
  source 1..78: mol_type = genomic DNA

SEQ ID NO: 57932 - DNA, 206 bp, Homo sapiens; identical to SEQ ID NO: 37314
  misc_feature 1..206: note = chr19:18718176-18718382
  misc_feature 1..206: note = hyper
  source 1..206: mol_type = genomic DNA

SEQ ID NO: 57933 - DNA, 123 bp, Homo sapiens; identical to SEQ ID NO: 37315
  misc_feature 1..123: note = chr19:18723837-18723960
  misc_feature 1..123: note = hyper
  source 1..123: mol_type = genomic DNA

SEQ ID NO: 57934 - DNA, 20 bp, Homo sapiens
  misc_feature 1..20: note = chr19:18898213-18898233
  misc_feature 1..20: note = hyper
  source 1..20: mol_type = genomic DNA
aaaccagccaagccccgccc

SEQ ID NO: 57935 - DNA, 112 bp, Homo sapiens; identical to SEQ ID NO: 13264
  misc_feature 1..112: note = chr19:18899103-18899215
  misc_feature 1..112: note = hyper
  source 1..112: mol_type = genomic DNA

SEQ ID NO: 57936 - DNA, 267 bp, Homo sapiens; identical to SEQ ID NO: 37319
  misc_feature 1..267: note = chr19:18900266-18900533
  misc_feature 1..267: note = hyper
  source 1..267: mol_type = genomic DNA

SEQ ID NO: 57937 - DNA, 146 bp, Homo sapiens; identical to SEQ ID NO: 37320
  misc_feature 1..146: note = chr19:18900756-18900902
  misc_feature 1..146: note = hyper
  source 1..146: mol_type = genomic DNA

SEQ ID NO: 57938 - DNA, 510 bp, Homo sapiens
  misc_feature 1..510: note = chr19:18901318-18901828
  misc_feature 1..510: note = hyper
  source 1..510: mol_type = genomic DNA
tgtgtctctgtctcccgtctcttctctctcccgaccgccccgccgcgctcaccgcacgcgtcacactccatcaccgtgtttttcaggaacgtgatctccctgacctgcaggggtgggatggaatcagcggggtcccaacctctcctcatccctcgggtctcccctctctctaccccggggtccctttctacagcctcttttcgccaaggactccctacccgccgacccccttccctccccatctcctctccaccttctcgggtacttcctctctcctcgctgggaactgagacccccttccgttccctggcactccctgccccgcacccgggccccgcacctgctgccgcagcagctcccgcacgtcctgcagcgccgcgttggtttcctgcagttcccgaagcatctgcgggcccaggtctgagcctgcggcggcaggggacctggtgaggcgtcatggggccggggaatcccaccaccaactcccaccgttgcagcgaacccggacct

SEQ ID NO: 57939 - DNA, 178 bp, Homo sapiens
  misc_feature 1..178: note = chr19:18902095-18902273
  misc_feature 1..178: note = hyper
  source 1..178: mol_type = genomic DNA
gggtggctgctcgctttctaccgcccacgaggcccgcggggcctatttatccccaaggcacggccggccccagggacggcccaccacagccctgcccaacgtccagcctcaaggtaaacagatggcgctggcccctgcgttcaagtccccgcccggaatgccccgcgaagtcgcccgc

SEQ ID NO: 57940 - skipped

SEQ ID NO: 57941 - DNA, 30 bp, Homo sapiens; identical to SEQ ID NO: 37323
  misc_feature 1..30: note = chr19:18981207-18981237
  misc_feature 1..30: note = hyper
  source 1..30: mol_type = genomic DNA

SEQ ID NO: 57942 - DNA, 294 bp, Homo sapiens; identical to SEQ ID NO: 37324
  misc_feature 1..294: note = chr19:19006016-19006310
  misc_feature 1..294: note = hyper
  source 1..294: mol_type = genomic DNA

SEQ ID NO: 57943 - DNA, 572 bp, Homo sapiens; identical to SEQ ID NO: 37325
  misc_feature 1..572: note = chr19:19006592-19007164
  misc_feature 1..572: note = hyper
  source 1..572: mol_type = genomic DNA

SEQ ID NO: 57944 - DNA, 269 bp, Homo sapiens; identical to SEQ ID NO: 37326
  misc_feature 1..269: note = chr19:19322660-19322929
  misc_feature 1..269: note = hyper
  source 1..269: mol_type = genomic DNA

SEQ ID NO: 57945 - DNA, 73 bp, Homo sapiens; identical to SEQ ID NO: 37327
  misc_feature 1..73: note = chr19:19373696-19373769
  misc_feature 1..73: note = hyper
  source 1..73: mol_type = genomic DNA

SEQ ID NO: 57946 - DNA, 35 bp, Homo sapiens; identical to SEQ ID NO: 37328
  misc_feature 1..35: note = chr19:19383770-19383805
  misc_feature 1..35: note = hyper
  source 1..35: mol_type = genomic DNA

SEQ ID NO: 57947 - DNA, 309 bp, Homo sapiens; identical to SEQ ID NO: 37329
  misc_feature 1..309: note = chr19:19649094-19649403
  misc_feature 1..309: note = hyper
  source 1..309: mol_type = genomic DNA

SEQ ID NO: 57948 - DNA, 347 bp, Homo sapiens; identical to SEQ ID NO: 37330
  misc_feature 1..347: note = chr19:19651135-19651482
  misc_feature 1..347: note = hyper
  source 1..347: mol_type = genomic DNA

SEQ ID NO: 57949 - DNA, 336 bp, Homo sapiens; identical to SEQ ID NO: 4606
  misc_feature 1..336: note = chr19:19651512-19651848
  misc_feature 1..336: note = hyper
  source 1..336: mol_type = genomic DNA

SEQ ID NO: 57950 - DNA, 438 bp, Homo sapiens; identical to SEQ ID NO: 37333
  misc_feature 1..438: note = chr19:19843591-19844029
  misc_feature 1..438: note = hyper
  source 1..438: mol_type = genomic DNA

SEQ ID NO: 57951 - DNA, 209 bp, Homo sapiens; identical to SEQ ID NO: 37334
  misc_feature 1..209: note = chr19:19932203-19932412
  misc_feature 1..209: note = hyper
  source 1..209: mol_type = genomic DNA

SEQ ID NO: 57952 - DNA, 120 bp, Homo sapiens; identical to SEQ ID NO: 37335
  misc_feature 1..120: note = chr19:19932472-19932592
  misc_feature 1..120: note = hyper
  source 1..120: mol_type = genomic DNA

SEQ ID NO: 57953 - DNA, 28 bp, Homo sapiens
  misc_feature 1..28: note = chr19:19932652-19932680
  misc_feature 1..28: note = hyper
  source 1..28: mol_type = genomic DNA
atgcttgaggccccgccccctcaggtcc

SEQ ID NO: 57954 - skipped

SEQ ID NO: 57955 - DNA, 74 bp, Homo sapiens; identical to SEQ ID NO: 37338
  misc_feature 1..74: note = chr19:20011722-20011796
  misc_feature 1..74: note = hyper
  source 1..74: mol_type = genomic DNA

SEQ ID NO: 57956 - skipped

SEQ ID NO: 57957 - DNA, 723 bp, Homo sapiens; identical to SEQ ID NO: 37340
  misc_feature 1..723: note = chr19:20149645-20150368
  misc_feature 1..723: note = hyper
  source 1..723: mol_type = genomic DNA

SEQ ID NO: 57958 - DNA, 251 bp, Homo sapiens; identical to SEQ ID NO: 37341
  misc_feature 1..251: note = chr19:20162654-20162905
  misc_feature 1..251: note = hyper
  source 1..251: mol_type = genomic DNA

SEQ ID NO: 57959 - DNA, 388 bp, Homo sapiens; identical to SEQ ID NO: 13278
  misc_feature 1..388: note = chr19:20162906-20163294
  misc_feature 1..388: note = hyper
  source 1..388: mol_type = genomic DNA

SEQ ID NO: 57960 - DNA, 132 bp, Homo sapiens
  misc_feature 1..132: note = chr19:20188872-20189004
  misc_feature 1..132: note = hyper
  source 1..132: mol_type = genomic DNA
agcctctgtggccctgtgacctgcaggtattgggagatccacagctgagggacccccggaagcctagaaatggtgagagtgcctttccagcattccgagagaggggagggactggttggaaccgatgggaag

SEQ ID NO: 57961 - DNA, 19 bp, Homo sapiens
  misc_feature 1..19: note = chr19:20189438-20189457
  misc_feature 1..19: note = hyper
  source 1..19: mol_type = genomic DNA
aagacgcaacttcctggtc

SEQ ID NO: 57962 - DNA, 11 bp, Homo sapiens
  misc_feature 1..11: note = chr19:21769289-21769300
  misc_feature 1..11: note = hyper
  source 1..11: mol_type = genomic DNA
cggcacctgga

SEQ ID NO: 57963 - DNA, 21 bp, Homo sapiens
  misc_feature 1..21: note = chr19:21769579-21769600
  misc_feature 1..21: note = hyper
  source 1..21: mol_type = genomic DNA
cgcctgcgtgggactccaggg

SEQ ID NO: 57964 - DNA, 89 bp, Homo sapiens
  misc_feature 1..89: note = chr19:22018434-22018523
  misc_feature 1..89: note = hyper
  source 1..89: mol_type = genomic DNA
gcgtgacccaccgcgcccggccgactctcctgtttctaatagaccaaaagagggactagaaatgccacggaccaaagctcttcctattc

SEQ ID NO: 57965 - DNA, 44 bp, Homo sapiens; identical to SEQ ID NO: 37349
  misc_feature 1..44: note = chr19:22018914-22018958
  misc_feature 1..44: note = hyper
  source 1..44: mol_type = genomic DNA

SEQ ID NO: 57966 - DNA, 218 bp, Homo sapiens; identical to SEQ ID NO: 37350
  misc_feature 1..218: note = chr19:22018959-22019177
  misc_feature 1..218: note = hyper
  source 1..218: mol_type = genomic DNA

SEQ ID NO: 57967 - DNA, 225 bp, Homo sapiens; identical to SEQ ID NO: 22961
  misc_feature 1..225: note = chr19:22034813-22035038
  misc_feature 1..225: note = hyper
  source 1..225: mol_type = genomic DNA

SEQ ID NO: 57968 - DNA, 80 bp, Homo sapiens
  misc_feature 1..80: note = chr19:22610555-22610635
  misc_feature 1..80: note = hyper
  source 1..80: mol_type = genomic DNA
gccaggagtctggagcgcaggtgccgggcaggcagcactgggagcgctcggcgacttggctggaggccgaaggtgccgcc

SEQ ID NO: 57969 - DNA, 194 bp, Homo sapiens
  misc_feature 1..194: note = chr19:22715443-22715637
  misc_feature 1..194: note = hyper
  source 1..194: mol_type = genomic DNA
tgagcaggcaattgctgccccgcccactctgggaagaggggcggggccgcccgctccagagggacggaagcggcggggccgccggatccagggacaatggggtggggcgggctttccctgggtgggcgcagcggcttcctgggtccccctcacgctctgggtcagagttcctttacaggcggacctgagaggca

SEQ ID NO: 57970 - DNA, 60 bp, Homo sapiens; identical to SEQ ID NO: 37356
  misc_feature 1..60: note = chr19:22715898-22715958
  misc_feature 1..60: note = hyper
  source 1..60: mol_type = genomic DNA

SEQ ID NO: 57971 - DNA, 56 bp, Homo sapiens; identical to SEQ ID NO: 37357
  misc_feature 1..56: note = chr19:22806000-22806056
  misc_feature 1..56: note = hyper
  source 1..56: mol_type = genomic DNA

SEQ ID NO: 57972 - DNA, 17 bp, Homo sapiens
  misc_feature 1..17: note = chr19:22806297-22806314
  misc_feature 1..17: note = hyper
  source 1..17: mol_type = genomic DNA
cgcggggagcccagccc

SEQ ID NO: 57973 - DNA, 96 bp, Homo sapiens; identical to SEQ ID NO: 37359
  misc_feature 1..96: note = chr19:22817131-22817227
  misc_feature 1..96: note = hyper
  source 1..96: mol_type = genomic DNA

SEQ ID NO: 57974 - DNA, 107 bp, Homo sapiens; identical to SEQ ID NO: 37360
  misc_feature 1..107: note = chr19:23253781-23253888
  misc_feature 1..107: note = hyper
  source 1..107: mol_type = genomic DNA

SEQ ID NO: 57975 - DNA, 75 bp, Homo sapiens
  misc_feature 1..75: note = chr19:23254114-23254189
  misc_feature 1..75: note = hyper
  source 1..75: mol_type = genomic DNA
cgactcacaagggacgcgccagagctctggtcccattgagacagttcagctgaaggctgcgggccttcccgagct

SEQ ID NO: 57976 - DNA, 39 bp, Homo sapiens
  misc_feature 1..39: note = chr19:23254219-23254258
  misc_feature 1..39: note = hyper
  source 1..39: mol_type = genomic DNA
cctcggcagctgccgctggagctccggaggacaagagaa

SEQ ID NO: 57977 - DNA, 37 bp, Homo sapiens; identical to SEQ ID NO: 22966
  misc_feature 1..37: note = chr19:23258694-23258731
  misc_feature 1..37: note = hyper
  source 1..37: mol_type = genomic DNA

SEQ ID NO: 57978 - DNA, 115 bp, Homo sapiens
  misc_feature 1..115: note = chr19:23299633-23299748
  misc_feature 1..115: note = hyper
  source 1..115: mol_type = genomic DNA
ggaggaagtcctgcccgaaaaggctgcagcctacgctgtcactcttcattcagtccagcatctgatcacatctgtcactcagggcctgagggggcggggccttaaacgttatcca

SEQ ID NO: 57979 - DNA, 30 bp, Homo sapiens; identical to SEQ ID NO: 37366
  misc_feature 1..30: note = chr19:23300324-23300354
  misc_feature 1..30: note = hyper
  source 1..30: mol_type = genomic DNA

SEQ ID NO: 57980 - DNA, 30 bp, Homo sapiens; identical to SEQ ID NO: 13295
  misc_feature 1..30: note = chr19:23386702-23386732
  misc_feature 1..30: note = hyper
  source 1..30: mol_type = genomic DNA

SEQ ID NO: 57981 - DNA, 496 bp, Homo sapiens; identical to SEQ ID NO: 37368
  misc_feature 1..496: note = chr19:23598350-23598846
  misc_feature 1..496: note = hyper
  source 1..496: mol_type = genomic DNA

SEQ ID NO: 57982 - DNA, 209 bp, Homo sapiens; identical to SEQ ID NO: 37369
  misc_feature 1..209: note = chr19:23654103-23654312
  misc_feature 1..209: note = hyper
  source 1..209: mol_type = genomic DNA

SEQ ID NO: 57983 - DNA, 52 bp, Homo sapiens
  misc_feature 1..52: note = chr19:24154540-24154592
  misc_feature 1..52: note = hyper
  source 1..52: mol_type = genomic DNA
agctctgcagttctccgccctgcctggaaaggaagcggccccgccaggtagt

SEQ ID NO: 57984 - DNA, 23 bp, Homo sapiens
  misc_feature 1..23: note = chr19:24154621-24154644
  misc_feature 1..23: note = hyper
  source 1..23: mol_type = genomic DNA
cttggccccgagggggtgacatc

SEQ ID NO: 57985 - DNA, 48 bp, Homo sapiens
  misc_feature 1..48: note = chr19:29284404-29284452
  misc_feature 1..48: note = hyper
  source 1..48: mol_type = genomic DNA
ccggccagccgctgtcgctgtcgccgccgcactcgcctgtccggacgc

SEQ ID NO: 57986 - DNA, 362 bp, Homo sapiens; identical to SEQ ID NO: 22973
  misc_feature 1..362: note = chr19:30015572-30015934
  misc_feature 1..362: note = hyper
  source 1..362: mol_type = genomic DNA

SEQ ID NO: 57987 - DNA, 202 bp, Homo sapiens
  misc_feature 1..202: note = chr19:30016712-30016914
  misc_feature 1..202: note = hyper
  source 1..202: mol_type = genomic DNA
gctgtactccaaccagaaagacggtggtccctccgagcgacccccgaggagagagggggagcgctctggggcgggggcggggcgggctgtggcaggagaggggagggcgggggcgatgcagcggtggaggcggcttggcgcccagccactgaccgccccctcccttcccctcccctccccctctccccgcctctctccggct

SEQ ID NO: 57988 - DNA, 131 bp, Homo sapiens
  misc_feature 1..131: note = chr19:30018608-30018739
  misc_feature 1..131: note = hyper
  source 1..131: mol_type = genomic DNA
tgctgggtagtgaaggaagcccccttggtcccatcaggctctccccgccctctgccactttgaggaccccagggctcccacggctgcgttccagaggccaccagaaaaccgagtaccggaaagccggcagg

SEQ ID NO: 57989 - DNA, 32 bp, Homo sapiens; identical to SEQ ID NO: 22976
  misc_feature 1..32: note = chr19:30019113-30019145
  misc_feature 1..32: note = hyper
  source 1..32: mol_type = genomic DNA

SEQ ID NO: 57990 - DNA, 93 bp, Homo sapiens
  misc_feature 1..93: note = chr19:30019838-30019931
  misc_feature 1..93: note = hyper
  source 1..93: mol_type = genomic DNA
ggtgttgcaggcttgcaggggacggggtagggggtggttgtgccaggctgcgaggggcccgggtcatggggttgctaactctgggaggagatg

SEQ ID NO: 57991 - DNA, 100 bp, Homo sapiens
  misc_feature 1..100: note = chr19:30019993-30020093
  misc_feature 1..100: note = hyper
  source 1..100: mol_type = genomic DNA
cggttcagaggtgagggctccctgggtgtttgttgagagccgtagagcagtacttcccgaagtccccaccggggcgcaggggaggagcacttcgctgggg

SEQ ID NO: 57992 - DNA, 133 bp, Homo sapiens
  misc_feature 1..133: note = chr19:30020473-30020606
  misc_feature 1..133: note = hyper
  source 1..133: mol_type = genomic DNA
gtgggcgtttggttaacgtgatggggacgtggggacacagtccaaagagctggctgcctggcgtccacgcagagttggaagccctatgccactgggtagacgcgggtgaaagggaagccggatcgtgatggtg

SEQ ID NO: 57993 - DNA, 196 bp, Homo sapiens; identical to SEQ ID NO: 37381
  misc_feature 1..196: note = chr19:30020843-30021039
  misc_feature 1..196: note = hyper
  source 1..196: mol_type = genomic DNA

SEQ ID NO: 57994 - DNA, 103 bp, Homo sapiens; identical to SEQ ID NO: 13308
  misc_feature 1..103: note = chr19:30021252-30021355
  misc_feature 1..103: note = hyper
  source 1..103: mol_type = genomic DNA

SEQ ID NO: 57995 - DNA, 402 bp, Homo sapiens; identical to SEQ ID NO: 37383
  misc_feature 1..402: note = chr19:30215009-30215411
  misc_feature 1..402: note = hyper
  source 1..402: mol_type = genomic DNA

SEQ ID NO: 57996 - DNA, 30 bp, Homo sapiens; identical to SEQ ID NO: 37384
  misc_feature 1..30: note = chr19:30334621-30334651
  misc_feature 1..30: note = hyper
  source 1..30: mol_type = genomic DNA

SEQ ID NO: 57997 - DNA, 69 bp, Homo sapiens
  misc_feature 1..69: note = chr19:30713411-30713480
  misc_feature 1..69: note = hyper
  source 1..69: mol_type = genomic DNA
gccgggaggtctccccggggacccccactcagcttgctcaggtcctggaggcatgcagagggcgtcggc

SEQ ID NO: 57998 - DNA, 203 bp, Homo sapiens
  misc_feature 1..203: note = chr19:30713706-30713909
  misc_feature 1..203: note = hyper
  source 1..203: mol_type = genomic DNA
cctccaggcctggaaggggctcccctggcctggaggccatgggcccggcccagaccggccagacaccgccagggacccccagaacgacgccaggacgcgcgccgggctccgtgcctcccacggcccaggcgaggccggcggctcgagggttaaaaggcgacccccattctgtaggggagaaagtgccttttctccaagtccat

SEQ ID NO: 57999 - DNA, 223 bp, Homo sapiens
  misc_feature 1..223: note = chr19:30714433-30714656
  misc_feature 1..223: note = hyper
  source 1..223: mol_type = genomic DNA
gcagggtccgaggatgctggcagcggcaaggcccggtgcccgccgacggcgcgcctggggagaggaccaccggcggtgagggcccaggcccagcgcccagggcagctgcgacgcgtccgtctccaacgccggcacgctaacccagcgctcctcccagcgcaaagttttctgtgtctctcccctcactcttggactggttgcttgccaccgaatgactccttca

SEQ ID NO: 58000 - DNA, 114 bp, Homo sapiens
  misc_feature 1..114: note = chr19:30715288-30715402
  misc_feature 1..114: note = hyper
  source 1..114: mol_type = genomic DNA
tttgcccagaggacccgccttgcaaagttgccttaaaaaagttattttgtttgataattaagtcctggagcccatcgcatgatgattattctacacccataaggcagagaacct

SEQ ID NO: 58001 - DNA, 103 bp, Homo sapiens; identical to SEQ ID NO: 22983
  misc_feature 1..103: note = chr19:30715766-30715869
  misc_feature 1..103: note = hyper
  source 1..103: mol_type = genomic DNA

SEQ ID NO: 58002 - DNA, 97 bp, Homo sapiens
  misc_feature 1..97: note = chr19:30716216-30716313
  misc_feature 1..97: note = hyper
  source 1..97: mol_type = genomic DNA
ggcgacaatggagagcgtttttaatggtacaatgcatttcacctaccagatagggggaggccgagccggggatggggatgtctgctggggctgggtg

SEQ ID NO: 58003 - DNA, 194 bp, Homo sapiens; identical to SEQ ID NO: 22984
  misc_feature 1..194: note = chr19:30716576-30716770
  misc_feature 1..194: note = hyper
  source 1..194: mol_type = genomic DNA

SEQ ID NO: 58004 - DNA, 698 bp, Homo sapiens
  misc_feature 1..698: note = chr19:30718149-30718847
  misc_feature 1..698: note = hyper
  source 1..698: mol_type = genomic DNA
tggggacaggtggaaagttaagtcccccccttttcacttctgtattgtgagtggttcctactgtgtgcctgttggagaacatgtccaccgttcccgagttaggtggaggattggaatgttggggggcggggagcgttggagttgaggacgcagtggccaggggctgggggccgagaaagagcagggcggggtctcagccccgcgtgcgggtggcagcggcggccgggttttgtttgccagatattgttatgtctaacgggtgcctcgccggagacgtgatttgtcagccgccttcgttttcactttagcagaaaatacggcagctgcgaggtgtcccggcctgcggggctcgggcacccggtgcgtcctgggggctgggtcgtgtgcgcgggtgggagccggcggccggcggggccggggcgaggggcgagcgggaggggcggagtgagcgagcgcgcggtacggccctccggttcctcctgcgccttctcccggcagccgccgccgccgccgccgccgctgtgcaatttagcagaaatccgacaggggccgcgtttgctgagcgcatccggcggccgggcagcccgagcgggccgccgggcctggtcggccggtgtagaggcgcggagggggccggcggaggggaccggcggggatgggcgcgggaagcacgcctgaccagagcacgcgccgttccc

SEQ ID NO: 58005 - DNA, 18 bp, Homo sapiens
  misc_feature 1..18: note = chr19:30718913-30718931
  misc_feature 1..18: note = hyper
  source 1..18: mol_type = genomic DNA
ccagggcttaggtgaact

SEQ ID NO: 58006 - DNA, 29 bp, Homo sapiens
  misc_feature 1..29: note = chr19:30718991-30719020
  misc_feature 1..29: note = hyper
  source 1..29: mol_type = genomic DNA
ggtgagactgggaacgcgctgttttcttt

SEQ ID NO: 58007 - DNA, 213 bp, Homo sapiens
  misc_feature 1..213: note = chr19:30719236-30719449
  misc_feature 1..213: note = hyper
  source 1..213: mol_type = genomic DNA
tggggacagggcccccgcccccgccggggtcgggtttgatggtgaaatagtaaacccacgcacggagggtcgccaggaaagtggacattaccgctttaattaacttcgagatgctccggcggcgggacctggcgtagccgtgacgcgcccccataaatctgcccggcccggggctgctccgagaactcgtacagtagcggcgtcagatccatc

SEQ ID NO: 58008 - DNA, 254 bp, Homo sapiens
  misc_feature 1..254: note = chr19:30865459-30865713
  misc_feature 1..254: note = hyper
  source 1..254: mol_type = genomic DNA
cgccctgaagaaaggcgccttggcaccgcctcggtgcccaccagaaggtgcccggattgcctcttttgcgcaaagacaaagggggtaattttttggcaagaaaacaaacccaaggaaaacacaacaaactgagtgttgtttttttttctttccctcctgcaacttctcggaccgtctctgccctctctcctccagagagggcgagtttcatcctggagggaggccgggggagctgcgaggccacccccagccgg

SEQ ID NO: 58009 - DNA, 51 bp, Homo sapiens; identical to SEQ ID NO: 37395
  misc_feature 1..51: note = chr19:30866452-30866503
  misc_feature 1..51: note = hyper
  source 1..51: mol_type = genomic DNA

SEQ ID NO: 58010 - DNA, 55 bp, Homo sapiens; identical to SEQ ID NO: 22988
  misc_feature 1..55: note = chr19:31839873-31839928
  misc_feature 1..55: note = hyper
  source 1..55: mol_type = genomic DNA

SEQ ID NO: 58011 - DNA, 1236 bp, Homo sapiens; identical to SEQ ID NO: 37397
  misc_feature 1..1236: note = chr19:31839941-31841177
  misc_feature 1..1236: note = hyper
  source 1..1236: mol_type = genomic DNA

SEQ ID NO: 58012 - DNA, 59 bp, Homo sapiens; identical to SEQ ID NO: 37398
  misc_feature 1..59: note = chr19:31841442-31841501
  misc_feature 1..59: note = hyper
  source 1..59: mol_type = genomic DNA

SEQ ID NO: 58013 - DNA, 92 bp, Homo sapiens; identical to SEQ ID NO: 22993
  misc_feature 1..92: note = chr19:31842389-31842481
  misc_feature 1..92: note = hyper
  source 1..92: mol_type = genomic DNA

SEQ ID NO: 58014 - DNA, 30 bp, Homo sapiens; identical to SEQ ID NO: 37401
  misc_feature 1..30: note = chr19:31842828-31842858
  misc_feature 1..30: note = hyper
  source 1..30: mol_type = genomic DNA

SEQ ID NO: 58015 - DNA, 78 bp, Homo sapiens; identical to SEQ ID NO: 22994
  misc_feature 1..78: note = chr19:32715595-32715673
  misc_feature 1..78: note = hyper
  source 1..78: mol_type = genomic DNA

SEQ ID NO: 58016 - DNA, 26 bp, Homo sapiens
  misc_feature 1..26: note = chr19:32715741-32715767
  misc_feature 1..26: note = hyper
  source 1..26: mol_type = genomic DNA
gctctcccgcccgctcgctgcccgcc

SEQ ID NO: 58017 - DNA, 43 bp, Homo sapiens; identical to SEQ ID NO: 37403
  misc_feature 1..43: note = chr19:33166926-33166969
  misc_feature 1..43: note = hyper
  source 1..43: mol_type = genomic DNA

SEQ ID NO: 58018 - DNA, 128 bp, Homo sapiens; identical to SEQ ID NO: 22995
  misc_feature 1..128: note = chr19:33166988-33167116
  misc_feature 1..128: note = hyper
  source 1..128: mol_type = genomic DNA

SEQ ID NO: 58019 - DNA, 30 bp, Homo sapiens; identical to SEQ ID NO: 37405
  misc_feature 1..30: note = chr19:33167843-33167873
  misc_feature 1..30: note = hyper
  source 1..30: mol_type = genomic DNA

SEQ ID NO: 58020 - DNA, 42 bp, Homo sapiens; identical to SEQ ID NO: 37406
  misc_feature 1..42: note = chr19:33685611-33685653
  misc_feature 1..42: note = hyper
  source 1..42: mol_type = genomic DNA

SEQ ID NO: 58021 - DNA, 80 bp, Homo sapiens; identical to SEQ ID NO: 37407
  misc_feature 1..80: note = chr19:33716537-33716617
  misc_feature 1..80: note = hyper
  source 1..80: mol_type = genomic DNA

SEQ ID NO: 58022 - DNA, 58 bp, Homo sapiens; identical to SEQ ID NO: 37408
  misc_feature 1..58: note = chr19:33717533-33717591
  misc_feature 1..58: note = hyper
  source 1..58: mol_type = genomic DNA

SEQ ID NO: 58023 - DNA, 37 bp, Homo sapiens; identical to SEQ ID NO: 37409
  misc_feature 1..37: note = chr19:33717859-33717896
  misc_feature 1..37: note = hyper
  source 1..37: mol_type = genomic DNA

SEQ ID NO: 58024 - DNA, 57 bp, Homo sapiens
  misc_feature 1..57: note = chr19:33792524-33792581
  misc_feature 1..57: note = hyper
  source 1..57: mol_type = genomic DNA
tcgcgcggaggtcggggtgcgcggcgcccagccccttgagcgcgctgccagggcccg

SEQ ID NO: 58025 - DNA, 225 bp, Homo sapiens
  misc_feature 1..225: note = chr19:33794450-33794675
  misc_feature 1..225: note = hyper
  source 1..225: mol_type = genomic DNA
cgagggtgtccaggccgccgggctgccaggtccgagcacgcacagggagaactctgcccagtggttcgccgggcgctgtagtccccgggatcctagggaccgaggcggccaggccctggggccccttgagtgcggcagctaatgctctcaccgcggcgggggaaggagcttgccaccgagacccccagccacgtgcgtccctcgcattctttaccggggccgggg

SEQ ID NO: 58026 - DNA, 15 bp, Homo sapiens
  misc_feature 1..15: note = chr19:34112272-34112287
  misc_feature 1..15: note = hyper
  source 1..15: mol_type = genomic DNA
atggatgcggacacc

SEQ ID NO: 58027 - DNA, 198 bp, Homo sapiens
  misc_feature 1..198: note = chr19:34112326-34112524
  misc_feature 1..198: note = hyper
  source 1..198: mol_type = genomic DNA
cgagctgaagcccagggatatcccagaatcttcctcaggatcaatcttccgcctttcaccggccctgcgcccccgcagcatcgggtcctgggcgcgcgcccctgccccgctgtggtcaaggcccgccccggtgacgcctggtccttttcccgggttggcgccgcgtgcgacccaccgaggcagtggcagcactggccg

SEQ ID NO: 58028 - DNA, 82 bp, Homo sapiens; identical to SEQ ID NO: 37414
  misc_feature 1..82: note = chr19:34113221-34113303
  misc_feature 1..82: note = hyper
  source 1..82: mol_type = genomic DNA

SEQ ID NO: 58029 - DNA, 419 bp, Homo sapiens
  misc_feature 1..419: note = chr19:34113587-34114006
  misc_feature 1..419: note = hyper
  source 1..419: mol_type = genomic DNA
agcgctcggggcgctggggcttcctggcgcgctcggagccggggctccggacgggttgcggcgggcagagactatgggggaagtttaagtggccttggcttcctacccagcggctccgtcgcgcgcgtccccgacccgcaactctccagggcaccggcctgtgagtgctggaggcgagtgtgcgtgcgtcagcgatggtgtgaaggtgtgtgcgtgcgtgtgtcgggagtgcgggagtcggagcctggggcggctccagggggcggggaaatgatccgtttggccgcgggaccgagccgagctctgacggcggctgcaactccggctaccgactctgcagacccgctctggcctcgctggaggccagccgggccaggagggcgatcacgggttttggcagtgcccgatgctggggcttg

SEQ ID NO: 58030 - DNA, 17 bp, Homo sapiens
  misc_feature 1..17: note = chr19:34114286-34114303
  misc_feature 1..17: note = hyper
  source 1..17: mol_type = genomic DNA
cgcgtcccggcccctct

SEQ ID NO: 58031 - DNA, 73 bp, Homo sapiens; identical to SEQ ID NO: 37418
  misc_feature 1..73: note = chr19:34175192-34175265
  misc_feature 1..73: note = hyper
  source 1..73: mol_type = genomic DNA

SEQ ID NO: 58032 - DNA, 75 bp, Homo sapiens; identical to SEQ ID NO: 37419
  misc_feature 1..75: note = chr19:34175542-34175617
  misc_feature 1..75: note = hyper
  source 1..75: mol_type = genomic DNA

SEQ ID NO: 58033 - DNA, 114 bp, Homo sapiens; identical to SEQ ID NO: 37420
  misc_feature 1..114: note = chr19:34288561-34288675
  misc_feature 1..114: note = hyper
  source 1..114: mol_type = genomic DNA

SEQ ID NO: 58034 - DNA, 32 bp, Homo sapiens; identical to SEQ ID NO: 37421
  misc_feature 1..32: note = chr19:34311466-34311498
  misc_feature 1..32: note = hyper
  source 1..32: mol_type = genomic DNA

SEQ ID NO: 58035 - DNA, 79 bp, Homo sapiens; identical to SEQ ID NO: 37422
  misc_feature 1..79: note = chr19:34396820-34396899
  misc_feature 1..79: note = hyper
  source 1..79: mol_type = genomic DNA

SEQ ID NO: 58036 - DNA, 30 bp, Homo sapiens; identical to SEQ ID NO: 37423
  misc_feature 1..30: note = chr19:34972190-34972220
  misc_feature 1..30: note = hyper
  source 1..30: mol_type = genomic DNA

SEQ ID NO: 58037 - DNA, 126 bp, Homo sapiens; identical to SEQ ID NO: 37424
  misc_feature 1..126: note = chr19:34972522-34972648
  misc_feature 1..126: note = hyper
  source 1..126: mol_type = genomic DNA

SEQ ID NO: 58038 - DNA, 449 bp, Homo sapiens; identical to SEQ ID NO: 37425
  misc_feature 1..449: note = chr19:34972675-34973124
  misc_feature 1..449: note = hyper
  source 1..449: mol_type = genomic DNA

SEQ ID NO: 58039 - DNA, 202 bp, Homo sapiens
  misc_feature 1..202: note = chr19:34973255-34973457
  misc_feature 1..202: note = hyper
  source 1..202: mol_type = genomic DNA
cggacccgcgtcccggtcccgggccgccttcggtgggcagcgcccgctccagcgtttccagcctcggctcccggggctcggccggcgcctacgctgacttcctcccgcccggcgcctgccccgcgcccgctcgctccccggagcctgcggggccggctcccttcccgctgcctgcactcccgctgccccctggccgggaggg

SEQ ID NO: 58040 - DNA, 91 bp, Homo sapiens; identical to SEQ ID NO: 37427
  misc_feature 1..91: note = chr19:34973553-34973644
  misc_feature 1..91: note = hyper
  source 1..91: mol_type = genomic DNA

SEQ ID NO: 58041 - DNA, 11 bp, Homo sapiens
  misc_feature 1..11: note = chr19:34973645-34973656
  misc_feature 1..11: note = hyper
  source 1..11: mol_type = genomic DNA
gggctggctgg

SEQ ID NO: 58042 - DNA, 69 bp, Homo sapiens
  misc_feature 1..69: note = chr19:34973697-34973766
  misc_feature 1..69: note = hyper
  source 1..69: mol_type = genomic DNA
ccctggggactggggagcgcaaagggtgagtgagtgcgcctggatccccagcagcggcttcacccctgc

SEQ ID NO: 58043 - DNA, 255 bp, Homo sapiens; identical to SEQ ID NO: 37429
  misc_feature 1..255: note = chr19:35068601-35068856
  misc_feature 1..255: note = hyper
  source 1..255: mol_type = genomic DNA

SEQ ID NO: 58044 - DNA, 30 bp, Homo sapiens; identical to SEQ ID NO: 37430
  misc_feature 1..30: note = chr19:35168907-35168937
  misc_feature 1..30: note = hyper
  source 1..30: mol_type = genomic DNA

SEQ ID NO: 58045 - DNA, 377 bp, Homo sapiens; identical to SEQ ID NO: 37431
  misc_feature 1..377: note = chr19:35263586-35263963
  misc_feature 1..377: note = hyper
  source 1..377: mol_type = genomic DNA

SEQ ID NO: 58046 - DNA, 26 bp, Homo sapiens
  misc_feature 1..26: note = chr19:35395923-35395949
  misc_feature 1..26: note = hyper
  source 1..26: mol_type = genomic DNA
cccagctgcaagggccggcgcaccca

SEQ ID NO: 58047 - DNA, 96 bp, Homo sapiens
  misc_feature 1..96: note = chr19:35396370-35396466
  misc_feature 1..96: note = hyper
  source 1..96: mol_type = genomic DNA
cctagctagacaagtgcttctcacgatccagcgcgtttaccgctcggtttcgtcgccgctaaggggtggtggtgtctgatccgtcaggctctgcgc

SEQ ID NO: 58048 - DNA, 30 bp, Homo sapiens; identical to SEQ ID NO: 37434
  misc_feature 1..30: note = chr19:35503957-35503987
  misc_feature 1..30: note = hyper
  source 1..30: mol_type = genomic DNA

SEQ ID NO: 58049 - DNA, 126 bp, Homo sapiens; identical to SEQ ID NO: 13334
  misc_feature 1..126: note = chr19:35531737-35531863
  misc_feature 1..126: note = hyper
  source 1..126: mol_type = genomic DNA

SEQ ID NO: 58050 - DNA, 121 bp, Homo sapiens; identical to SEQ ID NO: 37436
  misc_feature 1..121: note = chr19:36024853-36024974
  misc_feature 1..121: note = hyper
  source 1..121: mol_type = genomic DNA

SEQ ID NO: 58051 - DNA, 15 bp, Homo sapiens
  misc_feature 1..15: note = chr19:36048580-36048595
  misc_feature 1..15: note = hyper
  source 1..15: mol_type = genomic DNA
ccaggctgaggtagg

SEQ ID NO: 58052 - DNA, 539 bp, Homo sapiens
  misc_feature 1..539: note = chr19:36048771-36049310
  misc_feature 1..539: note = hyper
  source 1..539: mol_type = genomic DNA
aggctgtggacgggggaacggggcggggctgtggacgagggaacggggcggggctgaggagaggggcggggccgagagctcggtgcgggctctgagagctgcggggaagggtgaaggtggaagatggaggccttgtgtggaggggtccttggtagaaggtaagcgttaaggcggggctaggtgcagatttggagtcctggacgcagggaatgaacagaattagggtgcggagttgggctgggggcggatttggagagcgaggtgctccccatggacagtcccgccgaggagaagctgtgggcggggctgggtggtgggcggggccttgcctctggtggacggggccataggcggagcgggagatggggtggggtttggctgcggagagaaggggcaaggagcgaagcccctcgtggcccgctgatgtgggtgtggcctggggcggggcccgaggtgggcgggcccaggccgtgggcggggccggctgcgcacctggaacttgttggtggagttgaagggtatctcgcagacttttggga

SEQ ID NO: 58053 - DNA, 57 bp, Homo sapiens; identical to SEQ ID NO: 23006
  misc_feature 1..57: note = chr19:36335147-36335204
  misc_feature 1..57: note = hyper
  source 1..57: mol_type = genomic DNA

SEQ ID NO: 58054 - DNA, 96 bp, Homo sapiens; identical to SEQ ID NO: 37439
  misc_feature 1..96: note = chr19:36336604-36336700
  misc_feature 1..96: note = hyper
  source 1..96: mol_type = genomic DNA

SEQ ID NO: 58055 - DNA, 102 bp, Homo sapiens; identical to SEQ ID NO: 37440
  misc_feature 1..102: note = chr19:36337017-36337119
  misc_feature 1..102: note = hyper
  source 1..102: mol_type = genomic DNA

SEQ ID NO: 58056 - DNA, 83 bp, Homo sapiens
  misc_feature 1..83: note = chr19:36347809-36347892
  misc_feature 1..83: note = hyper
  source 1..83: mol_type = genomic DNA
cccagagacccaggccgcggaactggcaggcgtttcagagcgtcagaggctgcggatgagcagacttggaggactccaggcca

SEQ ID NO: 58057 - DNA, 147 bp, Homo sapiens; identical to SEQ ID NO: 37442
  misc_feature 1..147: note = chr19:36351801-36351948
  misc_feature 1..147: note = hyper
  source 1..147: mol_type = genomic DNA

SEQ ID NO: 58058 - DNA, 30 bp, Homo sapiens; identical to SEQ ID NO: 13340
  misc_feature 1..30: note = chr19:36361080-36361110
  misc_feature 1..30: note = hyper
  source 1..30: mol_type = genomic DNA

SEQ ID NO: 58059 - DNA, 215 bp, Homo sapiens
  misc_feature 1..215: note = chr19:36449891-36450106
  misc_feature 1..215: note = hyper
  source 1..215: mol_type = genomic DNA
tgtttccagggctgccgcttcatcacggctttctcggaaaacgggggcgctgagaagcccaacttccagctatatatgtcgccaccgcccacagggcccccgacggcgatgctggtgacagcgctccctgcgtgggcgccactctccccgtgctccccgcgcctgcagccaggcacgacggtgtgggtgtgcccgcccggggcagaggagctgca

SEQ ID NO: 58060 - DNA, 15 bp, Homo sapiens
  misc_feature 1..15: note = chr19:36450544-36450559
  misc_feature 1..15: note = hyper
  source 1..15: mol_type = genomic DNA
cgccccagggtcgct

SEQ ID NO: 58061 - DNA, 420 bp, Homo sapiens
  misc_feature 1..420: note = chr19:36523480-36523900
  misc_feature 1..420: note = hyper
  source 1..420: mol_type = genomic DNA
acctcccccaggcccagccccccattcttctcctcccgcgtcaggcccctcagtcgcggctgccccctccccgggtttgtttatctcgggattcaggatgcttcgcccctccccttctccgcgggccgccccctccccatcttacctcgggcagacagcgctggggaccaaagtggagactggggagactgtgggagcaatggggtgtcggtgtcaggggacgtgatgggggaggcaagggagacagagagaaggggacgaggcccagacgccgacagggggtgggggcggagagggaggggcgcgactgcgcatgcgcctgctgcccccctaccggcggcgggggaggagggaccaggaggagggaccgggaggcgctcgcattgatggaggggccagaggcggcgactgaaaggggag

SEQ ID NO: 58062 - DNA, 11 bp, Homo sapiens
  misc_feature 1..11: note = chr19:36736016-36736027
  misc_feature 1..11: note = hyper
  source 1..11: mol_type = genomic DNA
agacccggcga

SEQ ID NO: 58063 - skipped

SEQ ID NO: 58064 - DNA, 88 bp, Homo sapiens
  misc_feature 1..88: note = chr19:36736491-36736579
  misc_feature 1..88: note = hyper
  source 1..88: mol_type = genomic DNA
gcttgagatgcagcctcccagcttcgaggctaccacctgcccgaattggtgctttggcagagtctctggtgcccgggtgaatgggttc

SEQ ID NO: 58065 - DNA, 82 bp, Homo sapiens; identical to SEQ ID NO: 23013
  misc_feature 1..82: note = chr19:36822242-36822324
  misc_feature 1..82: note = hyper
  source 1..82: mol_type = genomic DNA

SEQ ID NO: 58066 - DNA, 18 bp, Homo sapiens
  misc_feature 1..18: note = chr19:36912332-36912350
  misc_feature 1..18: note = hyper
  source 1..18: mol_type = genomic DNA
cccggcaccaggggacgc

SEQ ID NO: 58067 - DNA, 81 bp, Homo sapiens; identical to SEQ ID NO: 37454
  misc_feature 1..81: note = chr19:36912480-36912561
  misc_feature 1..81: note = hyper
  source 1..81: mol_type = genomic DNA

SEQ ID NO: 58068 - DNA, 15 bp, Homo sapiens
  misc_feature 1..15: note = chr19:37096575-37096590
  misc_feature 1..15: note = hyper
  source 1..15: mol_type = genomic DNA
cgcgcgggcgcgcgc

SEQ ID NO: 58069 - DNA, 629 bp, Homo sapiens; identical to SEQ ID NO: 37457
  misc_feature 1..629: note = chr19:37157547-37158176
  misc_feature 1..629: note = hyper
  source 1..629: mol_type = genomic DNA

SEQ ID NO: 58070 - DNA, 187 bp, Homo sapiens
  misc_feature 1..187: note = chr19:37263345-37263532
  misc_feature 1..187: note = hyper
  source 1..187: mol_type = genomic DNA
ggtactgcacagacacgcaaagtcacacacccaccccgggacacgcagtccaaccacacagtcaccggttcttcacatccgcacgcacaacgagggtcgtccaggacacacacacccactccgggcgcgcacagtcacaagcgcccacctgatcacccagagtcagcaccacacagccacagtcaca

SEQ ID NO: 58071 - DNA, 638 bp, Homo sapiens
  misc_feature 1..638: note = chr19:37263584-37264222
  misc_feature 1..638: note = hyper
  source 1..638: mol_type = genomic DNA
tcagccctccacacacaaaaggaccggagccggattcctcaccctcagcattctctggttccgctcggggccagcctagccaagttcctcaggactccaaggcgcggcggcagctaaatcggcacagcaaacggtcccgccacctggctaagaggaagccaaaatctcgcgagacgtggcgtcggcctgcgggatcctctgggaaatgtagtccagagcccgactgcgggcttccctatgcctctcatttccaagcctggcttgtttccttttaccgctcctctccaacgaggatcgcagagccctcatgccgagcggctcgctatggggccggctcgcccgctagagtggtcaggcctgattatccctggcagctctgttatctggggtaagacacaggaaaacgtgcttccggttctcggcggaagtagccccgaacggtagaaccgatgggaaatgtagtccagggcagaaaagcggtcaacccagccacgatgcgagccaaaggattcttggctccaagcctggtcctggctgttagtttggaactcatgcacccagatgctaactcgccctcagaatgcagaggggatgaaacactgaccggacaattcaatctgtatatgggtgagtccagg

SEQ ID NO: 58072 - DNA, 32 bp, Homo sapiens; identical to SEQ ID NO: 37459
  misc_feature 1..32: note = chr19:37287904-37287936
  misc_feature 1..32: note = hyper
  source 1..32: mol_type = genomic DNA

SEQ ID NO: 58073 - DNA, 42 bp, Homo sapiens
  misc_feature 1..42: note = chr19:37288765-37288807
  misc_feature 1..42: note = hyper
  source 1..42: mol_type = genomic DNA
agccaggtgttctgttgcagaacgcctcgaagggagggagtg

SEQ ID NO: 58074 - DNA, 30 bp, Homo sapiens; identical to SEQ ID NO: 37463
  misc_feature 1..30: note = chr19:37328802-37328832
  misc_feature 1..30: note = hyper
  source 1..30: mol_type = genomic DNA

SEQ ID NO: 58075 - DNA, 165 bp, Homo sapiens; identical to SEQ ID NO: 37464
  misc_feature 1..165: note = chr19:37329224-37329389
  misc_feature 1..165: note = hyper
  source 1..165: mol_type = genomic DNA

SEQ ID NO: 58076 - DNA, 257 bp, Homo sapiens; identical to SEQ ID NO: 37465
  misc_feature 1..257: note = chr19:37340845-37341102
  misc_feature 1..257: note = hyper
  source 1..257: mol_type = genomic DNA

SEQ ID NO: 58077 - DNA, 32 bp, Homo sapiens; identical to SEQ ID NO: 37466
  misc_feature 1..32: note = chr19:37341165-37341197
  misc_feature 1..32: note = hyper
  source 1..32: mol_type = genomic DNA

SEQ ID NO: 58078 - DNA, 292 bp, Homo sapiens
  misc_feature 1..292: note = chr19:37341469-37341761
  misc_feature 1..292: note = hyper
  source 1..292: mol_type = genomic DNA
tgctgaagtgctgttcgcaggctatggaggaggcctggccaagcaaaaagggctcagaggagcctgactaaagcttggtctagggactccttgtcaggtgagactcccggaaggctccgatgggcagctcacctcaaagagatagttttgttggtgccagagtccgcgccaggggaatcgggatggctgggctgtagctttcggcaacctgtcgctttctggactacacttcccagaagcctctaggcccagggcactctcccgcgataactagattgtctcttgaggagtg

SEQ ID NO: 58079 - DNA, 171 bp, Homo sapiens
  misc_feature 1..171: note = chr19:37341962-37342133
  misc_feature 1..171: note = hyper
  source 1..171: mol_type = genomic DNA
tgtacggttgtgactgggggcgtgtgtctgtgcgaccgtgtatggaactgtgagggcggggaggaggactttttgtttatgtttgtgcgggtgtgagtagagtttaattgtgaccgggttgggcactgtgtttgcgagtgtgaggttcctggaccgcggttgtgactgtat

SEQ ID NO: 58080 - DNA, 362 bp, Homo sapiens
  misc_feature 1..362: note = chr19:37406765-37407127
  misc_feature 1..362: note = hyper
  source 1..362: mol_type = genomic DNA
ctccacctttcaggccgctccgcccgcaggggcccaaggcgccagctccccatcggtcttcggtatcctcacctaagccctttccagtcatcccggatgggaacttgcagacctgagccagttctcctggggaccaaaatatctcacctcccagatctaagggtcccgccaggagtgacgaaacgttcgaattcctgcgagaaaagtggcaggccaccaggccctctgggaaatgtagtccagagcgggacccacgccgattcctgtcagctcctcgcctgggcccacccgaaacggctgctccctcaactctcaacatccagccgagcctcggagttgcgggtcgccgtagcgctgcgcaa

SEQ ID NO: 58081 - DNA, 147 bp, Homo sapiens
  misc_feature 1..147: note = chr19:37407443-37407590
  misc_feature 1..147: note = hyper
  source 1..147: mol_type = genomic DNA
ccagagtgtcccgagtagcggcagtggggagtgctcagggtacgctaatggtgagtggttgcagttgatgggacaaaaaactgtgatgggagttagtgtgggtgtgtggttgtgtgtgtgagtgtgacggcacgaataatctgatgg

SEQ ID NO: 58082 - DNA, 42 bp, Homo sapiens
  misc_feature 1..42: note = chr19:37464696-37464738
  misc_feature 1..42: note = hyper
  source 1..42: mol_type = genomic DNA
gaggcctgggagggggcgggacaccctcgctgtacattctgg

SEQ ID NO: 58083 - DNA, 865 bp, Homo sapiens; identical to SEQ ID NO: 37473
  misc_feature 1..865: note = chr19:37957671-37958536
  misc_feature 1..865: note = hyper
  source 1..865: mol_type = genomic DNA

SEQ ID NO: 58084 - DNA, 15 bp, Homo sapiens
  misc_feature 1..15: note = chr19:37959786-37959801
  misc_feature 1..15: note = hyper
  source 1..15: mol_type = genomic DNA
cctcccaattttttt

SEQ ID NO: 58085 - DNA, 542 bp, Homo sapiens; identical to SEQ ID NO: 23026
  misc_feature 1..542: note = chr19:37959963-37960505
  misc_feature 1..542: note = hyper
  source 1..542: mol_type = genomic DNA

SEQ ID NO: 58086 - DNA, 30 bp, Homo sapiens; identical to SEQ ID NO: 37476
  misc_feature 1..30: note = chr19:37960799-37960829
  misc_feature 1..30: note = hyper
  source 1..30: mol_type = genomic DNA

SEQ ID NO: 58087 - DNA, 107 bp, Homo sapiens; identical to SEQ ID NO: 37477
  misc_feature 1..107: note = chr19:37997089-37997196
  misc_feature 1..107: note = hyper
  source 1..107: mol_type = genomic DNA

SEQ ID NO: 58088 - DNA, 137 bp, Homo sapiens
  misc_feature 1..137: note = chr19:38042693-38042830
  misc_feature 1..137: note = hyper
  source 1..137: mol_type = genomic DNA
tctgtgtgtgtttctgtgcaagtgttgcatgtctgtgtgtgtggggggggtggtgtctggtgaaaagaatgtgtctcgtgcggtggagcgccgtttctctgtagtccgcgggctctcttatgcgccctcttgtggtc

SEQ ID NO: 58089 - DNA, 40 bp, Homo sapiens; identical to SEQ ID NO: 37481
  misc_feature 1..40: note = chr19:38086122-38086162
  misc_feature 1..40: note = hyper
  source 1..40: mol_type = genomic DNA

SEQ ID NO: 58090 - DNA, 52 bp, Homo sapiens
  misc_feature 1..52: note = chr19:38146010-38146062
  misc_feature 1..52: note = hyper
  source 1..52: mol_type = genomic DNA
cctcttgggccttttcgctacggccgagcctaagtggctgaagcgcggacga

SEQ ID NO: 58091 - DNA, 210 bp, Homo sapiens
  misc_feature 1..210: note = chr19:38146247-38146457
  misc_feature 1..210: note = hyper
  source 1..210: mol_type = genomic DNA
ggcccactccgcgctcttttccctcagaaaagcagcggccacagtggcgcccggctcccagccccagcctcacccgactcagaggatagcccagccctgggagtcagcggcgccagaatacgggagagcgcctgtctccgtcgcgaatgcgctagcgcgcgggggggcggaggcaagtcccgcagctgctccgggccgggaggggcgcgt

SEQ ID NO: 58092 - DNA, 696 bp, Homo sapiens
  misc_feature 1..696: note = chr19:38146568-38147264
  misc_feature 1..696: note = hyper
  source 1..696: mol_type = genomic DNA
ccattaaagataatccaggcctgctcccctgtggacactgcggtccaaaatttaaaaaaacaatattccgcctttttatttttcatttggttctcggctcggagacaggcggaggctgcgagccccgccccgcccccagcgacgcctcaccggaacctttggaaatcggcttctgcctcgagtgcgcaagcgcgcggggggcgaacgctggggcccttcagggagcaagggagaagtgtggggccgcacctgccgaggggtcgggaggtttggaggagggtggaggttggctacaggatcccgatggggatggagtgttcaaatctaggcctgtagccgtgaccctggcgtgagttggatggaggaaaccccagtatcgcgagcctggaccaaggcgcggcgcgtgctgcctgtggtgtttgctgagtgacggccgccgcgcccccgcgtacctggaccgagtgcctggccgctggcggagtagtgtttccgtgcacggggctgctgcgtgcgcgtgtgccgttctctagcgggggattaggatggtgccgcagagaaggctgcgcggtggtgcctgactctgacgctggctgtagcgggtctctggggtctttgcggtttgtgtctgcgtttgtgacgtacctgacatcggatctgtgactgtggctctgcctcatccagcgttatttccagaat

SEQ ID NO: 58093 - DNA, 69 bp, Homo sapiens
  misc_feature 1..69: note = chr19:38182815-38182884
  misc_feature 1..69: note = hyper
  source 1..69: mol_type = genomic DNA
caggtgacgatccctcgcgggcactcactctcgctcacactacaatcagatcctccatgcggctttcat

SEQ ID NO: 58094 - DNA, 175 bp, Homo sapiens
  misc_feature 1..175: note = chr19:38183299-38183474
  misc_feature 1..175: note = hyper
  source 1..175: mol_type = genomic DNA
ggacgcggtagcggagctgctcaaagcgaggtgctcagccctgggaggctcagggctgcccgaggggcttagtcccagagccagtgctgtcaggggctgagcatgtgaatagggcagtcggaagaccatgtgtgtctgtggcttttaaatacaccccgaacgtctatctctttta

SEQ ID NO: 58095 - DNA, 141 bp, Homo sapiens; identical to SEQ ID NO: 37487
  misc_feature 1..141: note = chr19:38210017-38210158
  misc_feature 1..141: note = hyper
  source 1..141: mol_type = genomic DNA

SEQ ID NO: 58096 - DNA, 180 bp, Homo sapiens; identical to SEQ ID NO: 37488
  misc_feature 1..180: note = chr19:38210571-38210751
  misc_feature 1..180: note = hyper
  source 1..180: mol_type = genomic DNA

SEQ ID NO: 58097 - DNA, 73 bp, Homo sapiens
  misc_feature 1..73: note = chr19:38308466-38308539
  misc_feature 1..73: note = hyper
  source 1..73: mol_type = genomic DNA
gtaacctggatgtgcagtgcgtgtcctttgcaaagcgtgcgttgctgtggctccgtggcgtcagcaacccttc

SEQ ID NO: 58098 - DNA, 30 bp, Homo sapiens; identical to SEQ ID NO: 13381
  misc_feature 1..30: note = chr19:38701199-38701229
  misc_feature 1..30: note = hyper
  source 1..30: mol_type = genomic DNA

SEQ ID NO: 58099 - DNA, 500 bp, Homo sapiens; identical to SEQ ID NO: 13382
  misc_feature 1..500: note = chr19:38701550-38702050
  misc_feature 1..500: note = hyper
  source 1..500: mol_type = genomic DNA

SEQ ID NO: 58100 - DNA, 92 bp, Homo sapiens; identical to SEQ ID NO: 37493
  misc_feature 1..92: note = chr19:38718791-38718883
  misc_feature 1..92: note = hyper
  source 1..92: mol_type = genomic DNA

SEQ ID NO: 58101 - DNA, 310 bp, Homo sapiens; identical to SEQ ID NO: 37494
  misc_feature 1..310: note = chr19:38746768-38747078
  misc_feature 1..310: note = hyper
  source 1..310: mol_type = genomic DNA

SEQ ID NO: 58102 - DNA, 53 bp, Homo sapiens; identical to SEQ ID NO: 23035
  misc_feature 1..53: note = chr19:38747106-38747159
  misc_feature 1..53: note = hyper
  source 1..53: mol_type = genomic DNA

SEQ ID NO: 58103 - DNA, 68 bp, Homo sapiens; identical to SEQ ID NO: 37497
  misc_feature 1..68: note = chr19:38853068-38853136
  misc_feature 1..68: note = hyper
  source 1..68: mol_type = genomic DNA

SEQ ID NO: 58104 - DNA, 339 bp, Homo sapiens; identical to SEQ ID NO: 37498
  misc_feature 1..339: note = chr19:38877688-38878027
  misc_feature 1..339: note = hyper
  source 1..339: mol_type = genomic DNA

SEQ ID NO: 58105 - DNA, 35 bp, Homo sapiens; identical to SEQ ID NO: 37499
  misc_feature 1..35: note = chr19:38879840-38879875
  misc_feature 1..35: note = hyper
  source 1..35: mol_type = genomic DNA

SEQ ID NO: 58106 - DNA, 170 bp, Homo sapiens; identical to SEQ ID NO: 37500
  misc_feature 1..170: note = chr19:38924266-38924436
  misc_feature 1..170: note = hyper
  source 1..170: mol_type = genomic DNA

SEQ ID NO: 58107 - DNA, 95 bp, Homo sapiens; identical to SEQ ID NO: 13388
  misc_feature 1..95: note = chr19:38924437-38924532
  misc_feature 1..95: note = hyper
  source 1..95: mol_type = genomic DNA

SEQ ID NO: 58108 - DNA, 85 bp, Homo sapiens; identical to SEQ ID NO: 37502
  misc_feature 1..85: note = chr19:39282953-39283038
  misc_feature 1..85: note = hyper
  source 1..85: mol_type = genomic DNA

SEQ ID NO: 58109 - DNA, 86 bp, Homo sapiens; identical to SEQ ID NO: 37503
  misc_feature 1..86: note = chr19:39283060-39283146
  misc_feature 1..86: note = hyper
  source 1..86: mol_type = genomic DNA

SEQ ID NO: 58110 - DNA, 362 bp, Homo sapiens; identical to SEQ ID NO: 37504
  misc_feature 1..362: note = chr19:39466200-39466562
  misc_feature 1..362: note = hyper
  source 1..362: mol_type = genomic DNA

SEQ ID NO: 58111 - DNA, 92 bp, Homo sapiens; identical to SEQ ID NO: 37505
  misc_feature 1..92: note = chr19:39522783-39522875
  misc_feature 1..92: note = hyper
  source 1..92: mol_type = genomic DNA

SEQ ID NO: 58112 - DNA, 118 bp, Homo sapiens; identical to SEQ ID NO: 37506
  misc_feature 1..118: note = chr19:39589701-39589819
  misc_feature 1..118: note = hyper
  source 1..118: mol_type = genomic DNA

SEQ ID NO: 58113 - DNA, 56 bp, Homo sapiens; identical to SEQ ID NO: 37507
  misc_feature 1..56: note = chr19:39687591-39687647
  misc_feature 1..56: note = hyper
  source 1..56: mol_type = genomic DNA

SEQ ID NO: 58114 - DNA, 133 bp, Homo sapiens
  misc_feature 1..133: note = chr19:39687844-39687977
  misc_feature 1..133: note = hyper
  source 1..133: mol_type = genomic DNA
gaggagtgggggccgctgagcgggggcctggagctgccccagcgcctcacctggaagctgctcctgttgcggcggccgctctaccgcaacctgctgcgctcgcccaaccccgaaggtgcgcaagggcccagag

SEQ ID NO: 58115 - DNA, 153 bp, Homo sapiens
  misc_feature 1..153: note = chr19:39755358-39755511
  misc_feature 1..153: note = hyper
  source 1..153: mol_type = genomic DNA
agtcacaaaaggagccctgcagggcggactcggctccaggtcgcgggcgcagggctatgccgggggagagcgggatgcaattcaaccctggttcacgccttcggggagctccctggttcagtacacgacaggcacgaccgtacgctgccagta

SEQ ID NO: 58116 - DNA, 415 bp, Homo sapiens; identical to SEQ ID NO: 37511
  misc_feature 1..415: note = chr19:39989727-39990142
  misc_feature 1..415: note = hyper
  source 1..415: mol_type = genomic DNA

SEQ ID NO: 58117 - DNA, 78 bp, Homo sapiens
  misc_feature 1..78: note = chr19:39993399-39993477
  misc_feature 1..78: note = hyper
  source 1..78: mol_type = genomic DNA
gcatccatgttcggccgggcccaccccagcacccctcctttgcctgtcctcgcagggcccgcctggagcctgctggcg

SEQ ID NO: 58118 - DNA, 270 bp, Homo sapiens
  misc_feature 1..270: note = chr19:39997813-39998083
  misc_feature 1..270: note = hyper
  source 1..270: mol_type = genomic DNA
gcggcgcgcaccgctgctcctgcgcgctgggcttcggcggccgcgactgccgcgagcgcgcggacccgtgcgccgcgcgcccctgtgctcacggcggccgctgctacgcccacttctccggcctcgtctgcgcttgcgctcccggctacatgggagcgcggtgtgagttcccagtgcaccccgacggcgcaagcgccttgcccgcggccccgccgggcctcaggcccggggaccctcagcgctaccttttgcctccggctctgggactgc

SEQ ID NO: 58119 - DNA, 150 bp, Homo sapiens; identical to SEQ ID NO: 37515
  misc_feature 1..150: note = chr19:40005754-40005904
  misc_feature 1..150: note = hyper
  source 1..150: mol_type = genomic DNA

SEQ ID NO: 58120 - DNA, 142 bp, Homo sapiens
  misc_feature 1..142: note = chr19:40006306-40006448
  misc_feature 1..142: note = hyper
  source 1..142: mol_type = genomic DNA
atccgcccccggaacctgctccggagctgcctttgttgcccgaggaggaccctgagccggcgccgagcctgaagctcatcccgtcggtctccagcgaggccgggcccgccccggggccccttcccacgcgcaccccgctggc

SEQ ID NO: 58121 - DNA, 78 bp, Homo sapiens
  misc_feature 1..78: note = chr19:40006498-40006576
  misc_feature 1..78: note = hyper
  source 1..78: mol_type = genomic DNA
cggccatcgggctggcggatccccccattcccagtcctgtcccctcgcccatcctggggaccatcccgtcggccatct

SEQ ID NO: 58122 - DNA, 23 bp, Homo sapiens
  misc_feature 1..23: note = chr19:40006639-40006662
  misc_feature 1..23: note = hyper
  source 1..23: mol_type = genomic DNA
tcctgattcgagtgacctactgg

SEQ ID NO: 58123 - DNA, 204 bp, Homo sapiens; identical to SEQ ID NO: 37518
  misc_feature 1..204: note = chr19:40324814-40325018
  misc_feature 1..204: note = hyper
  source 1..204: mol_type = genomic DNA

SEQ ID NO: 58124 - DNA, 55 bp, Homo sapiens
  misc_feature 1..55: note = chr19:40723945-40724000
  misc_feature 1..55: note = hyper
  source 1..55: mol_type = genomic DNA
tggtgggcccgggggcgggggcgggcaggccgctagggcgggccccctgcgccgc

SEQ ID NO: 58125 - DNA, 171 bp, Homo sapiens
  misc_feature 1..171: note = chr19:40724263-40724434
  misc_feature 1..171: note = hyper
  source 1..171: mol_type = genomic DNA
ccggggacagcgcgccgcgctgcattgtgggaaactcctgccgccgccgctgcagctaccgcatcgccccccgcggggctggtccccaccctttctccgccccctcacctccggcagccgactccggctgccccctatgggtctagggaaacccctcgagacttcccccat

SEQ ID NO: 58126 - DNA, 15 bp, Homo sapiens
  misc_feature 1..15: note = chr19:41019048-41019063
  misc_feature 1..15: note = hyper
  source 1..15: mol_type = genomic DNA
ctgctggactggctt

SEQ ID NO: 58127 - DNA, 47 bp, Homo sapiens; identical to SEQ ID NO: 37522
  misc_feature 1..47: note = chr19:41019075-41019122
  misc_feature 1..47: note = hyper
  source 1..47: mol_type = genomic DNA

SEQ ID NO: 58128 - DNA, 160 bp, Homo sapiens; identical to SEQ ID NO: 23050
  misc_feature 1..160: note = chr19:41025379-41025539
  misc_feature 1..160: note = hyper
  source 1..160: mol_type = genomic DNA

SEQ ID NO: 58129 - DNA, 218 bp, Homo sapiens
  misc_feature 1..218: note = chr19:41025683-41025901
  misc_feature 1..218: note = hyper
  source 1..218: mol_type = genomic DNA
ctacatgacctcgacgctttcctggactggctcgtgcgcgcccaggaggcggcgggcggcagcgaggggcccctgcccaacagcctagaagaggcggacgcgctgctggcgcgccacgctgcgctcaaggaggaggtggaccagcgcgaggaagactatgctcgcatcgtggcggccagcgaggcgctgctggccgccgacggcgcagagctgggccc

SEQ ID NO: 58130 - DNA, 48 bp, Homo sapiens; identical to SEQ ID NO: 37524
  misc_feature 1..48: note = chr19:41055131-41055179
  misc_feature 1..48: note = hyper
  source 1..48: mol_type = genomic DNA

SEQ ID NO: 58131 - DNA, 47 bp, Homo sapiens
  misc_feature 1..47: note = chr19:41060306-41060353
  misc_feature 1..47: note = hyper
  source 1..47: mol_type = genomic DNA
catgatgagtgaggacaagggcaaggtgcgcccgagctgggggtgcg

SEQ ID NO: 58132 - DNA, 32 bp, Homo sapiens
  misc_feature 1..32: note = chr19:41073555-41073587
  misc_feature 1..32: note = hyper
  source 1..32: mol_type = genomic DNA
cctccatcctcagatcgagaaaatcaaagcgg

SEQ ID NO: 58133 - DNA, 181 bp, Homo sapiens
  misc_feature 1..181: note = chr19:41073677-41073858
  misc_feature 1..181: note = hyper
  source 1..181: mol_type = genomic DNA
ggccagggggctatgaaaggggcttggagcccctggcccgccgagcctcggacacgctctcggccgaggtgcggactcgggtggggtatgtgcgccaggagctcaagcccgagcgcctccagccgcgcattgaccggctgccggagatcccggggagggtggagcccgcggccctgccggc

SEQ ID NO: 58134 - DNA, 132 bp, Homo sapiens; identical to SEQ ID NO: 37527
  misc_feature 1..132: note = chr19:41074018-41074150
  misc_feature 1..132: note = hyper
  source 1..132: mol_type = genomic DNA

SEQ ID NO: 58135 - DNA, 43 bp, Homo sapiens; identical to SEQ ID NO: 37528
  misc_feature 1..43: note = chr19:41102899-41102942
  misc_feature 1..43: note = hyper
  source 1..43: mol_type = genomic DNA

SEQ ID NO: 58136 - DNA, 13 bp, Homo sapiens
  misc_feature 1..13: note = chr19:41105989-41106002
  misc_feature 1..13: note = hyper
  source 1..13: mol_type = genomic DNA
gctctactgaagc

SEQ ID NO: 58137 - DNA, 69 bp, Homo sapiens; identical to SEQ ID NO: 37530
  misc_feature 1..69: note = chr19:41106351-41106420
  misc_feature 1..69: note = hyper
  source 1..69: mol_type = genomic DNA

SEQ ID NO: 58138 - DNA, 21 bp, Homo sapiens
  misc_feature 1..21: note = chr19:41119669-41119690
  misc_feature 1..21: note = hyper
  source 1..21: mol_type = genomic DNA
ggggggcggtgtttgcaggga

SEQ ID NO: 58139 - DNA, 59 bp, Homo sapiens; identical to SEQ ID NO: 13408
  misc_feature 1..59: note = chr19:41354396-41354455
  misc_feature 1..59: note = hyper
  source 1..59: mol_type = genomic DNA

SEQ ID NO: 58140 - DNA, 91 bp, Homo sapiens; identical to SEQ ID NO: 23055
  misc_feature 1..91: note = chr19:41354575-41354666
  misc_feature 1..91: note = hyper
  source 1..91: mol_type = genomic DNA

SEQ ID NO: 58141 - DNA, 85 bp, Homo sapiens
  misc_feature 1..85: note = chr19:41354722-41354807
  misc_feature 1..85: note = hyper
  source 1..85: mol_type = genomic DNA
cggagcagctccaaggggctccccaagggtggaggagagagggagtagggtgggagagagatggattcagcgccattgcccagca

SEQ ID NO: 58142 - DNA, 75 bp, Homo sapiens; identical to SEQ ID NO: 37535
  misc_feature 1..75: note = chr19:41596078-41596153
  misc_feature 1..75: note = hyper
  source 1..75: mol_type = genomic DNA

SEQ ID NO: 58143 - DNA, 105 bp, Homo sapiens; identical to SEQ ID NO: 23058
  misc_feature 1..105: note = chr19:41641726-41641831
  misc_feature 1..105: note = hyper
  source 1..105: mol_type = genomic DNA

SEQ ID NO: 58144 - DNA, 25 bp, Homo sapiens
  misc_feature 1..25: note = chr19:41641886-41641911
  misc_feature 1..25: note = hyper
  source 1..25: mol_type = genomic DNA
cctcctttcccgtccccaccacagg

SEQ ID NO: 58145 - DNA, 219 bp, Homo sapiens; identical to SEQ ID NO: 23060
  misc_feature 1..219: note = chr19:42028283-42028502
  misc_feature 1..219: note = hyper
  source 1..219: mol_type = genomic DNA

SEQ ID NO: 58146 - DNA, 193 bp, Homo sapiens; identical to SEQ ID NO: 23061
  misc_feature 1..193: note = chr19:42028549-42028742
  misc_feature 1..193: note = hyper
  source 1..193: mol_type = genomic DNA

SEQ ID NO: 58147 - DNA, 46 bp, Homo sapiens; identical to SEQ ID NO: 37538
  misc_feature 1..46: note = chr19:42419428-42419474
  misc_feature 1..46: note = hyper
  source 1..46: mol_type = genomic DNA

SEQ ID NO: 58148 - DNA, 60 bp, Homo sapiens; identical to SEQ ID NO: 37539
  misc_feature 1..60: note = chr19:42445049-42445109
  misc_feature 1..60: note = hyper
  source 1..60: mol_type = genomic DNA

SEQ ID NO: 58149 - DNA, 115 bp, Homo sapiens; identical to SEQ ID NO: 37540
  misc_feature 1..115: note = chr19:42574036-42574151
  misc_feature 1..115: note = hyper
  source 1..115: mol_type = genomic DNA

SEQ ID NO: 58150 - DNA, 221 bp, Homo sapiens; identical to SEQ ID NO: 37541
  misc_feature 1..221: note = chr19:42636368-42636589
  misc_feature 1..221: note = hyper
  source 1..221: mol_type = genomic DNA

SEQ ID NO: 58151 - DNA, 116 bp, Homo sapiens; identical to SEQ ID NO: 37542
  misc_feature 1..116: note = chr19:42683705-42683821
  misc_feature 1..116: note = hyper
  source 1..116: mol_type = genomic DNA

SEQ ID NO: 58152 - DNA, 42 bp, Homo sapiens; identical to SEQ ID NO: 37543
  misc_feature 1..42: note = chr19:42774775-42774817
  misc_feature 1..42: note = hyper
  source 1..42: mol_type = genomic DNA

SEQ ID NO: 58153 - DNA, 184 bp, Homo sapiens; identical to SEQ ID NO: 37545
  misc_feature 1..184: note = chr19:42828316-42828500
  misc_feature 1..184: note = hyper
  source 1..184: mol_type = genomic DNA

SEQ ID NO: 58154 - DNA, 114 bp, Homo sapiens; identical to SEQ ID NO: 37546
  misc_feature 1..114: note = chr19:42905723-42905837
  misc_feature 1..114: note = hyper
  source 1..114: mol_type = genomic DNA

SEQ ID NO: 58155 - DNA, 68 bp, Homo sapiens; identical to SEQ ID NO: 13416
  misc_feature 1..68: note = chr19:42906129-42906197
  misc_feature 1..68: note = hyper
  source 1..68: mol_type = genomic DNA

SEQ ID NO: 58156 - DNA, 54 bp, Homo sapiens; identical to SEQ ID NO: 37548
  misc_feature 1..54: note = chr19:42927424-42927478
  misc_feature 1..54: note = hyper
  source 1..54: mol_type = genomic DNA

SEQ ID NO: 58157 - DNA, 238 bp, Homo sapiens; identical to SEQ ID NO: 37549
  misc_feature 1..238: note = chr19:42928122-42928360
  misc_feature 1..238: note = hyper
  source 1..238: mol_type = genomic DNA

SEQ ID NO: 58158 - DNA, 140 bp, Homo sapiens; identical to SEQ ID NO: 37550
  misc_feature 1..140: note = chr19:44203673-44203813
  misc_feature 1..140: note = hyper
  source 1..140: mol_type = genomic DNA

SEQ ID NO: 58159 - DNA, 229 bp, Homo sapiens; identical to SEQ ID NO: 37551
  misc_feature 1..229: note = chr19:44302881-44303110
  misc_feature 1..229: note = hyper
  source 1..229: mol_type = genomic DNA

SEQ ID NO: 58160 - DNA, 61 bp, Homo sapiens; identical to SEQ ID NO: 37552
  misc_feature 1..61: note = chr19:44324840-44324901
  misc_feature 1..61: note = hyper
  source 1..61: mol_type = genomic DNA

SEQ ID NO: 58161 - DNA, 15 bp, Homo sapiens
  misc_feature 1..15: note = chr19:44324902-44324917
  misc_feature 1..15: note = hyper
  source 1..15: mol_type = genomic DNA
cgtcccaagggtttc

SEQ ID NO: 58162 - DNA, 46 bp, Homo sapiens; identical to SEQ ID NO: 37556
  misc_feature 1..46: note = chr19:44455621-44455667
  misc_feature 1..46: note = hyper
  source 1..46: mol_type = genomic DNA

SEQ ID NO: 58163 - DNA, 110 bp, Homo sapiens; identical to SEQ ID NO: 37557
  misc_feature 1..110: note = chr19:44488496-44488606
  misc_feature 1..110: note = hyper
  source 1..110: mol_type = genomic DNA

SEQ ID NO: 58164 - DNA, 431 bp, Homo sapiens; identical to SEQ ID NO: 37558
  misc_feature 1..431: note = chr19:44711532-44711963
  misc_feature 1..431: note = hyper
  source 1..431: mol_type = genomic DNA

SEQ ID NO: 58165 - DNA, 83 bp, Homo sapiens
  misc_feature 1..83: note = chr19:44905416-44905499
  misc_feature 1..83: note = hyper
  source 1..83: mol_type = genomic DNA
actgaccctaagcttcgacccgaagaggcacagcgcaagtcgctgtcacgaaacgtgaagatgcactgttttgtcaaacccag

SEQ ID NO: 58166 - DNA, 82 bp, Homo sapiens
  misc_feature 1..82: note = chr19:44905529-44905611
  misc_feature 1..82: note = hyper
  source 1..82: mol_type = genomic DNA
gcccacgctcttcccatcctatcccgggtaggtcgggccgctgaacttccctagtctaccccacctacgaggccttatcatt

SEQ ID NO: 58167 - DNA, 45 bp, Homo sapiens
  misc_feature 1..45: note = chr19:45300099-45300144
  misc_feature 1..45: note = hyper
  source 1..45: mol_type = genomic DNA
acagctcaggaagtccgggaacattattcgaccacagcaaacaag

SEQ ID NO: 58168 - DNA, 31 bp, Homo sapiens; identical to SEQ ID NO: 23070
  misc_feature 1..31: note = chr19:45656363-45656394
  misc_feature 1..31: note = hyper
  source 1..31: mol_type = genomic DNA

SEQ ID NO: 58169 - DNA, 21 bp, Homo sapiens
  misc_feature 1..21: note = chr19:45656661-45656682
  misc_feature 1..21: note = hyper
  source 1..21: mol_type = genomic DNA
gcagccccaggcacacgcggc

SEQ ID NO: 58170 - DNA, 48 bp, Homo sapiens
  misc_feature 1..48: note = chr19:45656913-45656961
  misc_feature 1..48: note = hyper
  source 1..48: mol_type = genomic DNA
gcaggaacaccaggtaccacagtagctgcgggacgccccagccgctca

SEQ ID NO: 58171 - DNA, 35 bp, Homo sapiens; identical to SEQ ID NO: 23072
  misc_feature 1..35: note = chr19:45657177-45657212
  misc_feature 1..35: note = hyper
  source 1..35: mol_type = genomic DNA

SEQ ID NO: 58172 - DNA, 57 bp, Homo sapiens
  misc_feature 1..57: note = chr19:45657284-45657341
  misc_feature 1..57: note = hyper
  source 1..57: mol_type = genomic DNA
tagagccggcagaggagagatgggaggaggcaaaaagagatacgaggaagagccagg

SEQ ID NO: 58173 - DNA, 30 bp, Homo sapiens; identical to SEQ ID NO: 13431
  misc_feature 1..30: note = chr19:45755404-45755434
  misc_feature 1..30: note = hyper
  source 1..30: mol_type = genomic DNA

SEQ ID NO: 58174 - DNA, 472 bp, Homo sapiens; identical to SEQ ID NO: 37570
  misc_feature 1..472: note = chr19:45826794-45827266
  misc_feature 1..472: note = hyper
  source 1..472: mol_type = genomic DNA

SEQ ID NO: 58175 - DNA, 109 bp, Homo sapiens
  misc_feature 1..109: note = chr19:45888837-45888946
  misc_feature 1..109: note = hyper
  source 1..109: mol_type = genomic DNA
agtcagcataaccctcgcggtaagggtcgcacttctcgaaggcggtggcgccgtcgctgagcgtggtggcgaagattgcagcgccgtgctgcaccagcgccatgcagat

SEQ ID NO: 58176 - skipped

SEQ ID NO: 58177 - DNA, 58 bp, Homo sapiens; identical to SEQ ID NO: 37573
  misc_feature 1..58: note = chr19:45931217-45931275
  misc_feature 1..58: note = hyper
  source 1..58: mol_type = genomic DNA

SEQ ID NO: 58178 - DNA, 329 bp, Homo sapiens
  misc_feature 1..329: note = chr19:46001719-46002048
  misc_feature 1..329: note = hyper
  source 1..329: mol_type = genomic DNA
agggctgaaggatggcggtcctggcccgccagctgcagcgtctcctctggaccgcttgcaagaaaaaggagagggagaaggaggggagggaggaagaggaggaggaggaggcggggcgcagggcccccgaagggcctcggtctctgttgacagcgccgcgccgcgcccagcggccgcacgggggtgccgaggcgtctgggggcctgcgcttcggggcgagcgcagcgcaaggctggcgcgcgcgcatggaggatgctcactgcacttggctttcgttacctggtctgcccccgggctgggccttgtttgccgtcctcgacggccacggt

SEQ ID NO: 58179 - DNA, 33 bp, Homo sapiens; identical to SEQ ID NO: 23076
  misc_feature 1..33: note = chr19:46002320-46002353
  misc_feature 1..33: note = hyper
  source 1..33: mol_type = genomic DNA

SEQ ID NO: 58180 - DNA, 91 bp, Homo sapiens; identical to SEQ ID NO: 37575
  misc_feature 1..91: note = chr19:46105207-46105298
  misc_feature 1..91: note = hyper
  source 1..91: mol_type = genomic DNA

SEQ ID NO: 58181 - DNA, 34 bp, Homo sapiens; identical to SEQ ID NO: 37576
  misc_feature 1..34: note = chr19:46148823-46148857
  misc_feature 1..34: note = hyper
  source 1..34: mol_type = genomic DNA

SEQ ID NO: 58182 - DNA, 65 bp, Homo sapiens; identical to SEQ ID NO: 37577
  misc_feature 1..65: note = chr19:46173896-46173961
  misc_feature 1..65: note = hyper
  source 1..65: mol_type = genomic DNA

SEQ ID NO: 58183 - DNA, 113 bp, Homo sapiens; identical to SEQ ID NO: 37578
  misc_feature 1..113: note = chr19:46180359-46180472
  misc_feature 1..113: note = hyper
  source 1..113: mol_type = genomic DNA

SEQ ID NO: 58184 - DNA, 21 bp, Homo sapiens
  misc_feature 1..21: note = chr19:46283058-46283079
  misc_feature 1..21: note = hyper
  source 1..21: mol_type = genomic DNA
tcaccttcagaatctcgaagt

SEQ ID NO: 58185 - DNA, 21 bp, Homo sapiens
  misc_feature 1..21: note = chr19:46379893-46379914
  misc_feature 1..21: note = hyper
  source 1..21: mol_type = genomic DNA
cgccttgccggctgcgtgtca

SEQ ID NO: 58186 - DNA, 229 bp, Homo sapiens
  misc_feature 1..229: note = chr19:46380148-46380377
  misc_feature 1..229: note = hyper
  source 1..229: mol_type = genomic DNA
gcccccgccccccggccaacagcccaaatattattccgcgggaggagtcggtggtggcgggaggaggcccaggctgaaagaggctttcagggcggccaggcctggggcttcctgtccccaggctcgggcctcaggccgccccagtggggacctcaggtggccggaggggcggggtgttgttgtagggtcctcgggggagggtggggccatccgtcggggtgtctggtgg

SEQ ID NO: 58187 - DNA, 117 bp, Homo sapiens; identical to SEQ ID NO: 37581
  misc_feature 1..117: note = chr19:46476943-46477060
  misc_feature 1..117: note = hyper
  source 1..117: mol_type = genomic DNA

SEQ ID NO: 58188 - DNA, 354 bp, Homo sapiens; identical to SEQ ID NO: 37582
  misc_feature 1..354: note = chr19:46477118-46477472
  misc_feature 1..354: note = hyper
  source 1..354: mol_type = genomic DNA

SEQ ID NO: 58189 - DNA, 259 bp, Homo sapiens; identical to SEQ ID NO: 37583
  misc_feature 1..259: note = chr19:46519255-46519514
  misc_feature 1..259: note = hyper
  source 1..259: mol_type = genomic DNA

SEQ ID NO: 58190 - DNA, 30 bp, Homo sapiens; identical to SEQ ID NO: 37584
  misc_feature 1..30: note = chr19:46907252-46907282
  misc_feature 1..30: note = hyper
  source 1..30: mol_type = genomic DNA

SEQ ID NO: 58191 - DNA, 215 bp, Homo sapiens; identical to SEQ ID NO: 37585
  misc_feature 1..215: note = chr19:46907501-46907716
  misc_feature 1..215: note = hyper
  source 1..215: mol_type = genomic DNA

SEQ ID NO: 58192 - DNA, 30 bp, Homo sapiens; identical to SEQ ID NO: 37586
  misc_feature 1..30: note = chr19:46908092-46908122
  misc_feature 1..30: note = hyper
  source 1..30: mol_type = genomic DNA

SEQ ID NO: 58193 - DNA, 153 bp, Homo sapiens
  misc_feature 1..153: note = chr19:46916572-46916725
  misc_feature 1..153: note = hyper
  source 1..153: mol_type = genomic DNA
agctccaagttggggcgcgcgggctgccagcgactcttcctgccccaggccccagggacgcggctggaacttgggacaggacttcgcagacaaagacggtccagtcgaagctattcaatatggccgaggcgctgggaggccccagcccgggcc

SEQ ID NO: 58194 - DNA, 103 bp, Homo sapiens
  misc_feature 1..103: note = chr19:46930026-46930129
  misc_feature 1..103: note = hyper
  source 1..103: mol_type = genomic DNA
attttctgcaaagggcgcaggcgcctggggtcagcctgtggtctccatagcaacggtcggacgcgctgctaggttctggctctgactgcgcctgcgcggctgg

SEQ ID NO: 58195 - DNA, 275 bp, Homo sapiens; identical to SEQ ID NO: 37590
  misc_feature 1..275: note = chr19:46932061-46932336
  misc_feature 1..275: note = hyper
  source 1..275: mol_type = genomic DNA

SEQ ID NO: 58196 - DNA, 52 bp, Homo sapiens
  misc_feature 1..52: note = chr19:46974500-46974552
  misc_feature 1..52: note = hyper
  source 1..52: mol_type = genomic DNA
gccccggtgctcacacgtgtccctgaatctgcagcaaaaggccctaggaccc

SEQ ID NO: 58197 - DNA, 143 bp, Homo sapiens
  misc_feature 1..143: note = chr19:46992866-46993009
  misc_feature 1..143: note = hyper
  source 1..143: mol_type = genomic DNA
gagggggcaaccgcgctccgctccacccgtcgccagaggctccacgcgcgggacagacccggctgctgcagcctgtgctggtctctgtgcaccgggacccttccctgcaggatctcaaggcctttacgcggctgctccttcga

SEQ ID NO: 58198 - DNA, 45 bp, Homo sapiens; identical to SEQ ID NO: 37597
  misc_feature 1..45: note = chr19:47143100-47143145
  misc_feature 1..45: note = hyper
  source 1..45: mol_type = genomic DNA

SEQ ID NO: 58199 - DNA, 170 bp, Homo sapiens; identical to SEQ ID NO: 37599
  misc_feature 1..170: note = chr19:47523113-47523283
  misc_feature 1..170: note = hyper
  source 1..170: mol_type = genomic DNA

SEQ ID NO: 58200 - DNA, 162 bp, Homo sapiens; identical to SEQ ID NO: 37600
  misc_feature 1..162: note = chr19:47523562-47523724
  misc_feature 1..162: note = hyper
  source 1..162: mol_type = genomic DNA

SEQ ID NO: 58201 - DNA, 162 bp, Homo sapiens; identical to SEQ ID NO: 37601
  misc_feature 1..162: note = chr19:47524772-47524934
  misc_feature 1..162: note = hyper
  source 1..162: mol_type = genomic DNA

SEQ ID NO: 58202 - DNA, 202 bp, Homo sapiens; identical to SEQ ID NO: 37602
  misc_feature 1..202: note = chr19:47742701-47742903
  misc_feature 1..202: note = hyper
  source 1..202: mol_type = genomic DNA

SEQ ID NO: 58203 - DNA, 30 bp, Homo sapiens; identical to SEQ ID NO: 37603
  misc_feature 1..30: note = chr19:47746438-47746468
  misc_feature 1..30: note = hyper
  source 1..30: mol_type = genomic DNA

SEQ ID NO: 58204 - skipped

SEQ ID NO: 58205 - DNA, 57 bp, Homo sapiens; identical to SEQ ID NO: 37605
  misc_feature 1..57: note = chr19:47921726-47921783
  misc_feature 1..57: note = hyper
  source 1..57: mol_type = genomic DNA

SEQ ID NO: 58206 - DNA, 39 bp, Homo sapiens; identical to SEQ ID NO: 37606
  misc_feature 1..39: note = chr19:47925553-47925592
  misc_feature 1..39: note = hyper
  source 1..39: mol_type = genomic DNA

SEQ ID NO: 58207 - DNA, 111 bp, Homo sapiens; identical to SEQ ID NO: 23087
  misc_feature 1..111: note = chr19:47933200-47933311
  misc_feature 1..111: note = hyper
  source 1..111: mol_type = genomic DNA

SEQ ID NO: 58208 - DNA, 41 bp, Homo sapiens
  misc_feature 1..41: note = chr19:47933732-47933773
  misc_feature 1..41: note = hyper
  source 1..41: mol_type = genomic DNA
gagacatacaggtcggaggggctttgcgccgccacccacag

SEQ ID NO: 58209 - DNA, 143 bp, Homo sapiens; identical to SEQ ID NO: 37608
  misc_feature 1..143: note = chr19:47960799-47960942
  misc_feature 1..143: note = hyper
  source 1..143: mol_type = genomic DNA

SEQ ID NO: 58210 - DNA, 177 bp, Homo sapiens
  misc_feature 1..177: note = chr19:48076465-48076642
  misc_feature 1..177: note = hyper
  source 1..177: mol_type = genomic DNA
cacgcgcggcgcaggcgcgcgtacgtgaccgcgggccgcctcacgcctcccagagcggcctcgcgcgtgcctcctggccgcgcgctctcggctgcttctccgaggggcggggcttgccgcgggcgggaaaggaggcggttggtcgccattttgggagggggcggttgagggcggaga

SEQ ID NO: 58211 - DNA, 49 bp, Homo sapiens; identical to SEQ ID NO: 37610
  misc_feature 1..49: note = chr19:48774925-48774974
  misc_feature 1..49: note = hyper
  source 1..49: mol_type = genomic DNA

SEQ ID NO: 58212 - DNA, 41 bp, Homo sapiens; identical to SEQ ID NO: 37611
  misc_feature 1..41: note = chr19:48775188-48775229
  misc_feature 1..41: note = hyper
  source 1..41: mol_type = genomic DNA

SEQ ID NO: 58213 - DNA, 32 bp, Homo sapiens; identical to SEQ ID NO: 37612
  misc_feature 1..32: note = chr19:48867764-48867796
  misc_feature 1..32: note = hyper
  source 1..32: mol_type = genomic DNA

SEQ ID NO: 58214 - DNA, 231 bp, Homo sapiens; identical to SEQ ID NO: 37613
  misc_feature 1..231: note = chr19:48901882-48902113
  misc_feature 1..231: note = hyper
  source 1..231: mol_type = genomic DNA

SEQ ID NO: 58215 - DNA, 85 bp, Homo sapiens; identical to SEQ ID NO: 37615
  misc_feature 1..85: note = chr19:48918604-48918689
  misc_feature 1..85: note = hyper
  source 1..85: mol_type = genomic DNA

SEQ ID NO: 58216 - DNA, 14 bp, Homo sapiens
  misc_feature 1..14: note = chr19:48947361-48947375
  misc_feature 1..14: note = hyper
  source 1..14: mol_type = genomic DNA
ggagaggatttggt

SEQ ID NO: 58217 - DNA, 42 bp, Homo sapiens; identical to SEQ ID NO: 37617
  misc_feature 1..42: note = chr19:48994825-48994867
  misc_feature 1..42: note = hyper
  source 1..42: mol_type = genomic DNA

SEQ ID NO: 58218 - DNA, 105 bp, Homo sapiens
  misc_feature 1..105: note = chr19:49127674-49127779
  misc_feature 1..105: note = hyper
  source 1..105: mol_type = genomic DNA
gaggacccggcgtgtgaggagggtgcgggggtcggggcagggaccggagtctaggggactgagggaccaagaggaacagagactcaggcccgggactggggcacc

SEQ ID NO: 58219 - DNA, 184 bp, Homo sapiens; identical to SEQ ID NO: 37619
  misc_feature 1..184: note = chr19:49242534-49242718
  misc_feature 1..184: note = hyper
  source 1..184: mol_type = genomic DNA

SEQ ID NO: 58220 - DNA, 39 bp, Homo sapiens; identical to SEQ ID NO: 23093
  misc_feature 1..39: note = chr19:49399310-49399349
  misc_feature 1..39: note = hyper
  source 1..39: mol_type = genomic DNA

SEQ ID NO: 58221 - DNA, 105 bp, Homo sapiens; identical to SEQ ID NO: 37621
  misc_feature 1..105: note = chr19:49560299-49560404
  misc_feature 1..105: note = hyper
  source 1..105: mol_type = genomic DNA

SEQ ID NO: 58222 - DNA, 30 bp, Homo sapiens; identical to SEQ ID NO: 37622
  misc_feature 1..30: note = chr19:49649675-49649705
  misc_feature 1..30: note = hyper
  source 1..30: mol_type = genomic DNA

SEQ ID NO: 58223 - DNA, 30 bp, Homo sapiens; identical to SEQ ID NO: 37623
  misc_feature 1..30: note = chr19:49652144-49652174
  misc_feature 1..30: note = hyper
  source 1..30: mol_type = genomic DNA

SEQ ID NO: 58224 - DNA, 109 bp, Homo sapiens; identical to SEQ ID NO: 37624
  misc_feature 1..109: note = chr19:49924453-49924562
  misc_feature 1..109: note = hyper
  source 1..109: mol_type = genomic DNA

SEQ ID NO: 58225 - DNA, 445 bp, Homo sapiens; identical to SEQ ID NO: 37625
  misc_feature 1..445: note = chr19:49925697-49926142
  misc_feature 1..445: note = hyper
  source 1..445: mol_type = genomic DNA

SEQ ID NO: 58226 - DNA, 34 bp, Homo sapiens; identical to SEQ ID NO: 37626
  misc_feature 1..34: note = chr19:49926495-49926529
  misc_feature 1..34: note = hyper
  source 1..34: mol_type = genomic DNA

SEQ ID NO: 58227 - DNA, 134 bp, Homo sapiens; identical to SEQ ID NO: 37627
  misc_feature 1..134: note = chr19:49932009-49932143
  misc_feature 1..134: note = hyper
  source 1..134: mol_type = genomic DNA

SEQ ID NO: 58228 - DNA, 195 bp, Homo sapiens
  misc_feature 1..195: note = chr19:49936174-49936369
  misc_feature 1..195: note = hyper
  source 1..195: mol_type = genomic DNA
ctggcatagacgtgaagaagcgccgccagggagtgctaaacttctgtgggggcgaggggagggccgctaagacggggagcggggctgagggcttctccgcgtcccttcagggaccacagtgtagttctgcagaaaccaaaggatcccgaccgcactgaaacttctatggacccaaaggcgcgggctacaccatgt

SEQ ID NO: 58229 - DNA, 11 bp, Homo sapiens
  misc_feature 1..11: note = chr19:49936853-49936864
  misc_feature 1..11: note = hyper
  source 1..11: mol_type = genomic DNA
tagcccctctc

SEQ ID NO: 58230 - DNA, 304 bp, Homo sapiens
  misc_feature 1..304: note = chr19:49936894-49937198
  misc_feature 1..304: note = hyper
  source 1..304: mol_type = genomic DNA
ctgcaggaaccgtccctgatctacacgctgtgcaggttcgtggcttgctatctctccccgccccttccccgaagatttggtcccggaccgtgagggggttcatgagtttcgcgctctctccgatggcgtcctcgatgtacttgcgctcctcctccgagatgctggggtgcagcgcgggggactcgtaggagacgagcagccagaacaggtaccagaagatcccgaagctgcctgggggggtcaggagggggatgggagcgaggtgaggaccggccccgctccgccccagcgccacccggaacca

SEQ ID NO: 58231 - DNA, 770 bp, Homo sapiens; identical to SEQ ID NO: 37630
  misc_feature 1..770: note = chr19:50194104-50194874
  misc_feature 1..770: note = hyper
  source 1..770: mol_type = genomic DNA

SEQ ID NO: 58232 - DNA, 37 bp, Homo sapiens
  misc_feature 1..37: note = chr19:50316207-50316244
  misc_feature 1..37: note = hyper
  source 1..37: mol_type = genomic DNA
acaccgaacccccttcggtttagatacaggcgtccaa

SEQ ID NO: 58233 - DNA, 245 bp, Homo sapiens
  misc_feature 1..245: note = chr19:50316468-50316713
  misc_feature 1..245: note = hyper
  source 1..245: mol_type = genomic DNA
gagatggggagctgattggaagaggattaacttcccgccttcttcacccaactcaaacagaccctcaaaccctattcaggcacctcccccaaacccattaggttctcttccgccctagccggaagtcacggtacccctaacaaagatggcggcaaattgaatttgcaaagctttctagtttctccgaggaggtaaagagaaccaagaagccggattgaagatgatgactgcgccaaggcgttgcc

SEQ ID NO: 58234 - DNA, 15 bp, Homo sapiens
  misc_feature 1..15: note = chr19:50393562-50393577
  misc_feature 1..15: note = hyper
  source 1..15: mol_type = genomic DNA
gaacaccttggtggc

SEQ ID NO: 58235 - DNA, 40 bp, Homo sapiens; identical to SEQ ID NO: 37633
  misc_feature 1..40: note = chr19:50393971-50394011
  misc_feature 1..40: note = hyper
  source 1..40: mol_type = genomic DNA

SEQ ID NO: 58236 - DNA, 30 bp, Homo sapiens; identical to SEQ ID NO: 37635
  misc_feature 1..30: note = chr19:50651036-50651066
  misc_feature 1..30: note = hyper
  source 1..30: mol_type = genomic DNA

SEQ ID NO: 58237 - DNA, 30 bp, Homo sapiens; identical to SEQ ID NO: 37636
  misc_feature 1..30: note = chr19:50651328-50651358
  misc_feature 1..30: note = hyper
  source 1..30: mol_type = genomic DNA

SEQ ID NO: 58238 - DNA, 30 bp, Homo sapiens; identical to SEQ ID NO: 37637
  misc_feature 1..30: note = chr19:50706864-50706894
  misc_feature 1..30: note = hyper
  source 1..30: mol_type = genomic DNA

SEQ ID NO: 58239 - DNA, 30 bp, Homo sapiens; identical to SEQ ID NO: 37638
  misc_feature 1..30: note = chr19:50815293-50815323
  misc_feature 1..30: note = hyper
  source 1..30: mol_type = genomic DNA

SEQ ID NO: 58240 - DNA, 271 bp, Homo sapiens; identical to SEQ ID NO: 37639
  misc_feature 1..271: note = chr19:50815780-50816051
  misc_feature 1..271: note = hyper
  source 1..271: mol_type = genomic DNA

SEQ ID NO: 58241 - DNA, 10 bp, Homo sapiens
  misc_feature 1..10: note = chr19:50816474-50816484
  misc_feature 1..10: note = hyper
  source 1..10: mol_type = genomic DNA
gggaaggggg

SEQ ID NO: 58242 - DNA, 734 bp, Homo sapiens; identical to SEQ ID NO: 37641
  misc_feature 1..734: note = chr19:50818424-50819158
  misc_feature 1..734: note = hyper
  source 1..734: mol_type = genomic DNA

SEQ ID NO: 58243 - DNA, 84 bp, Homo sapiens; identical to SEQ ID NO: 37642
  misc_feature 1..84: note = chr19:50829625-50829709
  misc_feature 1..84: note = hyper
  source 1..84: mol_type = genomic DNA

SEQ ID NO: 58244 - DNA, 510 bp, Homo sapiens; identical to SEQ ID NO: 37643
  misc_feature 1..510: note = chr19:50831498-50832008
  misc_feature 1..510: note = hyper
  source 1..510: mol_type = genomic DNA

SEQ ID NO: 58245 - DNA, 58 bp, Homo sapiens; identical to SEQ ID NO: 37644
  misc_feature 1..58: note = chr19:50832951-50833009
  misc_feature 1..58: note = hyper
  source 1..58: mol_type = genomic DNA

SEQ ID NO: 58246 - DNA, 107 bp, Homo sapiens
  misc_feature 1..107: note = chr19:50833863-50833970
  misc_feature 1..107: note = hyper
  source 1..107: mol_type = genomic DNA
aggaccgagggtagatgaggactggtgaggagggggcacgcaaggaggcagagaggacgggagaggggagaggccaaagcgccaggaagcaccgtcaagactgaggc

SEQ ID NO: 58247 - DNA, 35 bp, Homo sapiens; identical to SEQ ID NO: 13473
  misc_feature 1..35: note = chr19:50836356-50836391
  misc_feature 1..35: note = hyper
  source 1..35: mol_type = genomic DNA

SEQ ID NO: 58248 - DNA, 32 bp, Homo sapiens; identical to SEQ ID NO: 37647
  misc_feature 1..32: note = chr19:50836392-50836424
  misc_feature 1..32: note = hyper
  source 1..32: mol_type = genomic DNA

SEQ ID NO: 58249 - DNA, 66 bp, Homo sapiens; identical to SEQ ID NO: 37648
  misc_feature 1..66: note = chr19:50837323-50837389
  misc_feature 1..66: note = hyper
  source 1..66: mol_type = genomic DNA

SEQ ID NO: 58250 - DNA, 30 bp, Homo sapiens; identical to SEQ ID NO: 37649
  misc_feature 1..30: note = chr19:51055016-51055046
  misc_feature 1..30: note = hyper
  source 1..30: mol_type = genomic DNA

SEQ ID NO: 58251 - DNA, 56 bp, Homo sapiens; identical to SEQ ID NO: 37650
  misc_feature 1..56: note = chr19:51111640-51111696
  misc_feature 1..56: note = hyper
  source 1..56: mol_type = genomic DNA

SEQ ID NO: 58252 - DNA, 67 bp, Homo sapiens; identical to SEQ ID NO: 37651
  misc_feature 1..67: note = chr19:51142512-51142579
  misc_feature 1..67: note = hyper
  source 1..67: mol_type = genomic DNA

SEQ ID NO: 58253 - DNA, 171 bp, Homo sapiens; identical to SEQ ID NO: 37652
  misc_feature 1..171: note = chr19:51142587-51142758
  misc_feature 1..171: note = hyper
  source 1..171: mol_type = genomic DNA

SEQ ID NO: 58254 - DNA, 277 bp, Homo sapiens; identical to SEQ ID NO: 37653
  misc_feature 1..277: note = chr19:51142834-51143111
  misc_feature 1..277: note = hyper
  source 1..277: mol_type = genomic DNA

SEQ ID NO: 58255 - DNA, 477 bp, Homo sapiens
  misc_feature 1..477: note = chr19:51161720-51162197
  misc_feature 1..477: note = hyper
  source 1..477: mol_type = genomic DNA
gttggaggtaaggtccggtgagatcagagagaaggagggatctcgagtgagtaggggcccgagtttgagtgacccagtagtgaccgggatagaggtctgagcctggaaaggcagctgtgagggggtggaagagactgagcacatagtaggtgtggggccaggggtgatagggtggggacaggcctggagtgcctagggtagagcgcagcctgcagtcgccagtggagggtcgggcctttgggcggtttgagatggagcctcgacagacagtgattaggacgcagaaccaggctaagagagcgtaaggagcctagagcgacccaggcgagagggcagggctggaggggagtttagggacggagcgatggtccgctggaccagggcctgtaaacgactccagggaccaggcagggactcttcgacgatcaaagccagggctgaaacgacctgcgagttccttttccgtccccacccccc

SEQ ID NO: 58256 - DNA, 49 bp, Homo sapiens; identical to SEQ ID NO: 37657
  misc_feature 1..49: note = chr19:51162729-51162778
  misc_feature 1..49: note = hyper
  source 1..49: mol_type = genomic DNA

SEQ ID NO: 58257 - DNA, 15 bp, Homo sapiens
  misc_feature 1..15: note = chr19:51170723-51170738
  misc_feature 1..15: note = hyper
  source 1..15: mol_type = genomic DNA
cagttttcaaggaac

SEQ ID NO: 58258 - DNA, 107 bp, Homo sapiens
  misc_feature 1..107: note = chr19:51171112-51171219
  misc_feature 1..107: note = hyper
  source 1..107: mol_type = genomic DNA
cgaggactccttcagcgctcgctcgcgggcggccagggccagccccagcggggaggcgggatccagggccttgccggtcagcgggtgcaccaggggtcgcgggggca

SEQ ID NO: 58259 - DNA, 291 bp, Homo sapiens; identical to SEQ ID NO: 37660
  misc_feature 1..291: note = chr19:51197503-51197794
  misc_feature 1..291: note = hyper
  source 1..291: mol_type = genomic DNA

SEQ ID NO: 58260 - DNA, 60 bp, Homo sapiens; identical to SEQ ID NO: 13484
  misc_feature 1..60: note = chr19:51198175-51198235
  misc_feature 1..60: note = hyper
  source 1..60: mol_type = genomic DNA

SEQ ID NO: 58261 - DNA, 634 bp, Homo sapiens; identical to SEQ ID NO: 37662
  misc_feature 1..634: note = chr19:51198514-51199148
  misc_feature 1..634: note = hyper
  source 1..634: mol_type = genomic DNA

SEQ ID NO: 58262 - DNA, 117 bp, Homo sapiens; identical to SEQ ID NO: 23114
  misc_feature 1..117: note = chr19:51227602-51227719
  misc_feature 1..117: note = hyper
  source 1..117: mol_type = genomic DNA

SEQ ID NO: 58263 - DNA, 213 bp, Homo sapiens
  misc_feature 1..213: note = chr19:51227785-51227998
  misc_feature 1..213: note = hyper
  source 1..213: mol_type = genomic DNA
gacacccgcgatgccgtgcaagccctgcaggaggcgcagggtcgcgccgagcgcgagcacggccgcttggagggtgagtccgcggcgcgcggggtggaaaaaaatgagactatctgggccaggaatgggactggttgagaaggtgaccctaggtgtccggggcgggagagttcgggagagctgctgtgtgctagcggacggggttagagagct

SEQ ID NO: 58264 - DNA, 21 bp, Homo sapiens
  misc_feature 1..21: note = chr19:51228248-51228269
  misc_feature 1..21: note = hyper
  source 1..21: mol_type = genomic DNA
gcctccttctctacccggccc

SEQ ID NO: 58265 - DNA, 132 bp, Homo sapiens; identical to SEQ ID NO: 23117
  misc_feature 1..132: note = chr19:51228507-51228639
  misc_feature 1..132: note = hyper
  source 1..132: mol_type = genomic DNA

SEQ ID NO: 58266 - DNA, 91 bp, Homo sapiens; identical to SEQ ID NO: 4680
  misc_feature 1..91: note = chr19:51228702-51228793
  misc_feature 1..91: note = hyper
  source 1..91: mol_type = genomic DNA

SEQ ID NO: 58267 - DNA, 167 bp, Homo sapiens; identical to SEQ ID NO: 37667
  misc_feature 1..167: note = chr19:51281496-51281663
  misc_feature 1..167: note = hyper
  source 1..167: mol_type = genomic DNA

SEQ ID NO: 58268 - DNA, 121 bp, Homo sapiens; identical to SEQ ID NO: 37668
  misc_feature 1..121: note = chr19:51412508-51412629
  misc_feature 1..121: note = hyper
  source 1..121: mol_type = genomic DNA

SEQ ID NO: 58269 - DNA, 285 bp, Homo sapiens
  misc_feature 1..285: note = chr19:51520138-51520423
  misc_feature 1..285: note = hyper
  source 1..285: mol_type = genomic DNA
ctcaaggagaatcagcgggagaggagtgacgggcccagaaatgcggaaaaggaccacaccgccccctggcggccacagcgcaagcccggtctctcctcctgctggaaggacaccggggaccgcacctccagctgtgggagttccgagagaccccgccctgcccgctcctccctggaggccgcctccacagccccccgtggcgtcctcggggatggatctcctcctacttgtttccgcagtgcgcggccgtcagcacccaactctggtccaccaggacacccgcgc

SEQ ID NO: 58270 - DNA, 39 bp, Homo sapiens
  misc_feature 1..39: note = chr19:51520453-51520492
  misc_feature 1..39: note = hyper
  source 1..39: mol_type = genomic DNA
cctgccagggctgcgagccgcgcgcgcacggggagccat

SEQ ID NO: 58271 - DNA, 54 bp, Homo sapiens; identical to SEQ ID NO: 37670
  misc_feature 1..54: note = chr19:51522680-51522734
  misc_feature 1..54: note = hyper
  source 1..54: mol_type = genomic DNA

SEQ ID NO: 58272 - DNA, 132 bp, Homo sapiens; identical to SEQ ID NO: 37671
  misc_feature 1..132: note = chr19:51568572-51568704
  misc_feature 1..132: note = hyper
  source 1..132: mol_type = genomic DNA

SEQ ID NO: 58273 - DNA, 30 bp, Homo sapiens; identical to SEQ ID NO: 37672
  misc_feature 1..30: note = chr19:51814766-51814796
  misc_feature 1..30: note = hyper
  source 1..30: mol_type = genomic DNA

SEQ ID NO: 58274 - DNA, 172 bp, Homo sapiens; identical to SEQ ID NO: 37673
  misc_feature 1..172: note = chr19:51815103-51815275
  misc_feature 1..172: note = hyper
  source 1..172: mol_type = genomic DNA

SEQ ID NO: 58275 - DNA, 135 bp, Homo sapiens; identical to SEQ ID NO: 37674
  misc_feature 1..135: note = chr19:51830260-51830395
  misc_feature 1..135: note = hyper
  source 1..135: mol_type = genomic DNA

SEQ ID NO: 58276 - DNA, 24 bp, Homo sapiens
  misc_feature 1..24: note = chr19:51830821-51830845
  misc_feature 1..24: note = hyper
  source 1..24: mol_type = genomic DNA
gcggtgggagtgacccgaggtaca

SEQ ID NO: 58277 - DNA, 232 bp, Homo sapiens; identical to SEQ ID NO: 23121
  misc_feature 1..232: note = chr19:51831128-51831360
  misc_feature 1..232: note = hyper
  source 1..232: mol_type = genomic DNA

SEQ ID NO: 58278 - DNA, 85 bp, Homo sapiens; identical to SEQ ID NO: 37677
  misc_feature 1..85: note = chr19:52074277-52074362
  misc_feature 1..85: note = hyper
  source 1..85: mol_type = genomic DNA

SEQ ID NO: 58279 - DNA, 30 bp, Homo sapiens; identical to SEQ ID NO: 37678
  misc_feature 1..30: note = chr19:52097396-52097426
  misc_feature 1..30: note = hyper
  source 1..30: mol_type = genomic DNA

SEQ ID NO: 58280 - DNA, 60 bp, Homo sapiens; identical to SEQ ID NO: 37679
  misc_feature 1..60: note = chr19:52205780-52205840
  misc_feature 1..60: note = hyper
  source 1..60: mol_type = genomic DNA

SEQ ID NO: 58281 - DNA, 377 bp, Homo sapiens
  misc_feature 1..377: note = chr19:52207367-52207744
  misc_feature 1..377: note = hyper
  source 1..377: mol_type = genomic DNA
accgcgggacgttctcctgcgtgatcaagcaagaccagcgccccctggcccggctctacttctttcttaacggtggggcggggcgcggccgcgtgagtgagcggggtcgggagaggggtggggctcgtgcctggctgacgtgcgcgcccccgcagtgacgggcccgcccccgcgggcggagacagagttgcaggcctcgttccgggaagtgctgcgctgggcgccgcgggatgccgagctgatcgagccctggaggcccagcctgggcgagctgctggccaggcccgaggctctgacgcccagcaatctgttcctgcttgcagtcctcggggccctcgcatcagcgagtgcgacagtgttggcgtggtgagttctgg

SEQ ID NO: 58282 - DNA, 93 bp, Homo sapiens
  misc_feature 1..93: note = chr19:52222430-52222523
  misc_feature 1..93: note = hyper
  source 1..93: mol_type = genomic DNA
cgagtgggctgaaggcgcctctactcacctgcacgtagtccaccgaatctccgagcgccttgaaggctgtgtacatgacctcgcgcttgccgc

SEQ ID NO: 58283 - DNA, 17 bp, Homo sapiens
  misc_feature 1..17: note = chr19:52223142-52223159
  misc_feature 1..17: note = hyper
  source 1..17: mol_type = genomic DNA
cgcgtcctgctgggagc

SEQ ID NO: 58284 - DNA, 214 bp, Homo sapiens; identical to SEQ ID NO: 37683
  misc_feature 1..214: note = chr19:52408028-52408242
  misc_feature 1..214: note = hyper
  source 1..214: mol_type = genomic DNA

SEQ ID NO: 58285 - DNA, 30 bp, Homo sapiens; identical to SEQ ID NO: 37684
  misc_feature 1..30: note = chr19:52430054-52430084
  misc_feature 1..30: note = hyper
  source 1..30: mol_type = genomic DNA

SEQ ID NO: 58286 - DNA, 76 bp, Homo sapiens; identical to SEQ ID NO: 37685
  misc_feature 1..76: note = chr19:52511308-52511384
  misc_feature 1..76: note = hyper
  source 1..76: mol_type = genomic DNA

SEQ ID NO: 58287 - DNA, 434 bp, Homo sapiens; identical to SEQ ID NO: 37686
  misc_feature 1..434: note = chr19:52531450-52531884
  misc_feature 1..434: note = hyper
  source 1..434: mol_type = genomic DNA

SEQ ID NO: 58288 - DNA, 89 bp, Homo sapiens; identical to SEQ ID NO: 37687
  misc_feature 1..89: note = chr19:52800826-52800915
  misc_feature 1..89: note = hyper
  source 1..89: mol_type = genomic DNA

SEQ ID NO: 58289 - DNA, 93 bp, Homo sapiens; identical to SEQ ID NO: 37688
  misc_feature 1..93: note = chr19:52839463-52839556
  misc_feature 1..93: note = hyper
  source 1..93: mol_type = genomic DNA

SEQ ID NO: 58290 - DNA, 46 bp, Homo sapiens; identical to SEQ ID NO: 37689
  misc_feature 1..46: note = chr19:52839996-52840042
  misc_feature 1..46: note = hyper
  source 1..46: mol_type = genomic DNA

SEQ ID NO: 58291 - DNA, 38 bp, Homo sapiens; identical to SEQ ID NO: 37690
  misc_feature 1..38: note = chr19:52840043-52840081
  misc_feature 1..38: note = hyper
  source 1..38: mol_type = genomic DNA

SEQ ID NO: 58292 - DNA, 29 bp, Homo sapiens
  misc_feature 1..29: note = chr19:52872845-52872874
  misc_feature 1..29: note = hyper
  source 1..29: mol_type = genomic DNA
tgcagcgcacgacctcggctcactgcagc

SEQ ID NO: 58293 - DNA, 94 bp, Homo sapiens
  misc_feature 1..94: note = chr19:52873440-52873534
  misc_feature 1..94: note = hyper
  source 1..94: mol_type = genomic DNA
gggccatgtagacagctcctgtcgcggagtttgcctgcttcaaatccttcagtgacccctagacacggcccgcgctgcgtaaagttctcacccg

SEQ ID NO: 58294 - DNA, 89 bp, Homo sapiens; identical to SEQ ID NO: 37694
  misc_feature 1..89: note = chr19:52900885-52900974
  misc_feature 1..89: note = hyper
  source 1..89: mol_type = genomic DNA

SEQ ID NO: 58295 - DNA, 69 bp, Homo sapiens; identical to SEQ ID NO: 37695
  misc_feature 1..69: note = chr19:52900975-52901044
  misc_feature 1..69: note = hyper
  source 1..69: mol_type = genomic DNA

SEQ ID NO: 58296 - DNA, 199 bp, Homo sapiens; identical to SEQ ID NO: 23131
  misc_feature 1..199: note = chr19:52956606-52956805
  misc_feature 1..199: note = hyper
  source 1..199: mol_type = genomic DNA

SEQ ID NO: 58297 - DNA, 24 bp, Homo sapiens
  misc_feature 1..24: note = chr19:52956848-52956872
  misc_feature 1..24: note = hyper
  source 1..24: mol_type = genomic DNA
ttggagcagcgggtgagtttccct

SEQ ID NO: 58298 - skipped

SEQ ID NO: 58299 - DNA, 33 bp, Homo sapiens; identical to SEQ ID NO: 37698
  misc_feature 1..33: note = chr19:53031314-53031347
  misc_feature 1..33: note = hyper
  source 1..33: mol_type = genomic DNA

SEQ ID NO: 58300 - DNA, 50 bp, Homo sapiens
  misc_feature 1..50: note = chr19:53073354-53073404
  misc_feature 1..50: note = hyper
  source 1..50: mol_type = genomic DNA
aaaaatagagtcgctgggagcgaggctgagagacgcacaggtcccgcccc

SEQ ID NO: 58301 - DNA, 158 bp, Homo sapiens
  misc_feature 1..158: note = chr19:53073405-53073563
  misc_feature 1..158: note = hyper
  source 1..158: mol_type = genomic DNA
gccccgccctctgccggttctaaagggcaaggtctctccgcctggggccccgcctctacctcgatcaggccccgcccaccttctcgttggctccacccaggcctggctttagtcctgtgcgcacacatccgcgcagaccaggaagcggatcccgtgga

SEQ ID NO: 58302 - DNA, 51 bp, Homo sapiens; identical to SEQ ID NO: 23134
  misc_feature 1..51: note = chr19:53073987-53074038
  misc_feature 1..51: note = hyper
  source 1..51: mol_type = genomic DNA

SEQ ID NO: 58303 - DNA, 38 bp, Homo sapiens; identical to SEQ ID NO: 37703
  misc_feature 1..38: note = chr19:53104584-53104622
  misc_feature 1..38: note = hyper
  source 1..38: mol_type = genomic DNA

SEQ ID NO: 58304 - DNA, 58 bp, Homo sapiens; identical to SEQ ID NO: 37704
  misc_feature 1..58: note = chr19:53104953-53105011
  misc_feature 1..58: note = hyper
  source 1..58: mol_type = genomic DNA

SEQ ID NO: 58305 - DNA, 280 bp, Homo sapiens; identical to SEQ ID NO: 37705
  misc_feature 1..280: note = chr19:53141079-53141359
  misc_feature 1..280: note = hyper
  source 1..280: mol_type = genomic DNA

SEQ ID NO: 58306 - DNA, 200 bp, Homo sapiens; identical to SEQ ID NO: 37706
  misc_feature 1..200: note = chr19:53141419-53141619
  misc_feature 1..200: note = hyper
  source 1..200: mol_type = genomic DNA

SEQ ID NO: 58307 - DNA, 216 bp, Homo sapiens; identical to SEQ ID NO: 37707
  misc_feature 1..216: note = chr19:53193364-53193580
  misc_feature 1..216: note = hyper
  source 1..216: mol_type = genomic DNA

SEQ ID NO: 58308 - DNA, 30 bp, Homo sapiens; identical to SEQ ID NO: 37708
  misc_feature 1..30: note = chr19:53193928-53193958
  misc_feature 1..30: note = hyper
  source 1..30: mol_type = genomic DNA

SEQ ID NO: 58309 - DNA, 46 bp, Homo sapiens
  misc_feature 1..46: note = chr19:53194235-53194281
  misc_feature 1..46: note = hyper
  source 1..46: mol_type = genomic DNA
gtgcaggcgcgaaggcgggagcctgaggtcccagctactcaggaag

SEQ ID NO: 58310 - DNA, 111 bp, Homo sapiens; identical to SEQ ID NO: 37710
  misc_feature 1..111: note = chr19:53361072-53361183
  misc_feature 1..111: note = hyper
  source 1..111: mol_type = genomic DNA

SEQ ID NO: 58311 - DNA, 403 bp, Homo sapiens; identical to SEQ ID NO: 37711
  misc_feature 1..403: note = chr19:53400389-53400792
  misc_feature 1..403: note = hyper
  source 1..403: mol_type = genomic DNA

SEQ ID NO: 58312 - DNA, 80 bp, Homo sapiens; identical to SEQ ID NO: 37712
  misc_feature 1..80: note = chr19:53426559-53426639
  misc_feature 1..80: note = hyper
  source 1..80: mol_type = genomic DNA

SEQ ID NO: 58313 - DNA, 36 bp, Homo sapiens; identical to SEQ ID NO: 37713
  misc_feature 1..36: note = chr19:53466073-53466109
  misc_feature 1..36: note = hyper
  source 1..36: mol_type = genomic DNA

SEQ ID NO: 58314 - DNA, 187 bp, Homo sapiens; identical to SEQ ID NO: 37714
  misc_feature 1..187: note = chr19:53496179-53496366
  misc_feature 1..187: note = hyper
  source 1..187: mol_type = genomic DNA

SEQ ID NO: 58315 - skipped

SEQ ID NO: 58316 - DNA, 135 bp, Homo sapiens; identical to SEQ ID NO: 37717
  misc_feature 1..135: note = chr19:53497254-53497389
  misc_feature 1..135: note = hyper
  source 1..135: mol_type = genomic DNA

SEQ ID NO: 58317 - DNA, 173 bp, Homo sapiens
  misc_feature 1..173: note = chr19:53561495-53561668
  misc_feature 1..173: note = hyper
  source 1..173: mol_type = genomic DNA
tatgcgggaagaagacgcgaatggcaggggacagggactggtctcagagcgagttttacccacatggcgaggtccgtatttacctcgggtgaagggcgcgatgcggggattttaaggtcagcagagcgggtgtggaaaagcgggacggcgaatcgaaggcttaatctacacct

SEQ ID NO: 58318 - DNA, 66 bp, Homo sapiens
  misc_feature 1..66: note = chr19:53561733-53561799
  misc_feature 1..66: note = hyper
  source 1..66: mol_type = genomic DNA
ctgcacgtgcgcgcagagcccgggtagcctggggcggagcccggggagaggcggggtctgcagagg

SEQ ID NO: 58319 - DNA, 103 bp, Homo sapiens; identical to SEQ ID NO: 13514
  misc_feature 1..103: note = chr19:53635501-53635604
  misc_feature 1..103: note = hyper
  source 1..103: mol_type = genomic DNA

SEQ ID NO: 58320 - DNA, 67 bp, Homo sapiens
  misc_feature 1..67: note = chr19:53635885-53635952
  misc_feature 1..67: note = hyper
  source 1..67: mol_type = genomic DNA
ggaaaaggttttaagcgggaggaagaagcaaaaggccggggacggggagcagcctcaaagcgacttc

SEQ ID NO: 58321 - DNA, 181 bp, Homo sapiens
  misc_feature 1..181: note = chr19:53661466-53661647
  misc_feature 1..181: note = hyper
  source 1..181: mol_type = genomic DNA
gactgcgaaggggaggcctggggagcagcagggcccggcacgaggaggagggaggtggcggggcgacggcgccttagaagaggggtggggtctgcaggatgccaggaccaggcagaggacgcggcctcgccggtaccggggctgaggagctgcgctccaggggccgacgagggcgaggctg

SEQ ID NO: 58322 - DNA, 247 bp, Homo sapiens; identical to SEQ ID NO: 23142
  misc_feature 1..247: note = chr19:53696167-53696414
  misc_feature 1..247: note = hyper
  source 1..247: mol_type = genomic DNA

SEQ ID NO: 58323 - DNA, 69 bp, Homo sapiens; identical to SEQ ID NO: 23143
  misc_feature 1..69: note = chr19:53696580-53696649
  misc_feature 1..69: note = hyper
  source 1..69: mol_type = genomic DNA

SEQ ID NO: 58324 - DNA, 13 bp, Homo sapiens
  misc_feature 1..13: note = chr19:53696650-53696663
  misc_feature 1..13: note = hyper
  source 1..13: mol_type = genomic DNA
gtggggaaaggcc

SEQ ID NO: 58325 - DNA, 100 bp, Homo sapiens; identical to SEQ ID NO: 37725
  misc_feature 1..100: note = chr19:53700343-53700443
  misc_feature 1..100: note = hyper
  source 1..100: mol_type = genomic DNA

SEQ ID NO: 58326 - DNA, 30 bp, Homo sapiens; identical to SEQ ID NO: 13521
  misc_feature 1..30: note = chr19:53757742-53757772
  misc_feature 1..30: note = hyper
  source 1..30: mol_type = genomic DNA

SEQ ID NO: 58327 - DNA, 32 bp, Homo sapiens; identical to SEQ ID NO: 37729
  misc_feature 1..32: note = chr19:53868692-53868724
  misc_feature 1..32: note = hyper
  source 1..32: mol_type = genomic DNA

SEQ ID NO: 58328 - DNA, 214 bp, Homo sapiens; identical to SEQ ID NO: 37730
  misc_feature 1..214: note = chr19:53868957-53869171
  misc_feature 1..214: note = hyper
  source 1..214: mol_type = genomic DNA

SEQ ID NO: 58329 - DNA, 70 bp, Homo sapiens; identical to SEQ ID NO: 37731
  misc_feature 1..70: note = chr19:53966826-53966896
  misc_feature 1..70: note = hyper
  source 1..70: mol_type = genomic DNA

SEQ ID NO: 58330 - DNA, 28 bp, Homo sapiens
  misc_feature 1..28: note = chr19:53970370-53970398
  misc_feature 1..28: note = hyper
  source 1..28: mol_type = genomic DNA
agacgaggaaggaagcgctgcgggaggg

SEQ ID NO: 58331 - DNA, 43 bp, Homo sapiens
  misc_feature 1..43: note = chr19:53970458-53970501
  misc_feature 1..43: note = hyper
  source 1..43: mol_type = genomic DNA
gcttcctgagtagctgggacctcaggctcctgcccccgcgcgc

SEQ ID NO: 58332 - DNA, 210 bp, Homo sapiens
  misc_feature 1..210: note = chr19:53970758-53970968
  misc_feature 1..210: note = hyper
  source 1..210: mol_type = genomic DNA
cagacaattccagggcttttgaatagtgcctcaaccttactggccggtctcgactccaaaaccctaaaacaggcgctggagcgagggtgacggactcacaggtcccaccccggccccgccctctgcgccttccaaagggcaaagtctctccgcctctcgccccgcccctgcttcgtcaggccccgcccacctcccaggtcccgcccaggc

SEQ ID NO: 58333 - DNA, 288 bp, Homo sapiens
  misc_feature 1..288: note = chr19:53971157-53971445
  misc_feature 1..288: note = hyper
  source 1..288: mol_type = genomic DNA
agagcaaattgagacgaccccgtgagagtccgggggtcgcttccttttgtgtttaaggtcgccctgaggctggtcccgtcccgggtctttctgctatagggcaatgtatacactttctatcgcgcatttttcctgctctaaacctttctctgactcctcccaccccgcgctttttgaagtcctcacccaaggggtggattctcgcccacttcggccggtggagcgcagaaccgcggccccagtcccgggaaggccgcgtcctctgtctggtcccgggatcctgcagac

SEQ ID NO: 58334 - DNA, 325 bp, Homo sapiens; identical to SEQ ID NO: 23149
  misc_feature 1..325: note = chr19:54024196-54024521
  misc_feature 1..325: note = hyper
  source 1..325: mol_type = genomic DNA

SEQ ID NO: 58335 - DNA, 30 bp, Homo sapiens; identical to SEQ ID NO: 37738
  misc_feature 1..30: note = chr19:54371989-54372019
  misc_feature 1..30: note = hyper
  source 1..30: mol_type = genomic DNA

SEQ ID NO: 58336 - DNA, 30 bp, Homo sapiens; identical to SEQ ID NO: 37739
  misc_feature 1..30: note = chr19:54382737-54382767
  misc_feature 1..30: note = hyper
  source 1..30: mol_type = genomic DNA

SEQ ID NO: 58337 - DNA, 413 bp, Homo sapiens; identical to SEQ ID NO: 37740
  misc_feature 1..413: note = chr19:54409951-54410364
  misc_feature 1..413: note = hyper
  source 1..413: mol_type = genomic DNA

SEQ ID NO: 58338 - DNA, 102 bp, Homo sapiens; identical to SEQ ID NO: 23152
  misc_feature 1..102: note = chr19:54411454-54411556
  misc_feature 1..102: note = hyper
  source 1..102: mol_type = genomic DNA

SEQ ID NO: 58339 - DNA, 23 bp, Homo sapiens
  misc_feature 1..23: note = chr19:54411586-54411609
  misc_feature 1..23: note = hyper
  source 1..23: mol_type = genomic DNA
cagtggagcggtgtgccttgtct

SEQ ID NO: 58340 - DNA, 91 bp, Homo sapiens; identical to SEQ ID NO: 37743
  misc_feature 1..91: note = chr19:54412658-54412749
  misc_feature 1..91: note = hyper
  source 1..91: mol_type = genomic DNA

SEQ ID NO: 58341 - DNA, 65 bp, Homo sapiens
  misc_feature 1..65: note = chr19:54412808-54412873
  misc_feature 1..65: note = hyper
  source 1..65: mol_type = genomic DNA
cgcccctcgaggtggctgcgagccgggtttggggcaacaagggacccgagtggctccaggggtgg

SEQ ID NO: 58342 - skipped

SEQ ID NO: 58343 - DNA, 143 bp, Homo sapiens; identical to SEQ ID NO: 37745
  misc_feature 1..143: note = chr19:54413008-54413151
  misc_feature 1..143: note = hyper
  source 1..143: mol_type = genomic DNA

SEQ ID NO: 58344 - DNA, 125 bp, Homo sapiens; identical to SEQ ID NO: 37746
  misc_feature 1..125: note = chr19:54413467-54413592
  misc_feature 1..125: note = hyper
  source 1..125: mol_type = genomic DNA

SEQ ID NO: 58345 - DNA, 44 bp, Homo sapiens; identical to SEQ ID NO: 37747
  misc_feature 1..44: note = chr19:54445558-54445602
  misc_feature 1..44: note = hyper
  source 1..44: mol_type = genomic DNA

SEQ ID NO: 58346 - DNA, 30 bp, Homo sapiens; identical to SEQ ID NO: 13533
  misc_feature 1..30: note = chr19:54463032-54463062
  misc_feature 1..30: note = hyper
  source 1..30: mol_type = genomic DNA

SEQ ID NO: 58347 - DNA, 203 bp, Homo sapiens; identical to SEQ ID NO: 37749
  misc_feature 1..203: note = chr19:54465531-54465734
  misc_feature 1..203: note = hyper
  source 1..203: mol_type = genomic DNA

SEQ ID NO: 58348 - DNA, 427 bp, Homo sapiens; identical to SEQ ID NO: 37750
  misc_feature 1..427: note = chr19:54466163-54466590
  misc_feature 1..427: note = hyper
  source 1..427: mol_type = genomic DNA

SEQ ID NO: 58349 - DNA, 102 bp, Homo sapiens; identical to SEQ ID NO: 37751
  misc_feature 1..102: note = chr19:54481331-54481433
  misc_feature 1..102: note = hyper
  source 1..102: mol_type = genomic DNA

SEQ ID NO: 58350 - DNA, 20 bp, Homo sapiens
  misc_feature 1..20: note = chr19:54481751-54481771
  misc_feature 1..20: note = hyper
  source 1..20: mol_type = genomic DNA
gcggcgactctgcgccgtga

SEQ ID NO: 58351 - DNA, 356 bp, Homo sapiens
  misc_feature 1..356: note = chr19:54482817-54483173
  misc_feature 1..356: note = hyper
  source 1..356: mol_type = genomic DNA
cagggagagtgatttcgataaataaagagggggaaagatattccaagagagagaaaaatagtccgaagaaaaaagaaaaggacaaagaaaaagagggagagaaaatcagaccgagaaatagagaaattttaaaaacaggagagagaatgaggcaacagtaaaataaaccagaacacagccggagagagagaatcacagaactgtcgggaggcgccgcgagatggggggccgggaagggggcgcaggcggccgcgtctgaccgccctcgctctccctccttttcctttccttcctcccccgcaggagttgtccgggcctccagcatcttccccatccttagcgccatcctgctgctg

SEQ ID NO: 58352 - DNA, 184 bp, Homo sapiens
  misc_feature 1..184: note = chr19:54483546-54483730
  misc_feature 1..184: note = hyper
  source 1..184: mol_type = genomic DNA
atcccaagcccgccgtcctggagacggaaggggaggagctggggagggggtgggaccttgagacacaattgggctcttgaggatagagaggcggggctgggtcttggagggcgggcccaggagaggtagaaagtgatctgagcgccgatgaggagcctgctttaaggggcgggcctttggagac

SEQ ID NO: 58353 - DNA, 174 bp, Homo sapiens; identical to SEQ ID NO: 23160
  misc_feature 1..174: note = chr19:54485823-54485997
  misc_feature 1..174: note = hyper
  source 1..174: mol_type = genomic DNA

SEQ ID NO: 58354 - DNA, 29 bp, Homo sapiens
  misc_feature 1..29: note = chr19:54486106-54486135
  misc_feature 1..29: note = hyper
  source 1..29: mol_type = genomic DNA
cgcggcgggggagccgaggggcgtgtccg

SEQ ID NO: 58355 - DNA, 192 bp, Homo sapiens; identical to SEQ ID NO: 37760
  misc_feature 1..192: note = chr19:54494879-54495071
  misc_feature 1..192: note = hyper
  source 1..192: mol_type = genomic DNA

SEQ ID NO: 58356 - DNA, 118 bp, Homo sapiens; identical to SEQ ID NO: 37761
  misc_feature 1..118: note = chr19:55684817-55684935
  misc_feature 1..118: note = hyper
  source 1..118: mol_type = genomic DNA

SEQ ID NO: 58357 - DNA, 91 bp, Homo sapiens; identical to SEQ ID NO: 37762
  misc_feature 1..91: note = chr19:55685239-55685330
  misc_feature 1..91: note = hyper
  source 1..91: mol_type = genomic DNA

SEQ ID NO: 58358 - DNA, 630 bp, Homo sapiens; identical to SEQ ID NO: 37763
  misc_feature 1..630: note = chr19:55690528-55691158
  misc_feature 1..630: note = hyper
  source 1..630: mol_type = genomic DNA

SEQ ID NO: 58359 - DNA, 30 bp, Homo sapiens; identical to SEQ ID NO: 37764
  misc_feature 1..30: note = chr19:55865272-55865302
  misc_feature 1..30: note = hyper
  source 1..30: mol_type = genomic DNA

SEQ ID NO: 58360 - DNA, 237 bp, Homo sapiens; identical to SEQ ID NO: 37765
  misc_feature 1..237: note = chr19:55952667-55952904
  misc_feature 1..237: note = hyper
  source 1..237: mol_type = genomic DNA

SEQ ID NO: 58361 - DNA, 746 bp, Homo sapiens; identical to SEQ ID NO: 37766
  misc_feature 1..746: note = chr19:55953773-55954519
  misc_feature 1..746: note = hyper
  source 1..746: mol_type = genomic DNA

SEQ ID NO: 58362 - DNA, 35 bp, Homo sapiens; identical to SEQ ID NO: 37767
  misc_feature 1..35: note = chr19:55962393-55962428
  misc_feature 1..35: note = hyper
  source 1..35: mol_type = genomic DNA

SEQ ID NO: 58363 - DNA, 160 bp, Homo sapiens; identical to SEQ ID NO: 37768
  misc_feature 1..160: note = chr19:55963107-55963267
  misc_feature 1..160: note = hyper
  source 1..160: mol_type = genomic DNA

SEQ ID NO: 58364 - DNA, 147 bp, Homo sapiens; identical to SEQ ID NO: 37769
  misc_feature 1..147: note = chr19:55963577-55963724
  misc_feature 1..147: note = hyper
  source 1..147: mol_type = genomic DNA

SEQ ID NO: 58365 - DNA, 53 bp, Homo sapiens; identical to SEQ ID NO: 37770
  misc_feature 1..53: note = chr19:56015184-56015237
  misc_feature 1..53: note = hyper
  source 1..53: mol_type = genomic DNA

SEQ ID NO: 58366 - DNA, 30 bp, Homo sapiens; identical to SEQ ID NO: 37771
  misc_feature 1..30: note = chr19:56728573-56728603
  misc_feature 1..30: note = hyper
  source 1..30: mol_type = genomic DNA

SEQ ID NO: 58367 - DNA, 20 bp, Homo sapiens
  misc_feature 1..20: note = chr19:56728658-56728678
  misc_feature 1..20: note = hyper
  source 1..20: mol_type = genomic DNA
cgatgatgactccagctttc

SEQ ID NO: 58368 - DNA, 22 bp, Homo sapiens
  misc_feature 1..22: note = chr19:56879479-56879501
  misc_feature 1..22: note = hyper
  source 1..22: mol_type = genomic DNA
ccacggccgaactcacgcctac

SEQ ID NO: 58369 - DNA, 193 bp, Homo sapiens; identical to SEQ ID NO: 1401
  misc_feature 1..193: note = chr19:56904511-56904704
  misc_feature 1..193: note = hyper
  source 1..193: mol_type = genomic DNA

SEQ ID NO: 58370 - DNA, 17 bp, Homo sapiens
  misc_feature 1..17: note = chr19:56904723-56904740
  misc_feature 1..17: note = hyper
  source 1..17: mol_type = genomic DNA
cgttcttctcaggcctg

SEQ ID NO: 58371 - DNA, 153 bp, Homo sapiens
  misc_feature 1..153: note = chr19:56905203-56905356
  misc_feature 1..153: note = hyper
  source 1..153: mol_type = genomic DNA
ccgtcactgtgtgtgcgtgattttgacagtgtgtggtggtagcttctgactccgcgtgggtcgttgaatgtatgactgggaccgtttagcggtggatacacaactgtgtgcggctgtggaagattgcctcatccgttacgttcccatttccgt

SEQ ID NO: 58372 - DNA, 178 bp, Homo sapiens
  misc_feature 1..178: note = chr19:56915142-56915320
  misc_feature 1..178: note = hyper
  source 1..178: mol_type = genomic DNA
gcccacgacagtgcccgatacagcaggcgctcaataagtggcgaatgaaagacagggcaaggcggagagagaagaaacagaaagggaaagagaaagcccgggccgccagagcgcttaatcacacgtacatcctaccgggcccctctccagctggctcaggctccacactggtcctcca

SEQ ID NO: 58373 - DNA, 222 bp, Homo sapiens; identical to SEQ ID NO: 23171
  misc_feature 1..222: note = chr19:56915428-56915650
  misc_feature 1..222: note = hyper
  source 1..222: mol_type = genomic DNA

SEQ ID NO: 58374 - DNA, 284 bp, Homo sapiens; identical to SEQ ID NO: 37780
  misc_feature 1..284: note = chr19:56915651-56915935
  misc_feature 1..284: note = hyper
  source 1..284: mol_type = genomic DNA

SEQ ID NO: 58375 - DNA, 89 bp, Homo sapiens
  misc_feature 1..89: note = chr19:56988468-56988557
  misc_feature 1..89: note = hyper
  source 1..89: mol_type = genomic DNA
cgggccgagaacccacgcaggcgcgagcccaccgcccacgcaagcacccgcgcagacgcccacgccatcgtggatgcgcaaacccacgc

SEQ ID NO: 58376 - DNA, 138 bp, Homo sapiens; identical to SEQ ID NO: 37782
  misc_feature 1..138: note = chr19:56988963-56989101
  misc_feature 1..138: note = hyper
  source 1..138: mol_type = genomic DNA

SEQ ID NO: 58377 - skipped

SEQ ID NO: 58378 - DNA, 261 bp, Homo sapiens; identical to SEQ ID NO: 37784
  misc_feature 1..261: note = chr19:57018744-57019005
  misc_feature 1..261: note = hyper
  source 1..261: mol_type = genomic DNA

SEQ ID NO: 58379 - DNA, 500 bp, Homo sapiens; identical to SEQ ID NO: 37785
  misc_feature 1..500: note = chr19:57019006-57019506
  misc_feature 1..500: note = hyper
  source 1..500: mol_type = genomic DNA

SEQ ID NO: 58380 - DNA, 30 bp, Homo sapiens; identical to SEQ ID NO: 37786
  misc_feature 1..30: note = chr19:57019931-57019961
  misc_feature 1..30: note = hyper
  source 1..30: mol_type = genomic DNA

SEQ ID NO: 58381 - DNA, 30 bp, Homo sapiens; identical to SEQ ID NO: 37787
  misc_feature 1..30: note = chr19:57049841-57049871
  misc_feature 1..30: note = hyper
  source 1..30: mol_type = genomic DNA

SEQ ID NO: 58382 - DNA, 238 bp, Homo sapiens; identical to SEQ ID NO: 37788
  misc_feature 1..238: note = chr19:57078361-57078599
  misc_feature 1..238: note = hyper
  source 1..238: mol_type = genomic DNA

SEQ ID NO: 58383 - DNA, 251 bp, Homo sapiens; identical to SEQ ID NO: 37789
  misc_feature 1..251: note = chr19:57079002-57079253
  misc_feature 1..251: note = hyper
  source 1..251: mol_type = genomic DNA

SEQ ID NO: 58384 - skipped

SEQ ID NO: 58385 - DNA, 21 bp, Homo sapiens
  misc_feature 1..21: note = chr19:57106588-57106609
  misc_feature 1..21: note = hyper
  source 1..21: mol_type = genomic DNA
cgcgcgcgggtttctgggaag

SEQ ID NO: 58386 - DNA, 73 bp, Homo sapiens; identical to SEQ ID NO: 37792
  misc_feature 1..73: note = chr19:57106836-57106909
  misc_feature 1..73: note = hyper
  source 1..73: mol_type = genomic DNA

SEQ ID NO: 58387 - DNA, 232 bp, Homo sapiens
  misc_feature 1..232: note = chr19:57149347-57149579
  misc_feature 1..232: note = hyper
  source 1..232: mol_type = genomic DNA
agggctttccccaggcggatgggttctttgaaggagggggaaaaaaaaaagtcttctccagctattctgtgtagagcgtcagcaccaccgaacgctaatgcttgaatggtttagaactgcggacagctcacgccagacagattcagcaccacggacagcccccaaggcagctcgtgatgtgaatggttcagcaccgcagacagctcaagcctcgccggacagccctgctgga

SEQ ID NO: 58388 - DNA, 631 bp, Homo sapiens
  misc_feature 1..631: note = chr19:57154254-57154885
  misc_feature 1..631: note = hyper
  source 1..631: mol_type = genomic DNA
ccgctggccttggggcgtctgtcgcagggtacctcgaacataacctacgtgctcatcagctagagatggaccagctcggtaccacacccccctgcaaccacgccgcgggtaccccgcctctgcggctcatccactcccttccccacgcgcctccaggtgcaggcttcccgggggtggaggaggggaggaggacacccacgctccccaattcccccacctcccatctcccacctccccccacccccccgcagcctccgcgtctgcgcagccgcagtcagtgcggcgccagctctgcagagcccagacagggtccggttggggagggtgagtccttcgagggacccccgcgggcgggaaggaggcggagaaaaggggctgggggcgcgggcggcgatccggggatgcgcgcgcgagtatggatgcgcagagggtgtgtgtgcctgggcgagggtgaggggcagaaccgctccagggatagggtccggggagagggcgtctccaagcccgtccggtgggagaggaccggggtctgtcggggtcgggtctgtttctccgcagcggaggtctgtgtcctggcttgggggttgcaggtgaattccagcctcctcgtgaggaggggagcacagacctg

SEQ ID NO: 58389 - DNA, 82 bp, Homo sapiens
  misc_feature 1..82: note = chr19:57182912-57182994
  misc_feature 1..82: note = hyper
  source 1..82: mol_type = genomic DNA
acacctgcaggaacacgcgcacactacacaccgttgctctcgcctcccggtatcaccttcgaacgcgctggccggccccctc

SEQ ID NO: 58390 - DNA, 36 bp, Homo sapiens; identical to SEQ ID NO: 37796
  misc_feature 1..36: note = chr19:57276895-57276931
  misc_feature 1..36: note = hyper
  source 1..36: mol_type = genomic DNA

SEQ ID NO: 58391 - DNA, 114 bp, Homo sapiens; identical to SEQ ID NO: 37797
  misc_feature 1..114: note = chr19:57610714-57610828
  misc_feature 1..114: note = hyper
  source 1..114: mol_type = genomic DNA

SEQ ID NO: 58392 - DNA, 38 bp, Homo sapiens
  misc_feature 1..38: note = chr19:57617484-57617522
  misc_feature 1..38: note = hyper
  source 1..38: mol_type = genomic DNA
ggcctccctgcatcccggagcgcactggggatgaggac

SEQ ID NO: 58393 - DNA, 49 bp, Homo sapiens
  misc_feature 1..49: note = chr19:57618121-57618170
  misc_feature 1..49: note = hyper
  source 1..49: mol_type = genomic DNA
agccgctgggggttcggcccaccccgcgaaccgagctcccggccctgtg

SEQ ID NO: 58394 - DNA, 40 bp, Homo sapiens
  misc_feature 1..40: note = chr19:57683295-57683335
  misc_feature 1..40: note = hyper
  source 1..40: mol_type = genomic DNA
gggcgcgagcgggggtccggggccgcgagctggggtccgg

SEQ ID NO: 58395 - DNA, 110 bp, Homo sapiens; identical to SEQ ID NO: 37802
  misc_feature 1..110: note = chr19:57683576-57683686
  misc_feature 1..110: note = hyper
  source 1..110: mol_type = genomic DNA

SEQ ID NO: 58396 - DNA, 94 bp, Homo sapiens; identical to SEQ ID NO: 37803
  misc_feature 1..94: note = chr19:57683805-57683899
  misc_feature 1..94: note = hyper
  source 1..94: mol_type = genomic DNA

SEQ ID NO: 58397 - DNA, 100 bp, Homo sapiens; identical to SEQ ID NO: 37804
  misc_feature 1..100: note = chr19:57703285-57703385
  misc_feature 1..100: note = hyper
  source 1..100: mol_type = genomic DNA

SEQ ID NO: 58398 - DNA, 30 bp, Homo sapiens; identical to SEQ ID NO: 37805
  misc_feature 1..30: note = chr19:57832233-57832263
  misc_feature 1..30: note = hyper
  source 1..30: mol_type = genomic DNA

SEQ ID NO: 58399 - DNA, 175 bp, Homo sapiens
  misc_feature 1..175: note = chr19:57862783-57862958
  misc_feature 1..175: note = hyper
  source 1..175: mol_type = genomic DNA
ccatgacccctgtcgtgggacgggcggcctctcgcggaggtgtctgccggggctgggctcttaccgaggcctccacacacgtcctcttgtccttgtctcccccagaagcagccgccttagtcttgtgagcgtttttacaccgggtagattgagacttggagtgctacactcagcc

SEQ ID NO: 58400 - DNA, 15 bp, Homo sapiens
  misc_feature 1..15: note = chr19:57989033-57989048
  misc_feature 1..15: note = hyper
  source 1..15: mol_type = genomic DNA
aacactagtaagcgg

SEQ ID NO: 58401 - DNA, 342 bp, Homo sapiens; identical to SEQ ID NO: 37809
  misc_feature 1..342: note = chr19:57998952-57999294
  misc_feature 1..342: note = hyper
  source 1..342: mol_type = genomic DNA

SEQ ID NO: 58402 - DNA, 54 bp, Homo sapiens; identical to SEQ ID NO: 23187
  misc_feature 1..54: note = chr19:58011070-58011124
  misc_feature 1..54: note = hyper
  source 1..54: mol_type = genomic DNA

SEQ ID NO: 58403 - DNA, 64 bp, Homo sapiens; identical to SEQ ID NO: 23188
  misc_feature 1..64: note = chr19:58011281-58011345
  misc_feature 1..64: note = hyper
  source 1..64: mol_type = genomic DNA

SEQ ID NO: 58404 - DNA, 178 bp, Homo sapiens; identical to SEQ ID NO: 37811
  misc_feature 1..178: note = chr19:58011346-58011524
  misc_feature 1..178: note = hyper
  source 1..178: mol_type = genomic DNA

SEQ ID NO: 58405 - DNA, 28 bp, Homo sapiens
  misc_feature 1..28: note = chr19:58038557-58038585
  misc_feature 1..28: note = hyper
  source 1..28: mol_type = genomic DNA
attgagtcctcacagcgcggcggactgc

SEQ ID NO: 58406 - DNA, 154 bp, Homo sapiens; identical to SEQ ID NO: 23190
  misc_feature 1..154: note = chr19:58038969-58039123
  misc_feature 1..154: note = hyper
  source 1..154: mol_type = genomic DNA

SEQ ID NO: 58407 - DNA, 204 bp, Homo sapiens; identical to SEQ ID NO: 37814
  misc_feature 1..204: note = chr19:58070569-58070773
  misc_feature 1..204: note = hyper
  source 1..204: mol_type = genomic DNA

SEQ ID NO: 58408 - DNA, 303 bp, Homo sapiens; identical to SEQ ID NO: 37815
  misc_feature 1..303: note = chr19:58071094-58071397
  misc_feature 1..303: note = hyper
  source 1..303: mol_type = genomic DNA

SEQ ID NO: 58409 - DNA, 45 bp, Homo sapiens
  misc_feature 1..45: note = chr19:58094961-58095006
  misc_feature 1..45: note = hyper
  source 1..45: mol_type = genomic DNA
cagagcaggagcagccgggggcgcggcccccacgtggcctcccgg

SEQ ID NO: 58410 - DNA, 154 bp, Homo sapiens; identical to SEQ ID NO: 37818
  misc_feature 1..154: note = chr19:58111112-58111266
  misc_feature 1..154: note = hyper
  source 1..154: mol_type = genomic DNA

SEQ ID NO: 58411 - DNA, 91 bp, Homo sapiens
  misc_feature 1..91: note = chr19:58111541-58111632
  misc_feature 1..91: note = hyper
  source 1..91: mol_type = genomic DNA
cccgaaactgagggacgcgtgaagggttttctgcagcccggaccgcactgtccggcacagtgaggcgctggtgctggatctcgtttctggt

SEQ ID NO: 58412 - DNA, 81 bp, Homo sapiens
  misc_feature 1..81: note = chr19:58111783-58111864
  misc_feature 1..81: note = hyper
  source 1..81: mol_type = genomic DNA
actgagtttcaccagcacactgagggccacagcgcgtaggacagaagaggggcacggccccagtcacgcttctaaaagttt

SEQ ID NO: 58413 - DNA, 122 bp, Homo sapiens; identical to SEQ ID NO: 23194
  misc_feature 1..122: note = chr19:58125422-58125544
  misc_feature 1..122: note = hyper
  source 1..122: mol_type = genomic DNA

SEQ ID NO: 58414 - DNA, 172 bp, Homo sapiens
  misc_feature 1..172: note = chr19:58125881-58126053
  misc_feature 1..172: note = hyper
  source 1..172: mol_type = genomic DNA
cctttcccagactttcgcccgccccaaatcctgaagttccaaatgaggagcgcctgtctgagtccctgcagcgcaggccccagtgtccaaggcagcggggcgctggtgggtgggggcgagtgtgactggcagaggggcagcctgagcataggtttggagctggactgagccc

SEQ ID NO: 58415 - DNA, 39 bp, Homo sapiens; identical to SEQ ID NO: 37821
  misc_feature 1..39: note = chr19:58126054-58126093
  misc_feature 1..39: note = hyper
  source 1..39: mol_type = genomic DNA

SEQ ID NO: 58416 - DNA, 55 bp, Homo sapiens; identical to SEQ ID NO: 37822
  misc_feature 1..55: note = chr19:58144370-58144425
  misc_feature 1..55: note = hyper
  source 1..55: mol_type = genomic DNA

SEQ ID NO: 58417 - DNA, 366 bp, Homo sapiens; identical to SEQ ID NO: 37823
  misc_feature 1..366: note = chr19:58175608-58175974
  misc_feature 1..366: note = hyper
  source 1..366: mol_type = genomic DNA

SEQ ID NO: 58418 - DNA, 105 bp, Homo sapiens
  misc_feature 1..105: note = chr19:58239088-58239193
  misc_feature 1..105: note = hyper
  source 1..105: mol_type = genomic DNA
gtagagtgtggttcccactgagctatccttcaaggcaggggattctcggcctgggctcttgggaaaactcgaagtaggagggccaagttgtttgggaaaagtaac

SEQ ID NO: 58419 - DNA, 371 bp, Homo sapiens; identical to SEQ ID NO: 37829
  misc_feature 1..371: note = chr19:58281000-58281371
  misc_feature 1..371: note = hyper
  source 1..371: mol_type = genomic DNA

SEQ ID NO: 58420 - DNA, 30 bp, Homo sapiens; identical to SEQ ID NO: 37830
  misc_feature 1..30: note = chr19:58361192-58361222
  misc_feature 1..30: note = hyper
  source 1..30: mol_type = genomic DNA

SEQ ID NO: 58421 - DNA, 29 bp, Homo sapiens
  misc_feature 1..29: note = chr19:58361543-58361572
  misc_feature 1..29: note = hyper
  source 1..29: mol_type = genomic DNA
gtaggaacactgaggcgctcacaggaggc

SEQ ID NO: 58422 - DNA, 37 bp, Homo sapiens
  misc_feature 1..37: note = chr19:58400042-58400079
  misc_feature 1..37: note = hyper
  source 1..37: mol_type = genomic DNA
tccgggctgcagagccgtgaacaggcgctgctacctc

SEQ ID NO: 58423 - DNA, 242 bp, Homo sapiens
  misc_feature 1..242: note = chr19:58400175-58400417
  misc_feature 1..242: note = hyper
  source 1..242: mol_type = genomic DNA
cacgtggttttaagcagagtcgggaggatagggcgaccagccaggagatatgggcacgacggtccgtatcctggcccaggagtgggtcacgctgggcgccgtcacagagctccagagtagcctctgtgcagcggaggacaactgctccccgacttctgggttcagtcaccacagtgcggacctagcgctcaggagcctctcctacaaataaatccaacaccaatcaaaatggccgccaccag

SEQ ID NO: 58424 - DNA, 55 bp, Homo sapiens
  misc_feature 1..55: note = chr19:58400518-58400573
  misc_feature 1..55: note = hyper
  source 1..55: mol_type = genomic DNA
tgggtaatgtagttccctaggcaacaaggagggtaaagggcgcaattcccagagg

SEQ ID NO: 58425 - DNA, 403 bp, Homo sapiens; identical to SEQ ID NO: 37833
  misc_feature 1..403: note = chr19:58446443-58446846
  misc_feature 1..403: note = hyper
  source 1..403: mol_type = genomic DNA

SEQ ID NO: 58426 - DNA, 194 bp, Homo sapiens; identical to SEQ ID NO: 37834
  misc_feature 1..194: note = chr19:58458530-58458724
  misc_feature 1..194: note = hyper
  source 1..194: mol_type = genomic DNA

SEQ ID NO: 58427 - DNA, 31 bp, Homo sapiens; identical to SEQ ID NO: 23202
  misc_feature 1..31: note = chr19:58459201-58459232
  misc_feature 1..31: note = hyper
  source 1..31: mol_type = genomic DNA

SEQ ID NO: 58428 - DNA, 835 bp, Homo sapiens
  misc_feature 1..835: note = chr19:58513683-58514518
  misc_feature 1..835: note = hyper
  source 1..835: mol_type = genomic DNA
tgcttccagagctcccgacccaaatttcctcctcaagaccgacgcggccgcgacgctgcaaaagctcgtcccggcctcacctggctcgcggccggcggtcccccttgaaggcggcgcagcaggatcggggtctgcccgcctggggcgtttggcttttgtcccgcgccgaggtccggcccaggagtgcgcttgggagctcccggcgcggcctcggggacaaaggcccgcggagccgacgtgcagcagagttcacccaggcccgtccgaccagaaaacgaagaacgcccggaggcgggaggccggaggcaggctgctggctggagaaccgacggcaacgacggcgcaaagccggcgcggaaagggcaggcgcaggacccaccctgacgccgcctctcccagccggctctcctgaccccccaagccccgcagctacggcggccccacagcctgagcaaaggcctcacctcagccgcggacaatggcggctgcttccccggcgtcgaccggagcgcgccgcggggtctgctgggagctgtagttccaggcgggcacttccggcgtcgggcagcggcgccgccatgacaggttcctgggccgcgccgcctcgccctgcctgggcggggttgggacctttctggcacctgcgtcgaagccggcggcaggatggactttgttgtcccggtcccagaccaccctcctccaccgtcgcctcccactgcaaaaaggcctgggtaagtcgcggccccgcgggcctcggtttgcccatccgcaaaatggcgcctcgtggtaccgggtttcccgggaggagctcggcgagttctcagcgctctcgagg

SEQ ID NO: 58429 - DNA, 159 bp, Homo sapiens
  misc_feature 1..159: note = chr19:58514552-58514711
  misc_feature 1..159: note = hyper
  source 1..159: mol_type = genomic DNA
aagtgactgctgttattctctttaagataaggaacctaattcgagctacccttctctgtgaagctcgacggctgagaacgtcagggctcgttcccaagtctctttccagaggccaggctttatgggagcatgggttaccagcgacgcaccctgtgagtt

SEQ ID NO: 58430 - DNA, 12 bp, Homo sapiens
  misc_feature 1..12: note = chr19:58520941-58520953
  misc_feature 1..12: note = hyper
  source 1..12: mol_type = genomic DNA
tctttggcatca

SEQ ID NO: 58431 - DNA, 48 bp, Homo sapiens; identical to SEQ ID NO: 37838
  misc_feature 1..48: note = chr19:58521268-58521316
  misc_feature 1..48: note = hyper
  source 1..48: mol_type = genomic DNA

SEQ ID NO: 58432 - DNA, 45 bp, Homo sapiens
  misc_feature 1..45: note = chr19:58545100-58545145
  misc_feature 1..45: note = hyper
  source 1..45: mol_type = genomic DNA
ggacactgtataaaacggttgcgtgtctggaatgccgtcgttttg

SEQ ID NO: 58433 - DNA, 60 bp, Homo sapiens; identical to SEQ ID NO: 37842
  misc_feature 1..60: note = chr19:58570949-58571009
  misc_feature 1..60: note = hyper
  source 1..60: mol_type = genomic DNA

SEQ ID NO: 58434 - DNA, 147 bp, Homo sapiens
  misc_feature 1..147: note = chr19:58609854-58610001
  misc_feature 1..147: note = hyper
  source 1..147: mol_type = genomic DNA
ggtgagaaacggagaaacaaagacaaaaagacgcgcagaccgggagggagagaagcatgaaggcccacagacgctcgggggcagaccaagacgccctggggtccccgaaacagagatgtacagagtcggacacggaaagggagagac

SEQ ID NO: 58435 - DNA, 30 bp, Homo sapiens; identical to SEQ ID NO: 37846
  misc_feature 1..30: note = chr19:58629357-58629387
  misc_feature 1..30: note = hyper
  source 1..30: mol_type = genomic DNA

SEQ ID NO: 58436 - DNA, 250 bp, Homo sapiens
  misc_feature 1..250: note = chr19:58662094-58662344
  misc_feature 1..250: note = hyper
  source 1..250: mol_type = genomic DNA
gctcagggatgcgtcggcacttacggttggcggccggcggcagccatgttccgggcgattgcgcttgcgcggctgccgggacaaggatgtgcgcgtgcgcggagtccccgagcttcccccgcccaacgctggggcggccgcgggtaccgggttattcattaccctggcgtggacttgcctcggggcggacgcgcaggcatttactttctcctatggtctcctctgatttttaacccgatgctatcattct

SEQ ID NO: 58437 - DNA, 182 bp, Homo sapiens; identical to SEQ ID NO: 23207
  misc_feature 1..182: note = chr19:58666313-58666495
  misc_feature 1..182: note = hyper
  source 1..182: mol_type = genomic DNA

SEQ ID NO: 58438 - DNA, 183 bp, Homo sapiens; identical to SEQ ID NO: 13601
  misc_feature 1..183: note = chr19:58666550-58666733
  misc_feature 1..183: note = hyper
  source 1..183: mol_type = genomic DNA

SEQ ID NO: 58439 - DNA, 703 bp, Homo sapiens; identical to SEQ ID NO: 37850
  misc_feature 1..703: note = chr19:58694552-58695255
  misc_feature 1..703: note = hyper
  source 1..703: mol_type = genomic DNA

SEQ ID NO: 58440 - DNA, 179 bp, Homo sapiens; identical to SEQ ID NO: 37851
  misc_feature 1..179: note = chr19:58740209-58740388
  misc_feature 1..179: note = hyper
  source 1..179: mol_type = genomic DNA

SEQ ID NO: 58441 - DNA, 203 bp, Homo sapiens
  misc_feature 1..203: note = chr19:58951068-58951271
  misc_feature 1..203: note = hyper
  source 1..203: mol_type = genomic DNA
caggatcctgagggccggaatcccagcgggtgagggcctggggcacactccacttacctgcgccgggcccatcagcaacgctggcaaccccattagaacctgtgggctgggcagggccataacaggaggcccagggctagccctgccgctgggccgaaccctcacacttccgctgggtgacggtcgcactcaggacctgtctt

SEQ ID NO: 58442 - DNA, 142 bp, Homo sapiens; identical to SEQ ID NO: 23212
  misc_feature 1..142: note = chr19:58951916-58952058
  misc_feature 1..142: note = hyper
  source 1..142: mol_type = genomic DNA

SEQ ID NO: 58443 - DNA, 63 bp, Homo sapiens
  misc_feature 1..63: note = chr20:291085-291148
  misc_feature 1..63: note = hyper
  source 1..63: mol_type = genomic DNA
aaggggagttgggggcgagcgccgaaatctgagtggctctttcaagcctccgttgccatagaa

SEQ ID NO: 58444 - DNA, 107 bp, Homo sapiens
  misc_feature 1..107: note = chr20:590327-590434
  misc_feature 1..107: note = hyper
  source 1..107: mol_type = genomic DNA
ggccgcagcgagggacgcagcacactcacccccttgcgctggttgctgaggcagaaggtgcagatggagcgcggctggcggccgccgtcggcggcggcggggacggc

SEQ ID NO: 58445 - DNA, 97 bp, Homo sapiens
  misc_feature 1..97: note = chr20:590502-590599
  misc_feature 1..97: note = hyper
  source 1..97: mol_type = genomic DNA
cgttggccaggtgcgcgatgtagctggacgccaggcgcacggtctcgatcttggacagcttgcggtccaccggctcggtggggatgagcgtgcgcag

SEQ ID NO: 58446 - DNA, 108 bp, Homo sapiens; identical to SEQ ID NO: 37859
  misc_feature 1..108: note = chr20:590967-591075
  misc_feature 1..108: note = hyper
  source 1..108: mol_type = genomic DNA

SEQ ID NO: 58447 - DNA, 111 bp, Homo sapiens
  misc_feature 1..111: note = chr20:592449-592560
  misc_feature 1..111: note = hyper
  source 1..111: mol_type = genomic DNA
gctgggctttggggaggagggaaacagccagcatgggccccctccccgcagggctggtcccacacacagccccagaccaggctgctgcttcctgagccgatgaattattac

SEQ ID NO: 58448 - DNA, 39 bp, Homo sapiens; identical to SEQ ID NO: 23215
  misc_feature 1..39: note = chr20:644787-644826
  misc_feature 1..39: note = hyper
  source 1..39: mol_type = genomic DNA

SEQ ID NO: 58449 - DNA, 369 bp, Homo sapiens; identical to SEQ ID NO: 37862
  misc_feature 1..369: note = chr20:644985-645354
  misc_feature 1..369: note = hyper
  source 1..369: mol_type = genomic DNA

SEQ ID NO: 58450 - DNA, 139 bp, Homo sapiens; identical to SEQ ID NO: 13613
  misc_feature 1..139: note = chr20:656937-657076
  misc_feature 1..139: note = hyper
  source 1..139: mol_type = genomic DNA

SEQ ID NO: 58451 - DNA, 36 bp, Homo sapiens; identical to SEQ ID NO: 37864
  misc_feature 1..36: note = chr20:690741-690777
  misc_feature 1..36: note = hyper
  source 1..36: mol_type = genomic DNA

SEQ ID NO: 58452 - DNA, 96 bp, Homo sapiens; identical to SEQ ID NO: 37865
  misc_feature 1..96: note = chr20:708614-708710
  misc_feature 1..96: note = hyper
  source 1..96: mol_type = genomic DNA

SEQ ID NO: 58453 - DNA, 30 bp, Homo sapiens; identical to SEQ ID NO: 37866
  misc_feature 1..30: note = chr20:866071-866101
  misc_feature 1..30: note = hyper
  source 1..30: mol_type = genomic DNA

SEQ ID NO: 58454 - DNA, 78 bp, Homo sapiens
  misc_feature 1..78: note = chr20:982671-982749
  misc_feature 1..78: note = hyper
  source 1..78: mol_type = genomic DNA
gcccccggtctgccccgcagcgcctgcccggccgccctgcccagccaccccttgtaccttgcttcttccttcggttca

SEQ ID NO: 58455 - DNA, 209 bp, Homo sapiens
  misc_feature 1..209: note = chr20:982989-983198
  misc_feature 1..209: note = hyper
  source 1..209: mol_type = genomic DNA
gcggggaggagccggcgcggcgggggcggcgcgttaaccagctcggggcccgggagcgcgcgcggggagggggcgggggtcacccgggtcggggccctcgagttcgatctgtcccgcagccggcggtcttgcgtctttcccgcccccagcactgcccccgagcacgtgcacgtgcccaccgccagccacaggtacgcacgcgcgcgcag

SEQ ID NO: 58456 - DNA, 50 bp, Homo sapiens; identical to SEQ ID NO: 37869
  misc_feature 1..50: note = chr20:1206113-1206163
  misc_feature 1..50: note = hyper
  source 1..50: mol_type = genomic DNA

SEQ ID NO: 58457 - DNA, 440 bp, Homo sapiens
  misc_feature 1..440: note = chr20:1783321-1783761
  misc_feature 1..440: note = hyper
  source 1..440: mol_type = genomic DNA
tccaggcagtaggttcgccagccattgcttgtgcgtcttcgcggagagagaggggggagatgccccggcgctccttacccggctggataagaccctttggggaacttgctgcttcgcaagtcttacttgtgaggacccggagggtttgcctttgaccccgcctgtgaccttaagaaaacccctttctaccctgcgcctgtcccacagctggaagtgataattttaagaatgaattaagcactcggtgtgtgacactgcggcactaagcactttctggactgtgttaggccccattttacagacggggaagctgaggcctccagaggcggagtaacctgctcatggttacaaagctggtcagcggcgggcaggatttgaatccagggttcccggttcctaatcctctgcttttaccacttaatttatcctgcctccaaggg

SEQ ID NO: 58458 - DNA, 155 bp, Homo sapiens; identical to SEQ ID NO: 37871
  misc_feature 1..155: note = chr20:2187759-2187914
  misc_feature 1..155: note = hyper
  source 1..155: mol_type = genomic DNA

SEQ ID NO: 58459 - skipped

SEQ ID NO: 58460 - DNA, 16 bp, Homo sapiens
  misc_feature 1..16: note = chr20:2672984-2673000
  misc_feature 1..16: note = hyper
  source 1..16: mol_type = genomic DNA
agtccaggcacaaggc

SEQ ID NO: 58461 - DNA, 59 bp, Homo sapiens; identical to SEQ ID NO: 37876
  misc_feature 1..59: note = chr20:2731616-2731675
  misc_feature 1..59: note = hyper
  source 1..59: mol_type = genomic DNA

SEQ ID NO: 58462 - DNA, 89 bp, Homo sapiens
  misc_feature 1..89: note = chr20:2780664-2780753
  misc_feature 1..89: note = hyper
  source 1..89: mol_type = genomic DNA
gggaactggggctgccgagtcagcagccattgctcccagcagggagttgagggagtgtgagtgtgtatatgtgtgtgtgcactgtgagt

SEQ ID NO: 58463 - DNA, 279 bp, Homo sapiens
  misc_feature 1..279: note = chr20:2781452-2781731
  misc_feature 1..279: note = hyper
  source 1..279: mol_type = genomic DNA
tcctctccgccgtctggggccaacccgcctcgttggcgcgctgcgcctttatagtctgcaaagccacactgaagagaccagagatcacctggtggccatcaagtcgaccaacaggaggcaaagccccttatctgagcaattcagaatgacacttccctattgtctaaagccacatctggtaccaagcttccgtcccaagaatttataagtaactagaatttctgtacgtttccggaatgagtgcacgttaagacccattgtgcaaactttgctgacatc

SEQ ID NO: 58464 - DNA, 185 bp, Homo sapiens
  misc_feature 1..185: note = chr20:2781761-2781946
  misc_feature 1..185: note = hyper
  source 1..185: mol_type = genomic DNA
tttaccatgacctaagtgactaatgtggtccaaattaccctgcagttccccgcagggagctcagtcctctcttgctgaagcgcctactgcgctctgctgcctcgtcctttccgtctaataaaactttccttttcagacctacacggttgttgataagttcttttaccacccgggagccaaccact

SEQ ID NO: 58465 - DNA, 44 bp, Homo sapiens
  misc_feature 1..44: note = chr20:2785615-2785659
  misc_feature 1..44: note = hyper
  source 1..44: mol_type = genomic DNA
caccatcaccaagcccggccctgcccctcctctcctttcccttc

SEQ ID NO: 58466 - DNA, 69 bp, Homo sapiens; identical to SEQ ID NO: 37881
  misc_feature 1..69: note = chr20:2820792-2820861
  misc_feature 1..69: note = hyper
  source 1..69: mol_type = genomic DNA

SEQ ID NO: 58467 - DNA, 138 bp, Homo sapiens; identical to SEQ ID NO: 37882
  misc_feature 1..138: note = chr20:2852976-2853114
  misc_feature 1..138: note = hyper
  source 1..138: mol_type = genomic DNA

SEQ ID NO: 58468 - DNA, 59 bp, Homo sapiens
  misc_feature 1..59: note = chr20:3052524-3052583
  misc_feature 1..59: note = hyper
  source 1..59: mol_type = genomic DNA
cggattttgacgccccgcccttgaccgcggtcgaggcccccacggcgccccagcgcgtc

SEQ ID NO: 58469 - DNA, 280 bp, Homo sapiens
  misc_feature 1..280: note = chr20:3052836-3053116
  misc_feature 1..280: note = hyper
  source 1..280: mol_type = genomic DNA
aactacctgccgtcgccctgccagtccggccagaaggcgtgcgggagcgggggccgctgcgcggtcttgggcctctgctgcagcccgggtgagcggggcaaggcgctccggggccagggggaggcgggcgggggtgcggccgggattcccctgactccacctcttcctccagacggctgccacgccgaccctgcctgcgacgcggaagccaccttctcccagcgctgaaacttgatggctccgaacaccctcgaagcgcgccactcgcttcccccatagc

SEQ ID NO: 58470 - DNA, 266 bp, Homo sapiens; identical to SEQ ID NO: 37885
  misc_feature 1..266: note = chr20:3063125-3063391
  misc_feature 1..266: note = hyper
  source 1..266: mol_type = genomic DNA

SEQ ID NO: 58471 - DNA, 185 bp, Homo sapiens; identical to SEQ ID NO: 37886
  misc_feature 1..185: note = chr20:3063622-3063807
  misc_feature 1..185: note = hyper
  source 1..185: mol_type = genomic DNA

SEQ ID NO: 58472 - DNA, 141 bp, Homo sapiens; identical to SEQ ID NO: 37887
  misc_feature 1..141: note = chr20:3073251-3073392
  misc_feature 1..141: note = hyper
  source 1..141: mol_type = genomic DNA

SEQ ID NO: 58473 - DNA, 113 bp, Homo sapiens
  misc_feature 1..113: note = chr20:3073899-3074012
  misc_feature 1..113: note = hyper
  source 1..113: mol_type = genomic DNA
gtccacgtgtgagcctcgccctaggctgccaattgagagttccacctccgcccagagagaccccacctcacccctccaacctggggcgcgcgggccggcggaggggtcctggg

SEQ ID NO: 58474 - DNA, 133 bp, Homo sapiens; identical to SEQ ID NO: 37889
  misc_feature 1..133: note = chr20:3218701-3218834
  misc_feature 1..133: note = hyper
  source 1..133: mol_type = genomic DNA

SEQ ID NO: 58475 - DNA, 70 bp, Homo sapiens
  misc_feature 1..70: note = chr20:3220823-3220893
  misc_feature 1..70: note = hyper
  source 1..70: mol_type = genomic DNA
tcagccgcgctgggacggagtcctcggccactgtgccctaaccatggtagaggaacggggacaggccggg

SEQ ID NO: 58476 - DNA, 70 bp, Homo sapiens
  misc_feature 1..70: note = chr20:3220943-3221013
  misc_feature 1..70: note = hyper
  source 1..70: mol_type = genomic DNA
atgcatagattgggtgagtaaggctggcccagttctcctcccggcaagataagaacgcattaggagggaa

SEQ ID NO: 58477 - DNA, 39 bp, Homo sapiens; identical to SEQ ID NO: 37891
  misc_feature 1..39: note = chr20:3229253-3229292
  misc_feature 1..39: note = hyper
  source 1..39: mol_type = genomic DNA

SEQ ID NO: 58478 - DNA, 21 bp, Homo sapiens
  misc_feature 1..21: note = chr20:3229612-3229633
  misc_feature 1..21: note = hyper
  source 1..21: mol_type = genomic DNA
gagaaccggcacccgtgcacg

SEQ ID NO: 58479 - DNA, 30 bp, Homo sapiens; identical to SEQ ID NO: 37893
  misc_feature 1..30: note = chr20:3388937-3388967
  misc_feature 1..30: note = hyper
  source 1..30: mol_type = genomic DNA

SEQ ID NO: 58480 - DNA, 238 bp, Homo sapiens; identical to SEQ ID NO: 37894
  misc_feature 1..238: note = chr20:3641310-3641548
  misc_feature 1..238: note = hyper
  source 1..238: mol_type = genomic DNA

SEQ ID NO: 58481 - DNA, 26 bp, Homo sapiens
  misc_feature 1..26: note = chr20:3641937-3641963
  misc_feature 1..26: note = hyper
  source 1..26: mol_type = genomic DNA
tgggaaaggcgcggggaggctgcagg

SEQ ID NO: 58482 - DNA, 246 bp, Homo sapiens; identical to SEQ ID NO: 37896
  misc_feature 1..246: note = chr20:3662517-3662763
  misc_feature 1..246: note = hyper
  source 1..246: mol_type = genomic DNA

SEQ ID NO: 58483 - skipped

SEQ ID NO: 58484 - DNA, 146 bp, Homo sapiens; identical to SEQ ID NO: 37898
  misc_feature 1..146: note = chr20:3713305-3713451
  misc_feature 1..146: note = hyper
  source 1..146: mol_type = genomic DNA

SEQ ID NO: 58485 - DNA, 821 bp, Homo sapiens; identical to SEQ ID NO: 37899
  misc_feature 1..821: note = chr20:3758266-3759087
  misc_feature 1..821: note = hyper
  source 1..821: mol_type = genomic DNA

SEQ ID NO: 58486 - DNA, 48 bp, Homo sapiens; identical to SEQ ID NO: 37900
  misc_feature 1..48: note = chr20:3766983-3767031
  misc_feature 1..48: note = hyper
  source 1..48: mol_type = genomic DNA

SEQ ID NO: 58487 - DNA, 154 bp, Homo sapiens; identical to SEQ ID NO: 37901
  misc_feature 1..154: note = chr20:4202578-4202732
  misc_feature 1..154: note = hyper
  source 1..154: mol_type = genomic DNA

SEQ ID NO: 58488 - DNA, 10 bp, Homo sapiens
  misc_feature 1..10: note = chr20:4229392-4229402
  misc_feature 1..10: note = hyper
  source 1..10: mol_type = genomic DNA
tcccccgcgg

SEQ ID NO: 58489 - DNA, 73 bp, Homo sapiens; identical to SEQ ID NO: 23238
  misc_feature 1..73: note = chr20:4229432-4229505
  misc_feature 1..73: note = hyper
  source 1..73: mol_type = genomic DNA

SEQ ID NO: 58490 - DNA, 51 bp, Homo sapiens
  misc_feature 1..51: note = chr20:4229735-4229786
  misc_feature 1..51: note = hyper
  source 1..51: mol_type = genomic DNA
tcctgtgacgcggagcgcggctgtccgagagcggagctgcctggcccgggc

SEQ ID NO: 58491 - DNA, 63 bp, Homo sapiens
  misc_feature 1..63: note = chr20:4803007-4803070
  misc_feature 1..63: note = hyper
  source 1..63: mol_type = genomic DNA
ctctcccgaaaaacacgttctaggcgccgggattccagatacctgggaaatagagtgcacgca

SEQ ID NO: 58492 - DNA, 271 bp, Homo sapiens
  misc_feature 1..271: note = chr20:4803650-4803921
  misc_feature 1..271: note = hyper
  source 1..271: mol_type = genomic DNA
tagaaggaggactagctccaagccacaactttcttcggacccaaggcaggccggctggggctccgcgcctacacggcccctggcgggggtccgcgcgccccgggagccccgcggctcggggaggaaagaggagacaagagacaggcgaggattacggggctgacccagccggggtagggaccatcgtggaaaaactttggcgaggtggggggacgcggaaagagagcggcccgcgccctgcaccttgcgccgggcatcccgcgccagtgcc

SEQ ID NO: 58493 - DNA, 30 bp, Homo sapiens; identical to SEQ ID NO: 37905
  misc_feature 1..30: note = chr20:4981307-4981337
  misc_feature 1..30: note = hyper
  source 1..30: mol_type = genomic DNA

SEQ ID NO: 58494 - DNA, 148 bp, Homo sapiens; identical to SEQ ID NO: 23240
  misc_feature 1..148: note = chr20:5296900-5297048
  misc_feature 1..148: note = hyper
  source 1..148: mol_type = genomic DNA

SEQ ID NO: 58495 - DNA, 65 bp, Homo sapiens; identical to SEQ ID NO: 37908
  misc_feature 1..65: note = chr20:5297672-5297737
  misc_feature 1..65: note = hyper
  source 1..65: mol_type = genomic DNA

SEQ ID NO: 58496 - DNA, 180 bp, Homo sapiens; identical to SEQ ID NO: 37909
  misc_feature 1..180: note = chr20:5892057-5892237
  misc_feature 1..180: note = hyper
  source 1..180: mol_type = genomic DNA

SEQ ID NO: 58497 - DNA, 495 bp, Homo sapiens; identical to SEQ ID NO: 37910
  misc_feature 1..495: note = chr20:6032710-6033205
  misc_feature 1..495: note = hyper
  source 1..495: mol_type = genomic DNA

SEQ ID NO: 58498 - DNA, 256 bp, Homo sapiens; identical to SEQ ID NO: 13649
  misc_feature 1..256: note = chr20:6033206-6033462
  misc_feature 1..256: note = hyper
  source 1..256: mol_type = genomic DNA

SEQ ID NO: 58499 - DNA, 76 bp, Homo sapiens; identical to SEQ ID NO: 37912
  misc_feature 1..76: note = chr20:6103795-6103871
  misc_feature 1..76: note = hyper
  source 1..76: mol_type = genomic DNA

SEQ ID NO: 58500 - DNA, 141 bp, Homo sapiens
  misc_feature 1..141: note = chr20:6748784-6748925
  misc_feature 1..141: note = hyper
  source 1..141: mol_type = genomic DNA
gagagcacagccacccgcctcggcggcccgggactcggctcgactcgccggagaatgcgcccgaggacgacggggcgccagagccgcggtgctttcaactggcgagcgcgaatgggggtgcactggagtaaggcagagtga

SEQ ID NO: 58501 - DNA, 113 bp, Homo sapiens
  misc_feature 1..113: note = chr20:8112265-8112378
  misc_feature 1..113: note = hyper
  source 1..113: mol_type = genomic DNA
actcaaggagaggagcgggagagggcaccctctttcttcctcggaaaataaaacctttgctttctttaggatgggctttctgtctcgaaagcacaacgtaaccgtttgcccgg

SEQ ID NO: 58502 - DNA, 331 bp, Homo sapiens
  misc_feature 1..331: note = chr20:8112408-8112739
  misc_feature 1..331: note = hyper
  source 1..331: mol_type = genomic DNA
ggcgcggccaggtttcctcaaagagcctctcaactgcgctcttctctgctgataaatgataattctcttcaaaaagctggtttgtggctggcgctggagagctccagctagagccaaaagccaggggttgcctctttggttcctcccgatgggccccttttcccagccagttgggatccaaagacgctccggagctcgagcccaaattcccaagaaaaccccaaagagcgtaaggctcctggggacccctagcacctctgcaaccagggcacggggcatgctcagagcgaatgcgggaggcaggcgttggctgcaatggggctcgggagcc

SEQ ID NO: 58503 - DNA, 269 bp, Homo sapiens
  misc_feature 1..269: note = chr20:8113288-8113557
  misc_feature 1..269: note = hyper
  source 1..269: mol_type = genomic DNA
atgagcccagatggccggggctcaacccggagtgcacgccttgcaactcaagcccgtgtgcgtgtccgacagcctcaagaagggcaccaaattcgtcaagtgggatgatgtaagtattggggcggcccgagtcggggcgctggctcgggcaccgggcagggcgggcgtcgtgggggtggggcaaggggcgcgttatgcaatgggcgcactgggagcgggcaggggcagcctcgggcgcacaggttggcatctgccaaagcggatgtcca

SEQ ID NO: 58504 - DNA, 39 bp, Homo sapiens
  misc_feature 1..39: note = chr20:8113605-8113644
  misc_feature 1..39: note = hyper
  source 1..39: mol_type = genomic DNA
gccatcctttctgggtctggcaggcgccccctgagggtc

SEQ ID NO: 58505 - DNA, 30 bp, Homo sapiens; identical to SEQ ID NO: 37916
  misc_feature 1..30: note = chr20:8113912-8113942
  misc_feature 1..30: note = hyper
  source 1..30: mol_type = genomic DNA

SEQ ID NO: 58506 - DNA, 50 bp, Homo sapiens; identical to SEQ ID NO: 37917
  misc_feature 1..50: note = chr20:9487096-9487146
  misc_feature 1..50: note = hyper
  source 1..50: mol_type = genomic DNA

SEQ ID NO: 58507 - DNA, 81 bp, Homo sapiens; identical to SEQ ID NO: 37918
  misc_feature 1..81: note = chr20:9487211-9487292
  misc_feature 1..81: note = hyper
  source 1..81: mol_type = genomic DNA

SEQ ID NO: 58508 - DNA, 48 bp, Homo sapiens
  misc_feature 1..48: note = chr20:9488328-9488376
  misc_feature 1..48: note = hyper
  source 1..48: mol_type = genomic DNA
cgcacctggcgggctggaccgggacagggggcggtgcgcaccggggct

SEQ ID NO: 58509 - skipped

SEQ ID NO: 58510 - DNA, 13 bp, Homo sapiens
  misc_feature 1..13: note = chr20:9495258-9495271
  misc_feature 1..13: note = hyper
  source 1..13: mol_type = genomic DNA
ccgtggaccgccg

SEQ ID NO: 58511 - DNA, 63 bp, Homo sapiens
  misc_feature 1..63: note = chr20:9495509-9495572
  misc_feature 1..63: note = hyper
  source 1..63: mol_type = genomic DNA
aaggaagaggggtccccagcatcgacagacttcgagttctcctgatgttgttccgtgagtagc

SEQ ID NO: 58512 - skipped

SEQ ID NO: 58513 - DNA, 30 bp, Homo sapiens; identical to SEQ ID NO: 13658
  misc_feature 1..30: note = chr20:9496079-9496109
  misc_feature 1..30: note = hyper
  source 1..30: mol_type = genomic DNA

SEQ ID NO: 58514 - skipped

SEQ ID NO: 58515 - DNA, 248 bp, Homo sapiens; identical to SEQ ID NO: 37929
  misc_feature 1..248: note = chr20:9819466-9819714
  misc_feature 1..248: note = hyper
  source 1..248: mol_type = genomic DNA

SEQ ID NO: 58516 - DNA, 131 bp, Homo sapiens; identical to SEQ ID NO: 23249
  misc_feature 1..131: note = chr20:10198600-10198731
  misc_feature 1..131: note = hyper
  source 1..131: mol_type = genomic DNA

SEQ ID NO: 58517 - DNA, 10 bp, Homo sapiens
  misc_feature 1..10: note = chr20:10198945-10198955
  misc_feature 1..10: note = hyper
  source 1..10: mol_type = genomic DNA
atgcccctac

SEQ ID NO: 58518 - DNA, 313 bp, Homo sapiens; identical to SEQ ID NO: 37932
  misc_feature 1..313: note = chr20:10199315-10199628
  misc_feature 1..313: note = hyper
  source 1..313: mol_type = genomic DNA

SEQ ID NO: 58519 - DNA, 37 bp, Homo sapiens; identical to SEQ ID NO: 13664
  misc_feature 1..37: note = chr20:10200078-10200115
  misc_feature 1..37: note = hyper
  source 1..37: mol_type = genomic DNA

SEQ ID NO: 58520 - DNA, 43 bp, Homo sapiens; identical to SEQ ID NO: 37934
  misc_feature 1..43: note = chr20:10200153-10200196
  misc_feature 1..43: note = hyper
  source 1..43: mol_type = genomic DNA

SEQ ID NO: 58521 - DNA, 43 bp, Homo sapiens
  misc_feature 1..43: note = chr20:13200556-13200599
  misc_feature 1..43: note = hyper
  source 1..43: mol_type = genomic DNA
taaatctttctaggacgcggagaaggaaggtaggaaattgggg

SEQ ID NO: 58522 - DNA, 367 bp, Homo sapiens; identical to SEQ ID NO: 37936
  misc_feature 1..367: note = chr20:13201198-13201565
  misc_feature 1..367: note = hyper
  source 1..367: mol_type = genomic DNA

SEQ ID NO: 58523 - DNA, 30 bp, Homo sapiens; identical to SEQ ID NO: 37937
  misc_feature 1..30: note = chr20:13202494-13202524
  misc_feature 1..30: note = hyper
  source 1..30: mol_type = genomic DNA

SEQ ID NO: 58524 - DNA, 41 bp, Homo sapiens; identical to SEQ ID NO: 37939
  misc_feature 1..41: note = chr20:17206884-17206925
  misc_feature 1..41: note = hyper
  source 1..41: mol_type = genomic DNA

SEQ ID NO: 58525 - DNA, 250 bp, Homo sapiens; identical to SEQ ID NO: 37940
  misc_feature 1..250: note = chr20:17207260-17207510
  misc_feature 1..250: note = hyper
  source 1..250: mol_type = genomic DNA

SEQ ID NO: 58526 - DNA, 196 bp, Homo sapiens
  misc_feature 1..196: note = chr20:17208389-17208585
  misc_feature 1..196: note = hyper
  source 1..196: mol_type = genomic DNA
caggatgccatgctccggggatgctgtccgaggtaccaagttctcgaggctgcctggggatggagggatgaagccctgaacagctaagcctggcgttggctacttggccagggaagtctcccccacccccatcccccggagaaagaatagtttcctacagacgaggctggacgtttggacactgcaattcacctcg

SEQ ID NO: 58527 - DNA, 37 bp, Homo sapiens; identical to SEQ ID NO: 23253
  misc_feature 1..37: note = chr20:17208620-17208657
  misc_feature 1..37: note = hyper
  source 1..37: mol_type = genomic DNA

SEQ ID NO: 58528 - DNA, 64 bp, Homo sapiens; identical to SEQ ID NO: 13668
  misc_feature 1..64: note = chr20:17208739-17208803
  misc_feature 1..64: note = hyper
  source 1..64: mol_type = genomic DNA

SEQ ID NO: 58529 - DNA, 40 bp, Homo sapiens; identical to SEQ ID NO: 37944
  misc_feature 1..40: note = chr20:17209595-17209635
  misc_feature 1..40: note = hyper
  source 1..40: mol_type = genomic DNA

SEQ ID NO: 58530 - DNA, 39 bp, Homo sapiens; identical to SEQ ID NO: 37945
  misc_feature 1..39: note = chr20:17919829-17919868
  misc_feature 1..39: note = hyper
  source 1..39: mol_type = genomic DNA

SEQ ID NO: 58531 - DNA, 176 bp, Homo sapiens
  misc_feature 1..176: note = chr20:18039647-18039823
  misc_feature 1..176: note = hyper
  source 1..176: mol_type = genomic DNA
agctgccgggtgctgcgggggcgcgtctggtcagggatgccctggagcccaaggctcacccaacagccagcctcacctgtctgtaacctgaccctccgcgctcccagcctacagggcccgggaatcaacacagcggttttccctgttcccttccgccctgaatggcccttggggac

SEQ ID NO: 58532 - DNA, 39 bp, Homo sapiens
  misc_feature 1..39: note = chr20:18039897-18039936
  misc_feature 1..39: note = hyper
  source 1..39: mol_type = genomic DNA
ccggggctgcgggcgggaccggtgcgcggcgcctctagg

SEQ ID NO: 58533 - DNA, 57 bp, Homo sapiens; identical to SEQ ID NO: 13669
  misc_feature 1..57: note = chr20:19192824-19192881
  misc_feature 1..57: note = hyper
  source 1..57: mol_type = genomic DNA

SEQ ID NO: 58534 - DNA, 257 bp, Homo sapiens; identical to SEQ ID NO: 37948
  misc_feature 1..257: note = chr20:19193359-19193616
  misc_feature 1..257: note = hyper
  source 1..257: mol_type = genomic DNA

SEQ ID NO: 58535 - DNA, 111 bp, Homo sapiens; identical to SEQ ID NO: 37949
  misc_feature 1..111: note = chr20:19739455-19739566
  misc_feature 1..111: note = hyper
  source 1..111: mol_type = genomic DNA

SEQ ID NO: 58536 - DNA, 90 bp, Homo sapiens
  misc_feature 1..90: note = chr20:19739696-19739786
  misc_feature 1..90: note = hyper
  source 1..90: mol_type = genomic DNA
ttggcctccacccttggcctgggctcccaccagctcggcgtccacccaccggcggtggcgcgcccctcgaccgcgcggggacagcaggat

SEQ ID NO: 58537 - DNA, 96 bp, Homo sapiens
  misc_feature 1..96: note = chr20:20344402-20344498
  misc_feature 1..96: note = hyper
  source 1..96: mol_type = genomic DNA
tcctcctgcggcaggcgaggcggggtgcaggtgtgagtggggtgggaggaaggggaaaggatcggggtcgccgcagcctttctggtcagtttcgct

SEQ ID NO: 58538 - DNA, 871 bp, Homo sapiens
  misc_feature 1..871: note = chr20:20344559-20345430
  misc_feature 1..871: note = hyper
  source 1..871: mol_type = genomic DNA
ggtggaggacacctcttgcgccccaaggtcaatgtcatcccgatgggtcccgtgccgtcctgactctccctgacctaattctttggttatgactttctcaccttctgggcttcgcctctgccagctttcgccgacgtcgcccttcccgccgcccgcccgggccttcctacccgctctcctccctccctggcccgacggtcccactgaggcaaaaacaaacagccctgagggcacttcaaggagcgtgcagtggccccgacggtactctcggggggataaaagaggtggccagccacgccgtcggcccccggccgaataatgggcgcgcagcagattgccagggggcacttgaaactcgaggggagggaaatacttgagcgcggtccctccccgcgaggacgcacgacgcagcctcgcggatcgtcccttgttcgctctctttcatgcactctccttttgtgtggaattatctaaacgggagatccctggcagctttatgctaatgcgccgaacaaaggcaacggcccgcgggcgggaggcccggaaggtgcctggggccgggccgggcggggtggcggccaggcgggctgcgcgtgtctctcgcgtgcccctgggactgacacaacaacccctcattcctgcaaatacaaagcctctcaccggctcgggtcgggcgcacccggcgcagggaggcgctggtccctccgggcggcgggcactgcagcggtaacgcacggttcctgccggttgtggctcgggggactgagggccgggagtgggggcttctgtgaagccagaagagaagtctgcagcagagtggtgatgaggggcgctgacacctcacccccaacgccgacgtctccaaacgcga

SEQ ID NO: 58539 - DNA, 10 bp, Homo sapiens
  misc_feature 1..10: note = chr20:20346166-20346176
  misc_feature 1..10: note = hyper
  source 1..10: mol_type = genomic DNA
gggtggtgaa

SEQ ID NO: 58540 - DNA, 127 bp, Homo sapiens; identical to SEQ ID NO: 23259
  misc_feature 1..127: note = chr20:20347333-20347460
  misc_feature 1..127: note = hyper
  source 1..127: mol_type = genomic DNA

SEQ ID NO: 58541 - DNA, 68 bp, Homo sapiens; identical to SEQ ID NO: 23260
  misc_feature 1..68: note = chr20:20348154-20348222
  misc_feature 1..68: note = hyper
  source 1..68: mol_type = genomic DNA

SEQ ID NO: 58542 - DNA, 28 bp, Homo sapiens
  misc_feature 1..28: note = chr20:20348257-20348285
  misc_feature 1..28: note = hyper
  source 1..28: mol_type = genomic DNA
cggctccggctcgcggattgaaccctcc

SEQ ID NO: 58543 - DNA, 388 bp, Homo sapiens
  misc_feature 1..388: note = chr20:20348765-20349153
  misc_feature 1..388: note = hyper
  source 1..388: mol_type = genomic DNA
ggcgcagagctgggccgagccgtcgccggcgccacgcgagtcccgcagccgccgcgcccgggcaatgggccgggggcactgagggccgccggggccgagcgcggaggggggaccgagccagtgccgtgccctcgggccgcgccaacatgccccgcggcttcctggtgaagcgcagcaagaagtccacgcccgtttcctaccgggtccgcggcggcgaggacggcgaccgcgcactgctgctctcgcccagctgcgggggcgcccgcgccgagcccccggcgccgagcccggtccccgggccgctgccgccgccgccgcccgcggagcgcgcccatgcagcgctcgccgccgcgcttgcctgcgcgcctgggccgcagccacccccgca

SEQ ID NO: 58544 - DNA, 319 bp, Homo sapiens
  misc_feature 1..319: note = chr20:20349255-20349574
  misc_feature 1..319: note = hyper
  source 1..319: mol_type = genomic DNA
cttcgaacgcagcttcaacctgggctcgccggtctcggccgagtccttccccacgcccgccgcgctgctcggagggggcggcggcggcggcgcgagcggagctggcggaggcggcacctgcggcggcgacccgctgctcttcgcgcccgccgagctcaagatgggcacggcgttctcggctggcgccgaggcggcccgcggcccgggccccggccccccactgccccctgccgccgccctgcggcccccgggaaagcggcccccgccccctaccgccgcggagccgcccgccaaggcagtcaaggccccgggcgccaag

SEQ ID NO: 58545 - DNA, 942 bp, Homo sapiens
  misc_feature 1..942: note = chr20:20349604-20350546
  misc_feature 1..942: note = hyper
  source 1..942: mol_type = genomic DNA
gaggacgaggtgaccacgtcgcccgtgctggggctcaagatcaaggagggcccggtggaggcgccgcggggccgcgcggggggcgcggcgcggccgctgggcgagttcatctgccagctgtgcaaggaggagtacgccgacccgttcgcgctggcgcagcacaaatgctcgcgcatcgtgcgtgtggagtaccgctgtcccgagtgcgccaaggtcttcagctgcccggccaacctggcctcgcaccgccgctggcacaaaccgcggcccgcgcccgccgccgcccgcgcgccggagccagaagcagcagccagggctgaggcgcgggaggcacccggcggcggcagcgaccgggacacgccgagccccggcggcgtgtccgagtcgggctccgaggacgggctctacgagtgccatcactgcgccaagaagttccgccgccaggcctacctacgcaagcacctgctggcgcaccaccaggcgctgcaggccaagggcgcgccgctagcgcccccggccgaggacctactggccttgtaccccgggcccgacgagaaggcgccccaggaggcggccggcgacggcgagggggccggcgtgctgggcctgagtgcgtccgccgagtgccacctgtgcccagtgtgcggagagtcgttcgccagcaagggcgctcaggagcgccacctgcgcctgctgcacgccgcccaggtgttcccctgcaagtactgcccggccaccttctacagctcgcccggccttacgcggcacatcaacaagtgccacccatccgaaaacagacaggtgatcctcctgcaggtgcccgtgcgcccggcctgctagagcgcgccctccaccccggcccccgaactgtgccttcgcttggagacccacaaagagagtgcgccctgcactccccgaacccgagtccgcgctgggggagcc

SEQ ID NO: 58546 - DNA, 60 bp, Homo sapiens
  misc_feature 1..60: note = chr20:21080654-21080714
  misc_feature 1..60: note = hyper
  source 1..60: mol_type = genomic DNA
gcaaattctgacctccgatggcgcctatcaattaccccgcccgcagtgaaagcgaaagcg

SEQ ID NO: 58547 - DNA, 279 bp, Homo sapiens; identical to SEQ ID NO: 23266
  misc_feature 1..279: note = chr20:21082253-21082532
  misc_feature 1..279: note = hyper
  source 1..279: mol_type = genomic DNA

SEQ ID NO: 58548 - DNA, 365 bp, Homo sapiens
  misc_feature 1..365: note = chr20:21082917-21083282
  misc_feature 1..365: note = hyper
  source 1..365: mol_type = genomic DNA
aaaagatcctggagctaaagcctgcgcctacaccagagaggggaatttaagtttcccactctcgacgtgtctggaaccttccctctagccgcatacccacaaccccctgctccctggctcctcccagtgtcaaggaaggagaaagactcccaccctgtccccaaagtctcagactaactcgctccaggtcacaggacccactaagagggcctttccagctcatgcccggaacaggggtgcagcggcgaccctctgggatctggagagagagaatttaacacggccttcctgaagtacattcacgcaaatgtgagaaagacttcaacgcacagaatcgccaaagcccttgccgtcttaaataaatc

SEQ ID NO: 58549 - DNA, 109 bp, Homo sapiens
  misc_feature 1..109: note = chr20:21084361-21084470
  misc_feature 1..109: note = hyper
  source 1..109: mol_type = genomic DNA
atgtgcgccaactcgcgctctggagacaggaaaaggtagcaccgctggcgtcctggcacgtcgagcgaacaatgccaccccacgcgtcactgatcgactcatcttgcag

SEQ ID NO: 58550 - DNA, 56 bp, Homo sapiens
  misc_feature 1..56: note = chr20:21085775-21085831
  misc_feature 1..56: note = hyper
  source 1..56: mol_type = genomic DNA
ctgggttcagcccaccgggtcccctttcgaatgccatttcccagctgaaaatccag

SEQ ID NO: 58551 - DNA, 288 bp, Homo sapiens; identical to SEQ ID NO: 23269
  misc_feature 1..288: note = chr20:21085864-21086152
  misc_feature 1..288: note = hyper
  source 1..288: mol_type = genomic DNA

SEQ ID NO: 58552 - DNA, 173 bp, Homo sapiens
  misc_feature 1..173: note = chr20:21086451-21086624
  misc_feature 1..173: note = hyper
  source 1..173: mol_type = genomic DNA
ctccctcttcccccggacctgcctgaaccccgccgagcactaggcaaggccgggctctgcgggctggggaaaagaaggggcttggggtggcccaacccgaccgccacctcggcccggcctgcggggaaaccccacaaagtcaaggcgcggggcggggtcggggggatgggatc

SEQ ID NO: 58553 - DNA, 20 bp, Homo sapiens
  misc_feature 1..20: note = chr20:21372154-21372174
  misc_feature 1..20: note = hyper
  source 1..20: mol_type = genomic DNA
ccgcgacctcgcagccgggg

SEQ ID NO: 58554 - skipped

SEQ ID NO: 58555 - DNA, 43 bp, Homo sapiens; identical to SEQ ID NO: 23271
  misc_feature 1..43: note = chr20:21376207-21376250
  misc_feature 1..43: note = hyper
  source 1..43: mol_type = genomic DNA

SEQ ID NO: 58556 - DNA, 106 bp, Homo sapiens
  misc_feature 1..106: note = chr20:21378551-21378657
  misc_feature 1..106: note = hyper
  source 1..106: mol_type = genomic DNA
tataattgcggaatggggaacgtgctgctaagtttggggggagggtgttgcgggggcttgcttcgtcctctccagttatcagcccctcattcgctccatcacctaa

SEQ ID NO: 58557 - DNA, 445 bp, Homo sapiens
  misc_feature 1..445: note = chr20:21485930-21486375
  misc_feature 1..445: note = hyper
  source 1..445: mol_type = genomic DNA
ctcgcggagacatctcgagtcccgcaggtgtctgagctgcgctgcgcgccccagccgggaagccttttcttatccaaccgcgccgccccgcggaaagcctgggtactgcagacgccctcaccggcccaccgacagctggttttgaagcgggggcttagaaaagtaaaggggacagtgtttggagccacgatgcctttgatgtgaggcggttccacccaacaatcaacgaatcaagctggaactgcaggccctacttttgttggggggaggaccttaaggaatgtcacccccttgtcccctaccctctgccccacgcccagcctctcagaaggcaccaggcgtgagtagagtgcgaggcgtccacaccctcgtgtcccttccattcccggacacctttgcaccctagccgaggcctcagcacggagtgagggttgcctggggtgcc

SEQ ID NO: 58558 - DNA, 36 bp, Homo sapiens; identical to SEQ ID NO: 23274
  misc_feature 1..36: note = chr20:21486881-21486917
  misc_feature 1..36: note = hyper
  source 1..36: mol_type = genomic DNA

SEQ ID NO: 58559 - DNA, 199 bp, Homo sapiens; identical to SEQ ID NO: 23275
  misc_feature 1..199: note = chr20:21486954-21487153
  misc_feature 1..199: note = hyper
  source 1..199: mol_type = genomic DNA

SEQ ID NO: 58560 - DNA, 163 bp, Homo sapiens
  misc_feature 1..163: note = chr20:21488351-21488514
  misc_feature 1..163: note = hyper
  source 1..163: mol_type = genomic DNA
tttctgaagtggtttcccatcgcaccaagaggccagtgggatggatccccgcgcataattcaaaggaacgcgcgcgtctttagctcttcggggttggtaaccaagtggtccggccgggcgcaagtcgccttggaaccggctgcagcccaagtctagctgggcc

SEQ ID NO: 58561 - DNA, 206 bp, Homo sapiens; identical to SEQ ID NO: 37976
  misc_feature 1..206: note = chr20:21488591-21488797
  misc_feature 1..206: note = hyper
  source 1..206: mol_type = genomic DNA

SEQ ID NO: 58562 - DNA, 57 bp, Homo sapiens; identical to SEQ ID NO: 37977
  misc_feature 1..57: note = chr20:21488998-21489055
  misc_feature 1..57: note = hyper
  source 1..57: mol_type = genomic DNA

SEQ ID NO: 58563 - DNA, 107 bp, Homo sapiens; identical to SEQ ID NO: 37982
  misc_feature 1..107: note = chr20:21491616-21491723
  misc_feature 1..107: note = hyper
  source 1..107: mol_type = genomic DNA

SEQ ID NO: 58564 - DNA, 111 bp, Homo sapiens; identical to SEQ ID NO: 37984
  misc_feature 1..111: note = chr20:21492990-21493101
  misc_feature 1..111: note = hyper
  source 1..111: mol_type = genomic DNA

SEQ ID NO: 58565 - DNA, 206 bp, Homo sapiens
  misc_feature 1..206: note = chr20:21493102-21493308
  misc_feature 1..206: note = hyper
  source 1..206: mol_type = genomic DNA
ccccggcagccagaccgtgcactggggggagggggagagagaagcgcgtcaggcgtctggaggccgcgcgcagcctgcaccagactcggagcaccctggatcctccgtgcgaccctggacctccgcgcctggcagcccagccccgctgcctttgccatgacccctgccttcctctacgcctgacgaagacgtcgggacctcccagg

SEQ ID NO: 58566 - DNA, 171 bp, Homo sapiens
  misc_feature 1..171: note = chr20:21494360-21494531
  misc_feature 1..171: note = hyper
  source 1..171: mol_type = genomic DNA
cgtggcgctcccctgccccggcgggcgggggaggggggagttggggggagggactgggggaggggaggggggaattggctttaattattgggataattattatttttaaaaagagaaagaaactggggatggggaggaaaaaaatgaagcccaacccagtgcctctctctg

SEQ ID NO: 58567 - DNA, 73 bp, Homo sapiens
  misc_feature 1..73: note = chr20:21494703-21494776
  misc_feature 1..73: note = hyper
  source 1..73: mol_type = genomic DNA
ccattgcccgagcgatcagtccatataaggctgggctccactcacgaacctggggaggcggggagagggggag

SEQ ID NO: 58568 - DNA, 51 bp, Homo sapiens; identical to SEQ ID NO: 37987
  misc_feature 1..51: note = chr20:21494991-21495042
  misc_feature 1..51: note = hyper
  source 1..51: mol_type = genomic DNA

SEQ ID NO: 58569 - DNA, 274 bp, Homo sapiens
  misc_feature 1..274: note = chr20:21495986-21496260
  misc_feature 1..274: note = hyper
  source 1..274: mol_type = genomic DNA
cgatgcctcgttttctccccagttttcttctcccacgcgagttctttagtgtggtctctttttggacgccttgggtgcgttcggagtacgcgctccacgtttccaggttaagtcaggttagtgtgaagtttccagccactctcggctctgggaactgaactttcccgggacttgcacttcctcctcggcgctggggttggaaaagaccacgccgcatttgccaccccttcttctagttaaaacttttttggggggggggtgcaggggtgtagat

SEQ ID NO: 58570 - DNA, 184 bp, Homo sapiens
  misc_feature 1..184: note = chr20:21496294-21496478
  misc_feature 1..184: note = hyper
  source 1..184: mol_type = genomic DNA
tcaggaaggagctttgtctgggggcggggaggggcacagaaggccacccctgcggggtccaggtctagtcttcccacaacctgggctcctccgcgcgggccaagctgagcgcgcgggcaccgggtcctcctcgcgcgcagctgcagcggacgccgccgcgccccagctgcccccgggttgccag

SEQ ID NO: 58571 - DNA, 297 bp, Homo sapiens
  misc_feature 1..297: note = chr20:21498638-21498935
  misc_feature 1..297: note = hyper
  source 1..297: mol_type = genomic DNA
aattctttccaggtaccgtcttgcacccaagcgagttcaatgtcctccgttccgtcaagtttgggtttgagctttgggctcagctgccgtggtctggagacctcgtaggcactctgcaagatgcctcgttctgctgcatgcttggggaggaagttgagctgggtgctggaagttctgaacccagcatgccccgggccggaggagatttgcttggtgtctccttagcgtcccgaacaccgcgcgcccctgctggggtaacctgaacagctggacccctcaactcgatctttattatca

SEQ ID NO: 58572 - DNA, 253 bp, Homo sapiens; identical to SEQ ID NO: 37991
  misc_feature 1..253: note = chr20:21499324-21499577
  misc_feature 1..253: note = hyper
  source 1..253: mol_type = genomic DNA

SEQ ID NO: 58573 - DNA, 217 bp, Homo sapiens
  misc_feature 1..217: note = chr20:21500134-21500351
  misc_feature 1..217: note = hyper
  source 1..217: mol_type = genomic DNA
aaatcaatggggaaggaaaatgtcacccaatctggtccctgagtgtggcgataaagacgttcaccttaaggatggcatctccaaaacagccccactttggcttcgacttccaatgcgggagcaggggctgcaggaagcagaggtgtcagctctcacgtcctggatgaaagaaataggggaatgcaccccaggagtactaccccgtgctgggaccttt

SEQ ID NO: 58574 - DNA, 313 bp, Homo sapiens
  misc_feature 1..313: note = chr20:21501724-21502037
  misc_feature 1..313: note = hyper
  source 1..313: mol_type = genomic DNA
ctaagggctggttccgggaaggacagggaatgcacccttgggccctcgggcacagagagggggttcctagggctctgtctctctctctccaatgtgagccccagaggttcacaaccttcccctagacgcaacgtcccctttccacccccaagagccactaaagtcgagaaggcgccagaggagctccaaagggcctcctggtagtgtgtgcgtgtgtgttgtgggaggaggttggggcggagggggcgcccctcggagacaaggaccccaccgaggttcatttctgatcctctggcgatctctactgacacaa

SEQ ID NO: 58575 - DNA, 147 bp, Homo sapiens; identical to SEQ ID NO: 23283
  misc_feature 1..147: note = chr20:21502443-21502590
  misc_feature 1..147: note = hyper
  source 1..147: mol_type = genomic DNA

SEQ ID NO: 58576 - DNA, 125 bp, Homo sapiens; identical to SEQ ID NO: 23284
  misc_feature 1..125: note = chr20:21503773-21503898
  misc_feature 1..125: note = hyper
  source 1..125: mol_type = genomic DNA

SEQ ID NO: 58577 - DNA, 45 bp, Homo sapiens; identical to SEQ ID NO: 37997
  misc_feature 1..45: note = chr20:21503899-21503944
  misc_feature 1..45: note = hyper
  source 1..45: mol_type = genomic DNA

SEQ ID NO: 58578 - DNA, 38 bp, Homo sapiens
  misc_feature 1..38: note = chr20:21682361-21682399
  misc_feature 1..38: note = hyper
  source 1..38: mol_type = genomic DNA
cgcggagtttcgttgtgttgttacacaagccagctttt

SEQ ID NO: 58579 - DNA, 39 bp, Homo sapiens; identical to SEQ ID NO: 37999
  misc_feature 1..39: note = chr20:21682946-21682985
  misc_feature 1..39: note = hyper
  source 1..39: mol_type = genomic DNA

SEQ ID NO: 58580 - DNA, 121 bp, Homo sapiens; identical to SEQ ID NO: 23286
  misc_feature 1..121: note = chr20:21683651-21683772
  misc_feature 1..121: note = hyper
  source 1..121: mol_type = genomic DNA

SEQ ID NO: 58581 - DNA, 17 bp, Homo sapiens
  misc_feature 1..17: note = chr20:21683899-21683916
  misc_feature 1..17: note = hyper
  source 1..17: mol_type = genomic DNA
cgcggactctgctaccg

SEQ ID NO: 58582 - DNA, 28 bp, Homo sapiens
  misc_feature 1..28: note = chr20:21684347-21684375
  misc_feature 1..28: note = hyper
  source 1..28: mol_type = genomic DNA
cgtccccactccccgcacccccggagcc

SEQ ID NO: 58583 - DNA, 30 bp, Homo sapiens; identical to SEQ ID NO: 38003
  misc_feature 1..30: note = chr20:21685666-21685696
  misc_feature 1..30: note = hyper
  source 1..30: mol_type = genomic DNA

SEQ ID NO: 58584 - DNA, 51 bp, Homo sapiens; identical to SEQ ID NO: 23288
  misc_feature 1..51: note = chr20:21686184-21686235
  misc_feature 1..51: note = hyper
  source 1..51: mol_type = genomic DNA

SEQ ID NO: 58585 - DNA, 52 bp, Homo sapiens
  misc_feature 1..52: note = chr20:21686677-21686729
  misc_feature 1..52: note = hyper
  source 1..52: mol_type = genomic DNA
ggtgggtcgggtccgcctgcctcccttccctctcgtccgctttccctgggcg

SEQ ID NO: 58586 - DNA, 45 bp, Homo sapiens; identical to SEQ ID NO: 38007
  misc_feature 1..45: note = chr20:21687755-21687800
  misc_feature 1..45: note = hyper
  source 1..45: mol_type = genomic DNA

SEQ ID NO: 58587 - DNA, 44 bp, Homo sapiens
  misc_feature 1..44: note = chr20:21689912-21689956
  misc_feature 1..44: note = hyper
  source 1..44: mol_type = genomic DNA
ggcctccaaccagcacggcgtgtacagcgccccgggcggcggct

SEQ ID NO: 58588 - DNA, 30 bp, Homo sapiens; identical to SEQ ID NO: 38009
  misc_feature 1..30: note = chr20:21693467-21693497
  misc_feature 1..30: note = hyper
  source 1..30: mol_type = genomic DNA

SEQ ID NO: 58589 - DNA, 65 bp, Homo sapiens
  misc_feature 1..65: note = chr20:21694434-21694499
  misc_feature 1..65: note = hyper
  source 1..65: mol_type = genomic DNA
ccacaggtcccaggacgtgctgtgcccacagtggtgagcgcatctggatccccggacctcgtggg

SEQ ID NO: 58590 - DNA, 46 bp, Homo sapiens
  misc_feature 1..46: note = chr20:21694529-21694575
  misc_feature 1..46: note = hyper
  source 1..46: mol_type = genomic DNA
caactgcctcctacgtcggaggaatccaggccgctccagggaaatc

SEQ ID NO: 58591 - DNA, 77 bp, Homo sapiens
  misc_feature 1..77: note = chr20:21748368-21748445
  misc_feature 1..77: note = hyper
  source 1..77: mol_type = genomic DNA
ttaatgggtgtccctcggagaggccgcacccgggagaaagcgctgacgcctccgacccagctccgcgcacagcggcg

SEQ ID NO: 58592 - DNA, 25 bp, Homo sapiens
  misc_feature 1..25: note = chr20:21748491-21748516
  misc_feature 1..25: note = hyper
  source 1..25: mol_type = genomic DNA
ccctcaaatgcgtgtttgccctgct

SEQ ID NO: 58593 - DNA, 172 bp, Homo sapiens
  misc_feature 1..172: note = chr20:22557675-22557847
  misc_feature 1..172: note = hyper
  source 1..172: mol_type = genomic DNA
acgggaggcattaattatttaaaaacgattagccttgccgtgtgtcctgcaggcgtcccatcatgttcagcgaagataaccagccacccgaggcgagccggggctcggagggcggcgggcgcgctccccagcaggcttcgggtgcggtggacacgggcgcacagcccaaggc

SEQ ID NO: 58594 - DNA, 10 bp, Homo sapiens
  misc_feature 1..10: note = chr20:22558627-22558637
  misc_feature 1..10: note = hyper
  source 1..10: mol_type = genomic DNA
agttgagact

SEQ ID NO: 58595 - DNA, 27 bp, Homo sapiens
  misc_feature 1..27: note = chr20:22558669-22558696
  misc_feature 1..27: note = hyper
  source 1..27: mol_type = genomic DNA
gtcaccatgctccggcctcagcctctt

SEQ ID NO: 58596 - DNA, 104 bp, Homo sapiens; identical to SEQ ID NO: 38015
  misc_feature 1..104: note = chr20:22559138-22559242
  misc_feature 1..104: note = hyper
  source 1..104: mol_type = genomic DNA

SEQ ID NO: 58597 - DNA, 13 bp, Homo sapiens
  misc_feature 1..13: note = chr20:22559632-22559645
  misc_feature 1..13: note = hyper
  source 1..13: mol_type = genomic DNA
gaaagcgcgcagt

SEQ ID NO: 58598 - DNA, 22 bp, Homo sapiens
  misc_feature 1..22: note = chr20:22559690-22559712
  misc_feature 1..22: note = hyper
  source 1..22: mol_type = genomic DNA
atttaagcgggaggggggcgtg

SEQ ID NO: 58599 - DNA, 169 bp, Homo sapiens; identical to SEQ ID NO: 38018
  misc_feature 1..169: note = chr20:22559973-22560142
  misc_feature 1..169: note = hyper
  source 1..169: mol_type = genomic DNA

SEQ ID NO: 58600 - DNA, 97 bp, Homo sapiens; identical to SEQ ID NO: 38019
  misc_feature 1..97: note = chr20:22560398-22560495
  misc_feature 1..97: note = hyper
  source 1..97: mol_type = genomic DNA

SEQ ID NO: 58601 - DNA, 118 bp, Homo sapiens
  misc_feature 1..118: note = chr20:22562603-22562721
  misc_feature 1..118: note = hyper
  source 1..118: mol_type = genomic DNA
caggcatgggggaaccgtagccggggtagtgcatcacctgttcgtaggccttgaggtccattttgtggggttggtggtggtggtggctgtggtggtgctgctgctccgaggacatgag

SEQ ID NO: 58602 - DNA, 46 bp, Homo sapiens
  misc_feature 1..46: note = chr20:22562840-22562886
  misc_feature 1..46: note = hyper
  source 1..46: mol_type = genomic DNA
gcccgggagagggcgccggctctggggggctcagcgccgcagccgg

SEQ ID NO: 58603 - DNA, 211 bp, Homo sapiens; identical to SEQ ID NO: 38021
  misc_feature 1..211: note = chr20:22567354-22567565
  misc_feature 1..211: note = hyper
  source 1..211: mol_type = genomic DNA

SEQ ID NO: 58604 - DNA, 133 bp, Homo sapiens; identical to SEQ ID NO: 38022
  misc_feature 1..133: note = chr20:22567605-22567738
  misc_feature 1..133: note = hyper
  source 1..133: mol_type = genomic DNA

SEQ ID NO: 58605 - DNA, 75 bp, Homo sapiens; identical to SEQ ID NO: 38023
  misc_feature 1..75: note = chr20:23029003-23029078
  misc_feature 1..75: note = hyper
  source 1..75: mol_type = genomic DNA

SEQ ID NO: 58606 - DNA, 30 bp, Homo sapiens; identical to SEQ ID NO: 13739
  misc_feature 1..30: note = chr20:23030745-23030775
  misc_feature 1..30: note = hyper
  source 1..30: mol_type = genomic DNA

SEQ ID NO: 58607 - DNA, 45 bp, Homo sapiens; identical to SEQ ID NO: 38028
  misc_feature 1..45: note = chr20:23031034-23031079
  misc_feature 1..45: note = hyper
  source 1..45: mol_type = genomic DNA

SEQ ID NO: 58608 - DNA, 255 bp, Homo sapiens
  misc_feature 1..255: note = chr20:23031293-23031548
  misc_feature 1..255: note = hyper
  source 1..255: mol_type = genomic DNA
atttcgtccagagtccgaattgatacccacgtgcatagaaacgccacttgctcggcaaagggcactgaagagccaccgtcctgtggatgggcagggtggggggggggctggaggaggacatgggaatccgtcactttcgacctcttccggtggttcacttaccgggaatgcggaagagtgggtctccccctcgggtcgcccccataatggtgagaggcaaactgtttaaaaacacccttgcctctctcctctact

SEQ ID NO: 58609 - DNA, 102 bp, Homo sapiens; identical to SEQ ID NO: 38030
  misc_feature 1..102: note = chr20:24449601-24449703
  misc_feature 1..102: note = hyper
  source 1..102: mol_type = genomic DNA

SEQ ID NO: 58610 - DNA, 472 bp, Homo sapiens
  misc_feature 1..472: note = chr20:24449759-24450231
  misc_feature 1..472: note = hyper
  source 1..472: mol_type = genomic DNA
cgggcagcaaattcctgtcctcctagtcccccgcagctatcccccgcccccagcctctgtggccctcacattgtcagacactggccgcgggccaccatctggacgcgatcccccgctagggcctccctggtctgggccaaagttggtggccaccttcgcgcgggctgcgccctccttctcttccctgccctcctcccccggggcccgcgcccgctgcctccagcacgcgcgtcggcaggctcggcaagcgaagaggagcggctcgccccagggcgcccctcgcccagcctgccggccaggcgagcgcgacgagagtctccccgcaccccttcctctcccgggggccgagagggttgggctccgccccggcgccgcagctcccgactccccgccgctcgggctgccgccgctgccccgcgcccggcgctcggggcagccgggggcgcaggcggagagcgcagggcggggagag

SEQ ID NO: 58611 - DNA, 191 bp, Homo sapiens; identical to SEQ ID NO: 23298
  misc_feature 1..191: note = chr20:24450513-24450704
  misc_feature 1..191: note = hyper
  source 1..191: mol_type = genomic DNA

SEQ ID NO: 58612 - DNA, 65 bp, Homo sapiens
  misc_feature 1..65: note = chr20:24451019-24451084
  misc_feature 1..65: note = hyper
  source 1..65: mol_type = genomic DNA
ctggagcctctttcctctagccaggacaagacctgccttcaaaagctgtctggcccctggcagcc

SEQ ID NO: 58613 - DNA, 52 bp, Homo sapiens; identical to SEQ ID NO: 38033
  misc_feature 1..52: note = chr20:24451085-24451137
  misc_feature 1..52: note = hyper
  source 1..52: mol_type = genomic DNA

SEQ ID NO: 58614 - DNA, 38 bp, Homo sapiens
  misc_feature 1..38: note = chr20:24451412-24451450
  misc_feature 1..38: note = hyper
  source 1..38: mol_type = genomic DNA
gggggtttcgttgcacgcagaggcttgggcgcttggca

SEQ ID NO: 58615 - DNA, 429 bp, Homo sapiens
  misc_feature 1..429: note = chr20:24451592-24452021
  misc_feature 1..429: note = hyper
  source 1..429: mol_type = genomic DNA
ttgggggtgtcgaggggaggggggctgggcgttacacagtggctccgttttctggttggaatcagttggtgaggcgtgcgcgcgcgagtccgtgtatctgtccgtctccctcctacagcccagcgtgtttggtctgagtccaaagaaggaggtggtgtgtgtgctgcgtagacctgcgcctgtggggtgagcagcctcatagcccccagagccggccaacttctccgtgctaggctgcgacctcaagggctgccgcgtcggggatcggaagtggtcttcaaagaggggtctaggtcgcgaaatcctggcagcagccgaagtgaaaaggagctgctaggaggcgggcggggggcagtctgatgtccgttctggcgcggacaggaagaaactgaagtcgaatttttagttgaattgcgtgctctgtgtttg

SEQ ID NO: 58616 - DNA, 26 bp, Homo sapiens
  misc_feature 1..26: note = chr20:25058359-25058385
  misc_feature 1..26: note = hyper
  source 1..26: mol_type = genomic DNA
cggcggagttgagcacggagtctggc

SEQ ID NO: 58617 - DNA, 104 bp, Homo sapiens
  misc_feature 1..104: note = chr20:25058616-25058720
  misc_feature 1..104: note = hyper
  source 1..104: mol_type = genomic DNA
gctatttctgaaggaaatagctcccgagggccaaccagccgccctcagggagagcgcccaggagcccccagcagcgcccacgtgcggtccggactcacgggcat

SEQ ID NO: 58618 - DNA, 61 bp, Homo sapiens; identical to SEQ ID NO: 23300
  misc_feature 1..61: note = chr20:25062880-25062941
  misc_feature 1..61: note = hyper
  source 1..61: mol_type = genomic DNA

SEQ ID NO: 58619 - DNA, 53 bp, Homo sapiens; identical to SEQ ID NO: 23301
  misc_feature 1..53: note = chr20:25063727-25063780
  misc_feature 1..53: note = hyper
  source 1..53: mol_type = genomic DNA

SEQ ID NO: 58620 - DNA, 721 bp, Homo sapiens
  misc_feature 1..721: note = chr20:25064458-25065179
  misc_feature 1..721: note = hyper
  source 1..721: mol_type = genomic DNA
aggcagggtagtcgattctaaggtggcccgaccggggtcgcccgcgaatggaaagcctaaggggcgagggcggacgcgggcgccgtgcctgcagccccgggtgccgaccaagtggcctcacctgggacaggtcttggggtctccctcccctaggtctccctggaaggtaggcgatcacgggagtgacagaccccgagtagatagccagtgatccaaagacaccaaaaggccaggcggtaggagcccagcctcagacactctctatagtgaccgcggcgcctcgggaaggatcgtcttaaactcattttgcaggtgagagcaactgggacttattaacccagtcacatcggacacagagacgtggcgagggcgacacagagcaggagactcaatcaaggagcccgtattggagctctaaggggactcagagatgcagaaggaacgaacttctaaggggtcttgcaattcctggactggggcgttcctaatgcatcccgggaccccaatgccagggaggggcctgcaggaccccagcggtgggcgagttgtgtcctgggtcaccttgtgtttcgcagcgtggcggtggcaggagcccagcgcgggaggacattttcatagcctcctacagtgagaaacgccccccacccgacgctgcgctcatctgtgtccccgctgttgccggggctctggtatccacttgcgcgccctatgtggtggggat

SEQ ID NO: 58621 - DNA, 68 bp, Homo sapiens
  misc_feature 1..68: note = chr20:25065395-25065463
  misc_feature 1..68: note = hyper
  source 1..68: mol_type = genomic DNA
gctccttccagcttccccctaccggataccacctgcaaatctattgccagaggcgcagctcccgcgaa

SEQ ID NO: 58622 - DNA, 35 bp, Homo sapiens; identical to SEQ ID NO: 38044
  misc_feature 1..35: note = chr20:25065766-25065801
  misc_feature 1..35: note = hyper
  source 1..35: mol_type = genomic DNA

SEQ ID NO: 58623 - DNA, 29 bp, Homo sapiens
  misc_feature 1..29: note = chr20:25129464-25129493
  misc_feature 1..29: note = hyper
  source 1..29: mol_type = genomic DNA
cgcccatccccgtgcgcacgtgttcgctg

SEQ ID NO: 58624 - DNA, 180 bp, Homo sapiens; identical to SEQ ID NO: 38046
  misc_feature 1..180: note = chr20:25565489-25565669
  misc_feature 1..180: note = hyper
  source 1..180: mol_type = genomic DNA

SEQ ID NO: 58625 - DNA, 392 bp, Homo sapiens; identical to SEQ ID NO: 38047
  misc_feature 1..392: note = chr20:25565825-25566217
  misc_feature 1..392: note = hyper
  source 1..392: mol_type = genomic DNA

SEQ ID NO: 58626 - DNA, 38 bp, Homo sapiens
  misc_feature 1..38: note = chr20:26188774-26188812
  misc_feature 1..38: note = hyper
  source 1..38: mol_type = genomic DNA
gggcacctgggagcccgcagaggggcggctgagggaga

SEQ ID NO: 58627 - DNA, 68 bp, Homo sapiens; identical to SEQ ID NO: 38049
  misc_feature 1..68: note = chr20:26189330-26189398
  misc_feature 1..68: note = hyper
  source 1..68: mol_type = genomic DNA

SEQ ID NO: 58628 - DNA, 23 bp, Homo sapiens
  misc_feature 1..23: note = chr20:26189578-26189601
  misc_feature 1..23: note = hyper
  source 1..23: mol_type = genomic DNA
gaggggcccgcagaggcgctcag

SEQ ID NO: 58629 - DNA, 357 bp, Homo sapiens
  misc_feature 1..357: note = chr20:26189956-26190313
  misc_feature 1..357: note = hyper
  source 1..357: mol_type = genomic DNA
cgtgggaggggcgcgtctcgtctcactcaaccgcctcgaaccccacaccgacgagctccctcaggacccacgcgcggacaccgaggcgccgaccggaggagggggcgctgggggtgggaacgacacaccaccgctcggcctcgggaacctgagggacaacccggagcgctccaggagcaccgcaaaggcccagggggagccaacgctcgcgcaaactccccgggagggcagcacgacgggccggcgggacagcacccccaccgctgcggaggggggccgcccgcaagtcgacaaccacaggaggcgagagcgaggggtgcctgccgcgtcagaggaccccccgacccaccccgcgag

SEQ ID NO: 58630 - DNA, 136 bp, Homo sapiens; identical to SEQ ID NO: 13761
  misc_feature 1..136: note = chr20:30063113-30063249
  misc_feature 1..136: note = hyper
  source 1..136: mol_type = genomic DNA

SEQ ID NO: 58631 - DNA, 275 bp, Homo sapiens; identical to SEQ ID NO: 38053
  misc_feature 1..275: note = chr20:30063250-30063525
  misc_feature 1..275: note = hyper
  source 1..275: mol_type = genomic DNA

SEQ ID NO: 58632 - DNA, 32 bp, Homo sapiens; identical to SEQ ID NO: 38054
  misc_feature 1..32: note = chr20:30193960-30193992
  misc_feature 1..32: note = hyper
  source 1..32: mol_type = genomic DNA

SEQ ID NO: 58633 - DNA, 56 bp, Homo sapiens; identical to SEQ ID NO: 38055
  misc_feature 1..56: note = chr20:30556169-30556225
  misc_feature 1..56: note = hyper
  source 1..56: mol_type = genomic DNA

SEQ ID NO: 58634 - DNA, 16 bp, Homo sapiens
  misc_feature 1..16: note = chr20:30582978-30582994
  misc_feature 1..16: note = hyper
  source 1..16: mol_type = genomic DNA
gcgcttgctggagacc

SEQ ID NO: 58635 - DNA, 36 bp, Homo sapiens
  misc_feature 1..36: note = chr20:30639105-30639141
  misc_feature 1..36: note = hyper
  source 1..36: mol_type = genomic DNA
ccagggtggttccttcgggcagggaactttgcatgg

SEQ ID NO: 58636 - DNA, 160 bp, Homo sapiens
  misc_feature 1..160: note = chr20:30639319-30639479
  misc_feature 1..160: note = hyper
  source 1..160: mol_type = genomic DNA
agggtaaggcctttccagggtgggttggaatctttgaagactgtggcaggaatcccttgataggtggggttaggatctctgaagggcagggttggaatctttggaccggcggtatagacccctgggtattaaaactcttaggcggcgggaggttagatcg

SEQ ID NO: 58637 - DNA, 259 bp, Homo sapiens
  misc_feature 1..259: note = chr20:30639847-30640106
  misc_feature 1..259: note = hyper
  source 1..259: mol_type = genomic DNA
atggatggtgctaatattttttttctcttcgtggagggtttgggatccttcttgcaggagacggaggttatgaccctcggggagccggttaggatcctggggtggcgtctgaatcttcggggaggtgttaggacacttggggcggagttagcctcgctcagggcgcggctaaggcgcccagatggcctgcgggcgccaccacgtccctggtcccagctcgggagcacatcagaggcttagaggcgagtgggaagggact

SEQ ID NO: 58638 - DNA, 173 bp, Homo sapiens
  misc_feature 1..173: note = chr20:30640270-30640443
  misc_feature 1..173: note = hyper
  source 1..173: mol_type = genomic DNA
acgaggagcgggcgcccaggtgagtgccgcgcacaggggaccgggaatacccggcccgcgaggggtcccaggaggcggagggagcccaggagcctggggagggctggctacgggtgcggctgggggcagcgaggggagacggaacgtcgggggagccgcgggtagcccggggg

SEQ ID NO: 58639 - DNA, 45 bp, Homo sapiens; identical to SEQ ID NO: 38060
  misc_feature 1..45: note = chr20:30640724-30640769
  misc_feature 1..45: note = hyper
  source 1..45: mol_type = genomic DNA

SEQ ID NO: 58640 - DNA, 139 bp, Homo sapiens
  misc_feature 1..139: note = chr20:30777885-30778024
  misc_feature 1..139: note = hyper
  source 1..139: mol_type = genomic DNA
tggaggccgcttccccgcgcccaggggaagggaaggcggtcccggggcccgctgcggggtggagggacccgcgccccccagcttctcgggcccgggccgcggggaccgtgcgcgcgtccccctcccgggcaaggccggg

SEQ ID NO: 58641 - DNA, 33 bp, Homo sapiens; identical to SEQ ID NO: 38062
  misc_feature 1..33: note = chr20:31797604-31797637
  misc_feature 1..33: note = hyper
  source 1..33: mol_type = genomic DNA

SEQ ID NO: 58642 - DNA, 49 bp, Homo sapiens; identical to SEQ ID NO: 38063
  misc_feature 1..49: note = chr20:32803885-32803934
  misc_feature 1..49: note = hyper
  source 1..49: mol_type = genomic DNA

SEQ ID NO: 58643 - DNA, 192 bp, Homo sapiens; identical to SEQ ID NO: 38064
  misc_feature 1..192: note = chr20:32803954-32804146
  misc_feature 1..192: note = hyper
  source 1..192: mol_type = genomic DNA

SEQ ID NO: 58644 - DNA, 30 bp, Homo sapiens; identical to SEQ ID NO: 38065
  misc_feature 1..30: note = chr20:32899446-32899476
  misc_feature 1..30: note = hyper
  source 1..30: mol_type = genomic DNA

SEQ ID NO: 58645 - DNA, 261 bp, Homo sapiens; identical to SEQ ID NO: 38066
  misc_feature 1..261: note = chr20:33146323-33146584
  misc_feature 1..261: note = hyper
  source 1..261: mol_type = genomic DNA

SEQ ID NO: 58646 - skipped

SEQ ID NO: 58647 - DNA, 101 bp, Homo sapiens; identical to SEQ ID NO: 23317
  misc_feature 1..101: note = chr20:34189391-34189492
  misc_feature 1..101: note = hyper
  source 1..101: mol_type = genomic DNA

SEQ ID NO: 58648 - DNA, 144 bp, Homo sapiens; identical to SEQ ID NO: 23318
  misc_feature 1..144: note = chr20:34189910-34190054
  misc_feature 1..144: note = hyper
  source 1..144: mol_type = genomic DNA

SEQ ID NO: 58649 - DNA, 217 bp, Homo sapiens; identical to SEQ ID NO: 38071
  misc_feature 1..217: note = chr20:35491258-35491475
  misc_feature 1..217: note = hyper
  source 1..217: mol_type = genomic DNA

SEQ ID NO: 58650 - DNA, 323 bp, Homo sapiens; identical to SEQ ID NO: 38072
  misc_feature 1..323: note = chr20:36012930-36013253
  misc_feature 1..323: note = hyper
  source 1..323: mol_type = genomic DNA

SEQ ID NO: 58651 - DNA, 248 bp, Homo sapiens
  misc_feature 1..248: note = chr20:36531551-36531799
  misc_feature 1..248: note = hyper
  source 1..248: mol_type = genomic DNA
cgtgcgctcgctccccgaagccggggctgggccggagccgggcgagggctgggagctgggccgggtccggggacagcgggcgaggggcagctgccggagccgggcagccaggccgctcagggcaggggacagctggcgccggttctgcggtctccggggcccagatgtgaggcggcggcgcccccggcccgagagcgcacgatgggggccccgctcgccgtagcgctgggcgccctccactacctggc

SEQ ID NO: 58652 - DNA, 81 bp, Homo sapiens
  misc_feature 1..81: note = chr20:36531910-36531991
  misc_feature 1..81: note = hyper
  source 1..81: mol_type = genomic DNA
aaccccaacccgggccgcgccactccaacttggccgccccggggctcgaaccggcgccagtcgtggcgggcatcccggggc

SEQ ID NO: 58653 - DNA, 332 bp, Homo sapiens; identical to SEQ ID NO: 38074
  misc_feature 1..332: note = chr20:36888856-36889188
  misc_feature 1..332: note = hyper
  source 1..332: mol_type = genomic DNA

SEQ ID NO: 58654 - DNA, 30 bp, Homo sapiens; identical to SEQ ID NO: 38075
  misc_feature 1..30: note = chr20:37274701-37274731
  misc_feature 1..30: note = hyper
  source 1..30: mol_type = genomic DNA

SEQ ID NO: 58655 - DNA, 143 bp, Homo sapiens
  misc_feature 1..143: note = chr20:37302554-37302697
  misc_feature 1..143: note = hyper
  source 1..143: mol_type = genomic DNA
aggggcgccgtggtgcggcatgaggctggagcctgatcactcggggtcttactggccacggtgaggagtcagggtttcatgcgcccctgcagtcagaaagcatggcccaaccccagtgccctaagtccggaaacattcaaagc

SEQ ID NO: 58656 - DNA, 58 bp, Homo sapiens
  misc_feature 1..58: note = chr20:37303343-37303401
  misc_feature 1..58: note = hyper
  source 1..58: mol_type = genomic DNA
cgtcgcgcgctcgccccacgctaggaatgcaaactgtaggcgccgccagccccccctt

SEQ ID NO: 58657 - DNA, 114 bp, Homo sapiens
  misc_feature 1..114: note = chr20:37351679-37351793
  misc_feature 1..114: note = hyper
  source 1..114: mol_type = genomic DNA
ttttccgtccgcccccgcccccacttccagtcacagccgctacttctccattcaggctgggactgccaggtggagccctgcggtttactgctcaggaggagcccggccaggaca

SEQ ID NO: 58658 - DNA, 567 bp, Homo sapiens
  misc_feature 1..567: note = chr20:37352626-37353193
  misc_feature 1..567: note = hyper
  source 1..567: mol_type = genomic DNA
ttagccagaggatctggggctgcacagctcccggaccctggagggggtggtccgggggtgggagactgcgagcatcagcccacgccggccccctcccaccctgcggcggcgaggtgggaagggccaggatgcgagcttagcacctcccctagaaatgcagcacttcgcccccccacctcccctgccctcggcgctccctctttcacgcgctccctcccgcctccttcccaagggcgcccttcttctgcccccagctcacgtctgaatccctcggcgccccctttctcttctcctagccccttcctcacgtcccctgcctccgggtatttcctctctccaatcccccacccccgcaccgcctgattccgaggggcgggagcgcattgggctgcgcacgggtgggggcgccgcgccagcttcgcgtagctgctctgacgccgctgccgccgccgccgccgccgccgccctccgcagcccagctcgcgccccgcggcagctccgcagtgcactagccaccaccgccgccgccgccgctccgccagacctgctgccagcttgcccggtcca

SEQ ID NO: 58659 - DNA, 219 bp, Homo sapiens
  misc_feature 1..219: note = chr20:37353236-37353455
  misc_feature 1..219: note = hyper
  source 1..219: mol_type = genomic DNA
agagagccccggggcgccgcgcggagagcaagcggagatagcgactttgcgccccccagccctcgccttcttgcatcgcgttccccgcatcctcgggtccttctgtcctttccgctgtccccaccgccgccatggccaccttgctccgcagcaagctgtccaacgtggccacgtccgtgtccaacaagtcccaggccaagatgagcggcatgttcgcca

SEQ ID NO: 58660 - DNA, 339 bp, Homo sapiens; identical to SEQ ID NO: 23328
  misc_feature 1..339: note = chr20:37353806-37354145
  misc_feature 1..339: note = hyper
  source 1..339: mol_type = genomic DNA

SEQ ID NO: 58661 - DNA, 30 bp, Homo sapiens; identical to SEQ ID NO: 23329
  misc_feature 1..30: note = chr20:37355202-37355232
  misc_feature 1..30: note = hyper
  source 1..30: mol_type = genomic DNA

SEQ ID NO: 58662 - DNA, 345 bp, Homo sapiens; identical to SEQ ID NO: 23330
  misc_feature 1..345: note = chr20:37355502-37355847
  misc_feature 1..345: note = hyper
  source 1..345: mol_type = genomic DNA

SEQ ID NO: 58663 - DNA, 472 bp, Homo sapiens
  misc_feature 1..472: note = chr20:37357353-37357825
  misc_feature 1..472: note = hyper
  source 1..472: mol_type = genomic DNA
agtgcgccctgccgccgcgcttgggaggccaagctttaaacatctctggttcctagtttctgattattcggggatgggggggatgggaggggacagggattcacgatccatcgcgtctgcgtttctgttgtcctttcttttccacaacaccctggttttggggggaggcggggtgcatttgcgggcagggttctctgtccttccaagtggggccccgacactttggttccagtcatcgagggggttgggaagggagggagagggggcgcagctcgcaggcgtggcaacttgaccttgggggaatatttcacatccatccagagctcggaatctacagcgtccagccatttccagcaagagcgcttcccattccggagacgtttcaaccctgcagcgggaaaggctgactgggaaatccattttgggtgggcaatttccttcaacgaagccggaaggcgagaagccgcggcgg

SEQ ID NO: 58664 - DNA, 52 bp, Homo sapiens
  misc_feature 1..52: note = chr20:37358190-37358242
  misc_feature 1..52: note = hyper
  source 1..52: mol_type = genomic DNA
ggtgtgaggaggaagctgaagacggagagtgctgtagcggccccctcagctg

SEQ ID NO: 58665 - DNA, 104 bp, Homo sapiens; identical to SEQ ID NO: 38084
  misc_feature 1..104: note = chr20:37359606-37359710
  misc_feature 1..104: note = hyper
  source 1..104: mol_type = genomic DNA

SEQ ID NO: 58666 - DNA, 241 bp, Homo sapiens; identical to SEQ ID NO: 38085
  misc_feature 1..241: note = chr20:37434112-37434353
  misc_feature 1..241: note = hyper
  source 1..241: mol_type = genomic DNA

SEQ ID NO: 58667 - DNA, 64 bp, Homo sapiens; identical to SEQ ID NO: 23333
  misc_feature 1..64: note = chr20:37434488-37434552
  misc_feature 1..64: note = hyper
  source 1..64: mol_type = genomic DNA

SEQ ID NO: 58668 - DNA, 150 bp, Homo sapiens; identical to SEQ ID NO: 23334
  misc_feature 1..150: note = chr20:37434744-37434894
  misc_feature 1..150: note = hyper
  source 1..150: mol_type = genomic DNA

SEQ ID NO: 58669 - DNA, 174 bp, Homo sapiens; identical to SEQ ID NO: 23335
  misc_feature 1..174: note = chr20:37434930-37435104
  misc_feature 1..174: note = hyper
  source 1..174: mol_type = genomic DNA

SEQ ID NO: 58670 - DNA, 152 bp, Homo sapiens; identical to SEQ ID NO: 23336
  misc_feature 1..152: note = chr20:37435218-37435370
  misc_feature 1..152: note = hyper
  source 1..152: mol_type = genomic DNA

SEQ ID NO: 58671 - DNA, 56 bp, Homo sapiens
  misc_feature 1..56: note = chr20:37435860-37435916
  misc_feature 1..56: note = hyper
  source 1..56: mol_type = genomic DNA
cctcctccaaggctggtaataaagcttcttagcccagccagcgactagctgtctac

SEQ ID NO: 58672 - DNA, 155 bp, Homo sapiens
  misc_feature 1..155: note = chr20:39316048-39316203
  misc_feature 1..155: note = hyper
  source 1..155: mol_type = genomic DNA
tcgcctctcgcctgccgggacgccagagtccctctcctttcctcgttgctctcttcctggcgcggactactctccgggcagcaaagcagctgtcccggcttaacgcgcaaagttcagaaagccaggagtctccagatggccttggtgacttctcg

SEQ ID NO: 58673 - DNA, 13 bp, Homo sapiens
  misc_feature 1..13: note = chr20:39316322-39316335
  misc_feature 1..13: note = hyper
  source 1..13: mol_type = genomic DNA
ccttagccaaggt

SEQ ID NO: 58674 - DNA, 199 bp, Homo sapiens
  misc_feature 1..199: note = chr20:39317392-39317591
  misc_feature 1..199: note = hyper
  source 1..199: mol_type = genomic DNA
ttcttcacgtcgaacttgagcaggtcgaagtcgttgacatactccatggccagcgggctggtgggcagctctggccccatgctcagctccgcggccatcgctgaagcgaggcgcagccgccgctgccgcccgggaaactttgcggccggccggagcgcgccgagccaagcgcgggggggaagagcggagaagagctggg

SEQ ID NO: 58675 - DNA, 139 bp, Homo sapiens
  misc_feature 1..139: note = chr20:39318987-39319126
  misc_feature 1..139: note = hyper
  source 1..139: mol_type = genomic DNA
cgatgtacaggtcctcgggtcccgtcttcgtactcagccgcgagcctcgagccgcgagctccgctctggtcgccccgttgaaattccgtgccccagcgttcgggggtgcccgtcggctgctccctgggccggaaggtcc

SEQ ID NO: 58676 - DNA, 13 bp, Homo sapiens
  misc_feature 1..13: note = chr20:39319653-39319666
  misc_feature 1..13: note = hyper
  source 1..13: mol_type = genomic DNA
cctatttttaata

SEQ ID NO: 58677 - DNA, 40 bp, Homo sapiens; identical to SEQ ID NO: 38096
  misc_feature 1..40: note = chr20:39994691-39994731
  misc_feature 1..40: note = hyper
  source 1..40: mol_type = genomic DNA

SEQ ID NO: 58678 - DNA, 20 bp, Homo sapiens
  misc_feature 1..20: note = chr20:39994762-39994782
  misc_feature 1..20: note = hyper
  source 1..20: mol_type = genomic DNA
cggaccgcctttcctcctct

SEQ ID NO: 58679 - DNA, 144 bp, Homo sapiens
  misc_feature 1..144: note = chr20:39995002-39995146
  misc_feature 1..144: note = hyper
  source 1..144: mol_type = genomic DNA
gggtgcccggggcctcgacgccccccgcgggtgcgggcaggtgggagcggcgacgcgcgcgggcccatccctccctcttcccgcccgccgcccgcccgcgcttacttgtgcggccccgggcgcagccgcgggcgccatcccgtc

SEQ ID NO: 58680 - DNA, 47 bp, Homo sapiens
  misc_feature 1..47: note = chr20:39995813-39995860
  misc_feature 1..47: note = hyper
  source 1..47: mol_type = genomic DNA
actgctctccagggctctggagccgagatggccgtgactgggggcac

SEQ ID NO: 58681 - DNA, 494 bp, Homo sapiens
  misc_feature 1..494: note = chr20:41817292-41817786
  misc_feature 1..494: note = hyper
  source 1..494: mol_type = genomic DNA
tacaccaaaagcaatcggtgctaagaaactttaaggtgattttgaacttggaagtacacctgcagcactcccttctcttccctccgccgctactcttgggggggggggggctcgggggtggaagctgcctgcggtggggcttggtgatgtgtaagaccctggactgtggtgccctccagcacccgccaacgtgcctttaggagcacggcaggcaccacccccccgcccccgctccccctactctggggaactacctctgctcaccgccttcccgtggccaaacccaaatatgagttccccgaacttttcaggagcggacgcgctcacgggtcaaatccactcccctccaagggccttaacacgggcgcccagctacctcggagaaaagccagcgggtagggcggaggtattgctctcggtcatcaacgcaaacatcccctcgggtgcctacagcggcctgcttaggggagcagcgtgttcagagcaaatggaga

SEQ ID NO: 58682 - DNA, 482 bp, Homo sapiens
  misc_feature 1..482: note = chr20:41818085-41818567
  misc_feature 1..482: note = hyper
  source 1..482: mol_type = genomic DNA
cgcgaggggccgggctcgctggccggggcgcgcggggacactgcttcccgcgcctgcaagctgagacccgggttccggccatggggacccgcgcccccgcgagcccacacaactttctcctccgagggccccgcggctgggggcccgcgcgcatccaggagggagcggggagcccaggggagccgggcgggcgcactcacctgcggcgctctgagcccgggcgccgggcagtggcggcagctgcagcctcaggagcaggctgagggcgagcgcggcgaggctcgccatccgggcggcggcgggcagctcagccccttcccgcgggggccggggccgggactggggcgggcgcggggtggccccgcatcgccggcgcggccgctggctgtgcgcgcggctggctccgctcgggctcccggagccggcgctcctgcgttccaagccgaggcgcggcgcgaactgaggcgggaggctgggcgggg

SEQ ID NO: 58683 - DNA, 273 bp, Homo sapiens
  misc_feature 1..273: note = chr20:41818914-41819187
  misc_feature 1..273: note = hyper
  source 1..273: mol_type = genomic DNA
gaagctgcagcagccgtttgaactcggggtggggaacaggtgaatgggggttcggtggcgagaagagggagggagggagcagccctcgcaactcaagataaggggccaggtgaattgcgaaagcgggtgggggcgtctgcccaaagctggggcaggcggctgctggccagggtctcgggcacaccctgagatgagaatttcatctaagagcgcgcgcgcgcacacacacacaacccactcacactcttctgggcgcatcgctgaccgcgccac

SEQ ID NO: 58684 - DNA, 30 bp, Homo sapiens; identical to SEQ ID NO: 38103
  misc_feature 1..30: note = chr20:42019069-42019099
  misc_feature 1..30: note = hyper
  source 1..30: mol_type = genomic DNA

SEQ ID NO: 58685 - DNA, 272 bp, Homo sapiens
  misc_feature 1..272: note = chr20:42136058-42136330
  misc_feature 1..272: note = hyper
  source 1..272: mol_type = genomic DNA
cggtccctgcgcccccgctgcgctctgctagctgtgatgcaggggttcgggggcaggaaaaatctcgacccgccacgcccgtgcggcaaacctgtcctaggttgagggggcatgaggcgcgcacaaccagggcctcgaaggcaggcaagagggcgcgggcgccacagaagcctgggcctgcgcctgggccgggcagatgtgcccggcgctcgggccccgcgctctgcgtcctgcagggaggcggacccgccccccgaacgcgcaggcgcgcg

SEQ ID NO: 58686 - DNA, 287 bp, Homo sapiens
  misc_feature 1..287: note = chr20:42136411-42136698
  misc_feature 1..287: note = hyper
  source 1..287: mol_type = genomic DNA
gaccttgcgtcccctgggcgccgcgccaccccgctccgtccagggcggcgagggctcaggtctgcggccccggcgtctcgctccttccgagcgcctccggcggggggcgcgggctggggaggaggttcgggaaaacgccggggaaagcggtctgggcggagcgcgcagggggccaggcgggtgcgggactccaggcccagccgaccctgcggcgtggcttcgggctgcgatcaggaggggcgaggagggtggaggctgcgtgtttggagatacgcaatcaattaaga

SEQ ID NO: 58687 - DNA, 62 bp, Homo sapiens; identical to SEQ ID NO: 38105
  misc_feature 1..62: note = chr20:42543184-42543246
  misc_feature 1..62: note = hyper
  source 1..62: mol_type = genomic DNA

SEQ ID NO: 58688 - DNA, 263 bp, Homo sapiens
  misc_feature 1..263: note = chr20:42543491-42543754
  misc_feature 1..263: note = hyper
  source 1..263: mol_type = genomic DNA
actgcccgcgggagccgccgccgccgccgccgcgcccgccatggacgtccgcctgtacccctcggcgcccgcggtgggcgcgcggcccggggccgagccggccggcctggcgcacctggactattaccacggcggcaaggtaggcgggggcgggcgggggtccccggcgggcggggccggagtcacctggcagctcgggactcaggcgctcccggggtcacacggggccgcgcacatcagccccgccgacgggcacgggcggc

SEQ ID NO: 58689 - DNA, 238 bp, Homo sapiens; identical to SEQ ID NO: 23348
  misc_feature 1..238: note = chr20:42543853-42544091
  misc_feature 1..238: note = hyper
  source 1..238: mol_type = genomic DNA

SEQ ID NO: 58690 - DNA, 31 bp, Homo sapiens
  misc_feature 1..31: note = chr20:42544984-42545015
  misc_feature 1..31: note = hyper
  source 1..31: mol_type = genomic DNA
tgggcctccctgagtgcgccctcaggcccca

SEQ ID NO: 58691 - DNA, 170 bp, Homo sapiens; identical to SEQ ID NO: 13811
  misc_feature 1..170: note = chr20:42587835-42588005
  misc_feature 1..170: note = hyper
  source 1..170: mol_type = genomic DNA

SEQ ID NO: 58692 - DNA, 30 bp, Homo sapiens; identical to SEQ ID NO: 38109
  misc_feature 1..30: note = chr20:42876029-42876059
  misc_feature 1..30: note = hyper
  source 1..30: mol_type = genomic DNA

SEQ ID NO: 58693 - DNA, 35 bp, Homo sapiens; identical to SEQ ID NO: 38110
  misc_feature 1..35: note = chr20:42876632-42876667
  misc_feature 1..35: note = hyper
  source 1..35: mol_type = genomic DNA

SEQ ID NO: 58694 - DNA, 61 bp, Homo sapiens; identical to SEQ ID NO: 38111
  misc_feature 1..61: note = chr20:43017338-43017399
  misc_feature 1..61: note = hyper
  source 1..61: mol_type = genomic DNA

SEQ ID NO: 58695 - DNA, 42 bp, Homo sapiens
  misc_feature 1..42: note = chr20:43438029-43438071
  misc_feature 1..42: note = hyper
  source 1..42: mol_type = genomic DNA
ctggctgaggttgtgcgcaggcctgggaggaggaggttcaag

SEQ ID NO: 58696 - DNA, 516 bp, Homo sapiens; identical to SEQ ID NO: 23350
  misc_feature 1..516: note = chr20:43438466-43438982
  misc_feature 1..516: note = hyper
  source 1..516: mol_type = genomic DNA

SEQ ID NO: 58697 - DNA, 197 bp, Homo sapiens
  misc_feature 1..197: note = chr20:43439022-43439219
  misc_feature 1..197: note = hyper
  source 1..197: mol_type = genomic DNA
cggcggcccggggccgggccgaggctccgctgcggggctggcgggcgcggcggggccggcgggcgggccaggagctggcggcgcgcggagcccgaggcgcgctgtgctgctggcggcggcggcggcggcggcggtggcggcggcggtggcggcgcagcgcgctctggtccgcggcgccccccgccggcagcgcgagg

SEQ ID NO: 58698 - DNA, 44 bp, Homo sapiens; identical to SEQ ID NO: 23353
  misc_feature 1..44: note = chr20:43439247-43439291
  misc_feature 1..44: note = hyper
  source 1..44: mol_type = genomic DNA

SEQ ID NO: 58699 - DNA, 42 bp, Homo sapiens
  misc_feature 1..42: note = chr20:43439510-43439552
  misc_feature 1..42: note = hyper
  source 1..42: mol_type = genomic DNA
cgctcaaagggtcccgcccaggcgggtcggcactcggcctcc

SEQ ID NO: 58700 - DNA, 102 bp, Homo sapiens; identical to SEQ ID NO: 38115
  misc_feature 1..102: note = chr20:43726528-43726630
  misc_feature 1..102: note = hyper
  source 1..102: mol_type = genomic DNA

SEQ ID NO: 58701 - DNA, 24 bp, Homo sapiens
  misc_feature 1..24: note = chr20:43726764-43726788
  misc_feature 1..24: note = hyper
  source 1..24: mol_type = genomic DNA
cgagtagcccgggttctccatggt

SEQ ID NO: 58702 - DNA, 30 bp, Homo sapiens; identical to SEQ ID NO: 38117
  misc_feature 1..30: note = chr20:43922213-43922243
  misc_feature 1..30: note = hyper
  source 1..30: mol_type = genomic DNA

SEQ ID NO: 58703 - DNA, 63 bp, Homo sapiens
  misc_feature 1..63: note = chr20:44452668-44452731
  misc_feature 1..63: note = hyper
  source 1..63: mol_type = genomic DNA
ctttcatcagagattcgatctcctcgtccgtcacgtgctccccggaggccctgaaaatctcag

SEQ ID NO: 58704 - DNA, 78 bp, Homo sapiens; identical to SEQ ID NO: 38119
  misc_feature 1..78: note = chr20:44519124-44519202
  misc_feature 1..78: note = hyper
  source 1..78: mol_type = genomic DNA

SEQ ID NO: 58705 - DNA, 30 bp, Homo sapiens; identical to SEQ ID NO: 13818
  misc_feature 1..30: note = chr20:44540105-44540135
  misc_feature 1..30: note = hyper
  source 1..30: mol_type = genomic DNA

SEQ ID NO: 58706 - DNA, 364 bp, Homo sapiens; identical to SEQ ID NO: 38121
  misc_feature 1..364: note = chr20:44540444-44540808
  misc_feature 1..364: note = hyper
  source 1..364: mol_type = genomic DNA

SEQ ID NO: 58707 - DNA, 33 bp, Homo sapiens
  misc_feature 1..33: note = chr20:44639148-44639181
  misc_feature 1..33: note = hyper
  source 1..33: mol_type = genomic DNA
gcgggcggtgattgacgacgcctttgcccgcgc

SEQ ID NO: 58708 - DNA, 15 bp, Homo sapiens
  misc_feature 1..15: note = chr20:44639731-44639746
  misc_feature 1..15: note = hyper
  source 1..15: mol_type = genomic DNA
ctcccactcatcacc

SEQ ID NO: 58709-58710 - skipped (2 entries)

SEQ ID NO: 58711 - DNA, 25 bp, Homo sapiens
  misc_feature 1..25: note = chr20:44640312-44640337
  misc_feature 1..25: note = hyper
  source 1..25: mol_type = genomic DNA
cgacggctaccgctggtgcgccacc

SEQ ID NO: 58712 - DNA, 33 bp, Homo sapiens; identical to SEQ ID NO: 38127
  misc_feature 1..33: note = chr20:44640787-44640820
  misc_feature 1..33: note = hyper
  source 1..33: mol_type = genomic DNA

SEQ ID NO: 58713 - DNA, 261 bp, Homo sapiens; identical to SEQ ID NO: 38128
  misc_feature 1..261: note = chr20:44650230-44650491
  misc_feature 1..261: note = hyper
  source 1..261: mol_type = genomic DNA

SEQ ID NO: 58714 - DNA, 58 bp, Homo sapiens; identical to SEQ ID NO: 38129
  misc_feature 1..58: note = chr20:44657782-44657840
  misc_feature 1..58: note = hyper
  source 1..58: mol_type = genomic DNA

SEQ ID NO: 58715 - DNA, 34 bp, Homo sapiens; identical to SEQ ID NO: 38130
  misc_feature 1..34: note = chr20:44658183-44658217
  misc_feature 1..34: note = hyper
  source 1..34: mol_type = genomic DNA

SEQ ID NO: 58716 - DNA, 171 bp, Homo sapiens; identical to SEQ ID NO: 38131
  misc_feature 1..171: note = chr20:44659126-44659297
  misc_feature 1..171: note = hyper
  source 1..171: mol_type = genomic DNA

SEQ ID NO: 58717 - DNA, 30 bp, Homo sapiens; identical to SEQ ID NO: 38132
  misc_feature 1..30: note = chr20:44660307-44660337
  misc_feature 1..30: note = hyper
  source 1..30: mol_type = genomic DNA

SEQ ID NO: 58718 - DNA, 30 bp, Homo sapiens; identical to SEQ ID NO: 38133
  misc_feature 1..30: note = chr20:44660605-44660635
  misc_feature 1..30: note = hyper
  source 1..30: mol_type = genomic DNA

SEQ ID NO: 58719 - DNA, 72 bp, Homo sapiens; identical to SEQ ID NO: 23360
  misc_feature 1..72: note = chr20:44660877-44660949
  misc_feature 1..72: note = hyper
  source 1..72: mol_type = genomic DNA

SEQ ID NO: 58720 - DNA, 30 bp, Homo sapiens; identical to SEQ ID NO: 38135
  misc_feature 1..30: note = chr20:44685865-44685895
  misc_feature 1..30: note = hyper
  source 1..30: mol_type = genomic DNA

SEQ ID NO: 58721 - DNA, 31 bp, Homo sapiens
  misc_feature 1..31: note = chr20:44686762-44686793
  misc_feature 1..31: note = hyper
  source 1..31: mol_type = genomic DNA
tgtacaggagacatcgcgtgtatttttaacg

SEQ ID NO: 58722 - DNA, 129 bp, Homo sapiens; identical to SEQ ID NO: 38138
  misc_feature 1..129: note = chr20:44687107-44687236
  misc_feature 1..129: note = hyper
  source 1..129: mol_type = genomic DNA

SEQ ID NO: 58723 - DNA, 30 bp, Homo sapiens; identical to SEQ ID NO: 38139
  misc_feature 1..30: note = chr20:44747259-44747289
  misc_feature 1..30: note = hyper
  source 1..30: mol_type = genomic DNA

SEQ ID NO: 58724 - DNA, 77 bp, Homo sapiens; identical to SEQ ID NO: 38140
  misc_feature 1..77: note = chr20:44803049-44803126
  misc_feature 1..77: note = hyper
  source 1..77: mol_type = genomic DNA

SEQ ID NO: 58725 - skipped

SEQ ID NO: 58726 - DNA, 135 bp, Homo sapiens
  misc_feature 1..135: note = chr20:44803675-44803810
  misc_feature 1..135: note = hyper
  source 1..135: mol_type = genomic DNA
cttgtggtggcgcctgagggtgaggatcagcagcaccagcactgcgagggggacagagggggcaactgagggccaagcccctcccagggcattagaaggaccctctaccccatctcctcccgcctcccacccagc

SEQ ID NO: 58727 - DNA, 45 bp, Homo sapiens; identical to SEQ ID NO: 38142
  misc_feature 1..45: note = chr20:44879746-44879791
  misc_feature 1..45: note = hyper
  source 1..45: mol_type = genomic DNA

SEQ ID NO: 58728 - DNA, 91 bp, Homo sapiens; identical to SEQ ID NO: 23366
  misc_feature 1..91: note = chr20:44880076-44880167
  misc_feature 1..91: note = hyper
  source 1..91: mol_type = genomic DNA

SEQ ID NO: 58729 - DNA, 26 bp, Homo sapiens
  misc_feature 1..26: note = chr20:44880275-44880301
  misc_feature 1..26: note = hyper
  source 1..26: mol_type = genomic DNA
cgggttggggccggcagatcctgcca

SEQ ID NO: 58730 - DNA, 157 bp, Homo sapiens; identical to SEQ ID NO: 13830
  misc_feature 1..157: note = chr20:44936314-44936471
  misc_feature 1..157: note = hyper
  source 1..157: mol_type = genomic DNA

SEQ ID NO: 58731 - DNA, 92 bp, Homo sapiens; identical to SEQ ID NO: 38146
  misc_feature 1..92: note = chr20:44936608-44936700
  misc_feature 1..92: note = hyper
  source 1..92: mol_type = genomic DNA

SEQ ID NO: 58732 - DNA, 179 bp, Homo sapiens
  misc_feature 1..179: note = chr20:44937023-44937202
  misc_feature 1..179: note = hyper
  source 1..179: mol_type = genomic DNA
agcgagagggggagccgcggcggcgtgtgcgcgcgtgtgtgtgagcgagagagcgagagagcgagagagcgagggagtgagcgagcgagcgggagcgagggagtgtgcgtgtctgactggggggaagtgtgcaagggacggatcccttccttcctcccgcagcctctggtggagactcg

SEQ ID NO: 58733 - DNA, 34 bp, Homo sapiens
  misc_feature 1..34: note = chr20:44941484-44941518
  misc_feature 1..34: note = hyper
  source 1..34: mol_type = genomic DNA
aggggacggggaggccgcccttggctgggggcgc

SEQ ID NO: 58734 - DNA, 166 bp, Homo sapiens
  misc_feature 1..166: note = chr20:45141834-45142000
  misc_feature 1..166: note = hyper
  source 1..166: mol_type = genomic DNA
ctagctacttggatgcgtaaacctttcaccttcaccaagcgccttcttcgggcaaatcagggccctagagagagctcgcccgtggcctgcaggtcaggagcccaatcctgccctggctgcctcgcctcccgaccacaggaaaccctccctccaaagacagggagag

SEQ ID NO: 58735 - DNA, 386 bp, Homo sapiens; identical to SEQ ID NO: 38154
  misc_feature 1..386: note = chr20:45338398-45338784
  misc_feature 1..386: note = hyper
  source 1..386: mol_type = genomic DNA

SEQ ID NO: 58736 - DNA, 1327 bp, Homo sapiens
  misc_feature 1..1327: note = chr20:45523196-45524523
  misc_feature 1..1327: note = hyper
  source 1..1327: mol_type = genomic DNA
ggaggtgcggggtgtcggtgggtggggaggaggctgggccctggcctccaggaccggcgagagtgagcgcgctctgctcggctgcaggctcaggaagcggcgcggcggcacgtgctgggccagagccccgcgccctgcgtccagccgccgggtgtgtgcgcccgcgtagcccagcgtcgcgcctcggcgcccccacgcgcccacgcagcggcgcggggacccgggcgggggcagagggagggcccggcccagggaggagaaggggccggtcctcccggcgcaggcagcagccgcggcagcccaggaggcggaggcagcggcaacggcagagacagcaacgtgcccgccgcagtcagcccggcctcgtcggacccgcaccggcccgcccgcccgcccgcaccgcgtcggggcgccctctccactgcgcgcggtgagtaccgccagcggcgcccaccccaggccgcccgccgggattcgccgggcggggggagttgttcaccgggaccccctcgccctgcgcctctttctggcactcgccaagcggggcctccgcagctgtcgggacgttctggggcgcacgggcctcccagggccaggaaggcacaagggcagaggggacagcagcagagcccccctctggaaaggctctcccaggctcggggccccagtttccccatgcgctttggggcaacgaccctgaagtttgctctcccgcgcgcgggacaagtgcatggcgcgcaggcggtgtagacgcggctgggtccttggcgttttgttcgattatggtcccggcggttcgcgataaggggcgctcccccagtccgcaaactcaagccctcaggtagtgtttatgggataaccaagaagcagagccaaccgctggaatcccggcttggggctggaacggcccgctgagactttgccttctagctattgatatatttcttttcaaaagtccgtttgcgctcggcccgctctggttcaggtctggggctttgaaccggggcagggaatcctggcgcctgctgcgggtagagttgaaacttagaaaagtttacatccgaagggtgtttagaaggcggcaaggatttcgttgtaatgggagaaagtgggaaatggaattgttttttagtcatgaagtctggaggttaaacggccgtgctggcccaggctccttcaatatattcctgcctgcctcccccccagcaataaatagtttataagctcaaggaatactaggaaagcgtgactggtgaacgtactcctatcgcaaaagactcagtgcgcttttctcagctgttgaactggaagcgccttttgcagtgcg

SEQ ID NO: 58737 - DNA, 25 bp, Homo sapiens
  misc_feature 1..25: note = chr20:45524553-45524578
  misc_feature 1..25: note = hyper
  source 1..25: mol_type = genomic DNA
gagttgacagcgtgcaccctgccgc

SEQ ID NO: 58738 - DNA, 128 bp, Homo sapiens; identical to SEQ ID NO: 38156
  misc_feature 1..128: note = chr20:46413326-46413454
  misc_feature 1..128: note = hyper
  source 1..128: mol_type = genomic DNA

SEQ ID NO: 58739 - DNA, 279 bp, Homo sapiens; identical to SEQ ID NO: 38157
  misc_feature 1..279: note = chr20:46414635-46414914
  misc_feature 1..279: note = hyper
  source 1..279: mol_type = genomic DNA

SEQ ID NO: 58740 - DNA, 30 bp, Homo sapiens; identical to SEQ ID NO: 38158
  misc_feature 1..30: note = chr20:46415157-46415187
  misc_feature 1..30: note = hyper
  source 1..30: mol_type = genomic DNA

SEQ ID NO: 58741 - DNA, 42 bp, Homo sapiens; identical to SEQ ID NO: 38159
  misc_feature 1..42: note = chr20:46415427-46415469
  misc_feature 1..42: note = hyper
  source 1..42: mol_type = genomic DNA

SEQ ID NO: 58742 - DNA, 10 bp, Homo sapiens
  misc_feature 1..10: note = chr20:47443719-47443729
  misc_feature 1..10: note = hyper
  source 1..10: mol_type = genomic DNA
atcctactcc

SEQ ID NO: 58743 - DNA, 146 bp, Homo sapiens; identical to SEQ ID NO: 23374
  misc_feature 1..146: note = chr20:47444282-47444428
  misc_feature 1..146: note = hyper
  source 1..146: mol_type = genomic DNA

SEQ ID NO: 58744 - DNA, 129 bp, Homo sapiens; identical to SEQ ID NO: 4825
  misc_feature 1..129: note = chr20:47444452-47444581
  misc_feature 1..129: note = hyper
  source 1..129: mol_type = genomic DNA

SEQ ID NO: 58745 - DNA, 184 bp, Homo sapiens; identical to SEQ ID NO: 4826
  misc_feature 1..184: note = chr20:47444609-47444793
  misc_feature 1..184: note = hyper
  source 1..184: mol_type = genomic DNA

SEQ ID NO: 58746 - DNA, 295 bp, Homo sapiens; identical to SEQ ID NO: 4827
  misc_feature 1..295: note = chr20:47444920-47445215
  misc_feature 1..295: note = hyper
  source 1..295: mol_type = genomic DNA

SEQ ID NO: 58747 - DNA, 227 bp, Homo sapiens; identical to SEQ ID NO: 23378
  misc_feature 1..227: note = chr20:47935268-47935495
  misc_feature 1..227: note = hyper
  source 1..227: mol_type = genomic DNA

SEQ ID NO: 58748 - DNA, 361 bp, Homo sapiens
  misc_feature 1..361: note = chr20:47935567-47935928
  misc_feature 1..361: note = hyper
  source 1..361: mol_type = genomic DNA
gagcacaagaggcgcaggcaggaaggagagcgcctggtgcgagagaggaaggagcgcacccagtaagcggtgtcgggggggtcgtgaagcttggagggcctcgaggggagggaggcgcttgggttgaggtagggcgccagatttcgcaaatcaaaatacagcacacccagttaaactcgaatttcagataaacaaatctttctagagaaaaatatgtcctaaatatcgcatgggatatacttatactaaaaaattatttgttgtttttctgaaattgaaatctaactcggagtcctgtattttatctgagagccccagctggggacgggcgcggggccaagagagctgcgagggaggaggg

SEQ ID NO: 58749 - DNA, 25 bp, Homo sapiens
  misc_feature 1..25: note = chr20:47936027-47936052
  misc_feature 1..25: note = hyper
  source 1..25: mol_type = genomic DNA
gatggaaagacgctcaaagcggagg

SEQ ID NO: 58750 - DNA, 138 bp, Homo sapiens; identical to SEQ ID NO: 38168
  misc_feature 1..138: note = chr20:48099124-48099262
  misc_feature 1..138: note = hyper
  source 1..138: mol_type = genomic DNA

SEQ ID NO: 58751 - DNA, 30 bp, Homo sapiens; identical to SEQ ID NO: 13849
  misc_feature 1..30: note = chr20:48099543-48099573
  misc_feature 1..30: note = hyper
  source 1..30: mol_type = genomic DNA

SEQ ID NO: 58752 - DNA, 30 bp, Homo sapiens; identical to SEQ ID NO: 38170
  misc_feature 1..30: note = chr20:48100342-48100372
  misc_feature 1..30: note = hyper
  source 1..30: mol_type = genomic DNA

SEQ ID NO: 58753 - DNA, 53 bp, Homo sapiens; identical to SEQ ID NO: 38171
  misc_feature 1..53: note = chr20:48184239-48184292
  misc_feature 1..53: note = hyper
  source 1..53: mol_type = genomic DNA

SEQ ID NO: 58754 - DNA, 53 bp, Homo sapiens
  misc_feature 1..53: note = chr20:48184328-48184381
  misc_feature 1..53: note = hyper
  source 1..53: mol_type = genomic DNA
cgattcgccccgggggacctaccggaccccgcaccttcccaccttgcaccttc

SEQ ID NO: 58755 - DNA, 220 bp, Homo sapiens
  misc_feature 1..220: note = chr20:48184435-48184655
  misc_feature 1..220: note = hyper
  source 1..220: mol_type = genomic DNA
cccacctccgagggtctcgccttgcccgggatactggagcgggactcgggccgggccggccgcgggctccgagacccttgggctgcagcccgggcgggagccgccccctttgtctggcggggccgagcggagcaggacactcaccgcgtgcggcggcggctcagtagcagcagcagcaacagtgcggccaggaggccgaggagcgcggcccaagccatcg

SEQ ID NO: 58756 - DNA, 109 bp, Homo sapiens; identical to SEQ ID NO: 38173
  misc_feature 1..109: note = chr20:48788910-48789019
  misc_feature 1..109: note = hyper
  source 1..109: mol_type = genomic DNA

SEQ ID NO: 58757 - DNA, 129 bp, Homo sapiens; identical to SEQ ID NO: 38174
  misc_feature 1..129: note = chr20:49435030-49435159
  misc_feature 1..129: note = hyper
  source 1..129: mol_type = genomic DNA

SEQ ID NO: 58758 - DNA, 30 bp, Homo sapiens; identical to SEQ ID NO: 38175
  misc_feature 1..30: note = chr20:49575750-49575780
  misc_feature 1..30: note = hyper
  source 1..30: mol_type = genomic DNA

SEQ ID NO: 58759 - DNA, 33 bp, Homo sapiens; identical to SEQ ID NO: 38176
  misc_feature 1..33: note = chr20:49576086-49576119
  misc_feature 1..33: note = hyper
  source 1..33: mol_type = genomic DNA

SEQ ID NO: 58760 - DNA, 11 bp, Homo sapiens
  misc_feature 1..11: note = chr20:49639123-49639134
  misc_feature 1..11: note = hyper
  source 1..11: mol_type = genomic DNA
cggcggcgaac

SEQ ID NO: 58761 - DNA, 50 bp, Homo sapiens; identical to SEQ ID NO: 38178
  misc_feature 1..50: note = chr20:49639135-49639185
  misc_feature 1..50: note = hyper
  source 1..50: mol_type = genomic DNA

SEQ ID NO: 58762 - DNA, 317 bp, Homo sapiens; identical to SEQ ID NO: 38179
  misc_feature 1..317: note = chr20:49639217-49639534
  misc_feature 1..317: note = hyper
  source 1..317: mol_type = genomic DNA

SEQ ID NO: 58763 - skipped

SEQ ID NO: 58764 - DNA, 68 bp, Homo sapiens
  misc_feature 1..68: note = chr20:49640157-49640225
  misc_feature 1..68: note = hyper
  source 1..68: mol_type = genomic DNA
atgtgctagatattaaaaccccactctccgctgccccggggccgcgctccacgcgcttacacatcctg

SEQ ID NO: 58765 - DNA, 45 bp, Homo sapiens; identical to SEQ ID NO: 38183
  misc_feature 1..45: note = chr20:49708478-49708523
  misc_feature 1..45: note = hyper
  source 1..45: mol_type = genomic DNA

SEQ ID NO: 58766 - DNA, 118 bp, Homo sapiens; identical to SEQ ID NO: 38184
  misc_feature 1..118: note = chr20:49836918-49837036
  misc_feature 1..118: note = hyper
  source 1..118: mol_type = genomic DNA

SEQ ID NO: 58767 - DNA, 270 bp, Homo sapiens; identical to SEQ ID NO: 38185
  misc_feature 1..270: note = chr20:50157750-50158020
  misc_feature 1..270: note = hyper
  source 1..270: mol_type = genomic DNA

SEQ ID NO: 58768 - DNA, 65 bp, Homo sapiens; identical to SEQ ID NO: 38186
  misc_feature 1..65: note = chr20:50158354-50158419
  misc_feature 1..65: note = hyper
  source 1..65: mol_type = genomic DNA

SEQ ID NO: 58769 - DNA, 30 bp, Homo sapiens; identical to SEQ ID NO: 38187
  misc_feature 1..30: note = chr20:50179106-50179136
  misc_feature 1..30: note = hyper
  source 1..30: mol_type = genomic DNA

SEQ ID NO: 58770 - DNA, 48 bp, Homo sapiens; identical to SEQ ID NO: 38188
  misc_feature 1..48: note = chr20:50417842-50417890
  misc_feature 1..48: note = hyper
  source 1..48: mol_type = genomic DNA

SEQ ID NO: 58771 - DNA, 45 bp, Homo sapiens; identical to SEQ ID NO: 23389
  misc_feature 1..45: note = chr20:50720392-50720437
  misc_feature 1..45: note = hyper
  source 1..45: mol_type = genomic DNA

SEQ ID NO: 58772 - DNA, 23 bp, Homo sapiens
  misc_feature 1..23: note = chr20:50722193-50722216
  misc_feature 1..23: note = hyper
  source 1..23: mol_type = genomic DNA
actttaatgtgcgcacgagtcac

SEQ ID NO: 58773 - DNA, 31 bp, Homo sapiens
  misc_feature 1..31: note = chr20:51589908-51589939
  misc_feature 1..31: note = hyper
  source 1..31: mol_type = genomic DNA
cgccgagctcctcgcccgccctccttgcccc

SEQ ID NO: 58774 - DNA, 85 bp, Homo sapiens
  misc_feature 1..85: note = chr20:52789475-52789560
  misc_feature 1..85: note = hyper
  source 1..85: mol_type = genomic DNA
ggtagtcgcgataggccttccacggtttgatctccagccgctgcgggtacgcgctctcggtgcggtacagcgcttccagcaggca

SEQ ID NO: 58775 - DNA, 26 bp, Homo sapiens
  misc_feature 1..26: note = chr20:52790155-52790181
  misc_feature 1..26: note = hyper
  source 1..26: mol_type = genomic DNA
atggggtggggcgaggttggtacgag

SEQ ID NO: 58776 - DNA, 39 bp, Homo sapiens; identical to SEQ ID NO: 38198
  misc_feature 1..39: note = chr20:52790612-52790651
  misc_feature 1..39: note = hyper
  source 1..39: mol_type = genomic DNA

SEQ ID NO: 58777 - DNA, 329 bp, Homo sapiens; identical to SEQ ID NO: 38199
  misc_feature 1..329: note = chr20:53091752-53092081
  misc_feature 1..329: note = hyper
  source 1..329: mol_type = genomic DNA

SEQ ID NO: 58778 - DNA, 51 bp, Homo sapiens
  misc_feature 1..51: note = chr20:53092141-53092192
  misc_feature 1..51: note = hyper
  source 1..51: mol_type = genomic DNA
tccttctcggccgggaggaggcagggctggatccctcagccgccgccgctc

SEQ ID NO: 58779 - DNA, 157 bp, Homo sapiens
  misc_feature 1..157: note = chr20:53092376-53092533
  misc_feature 1..157: note = hyper
  source 1..157: mol_type = genomic DNA
tctccaactttctcccaccgactgcttgtcttgaccctgccctccaccctccccagagccacttcgggtgcgcgctcttgggtaaagggggggtcaccggctgtctgggatggcttccaattttaatgacatagtgaagcaagggtacgtgaggatc

SEQ ID NO: 58780 - DNA, 182 bp, Homo sapiens; identical to SEQ ID NO: 38203
  misc_feature 1..182: note = chr20:53092686-53092868
  misc_feature 1..182: note = hyper
  source 1..182: mol_type = genomic DNA

SEQ ID NO: 58781 - DNA, 173 bp, Homo sapiens
  misc_feature 1..173: note = chr20:53092912-53093085
  misc_feature 1..173: note = hyper
  source 1..173: mol_type = genomic DNA
cgccgccaacttaacttttccgggggatggatcggctggttgagaaagaggacacgcatactcggtgtgaacgaggtcacgaaccctctgaccccagggagagatttctgccaagcgtaaggtgtctttggatccccccacctctgtcccaggtgtcgtgtcaaaggcggtgc

SEQ ID NO: 58782 - DNA, 134 bp, Homo sapiens
  misc_feature 1..134: note = chr20:53093115-53093249
  misc_feature 1..134: note = hyper
  source 1..134: mol_type = genomic DNA
tagatacttgaatctggattttccgtggttcgaagccggggtggtggatttctgttgctggaatacaccctggaggtccacggaagggttatttacgtggaacctgatacctggcatagcgcaagtgctcccta

SEQ ID NO: 58783 - DNA, 429 bp, Homo sapiens
  misc_feature 1..429: note = chr20:54578078-54578507
  misc_feature 1..429: note = hyper
  source 1..429: mol_type = genomic DNA
tcatcaagccaaacacggagcaccaggtcgctaaacagcagctacagcttccgtcagctcttcccctactctcatcaacctcaaagtctgtctttccccagctatttgcaattctctgaaaggacatgagcccgggaagggagaactggctcccaagcgctttcctacaggagctcagcgcagttgccaaattccttttcctcccctcctccgcaacttttctctaagtaccggagaagggcttgctgcctactccgaggcagcggcagtgccagcggtgcctggcacacgaacagtggaacctgcaggcgagatctgacccccggctctgcccccgccctccgcggccacctgcccgatctctgaagagtgtggaagcccggggctctcttgggagagaagcttctctacctgggagaaacaaatcaa

SEQ ID NO: 58784 - DNA, 39 bp, Homo sapiens
  misc_feature 1..39: note = chr20:54578725-54578764
  misc_feature 1..39: note = hyper
  source 1..39: mol_type = genomic DNA
taggggcccggaagaaatgggagccggggctggtgagag

SEQ ID NO: 58785 - DNA, 199 bp, Homo sapiens; identical to SEQ ID NO: 23394
  misc_feature 1..199: note = chr20:54580323-54580522
  misc_feature 1..199: note = hyper
  source 1..199: mol_type = genomic DNA

SEQ ID NO: 58786 - DNA, 65 bp, Homo sapiens; identical to SEQ ID NO: 13872
  misc_feature 1..65: note = chr20:54919287-54919352
  misc_feature 1..65: note = hyper
  source 1..65: mol_type = genomic DNA

SEQ ID NO: 58787 - DNA, 137 bp, Homo sapiens; identical to SEQ ID NO: 23396
  misc_feature 1..137: note = chr20:55199898-55200035
  misc_feature 1..137: note = hyper
  source 1..137: mol_type = genomic DNA

SEQ ID NO: 58788 - DNA, 216 bp, Homo sapiens
  misc_feature 1..216: note = chr20:55200706-55200922
  misc_feature 1..216: note = hyper
  source 1..216: mol_type = genomic DNA
ccccccggggcagggcagggggagagtcaggcatgtctctaacgggctccctagtagaaccgctaggaaagtggccttcaaccctaggcacctttgtggctttcaggtagttgggcgactaaaaattcacttttgcctgctgtgaaatgggacaggtggttgtcaggttagagactgtgcccacgaagtctcgtttggcgggccgggactgacgtg

SEQ ID NO: 58789 - DNA, 265 bp, Homo sapiens; identical to SEQ ID NO: 23398
  misc_feature 1..265: note = chr20:55201092-55201357
  misc_feature 1..265: note = hyper
  source 1..265: mol_type = genomic DNA

SEQ ID NO: 58790 - skipped

SEQ ID NO: 58791 - DNA, 184 bp, Homo sapiens
  misc_feature 1..184: note = chr20:55201580-55201764
  misc_feature 1..184: note = hyper
  source 1..184: mol_type = genomic DNA
cgtctggggtgggggcaggggtggcggatgactcaggcctggggccgggagccctgtttccaaaggcaccacctcgcgcctctttggaagtggcgcgctgttggggcgctcccgctgttgcagaggcctggtttgcggtttcataggggcgtgggtccagggcttccagggagtaagtgagttt

SEQ ID NO: 58792 - DNA, 200 bp, Homo sapiens
  misc_feature 1..200: note = chr20:55202626-55202826
  misc_feature 1..200: note = hyper
  source 1..200: mol_type = genomic DNA
tcttcctggacctgtgctctggagtgcctgcgggcctgggtctaatttctgcttctggcaggtgtccccctcccccgccgctaataccaggagcgctgcttctgcggtaacttattttacccccagaagcctgttttgggaccgaagtgtcagggtcctgtgtgtctttttatgcactgttctccttagtgcaaagccct

SEQ ID NO: 58793 - DNA, 218 bp, Homo sapiens
  misc_feature 1..218: note = chr20:55204104-55204322
  misc_feature 1..218: note = hyper
  source 1..218: mol_type = genomic DNA
gtgacagaaggaaggcgcgtcgggggacccaggcctcgcaggtcttcggctgtcaacgaggcaccgcccactgactccgcgcttcgtccctcacagcgtggggctcggcgctgcgccaggcccgggtgcggggcggagctaggctgggactggctgggggccgccccgcccggcgcctgggcctccgcgccggcccccggggaggagttatgataatt

SEQ ID NO: 58794 - DNA, 362 bp, Homo sapiens
  misc_feature 1..362: note = chr20:55204604-55204966
  misc_feature 1..362: note = hyper
  source 1..362: mol_type = genomic DNA
tgtggaaaataaccgataatgtcaagtacgaagaggactgcgaggtgagctggggctccggggtgcagccccgccccgccgaggacagtccgggaggcaggggccactggaccgaggtcggggacgagggcataggagccctggcctctcggtgggacgggatccacttctccggacaccccttagtccatttctgcggggcccctttcctgtatagggccttttcctaaatagcctcccctcgggaacgaggcctggaaagagaatggcaaatcccacccacacagcttaccgggcgctttcctaagcggcaaacagccctgcttcccgttttctcggaaaagtgccccgtctgcaaccct

SEQ ID NO: 58795 - DNA, 123 bp, Homo sapiens; identical to SEQ ID NO: 38215
  misc_feature 1..123: note = chr20:55205304-55205427
  misc_feature 1..123: note = hyper
  source 1..123: mol_type = genomic DNA

SEQ ID NO: 58796 - DNA, 15 bp, Homo sapiens
  misc_feature 1..15: note = chr20:55205765-55205780
  misc_feature 1..15: note = hyper
  source 1..15: mol_type = genomic DNA
ggggcgggggaggtg

SEQ ID NO: 58797 - DNA, 37 bp, Homo sapiens
  misc_feature 1..37: note = chr20:55206393-55206430
  misc_feature 1..37: note = hyper
  source 1..37: mol_type = genomic DNA
cccctccctaccagcagctggcctactcccagtcggc

SEQ ID NO: 58798 - DNA, 42 bp, Homo sapiens; identical to SEQ ID NO: 38218
  misc_feature 1..42: note = chr20:55405254-55405296
  misc_feature 1..42: note = hyper
  source 1..42: mol_type = genomic DNA

SEQ ID NO: 58799 - DNA, 30 bp, Homo sapiens; identical to SEQ ID NO: 38219
  misc_feature 1..30: note = chr20:55499420-55499450
  misc_feature 1..30: note = hyper
  source 1..30: mol_type = genomic DNA

SEQ ID NO: 58800 - DNA, 225 bp, Homo sapiens
  misc_feature 1..225: note = chr20:55499791-55500016
  misc_feature 1..225: note = hyper
  source 1..225: mol_type = genomic DNA
aaaggggggggaacccgattagttccaaataagcgtctcttaatcacccttatgaaggcgtaatttgcaaaacactcctaggaagtaacatctttttcatttcaggggaaaaaaaaagtgcattgataaaaaataagtagaacattttaattaaaactcataaagttgtggacatctggttgggattgttcgccgcggcggtgattagcggatccgtgcacctag

SEQ ID NO: 58801 - DNA, 217 bp, Homo sapiens
  misc_feature 1..217: note = chr20:55500085-55500302
  misc_feature 1..217: note = hyper
  source 1..217: mol_type = genomic DNA
ttgtagtgcggggcctacgcctattagattccaatcagtttcgcctaaaaaggggaggagggcggagtgggaggggggcccagagttaaacacaggaaacaagcgttgagtgtgtgccaataaaaatggtcacaaatcagggctgctgatgtcataaccctgggggtcgggggtcagggggagtgaatgcgcctgaaagggaccgcctgtctgcggc

SEQ ID NO: 58802 - DNA, 63 bp, Homo sapiens; identical to SEQ ID NO: 38223
  misc_feature 1..63: note = chr20:55501052-55501115
  misc_feature 1..63: note = hyper
  source 1..63: mol_type = genomic DNA

SEQ ID NO: 58803 - DNA, 87 bp, Homo sapiens; identical to SEQ ID NO: 38224
  misc_feature 1..87: note = chr20:55588889-55588976
  misc_feature 1..87: note = hyper
  source 1..87: mol_type = genomic DNA

SEQ ID NO: 58804 - DNA, 56 bp, Homo sapiens; identical to SEQ ID NO: 38225
  misc_feature 1..56: note = chr20:55839612-55839668
  misc_feature 1..56: note = hyper
  source 1..56: mol_type = genomic DNA

SEQ ID NO: 58805 - DNA, 87 bp, Homo sapiens; identical to SEQ ID NO: 38226
  misc_feature 1..87: note = chr20:55839692-55839779
  misc_feature 1..87: note = hyper
  source 1..87: mol_type = genomic DNA

SEQ ID NO: 58806 - DNA, 205 bp, Homo sapiens
  misc_feature 1..205: note = chr20:55840929-55841134
  misc_feature 1..205: note = hyper
  source 1..205: mol_type = genomic DNA
catgaacatgggtgccgagttgtgcttgccctggaggtgcgggcgcgggcggtggggcaagcccaaaatggagaggatctcgcgctgcatctcccgccgctcctggctgcggaggcgccggtggatgaagctcgagtgcacctcgttgtccaggctgaagtcggccagggcggagcgcagcaggaacaggggtgcccagagcgcc

SEQ ID NO: 58807 - DNA, 245 bp, Homo sapiens
  misc_feature 1..245: note = chr20:55841356-55841601
  misc_feature 1..245: note = hyper
  source 1..245: mol_type = genomic DNA
tgctcggtgctggccccgggcccctcgccccgcactcgcccgggcgcaccgcagggcttggaaagcagccccggcgaacgaaaaggcgagtgaggaggcgggcgcgggtgggaggagcagccagcaagcctaggagtccagagagccaacgccggggaggcagcgaggaggcaggcgggcgggcgagcgctccttcttcccgctcctctggcgctctcgccctcgggcggcggcaacccaccctc

SEQ ID NO: 58808 - DNA, 41 bp, Homo sapiens
  misc_feature 1..41: note = chr20:55842055-55842096
  misc_feature 1..41: note = hyper
  source 1..41: mol_type = genomic DNA
cggtgacccttgagccggtcttgcccctcagtccctgtatc

SEQ ID NO: 58809 - DNA, 98 bp, Homo sapiens
  misc_feature 1..98: note = chr20:55842189-55842287
  misc_feature 1..98: note = hyper
  source 1..98: mol_type = genomic DNA
ccactcaccacctcccgcccccatcagacgctgctttctcctcccagagacctccaagacctgccaagctgaggttgtttcctcgcctcgcccctcgc

SEQ ID NO: 58810 - DNA, 47 bp, Homo sapiens
  misc_feature 1..47: note = chr20:56803351-56803398
  misc_feature 1..47: note = hyper
  source 1..47: mol_type = genomic DNA
cccgcacggtcatgtcgccgcggcagtttgccactcggaacatctcc

SEQ ID NO: 58811 - DNA, 401 bp, Homo sapiens; identical to SEQ ID NO: 23405
  misc_feature 1..401: note = chr20:56803441-56803842
  misc_feature 1..401: note = hyper
  source 1..401: mol_type = genomic DNA

SEQ ID NO: 58812 - DNA, 205 bp, Homo sapiens; identical to SEQ ID NO: 23406
  misc_feature 1..205: note = chr20:56803920-56804125
  misc_feature 1..205: note = hyper
  source 1..205: mol_type = genomic DNA

SEQ ID NO: 58813 - skipped

SEQ ID NO: 58814 - DNA, 42 bp, Homo sapiens
  misc_feature 1..42: note = chr20:57224800-57224842
  misc_feature 1..42: note = hyper
  source 1..42: mol_type = genomic DNA
tcctcacagtgaactcgcccagccctgctcgcggctctctcg

SEQ ID NO: 58815 - DNA, 106 bp, Homo sapiens
  misc_feature 1..106: note = chr20:57225307-57225413
  misc_feature 1..106: note = hyper
  source 1..106: mol_type = genomic DNA
ccccgacccgctccggccgcgcgctgggccaggcccttggcctcaagcctcccgggcggctccgggccggacccgggtctccgtcgcgggacgccagcctgtttgt

SEQ ID NO: 58816 - DNA, 300 bp, Homo sapiens; identical to SEQ ID NO: 38233
  misc_feature 1..300: note = chr20:57875589-57875889
  misc_feature 1..300: note = hyper
  source 1..300: mol_type = genomic DNA

SEQ ID NO: 58817 - DNA, 47 bp, Homo sapiens; identical to SEQ ID NO: 38234
  misc_feature 1..47: note = chr20:58152512-58152559
  misc_feature 1..47: note = hyper
  source 1..47: mol_type = genomic DNA

SEQ ID NO: 58818 - DNA, 238 bp, Homo sapiens; identical to SEQ ID NO: 38235
  misc_feature 1..238: note = chr20:58179141-58179379
  misc_feature 1..238: note = hyper
  source 1..238: mol_type = genomic DNA

SEQ ID NO: 58819 - DNA, 16 bp, Homo sapiens
  misc_feature 1..16: note = chr20:58179793-58179809
  misc_feature 1..16: note = hyper
  source 1..16: mol_type = genomic DNA
gaatgggaataaacac

SEQ ID NO: 58820 - DNA, 41 bp, Homo sapiens
  misc_feature 1..41: note = chr20:58179854-58179895
  misc_feature 1..41: note = hyper
  source 1..41: mol_type = genomic DNA
tgcagccggcgaggctattgtctccccgccctgaagccagc

SEQ ID NO: 58821 - DNA, 106 bp, Homo sapiens; identical to SEQ ID NO: 13893
  misc_feature 1..106: note = chr20:58180470-58180576
  misc_feature 1..106: note = hyper
  source 1..106: mol_type = genomic DNA

SEQ ID NO: 58822 - DNA, 53 bp, Homo sapiens; identical to SEQ ID NO: 38239
  misc_feature 1..53: note = chr20:58508817-58508870
  misc_feature 1..53: note = hyper
  source 1..53: mol_type = genomic DNA

SEQ ID NO: 58823 - DNA, 30 bp, Homo sapiens; identical to SEQ ID NO: 38240
  misc_feature 1..30: note = chr20:58514777-58514807
  misc_feature 1..30: note = hyper
  source 1..30: mol_type = genomic DNA

SEQ ID NO: 58824 - DNA, 94 bp, Homo sapiens; identical to SEQ ID NO: 38241
  misc_feature 1..94: note = chr20:59804316-59804410
  misc_feature 1..94: note = hyper
  source 1..94: mol_type = genomic DNA

SEQ ID NO: 58825 - DNA, 85 bp, Homo sapiens
  misc_feature 1..85: note = chr20:59826877-59826962
  misc_feature 1..85: note = hyper
  source 1..85: mol_type = genomic DNA
cacccctgagctgcccgacctgggttcaagcccgggtcaggggagttagcaaggagacacctgaaaaataaaaggacagaatgga

SEQ ID NO: 58826 - DNA, 147 bp, Homo sapiens; identical to SEQ ID NO: 13897
  misc_feature 1..147: note = chr20:59829066-59829213
  misc_feature 1..147: note = hyper
  source 1..147: mol_type = genomic DNA

SEQ ID NO: 58827 - DNA, 30 bp, Homo sapiens; identical to SEQ ID NO: 38245
  misc_feature 1..30: note = chr20:60794906-60794936
  misc_feature 1..30: note = hyper
  source 1..30: mol_type = genomic DNA

SEQ ID NO: 58828 - DNA, 451 bp, Homo sapiens; identical to SEQ ID NO: 38246
  misc_feature 1..451: note = chr20:61339658-61340109
  misc_feature 1..451: note = hyper
  source 1..451: mol_type = genomic DNA

SEQ ID NO: 58829 - DNA, 471 bp, Homo sapiens
  misc_feature 1..471: note = chr20:61340110-61340581
  misc_feature 1..471: note = hyper
  source 1..471: mol_type = genomic DNA
gagagcgcgagggaggagattctgagcgagggaggggagcgcgcccgggcagcagtgcgtgcgctcctcccggcgccacaagctcgccccgcgcagcccgagccgggctgggcgctgtcctcgggggcctggggaaccgcgcggtttggagatcggaggcacctggaacccgtggcaagcgccgagccgggagacagcccgaggaaccacgggttctggagctaggagccggaagctgggagtccggaggagagcggagcccggagcccggagcccggggcggcgcgtctgggtctggcgcttcccgactggacggcgcgcccgctggtcttcgccacgcgccctcccctgggctcccgttcatcggtccccgcctgagacgcgcccactcctgcccggacttccagccccggaggcgccggacagagccgcggactccagcgcccaccatgcgcctcaacagctccgcgc

SEQ ID NO: 58830 - DNA, 79 bp, Homo sapiens; identical to SEQ ID NO: 13900
  misc_feature 1..79: note = chr20:61447684-61447763
  misc_feature 1..79: note = hyper
  source 1..79: mol_type = genomic DNA

SEQ ID NO: 58831 - DNA, 30 bp, Homo sapiens; identical to SEQ ID NO: 38249
  misc_feature 1..30: note = chr20:61448109-61448139
  misc_feature 1..30: note = hyper
  source 1..30: mol_type = genomic DNA

SEQ ID NO: 58832 - DNA, 96 bp, Homo sapiens
  misc_feature 1..96: note = chr20:61560322-61560418
  misc_feature 1..96: note = hyper
  source 1..96: mol_type = genomic DNA
aaaaaaatggctttccgctgttataagcctccttcctaagactcagggtccgcagcagaataccctgacccaaaataaaaatactatgacaaaaat

SEQ ID NO: 58833 - DNA, 33 bp, Homo sapiens
  misc_feature 1..33: note = chr20:61560922-61560955
  misc_feature 1..33: note = hyper
  source 1..33: mol_type = genomic DNA
cctcagtgcccggcgcgccgggggctgtatcgc

SEQ ID NO: 58834 - DNA, 375 bp, Homo sapiens; identical to SEQ ID NO: 38252
  misc_feature 1..375: note = chr20:61585299-61585674
  misc_feature 1..375: note = hyper
  source 1..375: mol_type = genomic DNA

SEQ ID NO: 58835 - DNA, 30 bp, Homo sapiens; identical to SEQ ID NO: 38253
  misc_feature 1..30: note = chr20:61636897-61636927
  misc_feature 1..30: note = hyper
  source 1..30: mol_type = genomic DNA

SEQ ID NO: 58836 - DNA, 187 bp, Homo sapiens; identical to SEQ ID NO: 23418
  misc_feature 1..187: note = chr20:61637281-61637468
  misc_feature 1..187: note = hyper
  source 1..187: mol_type = genomic DNA

SEQ ID NO: 58837 - DNA, 167 bp, Homo sapiens
  misc_feature 1..167: note = chr20:61638631-61638798
  misc_feature 1..167: note = hyper
  source 1..167: mol_type = genomic DNA
ccctagcgcaagagtccctggcgacacgcaggggccagagcgggggggcgcgccgcaatagcagcagcgccagcgccaacaccctgtcccgctgaggggccgcttcgggtcggggtcagggtcgtgggcgctctggtgcagccgcggcgcagcgtgtacccggagcc

SEQ ID NO: 58838 - DNA, 48 bp, Homo sapiens; identical to SEQ ID NO: 38258
  misc_feature 1..48: note = chr20:61639020-61639068
  misc_feature 1..48: note = hyper
  source 1..48: mol_type = genomic DNA

SEQ ID NO: 58839 - DNA, 77 bp, Homo sapiens; identical to SEQ ID NO: 38259
  misc_feature 1..77: note = chr20:61664493-61664570
  misc_feature 1..77: note = hyper
  source 1..77: mol_type = genomic DNA

SEQ ID NO: 58840 - DNA, 27 bp, Homo sapiens
  misc_feature 1..27: note = chr20:61703439-61703466
  misc_feature 1..27: note = hyper
  source 1..27: mol_type = genomic DNA
gcgcctctgaccctccgctccgggctc

SEQ ID NO: 58841 - DNA, 160 bp, Homo sapiens; identical to SEQ ID NO: 23420
  misc_feature 1..160: note = chr20:61703875-61704035
  misc_feature 1..160: note = hyper
  source 1..160: mol_type = genomic DNA

SEQ ID NO: 58842 - DNA, 180 bp, Homo sapiens; identical to SEQ ID NO: 13910
  misc_feature 1..180: note = chr20:61733260-61733440
  misc_feature 1..180: note = hyper
  source 1..180: mol_type = genomic DNA

SEQ ID NO: 58843 - DNA, 394 bp, Homo sapiens; identical to SEQ ID NO: 38264
  misc_feature 1..394: note = chr20:61733694-61734088
  misc_feature 1..394: note = hyper
  source 1..394: mol_type = genomic DNA

SEQ ID NO: 58844 - DNA, 65 bp, Homo sapiens; identical to SEQ ID NO: 38265
  misc_feature 1..65: note = chr20:61734101-61734166
  misc_feature 1..65: note = hyper
  source 1..65: mol_type = genomic DNA

SEQ ID NO: 58845 - DNA, 20 bp, Homo sapiens
  misc_feature 1..20: note = chr20:61734481-61734501
  misc_feature 1..20: note = hyper
  source 1..20: mol_type = genomic DNA
gctgccgcttctgatggagg

SEQ ID NO: 58846 - DNA, 97 bp, Homo sapiens
  misc_feature 1..97: note = chr20:61747797-61747894
  misc_feature 1..97: note = hyper
  source 1..97: mol_type = genomic DNA
aagttccctggagttcgttgcagtggaatccatggcccaggtgagcacagctgcagggagctgcgcggggggagccgcagagctgggcacttgcgaa

SEQ ID NO: 58847 - DNA, 71 bp, Homo sapiens
  misc_feature 1..71: note = chr20:61747934-61748005
  misc_feature 1..71: note = hyper
  source 1..71: mol_type = genomic DNA
cggagggcggggtgcggagatgccgttcagaacctcggacagcgccgcggcccatccggccagccagaagc

SEQ ID NO: 58848 - DNA, 418 bp, Homo sapiens; identical to SEQ ID NO: 38268
  misc_feature 1..418: note = chr20:61806420-61806838
  misc_feature 1..418: note = hyper
  source 1..418: mol_type = genomic DNA

SEQ ID NO: 58849 - DNA, 334 bp, Homo sapiens; identical to SEQ ID NO: 38269
  misc_feature 1..334: note = chr20:61807183-61807517
  misc_feature 1..334: note = hyper
  source 1..334: mol_type = genomic DNA

SEQ ID NO: 58850 - DNA, 143 bp, Homo sapiens; identical to SEQ ID NO: 38270
  misc_feature 1..143: note = chr20:61807775-61807918
  misc_feature 1..143: note = hyper
  source 1..143: mol_type = genomic DNA

SEQ ID NO: 58851 - DNA, 23 bp, Homo sapiens
  misc_feature 1..23: note = chr20:61808158-61808181
  misc_feature 1..23: note = hyper
  source 1..23: mol_type = genomic DNA
cctagagggccagatcgggggcg

SEQ ID NO: 58852 - DNA, 111 bp, Homo sapiens; identical to SEQ ID NO: 23426
  misc_feature 1..111: note = chr20:61808270-61808381
  misc_feature 1..111: note = hyper
  source 1..111: mol_type = genomic DNA

SEQ ID NO: 58853 - DNA, 46 bp, Homo sapiens; identical to SEQ ID NO: 23427
  misc_feature 1..46: note = chr20:61810089-61810135
  misc_feature 1..46: note = hyper
  source 1..46: mol_type = genomic DNA

SEQ ID NO: 58854 - skipped

SEQ ID NO: 58855 - DNA, 25 bp, Homo sapiens
  misc_feature 1..25: note = chr20:61862355-61862380
  misc_feature 1..25: note = hyper
  source 1..25: mol_type = genomic DNA
agtgtgctcttctgccggcgtgctc

SEQ ID NO: 58856 - DNA, 25 bp, Homo sapiens
  misc_feature 1..25: note = chr20:61862452-61862477
  misc_feature 1..25: note = hyper
  source 1..25: mol_type = genomic DNA
ggtgcctgcccgctaggtctcaggg

SEQ ID NO: 58857 - DNA, 412 bp, Homo sapiens; identical to SEQ ID NO: 38279
  misc_feature 1..412: note = chr20:61884691-61885103
  misc_feature 1..412: note = hyper
  source 1..412: mol_type = genomic DNA

SEQ ID NO: 58858 - DNA, 52 bp, Homo sapiens
  misc_feature 1..52: note = chr20:61885195-61885247
  misc_feature 1..52: note = hyper
  source 1..52: mol_type = genomic DNA
cgggggcgggcggggccggtttgctcgcgggtgggcaggacgttctcacccc

SEQ ID NO: 58859 - DNA, 89 bp, Homo sapiens
  misc_feature 1..89: note = chr20:61885462-61885551
  misc_feature 1..89: note = hyper
  source 1..89: mol_type = genomic DNA
ggccagcccatccagccgctgccccgcacctgtccccgccgctccggacccgcggccgccccccgcgcacgcacaccggggacgggacc

SEQ ID NO: 58860 - DNA, 208 bp, Homo sapiens
  misc_feature 1..208: note = chr20:61885860-61886068
  misc_feature 1..208: note = hyper
  source 1..208: mol_type = genomic DNA
cgcccgctccccacgcgccgcagcctggaccccgccccctccgcatcccgttcccccctcctccccgcaacccccggcccagccccagccccgggtaacagctgcgctgcgtctcccctcccacccccgcctgcggcccctgggggcttcgcgccggccggagagggggaccgttcttaaaggggcgatggcgcggcctctcgggtag

SEQ ID NO: 58861 - DNA, 18 bp, Homo sapiens
  misc_feature 1..18: note = chr20:61886258-61886276
  misc_feature 1..18: note = hyper
  source 1..18: mol_type = genomic DNA
aggcgttttctctgagag

SEQ ID NO: 58862 - DNA, 167 bp, Homo sapiens; identical to SEQ ID NO: 38285
  misc_feature 1..167: note = chr20:62102801-62102968
  misc_feature 1..167: note = hyper
  source 1..167: mol_type = genomic DNA

SEQ ID NO: 58863 - DNA, 325 bp, Homo sapiens; identical to SEQ ID NO: 38286
  misc_feature 1..325: note = chr20:62103301-62103626
  misc_feature 1..325: note = hyper
  source 1..325: mol_type = genomic DNA

SEQ ID NO: 58864 - DNA, 180 bp, Homo sapiens; identical to SEQ ID NO: 38287
  misc_feature 1..180: note = chr20:62103667-62103847
  misc_feature 1..180: note = hyper
  source 1..180: mol_type = genomic DNA

SEQ ID NO: 58865 - DNA, 34 bp, Homo sapiens; identical to SEQ ID NO: 38290
  misc_feature 1..34: note = chr20:62283802-62283836
  misc_feature 1..34: note = hyper
  source 1..34: mol_type = genomic DNA

SEQ ID NO: 58866 - DNA, 191 bp, Homo sapiens; identical to SEQ ID NO: 38291
  misc_feature 1..191: note = chr20:62369082-62369273
  misc_feature 1..191: note = hyper
  source 1..191: mol_type = genomic DNA

SEQ ID NO: 58867 - DNA, 164 bp, Homo sapiens
  misc_feature 1..164: note = chr20:62461475-62461639
  misc_feature 1..164: note = hyper
  source 1..164: mol_type = genomic DNA
tccgttcttcgccccatctggtctgtaccctggctcctcggtccagccctattgtgtgtgcttcgttaaacctacaaacagtgaatctgtcagcggggccaggggaaccccaactagcaggagccctccctctggcgcagagaattccccgtttgccttaggga

SEQ ID NO: 58868 - DNA, 50 bp, Homo sapiens; identical to SEQ ID NO: 38293
  misc_feature 1..50: note = chr20:62463147-62463197
  misc_feature 1..50: note = hyper
  source 1..50: mol_type = genomic DNA

SEQ ID NO: 58869 - DNA, 130 bp, Homo sapiens; identical to SEQ ID NO: 38294
  misc_feature 1..130: note = chr20:62463622-62463752
  misc_feature 1..130: note = hyper
  source 1..130: mol_type = genomic DNA

SEQ ID NO: 58870 - DNA, 87 bp, Homo sapiens; identical to SEQ ID NO: 38295
  misc_feature 1..87: note = chr20:62600722-62600809
  misc_feature 1..87: note = hyper
  source 1..87: mol_type = genomic DNA

SEQ ID NO: 58871 - DNA, 82 bp, Homo sapiens; identical to SEQ ID NO: 38296
  misc_feature 1..82: note = chr20:62673837-62673919
  misc_feature 1..82: note = hyper
  source 1..82: mol_type = genomic DNA

SEQ ID NO: 58872 - DNA, 15 bp, Homo sapiens
  misc_feature 1..15: note = chr20:62680421-62680436
  misc_feature 1..15: note = hyper
  source 1..15: mol_type = genomic DNA
cgcggcccgggaccc

SEQ ID NO: 58873 - DNA, 41 bp, Homo sapiens; identical to SEQ ID NO: 38298
  misc_feature 1..41: note = chr20:62714767-62714808
  misc_feature 1..41: note = hyper
  source 1..41: mol_type = genomic DNA

SEQ ID NO: 58874 - DNA, 274 bp, Homo sapiens; identical to SEQ ID NO: 38299
  misc_feature 1..274: note = chr20:62715272-62715546
  misc_feature 1..274: note = hyper
  source 1..274: mol_type = genomic DNA

SEQ ID NO: 58875 - DNA, 749 bp, Homo sapiens; identical to SEQ ID NO: 38300
  misc_feature 1..749: note = chr20:62733381-62734130
  misc_feature 1..749: note = hyper
  source 1..749: mol_type = genomic DNA

SEQ ID NO: 58876 - DNA, 132 bp, Homo sapiens; identical to SEQ ID NO: 38301
  misc_feature 1..132: note = chr20:62734172-62734304
  misc_feature 1..132: note = hyper
  source 1..132: mol_type = genomic DNA

SEQ ID NO: 58877 - DNA, 30 bp, Homo sapiens; identical to SEQ ID NO: 38302
  misc_feature 1..30: note = chr20:62793356-62793386
  misc_feature 1..30: note = hyper
  source 1..30: mol_type = genomic DNA

SEQ ID NO: 58878 - DNA, 101 bp, Homo sapiens; identical to SEQ ID NO: 13928
  misc_feature 1..101: note = chr20:62947884-62947985
  misc_feature 1..101: note = hyper
  source 1..101: mol_type = genomic DNA

SEQ ID NO: 58879 - DNA, 315 bp, Homo sapiens; identical to SEQ ID NO: 38304
  misc_feature 1..315: note = chr20:62948007-62948322
  misc_feature 1..315: note = hyper
  source 1..315: mol_type = genomic DNA

SEQ ID NO: 58880 - DNA, 291 bp, Homo sapiens; identical to SEQ ID NO: 38305
  misc_feature 1..291: note = chr21:15588524-15588815
  misc_feature 1..291: note = hyper
  source 1..291: mol_type = genomic DNA

SEQ ID NO: 58881 - DNA, 152 bp, Homo sapiens; identical to SEQ ID NO: 38306
  misc_feature 1..152: note = chr21:16438562-16438714
  misc_feature 1..152: note = hyper
  source 1..152: mol_type = genomic DNA

SEQ ID NO: 58882 - DNA, 61 bp, Homo sapiens; identical to SEQ ID NO: 38307
  misc_feature 1..61: note = chr21:18985496-18985557
  misc_feature 1..61: note = hyper
  source 1..61: mol_type = genomic DNA

SEQ ID NO: 58883 - DNA, 30 bp, Homo sapiens; identical to SEQ ID NO: 38308
  misc_feature 1..30: note = chr21:19617785-19617815
  misc_feature 1..30: note = hyper
  source 1..30: mol_type = genomic DNA

SEQ ID NO: 58884 - DNA, 53 bp, Homo sapiens; identical to SEQ ID NO: 38309
  misc_feature 1..53: note = chr21:22370172-22370225
  misc_feature 1..53: note = hyper
  source 1..53: mol_type = genomic DNA

SEQ ID NO: 58885 - DNA, 96 bp, Homo sapiens
  misc_feature 1..96: note = chr21:22370236-22370332
  misc_feature 1..96: note = hyper
  source 1..96: mol_type = genomic DNA
cggtcgcctgcagtatcagtatcagcatcagcatcagcatcagcatctgcatgagcatcagctcagctcagctcagctcagcatcagctcagctgt

SEQ ID NO: 58886 - DNA, 18 bp, Homo sapiens
  misc_feature 1..18: note = chr21:22370458-22370476
  misc_feature 1..18: note = hyper
  source 1..18: mol_type = genomic DNA
ccctctaggcggaggcac

SEQ ID NO: 58887 - DNA, 136 bp, Homo sapiens
  misc_feature 1..136: note = chr21:22370552-22370688
  misc_feature 1..136: note = hyper
  source 1..136: mol_type = genomic DNA
cgtgcagcgcggagggatacgcctcggccgcacctcccctcgccgcgcccccgcccccgccgccctccccgcccggctctgctgccgccgcggcggccgctgctgctgctgcttctgccgccgctgccgccgccgc

SEQ ID NO: 58888-58889 - skipped (2 entries)

SEQ ID NO: 58890 - DNA, 15 bp, Homo sapiens
  misc_feature 1..15: note = chr21:26934786-26934801
  misc_feature 1..15: note = hyper
  source 1..15: mol_type = genomic DNA
cgctggatggattcc

SEQ ID NO: 58891 - DNA, 30 bp, Homo sapiens; identical to SEQ ID NO: 38314
  misc_feature 1..30: note = chr21:27011446-27011476
  misc_feature 1..30: note = hyper
  source 1..30: mol_type = genomic DNA

SEQ ID NO: 58892 - DNA, 52 bp, Homo sapiens; identical to SEQ ID NO: 38315
  misc_feature 1..52: note = chr21:27012069-27012121
  misc_feature 1..52: note = hyper
  source 1..52: mol_type = genomic DNA

SEQ ID NO: 58893 - DNA, 28 bp, Homo sapiens
  misc_feature 1..28: note = chr21:27012148-27012176
  misc_feature 1..28: note = hyper
  source 1..28: mol_type = genomic DNA
cgccaccgcctcctcctgctgctgctgc

SEQ ID NO: 58894 - DNA, 196 bp, Homo sapiens
  misc_feature 1..196: note = chr21:27012177-27012373
  misc_feature 1..196: note = hyper
  source 1..196: mol_type = genomic DNA
ctacctggtggtcgccctgggctgtaagttgctcgggttcctctacccttcctgcctggaccagcctgcccccaccctccagccccccacggggcgctggctgacagtgtctgggcggctctgggccgaggtcgccgcggggcgtctgaccttgcgcccaggcgagcgggaaacccagggtgcccgcgagcggacg

SEQ ID NO: 58895 - DNA, 294 bp, Homo sapiens
  misc_feature 1..294: note = chr21:27012431-27012725
  misc_feature 1..294: note = hyper
  source 1..294: mol_type = genomic DNA
gttctagatacagaaaattaagggttcccactagcaggttctcatctgtttgcaaagttggggtaagttttcagacagagggacgtgattcgaatgcaaaactcactacccactggtaagatgctaagaccccaagaaagatggcatcactgggaggcgggcgccggccacactttgagtccccggggagggggcagcgtccgcgtggtctgggctctgtagcgtcccagctgagccggcgatatgcagcgcacttgtggggcggaggtggagggaattcgtggctgctgagcc

SEQ ID NO: 58896 - DNA, 82 bp, Homo sapiens; identical to SEQ ID NO: 23440
  misc_feature 1..82: note = chr21:27944913-27944995
  misc_feature 1..82: note = hyper
  source 1..82: mol_type = genomic DNA

SEQ ID NO: 58897 - DNA, 67 bp, Homo sapiens; identical to SEQ ID NO: 23441
  misc_feature 1..67: note = chr21:27945081-27945148
  misc_feature 1..67: note = hyper
  source 1..67: mol_type = genomic DNA

SEQ ID NO: 58898 - DNA, 26 bp, Homo sapiens
  misc_feature 1..26: note = chr21:27945604-27945630
  misc_feature 1..26: note = hyper
  source 1..26: mol_type = genomic DNA
cgggcagggggcgggggtggccccga

SEQ ID NO: 58899 - DNA, 243 bp, Homo sapiens
  misc_feature 1..243: note = chr21:28217690-28217933
  misc_feature 1..243: note = hyper
  source 1..243: mol_type = genomic DNA
caatagcccctggctcggagccgctttccagcgagtgcaagaaccgggcagccgagcggtccttttatagtggaccagtgaaacccccacccccaccccactcctcccctttggcccttttccatcccaaagacgccgcccccggctccgttggtgctaaaccgcgctccgcgctgcgggctcgggagggggagggggcagcctccgcgctggctccacgccactgctcgtcaatctaggggc

SEQ ID NO: 58900 - DNA, 81 bp, Homo sapiens; identical to SEQ ID NO: 13938
  misc_feature 1..81: note = chr21:28218267-28218348
  misc_feature 1..81: note = hyper
  source 1..81: mol_type = genomic DNA

SEQ ID NO: 58901 - DNA, 99 bp, Homo sapiens; identical to SEQ ID NO: 38322
  misc_feature 1..99: note = chr21:28218619-28218718
  misc_feature 1..99: note = hyper
  source 1..99: mol_type = genomic DNA

SEQ ID NO: 58902 - DNA, 87 bp, Homo sapiens
  misc_feature 1..87: note = chr21:28219045-28219132
  misc_feature 1..87: note = hyper
  source 1..87: mol_type = genomic DNA
ctccaagtagatctgggtcctttcctcgctcctccccagatcttccccacttcagttggccccagccagaagcgtcccttctagttc

SEQ ID NO: 58903 - DNA, 44 bp, Homo sapiens; identical to SEQ ID NO: 38324
  misc_feature 1..44: note = chr21:28338515-28338559
  misc_feature 1..44: note = hyper
  source 1..44: mol_type = genomic DNA

SEQ ID NO: 58904 - skipped

SEQ ID NO: 58905 - DNA, 16 bp, Homo sapiens
  misc_feature 1..16: note = chr21:28339876-28339892
  misc_feature 1..16: note = hyper
  source 1..16: mol_type = genomic DNA
tcccctttgcacaccc

SEQ ID NO: 58906 - DNA, 30 bp, Homo sapiens; identical to SEQ ID NO: 23444
  misc_feature 1..30: note = chr21:28340318-28340348
  misc_feature 1..30: note = hyper
  source 1..30: mol_type = genomic DNA

SEQ ID NO: 58907 - DNA, 81 bp, Homo sapiens; identical to SEQ ID NO: 23445
  misc_feature 1..81: note = chr21:31311553-31311634
  misc_feature 1..81: note = hyper
  source 1..81: mol_type = genomic DNA

SEQ ID NO: 58908 - DNA, 220 bp, Homo sapiens; identical to SEQ ID NO: 38330
  misc_feature 1..220: note = chr21:31311700-31311920
  misc_feature 1..220: note = hyper
  source 1..220: mol_type = genomic DNA

SEQ ID NO: 58909 - DNA, 76 bp, Homo sapiens; identical to SEQ ID NO: 23446
  misc_feature 1..76: note = chr21:31312105-31312181
  misc_feature 1..76: note = hyper
  source 1..76: mol_type = genomic DNA

SEQ ID NO: 58910 - DNA, 207 bp, Homo sapiens; identical to SEQ ID NO: 13945
  misc_feature 1..207: note = chr21:32716260-32716467
  misc_feature 1..207: note = hyper
  source 1..207: mol_type = genomic DNA

SEQ ID NO: 58911 - DNA, 152 bp, Homo sapiens; identical to SEQ ID NO: 38334
  misc_feature 1..152: note = chr21:33245337-33245489
  misc_feature 1..152: note = hyper
  source 1..152: mol_type = genomic DNA

SEQ ID NO: 58912 - DNA, 30 bp, Homo sapiens; identical to SEQ ID NO: 38335
  misc_feature 1..30: note = chr21:34392013-34392043
  misc_feature 1..30: note = hyper
  source 1..30: mol_type = genomic DNA

SEQ ID NO: 58913 - DNA, 508 bp, Homo sapiens; identical to SEQ ID NO: 23448
  misc_feature 1..508: note = chr21:34392566-34393074
  misc_feature 1..508: note = hyper
  source 1..508: mol_type = genomic DNA

SEQ ID NO: 58914 - DNA, 498 bp, Homo sapiens
  misc_feature 1..498: note = chr21:34396269-34396767
  misc_feature 1..498: note = hyper
  source 1..498: mol_type = genomic DNA
ccccacccccccgctccctgcgtcgtccgagtgacagattctactaattgaacggttatgggtcatccttgtaaccgttggacgacataacaccacgcttcagttcttcatgttttaaatacatatttaacggatggctgcagagccagctgggaaacacgcggattgaaaaataatgctccagaaggcacgagactggggcgaaggcgagagcgggctgggcttctagcggagaccgcagagggagacatatctcagaactaggggcaataacgtgggtttctctttgtatttgtttattttgtaactttgctacttgaagaccaattatttactatgctaatttgtttgcttgtttttaaaaccgtacttgcacagtaaaagttccccaacaacggaagtaacccgacgttcctcacactccctaggagactgtgtgcgtgtgtgcccgcgcgtgcgctcacagtgtcaagtgctagcatccgagatctgcagaaa

SEQ ID NO: 58915 - DNA, 291 bp, Homo sapiens; identical to SEQ ID NO: 38339
  misc_feature 1..291: note = chr21:34397481-34397772
  misc_feature 1..291: note = hyper
  source 1..291: mol_type = genomic DNA

SEQ ID NO: 58916 - DNA, 80 bp, Homo sapiens; identical to SEQ ID NO: 23451
  misc_feature 1..80: note = chr21:34397990-34398070
  misc_feature 1..80: note = hyper
  source 1..80: mol_type = genomic DNA

SEQ ID NO: 58917 - DNA, 229 bp, Homo sapiens
  misc_feature 1..229: note = chr21:34398634-34398863
  misc_feature 1..229: note = hyper
  source 1..229: mol_type = genomic DNA
gtgcgtgtgcgtgtgtttgctgcgtggtgtcgatggagataaggtggatccgtttgaggaaccaaatcattagttctctatctagatctccattctccccaaagaaaggccctcacttcccactcgtttattccagcccgggggctcagttttcccacacctaactgaaagcccgaagcctctagaatgccacccgcaccccgagggtcaccaacgctccctgaaataa

SEQ ID NO: 58918 - DNA, 41 bp, Homo sapiens
  misc_feature 1..41: note = chr21:34401144-34401185
  misc_feature 1..41: note = hyper
  source 1..41: mol_type = genomic DNA
atgatgaggtaagtgcgcaatgctaagctgtttgctcacgt

SEQ ID NO: 58919 - DNA, 79 bp, Homo sapiens
  misc_feature 1..79: note = chr21:34401392-34401471
  misc_feature 1..79: note = hyper
  source 1..79: mol_type = genomic DNA
atctgttttatttttgtaaaaacaaagtgctaaataatatttattacttgtttggttgcaaaaacggaataaatgactg

SEQ ID NO: 58920 - DNA, 90 bp, Homo sapiens; identical to SEQ ID NO: 38348
  misc_feature 1..90: note = chr21:34442167-34442257
  misc_feature 1..90: note = hyper
  source 1..90: mol_type = genomic DNA

SEQ ID NO: 58921 - skipped

SEQ ID NO: 58922 - DNA, 373 bp, Homo sapiens
  misc_feature 1..373: note = chr21:34442730-34443103
  misc_feature 1..373: note = hyper
  source 1..373: mol_type = genomic DNA
cgacggcccccctcctccccaaggctgcgcgcgagaagccggaggcgccggccgagcctccaggccccgggcccgggtcaggcgcgcacccgggcggcagcgcccggccggacgccaaggaggagcagcagcagcagctgcggcgcaagatcaacagccgcgagcggaagcgcatgcaggacctgaacctggccatggacgccctgcgcgaggtcatcctgccctactcagcggcgcactgccagggcgcgcccggccgcaagctctccaagatagccacgctgctgctcgcccgcaactacatcctactgctgggcagctcgctgcaggagctgcgccgcgcgctgggcgagggcgccgggcccgccgcgcc

SEQ ID NO: 58923 - DNA, 247 bp, Homo sapiens; identical to SEQ ID NO: 23455
  misc_feature 1..247: note = chr21:34443262-34443509
  misc_feature 1..247: note = hyper
  source 1..247: mol_type = genomic DNA

SEQ ID NO: 58924 - DNA, 207 bp, Homo sapiens
  misc_feature 1..207: note = chr21:34443956-34444163
  misc_feature 1..207: note = hyper
  source 1..207: mol_type = genomic DNA
gggacgtggcagacggacggaccctcggcggacaggtggtcggcgtcggggtgcggtgggtaggggcgaggacaacgcagggtgcgctgggttgggacgtgggtccacttttgtagaccagctgtttggagagctgtatttaagactcgcgtatccagtgttttgtcgcagagagttttcgctcttaaatcctgggggtttcttaga

SEQ ID NO: 58925 - DNA, 326 bp, Homo sapiens; identical to SEQ ID NO: 38353
  misc_feature 1..326: note = chr21:34481940-34482266
  misc_feature 1..326: note = hyper
  source 1..326: mol_type = genomic DNA

SEQ ID NO: 58926 - DNA, 30 bp, Homo sapiens; identical to SEQ ID NO: 38354
  misc_feature 1..30: note = chr21:34499655-34499685
  misc_feature 1..30: note = hyper
  source 1..30: mol_type = genomic DNA

SEQ ID NO: 58927 - DNA, 148 bp, Homo sapiens; identical to SEQ ID NO: 38355
  misc_feature 1..148: note = chr21:35574488-35574636
  misc_feature 1..148: note = hyper
  source 1..148: mol_type = genomic DNA

SEQ ID NO: 58928 - DNA, 52 bp, Homo sapiens; identical to SEQ ID NO: 23457
  misc_feature 1..52: note = chr21:36041933-36041985
  misc_feature 1..52: note = hyper
  source 1..52: mol_type = genomic DNA

SEQ ID NO: 58929 - DNA, 420 bp, Homo sapiens
  misc_feature 1..420: note = chr21:36042238-36042658
  misc_feature 1..420: note = hyper
  source 1..420: mol_type = genomic DNA
ccgggtgggggacagcgtagacgcggaaggtccggcgggggacagcgtagacgcggagggcccgctgggggacaacatacaagccgagggcccggcgggggacagcgtagacgcggagggccgggtgggggacagcgtagacgcggaaggtccggcgggggacagcgtagacgcggagggccgggtgggggacagcgtagaggcgggggacccggcgggggacggcgtagaagcgggggtcccggcgggggacagcgtagaagccgaaggcccggcgggggacagcatggacgccgagggtccggcaggaagggcgcgccgggtctcgggtgagccgcagcaatcgggggacggcagcctctcgccccaggccgaggcaattgaggtcgcagccggggagagtgcggggcgcagccccgg

SEQ ID NO: 58930 - DNA, 293 bp, Homo sapiens; identical to SEQ ID NO: 23460
  misc_feature 1..293: note = chr21:36042861-36043154
  misc_feature 1..293: note = hyper
  source 1..293: mol_type = genomic DNA

SEQ ID NO: 58931 - DNA, 51 bp, Homo sapiens; identical to SEQ ID NO: 38359
  misc_feature 1..51: note = chr21:38063644-38063695
  misc_feature 1..51: note = hyper
  source 1..51: mol_type = genomic DNA

SEQ ID NO: 58932 - DNA, 156 bp, Homo sapiens; identical to SEQ ID NO: 23461
  misc_feature 1..156: note = chr21:38065799-38065955
  misc_feature 1..156: note = hyper
  source 1..156: mol_type = genomic DNA

SEQ ID NO: 58933 - DNA, 112 bp, Homo sapiens; identical to SEQ ID NO: 38362
  misc_feature 1..112: note = chr21:38066820-38066932
  misc_feature 1..112: note = hyper
  source 1..112: mol_type = genomic DNA

SEQ ID NO: 58934 - DNA, 30 bp, Homo sapiens; identical to SEQ ID NO: 38363
  misc_feature 1..30: note = chr21:38067379-38067409
  misc_feature 1..30: note = hyper
  source 1..30: mol_type = genomic DNA

SEQ ID NO: 58935 - DNA, 30 bp, Homo sapiens; identical to SEQ ID NO: 38364
  misc_feature 1..30: note = chr21:38067871-38067901
  misc_feature 1..30: note = hyper
  source 1..30: mol_type = genomic DNA

SEQ ID NO: 58936 - DNA, 256 bp, Homo sapiens; identical to SEQ ID NO: 23463
  misc_feature 1..256: note = chr21:38069203-38069459
  misc_feature 1..256: note = hyper
  source 1..256: mol_type = genomic DNA

SEQ ID NO: 58937 - DNA, 97 bp, Homo sapiens
  misc_feature 1..97: note = chr21:38069496-38069593
  misc_feature 1..97: note = hyper
  source 1..97: mol_type = genomic DNA
cgcattaaatcctcccgaagcccaggaggtgccagagcgggctcagggggccgcctgcggaagctgcggcaggggctgggtccgtagcctctaaccc

SEQ ID NO: 58938 - DNA, 13 bp, Homo sapiens
  misc_feature 1..13: note = chr21:38069793-38069806
  misc_feature 1..13: note = hyper
  source 1..13: mol_type = genomic DNA
tgtgcgtccggct

SEQ ID NO: 58939 - DNA, 133 bp, Homo sapiens
  misc_feature 1..133: note = chr21:38070572-38070705
  misc_feature 1..133: note = hyper
  source 1..133: mol_type = genomic DNA
catgggccccacctgcgccacctgcgcccaccctgtgaccctggctcagcgaccttggcccttaatcgcccaacgccgattcctcaaaattccggctgcgctgaatcgggctgcttttgccgccgccccggca

SEQ ID NO: 58940 - DNA, 376 bp, Homo sapiens; identical to SEQ ID NO: 38371
  misc_feature 1..376: note = chr21:38072027-38072403
  misc_feature 1..376: note = hyper
  source 1..376: mol_type = genomic DNA

SEQ ID NO: 58941 - DNA, 102 bp, Homo sapiens
  misc_feature 1..102: note = chr21:38072905-38073007
  misc_feature 1..102: note = hyper
  source 1..102: mol_type = genomic DNA
agggtcagcttcaggcgctgcgagtcagcggggatcacggtgaggcccaagcactgcaggctgaggccacagagcgaacacttgtgctgagccgggccctct

SEQ ID NO: 58942 - DNA, 100 bp, Homo sapiens; identical to SEQ ID NO: 23468
  misc_feature 1..100: note = chr21:38073070-38073170
  misc_feature 1..100: note = hyper
  source 1..100: mol_type = genomic DNA

SEQ ID NO: 58943 - DNA, 61 bp, Homo sapiens; identical to SEQ ID NO: 23469
  misc_feature 1..61: note = chr21:38073239-38073300
  misc_feature 1..61: note = hyper
  source 1..61: mol_type = genomic DNA

SEQ ID NO: 58944 - DNA, 30 bp, Homo sapiens; identical to SEQ ID NO: 38375
  misc_feature 1..30: note = chr21:38075927-38075957
  misc_feature 1..30: note = hyper
  source 1..30: mol_type = genomic DNA

SEQ ID NO: 58945 - DNA, 35 bp, Homo sapiens; identical to SEQ ID NO: 13975
  misc_feature 1..35: note = chr21:38076386-38076421
  misc_feature 1..35: note = hyper
  source 1..35: mol_type = genomic DNA

SEQ ID NO: 58946 - DNA, 25 bp, Homo sapiens
  misc_feature 1..25: note = chr21:38077206-38077231
  misc_feature 1..25: note = hyper
  source 1..25: mol_type = genomic DNA
ggggagaacacgagggctccgacgc

SEQ ID NO: 58947 - DNA, 15 bp, Homo sapiens
  misc_feature 1..15: note = chr21:38077617-38077632
  misc_feature 1..15: note = hyper
  source 1..15: mol_type = genomic DNA
cgaagtggtttgcaa

SEQ ID NO: 58948 - DNA, 35 bp, Homo sapiens; identical to SEQ ID NO: 38380
  misc_feature 1..35: note = chr21:38078760-38078795
  misc_feature 1..35: note = hyper
  source 1..35: mol_type = genomic DNA

SEQ ID NO: 58949 - DNA, 80 bp, Homo sapiens
  misc_feature 1..80: note = chr21:38079908-38079988
  misc_feature 1..80: note = hyper
  source 1..80: mol_type = genomic DNA
taggtttttagttgccgaatagggaagggtttgcgaagccgctgccctgggccgaggtgcattttacgcttccagaggtc

SEQ ID NO: 58950 - DNA, 59 bp, Homo sapiens
  misc_feature 1..59: note = chr21:38080684-38080743
  misc_feature 1..59: note = hyper
  source 1..59: mol_type = genomic DNA
tagcttttgcggaggtggtgaagaagggcaggaggcctgttgagcggaggagtccgggg

SEQ ID NO: 58951 - DNA, 60 bp, Homo sapiens
  misc_feature 1..60: note = chr21:38081835-38081895
  misc_feature 1..60: note = hyper
  source 1..60: mol_type = genomic DNA
gtcaagtgctttccaatctcacttccctcagcaggttccacccagcgcttgctctgtgcc

SEQ ID NO: 58952 - DNA, 246 bp, Homo sapiens
  misc_feature 1..246: note = chr21:38082684-38082930
  misc_feature 1..246: note = hyper
  source 1..246: mol_type = genomic DNA
cgggtcggccgggtagccctgagcacagctcgccacttccaggtgggctgttggcgctggctggggacacatcccgatctttcaaatgccctttacagagcctcatcaacgacccgattcattcccccctcctgtcatttgtctctgccatcgaaaaatgcctaccgagagctgctctgcatttccgccctctattttgtgttttactttaaaataataataaaaaaaatgttggctgcaggacgc

SEQ ID NO: 58953 - DNA, 150 bp, Homo sapiens; identical to SEQ ID NO: 23474
  misc_feature 1..150: note = chr21:38119754-38119904
  misc_feature 1..150: note = hyper
  source 1..150: mol_type = genomic DNA

SEQ ID NO: 58954 - DNA, 226 bp, Homo sapiens
  misc_feature 1..226: note = chr21:38120312-38120538
  misc_feature 1..226: note = hyper
  source 1..226: mol_type = genomic DNA
agccccgccgccacctccccgcccggcgcgcccctgccgcactacctgggcgcctcggtcatcatcaccaacgggaggtgacccgctggccgcccgcgccaggagcctggacccggcctcccggggctgcggcgccaccgagcccggcaaatgcgcacgacctacattaatttatgcagagacagctgtttgaattggaccccgccgccgacttgcggatttccac

SEQ ID NO: 58955 - DNA, 24 bp, Homo sapiens
  misc_feature 1..24: note = chr21:38120553-38120577
  misc_feature 1..24: note = hyper
  source 1..24: mol_type = genomic DNA
cgccggtgccgagggccgaggagc

SEQ ID NO: 58956 - DNA, 89 bp, Homo sapiens; identical to SEQ ID NO: 38388
  misc_feature 1..89: note = chr21:38378464-38378553
  misc_feature 1..89: note = hyper
  source 1..89: mol_type = genomic DNA

SEQ ID NO: 58957 - DNA, 56 bp, Homo sapiens; identical to SEQ ID NO: 38389
  misc_feature 1..56: note = chr21:38378983-38379039
  misc_feature 1..56: note = hyper
  source 1..56: mol_type = genomic DNA

SEQ ID NO: 58958 - DNA, 30 bp, Homo sapiens; identical to SEQ ID NO: 38390
  misc_feature 1..30: note = chr21:38379523-38379553
  misc_feature 1..30: note = hyper
  source 1..30: mol_type = genomic DNA

SEQ ID NO: 58959 - DNA, 271 bp, Homo sapiens; identical to SEQ ID NO: 38391
  misc_feature 1..271: note = chr21:38593435-38593706
  misc_feature 1..271: note = hyper
  source 1..271: mol_type = genomic DNA

SEQ ID NO: 58960 - DNA, 106 bp, Homo sapiens
  misc_feature 1..106: note = chr21:39047670-39047776
  misc_feature 1..106: note = hyper
  source 1..106: mol_type = genomic DNA
gccgggctgggcagccgacgcaccgctaggtggcgcacgcgctcgctgcgtctttcagggctgcaggtacggtgcgggtttctggtgcgctgaccgcgctggggat

SEQ ID NO: 58961 - DNA, 238 bp, Homo sapiens; identical to SEQ ID NO: 38393
  misc_feature 1..238: note = chr21:39286637-39286875
  misc_feature 1..238: note = hyper
  source 1..238: mol_type = genomic DNA

SEQ ID NO: 58962 - DNA, 37 bp, Homo sapiens; identical to SEQ ID NO: 13985
  misc_feature 1..37: note = chr21:39288011-39288048
  misc_feature 1..37: note = hyper
  source 1..37: mol_type = genomic DNA

SEQ ID NO: 58963 - DNA, 30 bp, Homo sapiens; identical to SEQ ID NO: 13986
  misc_feature 1..30: note = chr21:39288362-39288392
  misc_feature 1..30: note = hyper
  source 1..30: mol_type = genomic DNA

SEQ ID NO: 58964 - DNA, 95 bp, Homo sapiens; identical to SEQ ID NO: 38396
  misc_feature 1..95: note = chr21:39288790-39288885
  misc_feature 1..95: note = hyper
  source 1..95: mol_type = genomic DNA

SEQ ID NO: 58965 - DNA, 130 bp, Homo sapiens; identical to SEQ ID NO: 38397
  misc_feature 1..130: note = chr21:39289195-39289325
  misc_feature 1..130: note = hyper
  source 1..130: mol_type = genomic DNA

SEQ ID NO: 58966 - DNA, 82 bp, Homo sapiens; identical to SEQ ID NO: 38398
  misc_feature 1..82: note = chr21:40032153-40032235
  misc_feature 1..82: note = hyper
  source 1..82: mol_type = genomic DNA

SEQ ID NO: 58967 - DNA, 46 bp, Homo sapiens; identical to SEQ ID NO: 38399
  misc_feature 1..46: note = chr21:40032796-40032842
  misc_feature 1..46: note = hyper
  source 1..46: mol_type = genomic DNA

SEQ ID NO: 58968 - DNA, 105 bp, Homo sapiens; identical to SEQ ID NO: 38400
  misc_feature 1..105: note = chr21:40033106-40033211
  misc_feature 1..105: note = hyper
  source 1..105: mol_type = genomic DNA

SEQ ID NO: 58969 - DNA, 395 bp, Homo sapiens; identical to SEQ ID NO: 38402
  misc_feature 1..395: note = chr21:42688823-42689218
  misc_feature 1..395: note = hyper
  source 1..395: mol_type = genomic DNA

SEQ ID NO: 58970 - DNA, 82 bp, Homo sapiens; identical to SEQ ID NO: 38403
  misc_feature 1..82: note = chr21:42878710-42878792
  misc_feature 1..82: note = hyper
  source 1..82: mol_type = genomic DNA

SEQ ID NO: 58971 - DNA, 42 bp, Homo sapiens; identical to SEQ ID NO: 38404
  misc_feature 1..42: note = chr21:42880442-42880484
  misc_feature 1..42: note = hyper
  source 1..42: mol_type = genomic DNA

SEQ ID NO: 58972 - DNA, 30 bp, Homo sapiens; identical to SEQ ID NO: 38405
  misc_feature 1..30: note = chr21:44073368-44073398
  misc_feature 1..30: note = hyper
  source 1..30: mol_type = genomic DNA

SEQ ID NO: 58973 - DNA, 102 bp, Homo sapiens; identical to SEQ ID NO: 38406
  misc_feature 1..102: note = chr21:44494676-44494778
  misc_feature 1..102: note = hyper
  source 1..102: mol_type = genomic DNA

SEQ ID NO: 58974 - DNA, 454 bp, Homo sapiens
  misc_feature 1..454: note = chr21:44495155-44495609
  misc_feature 1..454: note = hyper
  source 1..454: mol_type = genomic DNA
ggtttccaggtgggagatccagaccctactgagacccggaaaccgccggccactccgcctccggaagcgacactttgggacaaagctggggacaagtaagcccagaagatcctcgggaagccgagaatttcgcgctccgctctcccacccacgctccgcctcccgcttgcatcctacagctcagctgcggtctcgcctggggctcagggaagtgaggtcccaggaaaacctccatcccccgaacgcaacctgggcagagccccgcgtccctcccccagcgggcacccacctcgcgtgccgcccgcgcaacgacagcgtttaccgccaccccacacggtccgccaaaaagggcgatttgcaaacagccatttcccatccacaatgcagcgaactcaatgctgggcaccgaaacgtgcatctcccccggattcccaccccgcgtccctgctccacg

SEQ ID NO: 58975 - DNA, 194 bp, Homo sapiens; identical to SEQ ID NO: 38409
  misc_feature 1..194: note = chr21:44495838-44496032
  misc_feature 1..194: note = hyper
  source 1..194: mol_type = genomic DNA

SEQ ID NO: 58976 - DNA, 346 bp, Homo sapiens; identical to SEQ ID NO: 38410
  misc_feature 1..346: note = chr21:44496398-44496744
  misc_feature 1..346: note = hyper
  source 1..346: mol_type = genomic DNA

SEQ ID NO: 58977 - DNA, 71 bp, Homo sapiens
  misc_feature 1..71: note = chr21:44847520-44847591
  misc_feature 1..71: note = hyper
  source 1..71: mol_type = genomic DNA
ggggcccgggggcctcgcgggctcgcgcgtggggctggcggcgcggatgccctggggcgctgcagaccccg

SEQ ID NO: 58978 - DNA, 221 bp, Homo sapiens
  misc_feature 1..221: note = chr21:44847622-44847843
  misc_feature 1..221: note = hyper
  source 1..221: mol_type = genomic DNA
cttttgctgttaaaatctgaaatgttcagcaagttagaaacttgaaacctaaggaagcgtgaccggccgctctggaagcccccgccgcgcggccggtcccggccccggccctcagcggcgctggcgtctgcgcgtcccggggctgcccccgcagcatgtggggctgggaccctcttcccgcgcgggccccgggcggacgctgcgggcggtgacggagccag

SEQ ID NO: 58979 - DNA, 299 bp, Homo sapiens
  misc_feature 1..299: note = chr21:45148316-45148615
  misc_feature 1..299: note = hyper
  source 1..299: mol_type = genomic DNA
tgctctcccctggaacgcctggaactagggtggtcaggctggggtggaggagctcccctggaatgttccagagcttcccccactcctgccgttctgagtcaccctgcctccccggaggaggaggaggatcagctgagccgccgcgctcacgtagtgtctggctgtctgcctgtctgcctcgctgtgagcagagtgggatgctgccgataaggcgcgcacgtgggccctgggaggagcccgaggcagccactcccgcacgtgggcaggaggagggctgctcacaccaccggccgagggag

SEQ ID NO: 58980 - DNA, 249 bp, Homo sapiens
  misc_feature 1..249: note = chr21:45148758-45149007
  misc_feature 1..249: note = hyper
  source 1..249: mol_type = genomic DNA
ggaggaagttgcgaccctttctaagccatcccactggcctggactctgctgggattattttgaccccccagggcagagtgtagccatctgactggctttctctctcggcaggagacggggcgcacgcctgcaggtgggggagccccaatacgtcacacggatgagcggggcaaagcccagccccccaccccgcacccgcccgcccgcaatcctgccccctggctgcggcctccgcggctcttcccaccc

SEQ ID NO: 58981 - DNA, 51 bp, Homo sapiens; identical to SEQ ID NO: 14000
  misc_feature 1..51: note = chr21:45875681-45875732
  misc_feature 1..51: note = hyper
  source 1..51: mol_type = genomic DNA

SEQ ID NO: 58982 - skipped

SEQ ID NO: 58983 - DNA, 289 bp, Homo sapiens; identical to SEQ ID NO: 38417
  misc_feature 1..289: note = chr21:46127234-46127523
  misc_feature 1..289: note = hyper
  source 1..289: mol_type = genomic DNA

SEQ ID NO: 58984 - DNA, 28 bp, Homo sapiens
  misc_feature 1..28: note = chr21:46127878-46127906
  misc_feature 1..28: note = hyper
  source 1..28: mol_type = genomic DNA
ctagcctgtgccccccgattccccccct

SEQ ID NO: 58985 - DNA, 30 bp, Homo sapiens; identical to SEQ ID NO: 14004
  misc_feature 1..30: note = chr21:46128279-46128309
  misc_feature 1..30: note = hyper
  source 1..30: mol_type = genomic DNA

SEQ ID NO: 58986 - DNA, 18 bp, Homo sapiens
  misc_feature 1..18: note = chr21:46128884-46128902
  misc_feature 1..18: note = hyper
  source 1..18: mol_type = genomic DNA
cactgagcagggtcccgc

SEQ ID NO: 58987 - DNA, 158 bp, Homo sapiens
  misc_feature 1..158: note = chr21:46128938-46129096
  misc_feature 1..158: note = hyper
  source 1..158: mol_type = genomic DNA
cactcaggacagggagaggcaatggaaagagacgtggccgccctcgcatcctgcagctcccgcactcccagcctcccagcctcccacccagccccccagagcccaccagtgaccccgcccactgggtcctcagatggctcccacgggatctcctgcct

SEQ ID NO: 58988 - DNA, 68 bp, Homo sapiens
  misc_feature 1..68: note = chr21:46129376-46129444
  misc_feature 1..68: note = hyper
  source 1..68: mol_type = genomic DNA
atgagtcctagaaagcgagagacgagaggggaatgagcgccgaaaatcaaagcaggttcccctcctga

SEQ ID NO: 58989 - DNA, 149 bp, Homo sapiens
  misc_feature 1..149: note = chr21:46129485-46129634
  misc_feature 1..149: note = hyper
  source 1..149: mol_type = genomic DNA
cccccagcctcgcgaccgcctgtgacctgcgggtcaaccacccgccgcggctccacgccgtgggcacagactcagggagcaggatgagaaagctgagacggcgcagccacggcccggtgccttcacgcgcacagcgacacagccccagc

SEQ ID NO: 58990 - DNA, 30 bp, Homo sapiens; identical to SEQ ID NO: 38422
  misc_feature 1..30: note = chr21:46130412-46130442
  misc_feature 1..30: note = hyper
  source 1..30: mol_type = genomic DNA

SEQ ID NO: 58991 - DNA, 30 bp, Homo sapiens; identical to SEQ ID NO: 38423
  misc_feature 1..30: note = chr21:46132288-46132318
  misc_feature 1..30: note = hyper
  source 1..30: mol_type = genomic DNA

SEQ ID NO: 58992 - DNA, 34 bp, Homo sapiens; identical to SEQ ID NO: 38424
  misc_feature 1..34: note = chr21:46143070-46143104
  misc_feature 1..34: note = hyper
  source 1..34: mol_type = genomic DNA

SEQ ID NO: 58993 - DNA, 217 bp, Homo sapiens; identical to SEQ ID NO: 38425
  misc_feature 1..217: note = chr21:46351695-46351912
  misc_feature 1..217: note = hyper
  source 1..217: mol_type = genomic DNA

SEQ ID NO: 58994 - DNA, 56 bp, Homo sapiens; identical to SEQ ID NO: 38426
  misc_feature 1..56: note = chr21:46352791-46352847
  misc_feature 1..56: note = hyper
  source 1..56: mol_type = genomic DNA

SEQ ID NO: 58995 - DNA, 436 bp, Homo sapiens; identical to SEQ ID NO: 38427
  misc_feature 1..436: note = chr21:46438321-46438757
  misc_feature 1..436: note = hyper
  source 1..436: mol_type = genomic DNA

SEQ ID NO: 58996 - skipped

SEQ ID NO: 58997 - DNA, 15 bp, Homo sapiens
  misc_feature 1..15: note = chr21:46439007-46439022
  misc_feature 1..15: note = hyper
  source 1..15: mol_type = genomic DNA
cgtctgtcccaggcc

SEQ ID NO: 58998 - DNA, 134 bp, Homo sapiens; identical to SEQ ID NO: 38430
  misc_feature 1..134: note = chr21:46706841-46706975
  misc_feature 1..134: note = hyper
  source 1..134: mol_type = genomic DNA

SEQ ID NO: 58999 - DNA, 378 bp, Homo sapiens; identical to SEQ ID NO: 38431
  misc_feature 1..378: note = chr21:46825344-46825722
  misc_feature 1..378: note = hyper
  source 1..378: mol_type = genomic DNA

SEQ ID NO: 59000 - DNA, 63 bp, Homo sapiens; identical to SEQ ID NO: 38432
  misc_feature 1..63: note = chr21:47010090-47010153
  misc_feature 1..63: note = hyper
  source 1..63: mol_type = genomic DNA

SEQ ID NO: 59001 - DNA, 44 bp, Homo sapiens
  misc_feature 1..44: note = chr21:47010451-47010495
  misc_feature 1..44: note = hyper
  source 1..44: mol_type = genomic DNA
ggtcggcggcgtcagcggcagctcccagacgacctaggactgca

SEQ ID NO: 59002 - DNA, 79 bp, Homo sapiens; identical to SEQ ID NO: 38434
  misc_feature 1..79: note = chr21:47010703-47010782
  misc_feature 1..79: note = hyper
  source 1..79: mol_type = genomic DNA

SEQ ID NO: 59003 - DNA, 55 bp, Homo sapiens
  misc_feature 1..55: note = chr21:47062825-47062880
  misc_feature 1..55: note = hyper
  source 1..55: mol_type = genomic DNA
ttcggggttgcggcacggctgggaattcaacggccattcccgtcccgtcgggccc

SEQ ID NO: 59004 - DNA, 106 bp, Homo sapiens
  misc_feature 1..106: note = chr21:47063432-47063538
  misc_feature 1..106: note = hyper
  source 1..106: mol_type = genomic DNA
ttccagagaactttccgggctcggattggccgcgccggttgatgttccgccctttcattggcccgcggcgcccgctttcgcgagcctgcccttgggcgggggcggg

SEQ ID NO: 59005 - DNA, 288 bp, Homo sapiens; identical to SEQ ID NO: 23499
  misc_feature 1..288: note = chr21:47063962-47064250
  misc_feature 1..288: note = hyper
  source 1..288: mol_type = genomic DNA

SEQ ID NO: 59006 - DNA, 74 bp, Homo sapiens; identical to SEQ ID NO: 38437
  misc_feature 1..74: note = chr21:47392726-47392800
  misc_feature 1..74: note = hyper
  source 1..74: mol_type = genomic DNA

SEQ ID NO: 59007 - DNA, 30 bp, Homo sapiens; identical to SEQ ID NO: 38438
  misc_feature 1..30: note = chr21:47393095-47393125
  misc_feature 1..30: note = hyper
  source 1..30: mol_type = genomic DNA

SEQ ID NO: 59008 - DNA, 324 bp, Homo sapiens; identical to SEQ ID NO: 38439
  misc_feature 1..324: note = chr21:47517989-47518313
  misc_feature 1..324: note = hyper
  source 1..324: mol_type = genomic DNA

SEQ ID NO: 59009 - DNA, 427 bp, Homo sapiens
  misc_feature 1..427: note = chr21:47518349-47518776
  misc_feature 1..427: note = hyper
  source 1..427: mol_type = genomic DNA
cggagccggcctgggcggggtgggggggtccctgtctgcgcccgagctcggtgctgggacccccgctcccgagacgaccccggcaccgcacgccccgccaggccccgcgtctgcgagcggttcgggtccggctccggcccgcggggaagacgccccggctggctgggacctccgggggcgcagggcctctccccgggccggacggaaggggcggcggggcggggggaggaggggctttcggtgcccgagggcgggactgggcggggaggggacgcgggtggccccgacgccccatcgctgcgcccctcccggcctggagcccaccagggccccgccaggcccaggagaagctgcagacggaggcggctccccagggcggcgggacccgggctgacagcgacccgcagcccctgccgggccgcccaca

SEQ ID NO: 59010 - DNA, 121 bp, Homo sapiens; identical to SEQ ID NO: 38441
  misc_feature 1..121: note = chr21:47717212-47717333
  misc_feature 1..121: note = hyper
  source 1..121: mol_type = genomic DNA

SEQ ID NO: 59011 - DNA, 300 bp, Homo sapiens; identical to SEQ ID NO: 38442
  misc_feature 1..300: note = chr21:48087199-48087499
  misc_feature 1..300: note = hyper
  source 1..300: mol_type = genomic DNA

SEQ ID NO: 59012 - DNA, 267 bp, Homo sapiens; identical to SEQ ID NO: 38443
  misc_feature 1..267: note = chr21:48087715-48087982
  misc_feature 1..267: note = hyper
  source 1..267: mol_type = genomic DNA

SEQ ID NO: 59013 - DNA, 11 bp, Homo sapiens
  misc_feature 1..11: note = chr22:17081921-17081932
  misc_feature 1..11: note = hyper
  source 1..11: mol_type = genomic DNA
attccttttcc

SEQ ID NO: 59014 - DNA, 33 bp, Homo sapiens; identical to SEQ ID NO: 38445
  misc_feature 1..33: note = chr22:17082347-17082380
  misc_feature 1..33: note = hyper
  source 1..33: mol_type = genomic DNA

SEQ ID NO: 59015 - DNA, 108 bp, Homo sapiens; identical to SEQ ID NO: 38446
  misc_feature 1..108: note = chr22:17082786-17082894
  misc_feature 1..108: note = hyper
  source 1..108: mol_type = genomic DNA

SEQ ID NO: 59016 - DNA, 59 bp, Homo sapiens
  misc_feature 1..59: note = chr22:17083003-17083062
  misc_feature 1..59: note = hyper
  source 1..59: mol_type = genomic DNA
ccgaggagcctggagccccggccccgagccccccagccgcagacaaaagacctcggggc

SEQ ID NO: 59017 - DNA, 189 bp, Homo sapiens
  misc_feature 1..189: note = chr22:17083207-17083396
  misc_feature 1..189: note = hyper
  source 1..189: mol_type = genomic DNA
ggcgggatgggggcggggcgggcccgcgggcggcggcagctcccggccccggccccacgcccctcggtagccgcccgcgcccggcctcccccgctccgcgccgcccgcccgggctcccgtcggcgcccggcttcgcacactttacttttcagtcgggccttttcagtgggtcttctccgcgactcttct

SEQ ID NO: 59018 - DNA, 29 bp, Homo sapiens
  misc_feature 1..29: note = chr22:17083524-17083553
  misc_feature 1..29: note = hyper
  source 1..29: mol_type = genomic DNA
cggagctgtcaaaacgcccgggccaggtg

SEQ ID NO: 59019 - DNA, 209 bp, Homo sapiens; identical to SEQ ID NO: 38450
  misc_feature 1..209: note = chr22:17083858-17084067
  misc_feature 1..209: note = hyper
  source 1..209: mol_type = genomic DNA

SEQ ID NO: 59020 - DNA, 15 bp, Homo sapiens
  misc_feature 1..15: note = chr22:17090840-17090855
  misc_feature 1..15: note = hyper
  source 1..15: mol_type = genomic DNA
cggccaagagcggat

SEQ ID NO: 59021 - DNA, 142 bp, Homo sapiens
  misc_feature 1..142: note = chr22:17600944-17601086
  misc_feature 1..142: note = hyper
  source 1..142: mol_type = genomic DNA
agcgccatggtgagacggaagcccgtggtgccgaagggcgcgcgtagctcgatgaggtctaggatggacgtgcccaggatcagcaccaccttgggagtgaaggcgatggagtagataagccaggccaggtaggcgaaggcga

SEQ ID NO: 59022 - DNA, 74 bp, Homo sapiens
  misc_feature 1..74: note = chr22:17601368-17601442
  misc_feature 1..74: note = hyper
  source 1..74: mol_type = genomic DNA
ggtccagcaggccgccctgcgccagcagcagcaccacggacagcgcctggtagccccagcggcacctgggactg

SEQ ID NO: 59023 - DNA, 101 bp, Homo sapiens
  misc_feature 1..101: note = chr22:17602410-17602511
  misc_feature 1..101: note = hyper
  source 1..101: mol_type = genomic DNA
ggcgggggtgcagtgcgtcacagtcgggtcgggagccctgtggcctggaggaagcgggaggaggcgcgggcagccgccagggcgaggcgacccggtgcggg

SEQ ID NO: 59024 - DNA, 15 bp, Homo sapiens
  misc_feature 1..15: note = chr22:17849412-17849427
  misc_feature 1..15: note = hyper
  source 1..15: mol_type = genomic DNA
ttagcagtactccac

SEQ ID NO: 59025 - DNA, 376 bp, Homo sapiens; identical to SEQ ID NO: 38456
  misc_feature 1..376: note = chr22:17849501-17849877
  misc_feature 1..376: note = hyper
  source 1..376: mol_type = genomic DNA

SEQ ID NO: 59026 - DNA, 340 bp, Homo sapiens
  misc_feature 1..340: note = chr22:17850114-17850454
  misc_feature 1..340: note = hyper
  source 1..340: mol_type = genomic DNA
caaagtcctggagggcggagggcgcctcgtgagagttctcgggggtgcggcccgcgccccctgggtcctgcggatctgggcccgggggcgcgcgccccgcccctccccctccctggcggtgcagctgtccgggcgggggtggggcgggggccggggcccgcgtgggattaactaggaccggggcgggagtcgaccgcggccggcggggagggctagccccgctctggcgggcgggcgcgtggcaggggctcccggaggccccgagctcccgggaggcgctccggccaacttcgggccggtggggaccgggcctgggcgcggggctctgaaggtgtggaag

SEQ ID NO: 59027 - DNA, 73 bp, Homo sapiens
  misc_feature 1..73: note = chr22:17850621-17850694
  misc_feature 1..73: note = hyper
  source 1..73: mol_type = genomic DNA
gcccggggctttgtgataactgggccgaaacccgagggtcctggagcgcggcgggtggcgggagcttgcggag

SEQ ID NO: 59028 - DNA, 78 bp, Homo sapiens; identical to SEQ ID NO: 38458
  misc_feature 1..78: note = chr22:17850953-17851031
  misc_feature 1..78: note = hyper
  source 1..78: mol_type = genomic DNA

SEQ ID NO: 59029 - DNA, 30 bp, Homo sapiens; identical to SEQ ID NO: 38459
  misc_feature 1..30: note = chr22:18986543-18986573
  misc_feature 1..30: note = hyper
  source 1..30: mol_type = genomic DNA

SEQ ID NO: 59030 - DNA, 678 bp, Homo sapiens
  misc_feature 1..678: note = chr22:19016854-19017532
  misc_feature 1..678: note = hyper
  source 1..678: mol_type = genomic DNA
gagacccggccctgccggggttccctgcgccccagaccggaacccccagggctttggtcgttcccacagccgtcccgcgggccccctccacggtgcgtcgcctgggccccagcggtcgctaggctgcagcctggggctcccggccatcccgggcgctggcggcggtggaggcagcagggcggatggcggagcccggccgcccgtgggcccaggcgcgtagtgcgtacagagccagcgaggtgctgcggcgcggcacgggccgccggcgggatccggggccgcaatccaatgggccgggccaggaagacgcccgagccccgggccggatggctcgcctgcgcggccagctccgggccgaagcggcttcgcggtccgaggtgccgcggctgctgaagctggtggagcgtgcgggggccggggcggccgggcgcgggcgagaggaccggcgcgcacagccgcgggctccgtgtgctcggtatgcggggagccccgcggcggggccacctacccggcgggggtcctggaggtgagcgagcggcggctgcaggagggcctggcggcagtgcgcgaggagctgggcgccgggattgaggcgctgcgcgcggagcttcgagcggagctggatgccctgcgcgcgctgctgccgccgccgccgtccccgcctgcccgccgcgagcc

SEQ ID NO: 59031 - DNA, 27 bp, Homo sapiens
  misc_feature 1..27: note = chr22:19017567-19017594
  misc_feature 1..27: note = hyper
  source 1..27: mol_type = genomic DNA
ccctgccgcggacgctcggcaccgtga

SEQ ID NO: 59032 - DNA, 282 bp, Homo sapiens; identical to SEQ ID NO: 23511
  misc_feature 1..282: note = chr22:19511567-19511849
  misc_feature 1..282: note = hyper
  source 1..282: mol_type = genomic DNA

SEQ ID NO: 59033 - DNA, 67 bp, Homo sapiens; identical to SEQ ID NO: 1519
  misc_feature 1..67: note = chr22:19512252-19512319
  misc_feature 1..67: note = hyper
  source 1..67: mol_type = genomic DNA

SEQ ID NO: 59034 - DNA, 27 bp, Homo sapiens
  misc_feature 1..27: note = chr22:19512376-19512403
  misc_feature 1..27: note = hyper
  source 1..27: mol_type = genomic DNA
cgtagaggccctcgtaggggggctctc

SEQ ID NO: 59035 - DNA, 20 bp, Homo sapiens
  misc_feature 1..20: note = chr22:19706677-19706697
  misc_feature 1..20: note = hyper
  source 1..20: mol_type = genomic DNA
ccccgcggctggatccgggc

SEQ ID NO: 59036 - DNA, 17 bp, Homo sapiens
  misc_feature 1..17: note = chr22:19711723-19711740
  misc_feature 1..17: note = hyper
  source 1..17: mol_type = genomic DNA
gcgcccccagcgctgcg

SEQ ID NO: 59037 - DNA, 145 bp, Homo sapiens; identical to SEQ ID NO: 14032
  misc_feature 1..145: note = chr22:19742613-19742758
  misc_feature 1..145: note = hyper
  source 1..145: mol_type = genomic DNA

SEQ ID NO: 59038 - DNA, 46 bp, Homo sapiens; identical to SEQ ID NO: 23515
  misc_feature 1..46: note = chr22:19742788-19742834
  misc_feature 1..46: note = hyper
  source 1..46: mol_type = genomic DNA

SEQ ID NO: 59039 - DNA, 23 bp, Homo sapiens
  misc_feature 1..23: note = chr22:19742969-19742992
  misc_feature 1..23: note = hyper
  source 1..23: mol_type = genomic DNA
agcactttcgtgggatggaggga

SEQ ID NO: 59040 - DNA, 46 bp, Homo sapiens
  misc_feature 1..46: note = chr22:19748598-19748644
  misc_feature 1..46: note = hyper
  source 1..46: mol_type = genomic DNA
cctacccgtttgcgccggccgccggggccgccaccagcgccgccgc

SEQ ID NO: 59041 - DNA, 32 bp, Homo sapiens; identical to SEQ ID NO: 38472
  misc_feature 1..32: note = chr22:19748960-19748992
  misc_feature 1..32: note = hyper
  source 1..32: mol_type = genomic DNA

SEQ ID NO: 59042 - DNA, 1439 bp, Homo sapiens; identical to SEQ ID NO: 38473
  misc_feature 1..1439: note = chr22:20790689-20792128
  misc_feature 1..1439: note = hyper
  source 1..1439: mol_type = genomic DNA

SEQ ID NO: 59043 - DNA, 146 bp, Homo sapiens; identical to SEQ ID NO: 38475
  misc_feature 1..146: note = chr22:21311370-21311516
  misc_feature 1..146: note = hyper
  source 1..146: mol_type = genomic DNA

SEQ ID NO: 59044 - DNA, 32 bp, Homo sapiens; identical to SEQ ID NO: 38476
  misc_feature 1..32: note = chr22:21319163-21319195
  misc_feature 1..32: note = hyper
  source 1..32: mol_type = genomic DNA

SEQ ID NO: 59045 - DNA, 213 bp, Homo sapiens; identical to SEQ ID NO: 38477
  misc_feature 1..213: note = chr22:21319645-21319858
  misc_feature 1..213: note = hyper
  source 1..213: mol_type = genomic DNA

SEQ ID NO: 59046 - DNA, 249 bp, Homo sapiens; identical to SEQ ID NO: 38478
  misc_feature 1..249: note = chr22:21333767-21334016
  misc_feature 1..249: note = hyper
  source 1..249: mol_type = genomic DNA

SEQ ID NO: 59047 - DNA, 81 bp, Homo sapiens; identical to SEQ ID NO: 38479
  misc_feature 1..81: note = chr22:21368301-21368382
  misc_feature 1..81: note = hyper
  source 1..81: mol_type = genomic DNA

SEQ ID NO: 59048 - DNA, 152 bp, Homo sapiens
  misc_feature 1..152: note = chr22:21368435-21368587
  misc_feature 1..152: note = hyper
  source 1..152: mol_type = genomic DNA
cgtccacaggccgccgtcgcctcttcctcctgctttttatcctccccagacctctggcaggaaccgctcatcgttacgcccctttcgcagcctcagaccctgaggcggagaccgcttggcgcctcacttagagcgcgacccggggatgtggg

SEQ ID NO: 59049 - DNA, 80 bp, Homo sapiens
  misc_feature 1..80: note = chr22:21368617-21368697
  misc_feature 1..80: note = hyper
  source 1..80: mol_type = genomic DNA
tgtggcgtccatcgactggcgtctgccacggcaattagcgacgcgctcccccgcggcggtcgccccggcaacccagtgct

SEQ ID NO: 59050 - DNA, 30 bp, Homo sapiens; identical to SEQ ID NO: 38481
  misc_feature 1..30: note = chr22:21386579-21386609
  misc_feature 1..30: note = hyper
  source 1..30: mol_type = genomic DNA

SEQ ID NO: 59051 - DNA, 71 bp, Homo sapiens; identical to SEQ ID NO: 38482
  misc_feature 1..71: note = chr22:21386912-21386983
  misc_feature 1..71: note = hyper
  source 1..71: mol_type = genomic DNA

SEQ ID NO: 59052 - DNA, 201 bp, Homo sapiens; identical to SEQ ID NO: 38483
  misc_feature 1..201: note = chr22:21400082-21400283
  misc_feature 1..201: note = hyper
  source 1..201: mol_type = genomic DNA

SEQ ID NO: 59053 - DNA, 90 bp, Homo sapiens; identical to SEQ ID NO: 23519
  misc_feature 1..90: note = chr22:22862697-22862787
  misc_feature 1..90: note = hyper
  source 1..90: mol_type = genomic DNA

SEQ ID NO: 59054 - DNA, 88 bp, Homo sapiens; identical to SEQ ID NO: 4903
  misc_feature 1..88: note = chr22:22863219-22863307
  misc_feature 1..88: note = hyper
  source 1..88: mol_type = genomic DNA

SEQ ID NO: 59055 - DNA, 88 bp, Homo sapiens; identical to SEQ ID NO: 38486
  misc_feature 1..88: note = chr22:23908151-23908239
  misc_feature 1..88: note = hyper
  source 1..88: mol_type = genomic DNA

SEQ ID NO: 59056 - DNA, 279 bp, Homo sapiens; identical to SEQ ID NO: 38487
  misc_feature 1..279: note = chr22:23908636-23908915
  misc_feature 1..279: note = hyper
  source 1..279: mol_type = genomic DNA

SEQ ID NO: 59057 - DNA, 153 bp, Homo sapiens
  misc_feature 1..153: note = chr22:24180534-24180687
  misc_feature 1..153: note = hyper
  source 1..153: mol_type = genomic DNA
atacggtcataaggacgcccccgaagagaaacatgaagacgaagtcggccgtgcggccgcggaaggagccctcttccagcatgcggcagtagcggaacctacggcgtcggtataggaagtgccaccaggcggggcctcagtttccccgtcccg

SEQ ID NO: 59058 - DNA, 228 bp, Homo sapiens; identical to SEQ ID NO: 23524
  misc_feature 1..228: note = chr22:24180766-24180994
  misc_feature 1..228: note = hyper
  source 1..228: mol_type = genomic DNA

SEQ ID NO: 59059 - DNA, 625 bp, Homo sapiens; identical to SEQ ID NO: 38489
  misc_feature 1..625: note = chr22:24181054-24181679
  misc_feature 1..625: note = hyper
  source 1..625: mol_type = genomic DNA

SEQ ID NO: 59060 - DNA, 270 bp, Homo sapiens; identical to SEQ ID NO: 38490
  misc_feature 1..270: note = chr22:24551644-24551914
  misc_feature 1..270: note = hyper
  source 1..270: mol_type = genomic DNA

SEQ ID NO: 59061 - DNA, 419 bp, Homo sapiens; identical to SEQ ID NO: 38491
  misc_feature 1..419: note = chr22:24552189-24552608
  misc_feature 1..419: note = hyper
  source 1..419: mol_type = genomic DNA

SEQ ID NO: 59062 - DNA, 106 bp, Homo sapiens
  misc_feature 1..106: note = chr22:24820224-24820330
  misc_feature 1..106: note = hyper
  source 1..106: mol_type = genomic DNA
tgtcccaaactgcaccggaaggcgcgcaggggtaggcggggagggaaggcaagtgcggcggccggcgcggcgcggggtgcggagccgcaggtagcgggcggggagc

SEQ ID NO: 59063 - DNA, 48 bp, Homo sapiens
  misc_feature 1..48: note = chr22:24820396-24820444
  misc_feature 1..48: note = hyper
  source 1..48: mol_type = genomic DNA
tcgcgagctcctccagcagggatggaccgggggcgcagaggcgcttcc

SEQ ID NO: 59064 - DNA, 369 bp, Homo sapiens; identical to SEQ ID NO: 38493
  misc_feature 1..369: note = chr22:25678246-25678615
  misc_feature 1..369: note = hyper
  source 1..369: mol_type = genomic DNA

SEQ ID NO: 59065 - DNA, 132 bp, Homo sapiens; identical to SEQ ID NO: 23527
  misc_feature 1..132: note = chr22:25678616-25678748
  misc_feature 1..132: note = hyper
  source 1..132: mol_type = genomic DNA

SEQ ID NO: 59066 - DNA, 128 bp, Homo sapiens; identical to SEQ ID NO: 23528
  misc_feature 1..128: note = chr22:25679337-25679465
  misc_feature 1..128: note = hyper
  source 1..128: mol_type = genomic DNA

SEQ ID NO: 59067 - DNA, 236 bp, Homo sapiens
  misc_feature 1..236: note = chr22:25816871-25817107
  misc_feature 1..236: note = hyper
  source 1..236: mol_type = genomic DNA
tcctttgtggccacccggaggggagagacttggttgggaggcgccaaccgagctggccgctgggactctgcacccaggtgcgccaacccttgggcgcacgctccccgcagaccctcgctgaaggagcggtgggcggcgcgccgcgaccctggcgggctacagattacaccgcttgcagggcgctgctggggcgcgcagagcggggctgccccagggtggctcccccaggttggggc

SEQ ID NO: 59068 - DNA, 278 bp, Homo sapiens; identical to SEQ ID NO: 23530
  misc_feature 1..278: note = chr22:25817180-25817458
  misc_feature 1..278: note = hyper
  source 1..278: mol_type = genomic DNA

SEQ ID NO: 59069 - DNA, 39 bp, Homo sapiens; identical to SEQ ID NO: 23531
  misc_feature 1..39: note = chr22:25817612-25817651
  misc_feature 1..39: note = hyper
  source 1..39: mol_type = genomic DNA

SEQ ID NO: 59070 - DNA, 30 bp, Homo sapiens; identical to SEQ ID NO: 14049
  misc_feature 1..30: note = chr22:26564863-26564893
  misc_feature 1..30: note = hyper
  source 1..30: mol_type = genomic DNA

SEQ ID NO: 59071 - DNA, 177 bp, Homo sapiens; identical to SEQ ID NO: 14050
  misc_feature 1..177: note = chr22:26565184-26565361
  misc_feature 1..177: note = hyper
  source 1..177: mol_type = genomic DNA

SEQ ID NO: 59072 - DNA, 131 bp, Homo sapiens; identical to SEQ ID NO: 14051
  misc_feature 1..131: note = chr22:26565502-26565633
  misc_feature 1..131: note = hyper
  source 1..131: mol_type = genomic DNA

SEQ ID NO: 59073 - DNA, 64 bp, Homo sapiens; identical to SEQ ID NO: 38501
  misc_feature 1..64: note = chr22:26565935-26565999
  misc_feature 1..64: note = hyper
  source 1..64: mol_type = genomic DNA

SEQ ID NO: 59074 - DNA, 448 bp, Homo sapiens; identical to SEQ ID NO: 38502
  misc_feature 1..448: note = chr22:27053580-27054028
  misc_feature 1..448: note = hyper
  source 1..448: mol_type = genomic DNA

SEQ ID NO: 59075 - DNA, 66 bp, Homo sapiens; identical to SEQ ID NO: 38503
  misc_feature 1..66: note = chr22:27069172-27069238
  misc_feature 1..66: note = hyper
  source 1..66: mol_type = genomic DNA

SEQ ID NO: 59076 - DNA, 30 bp, Homo sapiens; identical to SEQ ID NO: 38504
  misc_feature 1..30: note = chr22:27695238-27695268
  misc_feature 1..30: note = hyper
  source 1..30: mol_type = genomic DNA

SEQ ID NO: 59077 - DNA, 30 bp, Homo sapiens; identical to SEQ ID NO: 38505
  misc_feature 1..30: note = chr22:28196522-28196552
  misc_feature 1..30: note = hyper
  source 1..30: mol_type = genomic DNA

SEQ ID NO: 59078 - DNA, 37 bp, Homo sapiens; identical to SEQ ID NO: 38506
  misc_feature 1..37: note = chr22:28196966-28197003
  misc_feature 1..37: note = hyper
  source 1..37: mol_type = genomic DNA

SEQ ID NO: 59079 - DNA, 278 bp, Homo sapiens; identical to SEQ ID NO: 38507
  misc_feature 1..278: note = chr22:28197276-28197554
  misc_feature 1..278: note = hyper
  source 1..278: mol_type = genomic DNA

SEQ ID NO: 59080 - DNA, 346 bp, Homo sapiens; identical to SEQ ID NO: 38508
  misc_feature 1..346: note = chr22:28198055-28198401
  misc_feature 1..346: note = hyper
  source 1..346: mol_type = genomic DNA

SEQ ID NO: 59081 - DNA, 21 bp, Homo sapiens
  misc_feature 1..21: note = chr22:28838179-28838200
  misc_feature 1..21: note = hyper
  source 1..21: mol_type = genomic DNA
ccttttccccatgatcgattc

SEQ ID NO: 59082 - DNA, 147 bp, Homo sapiens; identical to SEQ ID NO: 23540
  misc_feature 1..147: note = chr22:28838292-28838439
  misc_feature 1..147: note = hyper
  source 1..147: mol_type = genomic DNA

SEQ ID NO: 59083 - DNA, 50 bp, Homo sapiens; identical to SEQ ID NO: 38510
  misc_feature 1..50: note = chr22:28838794-28838844
  misc_feature 1..50: note = hyper
  source 1..50: mol_type = genomic DNA

SEQ ID NO: 59084 - DNA, 813 bp, Homo sapiens; identical to SEQ ID NO: 38511
  misc_feature 1..813: note = chr22:29075406-29076219
  misc_feature 1..813: note = hyper
  source 1..813: mol_type = genomic DNA

SEQ ID NO: 59085 - DNA, 64 bp, Homo sapiens; identical to SEQ ID NO: 38512
  misc_feature 1..64: note = chr22:29426589-29426653
  misc_feature 1..64: note = hyper
  source 1..64: mol_type = genomic DNA

SEQ ID NO: 59086 - DNA, 30 bp, Homo sapiens; identical to SEQ ID NO: 38513
  misc_feature 1..30: note = chr22:29709206-29709236
  misc_feature 1..30: note = hyper
  source 1..30: mol_type = genomic DNA

SEQ ID NO: 59087 - DNA, 71 bp, Homo sapiens; identical to SEQ ID NO: 38514
  misc_feature 1..71: note = chr22:29875904-29875975
  misc_feature 1..71: note = hyper
  source 1..71: mol_type = genomic DNA

SEQ ID NO: 59088 - DNA, 109 bp, Homo sapiens; identical to SEQ ID NO: 38515
  misc_feature 1..109: note = chr22:29876004-29876113
  misc_feature 1..109: note = hyper
  source 1..109: mol_type = genomic DNA

SEQ ID NO: 59089 - DNA, 307 bp, Homo sapiens
  misc_feature 1..307: note = chr22:29876916-29877223
  misc_feature 1..307: note = hyper
  source 1..307: mol_type = genomic DNA
gctgcaggaggagtgcggctacctgcggcgccaccaccaggaagaggtgggcgagctgctcggccagatccagggctccggcgccgcgcaggcgcagatgcaggccgagacgcgcgacgccctgaagtgcgacgtgacgtcggcgctgcgcgagattcgcgcgcagcttgaaggccacgcggtgcagagcacgctgcagtccgaggagtggttccgaggtacgcaggcgcgcgggtggggggaggggcgcccctgctgaccccgcagcgaacttttgggctgcgtgacccaagggggcgctgccgga

SEQ ID NO: 59090 - DNA, 286 bp, Homo sapiens
  misc_feature 1..286: note = chr22:29877299-29877585
  misc_feature 1..286: note = hyper
  source 1..286: mol_type = genomic DNA
ggtctcttgtgggacgccccaactctgggttgtccttcggttccccctttccaggttctttacggctgtacttcaactctgggccccctgctgctctctaccccaagcttaggcgaccccactctgagatccctcccccgtcaagaaaaaaacaagtttcctctacaggaaaaaagtggtgcaggattctggtctgcaagcgctggagactcttagcccttctaagtagcaaggcttccccgccaatgctgccatgccctctcctacaccccgcaagaaactctat

SEQ ID NO: 59091 - DNA, 461 bp, Homo sapiens; identical to SEQ ID NO: 38517
  misc_feature 1..461: note = chr22:30115986-30116447
  misc_feature 1..461: note = hyper
  source 1..461: mol_type = genomic DNA

SEQ ID NO: 59092 - DNA, 177 bp, Homo sapiens
  misc_feature 1..177: note = chr22:30116727-30116904
  misc_feature 1..177: note = hyper
  source 1..177: mol_type = genomic DNA
ggcccagcccctgcccgcgtggtccccagcgctgcggaaacttgccgggccccgcagcggggtcacggggccgcgcagtcggcggtgacggtgcggcaacgcggcggactggggcgggggtccgcgctgagcccccagcgccggcccggccggagcacccgcatcctgatcccctcc

SEQ ID NO: 59093 - DNA, 462 bp, Homo sapiens; identical to SEQ ID NO: 38519
  misc_feature 1..462: note = chr22:30938045-30938507
  misc_feature 1..462: note = hyper
  source 1..462: mol_type = genomic DNA

SEQ ID NO: 59094 - DNA, 74 bp, Homo sapiens
  misc_feature 1..74: note = chr22:30938584-30938658
  misc_feature 1..74: note = hyper
  source 1..74: mol_type = genomic DNA
ccgcctcgggccgctgctctgcctgctgctccccgcgtcctgcgcctggtcaggagtggcgggtgaggaggagc

SEQ ID NO: 59095 - DNA, 30 bp, Homo sapiens; identical to SEQ ID NO: 38521
  misc_feature 1..30: note = chr22:31003156-31003186
  misc_feature 1..30: note = hyper
  source 1..30: mol_type = genomic DNA

SEQ ID NO: 59096 - DNA, 114 bp, Homo sapiens; identical to SEQ ID NO: 23551
  misc_feature 1..114: note = chr22:31218396-31218510
  misc_feature 1..114: note = hyper
  source 1..114: mol_type = genomic DNA

SEQ ID NO: 59097 - DNA, 254 bp, Homo sapiens
  misc_feature 1..254: note = chr22:31218540-31218794
  misc_feature 1..254: note = hyper
  source 1..254: mol_type = genomic DNA
tgcacgcgtccgtgcaagcccccgggacccggcgccatgtagcgccccgccgattggaggctgccccgccgcgggaaatgaagggacgcggctgctgggacacggcctccgtgcgctccttctgcagctccggctgcctgaataaatttaagaagggttagtgcttgccgggcttccacccggagggaggccaggctccccgcgcatgcacgcccggtgcctggctttgctgcgtgatcgatccacgggagcct

SEQ ID NO: 59098 - DNA, 117 bp, Homo sapiens
  misc_feature 1..117: note = chr22:31218829-31218946
  misc_feature 1..117: note = hyper
  source 1..117: mol_type = genomic DNA
gagcctcggggaacccctgtccccgcaccccgccggcgtgcgctcccggcttgcttcacgcgcggggcattttggagagggggctgcggctagagacttgtccgtctaattaaccta

SEQ ID NO: 59099 - DNA, 479 bp, Homo sapiens
  misc_feature 1..479: note = chr22:31480651-31481130
  misc_feature 1..479: note = hyper
  source 1..479: mol_type = genomic DNA
tcagggttcttcagccgccacctccctctcttaagcgaggctcgggcggcgctggaaaagagttttggagagaagctggagcagtggttgaatctctgggaaaggacagatgagaacctgccccggtctcgggatcggtgcctctcgaagtctttccgaccccgggagcggctcctccagcacccggcgcccgccattactgcgccccgcgcgccggcccggcccccgctggcctcgtggcaagaacgggggcgtcccgagccgggctcctccccgcggggccgggccatataaggaaaagctaggcccgctccgcccgccctgcgccccagcgtctggccgatttggggacgcgggcagtcgcttccggccccggctcccgcacattcttgaggattgggccggggatgggaggaatggggacgcctggggacttgcacgccgcgtgcccctccaccacccgccgggacgccctctgc

SEQ ID NO: 59100 - DNA, 174 bp, Homo sapiens
  misc_feature 1..174: note = chr22:31481332-31481506
  misc_feature 1..174: note = hyper
  source 1..174: mol_type = genomic DNA
ccttcagcgccccctggcgaggcttccctccaccgccggcgggacccccatgggcaaccgggggagctgggactgaaagcctggagagccccctccgttgtgctgttggggagactgaggcccagtgagacctcagggcctgccaggcgttcccaacagcgagggcagagagta

SEQ ID NO: 59101 - DNA, 378 bp, Homo sapiens; identical to SEQ ID NO: 38525
  misc_feature 1..378: note = chr22:32571939-32572317
  misc_feature 1..378: note = hyper
  source 1..378: mol_type = genomic DNA

SEQ ID NO: 59102 - DNA, 87 bp, Homo sapiens
  misc_feature 1..87: note = chr22:33197652-33197739
  misc_feature 1..87: note = hyper
  source 1..87: mol_type = genomic DNA
cccagcgctatatcactcggccgcccaggcagcggcgcagagcgggcagcaggcaggcggcgggcgctcagacggcttctcctcctc

SEQ ID NO: 59103 - DNA, 331 bp, Homo sapiens; identical to SEQ ID NO: 38527
  misc_feature 1..331: note = chr22:33197949-33198280
  misc_feature 1..331: note = hyper
  source 1..331: mol_type = genomic DNA

SEQ ID NO: 59104 - DNA, 125 bp, Homo sapiens
  misc_feature 1..125: note = chr22:33454366-33454491
  misc_feature 1..125: note = hyper
  source 1..125: mol_type = genomic DNA
tgcccctcaacgcgcgcgagcgcccccgcccggcggcccggcctccccgcgccgcggcgccccattggctcgggcaacgaggcccccggacggccccgcccacccgcgcccactccctcgcccac

SEQ ID NO: 59105 - DNA, 13 bp, Homo sapiens
  misc_feature 1..13: note = chr22:33454492-33454505
  misc_feature 1..13: note = hyper
  source 1..13: mol_type = genomic DNA
cctctccccaacg

SEQ ID NO: 59106 - DNA, 30 bp, Homo sapiens; identical to SEQ ID NO: 14075
  misc_feature 1..30: note = chr22:35420285-35420315
  misc_feature 1..30: note = hyper
  source 1..30: mol_type = genomic DNA

SEQ ID NO: 59107 - DNA, 30 bp, Homo sapiens; identical to SEQ ID NO: 14076
  misc_feature 1..30: note = chr22:36553195-36553225
  misc_feature 1..30: note = hyper
  source 1..30: mol_type = genomic DNA

SEQ ID NO: 59108 - DNA, 30 bp, Homo sapiens; identical to SEQ ID NO: 38534
  misc_feature 1..30: note = chr22:36726916-36726946
  misc_feature 1..30: note = hyper
  source 1..30: mol_type = genomic DNA

SEQ ID NO: 59109 - DNA, 589 bp, Homo sapiens; identical to SEQ ID NO: 38535
  misc_feature 1..589: note = chr22:37099177-37099766
  misc_feature 1..589: note = hyper
  source 1..589: mol_type = genomic DNA

SEQ ID NO: 59110 - DNA, 57 bp, Homo sapiens; identical to SEQ ID NO: 38536
  misc_feature 1..57: note = chr22:37212414-37212471
  misc_feature 1..57: note = hyper
  source 1..57: mol_type = genomic DNA

SEQ ID NO: 59111 - DNA, 92 bp, Homo sapiens; identical to SEQ ID NO: 38537
  misc_feature 1..92: note = chr22:37212682-37212774
  misc_feature 1..92: note = hyper
  source 1..92: mol_type = genomic DNA

SEQ ID NO: 59112 - DNA, 93 bp, Homo sapiens; identical to SEQ ID NO: 38538
  misc_feature 1..93: note = chr22:37212813-37212906
  misc_feature 1..93: note = hyper
  source 1..93: mol_type = genomic DNA

SEQ ID NO: 59113 - DNA, 117 bp, Homo sapiens; identical to SEQ ID NO: 38539
  misc_feature 1..117: note = chr22:37213161-37213278
  misc_feature 1..117: note = hyper
  source 1..117: mol_type = genomic DNA

SEQ ID NO: 59114 - DNA, 209 bp, Homo sapiens; identical to SEQ ID NO: 38540
  misc_feature 1..209: note = chr22:37730661-37730870
  misc_feature 1..209: note = hyper
  source 1..209: mol_type = genomic DNA

SEQ ID NO: 59115 - DNA, 325 bp, Homo sapiens; identical to SEQ ID NO: 38541
  misc_feature 1..325: note = chr22:37730926-37731251
  misc_feature 1..325: note = hyper
  source 1..325: mol_type = genomic DNA

SEQ ID NO: 59116 - DNA, 87 bp, Homo sapiens; identical to SEQ ID NO: 38542
  misc_feature 1..87: note = chr22:37816102-37816189
  misc_feature 1..87: note = hyper
  source 1..87: mol_type = genomic DNA

SEQ ID NO: 59117 - DNA, 11 bp, Homo sapiens
  misc_feature 1..11: note = chr22:38220642-38220653
  misc_feature 1..11: note = hyper
  source 1..11: mol_type = genomic DNA
ctgggccgcag

SEQ ID NO: 59118 - DNA, 60 bp, Homo sapiens; identical to SEQ ID NO: 14080
  misc_feature 1..60: note = chr22:38221288-38221348
  misc_feature 1..60: note = hyper
  source 1..60: mol_type = genomic DNA

SEQ ID NO: 59119 - DNA, 112 bp, Homo sapiens
  misc_feature 1..112: note = chr22:38476957-38477069
  misc_feature 1..112: note = hyper
  source 1..112: mol_type = genomic DNA
gcgcgcccaccatgccgtaggagaggccgaaggcgacgcagaaggcgacgagggcgccgtaggagcgcgcgcgtgcgctgctcaggtctgtgagcccattggccagcagggc

SEQ ID NO: 59120 - DNA, 12 bp, Homo sapiens
  misc_feature 1..12: note = chr22:38477794-38477806
  misc_feature 1..12: note = hyper
  source 1..12: mol_type = genomic DNA
gggacttcgaag

SEQ ID NO: 59121 - DNA, 35 bp, Homo sapiens; identical to SEQ ID NO: 38547
  misc_feature 1..35: note = chr22:38478441-38478476
  misc_feature 1..35: note = hyper
  source 1..35: mol_type = genomic DNA

SEQ ID NO: 59122 - DNA, 288 bp, Homo sapiens; identical to SEQ ID NO: 38548
  misc_feature 1..288: note = chr22:38850818-38851106
  misc_feature 1..288: note = hyper
  source 1..288: mol_type = genomic DNA

SEQ ID NO: 59123 - DNA, 100 bp, Homo sapiens; identical to SEQ ID NO: 38549
  misc_feature 1..100: note = chr22:38965918-38966018
  misc_feature 1..100: note = hyper
  source 1..100: mol_type = genomic DNA

SEQ ID NO: 59124 - DNA, 158 bp, Homo sapiens; identical to SEQ ID NO: 38550
  misc_feature 1..158: note = chr22:39473204-39473362
  misc_feature 1..158: note = hyper
  source 1..158: mol_type = genomic DNA

SEQ ID NO: 59125 - DNA, 157 bp, Homo sapiens; identical to SEQ ID NO: 38551
  misc_feature 1..157: note = chr22:39784321-39784478
  misc_feature 1..157: note = hyper
  source 1..157: mol_type = genomic DNA

SEQ ID NO: 59126 - DNA, 66 bp, Homo sapiens; identical to SEQ ID NO: 38552
  misc_feature 1..66: note = chr22:39853091-39853157
  misc_feature 1..66: note = hyper
  source 1..66: mol_type = genomic DNA

SEQ ID NO: 59127 - DNA, 128 bp, Homo sapiens
  misc_feature 1..128: note = chr22:39853393-39853521
  misc_feature 1..128: note = hyper
  source 1..128: mol_type = genomic DNA
gggccgcgctgcctgcgatgccgggcgcccgccgcagccgctgccgccggagcccgggatggggcgagaggctgcggcggacgccagcatctccccgccggggaccccgggggccgcggagccgccgc

SEQ ID NO: 59128 - DNA, 134 bp, Homo sapiens; identical to SEQ ID NO: 38555
  misc_feature 1..134: note = chr22:39854212-39854346
  misc_feature 1..134: note = hyper
  source 1..134: mol_type = genomic DNA

SEQ ID NO: 59129 - DNA, 30 bp, Homo sapiens; identical to SEQ ID NO: 14086
  misc_feature 1..30: note = chr22:39942115-39942145
  misc_feature 1..30: note = hyper
  source 1..30: mol_type = genomic DNA

SEQ ID NO: 59130 - DNA, 303 bp, Homo sapiens; identical to SEQ ID NO: 38557
  misc_feature 1..303: note = chr22:39953480-39953783
  misc_feature 1..303: note = hyper
  source 1..303: mol_type = genomic DNA

SEQ ID NO: 59131 - DNA, 60 bp, Homo sapiens; identical to SEQ ID NO: 23568
  misc_feature 1..60: note = chr22:39954516-39954576
  misc_feature 1..60: note = hyper
  source 1..60: mol_type = genomic DNA

SEQ ID NO: 59132 - DNA, 30 bp, Homo sapiens; identical to SEQ ID NO: 38559
  misc_feature 1..30: note = chr22:40060586-40060616
  misc_feature 1..30: note = hyper
  source 1..30: mol_type = genomic DNA

SEQ ID NO: 59133 - DNA, 211 bp, Homo sapiens; identical to SEQ ID NO: 38560
  misc_feature 1..211: note = chr22:40081794-40082005
  misc_feature 1..211: note = hyper
  source 1..211: mol_type = genomic DNA

SEQ ID NO: 59134 - DNA, 349 bp, Homo sapiens; identical to SEQ ID NO: 38561
  misc_feature 1..349: note = chr22:42306171-42306520
  misc_feature 1..349: note = hyper
  source 1..349: mol_type = genomic DNA

SEQ ID NO: 59135 - DNA, 142 bp, Homo sapiens; identical to SEQ ID NO: 38562
  misc_feature 1..142: note = chr22:42307095-42307237
  misc_feature 1..142: note = hyper
  source 1..142: mol_type = genomic DNA

SEQ ID NO: 59136 - DNA, 45 bp, Homo sapiens; identical to SEQ ID NO: 23571
  misc_feature 1..45: note = chr22:42310042-42310087
  misc_feature 1..45: note = hyper
  source 1..45: mol_type = genomic DNA

SEQ ID NO: 59137 - DNA, 528 bp, Homo sapiens
  misc_feature 1..528: note = chr22:42310220-42310748
  misc_feature 1..528: note = hyper
  source 1..528: mol_type = genomic DNA
gcgctgcgacgccgcacacagcgtagacggccgtatggctgcgctcgcggccggggtcccggggcgctgcggtgtcgcgggcgcgggcgggcggccggcctgtctggacccaggccggcgtgtcgtagttggaacagcggctctggtcgaggcgccgcggcccgtcgtggcagcagaagcggtagccgcacgtgccgcagcagaagctgtaggctccggagctgcagttgaagggcgggtcccactggcccatcacgtcgtagtagccgcggcagcggtcgcccccctccggggctgtcgtgccgggcgccgcgggaccctgcgcctcgggggctcccgcgcggcccgacggcggccgcgccagcagcaacgcgagccgaagcgcgagcgcgagccggaggccgggaggacggcggccgccgagcagtccccgcgccccggcccgcgccatcgggcccgcgcctcccgctactgcgcccggtgcatggccgggcgccgcggctccctccggctcggctcctccgctcc

SEQ ID NO: 59138 - DNA, 165 bp, Homo sapiens
  misc_feature 1..165: note = chr22:42311356-42311521
  misc_feature 1..165: note = hyper
  source 1..165: mol_type = genomic DNA
cctgtaccttacaggcgcggaggtcaaagcagcccggaattgccccgggacgggcagggccaccctctcacctccttcccgtcccctctgtccgttctgatcataacataaggagggccccttcccctctcggcgcctcgattttcccacctgtcaaatgggaag

SEQ ID NO: 59139 - DNA, 65 bp, Homo sapiens; identical to SEQ ID NO: 38565
  misc_feature 1..65: note = chr22:42315616-42315681
  misc_feature 1..65: note = hyper
  source 1..65: mol_type = genomic DNA

SEQ ID NO: 59140 - DNA, 38 bp, Homo sapiens
  misc_feature 1..38: note = chr22:42353573-42353611
  misc_feature 1..38: note = hyper
  source 1..38: mol_type = genomic DNA
gtgatgcttgggcctcgggctctgtgaagcctgaaggt

SEQ ID NO: 59141 - DNA, 132 bp, Homo sapiens
  misc_feature 1..132: note = chr22:42353892-42354024
  misc_feature 1..132: note = hyper
  source 1..132: mol_type = genomic DNA
ctgagccgacttgcaaaggggataggcgggcggcaccgggcgccctcccccagcccgccccgcccgcccagcccggagacccccaaggcagagggaggccggcctgttggccctccacgctatccctctgca

SEQ ID NO: 59142 - DNA, 75 bp, Homo sapiens; identical to SEQ ID NO: 14093
  misc_feature 1..75: note = chr22:42679405-42679480
  misc_feature 1..75: note = hyper
  source 1..75: mol_type = genomic DNA

SEQ ID NO: 59143 - DNA, 268 bp, Homo sapiens; identical to SEQ ID NO: 38568
  misc_feature 1..268: note = chr22:42679916-42680184
  misc_feature 1..268: note = hyper
  source 1..268: mol_type = genomic DNA

SEQ ID NO: 59144 - DNA, 59 bp, Homo sapiens; identical to SEQ ID NO: 38569
  misc_feature 1..59: note = chr22:42696044-42696103
  misc_feature 1..59: note = hyper
  source 1..59: mol_type = genomic DNA

SEQ ID NO: 59145 - DNA, 163 bp, Homo sapiens; identical to SEQ ID NO: 38570
  misc_feature 1..163: note = chr22:42896542-42896705
  misc_feature 1..163: note = hyper
  source 1..163: mol_type = genomic DNA

SEQ ID NO: 59146 - DNA, 63 bp, Homo sapiens; identical to SEQ ID NO: 38571
  misc_feature 1..63: note = chr22:43116061-43116124
  misc_feature 1..63: note = hyper
  source 1..63: mol_type = genomic DNA

SEQ ID NO: 59147 - DNA, 85 bp, Homo sapiens; identical to SEQ ID NO: 38572
  misc_feature 1..85: note = chr22:43738565-43738650
  misc_feature 1..85: note = hyper
  source 1..85: mol_type = genomic DNA

SEQ ID NO: 59148 - DNA, 500 bp, Homo sapiens; identical to SEQ ID NO: 38573
  misc_feature 1..500: note = chr22:43739010-43739510
  misc_feature 1..500: note = hyper
  source 1..500: mol_type = genomic DNA

SEQ ID NO: 59149 - DNA, 50 bp, Homo sapiens; identical to SEQ ID NO: 38574
  misc_feature 1..50: note = chr22:43739731-43739781
  misc_feature 1..50: note = hyper
  source 1..50: mol_type = genomic DNA

SEQ ID NO: 59150 - DNA, 259 bp, Homo sapiens
  misc_feature 1..259: note = chr22:43739825-43740084
  misc_feature 1..259: note = hyper
  source 1..259: mol_type = genomic DNA
cgtttcttgagcacctactggggaccgagtgcgggcgaggcagcagcgaaggaaccgggaggggaaacctcgtgaagatcacttgaaaattgacgttcaaaacaaacgaactttttagcactcgtcaaaggacagtggcccgtcagtgtgcttgtcacggggcggccgcaggacctgcgtctggaaccgggcgggcgcccgggacggacaatgccgcttggcggtcggtcccgcgggaggcccccgcacggggctaacc

SEQ ID NO: 59151 - DNA, 33 bp, Homo sapiens
  misc_feature 1..33: note = chr22:43740128-43740161
  misc_feature 1..33: note = hyper
  source 1..33: mol_type = genomic DNA
cccctgtgacagaccgggcggggccaggaggag

SEQ ID NO: 59152 - DNA, 81 bp, Homo sapiens; identical to SEQ ID NO: 23580
  misc_feature 1..81: note = chr22:44258285-44258366
  misc_feature 1..81: note = hyper
  source 1..81: mol_type = genomic DNA

SEQ ID NO: 59153 - DNA, 13 bp, Homo sapiens
  misc_feature 1..13: note = chr22:44258506-44258519
  misc_feature 1..13: note = hyper
  source 1..13: mol_type = genomic DNA
tcctccccgcccc

SEQ ID NO: 59154 - DNA, 72 bp, Homo sapiens; identical to SEQ ID NO: 38578
  misc_feature 1..72: note = chr22:44263900-44263972
  misc_feature 1..72: note = hyper
  source 1..72: mol_type = genomic DNA

SEQ ID NO: 59155 - DNA, 206 bp, Homo sapiens
  misc_feature 1..206: note = chr22:44287444-44287650
  misc_feature 1..206: note = hyper
  source 1..206: mol_type = genomic DNA
taaatgaggctgtgccgggggtagagggcgcagagcacagcgccaggcaccagcgtctctgggctcgatccgctttcattaagctgtccccgccccttttcgcccccgcggtccgggactcaccgaccgacttgccgcagacgatgctgactgcgttgagcgccccagacgaggaaccgtagatgcggcgggcgccctggaggagg

SEQ ID NO: 59156 - DNA, 103 bp, Homo sapiens
  misc_feature 1..103: note = chr22:44287696-44287799
  misc_feature 1..103: note = hyper
  source 1..103: mol_type = genomic DNA
cgcccaggtagccggcgccggagaaggacaggttccatctgccctcctcctctaagaagcccatggcgggtggaccgggcggggtgatcgggacgaggaaggg

SEQ ID NO: 59157 - DNA, 37 bp, Homo sapiens; identical to SEQ ID NO: 38580
  misc_feature 1..37: note = chr22:44319869-44319906
  misc_feature 1..37: note = hyper
  source 1..37: mol_type = genomic DNA

SEQ ID NO: 59158 - DNA, 82 bp, Homo sapiens; identical to SEQ ID NO: 38581
  misc_feature 1..82: note = chr22:44320125-44320207
  misc_feature 1..82: note = hyper
  source 1..82: mol_type = genomic DNA

SEQ ID NO: 59159 - DNA, 193 bp, Homo sapiens; identical to SEQ ID NO: 38582
  misc_feature 1..193: note = chr22:44420487-44420680
  misc_feature 1..193: note = hyper
  source 1..193: mol_type = genomic DNA

SEQ ID NO: 59160 - DNA, 139 bp, Homo sapiens; identical to SEQ ID NO: 14101
  misc_feature 1..139: note = chr22:44726839-44726978
  misc_feature 1..139: note = hyper
  source 1..139: mol_type = genomic DNA

SEQ ID NO: 59161 - DNA, 884 bp, Homo sapiens; identical to SEQ ID NO: 38584
  misc_feature 1..884: note = chr22:44727367-44728251
  misc_feature 1..884: note = hyper
  source 1..884: mol_type = genomic DNA

SEQ ID NO: 59162 - DNA, 57 bp, Homo sapiens; identical to SEQ ID NO: 38585
  misc_feature 1..57: note = chr22:45016369-45016426
  misc_feature 1..57: note = hyper
  source 1..57: mol_type = genomic DNA

SEQ ID NO: 59163 - DNA, 84 bp, Homo sapiens
  misc_feature 1..84: note = chr22:45403002-45403086
  misc_feature 1..84: note = hyper
  source 1..84: mol_type = genomic DNA
actgaaaagggttagcgcatttgtcccaagccttcggtccagcccggcggcccagaccaggcgcgggccgcggcactgccatct

SEQ ID NO: 59164 - DNA, 47 bp, Homo sapiens
  misc_feature 1..47: note = chr22:45403133-45403180
  misc_feature 1..47: note = hyper
  source 1..47: mol_type = genomic DNA
ccccctcccatcactttttaactttaaagactcgacacgaacgcccg

SEQ ID NO: 59165 - DNA, 30 bp, Homo sapiens; identical to SEQ ID NO: 38587
  misc_feature 1..30: note = chr22:45403911-45403941
  misc_feature 1..30: note = hyper
  source 1..30: mol_type = genomic DNA

SEQ ID NO: 59166 - DNA, 284 bp, Homo sapiens
  misc_feature 1..284: note = chr22:45404433-45404717
  misc_feature 1..284: note = hyper
  source 1..284: mol_type = genomic DNA
cgctgagcgcggcgatccgcggctgcctttcgtggagctgcttcttgaggtcgccgttctgcggaaacacggaggagcgggctcaggcaggccacccggggtcaggtgcaccccagcaccgcgggccgcggcaccccccgcccggagccccacgggcggggccggccgcagcgcaccccaagtttcccgggccgcgtcctgcacgcgcggcggccgggcagtgccgcgcggggccgcttacctgtggctgccgcctcatcggggcagctcgcggggcggggcgg

SEQ ID NO: 59167 - DNA, 257 bp, Homo sapiens
  misc_feature 1..257: note = chr22:45405061-45405318
  misc_feature 1..257: note = hyper
  source 1..257: mol_type = genomic DNA
gggaccggctcacgaaggggccccctccaggcaccctcccagtcatgcagaccctacatcgcttaagagaagactccaggctcgggtcccacgcgtcctcgatcccgcaaactgtgcaggacagcgccaggggcaggcggaggggagcccagaagggggtccgcgcgtgtgctcactccctcgccccccgcccccgggcaggctccagcctggaagacccagagacccggaagagaggatgctgggctcgggtcccc

SEQ ID NO: 59168 - DNA, 14 bp, Homo sapiens
  misc_feature 1..14: note = chr22:45405418-45405432
  misc_feature 1..14: note = hyper
  source 1..14: mol_type = genomic DNA
ctgcagctccatcc

SEQ ID NO: 59169 - DNA, 144 bp, Homo sapiens
  misc_feature 1..144: note = chr22:45405476-45405620
  misc_feature 1..144: note = hyper
  source 1..144: mol_type = genomic DNA
cgggaagttgcgcggctccgcgggggccagagcgggcgcgggcggacgcggcctccgggctgggttgggggggacacgagccccctcccccacggccgaaagggaagggggctggcgaaggggaagacaggcttccgggcgccg

SEQ ID NO: 59170 - DNA, 232 bp, Homo sapiens; identical to SEQ ID NO: 23591
  misc_feature 1..232: note = chr22:45406039-45406271
  misc_feature 1..232: note = hyper
  source 1..232: mol_type = genomic DNA

SEQ ID NO: 59171 - DNA, 57 bp, Homo sapiens
  misc_feature 1..57: note = chr22:45406328-45406385
  misc_feature 1..57: note = hyper
  source 1..57: mol_type = genomic DNA
aattagtcgcgtcgccacattcccccgccgcctgatggcctccgtgttgtttaaaca

SEQ ID NO: 59172 - DNA, 48 bp, Homo sapiens; identical to SEQ ID NO: 38594
  misc_feature 1..48: note = chr22:45680744-45680792
  misc_feature 1..48: note = hyper
  source 1..48: mol_type = genomic DNA

SEQ ID NO: 59173 - DNA, 76 bp, Homo sapiens; identical to SEQ ID NO: 38595
  misc_feature 1..76: note = chr22:45809534-45809610
  misc_feature 1..76: note = hyper
  source 1..76: mol_type = genomic DNA

SEQ ID NO: 59174 - DNA, 34 bp, Homo sapiens; identical to SEQ ID NO: 38596
  misc_feature 1..34: note = chr22:45899024-45899058
  misc_feature 1..34: note = hyper
  source 1..34: mol_type = genomic DNA

SEQ ID NO: 59175 - DNA, 39 bp, Homo sapiens
  misc_feature 1..39: note = chr22:46263809-46263848
  misc_feature 1..39: note = hyper
  source 1..39: mol_type = genomic DNA
ccagactcactgcccacccccggccgagctggctgccag

SEQ ID NO: 59176 - DNA, 58 bp, Homo sapiens; identical to SEQ ID NO: 38600
  misc_feature 1..58: note = chr22:46367066-46367124
  misc_feature 1..58: note = hyper
  source 1..58: mol_type = genomic DNA

SEQ ID NO: 59177 - DNA, 22 bp, Homo sapiens
  misc_feature 1..22: note = chr22:46368102-46368124
  misc_feature 1..22: note = hyper
  source 1..22: mol_type = genomic DNA
cgacagtagaagcatggtgggc

SEQ ID NO: 59178 - DNA, 30 bp, Homo sapiens; identical to SEQ ID NO: 38602
  misc_feature 1..30: note = chr22:46373796-46373826
  misc_feature 1..30: note = hyper
  source 1..30: mol_type = genomic DNA

SEQ ID NO: 59179 - DNA, 132 bp, Homo sapiens; identical to SEQ ID NO: 38603
  misc_feature 1..132: note = chr22:46440571-46440703
  misc_feature 1..132: note = hyper
  source 1..132: mol_type = genomic DNA

SEQ ID NO: 59180 - DNA, 44 bp, Homo sapiens; identical to SEQ ID NO: 38604
  misc_feature 1..44: note = chr22:46512635-46512679
  misc_feature 1..44: note = hyper
  source 1..44: mol_type = genomic DNA

SEQ ID NO: 59181 - DNA, 98 bp, Homo sapiens; identical to SEQ ID NO: 38605
  misc_feature 1..98: note = chr22:46658645-46658743
  misc_feature 1..98: note = hyper
  source 1..98: mol_type = genomic DNA

SEQ ID NO: 59182 - DNA, 207 bp, Homo sapiens; identical to SEQ ID NO: 38606
  misc_feature 1..207: note = chr22:46932741-46932948
  misc_feature 1..207: note = hyper
  source 1..207: mol_type = genomic DNA

SEQ ID NO: 59183 - DNA, 115 bp, Homo sapiens; identical to SEQ ID NO: 38608
  misc_feature 1..115: note = chr22:48885907-48886022
  misc_feature 1..115: note = hyper
  source 1..115: mol_type = genomic DNA

SEQ ID NO: 59184 - DNA, 455 bp, Homo sapiens; identical to SEQ ID NO: 23593
  misc_feature 1..455: note = chr22:48886204-48886659
  misc_feature 1..455: note = hyper
  source 1..455: mol_type = genomic DNA

SEQ ID NO: 59185 - DNA, 111 bp, Homo sapiens
  misc_feature 1..111: note = chr22:48886849-48886960
  misc_feature 1..111: note = hyper
  source 1..111: mol_type = genomic DNA
ctagaaatgctgtggcaccgagcggggaggggtcgccaagcctgggggtctcaacccgagctgcccaggcagacgaggccaccgtgggtgcgccggcgcccctgggaactc

SEQ ID NO: 59186 - DNA, 82 bp, Homo sapiens; identical to SEQ ID NO: 38610
  misc_feature 1..82: note = chr22:48970842-48970924
  misc_feature 1..82: note = hyper
  source 1..82: mol_type = genomic DNA

SEQ ID NO: 59187 - DNA, 201 bp, Homo sapiens; identical to SEQ ID NO: 1525
  misc_feature 1..201: note = chr22:48971758-48971959
  misc_feature 1..201: note = hyper
  source 1..201: mol_type = genomic DNA

SEQ ID NO: 59188 - DNA, 176 bp, Homo sapiens; identical to SEQ ID NO: 1526
  misc_feature 1..176: note = chr22:48971960-48972136
  misc_feature 1..176: note = hyper
  source 1..176: mol_type = genomic DNA

SEQ ID NO: 59189 - DNA, 120 bp, Homo sapiens; identical to SEQ ID NO: 38615
  misc_feature 1..120: note = chr22:50242347-50242467
  misc_feature 1..120: note = hyper
  source 1..120: mol_type = genomic DNA

SEQ ID NO: 59190 - DNA, 775 bp, Homo sapiens; identical to SEQ ID NO: 38616
  misc_feature 1..775: note = chr22:50242748-50243523
  misc_feature 1..775: note = hyper
  source 1..775: mol_type = genomic DNA

SEQ ID NO: 59191 - DNA, 154 bp, Homo sapiens; identical to SEQ ID NO: 38617
  misc_feature 1..154: note = chr22:50421887-50422041
  misc_feature 1..154: note = hyper
  source 1..154: mol_type = genomic DNA

SEQ ID NO: 59192 - DNA, 53 bp, Homo sapiens; identical to SEQ ID NO: 38618
  misc_feature 1..53: note = chr22:50453483-50453536
  misc_feature 1..53: note = hyper
  source 1..53: mol_type = genomic DNA

SEQ ID NO: 59193 - DNA, 176 bp, Homo sapiens; identical to SEQ ID NO: 23599
  misc_feature 1..176: note = chr22:50496971-50497147
  misc_feature 1..176: note = hyper
  source 1..176: mol_type = genomic DNA

SEQ ID NO: 59194 - DNA, 12 bp, Homo sapiens
  misc_feature 1..12: note = chr22:50497287-50497299
  misc_feature 1..12: note = hyper
  source 1..12: mol_type = genomic DNA
ggggtcccacgc

SEQ ID NO: 59195 - DNA, 30 bp, Homo sapiens; identical to SEQ ID NO: 38621
  misc_feature 1..30: note = chr22:50609166-50609196
  misc_feature 1..30: note = hyper
  source 1..30: mol_type = genomic DNA

SEQ ID NO: 59196 - DNA, 48 bp, Homo sapiens
  misc_feature 1..48: note = chr22:50623624-50623672
  misc_feature 1..48: note = hyper
  source 1..48: mol_type = genomic DNA
ccccctggaggcctccggacgatcggaagtgactgagcgtccgggtcc

SEQ ID NO: 59197 - DNA, 63 bp, Homo sapiens
  misc_feature 1..63: note = chr22:50623815-50623878
  misc_feature 1..63: note = hyper
  source 1..63: mol_type = genomic DNA
cccgggtcggggaccgctctgggccgacccccggaggacggactaggccgatccccagaggga

SEQ ID NO: 59198 - DNA, 44 bp, Homo sapiens; identical to SEQ ID NO: 38624
  misc_feature 1..44: note = chr22:50987052-50987096
  misc_feature 1..44: note = hyper
  source 1..44: mol_type = genomic DNA

SEQ ID NO: 59199 - DNA, 38 bp, Homo sapiens; identical to SEQ ID NO: 38627
  misc_feature 1..38: note = chr22:51111972-51112010
  misc_feature 1..38: note = hyper
  source 1..38: mol_type = genomic DNA

SEQ ID NO: 59200 - DNA, 124 bp, Homo sapiens
  misc_feature 1..124: note = chr22:51112026-51112150
  misc_feature 1..124: note = hyper
  source 1..124: mol_type = genomic DNA
cgtaaaactaaaattcacttcccagtcgcaggtggagactagtagcgccccctcccctaggcccttccccgtaggtcgcgcccccatcccgccgtcgctaaggtgacggggagggggcgacagg

SEQ ID NO: 59201 - DNA, 158 bp, Homo sapiens; identical to SEQ ID NO: 38629
  misc_feature 1..158: note = chrX:2846239-2846397
  misc_feature 1..158: note = hyper
  source 1..158: mol_type = genomic DNA

SEQ ID NO: 59202 - DNA, 42 bp, Homo sapiens; identical to SEQ ID NO: 38630
  misc_feature 1..42: note = chrX:2846814-2846856
  misc_feature 1..42: note = hyper
  source 1..42: mol_type = genomic DNA

SEQ ID NO: 59203 - DNA, 53 bp, Homo sapiens; identical to SEQ ID NO: 38631
  misc_feature 1..53: note = chrX:2847143-2847196
  misc_feature 1..53: note = hyper
  source 1..53: mol_type = genomic DNA

SEQ ID NO: 59204 - DNA, 289 bp, Homo sapiens; identical to SEQ ID NO: 38632
  misc_feature 1..289: note = chrX:3263410-3263699
  misc_feature 1..289: note = hyper
  source 1..289: mol_type = genomic DNA

SEQ ID NO: 59205 - DNA, 45 bp, Homo sapiens; identical to SEQ ID NO: 38633
  misc_feature 1..45: note = chrX:3264124-3264169
  misc_feature 1..45: note = hyper
  source 1..45: mol_type = genomic DNA

SEQ ID NO: 59206 - DNA, 238 bp, Homo sapiens; identical to SEQ ID NO: 38634
  misc_feature 1..238: note = chrX:3264775-3265013
  misc_feature 1..238: note = hyper
  source 1..238: mol_type = genomic DNA

SEQ ID NO: 59207 - DNA, 29 bp, Homo sapiens
  misc_feature 1..29: note = chrX:3265150-3265179
  misc_feature 1..29: note = hyper
  source 1..29: mol_type = genomic DNA
cgggctggccccgccggcatcccactagc

SEQ ID NO: 59208 - DNA, 25 bp, Homo sapiens
  misc_feature 1..25: note = chrX:6143655-6143680
  misc_feature 1..25: note = hyper
  source 1..25: mol_type = genomic DNA
ctggcaattctgcttcgtcaggata

SEQ ID NO: 59209 - DNA, 145 bp, Homo sapiens; identical to SEQ ID NO: 38637
  misc_feature 1..145: note = chrX:6143800-6143945
  misc_feature 1..145: note = hyper
  source 1..145: mol_type = genomic DNA

SEQ ID NO: 59210 - DNA, 39 bp, Homo sapiens; identical to SEQ ID NO: 38638
  misc_feature 1..39: note = chrX:6144250-6144289
  misc_feature 1..39: note = hyper
  source 1..39: mol_type = genomic DNA

SEQ ID NO: 59211 - DNA, 92 bp, Homo sapiens; identical to SEQ ID NO: 38639
  misc_feature 1..92: note = chrX:6144913-6145005
  misc_feature 1..92: note = hyper
  source 1..92: mol_type = genomic DNA

SEQ ID NO: 59212 - DNA, 88 bp, Homo sapiens; identical to SEQ ID NO: 23608
  misc_feature 1..88: note = chrX:6145243-6145331
  misc_feature 1..88: note = hyper
  source 1..88: mol_type = genomic DNA

SEQ ID NO: 59213 - DNA, 32 bp, Homo sapiens
  misc_feature 1..32: note = chrX:6145688-6145720
  misc_feature 1..32: note = hyper
  source 1..32: mol_type = genomic DNA
tggagcccgctccccggtttacagaagcagcc

SEQ ID NO: 59214 - DNA, 15 bp, Homo sapiens
  misc_feature 1..15: note = chrX:6145835-6145850
  misc_feature 1..15: note = hyper
  source 1..15: mol_type = genomic DNA
cgtcatcttatccga

SEQ ID NO: 59215 - DNA, 47 bp, Homo sapiens; identical to SEQ ID NO: 38642
  misc_feature 1..47: note = chrX:8698504-8698551
  misc_feature 1..47: note = hyper
  source 1..47: mol_type = genomic DNA

SEQ ID NO: 59216 - DNA, 109 bp, Homo sapiens
  misc_feature 1..109: note = chrX:8698754-8698863
  misc_feature 1..109: note = hyper
  source 1..109: mol_type = genomic DNA
agagtttccctgaagcgagaaattgggaacttggaacaggtgggcacctagggatagaggcgagaagaagaaggagagaaggatgagagaagagaaaaataagcggagg

SEQ ID NO: 59217 - DNA, 161 bp, Homo sapiens; identical to SEQ ID NO: 23611
  misc_feature 1..161: note = chrX:8698897-8699058
  misc_feature 1..161: note = hyper
  source 1..161: mol_type = genomic DNA

SEQ ID NO: 59218 - DNA, 89 bp, Homo sapiens; identical to SEQ ID NO: 38644
  misc_feature 1..89: note = chrX:8699110-8699199
  misc_feature 1..89: note = hyper
  source 1..89: mol_type = genomic DNA

SEQ ID NO: 59219 - skipped

SEQ ID NO: 59220 - DNA, 80 bp, Homo sapiens; identical to SEQ ID NO: 38646
  misc_feature 1..80: note = chrX:8700319-8700399
  misc_feature 1..80: note = hyper
  source 1..80: mol_type = genomic DNA

SEQ ID NO: 59221 - DNA, 80 bp, Homo sapiens; identical to SEQ ID NO: 38647
  misc_feature 1..80: note = chrX:13707316-13707396
  misc_feature 1..80: note = hyper
  source 1..80: mol_type = genomic DNA

SEQ ID NO: 59222 - DNA, 114 bp, Homo sapiens; identical to SEQ ID NO: 38648
  misc_feature 1..114: note = chrX:13955908-13956022
  misc_feature 1..114: note = hyper
  source 1..114: mol_type = genomic DNA

SEQ ID NO: 59223 - DNA, 241 bp, Homo sapiens; identical to SEQ ID NO: 38649
  misc_feature 1..241: note = chrX:13956288-13956529
  misc_feature 1..241: note = hyper
  source 1..241: mol_type = genomic DNA

SEQ ID NO: 59224 - DNA, 326 bp, Homo sapiens; identical to SEQ ID NO: 38650
  misc_feature 1..326: note = chrX:13956748-13957074
  misc_feature 1..326: note = hyper
  source 1..326: mol_type = genomic DNA

SEQ ID NO: 59225 - DNA, 125 bp, Homo sapiens; identical to SEQ ID NO: 38651
  misc_feature 1..125: note = chrX:15756104-15756229
  misc_feature 1..125: note = hyper
  source 1..125: mol_type = genomic DNA

SEQ ID NO: 59226 - DNA, 195 bp, Homo sapiens; identical to SEQ ID NO: 38652
  misc_feature 1..195: note = chrX:16729945-16730140
  misc_feature 1..195: note = hyper
  source 1..195: mol_type = genomic DNA

SEQ ID NO: 59227 - DNA, 161 bp, Homo sapiens; identical to SEQ ID NO: 38653
  misc_feature 1..161: note = chrX:16730152-16730313
  misc_feature 1..161: note = hyper
  source 1..161: mol_type = genomic DNA

SEQ ID NO: 59228 - DNA, 30 bp, Homo sapiens; identical to SEQ ID NO: 38654
  misc_feature 1..30: note = chrX:16730872-16730902
  misc_feature 1..30: note = hyper
  source 1..30: mol_type = genomic DNA

SEQ ID NO: 59229 - DNA, 30 bp, Homo sapiens; identical to SEQ ID NO: 38655
  misc_feature 1..30: note = chrX:33744540-33744570
  misc_feature 1..30: note = hyper
  source 1..30: mol_type = genomic DNA

SEQ ID NO: 59230 - DNA, 33 bp, Homo sapiens; identical to SEQ ID NO: 38656
  misc_feature 1..33: note = chrX:40017591-40017624
  misc_feature 1..33: note = hyper
  source 1..33: mol_type = genomic DNA

SEQ ID NO: 59231 - DNA, 69 bp, Homo sapiens; identical to SEQ ID NO: 38657
  misc_feature 1..69: note = chrX:40017828-40017897
  misc_feature 1..69: note = hyper
  source 1..69: mol_type = genomic DNA

SEQ ID NO: 59232 - DNA, 44 bp, Homo sapiens; identical to SEQ ID NO: 38658
  misc_feature 1..44: note = chrX:40031390-40031434
  misc_feature 1..44: note = hyper
  source 1..44: mol_type = genomic DNA

SEQ ID NO: 59233 - DNA, 53 bp, Homo sapiens; identical to SEQ ID NO: 38659
  misc_feature 1..53: note = chrX:40034521-40034574
  misc_feature 1..53: note = hyper
  source 1..53: mol_type = genomic DNA

SEQ ID NO: 59234 - DNA, 176 bp, Homo sapiens; identical to SEQ ID NO: 38660
  misc_feature 1..176: note = chrX:91035629-91035805
  misc_feature 1..176: note = hyper
  source 1..176: mol_type = genomic DNA

SEQ ID NO: 59235 - DNA, 136 bp, Homo sapiens; identical to SEQ ID NO: 38661
  misc_feature 1..136: note = chrX:91037072-91037208
  misc_feature 1..136: note = hyper
  source 1..136: mol_type = genomic DNA

SEQ ID NO: 59236 - DNA, 37 bp, Homo sapiens; identical to SEQ ID NO: 38662
  misc_feature 1..37: note = chrX:103087260-103087297
  misc_feature 1..37: note = hyper
  source 1..37: mol_type = genomic DNA

SEQ ID NO: 59237 - DNA, 30 bp, Homo sapiens; identical to SEQ ID NO: 38663
  misc_feature 1..30: note = chrY:4869647-4869677
  misc_feature 1..30: note = hyper
  source 1..30: mol_type = genomic DNA

SEQ ID NO: 59238 - DNA, 80 bp, Homo sapiens; identical to SEQ ID NO: 38664
  misc_feature 1..80: note = AC211950.2_11234-25326:40-120
  misc_feature 1..80: note = hyper
  source 1..80: mol_type = genomic DNA

SEQ ID NO: 59239 - DNA, 227 bp, Homo sapiens
  misc_feature 1..227: note = AC211950.2_11234-25326:13516-13743
  misc_feature 1..227: note = hyper
  source 1..227: mol_type = genomic DNA
ttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctg

SEQ ID NO: 59240 - DNA, 60 bp, Homo sapiens; identical to SEQ ID NO: 38667
  misc_feature 1..60: note = AC231386.2_19255-24791:4032-4092
  misc_feature 1..60: note = hyper
  source 1..60: mol_type = genomic DNA

SEQ ID NO: 59241 - DNA, 200 bp, Homo sapiens; identical to SEQ ID NO: 38668
  misc_feature 1..200: note = AC241442.1_28021-33880:358-558
  misc_feature 1..200: note = hyper
  source 1..200: mol_type = genomic DNA

SEQ ID NO: 59242 - DNA, 137 bp, Homo sapiens
  misc_feature 1..137: note = AC241851.2_88-34049:15124-15261
  misc_feature 1..137: note = hyper
  source 1..137: mol_type = genomic DNA
cggcttcttgcccccaccgcccgggctttttgcgccgcggctttttgctgctatttgtccctgccaccgcggcgttttgcccccgcagccgcggctccttgccccctacgcggcttcctgcctccgccaccgtggct

SEQ ID NO: 59243 - DNA, 194 bp, Homo sapiens
  misc_feature 1..194: note = AC241851.2_88-34049:15350-15544
  misc_feature 1..194: note = hyper
  source 1..194: mol_type = genomic DNA
acagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggttttt

SEQ ID NO: 59244 - DNA, 35 bp, Homo sapiens; identical to SEQ ID NO: 38670
  misc_feature 1..35: note = AC241851.2_88-34049:15844-15879
  misc_feature 1..35: note = hyper
  source 1..35: mol_type = genomic DNA

SEQ ID NO: 59245 - DNA, 123 bp, Homo sapiens; identical to SEQ ID NO: 38671
  misc_feature 1..123: note = AEKP01168736.1_1-4752:1196-1319
  misc_feature 1..123: note = hyper
  source 1..123: mol_type = genomic DNA

SEQ ID NO: 59246 - DNA, 125 bp, Homo sapiens
  misc_feature 1..125: note = AEKP01168736.1_1-4752:1629-1754
  misc_feature 1..125: note = hyper
  source 1..125: mol_type = genomic DNA
ggggcgcgtgcaggtcggagccggcaggtgaggagccagggtctaagctagggcccggggtccaaaggaaaggctttcagatctgagctccgcggctctggcggcggtggagctgggagcccgcg

SEQ ID NO: 59247 - DNA, 344 bp, Homo sapiens; identical to SEQ ID NO: 23624
  misc_feature 1..344: note = AEKP01168736.1_1-4752:2287-2631
  misc_feature 1..344: note = hyper
  source 1..344: mol_type = genomic DNA

SEQ ID NO: 59248 - DNA, 30 bp, Homo sapiens; identical to SEQ ID NO: 38674
  misc_feature 1..30: note = AEKP01171767.1_199-12179:11068-11098
  misc_feature 1..30: note = hyper
  source 1..30: mol_type = genomic DNA

SEQ ID NO: 59249 - DNA, 86 bp, Homo sapiens; identical to SEQ ID NO: 38675
  misc_feature 1..86: note = AEKP01197830.1_1-1408:113-199
  misc_feature 1..86: note = hyper
  source 1..86: mol_type = genomic DNA

SEQ ID NO: 59250 - DNA, 43 bp, Homo sapiens; identical to SEQ ID NO: 38676
  misc_feature 1..43: note = AEKP01197830.1_1-1408:476-519
  misc_feature 1..43: note = hyper
  source 1..43: mol_type = genomic DNA

SEQ ID NO: 59251 - DNA, 32 bp, Homo sapiens; identical to SEQ ID NO: 38677
  misc_feature 1..32: note = GL000258.1:893217-893249
  misc_feature 1..32: note = hyper
  source 1..32: mol_type = genomic DNA

SEQ ID NO: 59252 - DNA, 82 bp, Homo sapiens; identical to SEQ ID NO: 14151
  misc_feature 1..82: note = JH159140.1:144237-144319
  misc_feature 1..82: note = hyper
  source 1..82: mol_type = genomic DNA

SEQ ID NO: 59253 - DNA, 170 bp, Homo sapiens; identical to SEQ ID NO: 38679
  misc_feature 1..170: note = JH636052.4:1361659-1361829
  misc_feature 1..170: note = hyper
  source 1..170: mol_type = genomic DNA

SEQ ID NO: 59254 - DNA, 24 bp, Homo sapiens
  misc_feature 1..24: note = JH636052.4:1362108-1362132
  misc_feature 1..24: note = hyper
  source 1..24: mol_type = genomic DNA
gacttgctcctacagcgcgggaaa

SEQ ID NO: 59255 - DNA, 24 bp, Homo sapiens
  misc_feature 1..24: note = JH636052.4:1362192-1362216
  misc_feature 1..24: note = hyper
  source 1..24: mol_type = genomic DNA
tgatgtcaccgacagtgcctttcc

SEQ ID NO: 59256 - DNA, 30 bp, Homo sapiens; identical to SEQ ID NO: 38682
  misc_feature 1..30: note = JH636052.4:2280989-2281019
  misc_feature 1..30: note = hyper
  source 1..30: mol_type = genomic DNA

SEQ ID NO: 59257 - DNA, 76 bp, Homo sapiens; identical to SEQ ID NO: 38683
  misc_feature 1..76: note = JH636052.4:2302666-2302742
  misc_feature 1..76: note = hyper
  source 1..76: mol_type = genomic DNA

SEQ ID NO: 59258 - DNA, 51 bp, Homo sapiens
  misc_feature 1..51: note = JH636052.4:5118718-5118769
  misc_feature 1..51: note = hyper
  source 1..51: mol_type = genomic DNA
ctgcgagggtcaggacggggcgaaggccattccgctgcccttccagcttcg

SEQ ID NO: 59259 - DNA, 26 bp, Homo sapiens
  misc_feature 1..26: note = JH636052.4:5118903-5118929
  misc_feature 1..26: note = hyper
  source 1..26: mol_type = genomic DNA
tgataccagaacgagagttgactgtg

SEQ ID NO: 59260 - DNA, 218 bp, Homo sapiens; identical to SEQ ID NO: 38685
  misc_feature 1..218: note = JH636058.1:413209-413427
  misc_feature 1..218: note = hyper
  source 1..218: mol_type = genomic DNA

SEQ ID NO: 59261 - DNA, 169 bp, Homo sapiens; identical to SEQ ID NO: 38686
  misc_feature 1..169: note = NW_001838403.1_1-2251:175-344
  misc_feature 1..169: note = hyper
  source 1..169: mol_type = genomic DNA

SEQ ID NO: 59262 - DNA, 30 bp, Homo sapiens; identical to SEQ ID NO: 38687
  misc_feature 1..30: note = chr1:865434-865464
  misc_feature 1..30: note = hypo
  source 1..30: mol_type = genomic DNA

SEQ ID NO: 59263 - DNA, 48 bp, Homo sapiens; identical to SEQ ID NO: 38688
  misc_feature 1..48: note = chr1:898728-898776
  misc_feature 1..48: note = hypo
  source 1..48: mol_type = genomic DNA

SEQ ID NO: 59264 - DNA, 149 bp, Homo sapiens; identical to SEQ ID NO: 23630
  misc_feature 1..149: note = chr1:913955-914104
  misc_feature 1..149: note = hypo
  source 1..149: mol_type = genomic DNA

SEQ ID NO: 59265 - DNA, 90 bp, Homo sapiens; identical to SEQ ID NO: 38690
  misc_feature 1..90: note = chr1:918405-918495
  misc_feature 1..90: note = hypo
  source 1..90: mol_type = genomic DNA

SEQ ID NO: 59266 - DNA, 47 bp, Homo sapiens; identical to SEQ ID NO: 38691
  misc_feature 1..47: note = chr1:942338-942385
  misc_feature 1..47: note = hypo
  source 1..47: mol_type = genomic DNA

SEQ ID NO: 59267 - DNA, 30 bp, Homo sapiens; identical to SEQ ID NO: 38692
  misc_feature 1..30: note = chr1:957607-957637
  misc_feature 1..30: note = hypo
  source 1..30: mol_type = genomic DNA

SEQ ID NO: 59268 - DNA, 356 bp, Homo sapiens; identical to SEQ ID NO: 38693
  misc_feature 1..356: note = chr1:986529-986885
  misc_feature 1..356: note = hypo
  source 1..356: mol_type = genomic DNA

SEQ ID NO: 59269 - DNA, 30 bp, Homo sapiens; identical to SEQ ID NO: 38694
  misc_feature 1..30: note = chr1:1045970-1046000
  misc_feature 1..30: note = hypo
  source 1..30: mol_type = genomic DNA

SEQ ID NO: 59270 - DNA, 70 bp, Homo sapiens; identical to SEQ ID NO: 38695
  misc_feature 1..70: note = chr1:1050115-1050185
  misc_feature 1..70: note = hypo
  source 1..70: mol_type = genomic DNA

SEQ ID NO: 59271 - DNA, 160 bp, Homo sapiens; identical to SEQ ID NO: 38696
  misc_feature 1..160: note = chr1:1067634-1067794
  misc_feature 1..160: note = hypo
  source 1..160: mol_type = genomic DNA

SEQ ID NO: 59272 - DNA, 30 bp, Homo sapiens; identical to SEQ ID NO: 38697
  misc_feature 1..30: note = chr1:1080521-1080551
  misc_feature 1..30: note = hypo
  source 1..30: mol_type = genomic DNA

SEQ ID NO: 59273 - DNA, 114 bp, Homo sapiens
  misc_feature 1..114: note = chr1:1080824-1080938
  misc_feature 1..114: note = hypo
  source 1..114: mol_type = genomic DNA
gcacggctgacccaaccccatctcatgactgaccccacctgactttatggctcaccccagtgaccccatggccaaccccacctgacctcatggccgacccgatctgacctcatg

SEQ ID NO: 59274 - DNA, 30 bp, Homo sapiens; identical to SEQ ID NO: 38699
  misc_feature 1..30: note = chr1:1083645-1083675
  misc_feature 1..30: note = hypo
  source 1..30: mol_type = genomic DNA

SEQ ID NO: 59275 - DNA, 30 bp, Homo sapiens; identical to SEQ ID NO: 38700
  misc_feature 1..30: note = chr1:1102634-1102664
  misc_feature 1..30: note = hypo
  source 1..30: mol_type = genomic DNA

SEQ ID NO: 59276 - DNA, 159 bp, Homo sapiens; identical to SEQ ID NO: 38701
  misc_feature 1..159: note = chr1:1145553-1145712
  misc_feature 1..159: note = hypo
  source 1..159: mol_type = genomic DNA

SEQ ID NO: 59277 - DNA, 41 bp, Homo sapiens; identical to SEQ ID NO: 23635
  misc_feature 1..41: note = chr1:1146693-1146734
  misc_feature 1..41: note = hypo
  source 1..41: mol_type = genomic DNA

SEQ ID NO: 59278 - DNA, 39 bp, Homo sapiens
  misc_feature 1..39: note = chr1:1146818-1146857
  misc_feature 1..39: note = hypo
  source 1..39: mol_type = genomic DNA
tgcagagttggcccaggagcgtggcggggcaggcggcct

SEQ ID NO: 59279 - DNA, 126 bp, Homo sapiens; identical to SEQ ID NO: 38703
  misc_feature 1..126: note = chr1:1168843-1168969
  misc_feature 1..126: note = hypo
  source 1..126: mol_type = genomic DNA

SEQ ID NO: 59280 - DNA, 33 bp, Homo sapiens; identical to SEQ ID NO: 38704
  misc_feature 1..33: note = chr1:1173925-1173958
  misc_feature 1..33: note = hypo
  source 1..33: mol_type = genomic DNA

SEQ ID NO: 59281 - DNA, 42 bp, Homo sapiens; identical to SEQ ID NO: 38706
  misc_feature 1..42: note = chr1:1234718-1234760
  misc_feature 1..42: note = hypo
  source 1..42: mol_type = genomic DNA

SEQ ID NO: 59282 - DNA, 103 bp, Homo sapiens; identical to SEQ ID NO: 38707
  misc_feature 1..103: note = chr1:1235178-1235281
  misc_feature 1..103: note = hypo
  source 1..103: mol_type = genomic DNA

SEQ ID NO: 59283 - DNA, 205 bp, Homo sapiens; identical to SEQ ID NO: 38709
  misc_feature 1..205: note = chr1:1238277-1238482
  misc_feature 1..205: note = hypo
  source 1..205: mol_type = genomic DNA

SEQ ID NO: 59284 - DNA, 292 bp, Homo sapiens; identical to SEQ ID NO: 38710
  misc_feature 1..292: note = chr1:1245060-1245352
  misc_feature 1..292: note = hypo
  source 1..292: mol_type = genomic DNA

SEQ ID NO: 59285 - DNA, 22 bp, Homo sapiens
  misc_feature 1..22: note = chr1:1253533-1253555
  misc_feature 1..22: note = hypo
  source 1..22: mol_type = genomic DNA
gccaccgcgcctggccaaggca

SEQ ID NO: 59286 - DNA, 311 bp, Homo sapiens
  misc_feature 1..311: note = chr1:1267151-1267462
  misc_feature 1..311: note = hypo
  source 1..311: mol_type = genomic DNA
ccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttctt

SEQ ID NO: 59287 - DNA, 207 bp, Homo sapiens; identical to SEQ ID NO: 23640
  misc_feature 1..207: note = chr1:1267699-1267906
  misc_feature 1..207: note = hypo
  source 1..207: mol_type = genomic DNA

SEQ ID NO: 59288 - DNA, 27 bp, Homo sapiens
  misc_feature 1..27: note = chr1:1268158-1268185
  misc_feature 1..27: note = hypo
  source 1..27: mol_type = genomic DNA
cgcgcaggaccccgtgaagccctggca

SEQ ID NO: 59289 - DNA, 88 bp, Homo sapiens; identical to SEQ ID NO: 38713
  misc_feature 1..88: note = chr1:1309067-1309155
  misc_feature 1..88: note = hypo
  source 1..88: mol_type = genomic DNA

SEQ ID NO: 59290 - DNA, 69 bp, Homo sapiens
  misc_feature 1..69: note = chr1:1341743-1341812
  misc_feature 1..69: note = hypo
  source 1..69: mol_type = genomic DNA
aaaccggggtacgttagatgctaggttcatgaggctgagacgggagtggtgaggcgcagtaatgaggcg

SEQ ID NO: 59291 - DNA, 46 bp, Homo sapiens; identical to SEQ ID NO: 38715
  misc_feature 1..46: note = chr1:1363856-1363902
  misc_feature 1..46: note = hypo
  source 1..46: mol_type = genomic DNA

SEQ ID NO: 59292 - DNA, 30 bp, Homo sapiens; identical to SEQ ID NO: 38716
  misc_feature 1..30: note = chr1:1483034-1483064
  misc_feature 1..30: note = hypo
  source 1..30: mol_type = genomic DNA

SEQ ID NO: 59293 - DNA, 23 bp, Homo sapiens
  misc_feature 1..23: note = chr1:1563170-1563193
  misc_feature 1..23: note = hypo
  source 1..23: mol_type = genomic DNA
cgggccctgtgtgagcgcggctg

SEQ ID NO: 59294 - DNA, 36 bp, Homo sapiens
  misc_feature 1..36: note = chr1:1563223-1563259
  misc_feature 1..36: note = hypo
  source 1..36: mol_type = genomic DNA
ctggcctgggtgccccctgcccgtgagtgcttgtcc

SEQ ID NO: 59295 - DNA, 103 bp, Homo sapiens; identical to SEQ ID NO: 38718
  misc_feature 1..103: note = chr1:1563663-1563766
  misc_feature 1..103: note = hypo
  source 1..103: mol_type = genomic DNA

SEQ ID NO: 59296 - DNA, 62 bp, Homo sapiens; identical to SEQ ID NO: 38719
  misc_feature 1..62: note = chr1:1625749-1625811
  misc_feature 1..62: note = hypo
  source 1..62: mol_type = genomic DNA

SEQ ID NO: 59297 - DNA, 24 bp, Homo sapiens
  misc_feature 1..24: note = chr1:1671766-1671790
  misc_feature 1..24: note = hypo
  source 1..24: mol_type = genomic DNA
tctttttttttgagacgggagtct

SEQ ID NO: 59298 - DNA, 20 bp, Homo sapiens
  misc_feature 1..20: note = chr1:1839158-1839178
  misc_feature 1..20: note = hypo
  source 1..20: mol_type = genomic DNA
ttttgttttttgagacggag

SEQ ID NO: 59299 - DNA, 140 bp, Homo sapiens; identical to SEQ ID NO: 38722
  misc_feature 1..140: note = chr1:1856211-1856351
  misc_feature 1..140: note = hypo
  source 1..140: mol_type = genomic DNA

SEQ ID NO: 59300 - DNA, 30 bp, Homo sapiens; identical to SEQ ID NO: 38723
  misc_feature 1..30: note = chr1:1861852-1861882
  misc_feature 1..30: note = hypo
  source 1..30: mol_type = genomic DNA

SEQ ID NO: 59301 - DNA, 410 bp, Homo sapiens; identical to SEQ ID NO: 38725
  misc_feature 1..410: note = chr1:1914707-1915117
  misc_feature 1..410: note = hypo
  source 1..410: mol_type = genomic DNA

SEQ ID NO: 59302 - DNA, 69 bp, Homo sapiens; identical to SEQ ID NO: 38726
  misc_feature 1..69: note = chr1:1974645-1974714
  misc_feature 1..69: note = hypo
  source 1..69: mol_type = genomic DNA

SEQ ID NO: 59303 - DNA, 30 bp, Homo sapiens; identical to SEQ ID NO: 38727
  misc_feature 1..30: note = chr1:1986234-1986264
  misc_feature 1..30: note = hypo
  source 1..30: mol_type = genomic DNA

SEQ ID NO: 59304 - DNA, 177 bp, Homo sapiens; identical to SEQ ID NO: 38728
  misc_feature 1..177: note = chr1:2013405-2013582
  misc_feature 1..177: note = hypo
  source 1..177: mol_type = genomic DNA

SEQ ID NO: 59305 - DNA, 138 bp, Homo sapiens
  misc_feature 1..138: note = chr1:2066352-2066490
  misc_feature 1..138: note = hypo
  source 1..138: mol_type = genomic DNA
caggcaggggacagacggacccggcctgcgttggcctggggtgacttcacggctccactgtcagcaagcggccgtcccgtggtggatcctgtccgccctgcgaggacacctggctccatccacacctgggcctctgtc

SEQ ID NO: 59306 - DNA, 32 bp, Homo sapiens
  misc_feature 1..32: note = chr1:2125483-2125515
  misc_feature 1..32: note = hypo
  source 1..32: mol_type = genomic DNA
gctccgggctcaccgtgcgcagtagctcggcc

SEQ ID NO: 59307 - DNA, 88 bp, Homo sapiens; identical to SEQ ID NO: 38731
  misc_feature 1..88: note = chr1:2141596-2141684
  misc_feature 1..88: note = hypo
  source 1..88: mol_type = genomic DNA

SEQ ID NO: 59308 - DNA, 36 bp, Homo sapiens; identical to SEQ ID NO: 38732
  misc_feature 1..36: note = chr1:2170934-2170970
  misc_feature 1..36: note = hypo
  source 1..36: mol_type = genomic DNA

SEQ ID NO: 59309 - DNA, 38 bp, Homo sapiens; identical to SEQ ID NO: 23645
  misc_feature 1..38: note = chr1:2263131-2263169
  misc_feature 1..38: note = hypo
  source 1..38: mol_type = genomic DNA

SEQ ID NO: 59310 - DNA, 96 bp, Homo sapiens
  misc_feature 1..96: note = chr1:2263263-2263359
  misc_feature 1..96: note = hypo
  source 1..96: mol_type = genomic DNA
tgcgcctctccctcgtgcggctctcccgcccctgcgcctctccctcgtgcgcctctcccgcccctgcgcctctccctcgtgcgcctctcccgcccc

SEQ ID NO: 59311 - DNA, 397 bp, Homo sapiens
  misc_feature 1..397: note = chr1:2267155-2267552
  misc_feature 1..397: note = hypo
  source 1..397: mol_type = genomic DNA
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctga

SEQ ID NO: 59312 - DNA, 40 bp, Homo sapiens
  misc_feature 1..40: note = chr1:2267690-2267730
  misc_feature 1..40: note = hypo
  source 1..40: mol_type = genomic DNA
ccacttcatgccagcccaggcaagtcgcagggcagctgtt

SEQ ID NO: 59313 - DNA, 30 bp, Homo sapiens; identical to SEQ ID NO: 38735
  misc_feature 1..30: note = chr1:2268713-2268743
  misc_feature 1..30: note = hypo
  source 1..30: mol_type = genomic DNA

SEQ ID NO: 59314 - DNA, 154 bp, Homo sapiens; identical to SEQ ID NO: 38736
  misc_feature 1..154: note = chr1:2275666-2275820
  misc_feature 1..154: note = hypo
  source 1..154: mol_type = genomic DNA

SEQ ID NO: 59315 - DNA, 111 bp, Homo sapiens; identical to SEQ ID NO: 38737
  misc_feature 1..111: note = chr1:2276089-2276200
  misc_feature 1..111: note = hypo
  source 1..111: mol_type = genomic DNA

SEQ ID NO: 59316 - DNA, 49 bp, Homo sapiens; identical to SEQ ID NO: 14177
  misc_feature 1..49: note = chr1:2307845-2307894
  misc_feature 1..49: note = hypo
  source 1..49: mol_type = genomic DNA

SEQ ID NO: 59317 - DNA, 271 bp, Homo sapiens
  misc_feature 1..271: note = chr1:2308105-2308376
  misc_feature 1..271: note = hypo
  source 1..271: mol_type = genomic DNA
ccccctccctgggtgcgcagcaatcaggtcagggcttggcatcctcggtacccaccgctggtgtccgggtgggagggctgagccaggcaagctttcatgcagcacttggtcagtccaagcacatttgagtgatcaattcaactgatccaatagcccggtcttgtctaattcacgttatcaatcacacctttgacaattcggctgtttctgtttcatgtaccccaagcaggaacgagcaagagcttattaaatagggtgcaggggaggctcc

SEQ ID NO: 59318 - DNA, 22 bp, Homo sapiens
  misc_feature 1..22: note = chr1:2308636-2308658
  misc_feature 1..22: note = hypo
  source 1..22: mol_type = genomic DNA
ggtcacacgacctttggggaag

SEQ ID NO: 59319 - DNA, 18 bp, Homo sapiens
  misc_feature 1..18: note = chr1:2309850-2309868
  misc_feature 1..18: note = hypo
  source 1..18: mol_type = genomic DNA
ggcagtaggcccaaacgt

SEQ ID NO: 59320 - DNA, 30 bp, Homo sapiens; identical to SEQ ID NO: 38742
  misc_feature 1..30: note = chr1:2310214-2310244
  misc_feature 1..30: note = hypo
  source 1..30: mol_type = genomic DNA

SEQ ID NO: 59321 - DNA, 30 bp, Homo sapiens; identical to SEQ ID NO: 38744
  misc_feature 1..30: note = chr1:2336335-2336365
  misc_feature 1..30: note = hypo
  source 1..30: mol_type = genomic DNA

SEQ ID NO: 59322 - DNA, 174 bp, Homo sapiens; identical to SEQ ID NO: 38745
  misc_feature 1..174: note = chr1:2338063-2338237
  misc_feature 1..174: note = hypo
  source 1..174: mol_type = genomic DNA

SEQ ID NO: 59323 - DNA, 348 bp, Homo sapiens; identical to SEQ ID NO: 14181
  misc_feature 1..348: note = chr1:2359972-2360320
  misc_feature 1..348: note = hypo
  source 1..348: mol_type = genomic DNA

SEQ ID NO: 59324 - DNA, 62 bp, Homo sapiens; identical to SEQ ID NO: 38747
  misc_feature 1..62: note = chr1:2382732-2382794
  misc_feature 1..62: note = hypo
  source 1..62: mol_type = genomic DNA

SEQ ID NO: 59325 - skipped

SEQ ID NO: 59326 - DNA, 162 bp, Homo sapiens
  misc_feature 1..162: note = chr1:2397031-2397193
  misc_feature 1..162: note = hypo
  source 1..162: mol_type = genomic DNA
acctgccacccgccgggccaaatgctctcaaagacagaattctgcttaaatgcccagaaaagagatttaggagatcagaatcttaagcaaattaacatgtgcagcgggcggcttttaatcaccgcctttaatcgcaggccgcggtgacggaaatcatctcct

SEQ ID NO: 59327 - DNA, 133 bp, Homo sapiens
  misc_feature 1..133: note = chr1:2428198-2428331
  misc_feature 1..133: note = hypo
  source 1..133: mol_type = genomic DNA
tgctatgctgctgggcgccgggcgaggtcgaggactggcagtctgatgcccggtcaccggcgccacagcggcgtccagctggcaggtgtcgtccttcagcgagaccaaggcccaccagattctgcagcagaag

SEQ ID NO: 59328 - DNA, 30 bp, Homo sapiens; identical to SEQ ID NO: 38750
  misc_feature 1..30: note = chr1:2430463-2430493
  misc_feature 1..30: note = hypo
  source 1..30: mol_type = genomic DNA

SEQ ID NO: 59329 - DNA, 30 bp, Homo sapiens; identical to SEQ ID NO: 38751
  misc_feature 1..30: note = chr1:2437269-2437299
  misc_feature 1..30: note = hypo
  source 1..30: mol_type = genomic DNA

SEQ ID NO: 59330 - DNA, 136 bp, Homo sapiens; identical to SEQ ID NO: 38752
  misc_feature 1..136: note = chr1:2468656-2468792
  misc_feature 1..136: note = hypo
  source 1..136: mol_type = genomic DNA

SEQ ID NO: 59331 - DNA, 18 bp, Homo sapiens
  misc_feature 1..18: note = chr1:2507045-2507063
  misc_feature 1..18: note = hypo
  source 1..18: mol_type = genomic DNA
ctcacaggctcacagcgg

SEQ ID NO: 59332 - DNA, 81 bp, Homo sapiens; identical to SEQ ID NO: 38754
  misc_feature 1..81: note = chr1:2519808-2519889
  misc_feature 1..81: note = hypo
  source 1..81: mol_type = genomic DNA

SEQ ID NO: 59333 - DNA, 51 bp, Homo sapiens; identical to SEQ ID NO: 38755
  misc_feature 1..51: note = chr1:2527420-2527471
  misc_feature 1..51: note = hypo
  source 1..51: mol_type = genomic DNA

SEQ ID NO: 59334 - DNA, 66 bp, Homo sapiens; identical to SEQ ID NO: 14186
  misc_feature 1..66: note = chr1:2537084-2537150
  misc_feature 1..66: note = hypo
  source 1..66: mol_type = genomic DNA

SEQ ID NO: 59335 - DNA, 125 bp, Homo sapiens; identical to SEQ ID NO: 38757
  misc_feature 1..125: note = chr1:2537758-2537883
  misc_feature 1..125: note = hypo
  source 1..125: mol_type = genomic DNA

SEQ ID NO: 59336 - DNA, 47 bp, Homo sapiens; identical to SEQ ID NO: 38758
  misc_feature 1..47: note = chr1:2702425-2702472
  misc_feature 1..47: note = hypo
  source 1..47: mol_type = genomic DNA

SEQ ID NO: 59337 - DNA, 113 bp, Homo sapiens; identical to SEQ ID NO: 14188
  misc_feature 1..113: note = chr1:2708372-2708485
  misc_feature 1..113: note = hypo
  source 1..113: mol_type = genomic DNA

SEQ ID NO: 59338 - DNA, 503 bp, Homo sapiens; identical to SEQ ID NO: 38760
  misc_feature 1..503: note = chr1:2716736-2717239
  misc_feature 1..503: note = hypo
  source 1..503: mol_type = genomic DNA

SEQ ID NO: 59339 - DNA, 163 bp, Homo sapiens; identical to SEQ ID NO: 38761
  misc_feature 1..163: note = chr1:2725529-2725692
  misc_feature 1..163: note = hypo
  source 1..163: mol_type = genomic DNA

SEQ ID NO: 59340 - DNA, 92 bp, Homo sapiens; identical to SEQ ID NO: 38762
  misc_feature 1..92: note = chr1:2725899-2725991
  misc_feature 1..92: note = hypo
  source 1..92: mol_type = genomic DNA

SEQ ID NO: 59341 - DNA, 30 bp, Homo sapiens; identical to SEQ ID NO: 38763
  misc_feature 1..30: note = chr1:2733570-2733600
  misc_feature 1..30: note = hypo
  source 1..30: mol_type = genomic DNA

SEQ ID NO: 59342 - DNA, 90 bp, Homo sapiens; identical to SEQ ID NO: 38764
  misc_feature 1..90: note = chr1:2733660-2733750
  misc_feature 1..90: note = hypo
  source 1..90: mol_type = genomic DNA

SEQ ID NO: 59343 - DNA, 30 bp, Homo sapiens; identical to SEQ ID NO: 38765
  misc_feature 1..30: note = chr1:2770901-2770931
  misc_feature 1..30: note = hypo
  source 1..30: mol_type = genomic DNA

SEQ ID NO: 59344 - DNA, 36 bp, Homo sapiens; identical to SEQ ID NO: 38766
  misc_feature 1..36: note = chr1:2826189-2826225
  misc_feature 1..36: note = hypo
  source 1..36: mol_type = genomic DNA

SEQ ID NO: 59345 - DNA, 36 bp, Homo sapiens; identical to SEQ ID NO: 38767
  misc_feature 1..36: note = chr1:2827849-2827885
  misc_feature 1..36: note = hypo
  source 1..36: mol_type = genomic DNA

SEQ ID NO: 59346 - DNA, 30 bp, Homo sapiens; identical to SEQ ID NO: 38768
  misc_feature 1..30: note = chr1:2830021-2830051
  misc_feature 1..30: note = hypo
  source 1..30: mol_type = genomic DNA

SEQ ID NO: 59347 - DNA, 161 bp, Homo sapiens; identical to SEQ ID NO: 38769
  misc_feature 1..161: note = chr1:2833818-2833979
  misc_feature 1..161: note = hypo
  source 1..161: mol_type = genomic DNA

SEQ ID NO: 59348 - DNA, 30 bp, Homo sapiens; identical to SEQ ID NO: 38770
  misc_feature 1..30: note = chr1:2836432-2836462
  misc_feature 1..30: note = hypo
  source 1..30: mol_type = genomic DNA

SEQ ID NO: 59349 - DNA, 34 bp, Homo sapiens; identical to SEQ ID NO: 38771
  misc_feature 1..34: note = chr1:2840699-2840733
  misc_feature 1..34: note = hypo
  source 1..34: mol_type = genomic DNA

SEQ ID NO: 59350 - DNA, 30 bp, Homo sapiens; identical to SEQ ID NO: 38772
  misc_feature 1..30: note = chr1:2846793-2846823
  misc_feature 1..30: note = hypo
  source 1..30: mol_type = genomic DNA

SEQ ID NO: 59351 - DNA, 43 bp, Homo sapiens; identical to SEQ ID NO: 38773
  misc_feature 1..43: note = chr1:2889049-2889092
  misc_feature 1..43: note = hypo
  source 1..43: mol_type = genomic DNA

SEQ ID NO: 59352 - DNA, 30 bp, Homo sapiens; identical to SEQ ID NO: 38774
  misc_feature 1..30: note = chr1:2918482-2918512
  misc_feature 1..30: note = hypo
  source 1..30: mol_type = genomic DNA

SEQ ID NO: 59353 - DNA, 30 bp, Homo sapiens; identical to SEQ ID NO: 38775
  misc_feature 1..30: note = chr1:2939161-2939191
  misc_feature 1..30: note = hypo
  source 1..30: mol_type = genomic DNA

SEQ ID NO: 59354 - DNA, 45 bp, Homo sapiens; identical to SEQ ID NO: 38776
  misc_feature 1..45: note = chr1:3015491-3015536
  misc_feature 1..45: note = hypo
  source 1..45: mol_type = genomic DNA

SEQ ID NO: 59355 - DNA, 141 bp, Homo sapiens; identical to SEQ ID NO: 38777
  misc_feature 1..141: note = chr1:3035035-3035176
  misc_feature 1..141: note = hypo
  source 1..141: mol_type = genomic DNA

SEQ ID NO: 59356 - DNA, 30 bp, Homo sapiens; identical to SEQ ID NO: 38778
  misc_feature 1..30: note = chr1:3063272-3063302
  misc_feature 1..30: note = hypo
  source 1..30: mol_type = genomic DNA

SEQ ID NO: 59357 - DNA, 30 bp, Homo sapiens; identical to SEQ ID NO: 38779
  misc_feature 1..30: note = chr1:3070343-3070373
  misc_feature 1..30: note = hypo
  source 1..30: mol_type = genomic DNA

SEQ ID NO: 59358 - DNA, 121 bp, Homo sapiens; identical to SEQ ID NO: 38780
  misc_feature 1..121: note = chr1:3078720-3078841
  misc_feature 1..121: note = hypo
  source 1..121: mol_type = genomic DNA

SEQ ID NO: 59359 - DNA, 17 bp, Homo sapiens
  misc_feature 1..17: note = chr1:3102636-3102653
  misc_feature 1..17: note = hypo
  source 1..17: mol_type = genomic DNA
acactgggtggggcacg

SEQ ID NO: 59360 - DNA, 17 bp, Homo sapiens
  misc_feature 1..17: note = chr1:3102779-3102796
  misc_feature 1..17: note = hypo
  source 1..17: mol_type = genomic DNA
gtcgcccatccccgtgg

SEQ ID NO: 59361 - DNA, 136 bp, Homo sapiens; identical to SEQ ID NO: 38782
  misc_feature 1..136: note = chr1:3111327-3111463
  misc_feature 1..136: note = hypo
  source 1..136: mol_type = genomic DNA

SEQ ID NO: 59362 - DNA, 35 bp, Homo sapiens; identical to SEQ ID NO: 38783
  misc_feature 1..35: note = chr1:3129231-3129266
  misc_feature 1..35: note = hypo
  source 1..35: mol_type = genomic DNA

SEQ ID NO: 59363 - DNA, 30 bp, Homo sapiens; identical to SEQ ID NO: 38784
  misc_feature 1..30: note = chr1:3179577-3179607
  misc_feature 1..30: note = hypo
  source 1..30: mol_type = genomic DNA

SEQ ID NO: 59364 - DNA, 70 bp, Homo sapiens; identical to SEQ ID NO: 38785
  misc_feature 1..70: note = chr1:3183016-3183086
  misc_feature 1..70: note = hypo
  source 1..70: mol_type = genomic DNA

SEQ ID NO: 59365 - DNA, 60 bp, Homo sapiens; identical to SEQ ID NO: 38786
  misc_feature 1..60: note = chr1:3184625-3184685
  misc_feature 1..60: note = hypo
  source 1..60: mol_type = genomic DNA

SEQ ID NO: 59366 - DNA, 172 bp, Homo sapiens; identical to SEQ ID NO: 38787
  misc_feature 1..172: note = chr1:3217156-3217328
  misc_feature 1..172: note = hypo
  source 1..172: mol_type = genomic DNA

SEQ ID NO: 59367 - DNA, 30 bp, Homo sapiens; identical to SEQ ID NO: 38788
  misc_feature 1..30: note = chr1:3294711-3294741
  misc_feature 1..30: note = hypo
  source 1..30: mol_type = genomic DNA

SEQ ID NO: 59368 - DNA, 92 bp, Homo sapiens
  misc_feature 1..92: note = chr1:3321998-3322090
  misc_feature 1..92: note = hypo
  source 1..92: mol_type = genomic DNA
agaaccaggccaaggcgggtgtccaggcagggcacgcgccaacggcatccgtctccccaggtgttcacggaccccagcaaccttcagcggca

SEQ ID NO: 59369 - DNA, 186 bp, Homo sapiens; identical to SEQ ID NO: 38790
  misc_feature 1..186: note = chr1:3325403-3325589
  misc_feature 1..186: note = hypo
  source 1..186: mol_type = genomic DNA

SEQ ID NO: 59370 - DNA, 30 bp, Homo sapiens; identical to SEQ ID NO: 38791
  misc_feature 1..30: note = chr1:3327976-3328006
  misc_feature 1..30: note = hypo
  source 1..30: mol_type = genomic DNA

SEQ ID NO: 59371 - DNA, 146 bp, Homo sapiens; identical to SEQ ID NO: 38792
  misc_feature 1..146: note = chr1:3342175-3342321
  misc_feature 1..146: note = hypo
  source 1..146: mol_type = genomic DNA

SEQ ID NO: 59372 - DNA, 30 bp, Homo sapiens; identical to SEQ ID NO: 38793
  misc_feature 1..30: note = chr1:3350102-3350132
  misc_feature 1..30: note = hypo
  source 1..30: mol_type = genomic DNA

SEQ ID NO: 59373 - DNA, 33 bp, Homo sapiens; identical to SEQ ID NO: 38794
  misc_feature 1..33: note = chr1:3372809-3372842
  misc_feature 1..33: note = hypo
  source 1..33: mol_type = genomic DNA

SEQ ID NO: 59374 - DNA, 36 bp, Homo sapiens; identical to SEQ ID NO: 38795
  misc_feature 1..36: note = chr1:3408534-3408570
  misc_feature 1..36: note = hypo
  source 1..36: mol_type = genomic DNA

SEQ ID NO: 59375 - DNA, 255 bp, Homo sapiens; identical to SEQ ID NO: 38796
  misc_feature 1..255: note = chr1:3411032-3411287
  misc_feature 1..255: note = hypo
  source 1..255: mol_type = genomic DNA

SEQ ID NO: 59376 - DNA, 30 bp, Homo sapiens; identical to SEQ ID NO: 38797
  misc_feature 1..30: note = chr1:3417138-3417168
  misc_feature 1..30: note = hypo
  source 1..30: mol_type = genomic DNA

SEQ ID NO: 59377 - DNA, 109 bp, Homo sapiens; identical to SEQ ID NO: 38798
  misc_feature 1..109: note = chr1:3463596-3463705
  misc_feature 1..109: note = hypo
  source 1..109: mol_type = genomic DNA

SEQ ID NO: 59378 - DNA, 69 bp, Homo sapiens; identical to SEQ ID NO: 38799
  misc_feature 1..69: note = chr1:3466914-3466983
  misc_feature 1..69: note = hypo
  source 1..69: mol_type = genomic DNA

SEQ ID NO: 59379 - DNA, 346 bp, Homo sapiens; identical to SEQ ID NO: 38800
  misc_feature 1..346: note = chr1:3467198-3467544
  misc_feature 1..346: note = hypo
  source 1..346: mol_type = genomic DNA

SEQ ID NO: 59380 - DNA, 30 bp, Homo sapiens; identical to SEQ ID NO: 38801
  misc_feature 1..30: note = chr1:3470143-3470173
  misc_feature 1..30: note = hypo
  source 1..30: mol_type = genomic DNA

SEQ ID NO: 59381 - DNA, 12 bp, Homo sapiens
  misc_feature 1..12: note = chr1:3601838-3601850
  misc_feature 1..12: note = hypo
  source 1..12: mol_type = genomic DNA
ccctgagctcca

SEQ ID NO: 59382 - DNA, 94 bp, Homo sapiens; identical to SEQ ID NO: 38803
  misc_feature 1..94: note = chr1:3607472-3607566
  misc_feature 1..94: note = hypo
  source 1..94: mol_type = genomic DNA

SEQ ID NO: 59383 - DNA, 57 bp, Homo sapiens; identical to SEQ ID NO: 38804
  misc_feature 1..57: note = chr1:3644717-3644774
  misc_feature 1..57: note = hypo
  source 1..57: mol_type = genomic DNA

SEQ ID NO: 59384 - DNA, 30 bp, Homo sapiens; identical to SEQ ID NO: 38806
  misc_feature 1..30: note = chr1:3661766-3661796
  misc_feature 1..30: note = hypo
  source 1..30: mol_type = genomic DNA

SEQ ID NO: 59385 - DNA, 30 bp, Homo sapiens; identical to SEQ ID NO: 38807
  misc_feature 1..30: note = chr1:3678034-3678064
  misc_feature 1..30: note = hypo
  source 1..30: mol_type = genomic DNA

SEQ ID NO: 59386 - DNA, 68 bp, Homo sapiens; identical to SEQ ID NO: 38808
  misc_feature 1..68: note = chr1:3680032-3680100
  misc_feature 1..68: note = hypo
  source 1..68: mol_type = genomic DNA

SEQ ID NO: 59387 - DNA, 30 bp, Homo sapiens; identical to SEQ ID NO: 38809
  misc_feature 1..30: note = chr1:3680304-3680334
  misc_feature 1..30: note = hypo
  source 1..30: mol_type = genomic DNA

SEQ ID NO: 59388 - DNA, 26 bp, Homo sapiens
  misc_feature 1..26: note = chr1:3683818-3683844
  misc_feature 1..26: note = hypo
  source 1..26: mol_type = genomic DNA
agctcaccaagcgggactgtgtcatc

SEQ ID NO: 59389 - DNA, 85 bp, Homo sapiens; identical to SEQ ID NO: 38811
  misc_feature 1..85: note = chr1:3684064-3684149
  misc_feature 1..85: note = hypo
  source 1..85: mol_type = genomic DNA

SEQ ID NO: 59390 - DNA, 30 bp, Homo sapiens; identical to SEQ ID NO: 38812
  misc_feature 1..30: note = chr1:3786550-3786580
  misc_feature 1..30: note = hypo
  source 1..30: mol_type = genomic DNA

SEQ ID NO: 59391 - DNA, 193 bp, Homo sapiens; identical to SEQ ID NO: 38813
  misc_feature 1..193: note = chr1:4082814-4083007
  misc_feature 1..193: note = hypo
  source 1..193: mol_type = genomic DNA

SEQ ID NO: 59392 - skipped

SEQ ID NO: 59393 - DNA, 175 bp, Homo sapiens; identical to SEQ ID NO: 38815
  misc_feature 1..175: note = chr1:4212772-4212947
  misc_feature 1..175: note = hypo
  source 1..175: mol_type = genomic DNA

SEQ ID NO: 59394 - DNA, 30 bp, Homo sapiens; identical to SEQ ID NO: 38816
  misc_feature 1..30: note = chr1:4279385-4279415
  misc_feature 1..30: note = hypo
  source 1..30: mol_type = genomic DNA

SEQ ID NO: 59395 - DNA, 152 bp, Homo sapiens; identical to SEQ ID NO: 38817
  misc_feature 1..152: note = chr1:4402113-4402265
  misc_feature 1..152: note = hypo
  source 1..152: mol_type = genomic DNA

SEQ ID NO: 59396 - DNA, 30 bp, Homo sapiens; identical to SEQ ID NO: 38818
  misc_feature 1..30: note = chr1:4426176-4426206
  misc_feature 1..30: note = hypo
  source 1..30: mol_type = genomic DNA

SEQ ID NO: 59397 - DNA, 51 bp, Homo sapiens; identical to SEQ ID NO: 38819
  misc_feature 1..51: note = chr1:4486515-4486566
  misc_feature 1..51: note = hypo
  source 1..51: mol_type = genomic DNA

SEQ ID NO: 59398 - DNA, 41 bp, Homo sapiens; identical to SEQ ID NO: 38820
  misc_feature 1..41: note = chr1:4542688-4542729
  misc_feature 1..41: note = hypo
  source 1..41: mol_type = genomic DNA

SEQ ID NO: 59399 - DNA, 68 bp, Homo sapiens; identical to SEQ ID NO: 38821
  misc_feature 1..68: note = chr1:4652230-4652298
  misc_feature 1..68: note = hypo
  source 1..68: mol_type = genomic DNA

SEQ ID NO: 59400 - DNA, 30 bp, Homo sapiens; identical to SEQ ID NO: 38822
  misc_feature 1..30: note = chr1:4659583-4659613
  misc_feature 1..30: note = hypo
  source 1..30: mol_type = genomic DNA

SEQ ID NO: 59401 - DNA, 124 bp, Homo sapiens; identical to SEQ ID NO: 38823
  misc_feature 1..124: note = chr1:4677050-4677174
  misc_feature 1..124: note = hypo
  source 1..124: mol_type = genomic DNA

SEQ ID NO: 59402 - DNA, 23 bp, Homo sapiens
  misc_feature 1..23: note = chr1:4711648-4711671
  misc_feature 1..23: note = hypo
  source 1..23: mol_type = genomic DNA
taataataagctgggcgcggtgg

SEQ ID NO: 59403 - DNA, 235 bp, Homo sapiens; identical to SEQ ID NO: 38825
  misc_feature 1..235: note = chr1:4726593-4726828
  misc_feature 1..235: note = hypo
  source 1..235: mol_type = genomic DNA

SEQ ID NO: 59404 - DNA, 148 bp, Homo sapiens; identical to SEQ ID NO: 38826
  misc_feature 1..148: note = chr1:4772507-4772655
  misc_feature 1..148: note = hypo
  source 1..148: mol_type = genomic DNA

SEQ ID NO: 59405 - DNA, 143 bp, Homo sapiens; identical to SEQ ID NO: 38827
  misc_feature 1..143: note = chr1:4782357-4782500
  misc_feature 1..143: note = hypo
  source 1..143: mol_type = genomic DNA

SEQ ID NO: 59406 - DNA, 43 bp, Homo sapiens; identical to SEQ ID NO: 38828
  misc_feature 1..43: note = chr1:5893925-5893968
  misc_feature 1..43: note = hypo
  source 1..43: mol_type = genomic DNA

SEQ ID NO: 59407 - DNA, 38 bp, Homo sapiens; identical to SEQ ID NO: 38829
  misc_feature 1..38: note = chr1:5894998-5895036
  misc_feature 1..38: note = hypo
  source 1..38: mol_type = genomic DNA

SEQ ID NO: 59408 - DNA, 30 bp, Homo sapiens; identical to SEQ ID NO: 38830
  misc_feature 1..30: note = chr1:6046247-6046277
  misc_feature 1..30: note = hypo
  source 1..30: mol_type = genomic DNA

SEQ ID NO: 59409 - DNA, 148 bp, Homo sapiens; identical to SEQ ID NO: 38831
  misc_feature 1..148: note = chr1:6071300-6071448
  misc_feature 1..148: note = hypo
  source 1..148: mol_type = genomic DNA

SEQ ID NO: 59410 - DNA, 30 bp, Homo sapiens; identical to SEQ ID NO: 38832
  misc_feature 1..30: note = chr1:6131731-6131761
  misc_feature 1..30: note = hypo
  source 1..30: mol_type = genomic DNA

SEQ ID NO: 59411 - DNA, 38 bp, Homo sapiens
  misc_feature 1..38: note = chr1:6166315-6166353
  misc_feature 1..38: note = hypo
  source 1..38: mol_type = genomic DNA
aacacagggaagtctcgaggacggctagatatctgtca

SEQ ID NO: 59412 - DNA, 124 bp, Homo sapiens
  misc_feature 1..124: note = chr1:6171810-6171934
  misc_feature 1..124: note = hypo
  source 1..124: mol_type = genomic DNA
ccagcccggcctggccaaggatacgtcacgatgcccgccagcagccagtagtcatggcgccggtgccagatgtcgtagattttcccagaggatacagcagcccgctcctcgttctgccacagcg

SEQ ID NO: 59413 - DNA, 24 bp, Homo sapiens
  misc_feature 1..24: note = chr1:6280273-6280297
  misc_feature 1..24: note = hypo
  source 1..24: mol_type = genomic DNA
tgaagtcttcgtccttgtcacagt

SEQ ID NO: 59414 - DNA, 30 bp, Homo sapiens; identical to SEQ ID NO: 14204
  misc_feature 1..30: note = chr1:6360980-6361010
  misc_feature 1..30: note = hypo
  source 1..30: mol_type = genomic DNA

SEQ ID NO: 59415 - DNA, 111 bp, Homo sapiens; identical to SEQ ID NO: 38837
  misc_feature 1..111: note = chr1:6391430-6391541
  misc_feature 1..111: note = hypo
  source 1..111: mol_type = genomic DNA

SEQ ID NO: 59416 - DNA, 45 bp, Homo sapiens
  misc_feature 1..45: note = chr1:6446308-6446353
  misc_feature 1..45: note = hypo
  source 1..45: mol_type = genomic DNA
ttcctgggcctacccctccctgaccttccccgcccctggagttag

SEQ ID NO: 59417 - DNA, 30 bp, Homo sapiens; identical to SEQ ID NO: 38839
  misc_feature 1..30: note = chr1:6635034-6635064
  misc_feature 1..30: note = hypo
  source 1..30: mol_type = genomic DNA

SEQ ID NO: 59418 - DNA, 30 bp, Homo sapiens; identical to SEQ ID NO: 38840
  misc_feature 1..30: note = chr1:6801549-6801579
  misc_feature 1..30: note = hypo
  source 1..30: mol_type = genomic DNA

SEQ ID NO: 59419 - DNA, 195 bp, Homo sapiens; identical to SEQ ID NO: 38841
  misc_feature 1..195: note = chr1:6984148-6984343
  misc_feature 1..195: note = hypo
  source 1..195: mol_type = genomic DNA

SEQ ID NO: 59420 - DNA, 30 bp, Homo sapiens; identical to SEQ ID NO: 38842
  misc_feature 1..30: note = chr1:7067759-7067789
  misc_feature 1..30: note = hypo
  source 1..30: mol_type = genomic DNA

SEQ ID NO: 59421 - DNA, 30 bp, Homo sapiens; identical to SEQ ID NO: 38843
  misc_feature 1..30: note = chr1:7162881-7162911
  misc_feature 1..30: note = hypo
  source 1..30: mol_type = genomic DNA

SEQ ID NO: 59422 - DNA, 30 bp, Homo sapiens; identical to SEQ ID NO: 38844
  misc_feature 1..30: note = chr1:7729014-7729044
  misc_feature 1..30: note = hypo
  source 1..30: mol_type = genomic DNA

SEQ ID NO: 59423 - DNA, 39 bp, Homo sapiens; identical to SEQ ID NO: 38845
  misc_feature 1..39: note = chr1:10103760-10103799
  misc_feature 1..39: note = hypo
  source 1..39: mol_type = genomic DNA

SEQ ID NO: 59424 - DNA, 30 bp, Homo sapiens; identical to SEQ ID NO: 38846
  misc_feature 1..30: note = chr1:10166597-10166627
  misc_feature 1..30: note = hypo
  source 1..30: mol_type = genomic DNA

SEQ ID NO: 59425 - DNA, 18 bp, Homo sapiens
  misc_feature 1..18: note = chr1:10959337-10959355
  misc_feature 1..18: note = hypo
  source 1..18: mol_type = genomic DNA
taccctgtagggggccgg

SEQ ID NO: 59426 - DNA, 101 bp, Homo sapiens; identical to SEQ ID NO: 38848
  misc_feature 1..101: note = chr1:11036267-11036368
  misc_feature 1..101: note = hypo
  source 1..101: mol_type = genomic DNA

SEQ ID NO: 59427 - DNA, 80 bp, Homo sapiens; identical to SEQ ID NO: 38849
  misc_feature 1..80: note = chr1:11073881-11073961
  misc_feature 1..80: note = hypo
  source 1..80: mol_type = genomic DNA

SEQ ID NO: 59428 - DNA, 38 bp, Homo sapiens; identical to SEQ ID NO: 38850
  misc_feature 1..38: note = chr1:11131698-11131736
  misc_feature 1..38: note = hypo
  source 1..38: mol_type = genomic DNA

SEQ ID NO: 59429 - DNA, 30 bp, Homo sapiens; identical to SEQ ID NO: 38851
  misc_feature 1..30: note = chr1:11139771-11139801
  misc_feature 1..30: note = hypo
  source 1..30: mol_type = genomic DNA

SEQ ID NO: 59430 - DNA, 30 bp, Homo sapiens; identical to SEQ ID NO: 38852
  misc_feature 1..30: note = chr1:11417987-11418017
  misc_feature 1..30: note = hypo
  source 1..30: mol_type = genomic DNA

SEQ ID NO: 59431 - DNA, 75 bp, Homo sapiens; identical to SEQ ID NO: 38853
  misc_feature 1..75: note = chr1:11596484-11596559
  misc_feature 1..75: note = hypo
  source 1..75: mol_type = genomic DNA

SEQ ID NO: 59432 - DNA, 76 bp, Homo sapiens; identical to SEQ ID NO: 38854
  misc_feature 1..76: note = chr1:11792825-11792901
  misc_feature 1..76: note = hypo
  source 1..76: mol_type = genomic DNA

SEQ ID NO: 59433 - DNA, 83 bp, Homo sapiens; identical to SEQ ID NO: 38855
  misc_feature 1..83: note = chr1:11854720-11854803
  misc_feature 1..83: note = hypo
  source 1..83: mol_type = genomic DNA

SEQ ID NO: 59434 - DNA, 54 bp, Homo sapiens; identical to SEQ ID NO: 23678
  misc_feature 1..54: note = chr1:11936694-11936748
  misc_feature 1..54: note = hypo
  source 1..54: mol_type = genomic DNA

SEQ ID NO: 59435 - skipped

SEQ ID NO: 59436 - DNA, 76 bp, Homo sapiens; identical to SEQ ID NO: 38857
  misc_feature 1..76: note = chr1:12078805-12078881
  misc_feature 1..76: note = hypo
  source 1..76: mol_type = genomic DNA

SEQ ID NO: 59437 - DNA, 28 bp, Homo sapiens
  misc_feature 1..28: note = chr1:12251415-12251443
  misc_feature 1..28: note = hypo
  source 1..28: mol_type = genomic DNA
cgaggagcaggactgcggggaggagcga

SEQ ID NO: 59438 - DNA, 17 bp, Homo sapiens
  misc_feature 1..17: note = chr1:12805063-12805080
  misc_feature 1..17: note = hypo
  source 1..17: mol_type = genomic DNA
aacgcatgcctcctctg

SEQ ID NO: 59439 - DNA, 194 bp, Homo sapiens; identical to SEQ ID NO: 38860
  misc_feature 1..194: note = chr1:14139406-14139600
  misc_feature 1..194: note = hypo
  source 1..194: mol_type = genomic DNA

SEQ ID NO: 59440 - DNA, 13 bp, Homo sapiens
  misc_feature 1..13: note = chr1:14730412-14730425
  misc_feature 1..13: note = hypo
  source 1..13: mol_type = genomic DNA
aagaagaggtctc

SEQ ID NO: 59441 - DNA, 30 bp, Homo sapiens; identical to SEQ ID NO: 38862
  misc_feature 1..30: note = chr1:15651124-15651154
  misc_feature 1..30: note = hypo
  source 1..30: mol_type = genomic DNA

SEQ ID NO: 59442 - DNA, 30 bp, Homo sapiens; identical to SEQ ID NO: 38863
  misc_feature 1..30: note = chr1:15928989-15929019
  misc_feature 1..30: note = hypo
  source 1..30: mol_type = genomic DNA

SEQ ID NO: 59443 - DNA, 88 bp, Homo sapiens; identical to SEQ ID NO: 38864
  misc_feature 1..88: note = chr1:16059358-16059446
  misc_feature 1..88: note = hypo
  source 1..88: mol_type = genomic DNA

SEQ ID NO: 59444 - DNA, 130 bp, Homo sapiens
  misc_feature 1..130: note = chr1:16475207-16475337
  misc_feature 1..130: note = hypo
  source 1..130: mol_type = genomic DNA
agcttcacgtggcgtgcctcgaagtcgctgctgacggtgatctcatcgggcgcaatggtgtcaatcttggtgaacaggcgcttctggaagttggtgccgtagtccaggtccgactcggcatagtagaggt

SEQ ID NO: 59445 - DNA, 243 bp, Homo sapiens; identical to SEQ ID NO: 38866
  misc_feature 1..243: note = chr1:16534520-16534763
  misc_feature 1..243: note = hypo
  source 1..243: mol_type = genomic DNA

SEQ ID NO: 59446 - DNA, 67 bp, Homo sapiens; identical to SEQ ID NO: 38867
  misc_feature 1..67: note = chr1:16535138-16535205
  misc_feature 1..67: note = hypo
  source 1..67: mol_type = genomic DNA

SEQ ID NO: 59447 - DNA, 30 bp, Homo sapiens; identical to SEQ ID NO: 38868
  misc_feature 1..30: note = chr1:16736310-16736340
  misc_feature 1..30: note = hypo
  source 1..30: mol_type = genomic DNA

SEQ ID NO: 59448 - DNA, 10 bp, Homo sapiens
  misc_feature 1..10: note = chr1:17787462-17787472
  misc_feature 1..10: note = hypo
  source 1..10: mol_type = genomic DNA
tggctcacgc

SEQ ID NO: 59449 - DNA, 16 bp, Homo sapiens
  misc_feature 1..16: note = chr1:18058862-18058878
  misc_feature 1..16: note = hypo
  source 1..16: mol_type = genomic DNA
tcgtctaaaaaaaaaa

SEQ ID NO: 59450 - DNA, 63 bp, Homo sapiens; identical to SEQ ID NO: 38872
  misc_feature 1..63: note = chr1:18703385-18703448
  misc_feature 1..63: note = hypo
  source 1..63: mol_type = genomic DNA

SEQ ID NO: 59451 - DNA, 30 bp, Homo sapiens; identical to SEQ ID NO: 38873
  misc_feature 1..30: note = chr1:18818951-18818981
  misc_feature 1..30: note = hypo
  source 1..30: mol_type = genomic DNA

SEQ ID NO: 59452 - DNA, 68 bp, Homo sapiens; identical to SEQ ID NO: 38874
  misc_feature 1..68: note = chr1:19213653-19213721
  misc_feature 1..68: note = hypo
  source 1..68: mol_type = genomic DNA

SEQ ID NO: 59453 - DNA, 103 bp, Homo sapiens; identical to SEQ ID NO: 38875
  misc_feature 1..103: note = chr1:19676719-19676822
  misc_feature 1..103: note = hypo
  source 1..103: mol_type = genomic DNA

SEQ ID NO: 59454 - DNA, 35 bp, Homo sapiens; identical to SEQ ID NO: 38876
  misc_feature 1..35: note = chr1:20492304-20492339
  misc_feature 1..35: note = hypo
  source 1..35: mol_type = genomic DNA

SEQ ID NO: 59455 - DNA, 25 bp, Homo sapiens
  misc_feature 1..25: note = chr1:20534656-20534681
  misc_feature 1..25: note = hypo
  source 1..25: mol_type = genomic DNA
agtgagaccccgcatccaaaagaaa

SEQ ID NO: 59456 - DNA, 124 bp, Homo sapiens
  misc_feature 1..124: note = chr1:21042770-21042894
  misc_feature 1..124: note = hypo
  source 1..124: mol_type = genomic DNA
taagagcagcacctgcggggctctcacagggtgcatacagggcttctttcgtgcatgggcacaggaagcactgccatacacaggtgatggcccaatgtctgcctgcaatgcagggagctggaca

SEQ ID NO: 59457 - DNA, 163 bp, Homo sapiens
  misc_feature 1..163: note = chr1:21042924-21043087
  misc_feature 1..163: note = hypo
  source 1..163: mol_type = genomic DNA
ggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 59458 - DNA, 30 bp, Homo sapiens; identical to SEQ ID NO: 38879
  misc_feature 1..30: note = chr1:21523157-21523187
  misc_feature 1..30: note = hypo
  source 1..30: mol_type = genomic DNA

SEQ ID NO: 59459 - DNA, 30 bp, Homo sapiens; identical to SEQ ID NO: 38880
  misc_feature 1..30: note = chr1:21568339-21568369
  misc_feature 1..30: note = hypo
  source 1..30: mol_type = genomic DNA

SEQ ID NO: 59460 - DNA, 30 bp, Homo sapiens; identical to SEQ ID NO: 38883
  misc_feature 1..30: note = chr1:21611198-21611228
  misc_feature 1..30: note = hypo
  source 1..30: mol_type = genomic DNA

SEQ ID NO: 59461 - DNA, 120 bp, Homo sapiens; identical to SEQ ID NO: 38884
  misc_feature 1..120: note = chr1:22092109-22092229
  misc_feature 1..120: note = hypo
  source 1..120: mol_type = genomic DNA

SEQ ID NO: 59462 - DNA, 25 bp, Homo sapiens
  misc_feature 1..25: note = chr1:22378609-22378634
  misc_feature 1..25: note = hypo
  source 1..25: mol_type = genomic DNA
gaactggtagtgggccgggcgcggt

SEQ ID NO: 59463 - DNA, 119 bp, Homo sapiens; identical to SEQ ID NO: 38886
  misc_feature 1..119: note = chr1:22447958-22448077
  misc_feature 1..119: note = hypo
  source 1..119: mol_type = genomic DNA

SEQ ID NO: 59464 - DNA, 184 bp, Homo sapiens; identical to SEQ ID NO: 38887
  misc_feature 1..184: note = chr1:22777513-22777697
  misc_feature 1..184: note = hypo
  source 1..184: mol_type = genomic DNA

SEQ ID NO: 59465 - DNA, 30 bp, Homo sapiens; identical to SEQ ID NO: 38888
  misc_feature 1..30: note = chr1:22900903-22900933
  misc_feature 1..30: note = hypo
  source 1..30: mol_type = genomic DNA

SEQ ID NO: 59466 - skipped

SEQ ID NO: 59467 - DNA, 99 bp, Homo sapiens
  misc_feature 1..99: note = chr1:22927482-22927581
  misc_feature 1..99: note = hypo
  source 1..99: mol_type = genomic DNA
ggaccgggcgcagcggcctcgcttctcccagattgtcagtgtcctcgatgcgctcatccgcagccctgagagtctcagggccaccgccacagtcagcag

SEQ ID NO: 59468 - DNA, 33 bp, Homo sapiens; identical to SEQ ID NO: 38890
  misc_feature 1..33: note = chr1:23694078-23694111
  misc_feature 1..33: note = hypo
  source 1..33: mol_type = genomic DNA

SEQ ID NO: 59469 - DNA, 40 bp, Homo sapiens; identical to SEQ ID NO: 38891
  misc_feature 1..40: note = chr1:23704242-23704282
  misc_feature 1..40: note = hypo
  source 1..40: mol_type = genomic DNA

SEQ ID NO: 59470 - DNA, 30 bp, Homo sapiens; identical to SEQ ID NO: 38892
  misc_feature 1..30: note = chr1:23833122-23833152
  misc_feature 1..30: note = hypo
  source 1..30: mol_type = genomic DNA

SEQ ID NO: 59471 - DNA, 30 bp, Homo sapiens; identical to SEQ ID NO: 38893
  misc_feature 1..30: note = chr1:23859450-23859480
  misc_feature 1..30: note = hypo
  source 1..30: mol_type = genomic DNA

SEQ ID NO: 59472 - DNA, 35 bp, Homo sapiens; identical to SEQ ID NO: 38894
  misc_feature 1..35: note = chr1:24017587-24017622
  misc_feature 1..35: note = hypo
  source 1..35: mol_type = genomic DNA

SEQ ID NO: 59473 - DNA, 127 bp, Homo sapiens; identical to SEQ ID NO: 38895
  misc_feature 1..127: note = chr1:24119136-24119263
  misc_feature 1..127: note = hypo
  source 1..127: mol_type = genomic DNA

SEQ ID NO: 59474 - DNA, 30 bp, Homo sapiens; identical to SEQ ID NO: 38896
  misc_feature 1..30: note = chr1:24435099-24435129
  misc_feature 1..30: note = hypo
  source 1..30: mol_type = genomic DNA

SEQ ID NO: 59475 - DNA, 164 bp, Homo sapiens
  misc_feature 1..164: note = chr1:24740829-24740993
  misc_feature 1..164: note = hypo
  source 1..164: mol_type = genomic DNA
ccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatggctc

SEQ ID NO: 59476 - DNA, 46 bp, Homo sapiens; identical to SEQ ID NO: 38898
  misc_feature 1..46: note = chr1:25220516-25220562
  misc_feature 1..46: note = hypo
  source 1..46: mol_type = genomic DNA

SEQ ID NO: 59477 - DNA, 30 bp, Homo sapiens; identical to SEQ ID NO: 38899
  misc_feature 1..30: note = chr1:26337225-26337255
  misc_feature 1..30: note = hypo
  source 1..30: mol_type = genomic DNA

SEQ ID NO: 59478 - DNA, 43 bp, Homo sapiens; identical to SEQ ID NO: 38900
  misc_feature 1..43: note = chr1:26969603-26969646
  misc_feature 1..43: note = hypo
  source 1..43: mol_type = genomic DNA

SEQ ID NO: 59479 - DNA, 36 bp, Homo sapiens
  misc_feature 1..36: note = chr1:27190278-27190314
  misc_feature 1..36: note = hypo
  source 1..36: mol_type = genomic DNA
tctggccaagaccactttcgacgaggccatggctga

SEQ ID NO: 59480 - DNA, 30 bp, Homo sapiens; identical to SEQ ID NO: 38902
  misc_feature 1..30: note = chr1:27628242-27628272
  misc_feature 1..30: note = hypo
  source 1..30: mol_type = genomic DNA

SEQ ID NO: 59481 - DNA, 46 bp, Homo sapiens
  misc_feature 1..46: note = chr1:27844548-27844594
  misc_feature 1..46: note = hypo
  source 1..46: mol_type = genomic DNA
agcacgctcctcaccagccctagctcaggctcggacctctctgact

SEQ ID NO: 59482 - DNA, 21 bp, Homo sapiens
  misc_feature 1..21: note = chr1:27868425-27868446
  misc_feature 1..21: note = hypo
  source 1..21: mol_type = genomic DNA
ccaccgcgcctggcaaggagg

SEQ ID NO: 59483 - DNA, 217 bp, Homo sapiens; identical to SEQ ID NO: 38905
  misc_feature 1..217: note = chr1:27876116-27876333
  misc_feature 1..217: note = hypo
  source 1..217: mol_type = genomic DNA

SEQ ID NO: 59484 - DNA, 72 bp, Homo sapiens; identical to SEQ ID NO: 38906
  misc_feature 1..72: note = chr1:28293332-28293404
  misc_feature 1..72: note = hypo
  source 1..72: mol_type = genomic DNA

SEQ ID NO: 59485 - DNA, 82 bp, Homo sapiens; identical to SEQ ID NO: 38907
  misc_feature 1..82: note = chr1:28853681-28853763
  misc_feature 1..82: note = hypo
  source 1..82: mol_type = genomic DNA

SEQ ID NO: 59486 - DNA, 41 bp, Homo sapiens; identical to SEQ ID NO: 38908
  misc_feature 1..41: note = chr1:28865194-28865235
  misc_feature 1..41: note = hypo
  source 1..41: mol_type = genomic DNA

SEQ ID NO: 59487 - DNA, 23 bp, Homo sapiens
  misc_feature 1..23: note = chr1:28926140-28926163
  misc_feature 1..23: note = hypo
  source 1..23: mol_type = genomic DNA
atggcacgcgcctgtggtgccac

SEQ ID NO: 59488 - DNA, 30 bp, Homo sapiens; identical to SEQ ID NO: 14220
  misc_feature 1..30: note = chr1:29074253-29074283
  misc_feature 1..30: note = hypo
  source 1..30: mol_type = genomic DNA

SEQ ID NO: 59489 - DNA, 26 bp, Homo sapiens
  misc_feature 1..26: note = chr1:29462593-29462619
  misc_feature 1..26: note = hypo
  source 1..26: mol_type = genomic DNA
gggcgcggtggctgacgcctgtaatc

SEQ ID NO: 59490 - DNA, 17 bp, Homo sapiens
  misc_feature 1..17: note = chr1:29463615-29463632
  misc_feature 1..17: note = hypo
  source 1..17: mol_type = genomic DNA
ttgaatgttcagggccg

SEQ ID NO: 59491 - DNA, 40 bp, Homo sapiens; identical to SEQ ID NO: 38914
  misc_feature 1..40: note = chr1:29516596-29516636
  misc_feature 1..40: note = hypo
  source 1..40: mol_type = genomic DNA

SEQ ID NO: 59492 - DNA, 30 bp, Homo sapiens; identical to SEQ ID NO: 38916
  misc_feature 1..30: note = chr1:30723094-30723124
  misc_feature 1..30: note = hypo
  source 1..30: mol_type = genomic DNA

SEQ ID NO: 59493 - DNA, 174 bp, Homo sapiens; identical to SEQ ID NO: 38917
  misc_feature 1..174: note = chr1:31208078-31208252
  misc_feature 1..174: note = hypo
  source 1..174: mol_type = genomic DNA

SEQ ID NO: 59494 - DNA, 23 bp, Homo sapiens
  misc_feature 1..23: note = chr1:32705550-32705573
  misc_feature 1..23: note = hypo
  source 1..23: mol_type = genomic DNA
gcctgggccgagagcgtgtccat

SEQ ID NO: 59495 - DNA, 33 bp, Homo sapiens; identical to SEQ ID NO: 38919
  misc_feature 1..33: note = chr1:32741468-32741501
  misc_feature 1..33: note = hypo
  source 1..33: mol_type = genomic DNA

SEQ ID NO: 59496 - DNA, 30 bp, Homo sapiens; identical to SEQ ID NO: 38920
  misc_feature 1..30: note = chr1:33220942-33220972
  misc_feature 1..30: note = hypo
  source 1..30: mol_type = genomic DNA

SEQ ID NO: 59497 - DNA, 149 bp, Homo sapiens; identical to SEQ ID NO: 38921
  misc_feature 1..149: note = chr1:33441493-33441642
  misc_feature 1..149: note = hypo
  source 1..149: mol_type = genomic DNA

SEQ ID NO: 59498 - DNA, 143 bp, Homo sapiens; identical to SEQ ID NO: 14223
  misc_feature 1..143: note = chr1:33473115-33473258
  misc_feature 1..143: note = hypo
  source 1..143: mol_type = genomic DNA

SEQ ID NO: 59499 - DNA, 50 bp, Homo sapiens; identical to SEQ ID NO: 38923
  misc_feature 1..50: note = chr1:33631092-33631142
  misc_feature 1..50: note = hypo
  source 1..50: mol_type = genomic DNA

SEQ ID NO: 59500 - DNA, 32 bp, Homo sapiens; identical to SEQ ID NO: 38924
  misc_feature 1..32: note = chr1:33798865-33798897
  misc_feature 1..32: note = hypo
  source 1..32: mol_type = genomic DNA

SEQ ID NO: 59501 - DNA, 30 bp, Homo sapiens; identical to SEQ ID NO: 38925
  misc_feature 1..30: note = chr1:33981589-33981619
  misc_feature 1..30: note = hypo
  source 1..30: mol_type = genomic DNA

SEQ ID NO: 59502 - DNA, 28 bp, Homo sapiens
  misc_feature 1..28: note = chr1:34130113-34130141
  misc_feature 1..28: note = hypo
  source 1..28: mol_type = genomic DNA
attttaggccaggagcggtggctcatgc

SEQ ID NO: 59503 - DNA, 41 bp, Homo sapiens; identical to SEQ ID NO: 38927
  misc_feature 1..41: note = chr1:34180223-34180264
  misc_feature 1..41: note = hypo
  source 1..41: mol_type = genomic DNA

SEQ ID NO: 59504 - DNA, 27 bp, Homo sapiens
  misc_feature 1..27: note = chr1:34979405-34979432
  misc_feature 1..27: note = hypo
  source 1..27: mol_type = genomic DNA
aagaagagggctgggcgcagtggctca

SEQ ID NO: 59505 - DNA, 23 bp, Homo sapiens
  misc_feature 1..23: note = chr1:35660562-35660585
  misc_feature 1..23: note = hypo
  source 1..23: mol_type = genomic DNA
aggcgggaccgggtgcggtggct

SEQ ID NO: 59506 - DNA, 110 bp, Homo sapiens
  misc_feature 1..110: note = chr1:35664746-35664856
  misc_feature 1..110: note = hypo
  source 1..110: mol_type = genomic DNA
agatttatcaagttactttacctgtatgttttgcctcagggcatttgcacttgctctttactcagcctgcagtgttctccccactcgccccgccccggctctttgcacag

SEQ ID NO: 59507 - DNA, 66 bp, Homo sapiens; identical to SEQ ID NO: 38931
  misc_feature 1..66: note = chr1:36056253-36056319
  misc_feature 1..66: note = hypo
  source 1..66: mol_type = genomic DNA

SEQ ID NO: 59508 - DNA, 120 bp, Homo sapiens; identical to SEQ ID NO: 38932
  misc_feature 1..120: note = chr1:36271442-36271562
  misc_feature 1..120: note = hypo
  source 1..120: mol_type = genomic DNA

SEQ ID NO: 59509 - DNA, 137 bp, Homo sapiens
  misc_feature 1..137: note = chr1:36563342-36563479
  misc_feature 1..137: note = hypo
  source 1..137: mol_type = genomic DNA
tataggtggccggcacgttgttcttgtacagggccacccacacgttggtgcccttgacgtgcacatggtaagcaaagtagtagacgccgcccacagggcaggtgaagatgccagtggctgggttgtagccgctgtgg

SEQ ID NO: 59510 - DNA, 72 bp, Homo sapiens
  misc_feature 1..72: note = chr1:36563522-36563594
  misc_feature 1..72: note = hypo
  source 1..72: mol_type = genomic DNA
cggggaagggcgaggtgagcaccgcagtgaaggccggtgtggcatgggcagacagctcgcccagcccaaact

SEQ ID NO: 59511 - DNA, 180 bp, Homo sapiens; identical to SEQ ID NO: 38934
  misc_feature 1..180: note = chr1:37148125-37148305
  misc_feature 1..180: note = hypo
  source 1..180: mol_type = genomic DNA

SEQ ID NO: 59512 - DNA, 30 bp, Homo sapiens; identical to SEQ ID NO: 38935
  misc_feature 1..30: note = chr1:37227648-37227678
  misc_feature 1..30: note = hypo
  source 1..30: mol_type = genomic DNA

SEQ ID NO: 59513 - DNA, 30 bp, Homo sapiens; identical to SEQ ID NO: 38936
  misc_feature 1..30: note = chr1:38207058-38207088
  misc_feature 1..30: note = hypo
  source 1..30: mol_type = genomic DNA

SEQ ID NO: 59514 - DNA, 87 bp, Homo sapiens; identical to SEQ ID NO: 38937
  misc_feature 1..87: note = chr1:38398355-38398442
  misc_feature 1..87: note = hypo
  source 1..87: mol_type = genomic DNA

SEQ ID NO: 59515 - DNA, 30 bp, Homo sapiens; identical to SEQ ID NO: 38938
  misc_feature 1..30: note = chr1:39075313-39075343
  misc_feature 1..30: note = hypo
  source 1..30: mol_type = genomic DNA

SEQ ID NO: 59516 - DNA, 28 bp, Homo sapiens
  misc_feature 1..28: note = chr1:39345389-39345417
  misc_feature 1..28: note = hypo
  source 1..28: mol_type = genomic DNA
tctgttttttttgttcgtttgttttctg

SEQ ID NO: 59517 - DNA, 146 bp, Homo sapiens; identical to SEQ ID NO: 38940
  misc_feature 1..146: note = chr1:39416821-39416967
  misc_feature 1..146: note = hypo
  source 1..146: mol_type = genomic DNA

SEQ ID NO: 59518 - DNA, 24 bp, Homo sapiens
  misc_feature 1..24: note = chr1:40025751-40025775
  misc_feature 1..24: note = hypo
  source 1..24: mol_type = genomic DNA
gtgcccagccgaggtgacaccaga

SEQ ID NO: 59519 - DNA, 15 bp, Homo sapiens
  misc_feature 1..15: note = chr1:40349647-40349662
  misc_feature 1..15: note = hypo
  source 1..15: mol_type = genomic DNA
cgtcttaaatggtag

SEQ ID NO: 59520 - DNA, 30 bp, Homo sapiens; identical to SEQ ID NO: 38943
  misc_feature 1..30: note = chr1:40409694-40409724
  misc_feature 1..30: note = hypo
  source 1..30: mol_type = genomic DNA

SEQ ID NO: 59521 - DNA, 138 bp, Homo sapiens; identical to SEQ ID NO: 38945
  misc_feature 1..138: note = chr1:40905029-40905167
  misc_feature 1..138: note = hypo
  source 1..138: mol_type = genomic DNA

SEQ ID NO: 59522 - DNA, 30 bp, Homo sapiens; identical to SEQ ID NO: 38946
  misc_feature 1..30: note = chr1:41117178-41117208
  misc_feature 1..30: note = hypo
  source 1..30: mol_type = genomic DNA

SEQ ID NO: 59523 - DNA, 46 bp, Homo sapiens; identical to SEQ ID NO: 38947
  misc_feature 1..46: note = chr1:41288701-41288747
  misc_feature 1..46: note = hypo
  source 1..46: mol_type = genomic DNA

SEQ ID NO: 59524 - DNA, 30 bp, Homo sapiens; identical to SEQ ID NO: 38948
  misc_feature 1..30: note = chr1:41486134-41486164
  misc_feature 1..30: note = hypo
  source 1..30: mol_type = genomic DNA

SEQ ID NO: 59525 - DNA, 30 bp, Homo sapiens; identical to SEQ ID NO: 38949
  misc_feature 1..30: note = chr1:41967243-41967273
  misc_feature 1..30: note = hypo
  source 1..30: mol_type = genomic DNA

SEQ ID NO: 59526 - DNA, 83 bp, Homo sapiens; identical to SEQ ID NO: 23696
  misc_feature 1..83: note = chr1:41991702-41991785
  misc_feature 1..83: note = hypo
  source 1..83: mol_type = genomic DNA

SEQ ID NO: 59527 - DNA, 30 bp, Homo sapiens; identical to SEQ ID NO: 38951
  misc_feature 1..30: note = chr1:42802631-42802661
  misc_feature 1..30: note = hypo
  source 1..30: mol_type = genomic DNA

SEQ ID NO: 59528 - DNA, 30 bp, Homo sapiens; identical to SEQ ID NO: 38952
  misc_feature 1..30: note = chr1:43209127-43209157
  misc_feature 1..30: note = hypo
  source 1..30: mol_type = genomic DNA

SEQ ID NO: 59529 - DNA, 92 bp, Homo sapiens; identical to SEQ ID NO: 38953
  misc_feature 1..92: note = chr1:43826882-43826974
  misc_feature 1..92: note = hypo
  source 1..92: mol_type = genomic DNA

SEQ ID NO: 59530 - DNA, 25 bp, Homo sapiens
  misc_feature 1..25: note = chr1:43834716-43834741
  misc_feature 1..25: note = hypo
  source 1..25: mol_type = genomic DNA
aatttctacctccagcggcccctgg

SEQ ID NO: 59531 - DNA, 57 bp, Homo sapiens; identical to SEQ ID NO: 38955
  misc_feature 1..57: note = chr1:43991727-43991784
  misc_feature 1..57: note = hypo
  source 1..57: mol_type = genomic DNA

SEQ ID NO: 59532 - DNA, 30 bp, Homo sapiens; identical to SEQ ID NO: 38956
  misc_feature 1..30: note = chr1:44000506-44000536
  misc_feature 1..30: note = hypo
  source 1..30: mol_type = genomic DNA

SEQ ID NO: 59533 - DNA, 30 bp, Homo sapiens; identical to SEQ ID NO: 38957
  misc_feature 1..30: note = chr1:44016696-44016726
  misc_feature 1..30: note = hypo
  source 1..30: mol_type = genomic DNA

SEQ ID NO: 59534 - DNA, 36 bp, Homo sapiens; identical to SEQ ID NO: 38958
  misc_feature 1..36: note = chr1:44043751-44043787
  misc_feature 1..36: note = hypo
  source 1..36: mol_type = genomic DNA

SEQ ID NO: 59535 - DNA, 34 bp, Homo sapiens; identical to SEQ ID NO: 38959
  misc_feature 1..34: note = chr1:44068855-44068889
  misc_feature 1..34: note = hypo
  source 1..34: mol_type = genomic DNA

SEQ ID NO: 59536 - DNA, 43 bp, Homo sapiens; identical to SEQ ID NO: 14234
  misc_feature 1..43: note = chr1:44351190-44351233
  misc_feature 1..43: note = hypo
  source 1..43: mol_type = genomic DNA

SEQ ID NO: 59537 - DNA, 45 bp, Homo sapiens; identical to SEQ ID NO: 38961
  misc_feature 1..45: note = chr1:44463208-44463253
  misc_feature 1..45: note = hypo
  source 1..45: mol_type = genomic DNA

SEQ ID NO: 59538 - DNA, 126 bp, Homo sapiens; identical to SEQ ID NO: 38962
  misc_feature 1..126: note = chr1:44463851-44463977
  misc_feature 1..126: note = hypo
  source 1..126: mol_type = genomic DNA

SEQ ID NO: 59539 - DNA, 150 bp, Homo sapiens; identical to SEQ ID NO: 38963
  misc_feature 1..150: note = chr1:44497521-44497671
  misc_feature 1..150: note = hypo
  source 1..150: mol_type = genomic DNA

SEQ ID NO: 59540 - DNA, 52 bp, Homo sapiens; identical to SEQ ID NO: 38964
  misc_feature 1..52: note = chr1:44584408-44584460
  misc_feature 1..52: note = hypo
  source 1..52: mol_type = genomic DNA

SEQ ID NO: 59541 - DNA, 54 bp, Homo sapiens; identical to SEQ ID NO: 38965
  misc_feature 1..54: note = chr1:44718072-44718126
  misc_feature 1..54: note = hypo
  source 1..54: mol_type = genomic DNA

SEQ ID NO: 59542 - DNA, 30 bp, Homo sapiens; identical to SEQ ID NO: 38967
  misc_feature 1..30: note = chr1:44794138-44794168
  misc_feature 1..30: note = hypo
  source 1..30: mol_type = genomic DNA

SEQ ID NO: 59543 - DNA, 62 bp, Homo sapiens; identical to SEQ ID NO: 38968
  misc_feature 1..62: note = chr1:45103094-45103156
  misc_feature 1..62: note = hypo
  source 1..62: mol_type = genomic DNA

SEQ ID NO: 59544 - DNA, 30 bp, Homo sapiens; identical to SEQ ID NO: 38969
  misc_feature 1..30: note = chr1:45106646-45106676
  misc_feature 1..30: note = hypo
  source 1..30: mol_type = genomic DNA

SEQ ID NO: 59545 - DNA, 42 bp, Homo sapiens; identical to SEQ ID NO: 38970
  misc_feature 1..42: note = chr1:45156636-45156678
  misc_feature 1..42: note = hypo
  source 1..42: mol_type = genomic DNA

SEQ ID NO: 59546 - DNA, 100 bp, Homo sapiens; identical to SEQ ID NO: 38971
  misc_feature 1..100: note = chr1:45280516-45280616
  misc_feature 1..100: note = hypo
  source 1..100: mol_type = genomic DNA

SEQ ID NO: 59547 - DNA, 73 bp, Homo sapiens; identical to SEQ ID NO: 38972
  misc_feature 1..73: note = chr1:45293244-45293317
  misc_feature 1..73: note = hypo
  source 1..73: mol_type = genomic DNA

SEQ ID NO: 59548 - DNA, 53 bp, Homo sapiens
  misc_feature 1..53: note = chr1:45308262-45308315
  misc_feature 1..53: note = hypo
  source 1..53: mol_type = genomic DNA
ttctgagagcaggatacatatgtacacacacctgtcgtcgggtggacacagag

SEQ ID NO: 59549 - DNA, 16 bp, Homo sapiens
  misc_feature 1..16: note = chr1:45466077-45466093
  misc_feature 1..16: note = hypo
  source 1..16: mol_type = genomic DNA
acgctgtataaataat

SEQ ID NO: 59550 - DNA, 16 bp, Homo sapiens
  misc_feature 1..16: note = chr1:45645619-45645635
  misc_feature 1..16: note = hypo
  source 1..16: mol_type = genomic DNA
aggagccaagatggcc

SEQ ID NO: 59551 - DNA, 38 bp, Homo sapiens; identical to SEQ ID NO: 14239
  misc_feature 1..38: note = chr1:46079131-46079169
  misc_feature 1..38: note = hypo
  source 1..38: mol_type = genomic DNA

SEQ ID NO: 59552 - DNA, 95 bp, Homo sapiens; identical to SEQ ID NO: 38977
  misc_feature 1..95: note = chr1:46921772-46921867
  misc_feature 1..95: note = hypo
  source 1..95: mol_type = genomic DNA

SEQ ID NO: 59553 - DNA, 26 bp, Homo sapiens
  misc_feature 1..26: note = chr1:47749558-47749584
  misc_feature 1..26: note = hypo
  source 1..26: mol_type = genomic DNA
tagcttttttttttgcgggggggtgg

SEQ ID NO: 59554 - DNA, 30 bp, Homo sapiens; identical to SEQ ID NO: 38979
  misc_feature 1..30: note = chr1:50918985-50919015
  misc_feature 1..30: note = hypo
  source 1..30: mol_type = genomic DNA

SEQ ID NO: 59555 - DNA, 200 bp, Homo sapiens; identical to SEQ ID NO: 38980
  misc_feature 1..200: note = chr1:51099269-51099469
  misc_feature 1..200: note = hypo
  source 1..200: mol_type = genomic DNA

SEQ ID NO: 59556 - DNA, 20 bp, Homo sapiens
  misc_feature 1..20: note = chr1:51176289-51176309
  misc_feature 1..20: note = hypo
  source 1..20: mol_type = genomic DNA
ttcgagacagagtctcgctc

SEQ ID NO: 59557 - DNA, 19 bp, Homo sapiens
  misc_feature 1..19: note = chr1:51727596-51727615
  misc_feature 1..19: note = hypo
  source 1..19: mol_type = genomic DNA
gctcactgcaacctccgtc

SEQ ID NO: 59558 - DNA, 78 bp, Homo sapiens; identical to SEQ ID NO: 38983
  misc_feature 1..78: note = chr1:51761832-51761910
  misc_feature 1..78: note = hypo
  source 1..78: mol_type = genomic DNA

SEQ ID NO: 59559 - DNA, 47 bp, Homo sapiens
  misc_feature 1..47: note = chr1:51763298-51763345
  misc_feature 1..47: note = hypo
  source 1..47: mol_type = genomic DNA
tcctgctggccttgccctacggctctcattatcggactgccaccatc

SEQ ID NO: 59560 - DNA, 213 bp, Homo sapiens; identical to SEQ ID NO: 38985
  misc_feature 1..213: note = chr1:51795524-51795737
  misc_feature 1..213: note = hypo
  source 1..213: mol_type = genomic DNA

SEQ ID NO: 59561 - DNA, 128 bp, Homo sapiens; identical to SEQ ID NO: 38986
  misc_feature 1..128: note = chr1:52455042-52455170
  misc_feature 1..128: note = hypo
  source 1..128: mol_type = genomic DNA

SEQ ID NO: 59562 - DNA, 16 bp, Homo sapiens
  misc_feature 1..16: note = chr1:53129138-53129154
  misc_feature 1..16: note = hypo
  source 1..16: mol_type = genomic DNA
atcagaacatgtggcc

SEQ ID NO: 59563 - DNA, 41 bp, Homo sapiens; identical to SEQ ID NO: 38989
  misc_feature 1..41: note = chr1:53703048-53703089
  misc_feature 1..41: note = hypo
  source 1..41: mol_type = genomic DNA

SEQ ID NO: 59564 - DNA, 75 bp, Homo sapiens; identical to SEQ ID NO: 38991
  misc_feature 1..75: note = chr1:53990562-53990637
  misc_feature 1..75: note = hypo
  source 1..75: mol_type = genomic DNA

SEQ ID NO: 59565 - DNA, 36 bp, Homo sapiens; identical to SEQ ID NO: 23706
  misc_feature 1..36: note = chr1:54586590-54586626
  misc_feature 1..36: note = hypo
  source 1..36: mol_type = genomic DNA

SEQ ID NO: 59566 - DNA, 261 bp, Homo sapiens; identical to SEQ ID NO: 23707
  misc_feature 1..261: note = chr1:54586736-54586997
  misc_feature 1..261: note = hypo
  source 1..261: mol_type = genomic DNA

SEQ ID NO: 59567 - DNA, 30 bp, Homo sapiens; identical to SEQ ID NO: 38993
  misc_feature 1..30: note = chr1:54722666-54722696
  misc_feature 1..30: note = hypo
  source 1..30: mol_type = genomic DNA

SEQ ID NO: 59568 - DNA, 30 bp, Homo sapiens; identical to SEQ ID NO: 38994
  misc_feature 1..30: note = chr1:54766254-54766284
  misc_feature 1..30: note = hypo
  source 1..30: mol_type = genomic DNA

SEQ ID NO: 59569 - DNA, 33 bp, Homo sapiens; identical to SEQ ID NO: 38995
  misc_feature 1..33: note = chr1:54839900-54839933
  misc_feature 1..33: note = hypo
  source 1..33: mol_type = genomic DNA

SEQ ID NO: 59570 - DNA, 17 bp, Homo sapiens
  misc_feature 1..17: note = chr1:54880702-54880719
  misc_feature 1..17: note = hypo
  source 1..17: mol_type = genomic DNA
cccggccacgtagagca

SEQ ID NO: 59571 - DNA, 23 bp, Homo sapiens
  misc_feature 1..23: note = chr1:55231044-55231067
  misc_feature 1..23: note = hypo
  source 1..23: mol_type = genomic DNA
tttgtttttttgagacggagttt

SEQ ID NO: 59572 - DNA, 70 bp, Homo sapiens; identical to SEQ ID NO: 38998
  misc_feature 1..70: note = chr1:55529166-55529236
  misc_feature 1..70: note = hypo
  source 1..70: mol_type = genomic DNA

SEQ ID NO: 59573 - DNA, 30 bp, Homo sapiens; identical to SEQ ID NO: 38999
  misc_feature 1..30: note = chr1:62189867-62189897
  misc_feature 1..30: note = hypo
  source 1..30: mol_type = genomic DNA

SEQ ID NO: 59574 - DNA, 30 bp, Homo sapiens; identical to SEQ ID NO: 39000
  misc_feature 1..30: note = chr1:62657668-62657698
  misc_feature 1..30: note = hypo
  source 1..30: mol_type = genomic DNA

SEQ ID NO: 59575 - DNA, 34 bp, Homo sapiens; identical to SEQ ID NO: 39002
  misc_feature 1..34: note = chr1:70672893-70672927
  misc_feature 1..34: note = hypo
  source 1..34: mol_type = genomic DNA

SEQ ID NO: 59576 - DNA, 79 bp, Homo sapiens; identical to SEQ ID NO: 39003
  misc_feature 1..79: note = chr1:72383504-72383583
  misc_feature 1..79: note = hypo
  source 1..79: mol_type = genomic DNA

SEQ ID NO: 59577 - DNA, 30 bp, Homo sapiens; identical to SEQ ID NO: 39004
  misc_feature 1..30: note = chr1:76259201-76259231
  misc_feature 1..30: note = hypo
  source 1..30: mol_type = genomic DNA

SEQ ID NO: 59578 - DNA, 24 bp, Homo sapiens
  misc_feature 1..24: note = chr1:76354586-76354610
  misc_feature 1..24: note = hypo
  source 1..24: mol_type = genomic DNA
tttttttttttgagacggagtctc

SEQ ID NO: 59579 - DNA, 30 bp, Homo sapiens; identical to SEQ ID NO: 14245
  misc_feature 1..30: note = chr1:78244815-78244845
  misc_feature 1..30: note = hypo
  source 1..30: mol_type = genomic DNA

SEQ ID NO: 59580 - DNA, 30 bp, Homo sapiens; identical to SEQ ID NO: 39008
  misc_feature 1..30: note = chr1:90292117-90292147
  misc_feature 1..30: note = hypo
  source 1..30: mol_type = genomic DNA

SEQ ID NO: 59581 - DNA, 33 bp, Homo sapiens; identical to SEQ ID NO: 39009
  misc_feature 1..33: note = chr1:92494939-92494972
  misc_feature 1..33: note = hypo
  source 1..33: mol_type = genomic DNA

SEQ ID NO: 59582 - DNA, 156 bp, Homo sapiens; identical to SEQ ID NO: 39010
  misc_feature 1..156: note = chr1:93222691-93222847
  misc_feature 1..156: note = hypo
  source 1..156: mol_type = genomic DNA

SEQ ID NO: 59583 - DNA, 30 bp, Homo sapiens; identical to SEQ ID NO: 39011
  misc_feature 1..30: note = chr1:94048058-94048088
  misc_feature 1..30: note = hypo
  source 1..30: mol_type = genomic DNA

SEQ ID NO: 59584 - DNA, 30 bp, Homo sapiens; identical to SEQ ID NO: 39012
  misc_feature 1..30: note = chr1:94048424-94048454
  misc_feature 1..30: note = hypo
  source 1..30: mol_type = genomic DNA

SEQ ID NO: 59585 - DNA, 30 bp, Homo sapiens; identical to SEQ ID NO: 39014
  misc_feature 1..30: note = chr1:97185220-97185250
  misc_feature 1..30: note = hypo
  source 1..30: mol_type = genomic DNA

SEQ ID NO: 59586 - DNA, 98 bp, Homo sapiens; identical to SEQ ID NO: 14249
  misc_feature 1..98: note = chr1:99611990-99612088
  misc_feature 1..98: note = hypo
  source 1..98: mol_type = genomic DNA

SEQ ID NO: 59587 - DNA, 38 bp, Homo sapiens; identical to SEQ ID NO: 14250
  misc_feature 1..38: note = chr1:99612148-99612186
  misc_feature 1..38: note = hypo
  source 1..38: mol_type = genomic DNA

SEQ ID NO: 59588 - DNA, 197 bp, Homo sapiens; identical to SEQ ID NO: 39017
  misc_feature 1..197: note = chr1:100436557-100436754
  misc_feature 1..197: note = hypo
  source 1..197: mol_type = genomic DNA

SEQ ID NO: 59589 - DNA, 86 bp, Homo sapiens; identical to SEQ ID NO: 4943
  misc_feature 1..86: note = chr1:100437183-100437269
  misc_feature 1..86: note = hypo
  source 1..86: mol_type = genomic DNA

SEQ ID NO: 59590 - DNA, 34 bp, Homo sapiens; identical to SEQ ID NO: 39019
  misc_feature 1..34: note = chr1:100814764-100814798
  misc_feature 1..34: note = hypo
  source 1..34: mol_type = genomic DNA

SEQ ID NO: 59591 - DNA, 30 bp, Homo sapiens; identical to SEQ ID NO: 39020
  misc_feature 1..30: note = chr1:100928393-100928423
  misc_feature 1..30: note = hypo
  source 1..30: mol_type = genomic DNA

SEQ ID NO: 59592 - DNA, 30 bp, Homo sapiens; identical to SEQ ID NO: 39021
  misc_feature 1..30: note = chr1:109076927-109076957
  misc_feature 1..30: note = hypo
  source 1..30: mol_type = genomic DNA

SEQ ID NO: 59593 - DNA, 30 bp, Homo sapiens; identical to SEQ ID NO: 39022
  misc_feature 1..30: note = chr1:109370476-109370506
  misc_feature 1..30: note = hypo
  source 1..30: mol_type = genomic DNA

SEQ ID NO: 59594 - DNA, 89 bp, Homo sapiens
  misc_feature 1..89: note = chr1:109585374-109585463
  misc_feature 1..89: note = hypo
  source 1..89: mol_type = genomic DNA
tattccacaaatatacgtgatgttcaaccgagcttaattaagcatccaggaagtataaccataaggaagaatacaattacacaaacctg

SEQ ID NO: 59595 - DNA, 19 bp, Homo sapiens
  misc_feature 1..19: note = chr1:109585754-109585773
  misc_feature 1..19: note = hypo
  source 1..19: mol_type = genomic DNA
actccgtctcacagaaaaa

SEQ ID NO: 59596 - DNA, 28 bp, Homo sapiens
  misc_feature 1..28: note = chr1:109593505-109593533
  misc_feature 1..28: note = hypo
  source 1..28: mol_type = genomic DNA
tcaagggccaggcaccgcggctcacgcc

SEQ ID NO: 59597 - DNA, 30 bp, Homo sapiens; identical to SEQ ID NO: 39028
  misc_feature 1..30: note = chr1:109701309-109701339
  misc_feature 1..30: note = hypo
  source 1..30: mol_type = genomic DNA

SEQ ID NO: 59598 - DNA, 30 bp, Homo sapiens; identical to SEQ ID NO: 39029
  misc_feature 1..30: note = chr1:109941519-109941549
  misc_feature 1..30: note = hypo
  source 1..30: mol_type = genomic DNA

SEQ ID NO: 59599 - DNA, 30 bp, Homo sapiens; identical to SEQ ID NO: 39030
  misc_feature 1..30: note = chr1:110305575-110305605
  misc_feature 1..30: note = hypo
  source 1..30: mol_type = genomic DNA

SEQ ID NO: 59600 - DNA, 99 bp, Homo sapiens; identical to SEQ ID NO: 39031
  misc_feature 1..99: note = chr1:110726670-110726769
  misc_feature 1..99: note = hypo
  source 1..99: mol_type = genomic DNA

SEQ ID NO: 59601 - DNA, 60 bp, Homo sapiens; identical to SEQ ID NO: 39033
  misc_feature 1..60: note = chr1:110884160-110884220
  misc_feature 1..60: note = hypo
  source 1..60: mol_type = genomic DNA

SEQ ID NO: 59602 - DNA, 31 bp, Homo sapiens; identical to SEQ ID NO: 39034
  misc_feature 1..31: note = chr1:111544898-111544929
  misc_feature 1..31: note = hypo
  source 1..31: mol_type = genomic DNA

SEQ ID NO: 59603 - DNA, 64 bp, Homo sapiens; identical to SEQ ID NO: 23719
  misc_feature 1..64: note = chr1:112084890-112084954
  misc_feature 1..64: note = hypo
  source 1..64: mol_type = genomic DNA

SEQ ID NO: 59604 - DNA, 105 bp, Homo sapiens
  misc_feature 1..105: note = chr1:112084984-112085089
  misc_feature 1..105: note = hypo
  source 1..105: mol_type = genomic DNA
gtgccagctgagaggtggtagagcaggaagctgcctgaggacctccatttatttggtgaaaaactgggctccgcccttaagagagcaagtcgagggccgtgtagg

SEQ ID NO: 59605 - DNA, 16 bp, Homo sapiens
  misc_feature 1..16: note = chr1:112192214-112192230
  misc_feature 1..16: note = hypo
  source 1..16: mol_type = genomic DNA
acgaccagaatattag

SEQ ID NO: 59606 - DNA, 152 bp, Homo sapiens; identical to SEQ ID NO: 39037
  misc_feature 1..152: note = chr1:112784462-112784614
  misc_feature 1..152: note = hypo
  source 1..152: mol_type = genomic DNA

SEQ ID NO: 59607 - DNA, 86 bp, Homo sapiens; identical to SEQ ID NO: 39038
  misc_feature 1..86: note = chr1:113751201-113751287
  misc_feature 1..86: note = hypo
  source 1..86: mol_type = genomic DNA

SEQ ID NO: 59608 - DNA, 80 bp, Homo sapiens; identical to SEQ ID NO: 39039
  misc_feature 1..80: note = chr1:115055238-115055318
  misc_feature 1..80: note = hypo
  source 1..80: mol_type = genomic DNA

SEQ ID NO: 59609 - DNA, 115 bp, Homo sapiens; identical to SEQ ID NO: 39040
  misc_feature 1..115: note = chr1:116213930-116214045
  misc_feature 1..115: note = hypo
  source 1..115: mol_type = genomic DNA

SEQ ID NO: 59610 - DNA, 125 bp, Homo sapiens
  misc_feature 1..125: note = chr1:116214318-116214443
  misc_feature 1..125: note = hypo
  source 1..125: mol_type = genomic DNA
actgtgtaaggaaatggcagcatggcgaggtttgtgccgcggcctacaagcagggctgcatgctccccaggcagactgtggcagagccaagcccctcacttgtagggaagcgtgtctcctaggtg

SEQ ID NO: 59611 - DNA, 45 bp, Homo sapiens; identical to SEQ ID NO: 39042
  misc_feature 1..45: note = chr1:116214942-116214987
  misc_feature 1..45: note = hypo
  source 1..45: mol_type = genomic DNA

SEQ ID NO: 59612 - DNA, 61 bp, Homo sapiens; identical to SEQ ID NO: 39043
  misc_feature 1..61: note = chr1:116574202-116574263
  misc_feature 1..61: note = hypo
  source 1..61: mol_type = genomic DNA

SEQ ID NO: 59613 - DNA, 124 bp, Homo sapiens; identical to SEQ ID NO: 39044
  misc_feature 1..124: note = chr1:150602992-150603116
  misc_feature 1..124: note = hypo
  source 1..124: mol_type = genomic DNA

SEQ ID NO: 59614 - DNA, 30 bp, Homo sapiens; identical to SEQ ID NO: 14264
  misc_feature 1..30: note = chr1:150850705-150850735
  misc_feature 1..30: note = hypo
  source 1..30: mol_type = genomic DNA

SEQ ID NO: 59615 - DNA, 102 bp, Homo sapiens; identical to SEQ ID NO: 1538
  misc_feature 1..102: note = chr1:151252684-151252786
  misc_feature 1..102: note = hypo
  source 1..102: mol_type = genomic DNA

SEQ ID NO: 59616 - DNA, 36 bp, Homo sapiens
  misc_feature 1..36: note = chr1:151300852-151300888
  misc_feature 1..36: note = hypo
  source 1..36: mol_type = genomic DNA
ttcttccaaacaaaacgaaaccatattaggccaaac

SEQ ID NO: 59617 - DNA, 18 bp, Homo sapiens
  misc_feature 1..18: note = chr1:151300918-151300936
  misc_feature 1..18: note = hypo
  source 1..18: mol_type = genomic DNA
cctctggtgttgcttttg

SEQ ID NO: 59618 - DNA, 30 bp, Homo sapiens; identical to SEQ ID NO: 39050
  misc_feature 1..30: note = chr1:151345799-151345829
  misc_feature 1..30: note = hypo
  source 1..30: mol_type = genomic DNA

SEQ ID NO: 59619 - DNA, 30 bp, Homo sapiens; identical to SEQ ID NO: 39051
  misc_feature 1..30: note = chr1:151481617-151481647
  misc_feature 1..30: note = hypo
  source 1..30: mol_type = genomic DNA

SEQ ID NO: 59620 - DNA, 32 bp, Homo sapiens; identical to SEQ ID NO: 39052
  misc_feature 1..32: note = chr1:151678615-151678647
  misc_feature 1..32: note = hypo
  source 1..32: mol_type = genomic DNA

SEQ ID NO: 59621 - DNA, 40 bp, Homo sapiens; identical to SEQ ID NO: 39053
  misc_feature 1..40: note = chr1:152276060-152276100
  misc_feature 1..40: note = hypo
  source 1..40: mol_type = genomic DNA

SEQ ID NO: 59622 - DNA, 51 bp, Homo sapiens; identical to SEQ ID NO: 39054
  misc_feature 1..51: note = chr1:152286249-152286300
  misc_feature 1..51: note = hypo
  source 1..51: mol_type = genomic DNA

SEQ ID NO: 59623 - DNA, 16 bp, Homo sapiens
  misc_feature 1..16: note = chr1:152696808-152696824
  misc_feature 1..16: note = hypo
  source 1..16: mol_type = genomic DNA
ggagtcttgctctgtc

SEQ ID NO: 59624 - DNA, 73 bp, Homo sapiens
  misc_feature 1..73: note = chr1:153540023-153540096
  misc_feature 1..73: note = hypo
  source 1..73: mol_type = genomic DNA
agcctggcagtgaggcgctccagactcggcctgctgctgcgtgtcccttaaacacaccggcacatgcaactag

SEQ ID NO: 59625 - DNA, 88 bp, Homo sapiens; identical to SEQ ID NO: 23727
  misc_feature 1..88: note = chr1:153540154-153540242
  misc_feature 1..88: note = hypo
  source 1..88: mol_type = genomic DNA

SEQ ID NO: 59626 - DNA, 150 bp, Homo sapiens; identical to SEQ ID NO: 39058
  misc_feature 1..150: note = chr1:153608334-153608484
  misc_feature 1..150: note = hypo
  source 1..150: mol_type = genomic DNA

SEQ ID NO: 59627 - DNA, 43 bp, Homo sapiens; identical to SEQ ID NO: 39059
  misc_feature 1..43: note = chr1:153645007-153645050
  misc_feature 1..43: note = hypo
  source 1..43: mol_type = genomic DNA

SEQ ID NO: 59628 - DNA, 54 bp, Homo sapiens
  misc_feature 1..54: note = chr1:153937070-153937124
  misc_feature 1..54: note = hypo
  source 1..54: mol_type = genomic DNA
acaaggctccagaaacgaagcccagtaattccttaagtaaaagaggaatgtgaa

SEQ ID NO: 59629 - DNA, 22 bp, Homo sapiens
  misc_feature 1..22: note = chr1:154098531-154098553
  misc_feature 1..22: note = hypo
  source 1..22: mol_type = genomic DNA
ccgcgcccggccaagaaatgtt

SEQ ID NO: 59630 - DNA, 22 bp, Homo sapiens
  misc_feature 1..22: note = chr1:154107501-154107523
  misc_feature 1..22: note = hypo
  source 1..22: mol_type = genomic DNA
ccacgcccggcctctgtgtacc

SEQ ID NO: 59631 - DNA, 23 bp, Homo sapiens
  misc_feature 1..23: note = chr1:154156755-154156778
  misc_feature 1..23: note = hypo
  source 1..23: mol_type = genomic DNA
gccggcctcggcctcccaaagtg

SEQ ID NO: 59632 - DNA, 30 bp, Homo sapiens; identical to SEQ ID NO: 39064
  misc_feature 1..30: note = chr1:154305492-154305522
  misc_feature 1..30: note = hypo
  source 1..30: mol_type = genomic DNA

SEQ ID NO: 59633 - DNA, 54 bp, Homo sapiens; identical to SEQ ID NO: 39065
  misc_feature 1..54: note = chr1:154499777-154499831
  misc_feature 1..54: note = hypo
  source 1..54: mol_type = genomic DNA

SEQ ID NO: 59634 - DNA, 46 bp, Homo sapiens; identical to SEQ ID NO: 39067
  misc_feature 1..46: note = chr1:154682497-154682543
  misc_feature 1..46: note = hypo
  source 1..46: mol_type = genomic DNA

SEQ ID NO: 59635 - DNA, 30 bp, Homo sapiens; identical to SEQ ID NO: 39068
  misc_feature 1..30: note = chr1:154808785-154808815
  misc_feature 1..30: note = hypo
  source 1..30: mol_type = genomic DNA

SEQ ID NO: 59636 - DNA, 30 bp, Homo sapiens; identical to SEQ ID NO: 39069
  misc_feature 1..30: note = chr1:154851806-154851836
  misc_feature 1..30: note = hypo
  source 1..30: mol_type = genomic DNA

SEQ ID NO: 59637 - DNA, 98 bp, Homo sapiens; identical to SEQ ID NO: 14271
  misc_feature 1..98: note = chr1:155160925-155161023
  misc_feature 1..98: note = hypo
  source 1..98: mol_type = genomic DNA

SEQ ID NO: 59638 - DNA, 30 bp, Homo sapiens; identical to SEQ ID NO: 39071
  misc_feature 1..30: note = chr1:155311790-155311820
  misc_feature 1..30: note = hypo
  source 1..30: mol_type = genomic DNA

SEQ ID NO: 59639 - DNA, 21 bp, Homo sapiens
  misc_feature 1..21: note = chr1:155563460-155563481
  misc_feature 1..21: note = hypo
  source 1..21: mol_type = genomic DNA
aataaaattgccattcgggcc

SEQ ID NO: 59640 - skipped

SEQ ID NO: 59641 - DNA, 59 bp, Homo sapiens; identical to SEQ ID NO: 39074
  misc_feature 1..59: note = chr1:155668700-155668759
  misc_feature 1..59: note = hypo
  source 1..59: mol_type = genomic DNA

SEQ ID NO: 59642 - DNA, 17 bp, Homo sapiens
  misc_feature 1..17: note = chr1:155892702-155892719
  misc_feature 1..17: note = hypo
  source 1..17: mol_type = genomic DNA
aaagacagtcctggccg

SEQ ID NO: 59643 - DNA, 31 bp, Homo sapiens; identical to SEQ ID NO: 39077
  misc_feature 1..31: note = chr1:155905287-155905318
  misc_feature 1..31: note = hypo
  source 1..31: mol_type = genomic DNA

SEQ ID NO: 59644 - DNA, 30 bp, Homo sapiens; identical to SEQ ID NO: 39078
  misc_feature 1..30: note = chr1:155911924-155911954
  misc_feature 1..30: note = hypo
  source 1..30: mol_type = genomic DNA

SEQ ID NO: 59645 - DNA, 30 bp, Homo sapiens; identical to SEQ ID NO: 39079
  misc_feature 1..30: note = chr1:155912603-155912633
  misc_feature 1..30: note = hypo
  source 1..30: mol_type = genomic DNA

SEQ ID NO: 59646 - DNA, 23 bp, Homo sapiens
  misc_feature 1..23: note = chr1:155954259-155954282
  misc_feature 1..23: note = hypo
  source 1..23: mol_type = genomic DNA
aaagccagacaaaggcgcccagg

SEQ ID NO: 59647 - DNA, 42 bp, Homo sapiens; identical to SEQ ID NO: 39081
  misc_feature 1..42: note = chr1:156030121-156030163
  misc_feature 1..42: note = hypo
  source 1..42: mol_type = genomic DNA

SEQ ID NO: 59648 - DNA, 105 bp, Homo sapiens; identical to SEQ ID NO: 39082
  misc_feature 1..105: note = chr1:156031479-156031584
  misc_feature 1..105: note = hypo
  source 1..105: mol_type = genomic DNA

SEQ ID NO: 59649 - DNA, 206 bp, Homo sapiens; identical to SEQ ID NO: 39083
  misc_feature 1..206: note = chr1:156253833-156254039
  misc_feature 1..206: note = hypo
  source 1..206: mol_type = genomic DNA

SEQ ID NO: 59650 - DNA, 102 bp, Homo sapiens; identical to SEQ ID NO: 39084
  misc_feature 1..102: note = chr1:156271344-156271446
  misc_feature 1..102: note = hypo
  source 1..102: mol_type = genomic DNA

SEQ ID NO: 59651 - DNA, 47 bp, Homo sapiens; identical to SEQ ID NO: 14276
  misc_feature 1..47: note = chr1:156433495-156433542
  misc_feature 1..47: note = hypo
  source 1..47: mol_type = genomic DNA

SEQ ID NO: 59652 - DNA, 18 bp, Homo sapiens
  misc_feature 1..18: note = chr1:156441212-156441230
  misc_feature 1..18: note = hypo
  source 1..18: mol_type = genomic DNA
gcccggccagaatcaact

SEQ ID NO: 59653 - DNA, 34 bp, Homo sapiens; identical to SEQ ID NO: 39087
  misc_feature 1..34: note = chr1:156690386-156690420
  misc_feature 1..34: note = hypo
  source 1..34: mol_type = genomic DNA

SEQ ID NO: 59654 - DNA, 154 bp, Homo sapiens; identical to SEQ ID NO: 39089
  misc_feature 1..154: note = chr1:156843312-156843466
  misc_feature 1..154: note = hypo
  source 1..154: mol_type = genomic DNA

SEQ ID NO: 59655 - DNA, 247 bp, Homo sapiens; identical to SEQ ID NO: 39090
  misc_feature 1..247: note = chr1:156849725-156849972
  misc_feature 1..247: note = hypo
  source 1..247: mol_type = genomic DNA

SEQ ID NO: 59656 - DNA, 37 bp, Homo sapiens; identical to SEQ ID NO: 39091
  misc_feature 1..37: note = chr1:156866362-156866399
  misc_feature 1..37: note = hypo
  source 1..37: mol_type = genomic DNA

SEQ ID NO: 59657 - DNA, 30 bp, Homo sapiens; identical to SEQ ID NO: 39092
  misc_feature 1..30: note = chr1:157086435-157086465
  misc_feature 1..30: note = hypo
  source 1..30: mol_type = genomic DNA

SEQ ID NO: 59658 - DNA, 30 bp, Homo sapiens
  misc_feature 1..30: note = chr1:157247317-157247347
  misc_feature 1..30: note = hypo
  source 1..30: mol_type = genomic DNA
gcttacctgggtatgggcattgtctgggcc

SEQ ID NO: 59659 - DNA, 75 bp, Homo sapiens; identical to SEQ ID NO: 23734
  misc_feature 1..75: note = chr1:157247388-157247463
  misc_feature 1..75: note = hypo
  source 1..75: mol_type = genomic DNA

SEQ ID NO: 59660 - DNA, 136 bp, Homo sapiens; identical to SEQ ID NO: 23735
  misc_feature 1..136: note = chr1:157458773-157458909
  misc_feature 1..136: note = hypo
  source 1..136: mol_type = genomic DNA

SEQ ID NO: 59661 - DNA, 38 bp, Homo sapiens; identical to SEQ ID NO: 39095
  misc_feature 1..38: note = chr1:157490582-157490620
  misc_feature 1..38: note = hypo
  source 1..38: mol_type = genomic DNA

SEQ ID NO: 59662 - DNA, 191 bp, Homo sapiens; identical to SEQ ID NO: 39096
  misc_feature 1..191: note = chr1:157527405-157527596
  misc_feature 1..191: note = hypo
  source 1..191: mol_type = genomic DNA

SEQ ID NO: 59663 - DNA, 87 bp, Homo sapiens; identical to SEQ ID NO: 39097
  misc_feature 1..87: note = chr1:157543012-157543099
  misc_feature 1..87: note = hypo
  source 1..87: mol_type = genomic DNA

SEQ ID NO: 59664 - DNA, 36 bp, Homo sapiens; identical to SEQ ID NO: 39098
  misc_feature 1..36: note = chr1:157791984-157792020
  misc_feature 1..36: note = hypo
  source 1..36: mol_type = genomic DNA

SEQ ID NO: 59665 - DNA, 202 bp, Homo sapiens
  misc_feature 1..202: note = chr1:157895211-157895413
  misc_feature 1..202: note = hypo
  source 1..202: mol_type = genomic DNA
gatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcaggg

SEQ ID NO: 59666 - DNA, 89 bp, Homo sapiens
  misc_feature 1..89: note = chr1:157895443-157895532
  misc_feature 1..89: note = hypo
  source 1..89: mol_type = genomic DNA
gaaagagtccagggccggcggggtgctatgaggcgaggacttcctgagccgaggaccgggtgggttgtgagttgcgaccagcctcgctg

SEQ ID NO: 59667 - DNA, 141 bp, Homo sapiens; identical to SEQ ID NO: 14282
  misc_feature 1..141: note = chr1:158169208-158169349
  misc_feature 1..141: note = hypo
  source 1..141: mol_type = genomic DNA

SEQ ID NO: 59668 - DNA, 60 bp, Homo sapiens; identical to SEQ ID NO: 39101
  misc_feature 1..60: note = chr1:158237112-158237172
  misc_feature 1..60: note = hypo
  source 1..60: mol_type = genomic DNA

SEQ ID NO: 59669 - DNA, 20 bp, Homo sapiens
  misc_feature 1..20: note = chr1:158366698-158366718
  misc_feature 1..20: note = hypo
  source 1..20: mol_type = genomic DNA
tattttggccaggggcggtg

SEQ ID NO: 59670 - DNA, 30 bp, Homo sapiens; identical to SEQ ID NO: 39103
  misc_feature 1..30: note = chr1:158578092-158578122
  misc_feature 1..30: note = hypo
  source 1..30: mol_type = genomic DNA

SEQ ID NO: 59671 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 59672 - DNA, 30 bp, Homo sapiens; identical to SEQ ID NO: 14287
  misc_feature 1..30: note = chr1:158639324-158639354
  misc_feature 1..30: note = hypo
  source 1..30: mol_type = genomic DNA

SEQ ID NO: 59673 - DNA, 44 bp, Homo sapiens; identical to SEQ ID NO: 39108
  misc_feature 1..44: note = chr1:158672331-158672375
  misc_feature 1..44: note = hypo
  source 1..44: mol_type = genomic DNA

SEQ ID NO: 59674 - DNA, 107 bp, Homo sapiens; identical to SEQ ID NO: 39109
  misc_feature 1..107: note = chr1:158723718-158723825
  misc_feature 1..107: note = hypo
  source 1..107: mol_type = genomic DNA

SEQ ID NO: 59675 - DNA, 17 bp, Homo sapiens
  misc_feature 1..17: note = chr1:158730575-158730592
  misc_feature 1..17: note = hypo
  source 1..17: mol_type = genomic DNA
ctgggtgcagtggctcg

SEQ ID NO: 59676 - DNA, 33 bp, Homo sapiens; identical to SEQ ID NO: 39111
  misc_feature 1..33: note = chr1:158748784-158748817
  misc_feature 1..33: note = hypo
  source 1..33: mol_type = genomic DNA

SEQ ID NO: 59677 - DNA, 42 bp, Homo sapiens; identical to SEQ ID NO: 39112
  misc_feature 1..42: note = chr1:158815297-158815339
  misc_feature 1..42: note = hypo
  source 1..42: mol_type = genomic DNA

SEQ ID NO: 59678 - DNA, 23 bp, Homo sapiens
  misc_feature 1..23: note = chr1:159448019-159448042
  misc_feature 1..23: note = hypo
  source 1..23: mol_type = genomic DNA
tttttttttttgagacggagtct

SEQ ID NO: 59679 - DNA, 41 bp, Homo sapiens; identical to SEQ ID NO: 39114
  misc_feature 1..41: note = chr1:159650169-159650210
  misc_feature 1..41: note = hypo
  source 1..41: mol_type = genomic DNA

SEQ ID NO: 59680 - DNA, 20 bp, Homo sapiens
  misc_feature 1..20: note = chr1:159679189-159679209
  misc_feature 1..20: note = hypo
  source 1..20: mol_type = genomic DNA
aagagcgagactccgtctcg

SEQ ID NO: 59681 - DNA, 30 bp, Homo sapiens; identical to SEQ ID NO: 39116
  misc_feature 1..30: note = chr1:159683905-159683935
  misc_feature 1..30: note = hypo
  source 1..30: mol_type = genomic DNA

SEQ ID NO: 59682 - DNA, 169 bp, Homo sapiens; identical to SEQ ID NO: 14290
  misc_feature 1..169: note = chr1:159883486-159883655
  misc_feature 1..169: note = hypo
  source 1..169: mol_type = genomic DNA

SEQ ID NO: 59683 - DNA, 19 bp, Homo sapiens
  misc_feature 1..19: note = chr1:159930262-159930281
  misc_feature 1..19: note = hypo
  source 1..19: mol_type = genomic DNA
ttttttcctttgagacgga

SEQ ID NO: 59684 - DNA, 30 bp, Homo sapiens; identical to SEQ ID NO: 14291
  misc_feature 1..30: note = chr1:159932029-159932059
  misc_feature 1..30: note = hypo
  source 1..30: mol_type = genomic DNA

SEQ ID NO: 59685 - DNA, 71 bp, Homo sapiens; identical to SEQ ID NO: 39120
  misc_feature 1..71: note = chr1:160025702-160025773
  misc_feature 1..71: note = hypo
  source 1..71: mol_type = genomic DNA

SEQ ID NO: 59686 - DNA, 33 bp, Homo sapiens
  misc_feature 1..33: note = chr1:160451202-160451235
  misc_feature 1..33: note = hypo
  source 1..33: mol_type = genomic DNA
actggagctgttcctattcggccatcttggctg

SEQ ID NO: 59687 - DNA, 61 bp, Homo sapiens
  misc_feature 1..61: note = chr1:160693873-160693934
  misc_feature 1..61: note = hypo
  source 1..61: mol_type = genomic DNA
tcacccgtggtaacccgagccctggtattatacacataggtcctgtcctcctgaaaacggg

SEQ ID NO: 59688 - DNA, 143 bp, Homo sapiens; identical to SEQ ID NO: 39123
  misc_feature 1..143: note = chr1:160787406-160787549
  misc_feature 1..143: note = hypo
  source 1..143: mol_type = genomic DNA

SEQ ID NO: 59689 - DNA, 30 bp, Homo sapiens; identical to SEQ ID NO: 39124
  misc_feature 1..30: note = chr1:160820959-160820989
  misc_feature 1..30: note = hypo
  source 1..30: mol_type = genomic DNA

SEQ ID NO: 59690 - DNA, 30 bp, Homo sapiens; identical to SEQ ID NO: 14294
  misc_feature 1..30: note = chr1:160853373-160853403
  misc_feature 1..30: note = hypo
  source 1..30: mol_type = genomic DNA

SEQ ID NO: 59691 - DNA, 94 bp, Homo sapiens; identical to SEQ ID NO: 39126
  misc_feature 1..94: note = chr1:160880601-160880695
  misc_feature 1..94: note = hypo
  source 1..94: mol_type = genomic DNA

SEQ ID NO: 59692 - DNA, 146 bp, Homo sapiens; identical to SEQ ID NO: 39127
  misc_feature 1..146: note = chr1:160953007-160953153
  misc_feature 1..146: note = hypo
  source 1..146: mol_type = genomic DNA

SEQ ID NO: 59693 - DNA, 16 bp, Homo sapiens
  misc_feature 1..16: note = chr1:161007746-161007762
  misc_feature 1..16: note = hypo
  source 1..16: mol_type = genomic DNA
ccgcttgcccatctga

SEQ ID NO: 59694 - DNA, 30 bp, Homo sapiens; identical to SEQ ID NO: 39130
  misc_feature 1..30: note = chr1:161044643-161044673
  misc_feature 1..30: note = hypo
  source 1..30: mol_type = genomic DNA

SEQ ID NO: 59695 - DNA, 181 bp, Homo sapiens; identical to SEQ ID NO: 39131
  misc_feature 1..181: note = chr1:161056643-161056824
  misc_feature 1..181: note = hypo
  source 1..181: mol_type = genomic DNA

SEQ ID NO: 59696 - DNA, 33 bp, Homo sapiens; identical to SEQ ID NO: 39132
  misc_feature 1..33: note = chr1:161358973-161359006
  misc_feature 1..33: note = hypo
  source 1..33: mol_type = genomic DNA

SEQ ID NO: 59697 - DNA, 360 bp, Homo sapiens; identical to SEQ ID NO: 39133
  misc_feature 1..360: note = chr1:161367772-161368132
  misc_feature 1..360: note = hypo
  source 1..360: mol_type = genomic DNA

SEQ ID NO: 59698 - DNA, 37 bp, Homo sapiens
  misc_feature 1..37: note = chr1:161442404-161442441
  misc_feature 1..37: note = hypo
  source 1..37: mol_type = genomic DNA
ttcccctggagaccccggcgggcagtctctcgaccct

SEQ ID NO: 59699 - DNA, 102 bp, Homo sapiens
  misc_feature 1..102: note = chr1:161442471-161442573
  misc_feature 1..102: note = hypo
  source 1..102: mol_type = genomic DNA
gtcgacctctctccctccgctctccctccgcgcccaacctcagttgcctggatgtgaggagagcctccccttctgccctcctcatcgcgccagcctgtcttg

SEQ ID NO: 59700 - DNA, 30 bp, Homo sapiens; identical to SEQ ID NO: 39136
  misc_feature 1..30: note = chr1:161493414-161493444
  misc_feature 1..30: note = hypo
  source 1..30: mol_type = genomic DNA

SEQ ID NO: 59701 - DNA, 30 bp, Homo sapiens; identical to SEQ ID NO: 39137
  misc_feature 1..30: note = chr1:161577640-161577670
  misc_feature 1..30: note = hypo
  source 1..30: mol_type = genomic DNA

SEQ ID NO: 59702 - DNA, 45 bp, Homo sapiens; identical to SEQ ID NO: 39138
  misc_feature 1..45: note = chr1:161879452-161879497
  misc_feature 1..45: note = hypo
  source 1..45: mol_type = genomic DNA

SEQ ID NO: 59703 - DNA, 30 bp, Homo sapiens; identical to SEQ ID NO: 14301
  misc_feature 1..30: note = chr1:161913509-161913539
  misc_feature 1..30: note = hypo
  source 1..30: mol_type = genomic DNA

SEQ ID NO: 59704 - DNA, 30 bp, Homo sapiens; identical to SEQ ID NO: 39140
  misc_feature 1..30: note = chr1:163363352-163363382
  misc_feature 1..30: note = hypo
  source 1..30: mol_type = genomic DNA

SEQ ID NO: 59705 - DNA, 39 bp, Homo sapiens; identical to SEQ ID NO: 39141
  misc_feature 1..39: note = chr1:165664200-165664239
  misc_feature 1..39: note = hypo
  source 1..39: mol_type = genomic DNA

SEQ ID NO: 59706 - DNA, 36 bp, Homo sapiens; identical to SEQ ID NO: 39142
  misc_feature 1..36: note = chr1:165809083-165809119
  misc_feature 1..36: note = hypo
  source 1..36: mol_type = genomic DNA

SEQ ID NO: 59707 - DNA, 30 bp, Homo sapiens; identical to SEQ ID NO: 39143
  misc_feature 1..30: note = chr1:167505794-167505824
  misc_feature 1..30: note = hypo
  source 1..30: mol_type = genomic DNA

SEQ ID NO: 59708 - DNA, 38 bp, Homo sapiens; identical to SEQ ID NO: 39144
  misc_feature 1..38: note = chr1:167789113-167789151
  misc_feature 1..38: note = hypo
  source 1..38: mol_type = genomic DNA

SEQ ID NO: 59709 - DNA, 30 bp, Homo sapiens; identical to SEQ ID NO: 39146
  misc_feature 1..30: note = chr1:168058977-168059007
  misc_feature 1..30: note = hypo
  source 1..30: mol_type = genomic DNA

SEQ ID NO: 59710 - DNA, 29 bp, Homo sapiens
  misc_feature 1..29: note = chr1:168116130-168116159
  misc_feature 1..29: note = hypo
  source 1..29: mol_type = genomic DNA
actacacgtagaagccgggtgcggtggct

SEQ ID NO: 59711 - DNA, 30 bp, Homo sapiens; identical to SEQ ID NO: 14304
  misc_feature 1..30: note = chr1:168150766-168150796
  misc_feature 1..30: note = hypo
  source 1..30: mol_type = genomic DNA

SEQ ID NO: 59712 - DNA, 120 bp, Homo sapiens; identical to SEQ ID NO: 39149
  misc_feature 1..120: note = chr1:171452999-171453119
  misc_feature 1..120: note = hypo
  source 1..120: mol_type = genomic DNA

SEQ ID NO: 59713 - DNA, 30 bp, Homo sapiens; identical to SEQ ID NO: 39150
  misc_feature 1..30: note = chr1:171555031-171555061
  misc_feature 1..30: note = hypo
  source 1..30: mol_type = genomic DNA

SEQ ID NO: 59714 - DNA, 17 bp, Homo sapiens
  misc_feature 1..17: note = chr1:172902655-172902672
  misc_feature 1..17: note = hypo
  source 1..17: mol_type = genomic DNA
atagcagacttgggccg

SEQ ID NO: 59715 - DNA, 30 bp, Homo sapiens; identical to SEQ ID NO: 39153
  misc_feature 1..30: note = chr1:173090762-173090792
  misc_feature 1..30: note = hypo
  source 1..30: mol_type = genomic DNA

SEQ ID NO: 59716 - DNA, 61 bp, Homo sapiens; identical to SEQ ID NO: 39154
  misc_feature 1..61: note = chr1:173477004-173477065
  misc_feature 1..61: note = hypo
  source 1..61: mol_type = genomic DNA

SEQ ID NO: 59717 - DNA, 30 bp, Homo sapiens; identical to SEQ ID NO: 39155
  misc_feature 1..30: note = chr1:173794930-173794960
  misc_feature 1..30: note = hypo
  source 1..30: mol_type = genomic DNA

SEQ ID NO: 59718 - DNA, 30 bp, Homo sapiens; identical to SEQ ID NO: 39156
  misc_feature 1..30: note = chr1:173897621-173897651
  misc_feature 1..30: note = hypo
  source 1..30: mol_type = genomic DNA

SEQ ID NO: 59719 - DNA, 77 bp, Homo sapiens; identical to SEQ ID NO: 39157
  misc_feature 1..77: note = chr1:173993036-173993113
  misc_feature 1..77: note = hypo
  source 1..77: mol_type = genomic DNA

SEQ ID NO: 59720 - DNA, 30 bp, Homo sapiens; identical to SEQ ID NO: 39158
  misc_feature 1..30: note = chr1:174421982-174422012
  misc_feature 1..30: note = hypo
  source 1..30: mol_type = genomic DNA

SEQ ID NO: 59721 - DNA, 348 bp, Homo sapiens; identical to SEQ ID NO: 39160
  misc_feature 1..348: note = chr1:175355017-175355365
  misc_feature 1..348: note = hypo
  source 1..348: mol_type = genomic DNA

SEQ ID NO: 59722 - DNA, 229 bp, Homo sapiens; identical to SEQ ID NO: 39161
  misc_feature 1..229: note = chr1:175365646-175365875
  misc_feature 1..229: note = hypo
  source 1..229: mol_type = genomic DNA

SEQ ID NO: 59723 - DNA, 78 bp, Homo sapiens; identical to SEQ ID NO: 14308
  misc_feature 1..78: note = chr1:175372494-175372572
  misc_feature 1..78: note = hypo
  source 1..78: mol_type = genomic DNA

SEQ ID NO: 59724 - DNA, 35 bp, Homo sapiens; identical to SEQ ID NO: 39163
  misc_feature 1..35: note = chr1:175375411-175375446
  misc_feature 1..35: note = hypo
  source 1..35: mol_type = genomic DNA

SEQ ID NO: 59725 - DNA, 102 bp, Homo sapiens; identical to SEQ ID NO: 39165
  misc_feature 1..102: note = chr1:175472249-175472351
  misc_feature 1..102: note = hypo
  source 1..102: mol_type = genomic DNA

SEQ ID NO: 59726 - DNA, 32 bp, Homo sapiens; identical to SEQ ID NO: 39166
  misc_feature 1..32: note = chr1:178531766-178531798
  misc_feature 1..32: note = hypo
  source 1..32: mol_type = genomic DNA

SEQ ID NO: 59727 - DNA, 30 bp, Homo sapiens; identical to SEQ ID NO: 39167
  misc_feature 1..30: note = chr1:178857986-178858016
  misc_feature 1..30: note = hypo
  source 1..30: mol_type = genomic DNA

SEQ ID NO: 59728 - DNA, 30 bp, Homo sapiens; identical to SEQ ID NO: 39168
  misc_feature 1..30: note = chr1:178994064-178994094
  misc_feature 1..30: note = hypo
  source 1..30: mol_type = genomic DNA

SEQ ID NO: 59729 - DNA, 26 bp, Homo sapiens
  misc_feature 1..26: note = chr1:179262298-179262324
  misc_feature 1..26: note = hypo
  source 1..26: mol_type = genomic DNA
gcgtgagccaccgcacctggcctcaa

SEQ ID NO: 59730 - DNA, 30 bp, Homo sapiens; identical to SEQ ID NO: 39170
  misc_feature 1..30: note = chr1:179781741-179781771
  misc_feature 1..30: note = hypo
  source 1..30: mol_type = genomic DNA

SEQ ID NO: 59731 - DNA, 30 bp, Homo sapiens; identical to SEQ ID NO: 14309
  misc_feature 1..30: note = chr1:179849955-179849985
  misc_feature 1..30: note = hypo
  source 1..30: mol_type = genomic DNA

SEQ ID NO: 59732 - DNA, 30 bp, Homo sapiens; identical to SEQ ID NO: 39172
  misc_feature 1..30: note = chr1:180096076-180096106
  misc_feature 1..30: note = hypo
  source 1..30: mol_type = genomic DNA

SEQ ID NO: 59733 - DNA, 30 bp, Homo sapiens; identical to SEQ ID NO: 39173
  misc_feature 1..30: note = chr1:180137119-180137149
  misc_feature 1..30: note = hypo
  source 1..30: mol_type = genomic DNA

SEQ ID NO: 59734 - DNA, 57 bp, Homo sapiens; identical to SEQ ID NO: 39174
  misc_feature 1..57: note = chr1:180235667-180235724
  misc_feature 1..57: note = hypo
  source 1..57: mol_type = genomic DNA

SEQ ID NO: 59735 - DNA, 30 bp, Homo sapiens; identical to SEQ ID NO: 39175
  misc_feature 1..30: note = chr1:180910386-180910416
  misc_feature 1..30: note = hypo
  source 1..30: mol_type = genomic DNA

SEQ ID NO: 59736 - DNA, 99 bp, Homo sapiens; identical to SEQ ID NO: 39176
  misc_feature 1..99: note = chr1:180925089-180925188
  misc_feature 1..99: note = hypo
  source 1..99: mol_type = genomic DNA

SEQ ID NO: 59737 - DNA, 30 bp, Homo sapiens; identical to SEQ ID NO: 39177
  misc_feature 1..30: note = chr1:181727256-181727286
  misc_feature 1..30: note = hypo
  source 1..30: mol_type = genomic DNA

SEQ ID NO: 59738 - DNA, 91 bp, Homo sapiens; identical to SEQ ID NO: 39178
  misc_feature 1..91: note = chr1:181922685-181922776
  misc_feature 1..91: note = hypo
  source 1..91: mol_type = genomic DNA

SEQ ID NO: 59739 - DNA, 21 bp, Homo sapiens
  misc_feature 1..21: note = chr1:182815386-182815407
  misc_feature 1..21: note = hypo
  source 1..21: mol_type = genomic DNA
tttgagatggagtttcgcttt

SEQ ID NO: 59740 - DNA, 30 bp, Homo sapiens; identical to SEQ ID NO: 39183
  misc_feature 1..30: note = chr1:191565747-191565777
  misc_feature 1..30: note = hypo
  source 1..30: mol_type = genomic DNA

SEQ ID NO: 59741 - DNA, 150 bp, Homo sapiens; identical to SEQ ID NO: 39184
  misc_feature 1..150: note = chr1:191763150-191763300
  misc_feature 1..150: note = hypo
  source 1..150: mol_type = genomic DNA

SEQ ID NO: 59742 - DNA, 30 bp, Homo sapiens; identical to SEQ ID NO: 39186
  misc_feature 1..30: note = chr1:197771436-197771466
  misc_feature 1..30: note = hypo
  source 1..30: mol_type = genomic DNA

SEQ ID NO: 59743 - DNA, 160 bp, Homo sapiens; identical to SEQ ID NO: 39187
  misc_feature 1..160: note = chr1:200505065-200505225
  misc_feature 1..160: note = hypo
  source 1..160: mol_type = genomic DNA

SEQ ID NO: 59744 - DNA, 30 bp, Homo sapiens; identical to SEQ ID NO: 14313
  misc_feature 1..30: note = chr1:200519350-200519380
  misc_feature 1..30: note = hypo
  source 1..30: mol_type = genomic DNA

SEQ ID NO: 59745 - DNA, 30 bp, Homo sapiens; identical to SEQ ID NO: 14314
  misc_feature 1..30: note = chr1:200864028-200864058
  misc_feature 1..30: note = hypo
  source 1..30: mol_type = genomic DNA

SEQ ID NO: 59746 - DNA, 49 bp, Homo sapiens; identical to SEQ ID NO: 39190
  misc_feature 1..49: note = chr1:200941620-200941669
  misc_feature 1..49: note = hypo
  source 1..49: mol_type = genomic DNA

SEQ ID NO: 59747 - DNA, 30 bp, Homo sapiens; identical to SEQ ID NO: 14315
  misc_feature 1..30: note = chr1:201244396-201244426
  misc_feature 1..30: note = hypo
  source 1..30: mol_type = genomic DNA

SEQ ID NO: 59748 - DNA, 196 bp, Homo sapiens; identical to SEQ ID NO: 39192
  misc_feature 1..196: note = chr1:201445702-201445898
  misc_feature 1..196: note = hypo
  source 1..196: mol_type = genomic DNA

SEQ ID NO: 59749 - DNA, 39 bp, Homo sapiens; identical to SEQ ID NO: 39193
  misc_feature 1..39: note = chr1:201797433-201797472
  misc_feature 1..39: note = hypo
  source 1..39: mol_type = genomic DNA

SEQ ID NO: 59750 - DNA, 30 bp, Homo sapiens; identical to SEQ ID NO: 39194
  misc_feature 1..30: note = chr1:201851118-201851148
  misc_feature 1..30: note = hypo
  source 1..30: mol_type = genomic DNA

SEQ ID NO: 59751 - DNA, 101 bp, Homo sapiens; identical to SEQ ID NO: 39195
  misc_feature 1..101: note = chr1:201977862-201977963
  misc_feature 1..101: note = hypo
  source 1..101: mol_type = genomic DNA

SEQ ID NO: 59752 - DNA, 30 bp, Homo sapiens; identical to SEQ ID NO: 39196
  misc_feature 1..30: note = chr1:201981114-201981144
  misc_feature 1..30: note = hypo
  source 1..30: mol_type = genomic DNA

SEQ ID NO: 59753 - DNA, 42 bp, Homo sapiens; identical to SEQ ID NO: 14317
  misc_feature 1..42: note = chr1:201982442-201982484
  misc_feature 1..42: note = hypo
  source 1..42: mol_type = genomic DNA

SEQ ID NO: 59754 - DNA, 31 bp, Homo sapiens; identical to SEQ ID NO: 23767
  misc_feature 1..31: note = chr1:201983200-201983231
  misc_feature 1..31: note = hypo
  source 1..31: mol_type = genomic DNA

SEQ ID NO: 59755 - DNA, 98 bp, Homo sapiens; identical to SEQ ID NO: 39199
  misc_feature 1..98: note = chr1:201984047-201984145
  misc_feature 1..98: note = hypo
  source 1..98: mol_type = genomic DNA

SEQ ID NO: 59756 - DNA, 159 bp, Homo sapiens; identical to SEQ ID NO: 39200
  misc_feature 1..159: note = chr1:201986490-201986649
  misc_feature 1..159: note = hypo
  source 1..159: mol_type = genomic DNA

SEQ ID NO: 59757 - DNA, 30 bp, Homo sapiens; identical to SEQ ID NO: 39202
  misc_feature 1..30: note = chr1:202101759-202101789
  misc_feature 1..30: note = hypo
  source 1..30: mol_type = genomic DNA

SEQ ID NO: 59758 - DNA, 139 bp, Homo sapiens; identical to SEQ ID NO: 39203
  misc_feature 1..139: note = chr1:202311995-202312134
  misc_feature 1..139: note = hypo
  source 1..139: mol_type = genomic DNA

SEQ ID NO: 59759 - DNA, 30 bp, Homo sapiens; identical to SEQ ID NO: 39204
  misc_feature 1..30: note = chr1:202856302-202856332
  misc_feature 1..30: note = hypo
  source 1..30: mol_type = genomic DNA

SEQ ID NO: 59760 - DNA, 37 bp, Homo sapiens; identical to SEQ ID NO: 39205
  misc_feature 1..37: note = chr1:202898225-202898262
  misc_feature 1..37: note = hypo
  source 1..37: mol_type = genomic DNA

SEQ ID NO: 59761 - DNA, 33 bp, Homo sapiens; identical to SEQ ID NO: 39206
  misc_feature 1..33: note = chr1:202933730-202933763
  misc_feature 1..33: note = hypo
  source 1..33: mol_type = genomic DNA

SEQ ID NO: 59762 - DNA, 79 bp, Homo sapiens; identical to SEQ ID NO: 39207
  misc_feature 1..79: note = chr1:202995301-202995380
  misc_feature 1..79: note = hypo
  source 1..79: mol_type = genomic DNA

SEQ ID NO: 59763 - DNA, 30 bp, Homo sapiens; identical to SEQ ID NO: 39208
  misc_feature 1..30: note = chr1:203257678-203257708
  misc_feature 1..30: note = hypo
  source 1..30: mol_type = genomic DNA

SEQ ID NO: 59764 - DNA, 33 bp, Homo sapiens; identical to SEQ ID NO: 39209
  misc_feature 1..33: note = chr1:203298181-203298214
  misc_feature 1..33: note = hypo
  source 1..33: mol_type = genomic DNA

SEQ ID NO: 59765 - DNA, 55 bp, Homo sapiens
  misc_feature 1..55: note = chr1:203429594-203429649
  misc_feature 1..55: note = hypo
  source 1..55: mol_type = genomic DNA
tatgctggacaaagggcggattcatatcgccagcaggatgaagcgggagagtgca

SEQ ID NO: 59766 - DNA, 22 bp, Homo sapiens
  misc_feature 1..22: note = chr1:203911836-203911858
  misc_feature 1..22: note = hypo
  source 1..22: mol_type = genomic DNA
gattcaggacagggccgggcgt

SEQ ID NO: 59767 - DNA, 30 bp, Homo sapiens; identical to SEQ ID NO: 39212
  misc_feature 1..30: note = chr1:204333529-204333559
  misc_feature 1..30: note = hypo
  source 1..30: mol_type = genomic DNA

SEQ ID NO: 59768 - DNA, 30 bp, Homo sapiens; identical to SEQ ID NO: 39213
  misc_feature 1..30: note = chr1:204535867-204535897
  misc_feature 1..30: note = hypo
  source 1..30: mol_type = genomic DNA

SEQ ID NO: 59769 - DNA, 30 bp, Homo sapiens; identical to SEQ ID NO: 39214
  misc_feature 1..30: note = chr1:204536295-204536325
  misc_feature 1..30: note = hypo
  source 1..30: mol_type = genomic DNA

SEQ ID NO: 59770 - DNA, 122 bp, Homo sapiens; identical to SEQ ID NO: 39215
  misc_feature 1..122: note = chr1:204587578-204587700
  misc_feature 1..122: note = hypo
  source 1..122: mol_type = genomic DNA

SEQ ID NO: 59771 - DNA, 112 bp, Homo sapiens; identical to SEQ ID NO: 39216
  misc_feature 1..112: note = chr1:204588271-204588383
  misc_feature 1..112: note = hypo
  source 1..112: mol_type = genomic DNA

SEQ ID NO: 59772 - DNA, 27 bp, Homo sapiens
  misc_feature 1..27: note = chr1:204721236-204721263
  misc_feature 1..27: note = hypo
  source 1..27: mol_type = genomic DNA
gctacagacccacgcctcctgctgtat

SEQ ID NO: 59773 - DNA, 145 bp, Homo sapiens; identical to SEQ ID NO: 39218
  misc_feature 1..145: note = chr1:205310661-205310806
  misc_feature 1..145: note = hypo
  source 1..145: mol_type = genomic DNA

SEQ ID NO: 59774 - DNA, 24 bp, Homo sapiens
  misc_feature 1..24: note = chr1:205311046-205311070
  misc_feature 1..24: note = hypo
  source 1..24: mol_type = genomic DNA
gattacaggcgtgagccaccgcgc

SEQ ID NO: 59775 - DNA, 30 bp, Homo sapiens; identical to SEQ ID NO: 39220
  misc_feature 1..30: note = chr1:205548923-205548953
  misc_feature 1..30: note = hypo
  source 1..30: mol_type = genomic DNA

SEQ ID NO: 59776 - DNA, 27 bp, Homo sapiens
  misc_feature 1..27: note = chr1:207227190-207227217
  misc_feature 1..27: note = hypo
  source 1..27: mol_type = genomic DNA
ttcgagattttcccacgtccctcactt

SEQ ID NO: 59777 - DNA, 25 bp, Homo sapiens
  misc_feature 1..25: note = chr1:207598909-207598934
  misc_feature 1..25: note = hypo
  source 1..25: mol_type = genomic DNA
ccaaactcaccgagtcatgcaggct

SEQ ID NO: 59778 - DNA, 30 bp, Homo sapiens; identical to SEQ ID NO: 14325
  misc_feature 1..30: note = chr1:207656486-207656516
  misc_feature 1..30: note = hypo
  source 1..30: mol_type = genomic DNA

SEQ ID NO: 59779 - DNA, 137 bp, Homo sapiens; identical to SEQ ID NO: 39225
  misc_feature 1..137: note = chr1:207787630-207787767
  misc_feature 1..137: note = hypo
  source 1..137: mol_type = genomic DNA

SEQ ID NO: 59780 - DNA, 30 bp, Homo sapiens; identical to SEQ ID NO: 39226
  misc_feature 1..30: note = chr1:207857205-207857235
  misc_feature 1..30: note = hypo
  source 1..30: mol_type = genomic DNA

SEQ ID NO: 59781 - DNA, 129 bp, Homo sapiens; identical to SEQ ID NO: 39227
  misc_feature 1..129: note = chr1:207911135-207911264
  misc_feature 1..129: note = hypo
  source 1..129: mol_type = genomic DNA

SEQ ID NO: 59782 - DNA, 116 bp, Homo sapiens; identical to SEQ ID NO: 39228
  misc_feature 1..116: note = chr1:207991495-207991611
  misc_feature 1..116: note = hypo
  source 1..116: mol_type = genomic DNA

SEQ ID NO: 59783 - DNA, 30 bp, Homo sapiens; identical to SEQ ID NO: 39229
  misc_feature 1..30: note = chr1:207992298-207992328
  misc_feature 1..30: note = hypo
  source 1..30: mol_type = genomic DNA

SEQ ID NO: 59784 - DNA, 115 bp, Homo sapiens; identical to SEQ ID NO: 39230
  misc_feature 1..115: note = chr1:208951412-208951527
  misc_feature 1..115: note = hypo
  source 1..115: mol_type = genomic DNA

SEQ ID NO: 59785 - DNA, 137 bp, Homo sapiens; identical to SEQ ID NO: 39231
  misc_feature 1..137: note = chr1:209306205-209306342
  misc_feature 1..137: note = hypo
  source 1..137: mol_type = genomic DNA

SEQ ID NO: 59786 - DNA, 185 bp, Homo sapiens; identical to SEQ ID NO: 39232
  misc_feature 1..185: note = chr1:209601396-209601581
  misc_feature 1..185: note = hypo
  source 1..185: mol_type = genomic DNA

SEQ ID NO: 59787 - DNA, 191 bp, Homo sapiens; identical to SEQ ID NO: 39233
  misc_feature 1..191: note = chr1:209999773-209999964
  misc_feature 1..191: note = hypo
  source 1..191: mol_type = genomic DNA

SEQ ID NO: 59788 - DNA, 33 bp, Homo sapiens; identical to SEQ ID NO: 39234
  misc_feature 1..33: note = chr1:211430421-211430454
  misc_feature 1..33: note = hypo
  source 1..33: mol_type = genomic DNA

SEQ ID NO: 59789 - DNA, 180 bp, Homo sapiens; identical to SEQ ID NO: 39236
  misc_feature 1..180: note = chr1:213189664-213189844
  misc_feature 1..180: note = hypo
  source 1..180: mol_type = genomic DNA

SEQ ID NO: 59790 - DNA, 101 bp, Homo sapiens; identical to SEQ ID NO: 39237
  misc_feature 1..101: note = chr1:213190144-213190245
  misc_feature 1..101: note = hypo
  source 1..101: mol_type = genomic DNA

SEQ ID NO: 59791 - DNA, 41 bp, Homo sapiens; identical to SEQ ID NO: 39238
  misc_feature 1..41: note = chr1:215745246-215745287
  misc_feature 1..41: note = hypo
  source 1..41: mol_type = genomic DNA

SEQ ID NO: 59792 - DNA, 30 bp, Homo sapiens; identical to SEQ ID NO: 39239
  misc_feature 1..30: note = chr1:217805039-217805069
  misc_feature 1..30: note = hypo
  source 1..30: mol_type = genomic DNA

SEQ ID NO: 59793 - DNA, 30 bp, Homo sapiens; identical to SEQ ID NO: 39240
  misc_feature 1..30: note = chr1:219253291-219253321
  misc_feature 1..30: note = hypo
  source 1..30: mol_type = genomic DNA

SEQ ID NO: 59794 - DNA, 39 bp, Homo sapiens; identical to SEQ ID NO: 39241
  misc_feature 1..39: note = chr1:220552763-220552802
  misc_feature 1..39: note = hypo
  source 1..39: mol_type = genomic DNA

SEQ ID NO: 59795 - DNA, 52 bp, Homo sapiens
  misc_feature 1..52: note = chr1:220636414-220636466
  misc_feature 1..52: note = hypo
  source 1..52: mol_type = genomic DNA
acaggtaggatctgccctcccaggtgtcgctgcagctgcagcacctgtggct

SEQ ID NO: 59796 - DNA, 30 bp, Homo sapiens; identical to SEQ ID NO: 39243
  misc_feature 1..30: note = chr1:221706708-221706738
  misc_feature 1..30: note = hypo
  source 1..30: mol_type = genomic DNA

SEQ ID NO: 59797 - DNA, 30 bp, Homo sapiens; identical to SEQ ID NO: 39244
  misc_feature 1..30: note = chr1:222391027-222391057
  misc_feature 1..30: note = hypo
  source 1..30: mol_type = genomic DNA

SEQ ID NO: 59798 - DNA, 165 bp, Homo sapiens; identical to SEQ ID NO: 39245
  misc_feature 1..165: note = chr1:222987570-222987735
  misc_feature 1..165: note = hypo
  source 1..165: mol_type = genomic DNA

SEQ ID NO: 59799 - DNA, 30 bp, Homo sapiens; identical to SEQ ID NO: 39246
  misc_feature 1..30: note = chr1:223841897-223841927
  misc_feature 1..30: note = hypo
  source 1..30: mol_type = genomic DNA

SEQ ID NO: 59800 - DNA, 189 bp, Homo sapiens; identical to SEQ ID NO: 39247
  misc_feature 1..189: note = chr1:223907491-223907680
  misc_feature 1..189: note = hypo
  source 1..189: mol_type = genomic DNA

SEQ ID NO: 59801 - DNA, 30 bp, Homo sapiens; identical to SEQ ID NO: 39248
  misc_feature 1..30: note = chr1:224232559-224232589
  misc_feature 1..30: note = hypo
  source 1..30: mol_type = genomic DNA

SEQ ID NO: 59802 - DNA, 24 bp, Homo sapiens
  misc_feature 1..24: note = chr1:224251284-224251308
  misc_feature 1..24: note = hypo
  source 1..24: mol_type = genomic DNA
gattacaggcgtgagccaccacgc

SEQ ID NO: 59803 - DNA, 30 bp, Homo sapiens; identical to SEQ ID NO: 14332
  misc_feature 1..30: note = chr1:224267844-224267874
  misc_feature 1..30: note = hypo
  source 1..30: mol_type = genomic DNA

SEQ ID NO: 59804 - DNA, 32 bp, Homo sapiens; identical to SEQ ID NO: 39251
  misc_feature 1..32: note = chr1:224300912-224300944
  misc_feature 1..32: note = hypo
  source 1..32: mol_type = genomic DNA

SEQ ID NO: 59805 - DNA, 16 bp, Homo sapiens
  misc_feature 1..16: note = chr1:224361275-224361291
  misc_feature 1..16: note = hypo
  source 1..16: mol_type = genomic DNA
acgtagagtgagattc

SEQ ID NO: 59806 - DNA, 121 bp, Homo sapiens; identical to SEQ ID NO: 14333
  misc_feature 1..121: note = chr1:226062878-226062999
  misc_feature 1..121: note = hypo
  source 1..121: mol_type = genomic DNA

SEQ ID NO: 59807 - DNA, 86 bp, Homo sapiens; identical to SEQ ID NO: 39254
  misc_feature 1..86: note = chr1:226163129-226163215
  misc_feature 1..86: note = hypo
  source 1..86: mol_type = genomic DNA

SEQ ID NO: 59808 - DNA, 30 bp, Homo sapiens; identical to SEQ ID NO: 39255
  misc_feature 1..30: note = chr1:226284013-226284043
  misc_feature 1..30: note = hypo
  source 1..30: mol_type = genomic DNA

SEQ ID NO: 59809 - DNA, 127 bp, Homo sapiens; identical to SEQ ID NO: 39256
  misc_feature 1..127: note = chr1:226303892-226304019
  misc_feature 1..127: note = hypo
  source 1..127: mol_type = genomic DNA

SEQ ID NO: 59810 - DNA, 49 bp, Homo sapiens; identical to SEQ ID NO: 39257
  misc_feature 1..49: note = chr1:226314981-226315030
  misc_feature 1..49: note = hypo
  source 1..49: mol_type = genomic DNA

SEQ ID NO: 59811 - DNA, 43 bp, Homo sapiens; identical to SEQ ID NO: 39258
  misc_feature 1..43: note = chr1:226620644-226620687
  misc_feature 1..43: note = hypo
  source 1..43: mol_type = genomic DNA

SEQ ID NO: 59812 - DNA, 30 bp, Homo sapiens; identical to SEQ ID NO: 39259
  misc_feature 1..30: note = chr1:226725373-226725403
  misc_feature 1..30: note = hypo
  source 1..30: mol_type = genomic DNA

SEQ ID NO: 59813 - DNA, 20 bp, Homo sapiens
  misc_feature 1..20: note = chr1:226816426-226816446
  misc_feature 1..20: note = hypo
  source 1..20: mol_type = genomic DNA
gtctccgtgacaactacaca

SEQ ID NO: 59814 - DNA, 30 bp, Homo sapiens; identical to SEQ ID NO: 39261
  misc_feature 1..30: note = chr1:226846375-226846405
  misc_feature 1..30: note = hypo
  source 1..30: mol_type = genomic DNA

SEQ ID NO: 59815 - DNA, 87 bp, Homo sapiens; identical to SEQ ID NO: 39262
  misc_feature 1..87: note = chr1:226908374-226908461
  misc_feature 1..87: note = hypo
  source 1..87: mol_type = genomic DNA

SEQ ID NO: 59816 - DNA, 38 bp, Homo sapiens; identical to SEQ ID NO: 39263
  misc_feature 1..38: note = chr1:226954853-226954891
  misc_feature 1..38: note = hypo
  source 1..38: mol_type = genomic DNA

SEQ ID NO: 59817 - DNA, 35 bp, Homo sapiens; identical to SEQ ID NO: 39264
  misc_feature 1..35: note = chr1:227174055-227174090
  misc_feature 1..35: note = hypo
  source 1..35: mol_type = genomic DNA

SEQ ID NO: 59818 - DNA, 42 bp, Homo sapiens; identical to SEQ ID NO: 14335
  misc_feature 1..42: note = chr1:227750829-227750871
  misc_feature 1..42: note = hypo
  source 1..42: mol_type = genomic DNA

SEQ ID NO: 59819 - DNA, 30 bp, Homo sapiens; identical to SEQ ID NO: 14336
  misc_feature 1..30: note = chr1:227921541-227921571
  misc_feature 1..30: note = hypo
  source 1..30: mol_type = genomic DNA

SEQ ID NO: 59820 - DNA, 30 bp, Homo sapiens; identical to SEQ ID NO: 39267
  misc_feature 1..30: note = chr1:227921780-227921810
  misc_feature 1..30: note = hypo
  source 1..30: mol_type = genomic DNA

SEQ ID NO: 59821 - DNA, 61 bp, Homo sapiens; identical to SEQ ID NO: 39268
  misc_feature 1..61: note = chr1:227926624-227926685
  misc_feature 1..61: note = hypo
  source 1..61: mol_type = genomic DNA

SEQ ID NO: 59822 - DNA, 30 bp, Homo sapiens; identical to SEQ ID NO: 39269
  misc_feature 1..30: note = chr1:227955886-227955916
  misc_feature 1..30: note = hypo
  source 1..30: mol_type = genomic DNA

SEQ ID NO: 59823 - DNA, 221 bp, Homo sapiens; identical to SEQ ID NO: 39270
  misc_feature 1..221: note = chr1:228083399-228083620
  misc_feature 1..221: note = hypo
  source 1..221: mol_type = genomic DNA

SEQ ID NO: 59824 - DNA, 30 bp, Homo sapiens; identical to SEQ ID NO: 39271
  misc_feature 1..30: note = chr1:228117865-228117895
  misc_feature 1..30: note = hypo
  source 1..30: mol_type = genomic DNA

SEQ ID NO: 59825 - DNA, 19 bp, Homo sapiens
  misc_feature 1..19: note = chr1:228201251-228201270
  misc_feature 1..19: note = hypo
  source 1..19: mol_type = genomic DNA
ggtgcgggttgggagagct

SEQ ID NO: 59826 - DNA, 37 bp, Homo sapiens; identical to SEQ ID NO: 39273
  misc_feature 1..37: note = chr1:228238537-228238574
  misc_feature 1..37: note = hypo
  source 1..37: mol_type = genomic DNA

SEQ ID NO: 59827 - DNA, 30 bp, Homo sapiens; identical to SEQ ID NO: 39274
  misc_feature 1..30: note = chr1:228342820-228342850
  misc_feature 1..30: note = hypo
  source 1..30: mol_type = genomic DNA

SEQ ID NO: 59828 - DNA, 30 bp, Homo sapiens; identical to SEQ ID NO: 39275
  misc_feature 1..30: note = chr1:228466507-228466537
  misc_feature 1..30: note = hypo
  source 1..30: mol_type = genomic DNA

SEQ ID NO: 59829 - DNA, 164 bp, Homo sapiens; identical to SEQ ID NO: 39276
  misc_feature 1..164: note = chr1:228495832-228495996
  misc_feature 1..164: note = hypo
  source 1..164: mol_type = genomic DNA

SEQ ID NO: 59830 - DNA, 38 bp, Homo sapiens; identical to SEQ ID NO: 39277
  misc_feature 1..38: note = chr1:228504430-228504468
  misc_feature 1..38: note = hypo
  source 1..38: mol_type = genomic DNA

SEQ ID NO: 59831 - DNA, 156 bp, Homo sapiens; identical to SEQ ID NO: 23784
  misc_feature 1..156: note = chr1:228529016-228529172
  misc_feature 1..156: note = hypo
  source 1..156: mol_type = genomic DNA

SEQ ID NO: 59832 - DNA, 30 bp, Homo sapiens; identical to SEQ ID NO: 14338
  misc_feature 1..30: note = chr1:228536492-228536522
  misc_feature 1..30: note = hypo
  source 1..30: mol_type = genomic DNA

SEQ ID NO: 59833 - DNA, 30 bp, Homo sapiens; identical to SEQ ID NO: 14339
  misc_feature 1..30: note = chr1:228552593-228552623
  misc_feature 1..30: note = hypo
  source 1..30: mol_type = genomic DNA

SEQ ID NO: 59834 - DNA, 163 bp, Homo sapiens; identical to SEQ ID NO: 39281
  misc_feature 1..163: note = chr1:228554806-228554969
  misc_feature 1..163: note = hypo
  source 1..163: mol_type = genomic DNA

SEQ ID NO: 59835 - DNA, 97 bp, Homo sapiens
  misc_feature 1..97: note = chr1:228559238-228559335
  misc_feature 1..97: note = hypo
  source 1..97: mol_type = genomic DNA
gcaccgcgtgctggaggaggaggccgccagggaggagcaggccaccctcctggccaaagccccctcattcgagactgccctccggctgcctgcctct

SEQ ID NO: 59836 - DNA, 46 bp, Homo sapiens; identical to SEQ ID NO: 39283
  misc_feature 1..46: note = chr1:228919370-228919416
  misc_feature 1..46: note = hypo
  source 1..46: mol_type = genomic DNA

SEQ ID NO: 59837 - DNA, 28 bp, Homo sapiens
  misc_feature 1..28: note = chr1:229705999-229706027
  misc_feature 1..28: note = hypo
  source 1..28: mol_type = genomic DNA
ttgctattacaggcgtaaaccaccgcac

SEQ ID NO: 59838 - DNA, 64 bp, Homo sapiens; identical to SEQ ID NO: 39285
  misc_feature 1..64: note = chr1:230107209-230107273
  misc_feature 1..64: note = hypo
  source 1..64: mol_type = genomic DNA

SEQ ID NO: 59839 - DNA, 35 bp, Homo sapiens
  misc_feature 1..35: note = chr1:230404263-230404298
  misc_feature 1..35: note = hypo
  source 1..35: mol_type = genomic DNA
tacagcacattaaacagaagcgtgtgctcaggccc

SEQ ID NO: 59840 - DNA, 72 bp, Homo sapiens; identical to SEQ ID NO: 39287
  misc_feature 1..72: note = chr1:230423782-230423854
  misc_feature 1..72: note = hypo
  source 1..72: mol_type = genomic DNA

SEQ ID NO: 59841 - DNA, 30 bp, Homo sapiens; identical to SEQ ID NO: 39288
  misc_feature 1..30: note = chr1:230424489-230424519
  misc_feature 1..30: note = hypo
  source 1..30: mol_type = genomic DNA

SEQ ID NO: 59842 - DNA, 30 bp, Homo sapiens; identical to SEQ ID NO: 39289
  misc_feature 1..30: note = chr1:230453332-230453362
  misc_feature 1..30: note = hypo
  source 1..30: mol_type = genomic DNA

SEQ ID NO: 59843 - DNA, 53 bp, Homo sapiens; identical to SEQ ID NO: 14343
  misc_feature 1..53: note = chr1:230453632-230453685
  misc_feature 1..53: note = hypo
  source 1..53: mol_type = genomic DNA

SEQ ID NO: 59844 - DNA, 30 bp, Homo sapiens; identical to SEQ ID NO: 39291
  misc_feature 1..30: note = chr1:230458365-230458395
  misc_feature 1..30: note = hypo
  source 1..30: mol_type = genomic DNA

SEQ ID NO: 59845 - DNA, 128 bp, Homo sapiens; identical to SEQ ID NO: 39292
  misc_feature 1..128: note = chr1:230992827-230992955
  misc_feature 1..128: note = hypo
  source 1..128: mol_type = genomic DNA

SEQ ID NO: 59846 - DNA, 53 bp, Homo sapiens; identical to SEQ ID NO: 39293
  misc_feature 1..53: note = chr1:231163086-231163139
  misc_feature 1..53: note = hypo
  source 1..53: mol_type = genomic DNA

SEQ ID NO: 59847 - DNA, 96 bp, Homo sapiens; identical to SEQ ID NO: 39294
  misc_feature 1..96: note = chr1:231663293-231663389
  misc_feature 1..96: note = hypo
  source 1..96: mol_type = genomic DNA

SEQ ID NO: 59848 - DNA, 120 bp, Homo sapiens; identical to SEQ ID NO: 39295
  misc_feature 1..120: note = chr1:231738873-231738993
  misc_feature 1..120: note = hypo
  source 1..120: mol_type = genomic DNA

SEQ ID NO: 59849 - DNA, 30 bp, Homo sapiens; identical to SEQ ID NO: 39296
  misc_feature 1..30: note = chr1:232761388-232761418
  misc_feature 1..30: note = hypo
  source 1..30: mol_type = genomic DNA

SEQ ID NO: 59850 - DNA, 278 bp, Homo sapiens; identical to SEQ ID NO: 39298
  misc_feature 1..278: note = chr1:234621065-234621343
  misc_feature 1..278: note = hypo
  source 1..278: mol_type = genomic DNA

SEQ ID NO: 59851 - DNA, 30 bp, Homo sapiens; identical to SEQ ID NO: 39299
  misc_feature 1..30: note = chr1:234625024-234625054
  misc_feature 1..30: note = hypo
  source 1..30: mol_type = genomic DNA

SEQ ID NO: 59852 - DNA, 30 bp, Homo sapiens; identical to SEQ ID NO: 39300
  misc_feature 1..30: note = chr1:234724806-234724836
  misc_feature 1..30: note = hypo
  source 1..30: mol_type = genomic DNA

SEQ ID NO: 59853 - DNA, 30 bp, Homo sapiens; identical to SEQ ID NO: 39301
  misc_feature 1..30: note = chr1:234795478-234795508
  misc_feature 1..30: note = hypo
  source 1..30: mol_type = genomic DNA

SEQ ID NO: 59854 - DNA, 30 bp, Homo sapiens; identical to SEQ ID NO: 39302
  misc_feature 1..30: note = chr1:234845113-234845143
  misc_feature 1..30: note = hypo
  source 1..30: mol_type = genomic DNA

SEQ ID NO: 59855 - DNA, 169 bp, Homo sapiens; identical to SEQ ID NO: 39303
  misc_feature 1..169: note = chr1:234882410-234882579
  misc_feature 1..169: note = hypo
  source 1..169: mol_type = genomic DNA

SEQ ID NO: 59856 - DNA, 30 bp, Homo sapiens; identical to SEQ ID NO: 14348
  misc_feature 1..30: note = chr1:234959409-234959439
  misc_feature 1..30: note = hypo
  source 1..30: mol_type = genomic DNA

SEQ ID NO: 59857 - DNA, 76 bp, Homo sapiens; identical to SEQ ID NO: 39305
  misc_feature 1..76: note = chr1:235003807-235003883
  misc_feature 1..76: note = hypo
  source 1..76: mol_type = genomic DNA

SEQ ID NO: 59858 - DNA, 39 bp, Homo sapiens; identical to SEQ ID NO: 39306
  misc_feature 1..39: note = chr1:235005711-235005750
  misc_feature 1..39: note = hypo
  source 1..39: mol_type = genomic DNA

SEQ ID NO: 59859 - DNA, 152 bp, Homo sapiens; identical to SEQ ID NO: 39307
  misc_feature 1..152: note = chr1:235267072-235267224
  misc_feature 1..152: note = hypo
  source 1..152: mol_type = genomic DNA

SEQ ID NO: 59860 - DNA, 76 bp, Homo sapiens; identical to SEQ ID NO: 39308
  misc_feature 1..76: note = chr1:235292638-235292714
  misc_feature 1..76: note = hypo
  source 1..76: mol_type = genomic DNA

SEQ ID NO: 59861 - DNA, 120 bp, Homo sapiens; identical to SEQ ID NO: 39309
  misc_feature 1..120: note = chr1:235325361-235325481
  misc_feature 1..120: note = hypo
  source 1..120: mol_type = genomic DNA

SEQ ID NO: 59862 - DNA, 31 bp, Homo sapiens; identical to SEQ ID NO: 39310
  misc_feature 1..31: note = chr1:235325541-235325572
  misc_feature 1..31: note = hypo
  source 1..31: mol_type = genomic DNA

SEQ ID NO: 59863 - DNA, 30 bp, Homo sapiens; identical to SEQ ID NO: 39311
  misc_feature 1..30: note = chr1:235793720-235793750
  misc_feature 1..30: note = hypo
  source 1..30: mol_type = genomic DNA

SEQ ID NO: 59864 - DNA, 20 bp, Homo sapiens
  misc_feature 1..20: note = chr1:236044137-236044157
  misc_feature 1..20: note = hypo
  source 1..20: mol_type = genomic DNA
tttagcggccgggcacggtg

SEQ ID NO: 59865 - DNA, 30 bp, Homo sapiens; identical to SEQ ID NO: 39313
  misc_feature 1..30: note = chr1:236081438-236081468
  misc_feature 1..30: note = hypo
  source 1..30: mol_type = genomic DNA

SEQ ID NO: 59866 - DNA, 24 bp, Homo sapiens
  misc_feature 1..24: note = chr1:236252519-236252543
  misc_feature 1..24: note = hypo
  source 1..24: mol_type = genomic DNA
gcttaccaggccaggcgtggtggc

SEQ ID NO: 59867 - DNA, 111 bp, Homo sapiens; identical to SEQ ID NO: 39315
  misc_feature 1..111: note = chr1:236768713-236768824
  misc_feature 1..111: note = hypo
  source 1..111: mol_type = genomic DNA

SEQ ID NO: 59868 - DNA, 40 bp, Homo sapiens; identical to SEQ ID NO: 39316
  misc_feature 1..40: note = chr1:236771396-236771436
  misc_feature 1..40: note = hypo
  source 1..40: mol_type = genomic DNA

SEQ ID NO: 59869 - DNA, 30 bp, Homo sapiens; identical to SEQ ID NO: 39317
  misc_feature 1..30: note = chr1:236811244-236811274
  misc_feature 1..30: note = hypo
  source 1..30: mol_type = genomic DNA

SEQ ID NO: 59870 - DNA, 30 bp, Homo sapiens; identical to SEQ ID NO: 39318
  misc_feature 1..30: note = chr1:236907863-236907893
  misc_feature 1..30: note = hypo
  source 1..30: mol_type = genomic DNA

SEQ ID NO: 59871 - DNA, 30 bp, Homo sapiens; identical to SEQ ID NO: 39319
  misc_feature 1..30: note = chr1:237753724-237753754
  misc_feature 1..30: note = hypo
  source 1..30: mol_type = genomic DNA

SEQ ID NO: 59872 - DNA, 32 bp, Homo sapiens; identical to SEQ ID NO: 39320
  misc_feature 1..32: note = chr1:238235533-238235565
  misc_feature 1..32: note = hypo
  source 1..32: mol_type = genomic DNA

SEQ ID NO: 59873 - DNA, 19 bp, Homo sapiens
  misc_feature 1..19: note = chr1:239516662-239516681
  misc_feature 1..19: note = hypo
  source 1..19: mol_type = genomic DNA
agagcgatactctgattaa

SEQ ID NO: 59874 - DNA, 192 bp, Homo sapiens; identical to SEQ ID NO: 39322
  misc_feature 1..192: note = chr1:239523114-239523306
  misc_feature 1..192: note = hypo
  source 1..192: mol_type = genomic DNA

SEQ ID NO: 59875 - DNA, 42 bp, Homo sapiens; identical to SEQ ID NO: 39323
  misc_feature 1..42: note = chr1:239987383-239987425
  misc_feature 1..42: note = hypo
  source 1..42: mol_type = genomic DNA

SEQ ID NO: 59876 - DNA, 95 bp, Homo sapiens
  misc_feature 1..95: note = chr1:240118753-240118848
  misc_feature 1..95: note = hypo
  source 1..95: mol_type = genomic DNA
ccctgacacttcacccgcgagcctggataaaaaggctcccatgacctctctctttagccaaccccgctgggtgcaatattcagaagtgctccccg

SEQ ID NO: 59877 - DNA, 30 bp, Homo sapiens
  misc_feature 1..30: note = chr1:240118973-240119003
  misc_feature 1..30: note = hypo
  source 1..30: mol_type = genomic DNA
atcagcacaccagcccgggggtctgcactc

SEQ ID NO: 59878 - DNA, 30 bp, Homo sapiens; identical to SEQ ID NO: 39325
  misc_feature 1..30: note = chr1:240308662-240308692
  misc_feature 1..30: note = hypo
  source 1..30: mol_type = genomic DNA

SEQ ID NO: 59879 - DNA, 120 bp, Homo sapiens; identical to SEQ ID NO: 39326
  misc_feature 1..120: note = chr1:240372821-240372941
  misc_feature 1..120: note = hypo
  source 1..120: mol_type = genomic DNA

SEQ ID NO: 59880 - DNA, 169 bp, Homo sapiens; identical to SEQ ID NO: 14351
  misc_feature 1..169: note = chr1:240463082-240463251
  misc_feature 1..169: note = hypo
  source 1..169: mol_type = genomic DNA

SEQ ID NO: 59881 - DNA, 20 bp, Homo sapiens
  misc_feature 1..20: note = chr1:240893174-240893194
  misc_feature 1..20: note = hypo
  source 1..20: mol_type = genomic DNA
gactccgtctcaaaaaaaaa

SEQ ID NO: 59882 - DNA, 55 bp, Homo sapiens; identical to SEQ ID NO: 39329
  misc_feature 1..55: note = chr1:241052144-241052199
  misc_feature 1..55: note = hypo
  source 1..55: mol_type = genomic DNA

SEQ ID NO: 59883 - DNA, 39 bp, Homo sapiens; identical to SEQ ID NO: 39330
  misc_feature 1..39: note = chr1:241096456-241096495
  misc_feature 1..39: note = hypo
  source 1..39: mol_type = genomic DNA

SEQ ID NO: 59884 - DNA, 30 bp, Homo sapiens; identical to SEQ ID NO: 39331
  misc_feature 1..30: note = chr1:241753208-241753238
  misc_feature 1..30: note = hypo
  source 1..30: mol_type = genomic DNA

SEQ ID NO: 59885 - DNA, 30 bp, Homo sapiens; identical to SEQ ID NO: 39332
  misc_feature 1..30: note = chr1:241913315-241913345
  misc_feature 1..30: note = hypo
  source 1..30: mol_type = genomic DNA

SEQ ID NO: 59886 - DNA, 30 bp, Homo sapiens; identical to SEQ ID NO: 39333
  misc_feature 1..30: note = chr1:242087568-242087598
  misc_feature 1..30: note = hypo
  source 1..30: mol_type = genomic DNA

SEQ ID NO: 59887 - DNA, 19 bp, Homo sapiens
  misc_feature 1..19: note = chr1:242122940-242122959
  misc_feature 1..19: note = hypo
  source 1..19: mol_type = genomic DNA
attacgggcatgagccacc

SEQ ID NO: 59888 - DNA, 177 bp, Homo sapiens; identical to SEQ ID NO: 14352
  misc_feature 1..177: note = chr1:242286750-242286927
  misc_feature 1..177: note = hypo
  source 1..177: mol_type = genomic DNA

SEQ ID NO: 59889 - DNA, 28 bp, Homo sapiens
  misc_feature 1..28: note = chr1:242633355-242633383
  misc_feature 1..28: note = hypo
  source 1..28: mol_type = genomic DNA
aggggctgccgggtgcggtggctcatgc

SEQ ID NO: 59890 - DNA, 147 bp, Homo sapiens; identical to SEQ ID NO: 39337
  misc_feature 1..147: note = chr1:242973101-242973248
  misc_feature 1..147: note = hypo
  source 1..147: mol_type = genomic DNA

SEQ ID NO: 59891 - DNA, 30 bp, Homo sapiens; identical to SEQ ID NO: 14353
  misc_feature 1..30: note = chr1:243057075-243057105
  misc_feature 1..30: note = hypo
  source 1..30: mol_type = genomic DNA

SEQ ID NO: 59892 - DNA, 33 bp, Homo sapiens; identical to SEQ ID NO: 39339
  misc_feature 1..33: note = chr1:243145074-243145107
  misc_feature 1..33: note = hypo
  source 1..33: mol_type = genomic DNA

SEQ ID NO: 59893 - DNA, 36 bp, Homo sapiens; identical to SEQ ID NO: 39340
  misc_feature 1..36: note = chr1:244115683-244115719
  misc_feature 1..36: note = hypo
  source 1..36: mol_type = genomic DNA

SEQ ID NO: 59894 - DNA, 30 bp, Homo sapiens; identical to SEQ ID NO: 39341
  misc_feature 1..30: note = chr1:244139857-244139887
  misc_feature 1..30: note = hypo
  source 1..30: mol_type = genomic DNA

SEQ ID NO: 59895 - DNA, 98 bp, Homo sapiens; identical to SEQ ID NO: 39342
  misc_feature 1..98: note = chr1:244142970-244143068
  misc_feature 1..98: note = hypo
  source 1..98: mol_type = genomic DNA

SEQ ID NO: 59896 - DNA, 105 bp, Homo sapiens; identical to SEQ ID NO: 39343
  misc_feature 1..105: note = chr1:244200765-244200870
  misc_feature 1..105: note = hypo
  source 1..105: mol_type = genomic DNA

SEQ ID NO: 59897 - DNA, 132 bp, Homo sapiens; identical to SEQ ID NO: 39344
  misc_feature 1..132: note = chr1:244243999-244244131
  misc_feature 1..132: note = hypo
  source 1..132: mol_type = genomic DNA

SEQ ID NO: 59898 - DNA, 30 bp, Homo sapiens; identical to SEQ ID NO: 39345
  misc_feature 1..30: note = chr1:244319117-244319147
  misc_feature 1..30: note = hypo
  source 1..30: mol_type = genomic DNA

SEQ ID NO: 59899 - DNA, 30 bp, Homo sapiens; identical to SEQ ID NO: 39346
  misc_feature 1..30: note = chr1:244914578-244914608
  misc_feature 1..30: note = hypo
  source 1..30: mol_type = genomic DNA

SEQ ID NO: 59900 - DNA, 180 bp, Homo sapiens; identical to SEQ ID NO: 39347
  misc_feature 1..180: note = chr1:245060866-245061046
  misc_feature 1..180: note = hypo
  source 1..180: mol_type = genomic DNA

SEQ ID NO: 59901 - DNA, 34 bp, Homo sapiens; identical to SEQ ID NO: 23799
  misc_feature 1..34: note = chr1:245135719-245135753
  misc_feature 1..34: note = hypo
  source 1..34: mol_type = genomic DNA

SEQ ID NO: 59902 - DNA, 30 bp, Homo sapiens; identical to SEQ ID NO: 39349
  misc_feature 1..30: note = chr1:245376976-245377006
  misc_feature 1..30: note = hypo
  source 1..30: mol_type = genomic DNA

SEQ ID NO: 59903 - DNA, 151 bp, Homo sapiens; identical to SEQ ID NO: 39350
  misc_feature 1..151: note = chr1:245461494-245461645
  misc_feature 1..151: note = hypo
  source 1..151: mol_type = genomic DNA

SEQ ID NO: 59904 - DNA, 43 bp, Homo sapiens; identical to SEQ ID NO: 39351
  misc_feature 1..43: note = chr1:245499703-245499746
  misc_feature 1..43: note = hypo
  source 1..43: mol_type = genomic DNA

SEQ ID NO: 59905 - DNA, 26 bp, Homo sapiens
  misc_feature 1..26: note = chr1:245627605-245627631
  misc_feature 1..26: note = hypo
  source 1..26: mol_type = genomic DNA
aggtaatgtgtgtcccgtcccccgac

SEQ ID NO: 59906 - DNA, 30 bp, Homo sapiens; identical to SEQ ID NO: 39353
  misc_feature 1..30: note = chr1:245750646-245750676
  misc_feature 1..30: note = hypo
  source 1..30: mol_type = genomic DNA

SEQ ID NO: 59907 - DNA, 33 bp, Homo sapiens; identical to SEQ ID NO: 39354
  misc_feature 1..33: note = chr1:245753467-245753500
  misc_feature 1..33: note = hypo
  source 1..33: mol_type = genomic DNA

SEQ ID NO: 59908 - DNA, 197 bp, Homo sapiens; identical to SEQ ID NO: 14356
  misc_feature 1..197: note = chr1:245772643-245772840
  misc_feature 1..197: note = hypo
  source 1..197: mol_type = genomic DNA

SEQ ID NO: 59909 - DNA, 154 bp, Homo sapiens; identical to SEQ ID NO: 39356
  misc_feature 1..154: note = chr1:245986642-245986796
  misc_feature 1..154: note = hypo
  source 1..154: mol_type = genomic DNA

SEQ ID NO: 59910 - DNA, 109 bp, Homo sapiens; identical to SEQ ID NO: 39357
  misc_feature 1..109: note = chr1:246172251-246172360
  misc_feature 1..109: note = hypo
  source 1..109: mol_type = genomic DNA

SEQ ID NO: 59911 - DNA, 30 bp, Homo sapiens; identical to SEQ ID NO: 39358
  misc_feature 1..30: note = chr1:246330476-246330506
  misc_feature 1..30: note = hypo
  source 1..30: mol_type = genomic DNA

SEQ ID NO: 59912 - DNA, 30 bp, Homo sapiens; identical to SEQ ID NO: 39359
  misc_feature 1..30: note = chr1:246363735-246363765
  misc_feature 1..30: note = hypo
  source 1..30: mol_type = genomic DNA

SEQ ID NO: 59913 - DNA, 30 bp, Homo sapiens; identical to SEQ ID NO: 39361
  misc_feature 1..30: note = chr1:246991095-246991125
  misc_feature 1..30: note = hypo
  source 1..30: mol_type = genomic DNA

SEQ ID NO: 59914 - DNA, 163 bp, Homo sapiens; identical to SEQ ID NO: 39362
  misc_feature 1..163: note = chr1:247185348-247185511
  misc_feature 1..163: note = hypo
  source 1..163: mol_type = genomic DNA

SEQ ID NO: 59915 - DNA, 245 bp, Homo sapiens; identical to SEQ ID NO: 39363
  misc_feature 1..245: note = chr1:247589856-247590101
  misc_feature 1..245: note = hypo
  source 1..245: mol_type = genomic DNA

SEQ ID NO: 59916 - DNA, 30 bp, Homo sapiens; identical to SEQ ID NO: 39364
  misc_feature 1..30: note = chr1:247615881-247615911
  misc_feature 1..30: note = hypo
  source 1..30: mol_type = genomic DNA

SEQ ID NO: 59917 - DNA, 30 bp, Homo sapiens; identical to SEQ ID NO: 39365
  misc_feature 1..30: note = chr1:247694897-247694927
  misc_feature 1..30: note = hypo
  source 1..30: mol_type = genomic DNA

SEQ ID NO: 59918 - DNA, 172 bp, Homo sapiens; identical to SEQ ID NO: 14360
  misc_feature 1..172: note = chr1:247709336-247709508
  misc_feature 1..172: note = hypo
  source 1..172: mol_type = genomic DNA

SEQ ID NO: 59919 - DNA, 180 bp, Homo sapiens; identical to SEQ ID NO: 14361
  misc_feature 1..180: note = chr1:247752018-247752198
  misc_feature 1..180: note = hypo
  source 1..180: mol_type = genomic DNA

SEQ ID NO: 59920 - DNA, 94 bp, Homo sapiens; identical to SEQ ID NO: 39369
  misc_feature 1..94: note = chr1:248026872-248026966
  misc_feature 1..94: note = hypo
  source 1..94: mol_type = genomic DNA

SEQ ID NO: 59921 - DNA, 50 bp, Homo sapiens
  misc_feature 1..50: note = chr1:248027965-248028015
  misc_feature 1..50: note = hypo
  source 1..50: mol_type = genomic DNA
gaggccaagcactgacgatgtgatccacggtgtcacctcaggagaaagtg

SEQ ID NO: 59922 - DNA, 57 bp, Homo sapiens
  misc_feature 1..57: note = chr1:248028202-248028259
  misc_feature 1..57: note = hypo
  source 1..57: mol_type = genomic DNA
agaggtgccagcgcccggccctgggtctgctggaggtgaggccgggtgccagaaaag

SEQ ID NO: 59923 - DNA, 197 bp, Homo sapiens; identical to SEQ ID NO: 39371
  misc_feature 1..197: note = chr1:248034262-248034459
  misc_feature 1..197: note = hypo
  source 1..197: mol_type = genomic DNA

SEQ ID NO: 59924 - DNA, 45 bp, Homo sapiens; identical to SEQ ID NO: 39372
  misc_feature 1..45: note = chr1:248047093-248047138
  misc_feature 1..45: note = hypo
  source 1..45: mol_type = genomic DNA

SEQ ID NO: 59925 - DNA, 30 bp, Homo sapiens; identical to SEQ ID NO: 39373
  misc_feature 1..30: note = chr1:248047898-248047928
  misc_feature 1..30: note = hypo
  source 1..30: mol_type = genomic DNA

SEQ ID NO: 59926 - DNA, 30 bp, Homo sapiens; identical to SEQ ID NO: 39374
  misc_feature 1..30: note = chr1:248074318-248074348
  misc_feature 1..30: note = hypo
  source 1..30: mol_type = genomic DNA

SEQ ID NO: 59927 - DNA, 36 bp, Homo sapiens; identical to SEQ ID NO: 39376
  misc_feature 1..36: note = chr1:248098787-248098823
  misc_feature 1..36: note = hypo
  source 1..36: mol_type = genomic DNA

SEQ ID NO: 59928 - DNA, 30 bp, Homo sapiens; identical to SEQ ID NO: 39377
  misc_feature 1..30: note = chr1:248099290-248099320
  misc_feature 1..30: note = hypo
  source 1..30: mol_type = genomic DNA

SEQ ID NO: 59929 - DNA, 238 bp, Homo sapiens
  misc_feature 1..238: note = chr1:248099809-248100047
  misc_feature 1..238: note = hypo
  source 1..238: mol_type = genomic DNA
ttggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggt

SEQ ID NO: 59930 - DNA, 28 bp, Homo sapiens
  misc_feature 1..28: note = chr1:248328673-248328701
  misc_feature 1..28: note = hypo
  source 1..28: mol_type = genomic DNA
cacccgtgactcgccaggctccgtctga

SEQ ID NO: 59931 - DNA, 35 bp, Homo sapiens
  misc_feature 1..35: note = chr1:248328841-248328876
  misc_feature 1..35: note = hypo
  source 1..35: mol_type = genomic DNA
ctccagaagcacaggatgtgcgaccttcagccttt

SEQ ID NO: 59932 - DNA, 30 bp, Homo sapiens; identical to SEQ ID NO: 39380
  misc_feature 1..30: note = chr1:248329246-248329276
  misc_feature 1..30: note = hypo
  source 1..30: mol_type = genomic DNA

SEQ ID NO: 59933 - DNA, 233 bp, Homo sapiens; identical to SEQ ID NO: 39382
  misc_feature 1..233: note = chr2:314488-314721
  misc_feature 1..233: note = hypo
  source 1..233: mol_type = genomic DNA

SEQ ID NO: 59934 - DNA, 70 bp, Homo sapiens; identical to SEQ ID NO: 39383
  misc_feature 1..70: note = chr2:484928-484998
  misc_feature 1..70: note = hypo
  source 1..70: mol_type = genomic DNA

SEQ ID NO: 59935 - DNA, 14 bp, Homo sapiens
  misc_feature 1..14: note = chr2:496214-496228
  misc_feature 1..14: note = hypo
  source 1..14: mol_type = genomic DNA
gaagctacaggagg

SEQ ID NO: 59936 - DNA, 69 bp, Homo sapiens; identical to SEQ ID NO: 39385
  misc_feature 1..69: note = chr2:503076-503145
  misc_feature 1..69: note = hypo
  source 1..69: mol_type = genomic DNA

SEQ ID NO: 59937 - DNA, 142 bp, Homo sapiens; identical to SEQ ID NO: 39386
  misc_feature 1..142: note = chr2:503859-504001
  misc_feature 1..142: note = hypo
  source 1..142: mol_type = genomic DNA

SEQ ID NO: 59938 - DNA, 64 bp, Homo sapiens; identical to SEQ ID NO: 39387
  misc_feature 1..64: note = chr2:522014-522078
  misc_feature 1..64: note = hypo
  source 1..64: mol_type = genomic DNA

SEQ ID NO: 59939 - DNA, 49 bp, Homo sapiens; identical to SEQ ID NO: 39388
  misc_feature 1..49: note = chr2:647861-647910
  misc_feature 1..49: note = hypo
  source 1..49: mol_type = genomic DNA

SEQ ID NO: 59940 - skipped

SEQ ID NO: 59941 - DNA, 30 bp, Homo sapiens; identical to SEQ ID NO: 39390
  misc_feature 1..30: note = chr2:925888-925918
  misc_feature 1..30: note = hypo
  source 1..30: mol_type = genomic DNA

SEQ ID NO: 59942 - DNA, 30 bp, Homo sapiens; identical to SEQ ID NO: 39391
  misc_feature 1..30: note = chr2:951526-951556
  misc_feature 1..30: note = hypo
  source 1..30: mol_type = genomic DNA

SEQ ID NO: 59943 - DNA, 49 bp, Homo sapiens; identical to SEQ ID NO: 39392
  misc_feature 1..49: note = chr2:973406-973455
  misc_feature 1..49: note = hypo
  source 1..49: mol_type = genomic DNA

SEQ ID NO: 59944 - DNA, 156 bp, Homo sapiens; identical to SEQ ID NO: 39393
  misc_feature 1..156: note = chr2:1019358-1019514
  misc_feature 1..156: note = hypo
  source 1..156: mol_type = genomic DNA

SEQ ID NO: 59945 - DNA, 108 bp, Homo sapiens; identical to SEQ ID NO: 39394
  misc_feature 1..108: note = chr2:1204810-1204918
  misc_feature 1..108: note = hypo
  source 1..108: mol_type = genomic DNA

SEQ ID NO: 59946 - DNA, 62 bp, Homo sapiens; identical to SEQ ID NO: 39395
  misc_feature 1..62: note = chr2:1424987-1425049
  misc_feature 1..62: note = hypo
  source 1..62: mol_type = genomic DNA

SEQ ID NO: 59947 - DNA, 30 bp, Homo sapiens; identical to SEQ ID NO: 39396
  misc_feature 1..30: note = chr2:1635811-1635841
  misc_feature 1..30: note = hypo
  source 1..30: mol_type = genomic DNA

SEQ ID NO: 59948 - DNA, 30 bp, Homo sapiens; identical to SEQ ID NO: 39397
  misc_feature 1..30: note = chr2:1637034-1637064
  misc_feature 1..30: note = hypo
  source 1..30: mol_type = genomic DNA

SEQ ID NO: 59949 - DNA, 33 bp, Homo sapiens; identical to SEQ ID NO: 39398
  misc_feature 1..33: note = chr2:1689084-1689117
  misc_feature 1..33: note = hypo
  source 1..33: mol_type = genomic DNA

SEQ ID NO: 59950 - DNA, 41 bp, Homo sapiens; identical to SEQ ID NO: 39399
  misc_feature 1..41: note = chr2:1893020-1893061
  misc_feature 1..41: note = hypo
  source 1..41: mol_type = genomic DNA

SEQ ID NO: 59951 - DNA, 30 bp, Homo sapiens; identical to SEQ ID NO: 39400
  misc_feature 1..30: note = chr2:1950712-1950742
  misc_feature 1..30: note = hypo
  source 1..30: mol_type = genomic DNA

SEQ ID NO: 59952 - DNA, 156 bp, Homo sapiens; identical to SEQ ID NO: 39401
  misc_feature 1..156: note = chr2:1972852-1973008
  misc_feature 1..156: note = hypo
  source 1..156: mol_type = genomic DNA

SEQ ID NO: 59953 - DNA, 30 bp, Homo sapiens; identical to SEQ ID NO: 39402
  misc_feature 1..30: note = chr2:2030884-2030914
  misc_feature 1..30: note = hypo
  source 1..30: mol_type = genomic DNA

SEQ ID NO: 59954 - DNA, 30 bp, Homo sapiens; identical to SEQ ID NO: 39403
  misc_feature 1..30: note = chr2:2190112-2190142
  misc_feature 1..30: note = hypo
  source 1..30: mol_type = genomic DNA

SEQ ID NO: 59955 - DNA, 106 bp, Homo sapiens; identical to SEQ ID NO: 39404
  misc_feature 1..106: note = chr2:2402544-2402650
  misc_feature 1..106: note = hypo
  source 1..106: mol_type = genomic DNA

SEQ ID NO: 59956 - DNA, 189 bp, Homo sapiens; identical to SEQ ID NO: 14371
  misc_feature 1..189: note = chr2:2522670-2522859
  misc_feature 1..189: note = hypo
  source 1..189: mol_type = genomic DNA

SEQ ID NO: 59957 - DNA, 50 bp, Homo sapiens; identical to SEQ ID NO: 39406
  misc_feature 1..50: note = chr2:2575682-2575732
  misc_feature 1..50: note = hypo
  source 1..50: mol_type = genomic DNA

SEQ ID NO: 59958 - DNA, 83 bp, Homo sapiens; identical to SEQ ID NO: 39407
  misc_feature 1..83: note = chr2:2665528-2665611
  misc_feature 1..83: note = hypo
  source 1..83: mol_type = genomic DNA

SEQ ID NO: 59959 - DNA, 447 bp, Homo sapiens; identical to SEQ ID NO: 39408
  misc_feature 1..447: note = chr2:2725048-2725495
  misc_feature 1..447: note = hypo
  source 1..447: mol_type = genomic DNA

SEQ ID NO: 59960 - DNA, 92 bp, Homo sapiens; identical to SEQ ID NO: 39409
  misc_feature 1..92: note = chr2:2730695-2730787
  misc_feature 1..92: note = hypo
  source 1..92: mol_type = genomic DNA

SEQ ID NO: 59961 - DNA, 30 bp, Homo sapiens; identical to SEQ ID NO: 39410
  misc_feature 1..30: note = chr2:2753113-2753143
  misc_feature 1..30: note = hypo
  source 1..30: mol_type = genomic DNA

SEQ ID NO: 59962 - DNA, 40 bp, Homo sapiens; identical to SEQ ID NO: 39411
  misc_feature 1..40: note = chr2:2799315-2799355
  misc_feature 1..40: note = hypo
  source 1..40: mol_type = genomic DNA

SEQ ID NO: 59963 - DNA, 30 bp, Homo sapiens; identical to SEQ ID NO: 39412
  misc_feature 1..30: note = chr2:2844886-2844916
  misc_feature 1..30: note = hypo
  source 1..30: mol_type = genomic DNA

SEQ ID NO: 59964 - DNA, 110 bp, Homo sapiens; identical to SEQ ID NO: 39413
  misc_feature 1..110: note = chr2:2854353-2854463
  misc_feature 1..110: note = hypo
  source 1..110: mol_type = genomic DNA

SEQ ID NO: 59965 - DNA, 30 bp, Homo sapiens; identical to SEQ ID NO: 39414
  misc_feature 1..30: note = chr2:2939589-2939619
  misc_feature 1..30: note = hypo
  source 1..30: mol_type = genomic DNA

SEQ ID NO: 59966 - DNA, 92 bp, Homo sapiens; identical to SEQ ID NO: 39415
  misc_feature 1..92: note = chr2:2941866-2941958
  misc_feature 1..92: note = hypo
  source 1..92: mol_type = genomic DNA

SEQ ID NO: 59967 - DNA, 105 bp, Homo sapiens; identical to SEQ ID NO: 39416
  misc_feature 1..105: note = chr2:3050299-3050404
  misc_feature 1..105: note = hypo
  source 1..105: mol_type = genomic DNA

SEQ ID NO: 59968 - DNA, 30 bp, Homo sapiens; identical to SEQ ID NO: 39417
  misc_feature 1..30: note = chr2:3176032-3176062
  misc_feature 1..30: note = hypo
  source 1..30: mol_type = genomic DNA

SEQ ID NO: 59969 - DNA, 30 bp, Homo sapiens; identical to SEQ ID NO: 39418
  misc_feature 1..30: note = chr2:3285842-3285872
  misc_feature 1..30: note = hypo
  source 1..30: mol_type = genomic DNA

SEQ ID NO: 59970 - DNA, 30 bp, Homo sapiens; identical to SEQ ID NO: 14373
  misc_feature 1..30: note = chr2:3331786-3331816
  misc_feature 1..30: note = hypo
  source 1..30: mol_type = genomic DNA

SEQ ID NO: 59971 - DNA, 33 bp, Homo sapiens; identical to SEQ ID NO: 39420
  misc_feature 1..33: note = chr2:3352677-3352710
  misc_feature 1..33: note = hypo
  source 1..33: mol_type = genomic DNA

SEQ ID NO: 59972 - DNA, 181 bp, Homo sapiens; identical to SEQ ID NO: 39421
  misc_feature 1..181: note = chr2:3833780-3833961
  misc_feature 1..181: note = hypo
  source 1..181: mol_type = genomic DNA

SEQ ID NO: 59973 - DNA, 129 bp, Homo sapiens; identical to SEQ ID NO: 39422
  misc_feature 1..129: note = chr2:3990793-3990922
  misc_feature 1..129: note = hypo
  source 1..129: mol_type = genomic DNA

SEQ ID NO: 59974 - DNA, 30 bp, Homo sapiens; identical to SEQ ID NO: 39423
  misc_feature 1..30: note = chr2:4130725-4130755
  misc_feature 1..30: note = hypo
  source 1..30: mol_type = genomic DNA

SEQ ID NO: 59975 - DNA, 57 bp, Homo sapiens; identical to SEQ ID NO: 14375
  misc_feature 1..57: note = chr2:5704308-5704365
  misc_feature 1..57: note = hypo
  source 1..57: mol_type = genomic DNA

SEQ ID NO: 59976 - DNA, 34 bp, Homo sapiens; identical to SEQ ID NO: 39425
  misc_feature 1..34: note = chr2:6024520-6024554
  misc_feature 1..34: note = hypo
  source 1..34: mol_type = genomic DNA

SEQ ID NO: 59977 - DNA, 30 bp, Homo sapiens; identical to SEQ ID NO: 39426
  misc_feature 1..30: note = chr2:6809103-6809133
  misc_feature 1..30: note = hypo
  source 1..30: mol_type = genomic DNA

SEQ ID NO: 59978 - DNA, 30 bp, Homo sapiens; identical to SEQ ID NO: 39427
  misc_feature 1..30: note = chr2:6989494-6989524
  misc_feature 1..30: note = hypo
  source 1..30: mol_type = genomic DNA

SEQ ID NO: 59979 - DNA, 30 bp, Homo sapiens; identical to SEQ ID NO: 14376
  misc_feature 1..30: note = chr2:7036178-7036208
  misc_feature 1..30: note = hypo
  source 1..30: mol_type = genomic DNA

SEQ ID NO: 59980 - DNA, 387 bp, Homo sapiens; identical to SEQ ID NO: 39430
  misc_feature 1..387: note = chr2:7172412-7172799
  misc_feature 1..387: note = hypo
  source 1..387: mol_type = genomic DNA

SEQ ID NO: 59981 - DNA, 17 bp, Homo sapiens
  misc_feature 1..17: note = chr2:7237246-7237263
  misc_feature 1..17: note = hypo
  source 1..17: mol_type = genomic DNA
cccgcccctcatggtgg

SEQ ID NO: 59982 - DNA, 24 bp, Homo sapiens
  misc_feature 1..24: note = chr2:7605198-7605222
  misc_feature 1..24: note = hypo
  source 1..24: mol_type = genomic DNA
aaaatgtaccgagttgtttctacc

SEQ ID NO: 59983 - DNA, 30 bp, Homo sapiens; identical to SEQ ID NO: 39433
  misc_feature 1..30: note = chr2:8768562-8768592
  misc_feature 1..30: note = hypo
  source 1..30: mol_type = genomic DNA

SEQ ID NO: 59984 - DNA, 171 bp, Homo sapiens; identical to SEQ ID NO: 14378
  misc_feature 1..171: note = chr2:8833973-8834144
  misc_feature 1..171: note = hypo
  source 1..171: mol_type = genomic DNA

SEQ ID NO: 59985 - DNA, 24 bp, Homo sapiens
  misc_feature 1..24: note = chr2:8834789-8834813
  misc_feature 1..24: note = hypo
  source 1..24: mol_type = genomic DNA
atcgctttgcagcaacggaaatta

SEQ ID NO: 59986 - DNA, 23 bp, Homo sapiens
  misc_feature 1..23: note = chr2:8834873-8834896
  misc_feature 1..23: note = hypo
  source 1..23: mol_type = genomic DNA
gcaaacgccgcaaataattttgc

SEQ ID NO: 59987 - DNA, 28 bp, Homo sapiens
  misc_feature 1..28: note = chr2:8835589-8835617
  misc_feature 1..28: note = hypo
  source 1..28: mol_type = genomic DNA
gaccccctgcgcccggcctgaccacaca

SEQ ID NO: 59988 - DNA, 30 bp, Homo sapiens; identical to SEQ ID NO: 39438
  misc_feature 1..30: note = chr2:8860441-8860471
  misc_feature 1..30: note = hypo
  source 1..30: mol_type = genomic DNA

SEQ ID NO: 59989 - DNA, 30 bp, Homo sapiens; identical to SEQ ID NO: 39439
  misc_feature 1..30: note = chr2:8870364-8870394
  misc_feature 1..30: note = hypo
  source 1..30: mol_type = genomic DNA

SEQ ID NO: 59990 - DNA, 92 bp, Homo sapiens; identical to SEQ ID NO: 14381
  misc_feature 1..92: note = chr2:8978147-8978239
  misc_feature 1..92: note = hypo
  source 1..92: mol_type = genomic DNA

SEQ ID NO: 59991 - DNA, 169 bp, Homo sapiens
  misc_feature 1..169: note = chr2:9134235-9134404
  misc_feature 1..169: note = hypo
  source 1..169: mol_type = genomic DNA
atcacaccagccctgcggactctaaacatgctccgtgccaagaatggtcctaggcagacgggacacaaagatgagtaagtggaggtccttattcttaaggaatttagtttgggagggagacttgtaaagcaaacaaaaaaaaaatcaatgctccaggtgttatcagagt

SEQ ID NO: 59992 - DNA, 180 bp, Homo sapiens; identical to SEQ ID NO: 14383
  misc_feature 1..180: note = chr2:9352635-9352815
  misc_feature 1..180: note = hypo
  source 1..180: mol_type = genomic DNA

SEQ ID NO: 59993 - DNA, 242 bp, Homo sapiens; identical to SEQ ID NO: 39443
  misc_feature 1..242: note = chr2:9960219-9960461
  misc_feature 1..242: note = hypo
  source 1..242: mol_type = genomic DNA

SEQ ID NO: 59994 - DNA, 27 bp, Homo sapiens
  misc_feature 1..27: note = chr2:9960764-9960791
  misc_feature 1..27: note = hypo
  source 1..27: mol_type = genomic DNA
tgccaacccgcccgatgactgtgtcta

SEQ ID NO: 59995 - DNA, 120 bp, Homo sapiens; identical to SEQ ID NO: 39446
  misc_feature 1..120: note = chr2:10151717-10151837
  misc_feature 1..120: note = hypo
  source 1..120: mol_type = genomic DNA

SEQ ID NO: 59996 - DNA, 120 bp, Homo sapiens; identical to SEQ ID NO: 39447
  misc_feature 1..120: note = chr2:10151897-10152017
  misc_feature 1..120: note = hypo
  source 1..120: mol_type = genomic DNA

SEQ ID NO: 59997 - DNA, 114 bp, Homo sapiens
  misc_feature 1..114: note = chr2:10153325-10153439
  misc_feature 1..114: note = hypo
  source 1..114: mol_type = genomic DNA
atgggagagtcaggtggacaggattgcgtatagccggatcaggtgggcaggcatgcgtatgagcgagtcaggtgggcagacatgcgtatgggcgggtcaggtggacaggcgtgt

SEQ ID NO: 59998 - DNA, 120 bp, Homo sapiens; identical to SEQ ID NO: 39449
  misc_feature 1..120: note = chr2:10154039-10154159
  misc_feature 1..120: note = hypo
  source 1..120: mol_type = genomic DNA

SEQ ID NO: 59999 - DNA, 241 bp, Homo sapiens
  misc_feature 1..241: note = chr2:10156389-10156630
  misc_feature 1..241: note = hypo
  source 1..241: mol_type = genomic DNA
gtcaggtgggtaggcgtgtgtatggatgtgcatatgggcgggtcaggtggacaggtgtgtatatgggtgtacatgtgtgcacaggtgctactttactctgtgttcaacacgtgttcgtggacgtgctccaggcccaaggcgaaggaataggatgtagcaggggcagggtctccgccccatactcagagtccttgggctccgggaagacacaaccgataagtggttacggggatgcctggga

SEQ ID NO: 60000 - DNA, 30 bp, Homo sapiens; identical to SEQ ID NO: 39451
  misc_feature 1..30: note = chr2:10238076-10238106
  misc_feature 1..30: note = hypo
  source 1..30: mol_type = genomic DNA

SEQ ID NO: 60001 - DNA, 30 bp, Homo sapiens; identical to SEQ ID NO: 39452
  misc_feature 1..30: note = chr2:10278078-10278108
  misc_feature 1..30: note = hypo
  source 1..30: mol_type = genomic DNA

SEQ ID NO: 60002 - DNA, 51 bp, Homo sapiens; identical to SEQ ID NO: 39453
  misc_feature 1..51: note = chr2:10281143-10281194
  misc_feature 1..51: note = hypo
  source 1..51: mol_type = genomic DNA

SEQ ID NO: 60003 - DNA, 77 bp, Homo sapiens; identical to SEQ ID NO: 14389
  misc_feature 1..77: note = chr2:10344641-10344718
  misc_feature 1..77: note = hypo
  source 1..77: mol_type = genomic DNA

SEQ ID NO: 60004 - DNA, 30 bp, Homo sapiens; identical to SEQ ID NO: 39455
  misc_feature 1..30: note = chr2:10408242-10408272
  misc_feature 1..30: note = hypo
  source 1..30: mol_type = genomic DNA

SEQ ID NO: 60005 - DNA, 30 bp, Homo sapiens; identical to SEQ ID NO: 39456
  misc_feature 1..30: note = chr2:10526275-10526305
  misc_feature 1..30: note = hypo
  source 1..30: mol_type = genomic DNA

SEQ ID NO: 60006 - DNA, 30 bp, Homo sapiens; identical to SEQ ID NO: 39457
  misc_feature 1..30: note = chr2:10577316-10577346
  misc_feature 1..30: note = hypo
  source 1..30: mol_type = genomic DNA

SEQ ID NO: 60007 - DNA, 30 bp, Homo sapiens; identical to SEQ ID NO: 39458
  misc_feature 1..30: note = chr2:10600641-10600671
  misc_feature 1..30: note = hypo
  source 1..30: mol_type = genomic DNA

SEQ ID NO: 60008 - DNA, 30 bp, Homo sapiens; identical to SEQ ID NO: 39459
  misc_feature 1..30: note = chr2:10911393-10911423
  misc_feature 1..30: note = hypo
  source 1..30: mol_type = genomic DNA

SEQ ID NO: 60009 - DNA, 226 bp, Homo sapiens; identical to SEQ ID NO: 39460
  misc_feature 1..226: note = chr2:10924927-10925153
  misc_feature 1..226: note = hypo
  source 1..226: mol_type = genomic DNA

SEQ ID NO: 60010 - DNA, 88 bp, Homo sapiens; identical to SEQ ID NO: 39461
  misc_feature 1..88: note = chr2:11538637-11538725
  misc_feature 1..88: note = hypo
  source 1..88: mol_type = genomic DNA

SEQ ID NO: 60011 - DNA, 148 bp, Homo sapiens; identical to SEQ ID NO: 39462
  misc_feature 1..148: note = chr2:11538785-11538933
  misc_feature 1..148: note = hypo
  source 1..148: mol_type = genomic DNA

SEQ ID NO: 60012 - DNA, 126 bp, Homo sapiens; identical to SEQ ID NO: 39463
  misc_feature 1..126: note = chr2:11678173-11678299
  misc_feature 1..126: note = hypo
  source 1..126: mol_type = genomic DNA

SEQ ID NO: 60013 - DNA, 120 bp, Homo sapiens; identical to SEQ ID NO: 39464
  misc_feature 1..120: note = chr2:11886072-11886192
  misc_feature 1..120: note = hypo
  source 1..120: mol_type = genomic DNA

SEQ ID NO: 60014 - DNA, 34 bp, Homo sapiens; identical to SEQ ID NO: 39465
  misc_feature 1..34: note = chr2:12092493-12092527
  misc_feature 1..34: note = hypo
  source 1..34: mol_type = genomic DNA

SEQ ID NO: 60015 - DNA, 117 bp, Homo sapiens; identical to SEQ ID NO: 39466
  misc_feature 1..117: note = chr2:12103180-12103297
  misc_feature 1..117: note = hypo
  source 1..117: mol_type = genomic DNA

SEQ ID NO: 60016 - DNA, 30 bp, Homo sapiens; identical to SEQ ID NO: 39467
  misc_feature 1..30: note = chr2:12303872-12303902
  misc_feature 1..30: note = hypo
  source 1..30: mol_type = genomic DNA

SEQ ID NO: 60017 - DNA, 76 bp, Homo sapiens; identical to SEQ ID NO: 39468
  misc_feature 1..76: note = chr2:12355766-12355842
  misc_feature 1..76: note = hypo
  source 1..76: mol_type = genomic DNA

SEQ ID NO: 60018 - DNA, 19 bp, Homo sapiens
  misc_feature 1..19: note = chr2:15579677-15579696
  misc_feature 1..19: note = hypo
  source 1..19: mol_type = genomic DNA
gtctacagctcccagcgtg

SEQ ID NO: 60019 - DNA, 30 bp, Homo sapiens; identical to SEQ ID NO: 39470
  misc_feature 1..30: note = chr2:15960211-15960241
  misc_feature 1..30: note = hypo
  source 1..30: mol_type = genomic DNA

SEQ ID NO: 60020 - DNA, 68 bp, Homo sapiens; identical to SEQ ID NO: 39471
  misc_feature 1..68: note = chr2:18453289-18453357
  misc_feature 1..68: note = hypo
  source 1..68: mol_type = genomic DNA

SEQ ID NO: 60021 - DNA, 39 bp, Homo sapiens; identical to SEQ ID NO: 39472
  misc_feature 1..39: note = chr2:20253274-20253313
  misc_feature 1..39: note = hypo
  source 1..39: mol_type = genomic DNA

SEQ ID NO: 60022 - DNA, 42 bp, Homo sapiens; identical to SEQ ID NO: 14394
  misc_feature 1..42: note = chr2:20431336-20431378
  misc_feature 1..42: note = hypo
  source 1..42: mol_type = genomic DNA

SEQ ID NO: 60023 - DNA, 142 bp, Homo sapiens; identical to SEQ ID NO: 14395
  misc_feature 1..142: note = chr2:20432683-20432825
  misc_feature 1..142: note = hypo
  source 1..142: mol_type = genomic DNA

SEQ ID NO: 60024 - DNA, 30 bp, Homo sapiens; identical to SEQ ID NO: 39475
  misc_feature 1..30: note = chr2:20442384-20442414
  misc_feature 1..30: note = hypo
  source 1..30: mol_type = genomic DNA

SEQ ID NO: 60025 - DNA, 30 bp, Homo sapiens; identical to SEQ ID NO: 14396
  misc_feature 1..30: note = chr2:20456198-20456228
  misc_feature 1..30: note = hypo
  source 1..30: mol_type = genomic DNA

SEQ ID NO: 60026 - DNA, 30 bp, Homo sapiens; identical to SEQ ID NO: 39477
  misc_feature 1..30: note = chr2:20553860-20553890
  misc_feature 1..30: note = hypo
  source 1..30: mol_type = genomic DNA

SEQ ID NO: 60027 - DNA, 21 bp, Homo sapiens
  misc_feature 1..21: note = chr2:24584330-24584351
  misc_feature 1..21: note = hypo
  source 1..21: mol_type = genomic DNA
tggcacagtggctcacgcttg

SEQ ID NO: 60028 - DNA, 63 bp, Homo sapiens; identical to SEQ ID NO: 39480
  misc_feature 1..63: note = chr2:24775908-24775971
  misc_feature 1..63: note = hypo
  source 1..63: mol_type = genomic DNA

SEQ ID NO: 60029 - DNA, 44 bp, Homo sapiens; identical to SEQ ID NO: 39481
  misc_feature 1..44: note = chr2:25241776-25241820
  misc_feature 1..44: note = hypo
  source 1..44: mol_type = genomic DNA

SEQ ID NO: 60030 - DNA, 28 bp, Homo sapiens
  misc_feature 1..28: note = chr2:25439965-25439993
  misc_feature 1..28: note = hypo
  source 1..28: mol_type = genomic DNA
gacagagaaagaccgtttctaaataagt

SEQ ID NO: 60031 - DNA, 47 bp, Homo sapiens
  misc_feature 1..47: note = chr2:26372997-26373044
  misc_feature 1..47: note = hypo
  source 1..47: mol_type = genomic DNA
cttagtgacagtgtggtgccagacattccgtccgctgtcacaacagc

SEQ ID NO: 60032 - DNA, 142 bp, Homo sapiens; identical to SEQ ID NO: 39484
  misc_feature 1..142: note = chr2:26607241-26607383
  misc_feature 1..142: note = hypo
  source 1..142: mol_type = genomic DNA

SEQ ID NO: 60033 - DNA, 42 bp, Homo sapiens; identical to SEQ ID NO: 14399
  misc_feature 1..42: note = chr2:27090590-27090632
  misc_feature 1..42: note = hypo
  source 1..42: mol_type = genomic DNA

SEQ ID NO: 60034 - DNA, 24 bp, Homo sapiens
  misc_feature 1..24: note = chr2:27433305-27433329
  misc_feature 1..24: note = hypo
  source 1..24: mol_type = genomic DNA
ctttttttttggagacggagtctc

SEQ ID NO: 60035 - DNA, 102 bp, Homo sapiens
  misc_feature 1..102: note = chr2:27578396-27578498
  misc_feature 1..102: note = hypo
  source 1..102: mol_type = genomic DNA
aaaaatacacttctcatggaaggcagcagcaggatgtaatggtacaaattctggatacacagtaaaggaatagatgatcagtaaattcgtactgagtttcta

SEQ ID NO: 60036 - DNA, 111 bp, Homo sapiens; identical to SEQ ID NO: 23838
  misc_feature 1..111: note = chr2:27887555-27887666
  misc_feature 1..111: note = hypo
  source 1..111: mol_type = genomic DNA

SEQ ID NO: 60037 - DNA, 212 bp, Homo sapiens; identical to SEQ ID NO: 39489
  misc_feature 1..212: note = chr2:28676953-28677165
  misc_feature 1..212: note = hypo
  source 1..212: mol_type = genomic DNA

SEQ ID NO: 60038 - DNA, 40 bp, Homo sapiens; identical to SEQ ID NO: 39490
  misc_feature 1..40: note = chr2:29462699-29462739
  misc_feature 1..40: note = hypo
  source 1..40: mol_type = genomic DNA

SEQ ID NO: 60039 - DNA, 81 bp, Homo sapiens; identical to SEQ ID NO: 39491
  misc_feature 1..81: note = chr2:29504693-29504774
  misc_feature 1..81: note = hypo
  source 1..81: mol_type = genomic DNA

SEQ ID NO: 60040 - DNA, 87 bp, Homo sapiens; identical to SEQ ID NO: 39492
  misc_feature 1..87: note = chr2:30368623-30368710
  misc_feature 1..87: note = hypo
  source 1..87: mol_type = genomic DNA

SEQ ID NO: 60041 - DNA, 37 bp, Homo sapiens; identical to SEQ ID NO: 39493
  misc_feature 1..37: note = chr2:30497257-30497294
  misc_feature 1..37: note = hypo
  source 1..37: mol_type = genomic DNA

SEQ ID NO: 60042 - DNA, 79 bp, Homo sapiens; identical to SEQ ID NO: 39494
  misc_feature 1..79: note = chr2:32263984-32264063
  misc_feature 1..79: note = hypo
  source 1..79: mol_type = genomic DNA

SEQ ID NO: 60043 - DNA, 18 bp, Homo sapiens
  misc_feature 1..18: note = chr2:32275102-32275120
  misc_feature 1..18: note = hypo
  source 1..18: mol_type = genomic DNA
aaaaaatatctgggccgg

SEQ ID NO: 60044 - DNA, 44 bp, Homo sapiens; identical to SEQ ID NO: 39496
  misc_feature 1..44: note = chr2:32472347-32472391
  misc_feature 1..44: note = hypo
  source 1..44: mol_type = genomic DNA

SEQ ID NO: 60045 - DNA, 30 bp, Homo sapiens; identical to SEQ ID NO: 39497
  misc_feature 1..30: note = chr2:32494200-32494230
  misc_feature 1..30: note = hypo
  source 1..30: mol_type = genomic DNA

SEQ ID NO: 60046 - DNA, 119 bp, Homo sapiens
  misc_feature 1..119: note = chr2:32504378-32504497
  misc_feature 1..119: note = hypo
  source 1..119: mol_type = genomic DNA
ttccagtgaccagacttactggctgctatgaaatcataaattatgtttacagaaatttcagtctgagaaagaacctagattttcctttttttttttttttttttttgagactgagtctc

SEQ ID NO: 60047 - DNA, 27 bp, Homo sapiens
  misc_feature 1..27: note = chr2:32551637-32551664
  misc_feature 1..27: note = hypo
  source 1..27: mol_type = genomic DNA
tgtgagccaccgcgcccagcctaccct

SEQ ID NO: 60048 - DNA, 22 bp, Homo sapiens
  misc_feature 1..22: note = chr2:33313226-33313248
  misc_feature 1..22: note = hypo
  source 1..22: mol_type = genomic DNA
atatggacagtgagccgggcgc

SEQ ID NO: 60049 - DNA, 30 bp, Homo sapiens; identical to SEQ ID NO: 39501
  misc_feature 1..30: note = chr2:33315571-33315601
  misc_feature 1..30: note = hypo
  source 1..30: mol_type = genomic DNA

SEQ ID NO: 60050 - DNA, 34 bp, Homo sapiens; identical to SEQ ID NO: 39502
  misc_feature 1..34: note = chr2:33530065-33530099
  misc_feature 1..34: note = hypo
  source 1..34: mol_type = genomic DNA

SEQ ID NO: 60051 - DNA, 70 bp, Homo sapiens; identical to SEQ ID NO: 39503
  misc_feature 1..70: note = chr2:33532830-33532900
  misc_feature 1..70: note = hypo
  source 1..70: mol_type = genomic DNA

SEQ ID NO: 60052 - DNA, 105 bp, Homo sapiens; identical to SEQ ID NO: 39504
  misc_feature 1..105: note = chr2:33653875-33653980
  misc_feature 1..105: note = hypo
  source 1..105: mol_type = genomic DNA

SEQ ID NO: 60053 - DNA, 66 bp, Homo sapiens; identical to SEQ ID NO: 39505
  misc_feature 1..66: note = chr2:36824207-36824273
  misc_feature 1..66: note = hypo
  source 1..66: mol_type = genomic DNA

SEQ ID NO: 60054 - DNA, 177 bp, Homo sapiens; identical to SEQ ID NO: 39507
  misc_feature 1..177: note = chr2:42281964-42282141
  misc_feature 1..177: note = hypo
  source 1..177: mol_type = genomic DNA

SEQ ID NO: 60055 - DNA, 30 bp, Homo sapiens; identical to SEQ ID NO: 39508
  misc_feature 1..30: note = chr2:42282578-42282608
  misc_feature 1..30: note = hypo
  source 1..30: mol_type = genomic DNA

SEQ ID NO: 60056 - DNA, 30 bp, Homo sapiens; identical to SEQ ID NO: 39509
  misc_feature 1..30: note = chr2:43227374-43227404
  misc_feature 1..30: note = hypo
  source 1..30: mol_type = genomic DNA

SEQ ID NO: 60057 - DNA, 189 bp, Homo sapiens; identical to SEQ ID NO: 4967
  misc_feature 1..189: note = chr2:43408168-43408357
  misc_feature 1..189: note = hypo
  source 1..189: mol_type = genomic DNA

SEQ ID NO: 60058 - DNA, 39 bp, Homo sapiens; identical to SEQ ID NO: 14407
  misc_feature 1..39: note = chr2:43412683-43412722
  misc_feature 1..39: note = hypo
  source 1..39: mol_type = genomic DNA

SEQ ID NO: 60059 - DNA, 107 bp, Homo sapiens; identical to SEQ ID NO: 39512
  misc_feature 1..107: note = chr2:43812086-43812193
  misc_feature 1..107: note = hypo
  source 1..107: mol_type = genomic DNA

SEQ ID NO: 60060 - DNA, 40 bp, Homo sapiens; identical to SEQ ID NO: 14408
  misc_feature 1..40: note = chr2:43824353-43824393
  misc_feature 1..40: note = hypo
  source 1..40: mol_type = genomic DNA

SEQ ID NO: 60061 - DNA, 87 bp, Homo sapiens; identical to SEQ ID NO: 39514
  misc_feature 1..87: note = chr2:44224206-44224293
  misc_feature 1..87: note = hypo
  source 1..87: mol_type = genomic DNA

SEQ ID NO: 60062 - skipped

SEQ ID NO: 60063 - DNA, 30 bp, Homo sapiens; identical to SEQ ID NO: 39516
  misc_feature 1..30: note = chr2:47200712-47200742
  misc_feature 1..30: note = hypo
  source 1..30: mol_type = genomic DNA

SEQ ID NO: 60064 - DNA, 30 bp, Homo sapiens; identical to SEQ ID NO: 39517
  misc_feature 1..30: note = chr2:47567513-47567543
  misc_feature 1..30: note = hypo
  source 1..30: mol_type = genomic DNA

SEQ ID NO: 60065 - DNA, 30 bp, Homo sapiens; identical to SEQ ID NO: 39518
  misc_feature 1..30: note = chr2:47574359-47574389
  misc_feature 1..30: note = hypo
  source 1..30: mol_type = genomic DNA

SEQ ID NO: 60066 - DNA, 23 bp, Homo sapiens
  misc_feature 1..23: note = chr2:47599482-47599505
  misc_feature 1..23: note = hypo
  source 1..23: mol_type = genomic DNA
agaggcggtgacagccgggcatg

SEQ ID NO: 60067 - DNA, 30 bp, Homo sapiens; identical to SEQ ID NO: 39523
  misc_feature 1..30: note = chr2:52856863-52856893
  misc_feature 1..30: note = hypo
  source 1..30: mol_type = genomic DNA

SEQ ID NO: 60068 - DNA, 30 bp, Homo sapiens; identical to SEQ ID NO: 39524
  misc_feature 1..30: note = chr2:55653035-55653065
  misc_feature 1..30: note = hypo
  source 1..30: mol_type = genomic DNA

SEQ ID NO: 60069 - DNA, 16 bp, Homo sapiens
  misc_feature 1..16: note = chr2:55669245-55669261
  misc_feature 1..16: note = hypo
  source 1..16: mol_type = genomic DNA
tggagccaagatggcc

SEQ ID NO: 60070 - DNA, 28 bp, Homo sapiens
  misc_feature 1..28: note = chr2:55874935-55874963
  misc_feature 1..28: note = hypo
  source 1..28: mol_type = genomic DNA
gcgtgagccaccgcgcccagcagacatt

SEQ ID NO: 60071 - DNA, 166 bp, Homo sapiens; identical to SEQ ID NO: 39527
  misc_feature 1..166: note = chr2:58641373-58641539
  misc_feature 1..166: note = hypo
  source 1..166: mol_type = genomic DNA

SEQ ID NO: 60072 - DNA, 44 bp, Homo sapiens; identical to SEQ ID NO: 39528
  misc_feature 1..44: note = chr2:59269682-59269726
  misc_feature 1..44: note = hypo
  source 1..44: mol_type = genomic DNA

SEQ ID NO: 60073 - DNA, 45 bp, Homo sapiens; identical to SEQ ID NO: 39529
  misc_feature 1..45: note = chr2:60411741-60411786
  misc_feature 1..45: note = hypo
  source 1..45: mol_type = genomic DNA

SEQ ID NO: 60074 - DNA, 30 bp, Homo sapiens; identical to SEQ ID NO: 14413
  misc_feature 1..30: note = chr2:60442223-60442253
  misc_feature 1..30: note = hypo
  source 1..30: mol_type = genomic DNA

SEQ ID NO: 60075 - DNA, 110 bp, Homo sapiens; identical to SEQ ID NO: 14414
  misc_feature 1..110: note = chr2:60705907-60706017
  misc_feature 1..110: note = hypo
  source 1..110: mol_type = genomic DNA

SEQ ID NO: 60076 - DNA, 170 bp, Homo sapiens
  misc_feature 1..170: note = chr2:60706804-60706974
  misc_feature 1..170: note = hypo
  source 1..170: mol_type = genomic DNA
cgtcctgtactcctgccccagctctaatgcaataaaatgtcttttatcaatgtaattcaaggcaaagagtcaagggtctgtcaccattttaaagaggcttattacatggccacaaaaatttgcctcaggctcaaacctggcatgtaaggtatcagcgtgggacaggttct

SEQ ID NO: 60077 - DNA, 30 bp, Homo sapiens; identical to SEQ ID NO: 39533
  misc_feature 1..30: note = chr2:60733708-60733738
  misc_feature 1..30: note = hypo
  source 1..30: mol_type = genomic DNA

SEQ ID NO: 60078 - DNA, 30 bp, Homo sapiens; identical to SEQ ID NO: 14415
  misc_feature 1..30: note = chr2:60887794-60887824
  misc_feature 1..30: note = hypo
  source 1..30: mol_type = genomic DNA

SEQ ID NO: 60079 - DNA, 37 bp, Homo sapiens; identical to SEQ ID NO: 39535
  misc_feature 1..37: note = chr2:61231438-61231475
  misc_feature 1..37: note = hypo
  source 1..37: mol_type = genomic DNA

SEQ ID NO: 60080 - DNA, 30 bp, Homo sapiens; identical to SEQ ID NO: 14416
  misc_feature 1..30: note = chr2:61406196-61406226
  misc_feature 1..30: note = hypo
  source 1..30: mol_type = genomic DNA

SEQ ID NO: 60081 - DNA, 18 bp, Homo sapiens
  misc_feature 1..18: note = chr2:61992299-61992317
  misc_feature 1..18: note = hypo
  source 1..18: mol_type = genomic DNA
aggcgtgagccaccgcgc

SEQ ID NO: 60082 - DNA, 56 bp, Homo sapiens; identical to SEQ ID NO: 39538
  misc_feature 1..56: note = chr2:62409597-62409653
  misc_feature 1..56: note = hypo
  source 1..56: mol_type = genomic DNA

SEQ ID NO: 60083 - DNA, 86 bp, Homo sapiens; identical to SEQ ID NO: 4970
  misc_feature 1..86: note = chr2:62589799-62589885
  misc_feature 1..86: note = hypo
  source 1..86: mol_type = genomic DNA

SEQ ID NO: 60084 - DNA, 30 bp, Homo sapiens; identical to SEQ ID NO: 39540
  misc_feature 1..30: note = chr2:64348216-64348246
  misc_feature 1..30: note = hypo
  source 1..30: mol_type = genomic DNA

SEQ ID NO: 60085 - DNA, 145 bp, Homo sapiens; identical to SEQ ID NO: 39541
  misc_feature 1..145: note = chr2:64835504-64835649
  misc_feature 1..145: note = hypo
  source 1..145: mol_type = genomic DNA

SEQ ID NO: 60086 - DNA, 92 bp, Homo sapiens; identical to SEQ ID NO: 39542
  misc_feature 1..92: note = chr2:65413492-65413584
  misc_feature 1..92: note = hypo
  source 1..92: mol_type = genomic DNA

SEQ ID NO: 60087 - DNA, 30 bp, Homo sapiens; identical to SEQ ID NO: 39543
  misc_feature 1..30: note = chr2:65868490-65868520
  misc_feature 1..30: note = hypo
  source 1..30: mol_type = genomic DNA

SEQ ID NO: 60088 - DNA, 30 bp, Homo sapiens; identical to SEQ ID NO: 39544
  misc_feature 1..30: note = chr2:66561514-66561544
  misc_feature 1..30: note = hypo
  source 1..30: mol_type = genomic DNA

SEQ ID NO: 60089 - DNA, 39 bp, Homo sapiens; identical to SEQ ID NO: 39547
  misc_feature 1..39: note = chr2:68530252-68530291
  misc_feature 1..39: note = hypo
  source 1..39: mol_type = genomic DNA

SEQ ID NO: 60090 - DNA, 39 bp, Homo sapiens; identical to SEQ ID NO: 39548
  misc_feature 1..39: note = chr2:68537171-68537210
  misc_feature 1..39: note = hypo
  source 1..39: mol_type = genomic DNA

SEQ ID NO: 60091 - DNA, 164 bp, Homo sapiens
  misc_feature 1..164: note = chr2:68672689-68672853
  misc_feature 1..164: note = hypo
  source 1..164: mol_type = genomic DNA
tcaaaataacaaacacgcacgacgtcttcgatcaccttcctgtaaaaccgggtttctagccggacccatgtcctcacagttcctgaatcaagttcaccgtctgtgcaagcgccacctgacagagctccctgcgacactgaaacgcgtttgggcacttcccacgt

SEQ ID NO: 60092 - DNA, 48 bp, Homo sapiens; identical to SEQ ID NO: 39550
  misc_feature 1..48: note = chr2:68882413-68882461
  misc_feature 1..48: note = hypo
  source 1..48: mol_type = genomic DNA

SEQ ID NO: 60093 - DNA, 139 bp, Homo sapiens; identical to SEQ ID NO: 39551
  misc_feature 1..139: note = chr2:69182056-69182195
  misc_feature 1..139: note = hypo
  source 1..139: mol_type = genomic DNA

SEQ ID NO: 60094 - DNA, 141 bp, Homo sapiens; identical to SEQ ID NO: 39552
  misc_feature 1..141: note = chr2:69720070-69720211
  misc_feature 1..141: note = hypo
  source 1..141: mol_type = genomic DNA

SEQ ID NO: 60095 - DNA, 95 bp, Homo sapiens; identical to SEQ ID NO: 39553
  misc_feature 1..95: note = chr2:69914132-69914227
  misc_feature 1..95: note = hypo
  source 1..95: mol_type = genomic DNA

SEQ ID NO: 60096 - DNA, 48 bp, Homo sapiens; identical to SEQ ID NO: 14421
  misc_feature 1..48: note = chr2:70364215-70364263
  misc_feature 1..48: note = hypo
  source 1..48: mol_type = genomic DNA

SEQ ID NO: 60097 - DNA, 90 bp, Homo sapiens; identical to SEQ ID NO: 39555
  misc_feature 1..90: note = chr2:70367809-70367899
  misc_feature 1..90: note = hypo
  source 1..90: mol_type = genomic DNA

SEQ ID NO: 60098 - DNA, 19 bp, Homo sapiens
  misc_feature 1..19: note = chr2:70477741-70477760
  misc_feature 1..19: note = hypo
  source 1..19: mol_type = genomic DNA
gtcggctgagcggggcggc

SEQ ID NO: 60099 - DNA, 30 bp, Homo sapiens; identical to SEQ ID NO: 39557
  misc_feature 1..30: note = chr2:71270959-71270989
  misc_feature 1..30: note = hypo
  source 1..30: mol_type = genomic DNA

SEQ ID NO: 60100 - DNA, 92 bp, Homo sapiens; identical to SEQ ID NO: 39559
  misc_feature 1..92: note = chr2:71455196-71455288
  misc_feature 1..92: note = hypo
  source 1..92: mol_type = genomic DNA

SEQ ID NO: 60101 - DNA, 30 bp, Homo sapiens; identical to SEQ ID NO: 39560
  misc_feature 1..30: note = chr2:71502899-71502929
  misc_feature 1..30: note = hypo
  source 1..30: mol_type = genomic DNA

SEQ ID NO: 60102 - DNA, 32 bp, Homo sapiens; identical to SEQ ID NO: 39561
  misc_feature 1..32: note = chr2:71622692-71622724
  misc_feature 1..32: note = hypo
  source 1..32: mol_type = genomic DNA

SEQ ID NO: 60103 - DNA, 83 bp, Homo sapiens; identical to SEQ ID NO: 39562
  misc_feature 1..83: note = chr2:72778912-72778995
  misc_feature 1..83: note = hypo
  source 1..83: mol_type = genomic DNA

SEQ ID NO: 60104 - DNA, 23 bp, Homo sapiens
  misc_feature 1..23: note = chr2:73440127-73440150
  misc_feature 1..23: note = hypo
  source 1..23: mol_type = genomic DNA
caggtgatcctcccacgcatcac

SEQ ID NO: 60105 - DNA, 30 bp, Homo sapiens; identical to SEQ ID NO: 39565
  misc_feature 1..30: note = chr2:73723848-73723878
  misc_feature 1..30: note = hypo
  source 1..30: mol_type = genomic DNA

SEQ ID NO: 60106 - DNA, 17 bp, Homo sapiens
  misc_feature 1..17: note = chr2:74425137-74425154
  misc_feature 1..17: note = hypo
  source 1..17: mol_type = genomic DNA
atatggtctcactctcg

SEQ ID NO: 60107 - DNA, 72 bp, Homo sapiens
  misc_feature 1..72: note = chr2:74454002-74454074
  misc_feature 1..72: note = hypo
  source 1..72: mol_type = genomic DNA
caggaggggaggttgcgctgcacctctgggttgcccaggccaacctgccaggcaggagggggaagcccgtgc

SEQ ID NO: 60108 - DNA, 58 bp, Homo sapiens; identical to SEQ ID NO: 23858
  misc_feature 1..58: note = chr2:74454261-74454319
  misc_feature 1..58: note = hypo
  source 1..58: mol_type = genomic DNA

SEQ ID NO: 60109 - DNA, 22 bp, Homo sapiens
  misc_feature 1..22: note = chr2:74669781-74669803
  misc_feature 1..22: note = hypo
  source 1..22: mol_type = genomic DNA
cataaagagcagctgcgcgcgg

SEQ ID NO: 60110 - DNA, 92 bp, Homo sapiens; identical to SEQ ID NO: 39570
  misc_feature 1..92: note = chr2:74700397-74700489
  misc_feature 1..92: note = hypo
  source 1..92: mol_type = genomic DNA

SEQ ID NO: 60111 - DNA, 36 bp, Homo sapiens; identical to SEQ ID NO: 39571
  misc_feature 1..36: note = chr2:74733345-74733381
  misc_feature 1..36: note = hypo
  source 1..36: mol_type = genomic DNA

SEQ ID NO: 60112 - DNA, 24 bp, Homo sapiens
  misc_feature 1..24: note = chr2:74874703-74874727
  misc_feature 1..24: note = hypo
  source 1..24: mol_type = genomic DNA
tgggttcactttaaacgaaatgaa

SEQ ID NO: 60113 - DNA, 35 bp, Homo sapiens; identical to SEQ ID NO: 39573
  misc_feature 1..35: note = chr2:81421368-81421403
  misc_feature 1..35: note = hypo
  source 1..35: mol_type = genomic DNA

SEQ ID NO: 60114 - DNA, 54 bp, Homo sapiens; identical to SEQ ID NO: 39574
  misc_feature 1..54: note = chr2:81424249-81424303
  misc_feature 1..54: note = hypo
  source 1..54: mol_type = genomic DNA

SEQ ID NO: 60115 - DNA, 30 bp, Homo sapiens; identical to SEQ ID NO: 39575
  misc_feature 1..30: note = chr2:85533655-85533685
  misc_feature 1..30: note = hypo
  source 1..30: mol_type = genomic DNA

SEQ ID NO: 60116 - DNA, 30 bp, Homo sapiens; identical to SEQ ID NO: 39576
  misc_feature 1..30: note = chr2:85542244-85542274
  misc_feature 1..30: note = hypo
  source 1..30: mol_type = genomic DNA

SEQ ID NO: 60117 - DNA, 34 bp, Homo sapiens; identical to SEQ ID NO: 39577
  misc_feature 1..34: note = chr2:85769773-85769807
  misc_feature 1..34: note = hypo
  source 1..34: mol_type = genomic DNA

SEQ ID NO: 60118 - DNA, 24 bp, Homo sapiens
  misc_feature 1..24: note = chr2:85838299-85838323
  misc_feature 1..24: note = hypo
  source 1..24: mol_type = genomic DNA
cagcctgggcgacagagacctagt

SEQ ID NO: 60119 - DNA, 29 bp, Homo sapiens
  misc_feature 1..29: note = chr2:86423740-86423769
  misc_feature 1..29: note = hypo
  source 1..29: mol_type = genomic DNA
atcaaaataaaacacgttaaatattaagc

SEQ ID NO: 60120 - DNA, 16 bp, Homo sapiens
  misc_feature 1..16: note = chr2:87056517-87056533
  misc_feature 1..16: note = hypo
  source 1..16: mol_type = genomic DNA
gcgcctggctggcata

SEQ ID NO: 60121 - DNA, 80 bp, Homo sapiens; identical to SEQ ID NO: 39581
  misc_feature 1..80: note = chr2:87961966-87962046
  misc_feature 1..80: note = hypo
  source 1..80: mol_type = genomic DNA

SEQ ID NO: 60122 - DNA, 30 bp, Homo sapiens; identical to SEQ ID NO: 39582
  misc_feature 1..30: note = chr2:88306721-88306751
  misc_feature 1..30: note = hypo
  source 1..30: mol_type = genomic DNA

SEQ ID NO: 60123 - DNA, 87 bp, Homo sapiens; identical to SEQ ID NO: 39584
  misc_feature 1..87: note = chr2:88573562-88573649
  misc_feature 1..87: note = hypo
  source 1..87: mol_type = genomic DNA

SEQ ID NO: 60124 - DNA, 157 bp, Homo sapiens
  misc_feature 1..157: note = chr2:88990264-88990421
  misc_feature 1..157: note = hypo
  source 1..157: mol_type = genomic DNA
gcccataccagtgacttgcgctcacggaagagttctgaaggcctggaatgcgtttgaagatgagttcatgagcagacagaaaggattccactaacagccgagaaacacaaaggtcatgtgtttttagggacctccaagtggtcggtaaggttggggt

SEQ ID NO: 60125 - DNA, 34 bp, Homo sapiens; identical to SEQ ID NO: 39586
  misc_feature 1..34: note = chr2:89071947-89071981
  misc_feature 1..34: note = hypo
  source 1..34: mol_type = genomic DNA

SEQ ID NO: 60126 - DNA, 30 bp, Homo sapiens; identical to SEQ ID NO: 39587
  misc_feature 1..30: note = chr2:89371674-89371704
  misc_feature 1..30: note = hypo
  source 1..30: mol_type = genomic DNA

SEQ ID NO: 60127 - DNA, 38 bp, Homo sapiens; identical to SEQ ID NO: 39588
  misc_feature 1..38: note = chr2:90003862-90003900
  misc_feature 1..38: note = hypo
  source 1..38: mol_type = genomic DNA

SEQ ID NO: 60128 - DNA, 89 bp, Homo sapiens; identical to SEQ ID NO: 39589
  misc_feature 1..89: note = chr2:95742095-95742184
  misc_feature 1..89: note = hypo
  source 1..89: mol_type = genomic DNA

SEQ ID NO: 60129 - DNA, 30 bp, Homo sapiens; identical to SEQ ID NO: 39590
  misc_feature 1..30: note = chr2:95745768-95745798
  misc_feature 1..30: note = hypo
  source 1..30: mol_type = genomic DNA

SEQ ID NO: 60130 - DNA, 49 bp, Homo sapiens
  misc_feature 1..49: note = chr2:95941629-95941678
  misc_feature 1..49: note = hypo
  source 1..49: mol_type = genomic DNA
ctgggcagtgggggtcgggtcacccctcatgccctgctgcctgcccagg

SEQ ID NO: 60131 - DNA, 40 bp, Homo sapiens; identical to SEQ ID NO: 23864
  misc_feature 1..40: note = chr2:95941812-95941852
  misc_feature 1..40: note = hypo
  source 1..40: mol_type = genomic DNA

SEQ ID NO: 60132 - DNA, 82 bp, Homo sapiens; identical to SEQ ID NO: 39592
  misc_feature 1..82: note = chr2:96784580-96784662
  misc_feature 1..82: note = hypo
  source 1..82: mol_type = genomic DNA

SEQ ID NO: 60133 - DNA, 24 bp, Homo sapiens
  misc_feature 1..24: note = chr2:96872240-96872264
  misc_feature 1..24: note = hypo
  source 1..24: mol_type = genomic DNA
cttaaaagtggaacacggccgggc

SEQ ID NO: 60134 - DNA, 30 bp, Homo sapiens; identical to SEQ ID NO: 39596
  misc_feature 1..30: note = chr2:97437788-97437818
  misc_feature 1..30: note = hypo
  source 1..30: mol_type = genomic DNA

SEQ ID NO: 60135 - DNA, 30 bp, Homo sapiens; identical to SEQ ID NO: 39597
  misc_feature 1..30: note = chr2:97603228-97603258
  misc_feature 1..30: note = hypo
  source 1..30: mol_type = genomic DNA

SEQ ID NO: 60136 - DNA, 119 bp, Homo sapiens; identical to SEQ ID NO: 39598
  misc_feature 1..119: note = chr2:97605950-97606069
  misc_feature 1..119: note = hypo
  source 1..119: mol_type = genomic DNA

SEQ ID NO: 60137 - DNA, 32 bp, Homo sapiens; identical to SEQ ID NO: 39599
  misc_feature 1..32: note = chr2:97652373-97652405
  misc_feature 1..32: note = hypo
  source 1..32: mol_type = genomic DNA

SEQ ID NO: 60138 - DNA, 30 bp, Homo sapiens; identical to SEQ ID NO: 14435
  misc_feature 1..30: note = chr2:98025687-98025717
  misc_feature 1..30: note = hypo
  source 1..30: mol_type = genomic DNA

SEQ ID NO: 60139 - DNA, 30 bp, Homo sapiens; identical to SEQ ID NO: 39601
  misc_feature 1..30: note = chr2:98263541-98263571
  misc_feature 1..30: note = hypo
  source 1..30: mol_type = genomic DNA

SEQ ID NO: 60140 - DNA, 30 bp, Homo sapiens; identical to SEQ ID NO: 39602
  misc_feature 1..30: note = chr2:98351134-98351164
  misc_feature 1..30: note = hypo
  source 1..30: mol_type = genomic DNA

SEQ ID NO: 60141 - DNA, 30 bp, Homo sapiens; identical to SEQ ID NO: 39603
  misc_feature 1..30: note = chr2:98354137-98354167
  misc_feature 1..30: note = hypo
  source 1..30: mol_type = genomic DNA

SEQ ID NO: 60142 - DNA, 145 bp, Homo sapiens; identical to SEQ ID NO: 39604
  misc_feature 1..145: note = chr2:98357736-98357881
  misc_feature 1..145: note = hypo
  source 1..145: mol_type = genomic DNA

SEQ ID NO: 60143 - DNA, 189 bp, Homo sapiens; identical to SEQ ID NO: 39605
  misc_feature 1..189: note = chr2:98702143-98702332
  misc_feature 1..189: note = hypo
  source 1..189: mol_type = genomic DNA

SEQ ID NO: 60144 - DNA, 30 bp, Homo sapiens; identical to SEQ ID NO: 39606
  misc_feature 1..30: note = chr2:98957314-98957344
  misc_feature 1..30: note = hypo
  source 1..30: mol_type = genomic DNA

SEQ ID NO: 60145 - DNA, 30 bp, Homo sapiens; identical to SEQ ID NO: 39607
  misc_feature 1..30: note = chr2:99004156-99004186
  misc_feature 1..30: note = hypo
  source 1..30: mol_type = genomic DNA

SEQ ID NO: 60146 - DNA, 88 bp, Homo sapiens; identical to SEQ ID NO: 39608
  misc_feature 1..88: note = chr2:99795933-99796021
  misc_feature 1..88: note = hypo
  source 1..88: mol_type = genomic DNA

SEQ ID NO: 60147 - DNA, 139 bp, Homo sapiens
  misc_feature 1..139: note = chr2:99796330-99796469
  misc_feature 1..139: note = hypo
  source 1..139: mol_type = genomic DNA
gagtttgtagttctgaccaaagcaccaaaccataaagggctcccctctgctgccccaaagcttctgtaacactttaattataagaagcttaaactagaaagaacagagggagcttagtccagaccgggagtgtcggggg

SEQ ID NO: 60148 - DNA, 39 bp, Homo sapiens; identical to SEQ ID NO: 39611
  misc_feature 1..39: note = chr2:99951448-99951487
  misc_feature 1..39: note = hypo
  source 1..39: mol_type = genomic DNA

SEQ ID NO: 60149 - DNA, 30 bp, Homo sapiens; identical to SEQ ID NO: 39612
  misc_feature 1..30: note = chr2:100107667-100107697
  misc_feature 1..30: note = hypo
  source 1..30: mol_type = genomic DNA

SEQ ID NO: 60150 - DNA, 162 bp, Homo sapiens; identical to SEQ ID NO: 39613
  misc_feature 1..162: note = chr2:100108060-100108222
  misc_feature 1..162: note = hypo
  source 1..162: mol_type = genomic DNA

SEQ ID NO: 60151 - DNA, 177 bp, Homo sapiens; identical to SEQ ID NO: 39615
  misc_feature 1..177: note = chr2:101520526-101520703
  misc_feature 1..177: note = hypo
  source 1..177: mol_type = genomic DNA

SEQ ID NO: 60152 - DNA, 40 bp, Homo sapiens
  misc_feature 1..40: note = chr2:101835057-101835097
  misc_feature 1..40: note = hypo
  source 1..40: mol_type = genomic DNA
ctgggattacaggcatgagccaccgcgcccagcctagtca

SEQ ID NO: 60153 - DNA, 30 bp, Homo sapiens; identical to SEQ ID NO: 39617
  misc_feature 1..30: note = chr2:101893777-101893807
  misc_feature 1..30: note = hypo
  source 1..30: mol_type = genomic DNA

SEQ ID NO: 60154 - DNA, 204 bp, Homo sapiens; identical to SEQ ID NO: 39618
  misc_feature 1..204: note = chr2:102246999-102247203
  misc_feature 1..204: note = hypo
  source 1..204: mol_type = genomic DNA

SEQ ID NO: 60155 - DNA, 91 bp, Homo sapiens; identical to SEQ ID NO: 39619
  misc_feature 1..91: note = chr2:104014594-104014685
  misc_feature 1..91: note = hypo
  source 1..91: mol_type = genomic DNA

SEQ ID NO: 60156 - DNA, 30 bp, Homo sapiens; identical to SEQ ID NO: 39620
  misc_feature 1..30: note = chr2:105719619-105719649
  misc_feature 1..30: note = hypo
  source 1..30: mol_type = genomic DNA

SEQ ID NO: 60157 - DNA, 41 bp, Homo sapiens; identical to SEQ ID NO: 39621
  misc_feature 1..41: note = chr2:105858359-105858400
  misc_feature 1..41: note = hypo
  source 1..41: mol_type = genomic DNA

SEQ ID NO: 60158 - DNA, 156 bp, Homo sapiens; identical to SEQ ID NO: 39622
  misc_feature 1..156: note = chr2:105972350-105972506
  misc_feature 1..156: note = hypo
  source 1..156: mol_type = genomic DNA

SEQ ID NO: 60159 - DNA, 257 bp, Homo sapiens; identical to SEQ ID NO: 39623
  misc_feature 1..257: note = chr2:106016141-106016398
  misc_feature 1..257: note = hypo
  source 1..257: mol_type = genomic DNA

SEQ ID NO: 60160 - DNA, 30 bp, Homo sapiens; identical to SEQ ID NO: 39625
  misc_feature 1..30: note = chr2:106111101-106111131
  misc_feature 1..30: note = hypo
  source 1..30: mol_type = genomic DNA

SEQ ID NO: 60161 - DNA, 30 bp, Homo sapiens; identical to SEQ ID NO: 14441
  misc_feature 1..30: note = chr2:106672847-106672877
  misc_feature 1..30: note = hypo
  source 1..30: mol_type = genomic DNA

SEQ ID NO: 60162 - DNA, 30 bp, Homo sapiens; identical to SEQ ID NO: 23871
  misc_feature 1..30: note = chr2:106959338-106959368
  misc_feature 1..30: note = hypo
  source 1..30: mol_type = genomic DNA

SEQ ID NO: 60163 - DNA, 55 bp, Homo sapiens; identical to SEQ ID NO: 23872
  misc_feature 1..55: note = chr2:106959988-106960043
  misc_feature 1..55: note = hypo
  source 1..55: mol_type = genomic DNA

SEQ ID NO: 60164 - DNA, 21 bp, Homo sapiens
  misc_feature 1..21: note = chr2:107278930-107278951
  misc_feature 1..21: note = hypo
  source 1..21: mol_type = genomic DNA
ccaccgcgcctggcctatttt

SEQ ID NO: 60165 - DNA, 245 bp, Homo sapiens; identical to SEQ ID NO: 39630
  misc_feature 1..245: note = chr2:107460171-107460416
  misc_feature 1..245: note = hypo
  source 1..245: mol_type = genomic DNA

SEQ ID NO: 60166 - DNA, 24 bp, Homo sapiens
  misc_feature 1..24: note = chr2:108104796-108104820
  misc_feature 1..24: note = hypo
  source 1..24: mol_type = genomic DNA
tttttttttttgagacggagtccc

SEQ ID NO: 60167 - DNA, 47 bp, Homo sapiens; identical to SEQ ID NO: 39632
  misc_feature 1..47: note = chr2:108160878-108160925
  misc_feature 1..47: note = hypo
  source 1..47: mol_type = genomic DNA

SEQ ID NO: 60168 - DNA, 59 bp, Homo sapiens
  misc_feature 1..59: note = chr2:109335074-109335133
  misc_feature 1..59: note = hypo
  source 1..59: mol_type = genomic DNA
tacaggcgtgaaccacagcgcccggcggaatgcgtggattttggcataagacggtggtt

SEQ ID NO: 60169 - DNA, 30 bp, Homo sapiens; identical to SEQ ID NO: 39634
  misc_feature 1..30: note = chr2:111438469-111438499
  misc_feature 1..30: note = hypo
  source 1..30: mol_type = genomic DNA

SEQ ID NO: 60170 - DNA, 40 bp, Homo sapiens; identical to SEQ ID NO: 39635
  misc_feature 1..40: note = chr2:111898079-111898119
  misc_feature 1..40: note = hypo
  source 1..40: mol_type = genomic DNA

SEQ ID NO: 60171 - DNA, 157 bp, Homo sapiens; identical to SEQ ID NO: 39636
  misc_feature 1..157: note = chr2:113013160-113013317
  misc_feature 1..157: note = hypo
  source 1..157: mol_type = genomic DNA

SEQ ID NO: 60172 - DNA, 38 bp, Homo sapiens; identical to SEQ ID NO: 39637
  misc_feature 1..38: note = chr2:113103393-113103431
  misc_feature 1..38: note = hypo
  source 1..38: mol_type = genomic DNA

SEQ ID NO: 60173 - DNA, 30 bp, Homo sapiens; identical to SEQ ID NO: 39638
  misc_feature 1..30: note = chr2:114394659-114394689
  misc_feature 1..30: note = hypo
  source 1..30: mol_type = genomic DNA

SEQ ID NO: 60174 - DNA, 16 bp, Homo sapiens
  misc_feature 1..16: note = chr2:114469916-114469932
  misc_feature 1..16: note = hypo
  source 1..16: mol_type = genomic DNA
acggagtctcgctgtc

SEQ ID NO: 60175 - DNA, 225 bp, Homo sapiens
  misc_feature 1..225: note = chr2:114515303-114515528
  misc_feature 1..225: note = hypo
  source 1..225: mol_type = genomic DNA
atcttggtcagatggcgtgaagaaattaaattttcttactcctatagtcgcgatgtagtgtacctcttaccttttaagtctcgtttcagtgaagttgaatgcatattctagcaactaataaaacaataccaatgaacattttttaattgatcgaatcagtttcaaactatcagcatcaaacacctctaataagtcattcagaaacctattgtgcagagtaaaaaa

SEQ ID NO: 60176 - DNA, 24 bp, Homo sapiens
  misc_feature 1..24: note = chr2:114515808-114515832
  misc_feature 1..24: note = hypo
  source 1..24: mol_type = genomic DNA
gcgagactccgtctcaaaataaat

SEQ ID NO: 60177 - DNA, 37 bp, Homo sapiens; identical to SEQ ID NO: 39642
  misc_feature 1..37: note = chr2:118628528-118628565
  misc_feature 1..37: note = hypo
  source 1..37: mol_type = genomic DNA

SEQ ID NO: 60178 - DNA, 270 bp, Homo sapiens; identical to SEQ ID NO: 39643
  misc_feature 1..270: note = chr2:120005499-120005769
  misc_feature 1..270: note = hypo
  source 1..270: mol_type = genomic DNA

SEQ ID NO: 60179 - DNA, 30 bp, Homo sapiens; identical to SEQ ID NO: 39644
  misc_feature 1..30: note = chr2:120441329-120441359
  misc_feature 1..30: note = hypo
  source 1..30: mol_type = genomic DNA

SEQ ID NO: 60180 - DNA, 81 bp, Homo sapiens; identical to SEQ ID NO: 39645
  misc_feature 1..81: note = chr2:120973474-120973555
  misc_feature 1..81: note = hypo
  source 1..81: mol_type = genomic DNA

SEQ ID NO: 60181 - DNA, 211 bp, Homo sapiens; identical to SEQ ID NO: 39646
  misc_feature 1..211: note = chr2:120973770-120973981
  misc_feature 1..211: note = hypo
  source 1..211: mol_type = genomic DNA

SEQ ID NO: 60182 - DNA, 255 bp, Homo sapiens; identical to SEQ ID NO: 23877
  misc_feature 1..255: note = chr2:120980098-120980353
  misc_feature 1..255: note = hypo
  source 1..255: mol_type = genomic DNA

SEQ ID NO: 60183 - DNA, 97 bp, Homo sapiens; identical to SEQ ID NO: 23878
  misc_feature 1..97: note = chr2:120980395-120980492
  misc_feature 1..97: note = hypo
  source 1..97: mol_type = genomic DNA

SEQ ID NO: 60184 - DNA, 120 bp, Homo sapiens; identical to SEQ ID NO: 39648
  misc_feature 1..120: note = chr2:121003516-121003636
  misc_feature 1..120: note = hypo
  source 1..120: mol_type = genomic DNA

SEQ ID NO: 60185 - DNA, 30 bp, Homo sapiens; identical to SEQ ID NO: 39649
  misc_feature 1..30: note = chr2:121639825-121639855
  misc_feature 1..30: note = hypo
  source 1..30: mol_type = genomic DNA

SEQ ID NO: 60186 - DNA, 24 bp, Homo sapiens
  misc_feature 1..24: note = chr2:122013325-122013349
  misc_feature 1..24: note = hypo
  source 1..24: mol_type = genomic DNA
tttttttttttgagacggaatctc

SEQ ID NO: 60187 - DNA, 47 bp, Homo sapiens; identical to SEQ ID NO: 39651
  misc_feature 1..47: note = chr2:122088821-122088868
  misc_feature 1..47: note = hypo
  source 1..47: mol_type = genomic DNA

SEQ ID NO: 60188 - DNA, 30 bp, Homo sapiens; identical to SEQ ID NO: 39652
  misc_feature 1..30: note = chr2:122104569-122104599
  misc_feature 1..30: note = hypo
  source 1..30: mol_type = genomic DNA

SEQ ID NO: 60189 - DNA, 181 bp, Homo sapiens
  misc_feature 1..181: note = chr2:122495413-122495594
  misc_feature 1..181: note = hypo
  source 1..181: mol_type = genomic DNA
ttacagcctgagggcagcatggctgctttaagagaccaaagaggcttgtgggggagaggcacactgggtggcgccggagggtcccccttaggaggtggcgttagcaccgaggcctgaaggctaaagagcggggtgtggagaaccgagcgcctgccgtccgctggaccggacaggcctgcac

SEQ ID NO: 60190 - DNA, 30 bp, Homo sapiens; identical to SEQ ID NO: 39654
  misc_feature 1..30: note = chr2:122511801-122511831
  misc_feature 1..30: note = hypo
  source 1..30: mol_type = genomic DNA

SEQ ID NO: 60191 - DNA, 37 bp, Homo sapiens; identical to SEQ ID NO: 39655
  misc_feature 1..37: note = chr2:126237007-126237044
  misc_feature 1..37: note = hypo
  source 1..37: mol_type = genomic DNA

SEQ ID NO: 60192 - DNA, 27 bp, Homo sapiens
  misc_feature 1..27: note = chr2:126347693-126347720
  misc_feature 1..27: note = hypo
  source 1..27: mol_type = genomic DNA
accaacaaaataggccgggtgtagtgg

SEQ ID NO: 60193 - DNA, 21 bp, Homo sapiens
  misc_feature 1..21: note = chr2:126413305-126413326
  misc_feature 1..21: note = hypo
  source 1..21: mol_type = genomic DNA
agcaatggccgggtgcggtgt

SEQ ID NO: 60194 - DNA, 30 bp, Homo sapiens; identical to SEQ ID NO: 39658
  misc_feature 1..30: note = chr2:127395350-127395380
  misc_feature 1..30: note = hypo
  source 1..30: mol_type = genomic DNA

SEQ ID NO: 60195 - DNA, 30 bp, Homo sapiens; identical to SEQ ID NO: 39659
  misc_feature 1..30: note = chr2:127397957-127397987
  misc_feature 1..30: note = hypo
  source 1..30: mol_type = genomic DNA

SEQ ID NO: 60196 - DNA, 81 bp, Homo sapiens; identical to SEQ ID NO: 39660
  misc_feature 1..81: note = chr2:127422857-127422938
  misc_feature 1..81: note = hypo
  source 1..81: mol_type = genomic DNA

SEQ ID NO: 60197 - DNA, 21 bp, Homo sapiens
  misc_feature 1..21: note = chr2:127423058-127423079
  misc_feature 1..21: note = hypo
  source 1..21: mol_type = genomic DNA
aaccaccgattcatgggacag

SEQ ID NO: 60198 - DNA, 30 bp, Homo sapiens; identical to SEQ ID NO: 39663
  misc_feature 1..30: note = chr2:127427725-127427755
  misc_feature 1..30: note = hypo
  source 1..30: mol_type = genomic DNA

SEQ ID NO: 60199 - DNA, 25 bp, Homo sapiens
  misc_feature 1..25: note = chr2:127428985-127429010
  misc_feature 1..25: note = hypo
  source 1..25: mol_type = genomic DNA
gctttatcacaggcacgagcacagg

SEQ ID NO: 60200 - DNA, 127 bp, Homo sapiens; identical to SEQ ID NO: 39665
  misc_feature 1..127: note = chr2:127433244-127433371
  misc_feature 1..127: note = hypo
  source 1..127: mol_type = genomic DNA

SEQ ID NO: 60201 - DNA, 40 bp, Homo sapiens; identical to SEQ ID NO: 14455
  misc_feature 1..40: note = chr2:127435251-127435291
  misc_feature 1..40: note = hypo
  source 1..40: mol_type = genomic DNA

SEQ ID NO: 60202 - DNA, 53 bp, Homo sapiens; identical to SEQ ID NO: 39667
  misc_feature 1..53: note = chr2:127438087-127438140
  misc_feature 1..53: note = hypo
  source 1..53: mol_type = genomic DNA

SEQ ID NO: 60203 - DNA, 232 bp, Homo sapiens
  misc_feature 1..232: note = chr2:127438663-127438895
  misc_feature 1..232: note = hypo
  source 1..232: mol_type = genomic DNA
acttggaaaatacagacagccatatgttagaagtaaacaaaaccactcctaacccgtctacttcttaaaagccggtacttaacatttgaagcgtatttcttttcatcgctttgttttaaggtttttgtggaatatttttcatcatttctatttagagggtcccgttttcttcacttaacatcaataccctaagcatttcttcctgttgctaagttcacgtgcaccccttccc

SEQ ID NO: 60204 - DNA, 113 bp, Homo sapiens; identical to SEQ ID NO: 39669
  misc_feature 1..113: note = chr2:127453528-127453641
  misc_feature 1..113: note = hypo
  source 1..113: mol_type = genomic DNA

SEQ ID NO: 60205 - DNA, 21 bp, Homo sapiens
  misc_feature 1..21: note = chr2:127459661-127459682
  misc_feature 1..21: note = hypo
  source 1..21: mol_type = genomic DNA
ccaccgcgctcagcccaggaa

SEQ ID NO: 60206 - DNA, 81 bp, Homo sapiens; identical to SEQ ID NO: 39671
  misc_feature 1..81: note = chr2:127801154-127801235
  misc_feature 1..81: note = hypo
  source 1..81: mol_type = genomic DNA

SEQ ID NO: 60207 - DNA, 30 bp, Homo sapiens; identical to SEQ ID NO: 39672
  misc_feature 1..30: note = chr2:127809267-127809297
  misc_feature 1..30: note = hypo
  source 1..30: mol_type = genomic DNA

SEQ ID NO: 60208 - DNA, 169 bp, Homo sapiens; identical to SEQ ID NO: 39673
  misc_feature 1..169: note = chr2:128050797-128050966
  misc_feature 1..169: note = hypo
  source 1..169: mol_type = genomic DNA

SEQ ID NO: 60209 - DNA, 30 bp, Homo sapiens; identical to SEQ ID NO: 39674
  misc_feature 1..30: note = chr2:128293422-128293452
  misc_feature 1..30: note = hypo
  source 1..30: mol_type = genomic DNA

SEQ ID NO: 60210 - DNA, 51 bp, Homo sapiens; identical to SEQ ID NO: 39675
  misc_feature 1..51: note = chr2:128380871-128380922
  misc_feature 1..51: note = hypo
  source 1..51: mol_type = genomic DNA

SEQ ID NO: 60211 - DNA, 140 bp, Homo sapiens
  misc_feature 1..140: note = chr2:128616477-128616617
  misc_feature 1..140: note = hypo
  source 1..140: mol_type = genomic DNA
aaatgatgctgttttcgacactggagaaaacaaaaggttgtacaataaggtaaataatcatagcttattagtcaacaatatcttagctcattagtcaacaatgtttagatggtcatattgtaaactctgttgatttaata

SEQ ID NO: 60212 - DNA, 80 bp, Homo sapiens
  misc_feature 1..80: note = chr2:128847723-128847803
  misc_feature 1..80: note = hypo
  source 1..80: mol_type = genomic DNA
ttccattagtcatctccttcatcctcctctccttcctccccttcatcatgttggctcatgtttatttattaaaattattt

SEQ ID NO: 60213 - DNA, 30 bp, Homo sapiens; identical to SEQ ID NO: 39678
  misc_feature 1..30: note = chr2:129128223-129128253
  misc_feature 1..30: note = hypo
  source 1..30: mol_type = genomic DNA

SEQ ID NO: 60214 - DNA, 171 bp, Homo sapiens; identical to SEQ ID NO: 39679
  misc_feature 1..171: note = chr2:130497037-130497208
  misc_feature 1..171: note = hypo
  source 1..171: mol_type = genomic DNA

SEQ ID NO: 60215 - DNA, 178 bp, Homo sapiens; identical to SEQ ID NO: 39680
  misc_feature 1..178: note = chr2:130666498-130666676
  misc_feature 1..178: note = hypo
  source 1..178: mol_type = genomic DNA

SEQ ID NO: 60216 - DNA, 30 bp, Homo sapiens; identical to SEQ ID NO: 39681
  misc_feature 1..30: note = chr2:130886777-130886807
  misc_feature 1..30: note = hypo
  source 1..30: mol_type = genomic DNA

SEQ ID NO: 60217 - DNA, 135 bp, Homo sapiens; identical to SEQ ID NO: 39682
  misc_feature 1..135: note = chr2:130947982-130948117
  misc_feature 1..135: note = hypo
  source 1..135: mol_type = genomic DNA

SEQ ID NO: 60218 - DNA, 42 bp, Homo sapiens; identical to SEQ ID NO: 39683
  misc_feature 1..42: note = chr2:131114462-131114504
  misc_feature 1..42: note = hypo
  source 1..42: mol_type = genomic DNA

SEQ ID NO: 60219 - DNA, 61 bp, Homo sapiens; identical to SEQ ID NO: 39685
  misc_feature 1..61: note = chr2:131486943-131487004
  misc_feature 1..61: note = hypo
  source 1..61: mol_type = genomic DNA

SEQ ID NO: 60220 - DNA, 261 bp, Homo sapiens; identical to SEQ ID NO: 14463
  misc_feature 1..261: note = chr2:131967115-131967376
  misc_feature 1..261: note = hypo
  source 1..261: mol_type = genomic DNA

SEQ ID NO: 60221 - DNA, 103 bp, Homo sapiens; identical to SEQ ID NO: 39687
  misc_feature 1..103: note = chr2:132415272-132415375
  misc_feature 1..103: note = hypo
  source 1..103: mol_type = genomic DNA

SEQ ID NO: 60222 - DNA, 30 bp, Homo sapiens; identical to SEQ ID NO: 39688
  misc_feature 1..30: note = chr2:132416768-132416798
  misc_feature 1..30: note = hypo
  source 1..30: mol_type = genomic DNA

SEQ ID NO: 60223 - DNA, 30 bp, Homo sapiens; identical to SEQ ID NO: 39689
  misc_feature 1..30: note = chr2:135832320-135832350
  misc_feature 1..30: note = hypo
  source 1..30: mol_type = genomic DNA

SEQ ID NO: 60224 - DNA, 36 bp, Homo sapiens; identical to SEQ ID NO: 39690
  misc_feature 1..36: note = chr2:140650928-140650964
  misc_feature 1..36: note = hypo
  source 1..36: mol_type = genomic DNA

SEQ ID NO: 60225 - DNA, 30 bp, Homo sapiens; identical to SEQ ID NO: 39691
  misc_feature 1..30: note = chr2:143931491-143931521
  misc_feature 1..30: note = hypo
  source 1..30: mol_type = genomic DNA

SEQ ID NO: 60226 - DNA, 41 bp, Homo sapiens; identical to SEQ ID NO: 39692
  misc_feature 1..41: note = chr2:145167740-145167781
  misc_feature 1..41: note = hypo
  source 1..41: mol_type = genomic DNA

SEQ ID NO: 60227 - DNA, 43 bp, Homo sapiens; identical to SEQ ID NO: 39693
  misc_feature 1..43: note = chr2:145174534-145174577
  misc_feature 1..43: note = hypo
  source 1..43: mol_type = genomic DNA

SEQ ID NO: 60228 - DNA, 21 bp, Homo sapiens
  misc_feature 1..21: note = chr2:145204291-145204312
  misc_feature 1..21: note = hypo
  source 1..21: mol_type = genomic DNA
taacaattggctggacgcggt

SEQ ID NO: 60229 - DNA, 80 bp, Homo sapiens
  misc_feature 1..80: note = chr2:148776729-148776809
  misc_feature 1..80: note = hypo
  source 1..80: mol_type = genomic DNA
atcggacatgattaccgtacacaatacagaagatactaagggctaagcaatgatgcataaacggggtccactgcccaaac

SEQ ID NO: 60230 - DNA, 38 bp, Homo sapiens; identical to SEQ ID NO: 39696
  misc_feature 1..38: note = chr2:149514655-149514693
  misc_feature 1..38: note = hypo
  source 1..38: mol_type = genomic DNA

SEQ ID NO: 60231 - DNA, 79 bp, Homo sapiens; identical to SEQ ID NO: 39697
  misc_feature 1..79: note = chr2:152266023-152266102
  misc_feature 1..79: note = hypo
  source 1..79: mol_type = genomic DNA

SEQ ID NO: 60232 - DNA, 30 bp, Homo sapiens; identical to SEQ ID NO: 39698
  misc_feature 1..30: note = chr2:162087925-162087955
  misc_feature 1..30: note = hypo
  source 1..30: mol_type = genomic DNA

SEQ ID NO: 60233 - DNA, 40 bp, Homo sapiens; identical to SEQ ID NO: 39699
  misc_feature 1..40: note = chr2:162166372-162166412
  misc_feature 1..40: note = hypo
  source 1..40: mol_type = genomic DNA

SEQ ID NO: 60234-60235 - skipped (2 entries)

SEQ ID NO: 60236 - DNA, 30 bp, Homo sapiens; identical to SEQ ID NO: 39702
  misc_feature 1..30: note = chr2:170584782-170584812
  misc_feature 1..30: note = hypo
  source 1..30: mol_type = genomic DNA

SEQ ID NO: 60237 - DNA, 29 bp, Homo sapiens
  misc_feature 1..29: note = chr2:171624032-171624061
  misc_feature 1..29: note = hypo
  source 1..29: mol_type = genomic DNA
tgagccaccgcgtccggccctcaacaaat

SEQ ID NO: 60238 - DNA, 23 bp, Homo sapiens
  misc_feature 1..23: note = chr2:171769313-171769336
  misc_feature 1..23: note = hypo
  source 1..23: mol_type = genomic DNA
catctaatcgctttggtaacttc

SEQ ID NO: 60239 - DNA, 21 bp, Homo sapiens
  misc_feature 1..21: note = chr2:172129423-172129444
  misc_feature 1..21: note = hypo
  source 1..21: mol_type = genomic DNA
ccaccgcgcctagatggggca

SEQ ID NO: 60240 - DNA, 11 bp, Homo sapiens
  misc_feature 1..11: note = chr2:172411125-172411136
  misc_feature 1..11: note = hypo
  source 1..11: mol_type = genomic DNA
ggatagtcacc

SEQ ID NO: 60241 - DNA, 20 bp, Homo sapiens
  misc_feature 1..20: note = chr2:173036684-173036704
  misc_feature 1..20: note = hypo
  source 1..20: mol_type = genomic DNA
caccgcgcccagcccaataa

SEQ ID NO: 60242 - DNA, 30 bp, Homo sapiens; identical to SEQ ID NO: 39711
  misc_feature 1..30: note = chr2:173291566-173291596
  misc_feature 1..30: note = hypo
  source 1..30: mol_type = genomic DNA

SEQ ID NO: 60243 - DNA, 21 bp, Homo sapiens
  misc_feature 1..21: note = chr2:176030420-176030441
  misc_feature 1..21: note = hypo
  source 1..21: mol_type = genomic DNA
ggagtctcgctgtgtcgccca

SEQ ID NO: 60244 - DNA, 79 bp, Homo sapiens; identical to SEQ ID NO: 39714
  misc_feature 1..79: note = chr2:176430829-176430908
  misc_feature 1..79: note = hypo
  source 1..79: mol_type = genomic DNA

SEQ ID NO: 60245 - DNA, 20 bp, Homo sapiens
  misc_feature 1..20: note = chr2:176569563-176569583
  misc_feature 1..20: note = hypo
  source 1..20: mol_type = genomic DNA
tagaccggagctgttcctat

SEQ ID NO: 60246 - DNA, 97 bp, Homo sapiens; identical to SEQ ID NO: 39716
  misc_feature 1..97: note = chr2:177498024-177498121
  misc_feature 1..97: note = hypo
  source 1..97: mol_type = genomic DNA

SEQ ID NO: 60247 - DNA, 32 bp, Homo sapiens; identical to SEQ ID NO: 39717
  misc_feature 1..32: note = chr2:178089350-178089382
  misc_feature 1..32: note = hypo
  source 1..32: mol_type = genomic DNA

SEQ ID NO: 60248 - DNA, 30 bp, Homo sapiens; identical to SEQ ID NO: 39718
  misc_feature 1..30: note = chr2:178131780-178131810
  misc_feature 1..30: note = hypo
  source 1..30: mol_type = genomic DNA

SEQ ID NO: 60249 - DNA, 11 bp, Homo sapiens
  misc_feature 1..11: note = chr2:178972992-178973003
  misc_feature 1..11: note = hypo
  source 1..11: mol_type = genomic DNA
cctggccagag

SEQ ID NO: 60250 - DNA, 136 bp, Homo sapiens
  misc_feature 1..136: note = chr2:178973042-178973178
  misc_feature 1..136: note = hypo
  source 1..136: mol_type = genomic DNA
acctcacgccctgggctgcaagcgcagccggacgcgcgcgaccagtgatcgccagccaatggcaagccgggacccggtcccactgctgattggcccccagatcccgtgggatctcacctctcgcagaggcttaaag

SEQ ID NO: 60251 - DNA, 30 bp, Homo sapiens; identical to SEQ ID NO: 39721
  misc_feature 1..30: note = chr2:179672126-179672156
  misc_feature 1..30: note = hypo
  source 1..30: mol_type = genomic DNA

SEQ ID NO: 60252 - DNA, 138 bp, Homo sapiens; identical to SEQ ID NO: 39722
  misc_feature 1..138: note = chr2:180886772-180886910
  misc_feature 1..138: note = hypo
  source 1..138: mol_type = genomic DNA

SEQ ID NO: 60253 - DNA, 148 bp, Homo sapiens; identical to SEQ ID NO: 39723
  misc_feature 1..148: note = chr2:182422221-182422369
  misc_feature 1..148: note = hypo
  source 1..148: mol_type = genomic DNA

SEQ ID NO: 60254 - DNA, 128 bp, Homo sapiens; identical to SEQ ID NO: 39724
  misc_feature 1..128: note = chr2:184406833-184406961
  misc_feature 1..128: note = hypo
  source 1..128: mol_type = genomic DNA

SEQ ID NO: 60255 - DNA, 141 bp, Homo sapiens; identical to SEQ ID NO: 39725
  misc_feature 1..141: note = chr2:188235961-188236102
  misc_feature 1..141: note = hypo
  source 1..141: mol_type = genomic DNA

SEQ ID NO: 60256 - DNA, 16 bp, Homo sapiens
  misc_feature 1..16: note = chr2:196302359-196302375
  misc_feature 1..16: note = hypo
  source 1..16: mol_type = genomic DNA
ccgcaggtcacttcag

SEQ ID NO: 60257 - DNA, 30 bp, Homo sapiens; identical to SEQ ID NO: 39727
  misc_feature 1..30: note = chr2:196319761-196319791
  misc_feature 1..30: note = hypo
  source 1..30: mol_type = genomic DNA

SEQ ID NO: 60258 - DNA, 30 bp, Homo sapiens; identical to SEQ ID NO: 39728
  misc_feature 1..30: note = chr2:197503336-197503366
  misc_feature 1..30: note = hypo
  source 1..30: mol_type = genomic DNA

SEQ ID NO: 60259 - DNA, 102 bp, Homo sapiens; identical to SEQ ID NO: 39729
  misc_feature 1..102: note = chr2:200524640-200524742
  misc_feature 1..102: note = hypo
  source 1..102: mol_type = genomic DNA

SEQ ID NO: 60260 - DNA, 30 bp, Homo sapiens; identical to SEQ ID NO: 14479
  misc_feature 1..30: note = chr2:203129332-203129362
  misc_feature 1..30: note = hypo
  source 1..30: mol_type = genomic DNA

SEQ ID NO: 60261 - DNA, 23 bp, Homo sapiens
  misc_feature 1..23: note = chr2:203484340-203484363
  misc_feature 1..23: note = hypo
  source 1..23: mol_type = genomic DNA
tgccatatcgggtgcaccagtta

SEQ ID NO: 60262 - DNA, 106 bp, Homo sapiens; identical to SEQ ID NO: 39732
  misc_feature 1..106: note = chr2:206757186-206757292
  misc_feature 1..106: note = hypo
  source 1..106: mol_type = genomic DNA

SEQ ID NO: 60263 - DNA, 30 bp, Homo sapiens; identical to SEQ ID NO: 39733
  misc_feature 1..30: note = chr2:206859091-206859121
  misc_feature 1..30: note = hypo
  source 1..30: mol_type = genomic DNA

SEQ ID NO: 60264 - DNA, 107 bp, Homo sapiens; identical to SEQ ID NO: 39735
  misc_feature 1..107: note = chr2:207557814-207557921
  misc_feature 1..107: note = hypo
  source 1..107: mol_type = genomic DNA

SEQ ID NO: 60265 - DNA, 30 bp, Homo sapiens; identical to SEQ ID NO: 39736
  misc_feature 1..30: note = chr2:208140368-208140398
  misc_feature 1..30: note = hypo
  source 1..30: mol_type = genomic DNA

SEQ ID NO: 60266 - DNA, 180 bp, Homo sapiens; identical to SEQ ID NO: 39737
  misc_feature 1..180: note = chr2:208574959-208575139
  misc_feature 1..180: note = hypo
  source 1..180: mol_type = genomic DNA

SEQ ID NO: 60267 - DNA, 31 bp, Homo sapiens; identical to SEQ ID NO: 39738
  misc_feature 1..31: note = chr2:209094651-209094682
  misc_feature 1..31: note = hypo
  source 1..31: mol_type = genomic DNA

SEQ ID NO: 60268 - DNA, 30 bp, Homo sapiens; identical to SEQ ID NO: 39739
  misc_feature 1..30: note = chr2:209225350-209225380
  misc_feature 1..30: note = hypo
  source 1..30: mol_type = genomic DNA

SEQ ID NO: 60269 - DNA, 175 bp, Homo sapiens; identical to SEQ ID NO: 39740
  misc_feature 1..175: note = chr2:214080302-214080477
  misc_feature 1..175: note = hypo
  source 1..175: mol_type = genomic DNA

SEQ ID NO: 60270 - DNA, 48 bp, Homo sapiens; identical to SEQ ID NO: 39741
  misc_feature 1..48: note = chr2:217675074-217675122
  misc_feature 1..48: note = hypo
  source 1..48: mol_type = genomic DNA

SEQ ID NO: 60271 - DNA, 30 bp, Homo sapiens; identical to SEQ ID NO: 39742
  misc_feature 1..30: note = chr2:219250043-219250073
  misc_feature 1..30: note = hypo
  source 1..30: mol_type = genomic DNA

SEQ ID NO: 60272 - DNA, 30 bp, Homo sapiens; identical to SEQ ID NO: 39743
  misc_feature 1..30: note = chr2:219251809-219251839
  misc_feature 1..30: note = hypo
  source 1..30: mol_type = genomic DNA

SEQ ID NO: 60273 - DNA, 185 bp, Homo sapiens; identical to SEQ ID NO: 39744
  misc_feature 1..185: note = chr2:219284495-219284680
  misc_feature 1..185: note = hypo
  source 1..185: mol_type = genomic DNA

SEQ ID NO: 60274 - DNA, 189 bp, Homo sapiens; identical to SEQ ID NO: 39745
  misc_feature 1..189: note = chr2:219431996-219432185
  misc_feature 1..189: note = hypo
  source 1..189: mol_type = genomic DNA

SEQ ID NO: 60275 - DNA, 30 bp, Homo sapiens; identical to SEQ ID NO: 39746
  misc_feature 1..30: note = chr2:219611841-219611871
  misc_feature 1..30: note = hypo
  source 1..30: mol_type = genomic DNA

SEQ ID NO: 60276 - DNA, 30 bp, Homo sapiens; identical to SEQ ID NO: 39747
  misc_feature 1..30: note = chr2:219773320-219773350
  misc_feature 1..30: note = hypo
  source 1..30: mol_type = genomic DNA

SEQ ID NO: 60277 - DNA, 30 bp, Homo sapiens; identical to SEQ ID NO: 14482
  misc_feature 1..30: note = chr2:220316287-220316317
  misc_feature 1..30: note = hypo
  source 1..30: mol_type = genomic DNA

SEQ ID NO: 60278 - DNA, 42 bp, Homo sapiens; identical to SEQ ID NO: 39750
  misc_feature 1..42: note = chr2:220384416-220384458
  misc_feature 1..42: note = hypo
  source 1..42: mol_type = genomic DNA

SEQ ID NO: 60279 - DNA, 39 bp, Homo sapiens; identical to SEQ ID NO: 39751
  misc_feature 1..39: note = chr2:221861787-221861826
  misc_feature 1..39: note = hypo
  source 1..39: mol_type = genomic DNA

SEQ ID NO: 60280 - DNA, 119 bp, Homo sapiens; identical to SEQ ID NO: 39752
  misc_feature 1..119: note = chr2:223753484-223753603
  misc_feature 1..119: note = hypo
  source 1..119: mol_type = genomic DNA

SEQ ID NO: 60281 - DNA, 30 bp, Homo sapiens; identical to SEQ ID NO: 14483
  misc_feature 1..30: note = chr2:223764711-223764741
  misc_feature 1..30: note = hypo
  source 1..30: mol_type = genomic DNA

SEQ ID NO: 60282 - DNA, 75 bp, Homo sapiens; identical to SEQ ID NO: 39754
  misc_feature 1..75: note = chr2:225394300-225394375
  misc_feature 1..75: note = hypo
  source 1..75: mol_type = genomic DNA

SEQ ID NO: 60283 - DNA, 24 bp, Homo sapiens
  misc_feature 1..24: note = chr2:226298377-226298401
  misc_feature 1..24: note = hypo
  source 1..24: mol_type = genomic DNA
aaaaaattagttgggcgtgatggc

SEQ ID NO: 60284 - DNA, 32 bp, Homo sapiens; identical to SEQ ID NO: 39756
  misc_feature 1..32: note = chr2:228264610-228264642
  misc_feature 1..32: note = hypo
  source 1..32: mol_type = genomic DNA

SEQ ID NO: 60285 - DNA, 30 bp, Homo sapiens; identical to SEQ ID NO: 39758
  misc_feature 1..30: note = chr2:228735796-228735826
  misc_feature 1..30: note = hypo
  source 1..30: mol_type = genomic DNA

SEQ ID NO: 60286 - DNA, 215 bp, Homo sapiens; identical to SEQ ID NO: 39759
  misc_feature 1..215: note = chr2:228888319-228888534
  misc_feature 1..215: note = hypo
  source 1..215: mol_type = genomic DNA

SEQ ID NO: 60287 - DNA, 70 bp, Homo sapiens
  misc_feature 1..70: note = chr2:230795565-230795635
  misc_feature 1..70: note = hypo
  source 1..70: mol_type = genomic DNA
ttttccctcctgctgtcatttaccccctcactgctcctcctgatggcagcaagtgcgcaaacattccctt

SEQ ID NO: 60288 - DNA, 37 bp, Homo sapiens; identical to SEQ ID NO: 39761
  misc_feature 1..37: note = chr2:231170274-231170311
  misc_feature 1..37: note = hypo
  source 1..37: mol_type = genomic DNA

SEQ ID NO: 60289 - DNA, 99 bp, Homo sapiens; identical to SEQ ID NO: 39762
  misc_feature 1..99: note = chr2:232243072-232243171
  misc_feature 1..99: note = hypo
  source 1..99: mol_type = genomic DNA

SEQ ID NO: 60290 - DNA, 30 bp, Homo sapiens; identical to SEQ ID NO: 39763
  misc_feature 1..30: note = chr2:232283743-232283773
  misc_feature 1..30: note = hypo
  source 1..30: mol_type = genomic DNA

SEQ ID NO: 60291 - DNA, 40 bp, Homo sapiens; identical to SEQ ID NO: 39764
  misc_feature 1..40: note = chr2:232330287-232330327
  misc_feature 1..40: note = hypo
  source 1..40: mol_type = genomic DNA

SEQ ID NO: 60292 - DNA, 39 bp, Homo sapiens; identical to SEQ ID NO: 39765
  misc_feature 1..39: note = chr2:232485651-232485690
  misc_feature 1..39: note = hypo
  source 1..39: mol_type = genomic DNA

SEQ ID NO: 60293 - DNA, 16 bp, Homo sapiens
  misc_feature 1..16: note = chr2:232526123-232526139
  misc_feature 1..16: note = hypo
  source 1..16: mol_type = genomic DNA
tttctactggccgggc

SEQ ID NO: 60294 - DNA, 30 bp, Homo sapiens; identical to SEQ ID NO: 39767
  misc_feature 1..30: note = chr2:232541215-232541245
  misc_feature 1..30: note = hypo
  source 1..30: mol_type = genomic DNA

SEQ ID NO: 60295 - DNA, 27 bp, Homo sapiens
  misc_feature 1..27: note = chr2:232546676-232546703
  misc_feature 1..27: note = hypo
  source 1..27: mol_type = genomic DNA
attaaaagagctggccgggcgcggtga

SEQ ID NO: 60296 - DNA, 25 bp, Homo sapiens
  misc_feature 1..25: note = chr2:232570350-232570375
  misc_feature 1..25: note = hypo
  source 1..25: mol_type = genomic DNA
cctgcatgggaataacgtcagaaaa

SEQ ID NO: 60297 - DNA, 46 bp, Homo sapiens; identical to SEQ ID NO: 39770
  misc_feature 1..46: note = chr2:233322968-233323014
  misc_feature 1..46: note = hypo
  source 1..46: mol_type = genomic DNA

SEQ ID NO: 60298 - DNA, 30 bp, Homo sapiens; identical to SEQ ID NO: 39771
  misc_feature 1..30: note = chr2:233474440-233474470
  misc_feature 1..30: note = hypo
  source 1..30: mol_type = genomic DNA

SEQ ID NO: 60299 - DNA, 20 bp, Homo sapiens
  misc_feature 1..20: note = chr2:233750505-233750525
  misc_feature 1..20: note = hypo
  source 1..20: mol_type = genomic DNA
gtgacacatggggcccggca

SEQ ID NO: 60300 - DNA, 30 bp, Homo sapiens; identical to SEQ ID NO: 14487
  misc_feature 1..30: note = chr2:233960620-233960650
  misc_feature 1..30: note = hypo
  source 1..30: mol_type = genomic DNA

SEQ ID NO: 60301 - DNA, 55 bp, Homo sapiens; identical to SEQ ID NO: 39774
  misc_feature 1..55: note = chr2:233986907-233986962
  misc_feature 1..55: note = hypo
  source 1..55: mol_type = genomic DNA

SEQ ID NO: 60302 - DNA, 116 bp, Homo sapiens; identical to SEQ ID NO: 39775
  misc_feature 1..116: note = chr2:233991021-233991137
  misc_feature 1..116: note = hypo
  source 1..116: mol_type = genomic DNA

SEQ ID NO: 60303 - DNA, 30 bp, Homo sapiens; identical to SEQ ID NO: 39776
  misc_feature 1..30: note = chr2:233997245-233997275
  misc_feature 1..30: note = hypo
  source 1..30: mol_type = genomic DNA

SEQ ID NO: 60304 - DNA, 111 bp, Homo sapiens; identical to SEQ ID NO: 39777
  misc_feature 1..111: note = chr2:234079674-234079785
  misc_feature 1..111: note = hypo
  source 1..111: mol_type = genomic DNA

SEQ ID NO: 60305 - DNA, 176 bp, Homo sapiens; identical to SEQ ID NO: 39778
  misc_feature 1..176: note = chr2:234109964-234110140
  misc_feature 1..176: note = hypo
  source 1..176: mol_type = genomic DNA

SEQ ID NO: 60306 - DNA, 30 bp, Homo sapiens; identical to SEQ ID NO: 39779
  misc_feature 1..30: note = chr2:234330364-234330394
  misc_feature 1..30: note = hypo
  source 1..30: mol_type = genomic DNA

SEQ ID NO: 60307 - DNA, 43 bp, Homo sapiens; identical to SEQ ID NO: 39780
  misc_feature 1..43: note = chr2:234331271-234331314
  misc_feature 1..43: note = hypo
  source 1..43: mol_type = genomic DNA

SEQ ID NO: 60308 - DNA, 380 bp, Homo sapiens; identical to SEQ ID NO: 39781
  misc_feature 1..380: note = chr2:234369732-234370112
  misc_feature 1..380: note = hypo
  source 1..380: mol_type = genomic DNA

SEQ ID NO: 60309 - DNA, 30 bp, Homo sapiens; identical to SEQ ID NO: 39782
  misc_feature 1..30: note = chr2:235382081-235382111
  misc_feature 1..30: note = hypo
  source 1..30: mol_type = genomic DNA

SEQ ID NO: 60310 - DNA, 92 bp, Homo sapiens; identical to SEQ ID NO: 39783
  misc_feature 1..92: note = chr2:236452425-236452517
  misc_feature 1..92: note = hypo
  source 1..92: mol_type = genomic DNA

SEQ ID NO: 60311 - DNA, 24 bp, Homo sapiens
  misc_feature 1..24: note = chr2:236877238-236877262
  misc_feature 1..24: note = hypo
  source 1..24: mol_type = genomic DNA
agccgacggcctgtccggcactgc

SEQ ID NO: 60312 - DNA, 110 bp, Homo sapiens; identical to SEQ ID NO: 39785
  misc_feature 1..110: note = chr2:238475095-238475205
  misc_feature 1..110: note = hypo
  source 1..110: mol_type = genomic DNA

SEQ ID NO: 60313 - DNA, 235 bp, Homo sapiens
  misc_feature 1..235: note = chr2:239050963-239051198
  misc_feature 1..235: note = hypo
  source 1..235: mol_type = genomic DNA
cttcagagccttgcccgtggacggtcaccttgtattctaattcctggcagtgggagatctgggggttccatatggggggccagggtggatggctgtgggagagcctggggtcctgggagacctaggcagtgactgcttaccggccgttcctaagacagccagcatttcccactgagccgggacaccctcgtgccgcctgctggaggccacccagggagcaggggcagggagaagc

SEQ ID NO: 60314 - DNA, 95 bp, Homo sapiens
  misc_feature 1..95: note = chr2:239051228-239051323
  misc_feature 1..95: note = hypo
  source 1..95: mol_type = genomic DNA
atcggttctgaagatggttcaggaactccaggaatgcccctgaaaggcacatggtgcaaggagggagcagcttgtgcactcgggcacacgccatc

SEQ ID NO: 60315 - DNA, 30 bp, Homo sapiens; identical to SEQ ID NO: 39787
  misc_feature 1..30: note = chr2:239083135-239083165
  misc_feature 1..30: note = hypo
  source 1..30: mol_type = genomic DNA

SEQ ID NO: 60316 - DNA, 30 bp, Homo sapiens; identical to SEQ ID NO: 39788
  misc_feature 1..30: note = chr2:239134032-239134062
  misc_feature 1..30: note = hypo
  source 1..30: mol_type = genomic DNA

SEQ ID NO: 60317 - DNA, 42 bp, Homo sapiens; identical to SEQ ID NO: 39789
  misc_feature 1..42: note = chr2:239147417-239147459
  misc_feature 1..42: note = hypo
  source 1..42: mol_type = genomic DNA

SEQ ID NO: 60318 - DNA, 30 bp, Homo sapiens; identical to SEQ ID NO: 39790
  misc_feature 1..30: note = chr2:239183260-239183290
  misc_feature 1..30: note = hypo
  source 1..30: mol_type = genomic DNA

SEQ ID NO: 60319 - DNA, 184 bp, Homo sapiens; identical to SEQ ID NO: 39792
  misc_feature 1..184: note = chr2:239322426-239322610
  misc_feature 1..184: note = hypo
  source 1..184: mol_type = genomic DNA

SEQ ID NO: 60320 - DNA, 63 bp, Homo sapiens
  misc_feature 1..63: note = chr2:239957267-239957330
  misc_feature 1..63: note = hypo
  source 1..63: mol_type = genomic DNA
ctagcctagcagccccgctctcctgcgggctcccccgtgggccaagtctcctaaactgggcca

SEQ ID NO: 60321 - DNA, 66 bp, Homo sapiens
  misc_feature 1..66: note = chr2:239957448-239957514
  misc_feature 1..66: note = hypo
  source 1..66: mol_type = genomic DNA
cgtcctccctcctgctggaggggactggacaccgttaatgacagcgaaaatcgcctggagttgatg

SEQ ID NO: 60322 - DNA, 127 bp, Homo sapiens; identical to SEQ ID NO: 39794
  misc_feature 1..127: note = chr2:239997460-239997587
  misc_feature 1..127: note = hypo
  source 1..127: mol_type = genomic DNA

SEQ ID NO: 60323 - DNA, 57 bp, Homo sapiens; identical to SEQ ID NO: 39795
  misc_feature 1..57: note = chr2:240080496-240080553
  misc_feature 1..57: note = hypo
  source 1..57: mol_type = genomic DNA

SEQ ID NO: 60324 - DNA, 134 bp, Homo sapiens; identical to SEQ ID NO: 39796
  misc_feature 1..134: note = chr2:240103588-240103722
  misc_feature 1..134: note = hypo
  source 1..134: mol_type = genomic DNA

SEQ ID NO: 60325 - DNA, 121 bp, Homo sapiens; identical to SEQ ID NO: 39797
  misc_feature 1..121: note = chr2:240103944-240104065
  misc_feature 1..121: note = hypo
  source 1..121: mol_type = genomic DNA

SEQ ID NO: 60326 - DNA, 25 bp, Homo sapiens
  misc_feature 1..25: note = chr2:240168786-240168811
  misc_feature 1..25: note = hypo
  source 1..25: mol_type = genomic DNA
aggtgatgcagctatcggcaatggc

SEQ ID NO: 60327 - DNA, 58 bp, Homo sapiens; identical to SEQ ID NO: 23911
  misc_feature 1..58: note = chr2:240169051-240169109
  misc_feature 1..58: note = hypo
  source 1..58: mol_type = genomic DNA

SEQ ID NO: 60328 - DNA, 50 bp, Homo sapiens; identical to SEQ ID NO: 39799
  misc_feature 1..50: note = chr2:240213736-240213786
  misc_feature 1..50: note = hypo
  source 1..50: mol_type = genomic DNA

SEQ ID NO: 60329 - DNA, 58 bp, Homo sapiens; identical to SEQ ID NO: 39800
  misc_feature 1..58: note = chr2:240566166-240566224
  misc_feature 1..58: note = hypo
  source 1..58: mol_type = genomic DNA

SEQ ID NO: 60330 - DNA, 55 bp, Homo sapiens; identical to SEQ ID NO: 39801
  misc_feature 1..55: note = chr2:240582300-240582355
  misc_feature 1..55: note = hypo
  source 1..55: mol_type = genomic DNA

SEQ ID NO: 60331 - DNA, 44 bp, Homo sapiens
  misc_feature 1..44: note = chr2:240658183-240658227
  misc_feature 1..44: note = hypo
  source 1..44: mol_type = genomic DNA
ggcagtgatgtctgtcggtaccccaaggcctgtgtggaggcagc

SEQ ID NO: 60332 - DNA, 88 bp, Homo sapiens
  misc_feature 1..88: note = chr2:240658421-240658509
  misc_feature 1..88: note = hypo
  source 1..88: mol_type = genomic DNA
aggaagggctcacaccctgacaggtgcgatcagtcagggcagggaggcgggcagcaggactggccactggccccgataggtgctggtg

SEQ ID NO: 60333 - DNA, 42 bp, Homo sapiens; identical to SEQ ID NO: 39803
  misc_feature 1..42: note = chr2:240658874-240658916
  misc_feature 1..42: note = hypo
  source 1..42: mol_type = genomic DNA

SEQ ID NO: 60334 - DNA, 203 bp, Homo sapiens; identical to SEQ ID NO: 39804
  misc_feature 1..203: note = chr2:240809498-240809701
  misc_feature 1..203: note = hypo
  source 1..203: mol_type = genomic DNA

SEQ ID NO: 60335 - DNA, 13 bp, Homo sapiens
  misc_feature 1..13: note = chr2:241095772-241095785
  misc_feature 1..13: note = hypo
  source 1..13: mol_type = genomic DNA
attcatgaagagt

SEQ ID NO: 60336 - DNA, 163 bp, Homo sapiens; identical to SEQ ID NO: 39806
  misc_feature 1..163: note = chr2:241107135-241107298
  misc_feature 1..163: note = hypo
  source 1..163: mol_type = genomic DNA

SEQ ID NO: 60337 - DNA, 30 bp, Homo sapiens; identical to SEQ ID NO: 39807
  misc_feature 1..30: note = chr2:241262151-241262181
  misc_feature 1..30: note = hypo
  source 1..30: mol_type = genomic DNA

SEQ ID NO: 60338 - DNA, 115 bp, Homo sapiens; identical to SEQ ID NO: 39808
  misc_feature 1..115: note = chr2:241350181-241350296
  misc_feature 1..115: note = hypo
  source 1..115: mol_type = genomic DNA

SEQ ID NO: 60339 - DNA, 30 bp, Homo sapiens; identical to SEQ ID NO: 39809
  misc_feature 1..30: note = chr2:241398532-241398562
  misc_feature 1..30: note = hypo
  source 1..30: mol_type = genomic DNA

SEQ ID NO: 60340 - DNA, 56 bp, Homo sapiens; identical to SEQ ID NO: 39811
  misc_feature 1..56: note = chr2:241543418-241543474
  misc_feature 1..56: note = hypo
  source 1..56: mol_type = genomic DNA

SEQ ID NO: 60341 - DNA, 21 bp, Homo sapiens
  misc_feature 1..21: note = chr2:241544980-241545001
  misc_feature 1..21: note = hypo
  source 1..21: mol_type = genomic DNA
ttctggggtgagtgtcgagat

SEQ ID NO: 60342 - DNA, 30 bp, Homo sapiens; identical to SEQ ID NO: 39813
  misc_feature 1..30: note = chr2:241662384-241662414
  misc_feature 1..30: note = hypo
  source 1..30: mol_type = genomic DNA

SEQ ID NO: 60343 - DNA, 44 bp, Homo sapiens; identical to SEQ ID NO: 39814
  misc_feature 1..44: note = chr2:241721534-241721578
  misc_feature 1..44: note = hypo
  source 1..44: mol_type = genomic DNA

SEQ ID NO: 60344 - DNA, 58 bp, Homo sapiens; identical to SEQ ID NO: 14500
  misc_feature 1..58: note = chr2:241722184-241722242
  misc_feature 1..58: note = hypo
  source 1..58: mol_type = genomic DNA

SEQ ID NO: 60345 - DNA, 30 bp, Homo sapiens; identical to SEQ ID NO: 39816
  misc_feature 1..30: note = chr2:241861894-241861924
  misc_feature 1..30: note = hypo
  source 1..30: mol_type = genomic DNA

SEQ ID NO: 60346 - DNA, 77 bp, Homo sapiens; identical to SEQ ID NO: 39817
  misc_feature 1..77: note = chr2:241862358-241862435
  misc_feature 1..77: note = hypo
  source 1..77: mol_type = genomic DNA

SEQ ID NO: 60347 - DNA, 437 bp, Homo sapiens
  misc_feature 1..437: note = chr2:241864757-241865194
  misc_feature 1..437: note = hypo
  source 1..437: mol_type = genomic DNA
gtctgactccctctccgcgtcaccccgccccgcgaaaggcacctccctcccagcccctggcaccttgtctcaggcattgagggacgggccaaggttgcagagccagagccaggagagctcggggcaggggcagatatcgcagggaggcaggagggcactgggctggcacctgggagagccaccttgatgctggcactcagtttaggggtcctttgtggggcccatggcaggtgggggcagagcagcggctgtgcacctgagcccaggtcagttaggcccagagggtttggggttccattcaagccccttgacttggggactctgagcgcctctcttaggagaggcttcctacccccaccatgccctgtgggttctctgtccaggagcaccggcctctgtcaggtgaacgcgctcctgcgggagcagctggaacatat

SEQ ID NO: 60348 - DNA, 82 bp, Homo sapiens
  misc_feature 1..82: note = chr2:241865346-241865428
  misc_feature 1..82: note = hypo
  source 1..82: mol_type = genomic DNA
ctatggctgggtagcaggcagggacatggtgagggtgcactggctcagtggctgtccctcttggggacgaggccacagcttc

SEQ ID NO: 60349 - DNA, 254 bp, Homo sapiens; identical to SEQ ID NO: 39819
  misc_feature 1..254: note = chr2:242004922-242005176
  misc_feature 1..254: note = hypo
  source 1..254: mol_type = genomic DNA

SEQ ID NO: 60350 - DNA, 78 bp, Homo sapiens; identical to SEQ ID NO: 39820
  misc_feature 1..78: note = chr2:242006616-242006694
  misc_feature 1..78: note = hypo
  source 1..78: mol_type = genomic DNA

SEQ ID NO: 60351 - DNA, 17 bp, Homo sapiens
  misc_feature 1..17: note = chr2:242009374-242009391
  misc_feature 1..17: note = hypo
  source 1..17: mol_type = genomic DNA
tgccacctctgcccacg

SEQ ID NO: 60352 - DNA, 237 bp, Homo sapiens
  misc_feature 1..237: note = chr2:242009421-242009658
  misc_feature 1..237: note = hypo
  source 1..237: mol_type = genomic DNA
tgctggaggcttatgtcatcaatgtgaccaccagccagagcaccaagagccgctatgtccccaacgggaagctggcgtcctacacggtgcgcgacctgctgccgggacggcggtaccagctctctgtgatagcagtgcagagcacggagctcgggccgcagcacagcgagcccgcccacctctacatcatcacctgtgagtgccgtgggccctgcgcgtgggcggggccagtgtttg

SEQ ID NO: 60353 - DNA, 30 bp, Homo sapiens; identical to SEQ ID NO: 39822
  misc_feature 1..30: note = chr2:242011200-242011230
  misc_feature 1..30: note = hypo
  source 1..30: mol_type = genomic DNA

SEQ ID NO: 60354 - DNA, 23 bp, Homo sapiens
  misc_feature 1..23: note = chr2:242021761-242021784
  misc_feature 1..23: note = hypo
  source 1..23: mol_type = genomic DNA
aggcgtctgtcaccacgtgtaag

SEQ ID NO: 60355 - DNA, 30 bp, Homo sapiens; identical to SEQ ID NO: 39824
  misc_feature 1..30: note = chr2:242128768-242128798
  misc_feature 1..30: note = hypo
  source 1..30: mol_type = genomic DNA

SEQ ID NO: 60356 - DNA, 30 bp, Homo sapiens; identical to SEQ ID NO: 39825
  misc_feature 1..30: note = chr2:242131916-242131946
  misc_feature 1..30: note = hypo
  source 1..30: mol_type = genomic DNA

SEQ ID NO: 60357 - DNA, 30 bp, Homo sapiens; identical to SEQ ID NO: 39826
  misc_feature 1..30: note = chr2:242138318-242138348
  misc_feature 1..30: note = hypo
  source 1..30: mol_type = genomic DNA

SEQ ID NO: 60358 - DNA, 74 bp, Homo sapiens; identical to SEQ ID NO: 39827
  misc_feature 1..74: note = chr2:242156554-242156628
  misc_feature 1..74: note = hypo
  source 1..74: mol_type = genomic DNA

SEQ ID NO: 60359 - DNA, 106 bp, Homo sapiens; identical to SEQ ID NO: 39828
  misc_feature 1..106: note = chr2:242436356-242436462
  misc_feature 1..106: note = hypo
  source 1..106: mol_type = genomic DNA

SEQ ID NO: 60360 - DNA, 120 bp, Homo sapiens; identical to SEQ ID NO: 39830
  misc_feature 1..120: note = chr2:242636866-242636986
  misc_feature 1..120: note = hypo
  source 1..120: mol_type = genomic DNA

SEQ ID NO: 60361 - DNA, 86 bp, Homo sapiens; identical to SEQ ID NO: 39831
  misc_feature 1..86: note = chr2:242637046-242637132
  misc_feature 1..86: note = hypo
  source 1..86: mol_type = genomic DNA

SEQ ID NO: 60362 - DNA, 71 bp, Homo sapiens; identical to SEQ ID NO: 39832
  misc_feature 1..71: note = chr2:242672951-242673022
  misc_feature 1..71: note = hypo
  source 1..71: mol_type = genomic DNA

SEQ ID NO: 60363 - DNA, 105 bp, Homo sapiens
  misc_feature 1..105: note = chr2:242756039-242756144
  misc_feature 1..105: note = hypo
  source 1..105: mol_type = genomic DNA
gcccaggtccctggacgtcctggtcagcggaacttcctcctctgggcagtggggtgccctgcacgtgctggggacagcagccctggcggagcaccggtccatgaa

SEQ ID NO: 60364 - DNA, 329 bp, Homo sapiens
  misc_feature 1..329: note = chr2:242756297-242756626
  misc_feature 1..329: note = hypo
  source 1..329: mol_type = genomic DNA
cagcgcccgggacctcaccgaggaggccatcggtggtgccgtgcagggtaggcgggcagggtgccggtctgggtccctttgattggccacggtccacatggaagggagattccagcgggaaattgccattctgccccacccctgtctccagccacaagggaaccaaccatccctttccccaggactgttctgcgcctcccgtcccaggcaaatccctctccccaggaccgtcctgagcctcccgtcccagacaaatccctctccccaggactgttctgcgcctcccgtcccaggcaaatccctctccccaggaccgtcctgcacctccc

SEQ ID NO: 60365 - DNA, 135 bp, Homo sapiens; identical to SEQ ID NO: 39834
  misc_feature 1..135: note = chr2:242757497-242757632
  misc_feature 1..135: note = hypo
  source 1..135: mol_type = genomic DNA

SEQ ID NO: 60366 - DNA, 30 bp, Homo sapiens; identical to SEQ ID NO: 39835
  misc_feature 1..30: note = chr2:242763132-242763162
  misc_feature 1..30: note = hypo
  source 1..30: mol_type = genomic DNA

SEQ ID NO: 60367 - DNA, 98 bp, Homo sapiens; identical to SEQ ID NO: 39836
  misc_feature 1..98: note = chr2:242784279-242784377
  misc_feature 1..98: note = hypo
  source 1..98: mol_type = genomic DNA

SEQ ID NO: 60368 - DNA, 39 bp, Homo sapiens; identical to SEQ ID NO: 39837
  misc_feature 1..39: note = chr2:242791597-242791636
  misc_feature 1..39: note = hypo
  source 1..39: mol_type = genomic DNA

SEQ ID NO: 60369 - DNA, 165 bp, Homo sapiens; identical to SEQ ID NO: 39838
  misc_feature 1..165: note = chr2:242794852-242795017
  misc_feature 1..165: note = hypo
  source 1..165: mol_type = genomic DNA

SEQ ID NO: 60370 - DNA, 30 bp, Homo sapiens; identical to SEQ ID NO: 39839
  misc_feature 1..30: note = chr2:242814897-242814927
  misc_feature 1..30: note = hypo
  source 1..30: mol_type = genomic DNA

SEQ ID NO: 60371 - DNA, 104 bp, Homo sapiens
  misc_feature 1..104: note = chr2:242832880-242832984
  misc_feature 1..104: note = hypo
  source 1..104: mol_type = genomic DNA
tggatacgtcccagccgaaatgttcaccgtgaatccggcaacctgtggagctgatttccatttctaaggaatgaggggggatggggaagaaccccccaggacag

SEQ ID NO: 60372 - DNA, 63 bp, Homo sapiens
  misc_feature 1..63: note = chr2:242833159-242833222
  misc_feature 1..63: note = hypo
  source 1..63: mol_type = genomic DNA
cttggcaaggcaggtggcggcaccaacaggcccgggggggacctttcccggacacctggcctc

SEQ ID NO: 60373 - DNA, 80 bp, Homo sapiens
  misc_feature 1..80: note = chr2:242833478-242833558
  misc_feature 1..80: note = hypo
  source 1..80: mol_type = genomic DNA
ttggttctgtggcctcggtttctgtcttcctgatggcacctctgtgacaggagctcagaccccggcatcagaccggcctc

SEQ ID NO: 60374 - DNA, 26 bp, Homo sapiens
  misc_feature 1..26: note = chr2:242836469-242836495
  misc_feature 1..26: note = hypo
  source 1..26: mol_type = genomic DNA
tcagcccatcccacgcggagcctggg

SEQ ID NO: 60375 - DNA, 76 bp, Homo sapiens; identical to SEQ ID NO: 39844
  misc_feature 1..76: note = chr2:242891535-242891611
  misc_feature 1..76: note = hypo
  source 1..76: mol_type = genomic DNA

SEQ ID NO: 60376 - DNA, 30 bp, Homo sapiens; identical to SEQ ID NO: 39845
  misc_feature 1..30: note = chr2:242892372-242892402
  misc_feature 1..30: note = hypo
  source 1..30: mol_type = genomic DNA

SEQ ID NO: 60377 - DNA, 21 bp, Homo sapiens
  misc_feature 1..21: note = chr2:242925641-242925662
  misc_feature 1..21: note = hypo
  source 1..21: mol_type = genomic DNA
aggagccgggagggccctggc

SEQ ID NO: 60378 - DNA, 114 bp, Homo sapiens; identical to SEQ ID NO: 39847
  misc_feature 1..114: note = chr2:242985077-242985191
  misc_feature 1..114: note = hypo
  source 1..114: mol_type = genomic DNA

SEQ ID NO: 60379 - DNA, 30 bp, Homo sapiens; identical to SEQ ID NO: 39848
  misc_feature 1..30: note = chr3:1741068-1741098
  misc_feature 1..30: note = hypo
  source 1..30: mol_type = genomic DNA

SEQ ID NO: 60380 - DNA, 191 bp, Homo sapiens; identical to SEQ ID NO: 39849
  misc_feature 1..191: note = chr3:2909417-2909608
  misc_feature 1..191: note = hypo
  source 1..191: mol_type = genomic DNA

SEQ ID NO: 60381 - DNA, 38 bp, Homo sapiens; identical to SEQ ID NO: 39850
  misc_feature 1..38: note = chr3:3167655-3167693
  misc_feature 1..38: note = hypo
  source 1..38: mol_type = genomic DNA

SEQ ID NO: 60382 - DNA, 30 bp, Homo sapiens; identical to SEQ ID NO: 39851
  misc_feature 1..30: note = chr3:3167988-3168018
  misc_feature 1..30: note = hypo
  source 1..30: mol_type = genomic DNA

SEQ ID NO: 60383 - DNA, 30 bp, Homo sapiens; identical to SEQ ID NO: 39852
  misc_feature 1..30: note = chr3:4755974-4756004
  misc_feature 1..30: note = hypo
  source 1..30: mol_type = genomic DNA

SEQ ID NO: 60384 - DNA, 87 bp, Homo sapiens; identical to SEQ ID NO: 39853
  misc_feature 1..87: note = chr3:5831053-5831140
  misc_feature 1..87: note = hypo
  source 1..87: mol_type = genomic DNA

SEQ ID NO: 60385 - DNA, 30 bp, Homo sapiens; identical to SEQ ID NO: 39854
  misc_feature 1..30: note = chr3:5970953-5970983
  misc_feature 1..30: note = hypo
  source 1..30: mol_type = genomic DNA

SEQ ID NO: 60386 - DNA, 30 bp, Homo sapiens; identical to SEQ ID NO: 39855
  misc_feature 1..30: note = chr3:9006374-9006404
  misc_feature 1..30: note = hypo
  source 1..30: mol_type = genomic DNA

SEQ ID NO: 60387 - DNA, 17 bp, Homo sapiens
  misc_feature 1..17: note = chr3:9688167-9688184
  misc_feature 1..17: note = hypo
  source 1..17: mol_type = genomic DNA
gccggattggtcatttc

SEQ ID NO: 60388 - DNA, 30 bp, Homo sapiens; identical to SEQ ID NO: 39857
  misc_feature 1..30: note = chr3:10127378-10127408
  misc_feature 1..30: note = hypo
  source 1..30: mol_type = genomic DNA

SEQ ID NO: 60389 - DNA, 35 bp, Homo sapiens; identical to SEQ ID NO: 39859
  misc_feature 1..35: note = chr3:10452258-10452293
  misc_feature 1..35: note = hypo
  source 1..35: mol_type = genomic DNA

SEQ ID NO: 60390 - DNA, 66 bp, Homo sapiens; identical to SEQ ID NO: 39860
  misc_feature 1..66: note = chr3:11581322-11581388
  misc_feature 1..66: note = hypo
  source 1..66: mol_type = genomic DNA

SEQ ID NO: 60391 - DNA, 30 bp, Homo sapiens; identical to SEQ ID NO: 39861
  misc_feature 1..30: note = chr3:12039968-12039998
  misc_feature 1..30: note = hypo
  source 1..30: mol_type = genomic DNA

SEQ ID NO: 60392 - DNA, 30 bp, Homo sapiens; identical to SEQ ID NO: 14520
  misc_feature 1..30: note = chr3:12586227-12586257
  misc_feature 1..30: note = hypo
  source 1..30: mol_type = genomic DNA

SEQ ID NO: 60393 - DNA, 68 bp, Homo sapiens; identical to SEQ ID NO: 39863
  misc_feature 1..68: note = chr3:12867218-12867286
  misc_feature 1..68: note = hypo
  source 1..68: mol_type = genomic DNA

SEQ ID NO: 60394 - DNA, 30 bp, Homo sapiens; identical to SEQ ID NO: 39864
  misc_feature 1..30: note = chr3:13083168-13083198
  misc_feature 1..30: note = hypo
  source 1..30: mol_type = genomic DNA

SEQ ID NO: 60395 - DNA, 100 bp, Homo sapiens; identical to SEQ ID NO: 39865
  misc_feature 1..100: note = chr3:13083990-13084090
  misc_feature 1..100: note = hypo
  source 1..100: mol_type = genomic DNA

SEQ ID NO: 60396 - DNA, 30 bp, Homo sapiens; identical to SEQ ID NO: 39866
  misc_feature 1..30: note = chr3:13096379-13096409
  misc_feature 1..30: note = hypo
  source 1..30: mol_type = genomic DNA

SEQ ID NO: 60397 - DNA, 30 bp, Homo sapiens; identical to SEQ ID NO: 39867
  misc_feature 1..30: note = chr3:13367390-13367420
  misc_feature 1..30: note = hypo
  source 1..30: mol_type = genomic DNA

SEQ ID NO: 60398 - DNA, 42 bp, Homo sapiens; identical to SEQ ID NO: 39868
  misc_feature 1..42: note = chr3:13373208-13373250
  misc_feature 1..42: note = hypo
  source 1..42: mol_type = genomic DNA

SEQ ID NO: 60399 - DNA, 30 bp, Homo sapiens; identical to SEQ ID NO: 39869
  misc_feature 1..30: note = chr3:13442799-13442829
  misc_feature 1..30: note = hypo
  source 1..30: mol_type = genomic DNA

SEQ ID NO: 60400 - DNA, 188 bp, Homo sapiens; identical to SEQ ID NO: 39870
  misc_feature 1..188: note = chr3:13612034-13612222
  misc_feature 1..188: note = hypo
  source 1..188: mol_type = genomic DNA

SEQ ID NO: 60401 - DNA, 40 bp, Homo sapiens; identical to SEQ ID NO: 23934
  misc_feature 1..40: note = chr3:13679132-13679172
  misc_feature 1..40: note = hypo
  source 1..40: mol_type = genomic DNA

SEQ ID NO: 60402 - DNA, 30 bp, Homo sapiens; identical to SEQ ID NO: 14522
  misc_feature 1..30: note = chr3:13680779-13680809
  misc_feature 1..30: note = hypo
  source 1..30: mol_type = genomic DNA

SEQ ID NO: 60403 - DNA, 78 bp, Homo sapiens; identical to SEQ ID NO: 39873
  misc_feature 1..78: note = chr3:13860693-13860771
  misc_feature 1..78: note = hypo
  source 1..78: mol_type = genomic DNA

SEQ ID NO: 60404 - DNA, 30 bp, Homo sapiens; identical to SEQ ID NO: 39874
  misc_feature 1..30: note = chr3:14197900-14197930
  misc_feature 1..30: note = hypo
  source 1..30: mol_type = genomic DNA

SEQ ID NO: 60405 - DNA, 161 bp, Homo sapiens; identical to SEQ ID NO: 39875
  misc_feature 1..161: note = chr3:14443179-14443340
  misc_feature 1..161: note = hypo
  source 1..161: mol_type = genomic DNA

SEQ ID NO: 60406 - DNA, 30 bp, Homo sapiens; identical to SEQ ID NO: 39876
  misc_feature 1..30: note = chr3:14676121-14676151
  misc_feature 1..30: note = hypo
  source 1..30: mol_type = genomic DNA

SEQ ID NO: 60407 - DNA, 30 bp, Homo sapiens; identical to SEQ ID NO: 39877
  misc_feature 1..30: note = chr3:14964046-14964076
  misc_feature 1..30: note = hypo
  source 1..30: mol_type = genomic DNA

SEQ ID NO: 60408 - DNA, 30 bp, Homo sapiens; identical to SEQ ID NO: 39878
  misc_feature 1..30: note = chr3:15105526-15105556
  misc_feature 1..30: note = hypo
  source 1..30: mol_type = genomic DNA

SEQ ID NO: 60409 - DNA, 30 bp, Homo sapiens; identical to SEQ ID NO: 39879
  misc_feature 1..30: note = chr3:16952388-16952418
  misc_feature 1..30: note = hypo
  source 1..30: mol_type = genomic DNA

SEQ ID NO: 60410 - skipped

SEQ ID NO: 60411 - DNA, 66 bp, Homo sapiens; identical to SEQ ID NO: 14524
  misc_feature 1..66: note = chr3:17499802-17499868
  misc_feature 1..66: note = hypo
  source 1..66: mol_type = genomic DNA

SEQ ID NO: 60412 - DNA, 36 bp, Homo sapiens; identical to SEQ ID NO: 39882
  misc_feature 1..36: note = chr3:18299798-18299834
  misc_feature 1..36: note = hypo
  source 1..36: mol_type = genomic DNA

SEQ ID NO: 60413 - DNA, 92 bp, Homo sapiens; identical to SEQ ID NO: 39883
  misc_feature 1..92: note = chr3:19791264-19791356
  misc_feature 1..92: note = hypo
  source 1..92: mol_type = genomic DNA

SEQ ID NO: 60414 - DNA, 31 bp, Homo sapiens; identical to SEQ ID NO: 39884
  misc_feature 1..31: note = chr3:20013239-20013270
  misc_feature 1..31: note = hypo
  source 1..31: mol_type = genomic DNA

SEQ ID NO: 60415 - DNA, 20 bp, Homo sapiens
  misc_feature 1..20: note = chr3:20139710-20139730
  misc_feature 1..20: note = hypo
  source 1..20: mol_type = genomic DNA
gacaacgtcccaaattaaaa

SEQ ID NO: 60416 - DNA, 81 bp, Homo sapiens; identical to SEQ ID NO: 39886
  misc_feature 1..81: note = chr3:21447519-21447600
  misc_feature 1..81: note = hypo
  source 1..81: mol_type = genomic DNA

SEQ ID NO: 60417 - DNA, 91 bp, Homo sapiens; identical to SEQ ID NO: 39887
  misc_feature 1..91: note = chr3:22370592-22370683
  misc_feature 1..91: note = hypo
  source 1..91: mol_type = genomic DNA

SEQ ID NO: 60418 - DNA, 158 bp, Homo sapiens; identical to SEQ ID NO: 39888
  misc_feature 1..158: note = chr3:32151266-32151424
  misc_feature 1..158: note = hypo
  source 1..158: mol_type = genomic DNA

SEQ ID NO: 60419 - DNA, 197 bp, Homo sapiens; identical to SEQ ID NO: 39889
  misc_feature 1..197: note = chr3:33841159-33841356
  misc_feature 1..197: note = hypo
  source 1..197: mol_type = genomic DNA

SEQ ID NO: 60420 - DNA, 76 bp, Homo sapiens; identical to SEQ ID NO: 39890
  misc_feature 1..76: note = chr3:33841656-33841732
  misc_feature 1..76: note = hypo
  source 1..76: mol_type = genomic DNA

SEQ ID NO: 60421 - DNA, 17 bp, Homo sapiens
  misc_feature 1..17: note = chr3:34246982-34246999
  misc_feature 1..17: note = hypo
  source 1..17: mol_type = genomic DNA
gggcgcggtgactcacg

SEQ ID NO: 60422 - DNA, 180 bp, Homo sapiens; identical to SEQ ID NO: 39892
  misc_feature 1..180: note = chr3:34690946-34691126
  misc_feature 1..180: note = hypo
  source 1..180: mol_type = genomic DNA

SEQ ID NO: 60423 - DNA, 17 bp, Homo sapiens
  misc_feature 1..17: note = chr3:37296942-37296959
  misc_feature 1..17: note = hypo
  source 1..17: mol_type = genomic DNA
cacgcctgacctttata

SEQ ID NO: 60424 - DNA, 37 bp, Homo sapiens; identical to SEQ ID NO: 39894
  misc_feature 1..37: note = chr3:37876204-37876241
  misc_feature 1..37: note = hypo
  source 1..37: mol_type = genomic DNA

SEQ ID NO: 60425 - DNA, 32 bp, Homo sapiens; identical to SEQ ID NO: 39895
  misc_feature 1..32: note = chr3:38032423-38032455
  misc_feature 1..32: note = hypo
  source 1..32: mol_type = genomic DNA

SEQ ID NO: 60426 - DNA, 30 bp, Homo sapiens; identical to SEQ ID NO: 39896
  misc_feature 1..30: note = chr3:38041112-38041142
  misc_feature 1..30: note = hypo
  source 1..30: mol_type = genomic DNA

SEQ ID NO: 60427 - DNA, 147 bp, Homo sapiens; identical to SEQ ID NO: 39897
  misc_feature 1..147: note = chr3:38627339-38627486
  misc_feature 1..147: note = hypo
  source 1..147: mol_type = genomic DNA

SEQ ID NO: 60428 - DNA, 30 bp, Homo sapiens; identical to SEQ ID NO: 39898
  misc_feature 1..30: note = chr3:38950258-38950288
  misc_feature 1..30: note = hypo
  source 1..30: mol_type = genomic DNA

SEQ ID NO: 60429 - DNA, 37 bp, Homo sapiens; identical to SEQ ID NO: 14527
  misc_feature 1..37: note = chr3:40501058-40501095
  misc_feature 1..37: note = hypo
  source 1..37: mol_type = genomic DNA

SEQ ID NO: 60430 - DNA, 52 bp, Homo sapiens; identical to SEQ ID NO: 39900
  misc_feature 1..52: note = chr3:41289147-41289199
  misc_feature 1..52: note = hypo
  source 1..52: mol_type = genomic DNA

SEQ ID NO: 60431 - DNA, 149 bp, Homo sapiens; identical to SEQ ID NO: 39901
  misc_feature 1..149: note = chr3:42200630-42200779
  misc_feature 1..149: note = hypo
  source 1..149: mol_type = genomic DNA

SEQ ID NO: 60432 - DNA, 11 bp, Homo sapiens
  misc_feature 1..11: note = chr3:42222719-42222730
  misc_feature 1..11: note = hypo
  source 1..11: mol_type = genomic DNA
ttgcattgaaa

SEQ ID NO: 60433 - DNA, 94 bp, Homo sapiens
  misc_feature 1..94: note = chr3:42640761-42640855
  misc_feature 1..94: note = hypo
  source 1..94: mol_type = genomic DNA
atgtgtattttatagtttaaaaaaaaaacttataaaatagtgtggtactcagacacagatcattggaacaaaaatccagaaacagacccacaca

SEQ ID NO: 60434 - DNA, 30 bp, Homo sapiens; identical to SEQ ID NO: 39904
  misc_feature 1..30: note = chr3:42851003-42851033
  misc_feature 1..30: note = hypo
  source 1..30: mol_type = genomic DNA

SEQ ID NO: 60435 - DNA, 21 bp, Homo sapiens
  misc_feature 1..21: note = chr3:43664372-43664393
  misc_feature 1..21: note = hypo
  source 1..21: mol_type = genomic DNA
tttgagatagagcctcgcaat

SEQ ID NO: 60436 - DNA, 30 bp, Homo sapiens; identical to SEQ ID NO: 39906
  misc_feature 1..30: note = chr3:44938829-44938859
  misc_feature 1..30: note = hypo
  source 1..30: mol_type = genomic DNA

SEQ ID NO: 60437 - DNA, 34 bp, Homo sapiens; identical to SEQ ID NO: 39907
  misc_feature 1..34: note = chr3:44999995-45000029
  misc_feature 1..34: note = hypo
  source 1..34: mol_type = genomic DNA

SEQ ID NO: 60438 - DNA, 30 bp, Homo sapiens; identical to SEQ ID NO: 39908
  misc_feature 1..30: note = chr3:45821641-45821671
  misc_feature 1..30: note = hypo
  source 1..30: mol_type = genomic DNA

SEQ ID NO: 60439 - DNA, 30 bp, Homo sapiens; identical to SEQ ID NO: 14530
  misc_feature 1..30: note = chr3:45885052-45885082
  misc_feature 1..30: note = hypo
  source 1..30: mol_type = genomic DNA

SEQ ID NO: 60440 - DNA, 37 bp, Homo sapiens; identical to SEQ ID NO: 39910
  misc_feature 1..37: note = chr3:46584785-46584822
  misc_feature 1..37: note = hypo
  source 1..37: mol_type = genomic DNA

SEQ ID NO: 60441 - DNA, 46 bp, Homo sapiens; identical to SEQ ID NO: 39911
  misc_feature 1..46: note = chr3:46949012-46949058
  misc_feature 1..46: note = hypo
  source 1..46: mol_type = genomic DNA

SEQ ID NO: 60442 - DNA, 22 bp, Homo sapiens
  misc_feature 1..22: note = chr3:47555871-47555893
  misc_feature 1..22: note = hypo
  source 1..22: mol_type = genomic DNA
gccgacacggaattatatcttg

SEQ ID NO: 60443 - DNA, 459 bp, Homo sapiens; identical to SEQ ID NO: 39915
  misc_feature 1..459: note = chr3:48636676-48637135
  misc_feature 1..459: note = hypo
  source 1..459: mol_type = genomic DNA

SEQ ID NO: 60444 - DNA, 30 bp, Homo sapiens; identical to SEQ ID NO: 39916
  misc_feature 1..30: note = chr3:48883988-48884018
  misc_feature 1..30: note = hypo
  source 1..30: mol_type = genomic DNA

SEQ ID NO: 60445 - DNA, 30 bp, Homo sapiens; identical to SEQ ID NO: 14534
  misc_feature 1..30: note = chr3:48948476-48948506
  misc_feature 1..30: note = hypo
  source 1..30: mol_type = genomic DNA

SEQ ID NO: 60446 - DNA, 90 bp, Homo sapiens; identical to SEQ ID NO: 39918
  misc_feature 1..90: note = chr3:49034204-49034294
  misc_feature 1..90: note = hypo
  source 1..90: mol_type = genomic DNA

SEQ ID NO: 60447 - DNA, 21 bp, Homo sapiens
  misc_feature 1..21: note = chr3:49056918-49056939
  misc_feature 1..21: note = hypo
  source 1..21: mol_type = genomic DNA
tttttttttttgagacggagt

SEQ ID NO: 60448 - DNA, 48 bp, Homo sapiens; identical to SEQ ID NO: 39920
  misc_feature 1..48: note = chr3:49057282-49057330
  misc_feature 1..48: note = hypo
  source 1..48: mol_type = genomic DNA

SEQ ID NO: 60449 - DNA, 30 bp, Homo sapiens; identical to SEQ ID NO: 39921
  misc_feature 1..30: note = chr3:49140985-49141015
  misc_feature 1..30: note = hypo
  source 1..30: mol_type = genomic DNA

SEQ ID NO: 60450 - DNA, 25 bp, Homo sapiens
  misc_feature 1..25: note = chr3:49189546-49189571
  misc_feature 1..25: note = hypo
  source 1..25: mol_type = genomic DNA
ggccgggcacagtggcgcacgcctg

SEQ ID NO: 60451 - DNA, 51 bp, Homo sapiens; identical to SEQ ID NO: 39923
  misc_feature 1..51: note = chr3:49755535-49755586
  misc_feature 1..51: note = hypo
  source 1..51: mol_type = genomic DNA

SEQ ID NO: 60452 - DNA, 229 bp, Homo sapiens
  misc_feature 1..229: note = chr3:49939702-49939931
  misc_feature 1..229: note = hypo
  source 1..229: mol_type = genomic DNA
cgcctgcccccccaccgcgcccccagatcccctcagtgatggaagggaagcagcctgtgttcagccatgtgcatgcagctcacaagtaagggccccttctttcagcttaccgggttggggcaaaaactgggcgactggaagaagtcgaggcctcgccggaggcctggatggactggggattcacaacagcgctccacaccctcatcaattagtgtgtccagcaggtcaa

SEQ ID NO: 60453 - DNA, 196 bp, Homo sapiens
  misc_feature 1..196: note = chr3:49940398-49940594
  misc_feature 1..196: note = hypo
  source 1..196: mol_type = genomic DNA
gagcgtgggctgaagctggcagccacggctgcgtccagtgaggatgccacgtagaaataggaggcctggccttgctcaaccacagttacacgggtgcccaatgggctggccacacagtcggggcagtcatcgggccggttatggtgggctgagaagaggcaggctggcgctgccagatgcacggctgtcccttggg

SEQ ID NO: 60454 - DNA, 43 bp, Homo sapiens; identical to SEQ ID NO: 39926
  misc_feature 1..43: note = chr3:50425370-50425413
  misc_feature 1..43: note = hypo
  source 1..43: mol_type = genomic DNA

SEQ ID NO: 60455 - DNA, 30 bp, Homo sapiens; identical to SEQ ID NO: 39927
  misc_feature 1..30: note = chr3:50426624-50426654
  misc_feature 1..30: note = hypo
  source 1..30: mol_type = genomic DNA

SEQ ID NO: 60456 - DNA, 192 bp, Homo sapiens; identical to SEQ ID NO: 39928
  misc_feature 1..192: note = chr3:50433950-50434142
  misc_feature 1..192: note = hypo
  source 1..192: mol_type = genomic DNA

SEQ ID NO: 60457 - DNA, 14 bp, Homo sapiens
  misc_feature 1..14: note = chr3:50575602-50575616
  misc_feature 1..14: note = hypo
  source 1..14: mol_type = genomic DNA
ggggctcaagcaat

SEQ ID NO: 60458 - DNA, 20 bp, Homo sapiens
  misc_feature 1..20: note = chr3:52352335-52352355
  misc_feature 1..20: note = hypo
  source 1..20: mol_type = genomic DNA
acaggcgtgagccactgcgc

SEQ ID NO: 60459 - DNA, 128 bp, Homo sapiens; identical to SEQ ID NO: 39931
  misc_feature 1..128: note = chr3:52415830-52415958
  misc_feature 1..128: note = hypo
  source 1..128: mol_type = genomic DNA

SEQ ID NO: 60460 - DNA, 30 bp, Homo sapiens; identical to SEQ ID NO: 39932
  misc_feature 1..30: note = chr3:52429714-52429744
  misc_feature 1..30: note = hypo
  source 1..30: mol_type = genomic DNA

SEQ ID NO: 60461 - DNA, 30 bp, Homo sapiens; identical to SEQ ID NO: 39933
  misc_feature 1..30: note = chr3:52537738-52537768
  misc_feature 1..30: note = hypo
  source 1..30: mol_type = genomic DNA

SEQ ID NO: 60462 - DNA, 240 bp, Homo sapiens; identical to SEQ ID NO: 14543
  misc_feature 1..240: note = chr3:52553207-52553447
  misc_feature 1..240: note = hypo
  source 1..240: mol_type = genomic DNA

SEQ ID NO: 60463 - DNA, 30 bp, Homo sapiens; identical to SEQ ID NO: 39936
  misc_feature 1..30: note = chr3:52599737-52599767
  misc_feature 1..30: note = hypo
  source 1..30: mol_type = genomic DNA

SEQ ID NO: 60464 - DNA, 135 bp, Homo sapiens; identical to SEQ ID NO: 39937
  misc_feature 1..135: note = chr3:52900714-52900849
  misc_feature 1..135: note = hypo
  source 1..135: mol_type = genomic DNA

SEQ ID NO: 60465 - DNA, 31 bp, Homo sapiens; identical to SEQ ID NO: 39938
  misc_feature 1..31: note = chr3:53032137-53032168
  misc_feature 1..31: note = hypo
  source 1..31: mol_type = genomic DNA

SEQ ID NO: 60466 - DNA, 111 bp, Homo sapiens
  misc_feature 1..111: note = chr3:53033524-53033635
  misc_feature 1..111: note = hypo
  source 1..111: mol_type = genomic DNA
aagccttggccagtgctcttttggtgtatcccttcagcttccagaggggaagccacaccctgatgctatgttcaaacgctccagaagacaggagttcgtgtccttgcccct

SEQ ID NO: 60467 - DNA, 30 bp, Homo sapiens; identical to SEQ ID NO: 39940
  misc_feature 1..30: note = chr3:53217535-53217565
  misc_feature 1..30: note = hypo
  source 1..30: mol_type = genomic DNA

SEQ ID NO: 60468 - DNA, 38 bp, Homo sapiens; identical to SEQ ID NO: 39941
  misc_feature 1..38: note = chr3:56718243-56718281
  misc_feature 1..38: note = hypo
  source 1..38: mol_type = genomic DNA

SEQ ID NO: 60469 - DNA, 28 bp, Homo sapiens
  misc_feature 1..28: note = chr3:57740997-57741025
  misc_feature 1..28: note = hypo
  source 1..28: mol_type = genomic DNA
gagccaccgcgcccggcctaattgctac

SEQ ID NO: 60470 - DNA, 187 bp, Homo sapiens; identical to SEQ ID NO: 39943
  misc_feature 1..187: note = chr3:58456517-58456704
  misc_feature 1..187: note = hypo
  source 1..187: mol_type = genomic DNA

SEQ ID NO: 60471 - DNA, 30 bp, Homo sapiens; identical to SEQ ID NO: 39944
  misc_feature 1..30: note = chr3:67047776-67047806
  misc_feature 1..30: note = hypo
  source 1..30: mol_type = genomic DNA

SEQ ID NO: 60472 - DNA, 31 bp, Homo sapiens; identical to SEQ ID NO: 39945
  misc_feature 1..31: note = chr3:68834960-68834991
  misc_feature 1..31: note = hypo
  source 1..31: mol_type = genomic DNA

SEQ ID NO: 60473 - DNA, 81 bp, Homo sapiens; identical to SEQ ID NO: 39946
  misc_feature 1..81: note = chr3:69741003-69741084
  misc_feature 1..81: note = hypo
  source 1..81: mol_type = genomic DNA

SEQ ID NO: 60474 - DNA, 21 bp, Homo sapiens
  misc_feature 1..21: note = chr3:70083716-70083737
  misc_feature 1..21: note = hypo
  source 1..21: mol_type = genomic DNA
aggcgtggtggctcacgctta

SEQ ID NO: 60475 - DNA, 30 bp, Homo sapiens; identical to SEQ ID NO: 39948
  misc_feature 1..30: note = chr3:72305951-72305981
  misc_feature 1..30: note = hypo
  source 1..30: mol_type = genomic DNA

SEQ ID NO: 60476 - DNA, 30 bp, Homo sapiens; identical to SEQ ID NO: 39949
  misc_feature 1..30: note = chr3:72773579-72773609
  misc_feature 1..30: note = hypo
  source 1..30: mol_type = genomic DNA

SEQ ID NO: 60477 - DNA, 28 bp, Homo sapiens
  misc_feature 1..28: note = chr3:73045129-73045157
  misc_feature 1..28: note = hypo
  source 1..28: mol_type = genomic DNA
tttttgaaacagtctcgctttgtcgcct

SEQ ID NO: 60478 - DNA, 22 bp, Homo sapiens
  misc_feature 1..22: note = chr3:73045583-73045605
  misc_feature 1..22: note = hypo
  source 1..22: mol_type = genomic DNA
ttctgaacgtgaagtgtataca

SEQ ID NO: 60479 - DNA, 165 bp, Homo sapiens; identical to SEQ ID NO: 39952
  misc_feature 1..165: note = chr3:73498616-73498781
  misc_feature 1..165: note = hypo
  source 1..165: mol_type = genomic DNA

SEQ ID NO: 60480 - DNA, 32 bp, Homo sapiens; identical to SEQ ID NO: 39953
  misc_feature 1..32: note = chr3:86960228-86960260
  misc_feature 1..32: note = hypo
  source 1..32: mol_type = genomic DNA

SEQ ID NO: 60481 - DNA, 28 bp, Homo sapiens
  misc_feature 1..28: note = chr3:87226527-87226555
  misc_feature 1..28: note = hypo
  source 1..28: mol_type = genomic DNA
tcagtgtgtttcacggaatagttttgga

SEQ ID NO: 60482 - DNA, 163 bp, Homo sapiens; identical to SEQ ID NO: 14551
  misc_feature 1..163: note = chr3:87782694-87782857
  misc_feature 1..163: note = hypo
  source 1..163: mol_type = genomic DNA

SEQ ID NO: 60483 - DNA, 28 bp, Homo sapiens
  misc_feature 1..28: note = chr3:87881755-87881783
  misc_feature 1..28: note = hypo
  source 1..28: mol_type = genomic DNA
gcgtgagccaccgcgcccagccagaata

SEQ ID NO: 60484 - DNA, 18 bp, Homo sapiens
  misc_feature 1..18: note = chr3:93697929-93697947
  misc_feature 1..18: note = hypo
  source 1..18: mol_type = genomic DNA
tatttatttttgagacgg

SEQ ID NO: 60485 - DNA, 30 bp, Homo sapiens; identical to SEQ ID NO: 39959
  misc_feature 1..30: note = chr3:93801136-93801166
  misc_feature 1..30: note = hypo
  source 1..30: mol_type = genomic DNA

SEQ ID NO: 60486 - DNA, 52 bp, Homo sapiens; identical to SEQ ID NO: 39960
  misc_feature 1..52: note = chr3:97200376-97200428
  misc_feature 1..52: note = hypo
  source 1..52: mol_type = genomic DNA

SEQ ID NO: 60487 - DNA, 31 bp, Homo sapiens; identical to SEQ ID NO: 39961
  misc_feature 1..31: note = chr3:98029454-98029485
  misc_feature 1..31: note = hypo
  source 1..31: mol_type = genomic DNA

SEQ ID NO: 60488 - DNA, 34 bp, Homo sapiens; identical to SEQ ID NO: 23958
  misc_feature 1..34: note = chr3:101231070-101231104
  misc_feature 1..34: note = hypo
  source 1..34: mol_type = genomic DNA

SEQ ID NO: 60489 - DNA, 36 bp, Homo sapiens
  misc_feature 1..36: note = chr3:101397204-101397240
  misc_feature 1..36: note = hypo
  source 1..36: mol_type = genomic DNA
tttcccccatggggtcgggcagtgagagcagaagac

SEQ ID NO: 60490 - DNA, 30 bp, Homo sapiens; identical to SEQ ID NO: 39964
  misc_feature 1..30: note = chr3:107632034-107632064
  misc_feature 1..30: note = hypo
  source 1..30: mol_type = genomic DNA

SEQ ID NO: 60491 - DNA, 30 bp, Homo sapiens; identical to SEQ ID NO: 39965
  misc_feature 1..30: note = chr3:107771985-107772015
  misc_feature 1..30: note = hypo
  source 1..30: mol_type = genomic DNA

SEQ ID NO: 60492 - DNA, 30 bp, Homo sapiens; identical to SEQ ID NO: 14555
  misc_feature 1..30: note = chr3:107833994-107834024
  misc_feature 1..30: note = hypo
  source 1..30: mol_type = genomic DNA

SEQ ID NO: 60493 - DNA, 34 bp, Homo sapiens; identical to SEQ ID NO: 39967
  misc_feature 1..34: note = chr3:111988003-111988037
  misc_feature 1..34: note = hypo
  source 1..34: mol_type = genomic DNA

SEQ ID NO: 60494 - DNA, 18 bp, Homo sapiens
  misc_feature 1..18: note = chr3:113557458-113557476
  misc_feature 1..18: note = hypo
  source 1..18: mol_type = genomic DNA
tttcgcacattggggcag

SEQ ID NO: 60495 - DNA, 30 bp, Homo sapiens; identical to SEQ ID NO: 39969
  misc_feature 1..30: note = chr3:113958215-113958245
  misc_feature 1..30: note = hypo
  source 1..30: mol_type = genomic DNA

SEQ ID NO: 60496 - DNA, 36 bp, Homo sapiens; identical to SEQ ID NO: 39970
  misc_feature 1..36: note = chr3:115502421-115502457
  misc_feature 1..36: note = hypo
  source 1..36: mol_type = genomic DNA

SEQ ID NO: 60497 - DNA, 71 bp, Homo sapiens; identical to SEQ ID NO: 39971
  misc_feature 1..71: note = chr3:115752446-115752517
  misc_feature 1..71: note = hypo
  source 1..71: mol_type = genomic DNA

SEQ ID NO: 60498 - DNA, 148 bp, Homo sapiens; identical to SEQ ID NO: 39972
  misc_feature 1..148: note = chr3:116990241-116990389
  misc_feature 1..148: note = hypo
  source 1..148: mol_type = genomic DNA

SEQ ID NO: 60499 - DNA, 37 bp, Homo sapiens; identical to SEQ ID NO: 14558
  misc_feature 1..37: note = chr3:118976384-118976421
  misc_feature 1..37: note = hypo
  source 1..37: mol_type = genomic DNA

SEQ ID NO: 60500 - DNA, 30 bp, Homo sapiens; identical to SEQ ID NO: 39974
  misc_feature 1..30: note = chr3:119055204-119055234
  misc_feature 1..30: note = hypo
  source 1..30: mol_type = genomic DNA

SEQ ID NO: 60501 - DNA, 98 bp, Homo sapiens; identical to SEQ ID NO: 39975
  misc_feature 1..98: note = chr3:119815404-119815502
  misc_feature 1..98: note = hypo
  source 1..98: mol_type = genomic DNA

SEQ ID NO: 60502 - DNA, 180 bp, Homo sapiens; identical to SEQ ID NO: 39976
  misc_feature 1..180: note = chr3:119815742-119815922
  misc_feature 1..180: note = hypo
  source 1..180: mol_type = genomic DNA

SEQ ID NO: 60503 - DNA, 18 bp, Homo sapiens
  misc_feature 1..18: note = chr3:119817451-119817469
  misc_feature 1..18: note = hypo
  source 1..18: mol_type = genomic DNA
aaacgctaggattactgg

SEQ ID NO: 60504 - DNA, 25 bp, Homo sapiens
  misc_feature 1..25: note = chr3:121265940-121265965
  misc_feature 1..25: note = hypo
  source 1..25: mol_type = genomic DNA
aaataaaagagatctcgccggccgt

SEQ ID NO: 60505 - DNA, 30 bp, Homo sapiens; identical to SEQ ID NO: 39979
  misc_feature 1..30: note = chr3:121438641-121438671
  misc_feature 1..30: note = hypo
  source 1..30: mol_type = genomic DNA

SEQ ID NO: 60506 - DNA, 82 bp, Homo sapiens; identical to SEQ ID NO: 39980
  misc_feature 1..82: note = chr3:121563924-121564006
  misc_feature 1..82: note = hypo
  source 1..82: mol_type = genomic DNA

SEQ ID NO: 60507 - DNA, 34 bp, Homo sapiens; identical to SEQ ID NO: 39981
  misc_feature 1..34: note = chr3:121638037-121638071
  misc_feature 1..34: note = hypo
  source 1..34: mol_type = genomic DNA

SEQ ID NO: 60508 - DNA, 30 bp, Homo sapiens; identical to SEQ ID NO: 39982
  misc_feature 1..30: note = chr3:121980857-121980887
  misc_feature 1..30: note = hypo
  source 1..30: mol_type = genomic DNA

SEQ ID NO: 60509 - DNA, 30 bp, Homo sapiens; identical to SEQ ID NO: 39983
  misc_feature 1..30: note = chr3:122100925-122100955
  misc_feature 1..30: note = hypo
  source 1..30: mol_type = genomic DNA

SEQ ID NO: 60510 - DNA, 38 bp, Homo sapiens; identical to SEQ ID NO: 39984
  misc_feature 1..38: note = chr3:122231278-122231316
  misc_feature 1..38: note = hypo
  source 1..38: mol_type = genomic DNA

SEQ ID NO: 60511 - DNA, 25 bp, Homo sapiens
  misc_feature 1..25: note = chr3:122234217-122234242
  misc_feature 1..25: note = hypo
  source 1..25: mol_type = genomic DNA
gcttgataacgtatgcgtagtatca

SEQ ID NO: 60512 - DNA, 91 bp, Homo sapiens; identical to SEQ ID NO: 39986
  misc_feature 1..91: note = chr3:122234549-122234640
  misc_feature 1..91: note = hypo
  source 1..91: mol_type = genomic DNA

SEQ ID NO: 60513 - DNA, 29 bp, Homo sapiens
  misc_feature 1..29: note = chr3:122573648-122573677
  misc_feature 1..29: note = hypo
  source 1..29: mol_type = genomic DNA
gactcaaaggctgggcgcggtggctcacg

SEQ ID NO: 60514 - DNA, 13 bp, Homo sapiens
  misc_feature 1..13: note = chr3:122702275-122702288
  misc_feature 1..13: note = hypo
  source 1..13: mol_type = genomic DNA
gcacaataaatca

SEQ ID NO: 60515 - DNA, 102 bp, Homo sapiens; identical to SEQ ID NO: 14566
  misc_feature 1..102: note = chr3:125456444-125456546
  misc_feature 1..102: note = hypo
  source 1..102: mol_type = genomic DNA

SEQ ID NO: 60516 - DNA, 39 bp, Homo sapiens; identical to SEQ ID NO: 14567
  misc_feature 1..39: note = chr3:125785793-125785832
  misc_feature 1..39: note = hypo
  source 1..39: mol_type = genomic DNA

SEQ ID NO: 60517 - DNA, 98 bp, Homo sapiens; identical to SEQ ID NO: 39991
  misc_feature 1..98: note = chr3:126134590-126134688
  misc_feature 1..98: note = hypo
  source 1..98: mol_type = genomic DNA

SEQ ID NO: 60518 - DNA, 35 bp, Homo sapiens; identical to SEQ ID NO: 39992
  misc_feature 1..35: note = chr3:126138969-126139004
  misc_feature 1..35: note = hypo
  source 1..35: mol_type = genomic DNA

SEQ ID NO: 60519 - DNA, 167 bp, Homo sapiens; identical to SEQ ID NO: 39993
  misc_feature 1..167: note = chr3:126195886-126196053
  misc_feature 1..167: note = hypo
  source 1..167: mol_type = genomic DNA

SEQ ID NO: 60520 - DNA, 77 bp, Homo sapiens; identical to SEQ ID NO: 39994
  misc_feature 1..77: note = chr3:127394832-127394909
  misc_feature 1..77: note = hypo
  source 1..77: mol_type = genomic DNA

SEQ ID NO: 60521 - DNA, 48 bp, Homo sapiens; identical to SEQ ID NO: 39995
  misc_feature 1..48: note = chr3:127395914-127395962
  misc_feature 1..48: note = hypo
  source 1..48: mol_type = genomic DNA

SEQ ID NO: 60522 - DNA, 68 bp, Homo sapiens; identical to SEQ ID NO: 39996
  misc_feature 1..68: note = chr3:127534964-127535032
  misc_feature 1..68: note = hypo
  source 1..68: mol_type = genomic DNA

SEQ ID NO: 60523 - DNA, 90 bp, Homo sapiens; identical to SEQ ID NO: 39997
  misc_feature 1..90: note = chr3:127536741-127536831
  misc_feature 1..90: note = hypo
  source 1..90: mol_type = genomic DNA

SEQ ID NO: 60524 - DNA, 52 bp, Homo sapiens; identical to SEQ ID NO: 39998
  misc_feature 1..52: note = chr3:127637657-127637709
  misc_feature 1..52: note = hypo
  source 1..52: mol_type = genomic DNA

SEQ ID NO: 60525 - DNA, 30 bp, Homo sapiens; identical to SEQ ID NO: 39999
  misc_feature 1..30: note = chr3:128346689-128346719
  misc_feature 1..30: note = hypo
  source 1..30: mol_type = genomic DNA

SEQ ID NO: 60526 - DNA, 80 bp, Homo sapiens; identical to SEQ ID NO: 40000
  misc_feature 1..80: note = chr3:128599546-128599626
  misc_feature 1..80: note = hypo
  source 1..80: mol_type = genomic DNA

SEQ ID NO: 60527 - DNA, 34 bp, Homo sapiens; identical to SEQ ID NO: 40001
  misc_feature 1..34: note = chr3:128611894-128611928
  misc_feature 1..34: note = hypo
  source 1..34: mol_type = genomic DNA

SEQ ID NO: 60528 - DNA, 30 bp, Homo sapiens; identical to SEQ ID NO: 40002
  misc_feature 1..30: note = chr3:128765921-128765951
  misc_feature 1..30: note = hypo
  source 1..30: mol_type = genomic DNA

SEQ ID NO: 60529 - DNA, 41 bp, Homo sapiens; identical to SEQ ID NO: 40003
  misc_feature 1..41: note = chr3:128790177-128790218
  misc_feature 1..41: note = hypo
  source 1..41: mol_type = genomic DNA

SEQ ID NO: 60530 - DNA, 72 bp, Homo sapiens; identical to SEQ ID NO: 40004
  misc_feature 1..72: note = chr3:130127080-130127152
  misc_feature 1..72: note = hypo
  source 1..72: mol_type = genomic DNA

SEQ ID NO: 60531 - DNA, 217 bp, Homo sapiens; identical to SEQ ID NO: 40005
  misc_feature 1..217: note = chr3:130474409-130474626
  misc_feature 1..217: note = hypo
  source 1..217: mol_type = genomic DNA

SEQ ID NO: 60532 - DNA, 30 bp, Homo sapiens; identical to SEQ ID NO: 40007
  misc_feature 1..30: note = chr3:133101687-133101717
  misc_feature 1..30: note = hypo
  source 1..30: mol_type = genomic DNA

SEQ ID NO: 60533 - DNA, 220 bp, Homo sapiens; identical to SEQ ID NO: 40008
  misc_feature 1..220: note = chr3:134320427-134320647
  misc_feature 1..220: note = hypo
  source 1..220: mol_type = genomic DNA

SEQ ID NO: 60534 - DNA, 30 bp, Homo sapiens; identical to SEQ ID NO: 40009
  misc_feature 1..30: note = chr3:134624264-134624294
  misc_feature 1..30: note = hypo
  source 1..30: mol_type = genomic DNA

SEQ ID NO: 60535 - DNA, 109 bp, Homo sapiens
  misc_feature 1..109: note = chr3:136582951-136583060
  misc_feature 1..109: note = hypo
  source 1..109: mol_type = genomic DNA
aataaaatgtgtatttatttttctaggcattatcctttgtccaggtttctgcagtgctttcaggtccatctaaataaaatttgaaacctacgtgtaatgttggccgggc

SEQ ID NO: 60536 - DNA, 17 bp, Homo sapiens
  misc_feature 1..17: note = chr3:137561189-137561206
  misc_feature 1..17: note = hypo
  source 1..17: mol_type = genomic DNA
agtctagctattggccg

SEQ ID NO: 60537 - DNA, 84 bp, Homo sapiens; identical to SEQ ID NO: 40012
  misc_feature 1..84: note = chr3:137717830-137717914
  misc_feature 1..84: note = hypo
  source 1..84: mol_type = genomic DNA

SEQ ID NO: 60538 - DNA, 22 bp, Homo sapiens
  misc_feature 1..22: note = chr3:138058968-138058990
  misc_feature 1..22: note = hypo
  source 1..22: mol_type = genomic DNA
gccaccgcgcccagccagcatc

SEQ ID NO: 60539 - DNA, 53 bp, Homo sapiens
  misc_feature 1..53: note = chr3:141174296-141174349
  misc_feature 1..53: note = hypo
  source 1..53: mol_type = genomic DNA
ggccgccattttcgtcgtctcttatcacgatgggaatcagcgttctctgctgc

SEQ ID NO: 60540 - DNA, 33 bp, Homo sapiens; identical to SEQ ID NO: 23976
  misc_feature 1..33: note = chr3:141482073-141482106
  misc_feature 1..33: note = hypo
  source 1..33: mol_type = genomic DNA

SEQ ID NO: 60541 - DNA, 30 bp, Homo sapiens; identical to SEQ ID NO: 40016
  misc_feature 1..30: note = chr3:142337360-142337390
  misc_feature 1..30: note = hypo
  source 1..30: mol_type = genomic DNA

SEQ ID NO: 60542 - DNA, 17 bp, Homo sapiens
  misc_feature 1..17: note = chr3:142802592-142802609
  misc_feature 1..17: note = hypo
  source 1..17: mol_type = genomic DNA
agcgtgagccaccgtgc

SEQ ID NO: 60543 - DNA, 24 bp, Homo sapiens
  misc_feature 1..24: note = chr3:142853160-142853184
  misc_feature 1..24: note = hypo
  source 1..24: mol_type = genomic DNA
gggctcaagcgatcctcccatcta

SEQ ID NO: 60544 - DNA, 30 bp, Homo sapiens; identical to SEQ ID NO: 40020
  misc_feature 1..30: note = chr3:142896285-142896315
  misc_feature 1..30: note = hypo
  source 1..30: mol_type = genomic DNA

SEQ ID NO: 60545 - DNA, 35 bp, Homo sapiens; identical to SEQ ID NO: 5001
  misc_feature 1..35: note = chr3:142913215-142913250
  misc_feature 1..35: note = hypo
  source 1..35: mol_type = genomic DNA

SEQ ID NO: 60546 - DNA, 30 bp, Homo sapiens; identical to SEQ ID NO: 40022
  misc_feature 1..30: note = chr3:142973621-142973651
  misc_feature 1..30: note = hypo
  source 1..30: mol_type = genomic DNA

SEQ ID NO: 60547 - DNA, 30 bp, Homo sapiens; identical to SEQ ID NO: 40023
  misc_feature 1..30: note = chr3:142973851-142973881
  misc_feature 1..30: note = hypo
  source 1..30: mol_type = genomic DNA

SEQ ID NO: 60548 - DNA, 21 bp, Homo sapiens
  misc_feature 1..21: note = chr3:142977041-142977062
  misc_feature 1..21: note = hypo
  source 1..21: mol_type = genomic DNA
acagagcgatactccatctca

SEQ ID NO: 60549 - DNA, 45 bp, Homo sapiens; identical to SEQ ID NO: 14579
  misc_feature 1..45: note = chr3:143092973-143093018
  misc_feature 1..45: note = hypo
  source 1..45: mol_type = genomic DNA

SEQ ID NO: 60550 - DNA, 34 bp, Homo sapiens; identical to SEQ ID NO: 40026
  misc_feature 1..34: note = chr3:143151477-143151511
  misc_feature 1..34: note = hypo
  source 1..34: mol_type = genomic DNA

SEQ ID NO: 60551 - DNA, 38 bp, Homo sapiens; identical to SEQ ID NO: 40027
  misc_feature 1..38: note = chr3:143210840-143210878
  misc_feature 1..38: note = hypo
  source 1..38: mol_type = genomic DNA

SEQ ID NO: 60552 - DNA, 26 bp, Homo sapiens
  misc_feature 1..26: note = chr3:146187920-146187946
  misc_feature 1..26: note = hypo
  source 1..26: mol_type = genomic DNA
gtgaaaatgatgaggcgtgtagaatg

SEQ ID NO: 60553 - DNA, 37 bp, Homo sapiens; identical to SEQ ID NO: 40029
  misc_feature 1..37: note = chr3:146188305-146188342
  misc_feature 1..37: note = hypo
  source 1..37: mol_type = genomic DNA

SEQ ID NO: 60554 - DNA, 43 bp, Homo sapiens; identical to SEQ ID NO: 40030
  misc_feature 1..43: note = chr3:148472167-148472210
  misc_feature 1..43: note = hypo
  source 1..43: mol_type = genomic DNA

SEQ ID NO: 60555 - DNA, 20 bp, Homo sapiens
  misc_feature 1..20: note = chr3:148556015-148556035
  misc_feature 1..20: note = hypo
  source 1..20: mol_type = genomic DNA
cagagcgagactctgtctca

SEQ ID NO: 60556 - DNA, 41 bp, Homo sapiens; identical to SEQ ID NO: 40032
  misc_feature 1..41: note = chr3:148705411-148705452
  misc_feature 1..41: note = hypo
  source 1..41: mol_type = genomic DNA

SEQ ID NO: 60557 - DNA, 27 bp, Homo sapiens
  misc_feature 1..27: note = chr3:148802983-148803010
  misc_feature 1..27: note = hypo
  source 1..27: mol_type = genomic DNA
actacaattatgggccggatgcggtgg

SEQ ID NO: 60558 - DNA, 30 bp, Homo sapiens; identical to SEQ ID NO: 40035
  misc_feature 1..30: note = chr3:149956581-149956611
  misc_feature 1..30: note = hypo
  source 1..30: mol_type = genomic DNA

SEQ ID NO: 60559 - DNA, 161 bp, Homo sapiens; identical to SEQ ID NO: 14584
  misc_feature 1..161: note = chr3:150135175-150135336
  misc_feature 1..161: note = hypo
  source 1..161: mol_type = genomic DNA

SEQ ID NO: 60560 - DNA, 88 bp, Homo sapiens; identical to SEQ ID NO: 40037
  misc_feature 1..88: note = chr3:150237908-150237996
  misc_feature 1..88: note = hypo
  source 1..88: mol_type = genomic DNA

SEQ ID NO: 60561 - DNA, 90 bp, Homo sapiens; identical to SEQ ID NO: 40038
  misc_feature 1..90: note = chr3:152321039-152321129
  misc_feature 1..90: note = hypo
  source 1..90: mol_type = genomic DNA

SEQ ID NO: 60562 - DNA, 30 bp, Homo sapiens; identical to SEQ ID NO: 40039
  misc_feature 1..30: note = chr3:152332728-152332758
  misc_feature 1..30: note = hypo
  source 1..30: mol_type = genomic DNA

SEQ ID NO: 60563 - DNA, 27 bp, Homo sapiens
  misc_feature 1..27: note = chr3:152829598-152829625
  misc_feature 1..27: note = hypo
  source 1..27: mol_type = genomic DNA
ggcgtgagcgaccgcacccagctgata

SEQ ID NO: 60564 - DNA, 30 bp, Homo sapiens; identical to SEQ ID NO: 40041
  misc_feature 1..30: note = chr3:152877598-152877628
  misc_feature 1..30: note = hypo
  source 1..30: mol_type = genomic DNA

SEQ ID NO: 60565 - DNA, 25 bp, Homo sapiens
  misc_feature 1..25: note = chr3:152979662-152979687
  misc_feature 1..25: note = hypo
  source 1..25: mol_type = genomic DNA
ccaccacgtccggccaactcatatt

SEQ ID NO: 60566 - DNA, 30 bp, Homo sapiens; identical to SEQ ID NO: 40043
  misc_feature 1..30: note = chr3:152999015-152999045
  misc_feature 1..30: note = hypo
  source 1..30: mol_type = genomic DNA

SEQ ID NO: 60567 - DNA, 18 bp, Homo sapiens
  misc_feature 1..18: note = chr3:153018756-153018774
  misc_feature 1..18: note = hypo
  source 1..18: mol_type = genomic DNA
aaaaatatgattggccgg

SEQ ID NO: 60568 - DNA, 23 bp, Homo sapiens
  misc_feature 1..23: note = chr3:154623592-154623615
  misc_feature 1..23: note = hypo
  source 1..23: mol_type = genomic DNA
cgagactccgtctcaaaaaaaat

SEQ ID NO: 60569 - DNA, 101 bp, Homo sapiens; identical to SEQ ID NO: 40046
  misc_feature 1..101: note = chr3:157303466-157303567
  misc_feature 1..101: note = hypo
  source 1..101: mol_type = genomic DNA

SEQ ID NO: 60570 - DNA, 30 bp, Homo sapiens; identical to SEQ ID NO: 40047
  misc_feature 1..30: note = chr3:166984418-166984448
  misc_feature 1..30: note = hypo
  source 1..30: mol_type = genomic DNA

SEQ ID NO: 60571 - DNA, 30 bp, Homo sapiens; identical to SEQ ID NO: 40048
  misc_feature 1..30: note = chr3:168490451-168490481
  misc_feature 1..30: note = hypo
  source 1..30: mol_type = genomic DNA

SEQ ID NO: 60572 - DNA, 64 bp, Homo sapiens; identical to SEQ ID NO: 40049
  misc_feature 1..64: note = chr3:169485397-169485461
  misc_feature 1..64: note = hypo
  source 1..64: mol_type = genomic DNA

SEQ ID NO: 60573 - DNA, 47 bp, Homo sapiens
  misc_feature 1..47: note = chr3:169541102-169541149
  misc_feature 1..47: note = hypo
  source 1..47: mol_type = genomic DNA
gctgccaggctccagggtctacattcttttttttttttttttctctt

SEQ ID NO: 60574 - DNA, 42 bp, Homo sapiens; identical to SEQ ID NO: 40052
  misc_feature 1..42: note = chr3:169980664-169980706
  misc_feature 1..42: note = hypo
  source 1..42: mol_type = genomic DNA

SEQ ID NO: 60575 - DNA, 145 bp, Homo sapiens; identical to SEQ ID NO: 40054
  misc_feature 1..145: note = chr3:172033174-172033319
  misc_feature 1..145: note = hypo
  source 1..145: mol_type = genomic DNA

SEQ ID NO: 60576 - DNA, 58 bp, Homo sapiens; identical to SEQ ID NO: 14590
  misc_feature 1..58: note = chr3:172384961-172385019
  misc_feature 1..58: note = hypo
  source 1..58: mol_type = genomic DNA

SEQ ID NO: 60577 - DNA, 31 bp, Homo sapiens; identical to SEQ ID NO: 40059
  misc_feature 1..31: note = chr3:172470196-172470227
  misc_feature 1..31: note = hypo
  source 1..31: mol_type = genomic DNA

SEQ ID NO: 60578 - DNA, 162 bp, Homo sapiens; identical to SEQ ID NO: 40060
  misc_feature 1..162: note = chr3:172727266-172727428
  misc_feature 1..162: note = hypo
  source 1..162: mol_type = genomic DNA

SEQ ID NO: 60579 - DNA, 92 bp, Homo sapiens; identical to SEQ ID NO: 40061
  misc_feature 1..92: note = chr3:172858998-172859090
  misc_feature 1..92: note = hypo
  source 1..92: mol_type = genomic DNA

SEQ ID NO: 60580 - DNA, 24 bp, Homo sapiens
  misc_feature 1..24: note = chr3:176545097-176545121
  misc_feature 1..24: note = hypo
  source 1..24: mol_type = genomic DNA
aaaagagaatttttccgacgggtg

SEQ ID NO: 60581 - DNA, 41 bp, Homo sapiens; identical to SEQ ID NO: 40063
  misc_feature 1..41: note = chr3:176872455-176872496
  misc_feature 1..41: note = hypo
  source 1..41: mol_type = genomic DNA

SEQ ID NO: 60582 - DNA, 77 bp, Homo sapiens; identical to SEQ ID NO: 40064
  misc_feature 1..77: note = chr3:176897068-176897145
  misc_feature 1..77: note = hypo
  source 1..77: mol_type = genomic DNA

SEQ ID NO: 60583 - DNA, 28 bp, Homo sapiens
  misc_feature 1..28: note = chr3:178577720-178577748
  misc_feature 1..28: note = hypo
  source 1..28: mol_type = genomic DNA
aaacaaaataaagttcggaaggggagcc

SEQ ID NO: 60584 - DNA, 30 bp, Homo sapiens; identical to SEQ ID NO: 40067
  misc_feature 1..30: note = chr3:179136841-179136871
  misc_feature 1..30: note = hypo
  source 1..30: mol_type = genomic DNA

SEQ ID NO: 60585 - DNA, 23 bp, Homo sapiens
  misc_feature 1..23: note = chr3:179171196-179171219
  misc_feature 1..23: note = hypo
  source 1..23: mol_type = genomic DNA
accgatcccggccccatattctt

SEQ ID NO: 60586 - DNA, 30 bp, Homo sapiens; identical to SEQ ID NO: 40070
  misc_feature 1..30: note = chr3:180042862-180042892
  misc_feature 1..30: note = hypo
  source 1..30: mol_type = genomic DNA

SEQ ID NO: 60587 - DNA, 323 bp, Homo sapiens; identical to SEQ ID NO: 40071
  misc_feature 1..323: note = chr3:182314974-182315297
  misc_feature 1..323: note = hypo
  source 1..323: mol_type = genomic DNA

SEQ ID NO: 60588 - DNA, 21 bp, Homo sapiens
  misc_feature 1..21: note = chr3:182704506-182704527
  misc_feature 1..21: note = hypo
  source 1..21: mol_type = genomic DNA
agcaaatgggctgggcgcggt

SEQ ID NO: 60589 - DNA, 30 bp, Homo sapiens; identical to SEQ ID NO: 40073
  misc_feature 1..30: note = chr3:182800477-182800507
  misc_feature 1..30: note = hypo
  source 1..30: mol_type = genomic DNA

SEQ ID NO: 60590 - DNA, 19 bp, Homo sapiens
  misc_feature 1..19: note = chr3:182812783-182812802
  misc_feature 1..19: note = hypo
  source 1..19: mol_type = genomic DNA
tgccctggccaggcacggt

SEQ ID NO: 60591 - DNA, 52 bp, Homo sapiens; identical to SEQ ID NO: 40077
  misc_feature 1..52: note = chr3:182987877-182987929
  misc_feature 1..52: note = hypo
  source 1..52: mol_type = genomic DNA

SEQ ID NO: 60592 - DNA, 30 bp, Homo sapiens; identical to SEQ ID NO: 40078
  misc_feature 1..30: note = chr3:183035309-183035339
  misc_feature 1..30: note = hypo
  source 1..30: mol_type = genomic DNA

SEQ ID NO: 60593 - DNA, 29 bp, Homo sapiens
  misc_feature 1..29: note = chr3:183183673-183183702
  misc_feature 1..29: note = hypo
  source 1..29: mol_type = genomic DNA
gtgagccactgccccgggccatgaaaaaa

SEQ ID NO: 60594 - DNA, 30 bp, Homo sapiens; identical to SEQ ID NO: 40080
  misc_feature 1..30: note = chr3:183603067-183603097
  misc_feature 1..30: note = hypo
  source 1..30: mol_type = genomic DNA

SEQ ID NO: 60595 - DNA, 172 bp, Homo sapiens; identical to SEQ ID NO: 40081
  misc_feature 1..172: note = chr3:183622013-183622185
  misc_feature 1..172: note = hypo
  source 1..172: mol_type = genomic DNA

SEQ ID NO: 60596 - DNA, 30 bp, Homo sapiens; identical to SEQ ID NO: 14600
  misc_feature 1..30: note = chr3:183648152-183648182
  misc_feature 1..30: note = hypo
  source 1..30: mol_type = genomic DNA

SEQ ID NO: 60597 - DNA, 222 bp, Homo sapiens; identical to SEQ ID NO: 40083
  misc_feature 1..222: note = chr3:183684023-183684245
  misc_feature 1..222: note = hypo
  source 1..222: mol_type = genomic DNA

SEQ ID NO: 60598 - DNA, 34 bp, Homo sapiens; identical to SEQ ID NO: 40084
  misc_feature 1..34: note = chr3:183713864-183713898
  misc_feature 1..34: note = hypo
  source 1..34: mol_type = genomic DNA

SEQ ID NO: 60599 - DNA, 16 bp, Homo sapiens
  misc_feature 1..16: note = chr3:183965935-183965951
  misc_feature 1..16: note = hypo
  source 1..16: mol_type = genomic DNA
ccggcagaaatgcatc

SEQ ID NO: 60600 - DNA, 26 bp, Homo sapiens
  misc_feature 1..26: note = chr3:184016195-184016221
  misc_feature 1..26: note = hypo
  source 1..26: mol_type = genomic DNA
atgaggttaataggccgggcgcggtg

SEQ ID NO: 60601 - DNA, 51 bp, Homo sapiens
  misc_feature 1..51: note = chr3:184018136-184018187
  misc_feature 1..51: note = hypo
  source 1..51: mol_type = genomic DNA
tccatgacttcagtgcccaagcctctcaaatttctgcgtccacactatggc

SEQ ID NO: 60602 - DNA, 71 bp, Homo sapiens; identical to SEQ ID NO: 40090
  misc_feature 1..71: note = chr3:184200659-184200730
  misc_feature 1..71: note = hypo
  source 1..71: mol_type = genomic DNA

SEQ ID NO: 60603 - DNA, 30 bp, Homo sapiens; identical to SEQ ID NO: 40091
  misc_feature 1..30: note = chr3:184226786-184226816
  misc_feature 1..30: note = hypo
  source 1..30: mol_type = genomic DNA

SEQ ID NO: 60604 - DNA, 109 bp, Homo sapiens; identical to SEQ ID NO: 40092
  misc_feature 1..109: note = chr3:184785147-184785256
  misc_feature 1..109: note = hypo
  source 1..109: mol_type = genomic DNA

SEQ ID NO: 60605 - DNA, 16 bp, Homo sapiens
  misc_feature 1..16: note = chr3:185001919-185001935
  misc_feature 1..16: note = hypo
  source 1..16: mol_type = genomic DNA
gcggccactttccttt

SEQ ID NO: 60606 - DNA, 23 bp, Homo sapiens
  misc_feature 1..23: note = chr3:185270882-185270905
  misc_feature 1..23: note = hypo
  source 1..23: mol_type = genomic DNA
aaaagaaaaacaggccggcacgg

SEQ ID NO: 60607 - DNA, 30 bp, Homo sapiens; identical to SEQ ID NO: 14609
  misc_feature 1..30: note = chr3:185278325-185278355
  misc_feature 1..30: note = hypo
  source 1..30: mol_type = genomic DNA

SEQ ID NO: 60608 - DNA, 73 bp, Homo sapiens
  misc_feature 1..73: note = chr3:185363001-185363074
  misc_feature 1..73: note = hypo
  source 1..73: mol_type = genomic DNA
aactaaaagggatagcgtcgtgggagttcaggagagatccgagtggatggtgaagtggatggctgaagcctgc

SEQ ID NO: 60609 - DNA, 44 bp, Homo sapiens; identical to SEQ ID NO: 24001
  misc_feature 1..44: note = chr3:185363261-185363305
  misc_feature 1..44: note = hypo
  source 1..44: mol_type = genomic DNA

SEQ ID NO: 60610 - DNA, 136 bp, Homo sapiens; identical to SEQ ID NO: 40098
  misc_feature 1..136: note = chr3:185385541-185385677
  misc_feature 1..136: note = hypo
  source 1..136: mol_type = genomic DNA

SEQ ID NO: 60611 - DNA, 30 bp, Homo sapiens; identical to SEQ ID NO: 40099
  misc_feature 1..30: note = chr3:185504526-185504556
  misc_feature 1..30: note = hypo
  source 1..30: mol_type = genomic DNA

SEQ ID NO: 60612 - DNA, 25 bp, Homo sapiens
  misc_feature 1..25: note = chr3:185551925-185551950
  misc_feature 1..25: note = hypo
  source 1..25: mol_type = genomic DNA
atcccaggctgggtgcggtggctca

SEQ ID NO: 60613 - DNA, 91 bp, Homo sapiens; identical to SEQ ID NO: 40102
  misc_feature 1..91: note = chr3:185667518-185667609
  misc_feature 1..91: note = hypo
  source 1..91: mol_type = genomic DNA

SEQ ID NO: 60614 - DNA, 21 bp, Homo sapiens
  misc_feature 1..21: note = chr3:186019128-186019149
  misc_feature 1..21: note = hypo
  source 1..21: mol_type = genomic DNA
tccatgtgacgggtgcggtgg

SEQ ID NO: 60615 - DNA, 30 bp, Homo sapiens; identical to SEQ ID NO: 40104
  misc_feature 1..30: note = chr3:186495172-186495202
  misc_feature 1..30: note = hypo
  source 1..30: mol_type = genomic DNA

SEQ ID NO: 60616 - DNA, 78 bp, Homo sapiens; identical to SEQ ID NO: 40105
  misc_feature 1..78: note = chr3:186527185-186527263
  misc_feature 1..78: note = hypo
  source 1..78: mol_type = genomic DNA

SEQ ID NO: 60617 - DNA, 30 bp, Homo sapiens; identical to SEQ ID NO: 40106
  misc_feature 1..30: note = chr3:187416788-187416818
  misc_feature 1..30: note = hypo
  source 1..30: mol_type = genomic DNA

SEQ ID NO: 60618 - DNA, 190 bp, Homo sapiens; identical to SEQ ID NO: 40107
  misc_feature 1..190: note = chr3:187870406-187870596
  misc_feature 1..190: note = hypo
  source 1..190: mol_type = genomic DNA

SEQ ID NO: 60619 - DNA, 29 bp, Homo sapiens
  misc_feature 1..29: note = chr3:190065742-190065771
  misc_feature 1..29: note = hypo
  source 1..29: mol_type = genomic DNA
agaccatgggctgggcgcggtggctcaca

SEQ ID NO: 60620 - DNA, 30 bp, Homo sapiens; identical to SEQ ID NO: 40109
  misc_feature 1..30: note = chr3:193093790-193093820
  misc_feature 1..30: note = hypo
  source 1..30: mol_type = genomic DNA

SEQ ID NO: 60621 - DNA, 107 bp, Homo sapiens; identical to SEQ ID NO: 24003
  misc_feature 1..107: note = chr3:193548530-193548637
  misc_feature 1..107: note = hypo
  source 1..107: mol_type = genomic DNA

SEQ ID NO: 60622 - DNA, 35 bp, Homo sapiens; identical to SEQ ID NO: 40112
  misc_feature 1..35: note = chr3:193588124-193588159
  misc_feature 1..35: note = hypo
  source 1..35: mol_type = genomic DNA

SEQ ID NO: 60623 - DNA, 30 bp, Homo sapiens; identical to SEQ ID NO: 40113
  misc_feature 1..30: note = chr3:193656666-193656696
  misc_feature 1..30: note = hypo
  source 1..30: mol_type = genomic DNA

SEQ ID NO: 60624 - DNA, 30 bp, Homo sapiens; identical to SEQ ID NO: 40114
  misc_feature 1..30: note = chr3:193774655-193774685
  misc_feature 1..30: note = hypo
  source 1..30: mol_type = genomic DNA

SEQ ID NO: 60625 - DNA, 36 bp, Homo sapiens; identical to SEQ ID NO: 14616
  misc_feature 1..36: note = chr3:193922775-193922811
  misc_feature 1..36: note = hypo
  source 1..36: mol_type = genomic DNA

SEQ ID NO: 60626 - DNA, 18 bp, Homo sapiens
  misc_feature 1..18: note = chr3:194041075-194041093
  misc_feature 1..18: note = hypo
  source 1..18: mol_type = genomic DNA
agcactttgggaggccga

SEQ ID NO: 60627 - DNA, 29 bp, Homo sapiens
  misc_feature 1..29: note = chr3:194048919-194048948
  misc_feature 1..29: note = hypo
  source 1..29: mol_type = genomic DNA
gggccctctgtggacgttagtctgctctg

SEQ ID NO: 60628 - DNA, 30 bp, Homo sapiens; identical to SEQ ID NO: 40118
  misc_feature 1..30: note = chr3:194128418-194128448
  misc_feature 1..30: note = hypo
  source 1..30: mol_type = genomic DNA

SEQ ID NO: 60629 - DNA, 30 bp, Homo sapiens; identical to SEQ ID NO: 40119
  misc_feature 1..30: note = chr3:195183871-195183901
  misc_feature 1..30: note = hypo
  source 1..30: mol_type = genomic DNA

SEQ ID NO: 60630 - DNA, 30 bp, Homo sapiens; identical to SEQ ID NO: 14618
  misc_feature 1..30: note = chr3:195536686-195536716
  misc_feature 1..30: note = hypo
  source 1..30: mol_type = genomic DNA

SEQ ID NO: 60631 - DNA, 35 bp, Homo sapiens
  misc_feature 1..35: note = chr3:195586997-195587032
  misc_feature 1..35: note = hypo
  source 1..35: mol_type = genomic DNA
caggatcacgagagccgcctctaacccacccccaa

SEQ ID NO: 60632 - DNA, 144 bp, Homo sapiens
  misc_feature 1..144: note = chr3:195587118-195587262
  misc_feature 1..144: note = hypo
  source 1..144: mol_type = genomic DNA
ccacctgcagcgctttcgtccctacctggcgttcaccgttctcacccatcacatcagcacaacgtgaccttgtggggagccacctcctctgctcccaagacacctggtgcgtaacgattacagagcacccgtcctgccgtgatg

SEQ ID NO: 60633 - DNA, 72 bp, Homo sapiens; identical to SEQ ID NO: 40123
  misc_feature 1..72: note = chr3:195597490-195597562
  misc_feature 1..72: note = hypo
  source 1..72: mol_type = genomic DNA

SEQ ID NO: 60634 - DNA, 108 bp, Homo sapiens; identical to SEQ ID NO: 40124
  misc_feature 1..108: note = chr3:195599732-195599840
  misc_feature 1..108: note = hypo
  source 1..108: mol_type = genomic DNA

SEQ ID NO: 60635 - DNA, 485 bp, Homo sapiens; identical to SEQ ID NO: 40125
  misc_feature 1..485: note = chr3:195600086-195600571
  misc_feature 1..485: note = hypo
  source 1..485: mol_type = genomic DNA

SEQ ID NO: 60636 - DNA, 112 bp, Homo sapiens; identical to SEQ ID NO: 40126
  misc_feature 1..112: note = chr3:195600916-195601028
  misc_feature 1..112: note = hypo
  source 1..112: mol_type = genomic DNA

SEQ ID NO: 60637 - DNA, 40 bp, Homo sapiens; identical to SEQ ID NO: 40127
  misc_feature 1..40: note = chr3:195601324-195601364
  misc_feature 1..40: note = hypo
  source 1..40: mol_type = genomic DNA

SEQ ID NO: 60638 - DNA, 30 bp, Homo sapiens; identical to SEQ ID NO: 40128
  misc_feature 1..30: note = chr3:195603893-195603923
  misc_feature 1..30: note = hypo
  source 1..30: mol_type = genomic DNA

SEQ ID NO: 60639 - DNA, 37 bp, Homo sapiens; identical to SEQ ID NO: 40129
  misc_feature 1..37: note = chr3:195604262-195604299
  misc_feature 1..37: note = hypo
  source 1..37: mol_type = genomic DNA

SEQ ID NO: 60640 - DNA, 30 bp, Homo sapiens; identical to SEQ ID NO: 40130
  misc_feature 1..30: note = chr3:195604945-195604975
  misc_feature 1..30: note = hypo
  source 1..30: mol_type = genomic DNA

SEQ ID NO: 60641 - DNA, 55 bp, Homo sapiens; identical to SEQ ID NO: 40131
  misc_feature 1..55: note = chr3:195637288-195637343
  misc_feature 1..55: note = hypo
  source 1..55: mol_type = genomic DNA

SEQ ID NO: 60642 - DNA, 72 bp, Homo sapiens
  misc_feature 1..72: note = chr3:195648722-195648794
  misc_feature 1..72: note = hypo
  source 1..72: mol_type = genomic DNA
acagaggagcacttccgtcacccaggaacacggctctgatcaaggaattcaagaacccaacagaaaaataca

SEQ ID NO: 60643 - DNA, 30 bp, Homo sapiens; identical to SEQ ID NO: 40133
  misc_feature 1..30: note = chr3:195835032-195835062
  misc_feature 1..30: note = hypo
  source 1..30: mol_type = genomic DNA

SEQ ID NO: 60644 - DNA, 30 bp, Homo sapiens; identical to SEQ ID NO: 40134
  misc_feature 1..30: note = chr3:195874797-195874827
  misc_feature 1..30: note = hypo
  source 1..30: mol_type = genomic DNA

SEQ ID NO: 60645 - DNA, 16 bp, Homo sapiens
  misc_feature 1..16: note = chr3:195926800-195926816
  misc_feature 1..16: note = hypo
  source 1..16: mol_type = genomic DNA
gcgacactctggctca

SEQ ID NO: 60646 - DNA, 36 bp, Homo sapiens; identical to SEQ ID NO: 40136
  misc_feature 1..36: note = chr3:195993024-195993060
  misc_feature 1..36: note = hypo
  source 1..36: mol_type = genomic DNA

SEQ ID NO: 60647 - DNA, 37 bp, Homo sapiens; identical to SEQ ID NO: 40137
  misc_feature 1..37: note = chr3:196056123-196056160
  misc_feature 1..37: note = hypo
  source 1..37: mol_type = genomic DNA

SEQ ID NO: 60648 - DNA, 30 bp, Homo sapiens; identical to SEQ ID NO: 40138
  misc_feature 1..30: note = chr3:196063648-196063678
  misc_feature 1..30: note = hypo
  source 1..30: mol_type = genomic DNA

SEQ ID NO: 60649 - DNA, 26 bp, Homo sapiens
  misc_feature 1..26: note = chr3:196226403-196226429
  misc_feature 1..26: note = hypo
  source 1..26: mol_type = genomic DNA
ctaaaacagcccggacgcggtggctc

SEQ ID NO: 60650 - DNA, 78 bp, Homo sapiens; identical to SEQ ID NO: 40141
  misc_feature 1..78: note = chr3:196256227-196256305
  misc_feature 1..78: note = hypo
  source 1..78: mol_type = genomic DNA

SEQ ID NO: 60651 - DNA, 30 bp, Homo sapiens; identical to SEQ ID NO: 14628
  misc_feature 1..30: note = chr3:196294577-196294607
  misc_feature 1..30: note = hypo
  source 1..30: mol_type = genomic DNA

SEQ ID NO: 60652 - DNA, 30 bp, Homo sapiens; identical to SEQ ID NO: 40143
  misc_feature 1..30: note = chr3:196386861-196386891
  misc_feature 1..30: note = hypo
  source 1..30: mol_type = genomic DNA

SEQ ID NO: 60653 - DNA, 137 bp, Homo sapiens; identical to SEQ ID NO: 24015
  misc_feature 1..137: note = chr3:196387158-196387295
  misc_feature 1..137: note = hypo
  source 1..137: mol_type = genomic DNA

SEQ ID NO: 60654 - DNA, 213 bp, Homo sapiens; identical to SEQ ID NO: 24016
  misc_feature 1..213: note = chr3:196387415-196387628
  misc_feature 1..213: note = hypo
  source 1..213: mol_type = genomic DNA

SEQ ID NO: 60655 - DNA, 50 bp, Homo sapiens
  misc_feature 1..50: note = chr3:196388333-196388383
  misc_feature 1..50: note = hypo
  source 1..50: mol_type = genomic DNA
tgcagcatgggcagacggtggccgactgggccatggtcacctgcaacctc

SEQ ID NO: 60656 - DNA, 17 bp, Homo sapiens
  misc_feature 1..17: note = chr3:196388581-196388598
  misc_feature 1..17: note = hypo
  source 1..17: mol_type = genomic DNA
tccgtttactgacctgg

SEQ ID NO: 60657 - DNA, 41 bp, Homo sapiens; identical to SEQ ID NO: 40146
  misc_feature 1..41: note = chr3:196402166-196402207
  misc_feature 1..41: note = hypo
  source 1..41: mol_type = genomic DNA

SEQ ID NO: 60658 - DNA, 30 bp, Homo sapiens; identical to SEQ ID NO: 40147
  misc_feature 1..30: note = chr3:196731020-196731050
  misc_feature 1..30: note = hypo
  source 1..30: mol_type = genomic DNA

SEQ ID NO: 60659 - DNA, 216 bp, Homo sapiens
  misc_feature 1..216: note = chr3:196731313-196731529
  misc_feature 1..216: note = hypo
  source 1..216: mol_type = genomic DNA
gctgagcacttcttggccttttccataaggctttctcactctgtcttacagatatctccccacaaacctaaacaatttcgagagggacttgtgttctgcaaccagtcacagaatatcaggtgagctgggcgtgtcttcactgacccacccgcccagggatgctgcactcctctccaccctgctcagaatcactagaatgaccgttctgtggctaca

SEQ ID NO: 60660 - DNA, 220 bp, Homo sapiens; identical to SEQ ID NO: 40149
  misc_feature 1..220: note = chr3:196754516-196754736
  misc_feature 1..220: note = hypo
  source 1..220: mol_type = genomic DNA

SEQ ID NO: 60661 - DNA, 30 bp, Homo sapiens; identical to SEQ ID NO: 40150
  misc_feature 1..30: note = chr3:196784239-196784269
  misc_feature 1..30: note = hypo
  source 1..30: mol_type = genomic DNA

SEQ ID NO: 60662 - DNA, 39 bp, Homo sapiens; identical to SEQ ID NO: 40151
  misc_feature 1..39: note = chr3:197313900-197313939
  misc_feature 1..39: note = hypo
  source 1..39: mol_type = genomic DNA

SEQ ID NO: 60663 - DNA, 282 bp, Homo sapiens
  misc_feature 1..282: note = chr3:197327042-197327324
  misc_feature 1..282: note = hypo
  source 1..282: mol_type = genomic DNA
ttctttacttttctagtcataacctattttcagctggaaaccagaaaggctggttctatgtgcagatggcaatgctgaggtttagaggtaaaacacccacctgaagtgaatagaggctggactggaacccaggatggctcacctggaggcggcgctcccatacggcacccggcagcctgttttgtacaggaacaatacttgccttcctccgcaaaaaacaaacaaacaaacaaaaaatgcaggggttgaaaagaaaactgcctgagctgaaaagttttgttg

SEQ ID NO: 60664 - DNA, 52 bp, Homo sapiens; identical to SEQ ID NO: 40153
  misc_feature 1..52: note = chr3:197327804-197327856
  misc_feature 1..52: note = hypo
  source 1..52: mol_type = genomic DNA

SEQ ID NO: 60665 - DNA, 66 bp, Homo sapiens; identical to SEQ ID NO: 40154
  misc_feature 1..66: note = chr3:197402137-197402203
  misc_feature 1..66: note = hypo
  source 1..66: mol_type = genomic DNA

SEQ ID NO: 60666 - skipped

SEQ ID NO: 60667 - DNA, 288 bp, Homo sapiens; identical to SEQ ID NO: 40157
  misc_feature 1..288: note = chr4:619531-619819
  misc_feature 1..288: note = hypo
  source 1..288: mol_type = genomic DNA

SEQ ID NO: 60668 - DNA, 74 bp, Homo sapiens; identical to SEQ ID NO: 40158
  misc_feature 1..74: note = chr4:628132-628206
  misc_feature 1..74: note = hypo
  source 1..74: mol_type = genomic DNA

SEQ ID NO: 60669 - DNA, 128 bp, Homo sapiens
  misc_feature 1..128: note = chr4:628444-628572
  misc_feature 1..128: note = hypo
  source 1..128: mol_type = genomic DNA
ctctttcctctcttgcggcagtgccctcacttcagctcatttgctgacgagctcactgactacaagacaaagaatatgctggccacacccatcatgaatggcaaagacgtcgtggcggtgatcatggc

SEQ ID NO: 60670 - DNA, 312 bp, Homo sapiens
  misc_feature 1..312: note = chr4:650884-651196
  misc_feature 1..312: note = hypo
  source 1..312: mol_type = genomic DNA
tccccgccaagcattcggctgtgtgcgtgtgctcatgtgtgtgcggtatgcatgcggccagggagaggacgacaaagggcccccccgggagcaggagcctctgcagagcacccgggagaccccacacagaagcactgcgacaccatggtggcagccccaggacctgcccgccgagccacggggcctggcacacaggcacatgggagggggcgcgccgggagcgctgagcgccagtgacactgccatcccctccagtccctgacacagttcctgggctggtcagtgatgaacaccgacacctacgacaagatg

SEQ ID NO: 60671 - DNA, 60 bp, Homo sapiens
  misc_feature 1..60: note = chr4:651261-651321
  misc_feature 1..60: note = hypo
  source 1..60: mol_type = genomic DNA
ggacgagatccagctcatcctggtgcggcggggcaggacgtccaggggtcacccaggggt

SEQ ID NO: 60672 - DNA, 335 bp, Homo sapiens; identical to SEQ ID NO: 40161
  misc_feature 1..335: note = chr4:660894-661229
  misc_feature 1..335: note = hypo
  source 1..335: mol_type = genomic DNA

SEQ ID NO: 60673 - DNA, 177 bp, Homo sapiens; identical to SEQ ID NO: 40162
  misc_feature 1..177: note = chr4:672016-672193
  misc_feature 1..177: note = hypo
  source 1..177: mol_type = genomic DNA

SEQ ID NO: 60674 - DNA, 78 bp, Homo sapiens; identical to SEQ ID NO: 40163
  misc_feature 1..78: note = chr4:676743-676821
  misc_feature 1..78: note = hypo
  source 1..78: mol_type = genomic DNA

SEQ ID NO: 60675 - DNA, 131 bp, Homo sapiens
  misc_feature 1..131: note = chr4:678501-678632
  misc_feature 1..131: note = hypo
  source 1..131: mol_type = genomic DNA
actgaccagcttgagcccatccaggaacttctctgaggtggagctggcagccccggcagagggcggggtggggggcacactctcccacaggcagatggtggacagcaggcagacgacgccagcagggatgg

SEQ ID NO: 60676 - DNA, 30 bp, Homo sapiens; identical to SEQ ID NO: 40165
  misc_feature 1..30: note = chr4:679038-679068
  misc_feature 1..30: note = hypo
  source 1..30: mol_type = genomic DNA

SEQ ID NO: 60677 - DNA, 59 bp, Homo sapiens; identical to SEQ ID NO: 14641
  misc_feature 1..59: note = chr4:718181-718240
  misc_feature 1..59: note = hypo
  source 1..59: mol_type = genomic DNA

SEQ ID NO: 60678 - DNA, 76 bp, Homo sapiens; identical to SEQ ID NO: 40167
  misc_feature 1..76: note = chr4:738388-738464
  misc_feature 1..76: note = hypo
  source 1..76: mol_type = genomic DNA

SEQ ID NO: 60679 - DNA, 33 bp, Homo sapiens; identical to SEQ ID NO: 40168
  misc_feature 1..33: note = chr4:759808-759841
  misc_feature 1..33: note = hypo
  source 1..33: mol_type = genomic DNA

SEQ ID NO: 60680 - DNA, 161 bp, Homo sapiens; identical to SEQ ID NO: 40169
  misc_feature 1..161: note = chr4:828951-829112
  misc_feature 1..161: note = hypo
  source 1..161: mol_type = genomic DNA

SEQ ID NO: 60681 - DNA, 51 bp, Homo sapiens
  misc_feature 1..51: note = chr4:829641-829692
  misc_feature 1..51: note = hypo
  source 1..51: mol_type = genomic DNA
agctccccgaggaaagagtgcctttgcttcccttgacgtgtcctgcacttt

SEQ ID NO: 60682 - DNA, 183 bp, Homo sapiens
  misc_feature 1..183: note = chr4:955184-955367
  misc_feature 1..183: note = hypo
  source 1..183: mol_type = genomic DNA
gccagctgggctcagcggggaccggggacgcccaccctgggctcgcccgcccactcggccggcggctcaccatgtgcacgacgcccgtcacgcccacaacctccagcagcccgtcgtccatgcgtggcttctcaaacctggtgtcgctgtcggagccccacaggtcggcccccgagccccagc

SEQ ID NO: 60683 - DNA, 882 bp, Homo sapiens
  misc_feature 1..882: note = chr4:955919-956801
  misc_feature 1..882: note = hypo
  source 1..882: mol_type = genomic DNA
ccctgagctccccaacagctctgccggcaggcagagacaagagcaaggaccaccctggcaccaagccgagcacccaggagagggcagcatgggcaggtcctggccaggctctgtcgccagctggctcagcacaatccccagcagtggctactttctgtgtctccctcaactgcccgctttgcagaggggatgatgcgggcgcgtacacccgagtgtggctgggaagaggacgcccgttgtgacgcgtgtagcggggtcatatgcaggagcctggaaggcaccccacgccgggctgccctgtaccttggggggctctgcgtctgccgtgtcgttctctgcactgccagcctcgtgggcatccagcaggatggtccagcggtccatgagcacggcgtcggcctcgtccacagacagcagtacggagaacgggtcctcgccgctgtagcccgccccccagcggaggactcgaccaaggtcattccctgggacacaagcagacacagagcatctgtccacacccacccgcccatcagctgggtgcagaccccaccacgaggacagccagcccaggcctcggcaaaagctgcacaggaaggggtagaccctgaggccccctcctcggctgcacggctgagcccacctgtgcccaggggcaggatggccacagaaggctccgggcaggccagtcggtaccgtgtctcctccagggcgccaagcacccagcccacagtgccatcgccaccacacaccagcacccggaagcagggcacctgggagaacaggtggagcctagcgggagacaggaagtgtcctctaccagctgcgggcgcagcccatcccccacccaggctgcctcttccaagtgcccgtcctggccgtgtg

SEQ ID NO: 60684 - DNA, 30 bp, Homo sapiens; identical to SEQ ID NO: 40173
  misc_feature 1..30: note = chr4:957020-957050
  misc_feature 1..30: note = hypo
  source 1..30: mol_type = genomic DNA

SEQ ID NO: 60685 - DNA, 35 bp, Homo sapiens; identical to SEQ ID NO: 40174
  misc_feature 1..35: note = chr4:1016331-1016366
  misc_feature 1..35: note = hypo
  source 1..35: mol_type = genomic DNA

SEQ ID NO: 60686 - DNA, 45 bp, Homo sapiens
  misc_feature 1..45: note = chr4:1016747-1016792
  misc_feature 1..45: note = hypo
  source 1..45: mol_type = genomic DNA
gctcctgggtgtggggccctcgggtggagctcctgggagctgggc

SEQ ID NO: 60687 - DNA, 150 bp, Homo sapiens; identical to SEQ ID NO: 40176
  misc_feature 1..150: note = chr4:1016852-1017002
  misc_feature 1..150: note = hypo
  source 1..150: mol_type = genomic DNA

SEQ ID NO: 60688 - DNA, 30 bp, Homo sapiens; identical to SEQ ID NO: 40177
  misc_feature 1..30: note = chr4:1022834-1022864
  misc_feature 1..30: note = hypo
  source 1..30: mol_type = genomic DNA

SEQ ID NO: 60689 - DNA, 194 bp, Homo sapiens; identical to SEQ ID NO: 40178
  misc_feature 1..194: note = chr4:1024234-1024428
  misc_feature 1..194: note = hypo
  source 1..194: mol_type = genomic DNA

SEQ ID NO: 60690 - DNA, 53 bp, Homo sapiens; identical to SEQ ID NO: 24034
  misc_feature 1..53: note = chr4:1025875-1025928
  misc_feature 1..53: note = hypo
  source 1..53: mol_type = genomic DNA

SEQ ID NO: 60691 - DNA, 119 bp, Homo sapiens
  misc_feature 1..119: note = chr4:1026074-1026193
  misc_feature 1..119: note = hypo
  source 1..119: mol_type = genomic DNA
tctgaggggcaaccccaccagcctgcttgggccccagcgtcttctcagcgtctgcctcctgtgaaaaccttccactcagtaaaggagcacagtaggttggttgccgggccaggctgggg

SEQ ID NO: 60692 - DNA, 294 bp, Homo sapiens; identical to SEQ ID NO: 40180
  misc_feature 1..294: note = chr4:1036245-1036539
  misc_feature 1..294: note = hypo
  source 1..294: mol_type = genomic DNA

SEQ ID NO: 60693 - DNA, 38 bp, Homo sapiens; identical to SEQ ID NO: 40181
  misc_feature 1..38: note = chr4:1282473-1282511
  misc_feature 1..38: note = hypo
  source 1..38: mol_type = genomic DNA

SEQ ID NO: 60694 - DNA, 163 bp, Homo sapiens; identical to SEQ ID NO: 40182
  misc_feature 1..163: note = chr4:1299056-1299219
  misc_feature 1..163: note = hypo
  source 1..163: mol_type = genomic DNA

SEQ ID NO: 60695 - DNA, 185 bp, Homo sapiens; identical to SEQ ID NO: 40183
  misc_feature 1..185: note = chr4:1299450-1299635
  misc_feature 1..185: note = hypo
  source 1..185: mol_type = genomic DNA

SEQ ID NO: 60696 - DNA, 30 bp, Homo sapiens; identical to SEQ ID NO: 40184
  misc_feature 1..30: note = chr4:1331816-1331846
  misc_feature 1..30: note = hypo
  source 1..30: mol_type = genomic DNA

SEQ ID NO: 60697 - DNA, 119 bp, Homo sapiens; identical to SEQ ID NO: 40185
  misc_feature 1..119: note = chr4:1332541-1332660
  misc_feature 1..119: note = hypo
  source 1..119: mol_type = genomic DNA

SEQ ID NO: 60698 - DNA, 222 bp, Homo sapiens; identical to SEQ ID NO: 40186
  misc_feature 1..222: note = chr4:1332878-1333100
  misc_feature 1..222: note = hypo
  source 1..222: mol_type = genomic DNA

SEQ ID NO: 60699 - DNA, 27 bp, Homo sapiens
  misc_feature 1..27: note = chr4:1338688-1338715
  misc_feature 1..27: note = hypo
  source 1..27: mol_type = genomic DNA
ctggcagaagcttcccggcagagggat

SEQ ID NO: 60700 - DNA, 211 bp, Homo sapiens; identical to SEQ ID NO: 40189
  misc_feature 1..211: note = chr4:1504889-1505100
  misc_feature 1..211: note = hypo
  source 1..211: mol_type = genomic DNA

SEQ ID NO: 60701 - DNA, 24 bp, Homo sapiens
  misc_feature 1..24: note = chr4:1512344-1512368
  misc_feature 1..24: note = hypo
  source 1..24: mol_type = genomic DNA
tgcggttttaacctgcgttttcct

SEQ ID NO: 60702 - DNA, 21 bp, Homo sapiens
  misc_feature 1..21: note = chr4:1556398-1556419
  misc_feature 1..21: note = hypo
  source 1..21: mol_type = genomic DNA
tgtccacccccagaccgcctt

SEQ ID NO: 60703 - DNA, 55 bp, Homo sapiens; identical to SEQ ID NO: 40192
  misc_feature 1..55: note = chr4:1562145-1562200
  misc_feature 1..55: note = hypo
  source 1..55: mol_type = genomic DNA

SEQ ID NO: 60704 - DNA, 76 bp, Homo sapiens
  misc_feature 1..76: note = chr4:1576408-1576484
  misc_feature 1..76: note = hypo
  source 1..76: mol_type = genomic DNA
ggggccttgcacacacgggcacccctgagacaggcgaggcctggacaggtgcaggaggtgggcctggagccggtgg

SEQ ID NO: 60705 - DNA, 130 bp, Homo sapiens
  misc_feature 1..130: note = chr4:1576528-1576658
  misc_feature 1..130: note = hypo
  source 1..130: mol_type = genomic DNA
gcttgtctctggcaggagggcccacgccctgtgtgccaggctgctgggcctccccggacggaccggctgcccgaacccctcggctatggcaagctttcatggtctctgcctccctcggtgtcaacacatg

SEQ ID NO: 60706 - DNA, 118 bp, Homo sapiens; identical to SEQ ID NO: 40194
  misc_feature 1..118: note = chr4:1577697-1577815
  misc_feature 1..118: note = hypo
  source 1..118: mol_type = genomic DNA

SEQ ID NO: 60707 - DNA, 154 bp, Homo sapiens; identical to SEQ ID NO: 40195
  misc_feature 1..154: note = chr4:1605613-1605767
  misc_feature 1..154: note = hypo
  source 1..154: mol_type = genomic DNA

SEQ ID NO: 60708 - DNA, 119 bp, Homo sapiens
  misc_feature 1..119: note = chr4:1616563-1616682
  misc_feature 1..119: note = hypo
  source 1..119: mol_type = genomic DNA
cacccagaggcaggtcgccccacacgcatttctccacggggtgccccatggccgtcctatgctgacggacaccagatggcatttcagcaccgggcacaggggccgctttaaacagcaaa

SEQ ID NO: 60709 - DNA, 30 bp, Homo sapiens; identical to SEQ ID NO: 40197
  misc_feature 1..30: note = chr4:1623727-1623757
  misc_feature 1..30: note = hypo
  source 1..30: mol_type = genomic DNA

SEQ ID NO: 60710 - DNA, 74 bp, Homo sapiens; identical to SEQ ID NO: 40198
  misc_feature 1..74: note = chr4:1663439-1663513
  misc_feature 1..74: note = hypo
  source 1..74: mol_type = genomic DNA

SEQ ID NO: 60711 - DNA, 357 bp, Homo sapiens; identical to SEQ ID NO: 40199
  misc_feature 1..357: note = chr4:1687122-1687479
  misc_feature 1..357: note = hypo
  source 1..357: mol_type = genomic DNA

SEQ ID NO: 60712 - DNA, 66 bp, Homo sapiens; identical to SEQ ID NO: 40200
  misc_feature 1..66: note = chr4:1791278-1791344
  misc_feature 1..66: note = hypo
  source 1..66: mol_type = genomic DNA

SEQ ID NO: 60713 - DNA, 345 bp, Homo sapiens; identical to SEQ ID NO: 40201
  misc_feature 1..345: note = chr4:1803132-1803477
  misc_feature 1..345: note = hypo
  source 1..345: mol_type = genomic DNA

SEQ ID NO: 60714 - DNA, 335 bp, Homo sapiens; identical to SEQ ID NO: 40202
  misc_feature 1..335: note = chr4:1805302-1805637
  misc_feature 1..335: note = hypo
  source 1..335: mol_type = genomic DNA

SEQ ID NO: 60715 - DNA, 61 bp, Homo sapiens
  misc_feature 1..61: note = chr4:1807294-1807355
  misc_feature 1..61: note = hypo
  source 1..61: mol_type = genomic DNA
ctgacaaggacctgtcggacctggtgtctgagatggagatgatgaagatgatcgggaaaca

SEQ ID NO: 60716 - DNA, 308 bp, Homo sapiens
  misc_feature 1..308: note = chr4:1807384-1807692
  misc_feature 1..308: note = hypo
  source 1..308: mol_type = genomic DNA
gcacgcagggcggtaggtgcggtagcggcggtggtgccggctgggcggccctcctgggcctggcagcccgtctgaggagcccgtgtccccagggcccctgtacgtgctggtggagtacgcggccaagggtaacctgcgggagtttctgcgggcgcggcggcccccgggcctggactactccttcgacacctgcaagccgcccgaggagcagctcaccttcaaggacctggtgtcctgtgcctaccaggtggcccggggcatggagtacttggcctcccagaaggtgggcagggcggcaggtgtgggtg

SEQ ID NO: 60717 - DNA, 260 bp, Homo sapiens; identical to SEQ ID NO: 40204
  misc_feature 1..260: note = chr4:1960118-1960378
  misc_feature 1..260: note = hypo
  source 1..260: mol_type = genomic DNA

SEQ ID NO: 60718 - DNA, 30 bp, Homo sapiens; identical to SEQ ID NO: 40205
  misc_feature 1..30: note = chr4:1961374-1961404
  misc_feature 1..30: note = hypo
  source 1..30: mol_type = genomic DNA

SEQ ID NO: 60719 - DNA, 155 bp, Homo sapiens; identical to SEQ ID NO: 40206
  misc_feature 1..155: note = chr4:1976939-1977094
  misc_feature 1..155: note = hypo
  source 1..155: mol_type = genomic DNA

SEQ ID NO: 60720 - DNA, 56 bp, Homo sapiens
  misc_feature 1..56: note = chr4:1993715-1993771
  misc_feature 1..56: note = hypo
  source 1..56: mol_type = genomic DNA
ggcctactcttccaccggtgcgcagatgcaagaaaacctgaagggtgagaagccgg

SEQ ID NO: 60721 - DNA, 155 bp, Homo sapiens
  misc_feature 1..155: note = chr4:1994180-1994335
  misc_feature 1..155: note = hypo
  source 1..155: mol_type = genomic DNA
cctcccacgaggaaacgcagagagccaggccatggcgtgcctgtgcctctgccatgcgcccactgggctgctcacagtgtgagacagctgggctggctggcgctgggggtgaacaacagcgccctgccctgtccagacgccggggctgaaacccc

SEQ ID NO: 60722 - DNA, 74 bp, Homo sapiens; identical to SEQ ID NO: 14668
  misc_feature 1..74: note = chr4:1994756-1994830
  misc_feature 1..74: note = hypo
  source 1..74: mol_type = genomic DNA

SEQ ID NO: 60723 - DNA, 30 bp, Homo sapiens; identical to SEQ ID NO: 40209
  misc_feature 1..30: note = chr4:2009272-2009302
  misc_feature 1..30: note = hypo
  source 1..30: mol_type = genomic DNA

SEQ ID NO: 60724 - DNA, 299 bp, Homo sapiens; identical to SEQ ID NO: 40210
  misc_feature 1..299: note = chr4:2065601-2065900
  misc_feature 1..299: note = hypo
  source 1..299: mol_type = genomic DNA

SEQ ID NO: 60725 - DNA, 30 bp, Homo sapiens; identical to SEQ ID NO: 40212
  misc_feature 1..30: note = chr4:2129422-2129452
  misc_feature 1..30: note = hypo
  source 1..30: mol_type = genomic DNA

SEQ ID NO: 60726 - DNA, 141 bp, Homo sapiens; identical to SEQ ID NO: 40213
  misc_feature 1..141: note = chr4:2278785-2278926
  misc_feature 1..141: note = hypo
  source 1..141: mol_type = genomic DNA

SEQ ID NO: 60727 - DNA, 87 bp, Homo sapiens
  misc_feature 1..87: note = chr4:2305585-2305672
  misc_feature 1..87: note = hypo
  source 1..87: mol_type = genomic DNA
gagaagtgggcagtgcgctcggatgcggctcagggcaaggggcccggcgctggcacagcccgctcccactgccccgcacaggcacgc

SEQ ID NO: 60728 - DNA, 91 bp, Homo sapiens; identical to SEQ ID NO: 24054
  misc_feature 1..91: note = chr4:2305827-2305918
  misc_feature 1..91: note = hypo
  source 1..91: mol_type = genomic DNA

SEQ ID NO: 60729 - DNA, 124 bp, Homo sapiens; identical to SEQ ID NO: 40215
  misc_feature 1..124: note = chr4:2459775-2459899
  misc_feature 1..124: note = hypo
  source 1..124: mol_type = genomic DNA

SEQ ID NO: 60730 - skipped

SEQ ID NO: 60731 - DNA, 84 bp, Homo sapiens
  misc_feature 1..84: note = chr4:2926282-2926366
  misc_feature 1..84: note = hypo
  source 1..84: mol_type = genomic DNA
gttgctctcctgggccgtcgtcatcctgggagctaggcactcctcctaagaggacctcttcaccggtttttgtctcgttctaga

SEQ ID NO: 60732 - DNA, 139 bp, Homo sapiens; identical to SEQ ID NO: 40218
  misc_feature 1..139: note = chr4:2932947-2933086
  misc_feature 1..139: note = hypo
  source 1..139: mol_type = genomic DNA

SEQ ID NO: 60733 - DNA, 45 bp, Homo sapiens; identical to SEQ ID NO: 40220
  misc_feature 1..45: note = chr4:2987431-2987476
  misc_feature 1..45: note = hypo
  source 1..45: mol_type = genomic DNA

SEQ ID NO: 60734 - DNA, 30 bp, Homo sapiens; identical to SEQ ID NO: 40221
  misc_feature 1..30: note = chr4:3252743-3252773
  misc_feature 1..30: note = hypo
  source 1..30: mol_type = genomic DNA

SEQ ID NO: 60735 - DNA, 30 bp, Homo sapiens; identical to SEQ ID NO: 40222
  misc_feature 1..30: note = chr4:3292632-3292662
  misc_feature 1..30: note = hypo
  source 1..30: mol_type = genomic DNA

SEQ ID NO: 60736 - DNA, 50 bp, Homo sapiens; identical to SEQ ID NO: 40223
  misc_feature 1..50: note = chr4:3310501-3310551
  misc_feature 1..50: note = hypo
  source 1..50: mol_type = genomic DNA

SEQ ID NO: 60737 - DNA, 91 bp, Homo sapiens; identical to SEQ ID NO: 40224
  misc_feature 1..91: note = chr4:3313229-3313320
  misc_feature 1..91: note = hypo
  source 1..91: mol_type = genomic DNA

SEQ ID NO: 60738 - DNA, 35 bp, Homo sapiens; identical to SEQ ID NO: 40225
  misc_feature 1..35: note = chr4:3418235-3418270
  misc_feature 1..35: note = hypo
  source 1..35: mol_type = genomic DNA

SEQ ID NO: 60739 - DNA, 213 bp, Homo sapiens; identical to SEQ ID NO: 40226
  misc_feature 1..213: note = chr4:3445886-3446099
  misc_feature 1..213: note = hypo
  source 1..213: mol_type = genomic DNA

SEQ ID NO: 60740 - DNA, 548 bp, Homo sapiens
  misc_feature 1..548: note = chr4:3446443-3446991
  misc_feature 1..548: note = hypo
  source 1..548: mol_type = genomic DNA
acggctctgcaacatcggtgagtgggtcagccccccggggtgccctggggcagtgccgggtggacccaccgtgggccggcctcactgcccctctgcccgcagagcctgatgagcgctgcttcttggggaacggcactgggtaccgtggcgtggccagcacctcagcctcgggcctcagctgcctggcctggaactccgatctgctctaccaggagctgcacgtggactccgtgggcgccgcggccctgctgggcctgggcccccatgcctactgccggtcagcaccacgccgctccaggccgccgcatgcggggcaggcaggatttgtcctggggagaggccccccggctccctaggacccaggcggggccagctccgtccagacaggccccggaacctctgcctgggaggctgcccgagggagggccactctcttcccactgctccaggtgcggggaaccgccctgctgggggttccgatgccccctccccatgccctcttcgaggggcagtgtgactccctgccagcccccacttatgcaccgcag

SEQ ID NO: 60741 - DNA, 108 bp, Homo sapiens
  misc_feature 1..108: note = chr4:3447021-3447129
  misc_feature 1..108: note = hypo
  source 1..108: mol_type = genomic DNA
ctacgtggtgaaggacagcgcgctctcctgggagtactgccgcctggaggcctgcggtgcgcggctggcggggggtgctgccttgggccccaccgaggtcacagcagt

SEQ ID NO: 60742 - DNA, 30 bp, Homo sapiens; identical to SEQ ID NO: 40229
  misc_feature 1..30: note = chr4:3449723-3449753
  misc_feature 1..30: note = hypo
  source 1..30: mol_type = genomic DNA

SEQ ID NO: 60743 - DNA, 271 bp, Homo sapiens; identical to SEQ ID NO: 40230
  misc_feature 1..271: note = chr4:3475099-3475370
  misc_feature 1..271: note = hypo
  source 1..271: mol_type = genomic DNA

SEQ ID NO: 60744 - DNA, 38 bp, Homo sapiens; identical to SEQ ID NO: 40231
  misc_feature 1..38: note = chr4:3664470-3664508
  misc_feature 1..38: note = hypo
  source 1..38: mol_type = genomic DNA

SEQ ID NO: 60745 - DNA, 61 bp, Homo sapiens; identical to SEQ ID NO: 40232
  misc_feature 1..61: note = chr4:3690841-3690902
  misc_feature 1..61: note = hypo
  source 1..61: mol_type = genomic DNA

SEQ ID NO: 60746 - DNA, 30 bp, Homo sapiens; identical to SEQ ID NO: 40233
  misc_feature 1..30: note = chr4:3702485-3702515
  misc_feature 1..30: note = hypo
  source 1..30: mol_type = genomic DNA

SEQ ID NO: 60747 - DNA, 30 bp, Homo sapiens; identical to SEQ ID NO: 40234
  misc_feature 1..30: note = chr4:3782694-3782724
  misc_feature 1..30: note = hypo
  source 1..30: mol_type = genomic DNA

SEQ ID NO: 60748 - DNA, 34 bp, Homo sapiens; identical to SEQ ID NO: 40235
  misc_feature 1..34: note = chr4:3783286-3783320
  misc_feature 1..34: note = hypo
  source 1..34: mol_type = genomic DNA

SEQ ID NO: 60749 - DNA, 30 bp, Homo sapiens; identical to SEQ ID NO: 40236
  misc_feature 1..30: note = chr4:4251746-4251776
  misc_feature 1..30: note = hypo
  source 1..30: mol_type = genomic DNA

SEQ ID NO: 60750 - DNA, 82 bp, Homo sapiens; identical to SEQ ID NO: 14678
  misc_feature 1..82: note = chr4:4256159-4256241
  misc_feature 1..82: note = hypo
  source 1..82: mol_type = genomic DNA

SEQ ID NO: 60751 - DNA, 30 bp, Homo sapiens; identical to SEQ ID NO: 40238
  misc_feature 1..30: note = chr4:4417662-4417692
  misc_feature 1..30: note = hypo
  source 1..30: mol_type = genomic DNA

SEQ ID NO: 60752 - DNA, 30 bp, Homo sapiens; identical to SEQ ID NO: 40239
  misc_feature 1..30: note = chr4:5171284-5171314
  misc_feature 1..30: note = hypo
  source 1..30: mol_type = genomic DNA

SEQ ID NO: 60753 - DNA, 30 bp, Homo sapiens; identical to SEQ ID NO: 40240
  misc_feature 1..30: note = chr4:5458789-5458819
  misc_feature 1..30: note = hypo
  source 1..30: mol_type = genomic DNA

SEQ ID NO: 60754 - DNA, 68 bp, Homo sapiens; identical to SEQ ID NO: 40241
  misc_feature 1..68: note = chr4:6537166-6537234
  misc_feature 1..68: note = hypo
  source 1..68: mol_type = genomic DNA

SEQ ID NO: 60755 - DNA, 182 bp, Homo sapiens; identical to SEQ ID NO: 40242
  misc_feature 1..182: note = chr4:6540136-6540318
  misc_feature 1..182: note = hypo
  source 1..182: mol_type = genomic DNA

SEQ ID NO: 60756 - DNA, 30 bp, Homo sapiens; identical to SEQ ID NO: 40243
  misc_feature 1..30: note = chr4:6627192-6627222
  misc_feature 1..30: note = hypo
  source 1..30: mol_type = genomic DNA

SEQ ID NO: 60757 - DNA, 31 bp, Homo sapiens; identical to SEQ ID NO: 24061
  misc_feature 1..31: note = chr4:6670153-6670184
  misc_feature 1..31: note = hypo
  source 1..31: mol_type = genomic DNA

SEQ ID NO: 60758 - DNA, 93 bp, Homo sapiens; identical to SEQ ID NO: 40245
  misc_feature 1..93: note = chr4:6719866-6719959
  misc_feature 1..93: note = hypo
  source 1..93: mol_type = genomic DNA

SEQ ID NO: 60759 - DNA, 17 bp, Homo sapiens
  misc_feature 1..17: note = chr4:6748557-6748574
  misc_feature 1..17: note = hypo
  source 1..17: mol_type = genomic DNA
gtcggcctgggtctgga

SEQ ID NO: 60760 - DNA, 44 bp, Homo sapiens; identical to SEQ ID NO: 40247
  misc_feature 1..44: note = chr4:6896389-6896433
  misc_feature 1..44: note = hypo
  source 1..44: mol_type = genomic DNA

SEQ ID NO: 60761 - DNA, 19 bp, Homo sapiens
  misc_feature 1..19: note = chr4:7035959-7035978
  misc_feature 1..19: note = hypo
  source 1..19: mol_type = genomic DNA
gagacgcagggaaggatgt

SEQ ID NO: 60762 - DNA, 151 bp, Homo sapiens; identical to SEQ ID NO: 40250
  misc_feature 1..151: note = chr4:7047052-7047203
  misc_feature 1..151: note = hypo
  source 1..151: mol_type = genomic DNA

SEQ ID NO: 60763 - DNA, 24 bp, Homo sapiens
  misc_feature 1..24: note = chr4:7084531-7084555
  misc_feature 1..24: note = hypo
  source 1..24: mol_type = genomic DNA
cgccatgcccggccccttgttcct

SEQ ID NO: 60764 - DNA, 30 bp, Homo sapiens; identical to SEQ ID NO: 40252
  misc_feature 1..30: note = chr4:7134112-7134142
  misc_feature 1..30: note = hypo
  source 1..30: mol_type = genomic DNA

SEQ ID NO: 60765 - DNA, 30 bp, Homo sapiens; identical to SEQ ID NO: 40253
  misc_feature 1..30: note = chr4:7237615-7237645
  misc_feature 1..30: note = hypo
  source 1..30: mol_type = genomic DNA

SEQ ID NO: 60766 - DNA, 32 bp, Homo sapiens; identical to SEQ ID NO: 40254
  misc_feature 1..32: note = chr4:7475475-7475507
  misc_feature 1..32: note = hypo
  source 1..32: mol_type = genomic DNA

SEQ ID NO: 60767 - DNA, 30 bp, Homo sapiens; identical to SEQ ID NO: 24065
  misc_feature 1..30: note = chr4:7647740-7647770
  misc_feature 1..30: note = hypo
  source 1..30: mol_type = genomic DNA

SEQ ID NO: 60768 - DNA, 28 bp, Homo sapiens
  misc_feature 1..28: note = chr4:7647945-7647973
  misc_feature 1..28: note = hypo
  source 1..28: mol_type = genomic DNA
gcgcacacggggccggcaggctggggac

SEQ ID NO: 60769 - DNA, 30 bp, Homo sapiens; identical to SEQ ID NO: 40256
  misc_feature 1..30: note = chr4:7679932-7679962
  misc_feature 1..30: note = hypo
  source 1..30: mol_type = genomic DNA

SEQ ID NO: 60770 - DNA, 339 bp, Homo sapiens; identical to SEQ ID NO: 40257
  misc_feature 1..339: note = chr4:7741325-7741664
  misc_feature 1..339: note = hypo
  source 1..339: mol_type = genomic DNA

SEQ ID NO: 60771 - DNA, 30 bp, Homo sapiens; identical to SEQ ID NO: 40258
  misc_feature 1..30: note = chr4:7968495-7968525
  misc_feature 1..30: note = hypo
  source 1..30: mol_type = genomic DNA

SEQ ID NO: 60772 - DNA, 105 bp, Homo sapiens; identical to SEQ ID NO: 40259
  misc_feature 1..105: note = chr4:8039486-8039591
  misc_feature 1..105: note = hypo
  source 1..105: mol_type = genomic DNA

SEQ ID NO: 60773 - DNA, 114 bp, Homo sapiens; identical to SEQ ID NO: 40260
  misc_feature 1..114: note = chr4:8240177-8240291
  misc_feature 1..114: note = hypo
  source 1..114: mol_type = genomic DNA

SEQ ID NO: 60774 - DNA, 32 bp, Homo sapiens; identical to SEQ ID NO: 40261
  misc_feature 1..32: note = chr4:8252769-8252801
  misc_feature 1..32: note = hypo
  source 1..32: mol_type = genomic DNA

SEQ ID NO: 60775 - DNA, 105 bp, Homo sapiens; identical to SEQ ID NO: 40262
  misc_feature 1..105: note = chr4:8327019-8327124
  misc_feature 1..105: note = hypo
  source 1..105: mol_type = genomic DNA

SEQ ID NO: 60776 - DNA, 30 bp, Homo sapiens; identical to SEQ ID NO: 40263
  misc_feature 1..30: note = chr4:8378202-8378232
  misc_feature 1..30: note = hypo
  source 1..30: mol_type = genomic DNA

SEQ ID NO: 60777 - DNA, 30 bp, Homo sapiens; identical to SEQ ID NO: 40264
  misc_feature 1..30: note = chr4:8386144-8386174
  misc_feature 1..30: note = hypo
  source 1..30: mol_type = genomic DNA

SEQ ID NO: 60778 - DNA, 50 bp, Homo sapiens; identical to SEQ ID NO: 40265
  misc_feature 1..50: note = chr4:8483913-8483963
  misc_feature 1..50: note = hypo
  source 1..50: mol_type = genomic DNA

SEQ ID NO: 60779 - DNA, 106 bp, Homo sapiens
  misc_feature 1..106: note = chr4:8607707-8607813
  misc_feature 1..106: note = hypo
  source 1..106: mol_type = genomic DNA
gcccccagtggagcccgaggtgaagctcatcggcaacattcatggcaacgaggtggcgggccgggagatgctcatctacctagcccagtacctgtgctctgagtac

SEQ ID NO: 60780 - DNA, 15 bp, Homo sapiens
  misc_feature 1..15: note = chr4:8608541-8608556
  misc_feature 1..15: note = hypo
  source 1..15: mol_type = genomic DNA
acgtccgagtactac

SEQ ID NO: 60781 - DNA, 51 bp, Homo sapiens
  misc_feature 1..51: note = chr4:8608600-8608651
  misc_feature 1..51: note = hypo
  source 1..51: mol_type = genomic DNA
cccccagcactactggtggggtaaggtaggagccgccgctgcccatgctgg

SEQ ID NO: 60782 - DNA, 39 bp, Homo sapiens; identical to SEQ ID NO: 40268
  misc_feature 1..39: note = chr4:8615881-8615920
  misc_feature 1..39: note = hypo
  source 1..39: mol_type = genomic DNA

SEQ ID NO: 60783 - DNA, 30 bp, Homo sapiens; identical to SEQ ID NO: 40269
  misc_feature 1..30: note = chr4:8793763-8793793
  misc_feature 1..30: note = hypo
  source 1..30: mol_type = genomic DNA

SEQ ID NO: 60784 - DNA, 124 bp, Homo sapiens; identical to SEQ ID NO: 40270
  misc_feature 1..124: note = chr4:8967222-8967346
  misc_feature 1..124: note = hypo
  source 1..124: mol_type = genomic DNA

SEQ ID NO: 60785 - DNA, 30 bp, Homo sapiens; identical to SEQ ID NO: 40271
  misc_feature 1..30: note = chr4:10200240-10200270
  misc_feature 1..30: note = hypo
  source 1..30: mol_type = genomic DNA

SEQ ID NO: 60786 - DNA, 30 bp, Homo sapiens; identical to SEQ ID NO: 40272
  misc_feature 1..30: note = chr4:15697120-15697150
  misc_feature 1..30: note = hypo
  source 1..30: mol_type = genomic DNA

SEQ ID NO: 60787 - DNA, 33 bp, Homo sapiens; identical to SEQ ID NO: 40273
  misc_feature 1..33: note = chr4:15789491-15789524
  misc_feature 1..33: note = hypo
  source 1..33: mol_type = genomic DNA

SEQ ID NO: 60788 - DNA, 100 bp, Homo sapiens; identical to SEQ ID NO: 40274
  misc_feature 1..100: note = chr4:16787098-16787198
  misc_feature 1..100: note = hypo
  source 1..100: mol_type = genomic DNA

SEQ ID NO: 60789 - DNA, 30 bp, Homo sapiens; identical to SEQ ID NO: 40275
  misc_feature 1..30: note = chr4:24535112-24535142
  misc_feature 1..30: note = hypo
  source 1..30: mol_type = genomic DNA

SEQ ID NO: 60790 - DNA, 37 bp, Homo sapiens; identical to SEQ ID NO: 40276
  misc_feature 1..37: note = chr4:36418721-36418758
  misc_feature 1..37: note = hypo
  source 1..37: mol_type = genomic DNA

SEQ ID NO: 60791 - DNA, 97 bp, Homo sapiens; identical to SEQ ID NO: 40277
  misc_feature 1..97: note = chr4:36418818-36418915
  misc_feature 1..97: note = hypo
  source 1..97: mol_type = genomic DNA

SEQ ID NO: 60792 - DNA, 174 bp, Homo sapiens; identical to SEQ ID NO: 40278
  misc_feature 1..174: note = chr4:39448304-39448478
  misc_feature 1..174: note = hypo
  source 1..174: mol_type = genomic DNA

SEQ ID NO: 60793 - DNA, 98 bp, Homo sapiens; identical to SEQ ID NO: 5017
  misc_feature 1..98: note = chr4:39816677-39816775
  misc_feature 1..98: note = hypo
  source 1..98: mol_type = genomic DNA

SEQ ID NO: 60794 - DNA, 38 bp, Homo sapiens; identical to SEQ ID NO: 5018
  misc_feature 1..38: note = chr4:39817075-39817113
  misc_feature 1..38: note = hypo
  source 1..38: mol_type = genomic DNA

SEQ ID NO: 60795 - DNA, 30 bp, Homo sapiens; identical to SEQ ID NO: 40281
  misc_feature 1..30: note = chr4:40479216-40479246
  misc_feature 1..30: note = hypo
  source 1..30: mol_type = genomic DNA

SEQ ID NO: 60796 - DNA, 100 bp, Homo sapiens; identical to SEQ ID NO: 40282
  misc_feature 1..100: note = chr4:40533094-40533194
  misc_feature 1..100: note = hypo
  source 1..100: mol_type = genomic DNA

SEQ ID NO: 60797 - DNA, 23 bp, Homo sapiens
  misc_feature 1..23: note = chr4:40910280-40910303
  misc_feature 1..23: note = hypo
  source 1..23: mol_type = genomic DNA
actgtgagaaaagaacgtttctg

SEQ ID NO: 60798 - DNA, 81 bp, Homo sapiens; identical to SEQ ID NO: 40284
  misc_feature 1..81: note = chr4:41314285-41314366
  misc_feature 1..81: note = hypo
  source 1..81: mol_type = genomic DNA

SEQ ID NO: 60799 - DNA, 29 bp, Homo sapiens
  misc_feature 1..29: note = chr4:41994108-41994137
  misc_feature 1..29: note = hypo
  source 1..29: mol_type = genomic DNA
ttgtaaaccttaggacgctgaggtgggtg

SEQ ID NO: 60800 - DNA, 151 bp, Homo sapiens; identical to SEQ ID NO: 40286
  misc_feature 1..151: note = chr4:42200720-42200871
  misc_feature 1..151: note = hypo
  source 1..151: mol_type = genomic DNA

SEQ ID NO: 60801 - DNA, 30 bp, Homo sapiens; identical to SEQ ID NO: 40287
  misc_feature 1..30: note = chr4:42316051-42316081
  misc_feature 1..30: note = hypo
  source 1..30: mol_type = genomic DNA

SEQ ID NO: 60802 - DNA, 90 bp, Homo sapiens; identical to SEQ ID NO: 40288
  misc_feature 1..90: note = chr4:43553281-43553371
  misc_feature 1..90: note = hypo
  source 1..90: mol_type = genomic DNA

SEQ ID NO: 60803 - DNA, 30 bp, Homo sapiens; identical to SEQ ID NO: 40289
  misc_feature 1..30: note = chr4:45473432-45473462
  misc_feature 1..30: note = hypo
  source 1..30: mol_type = genomic DNA

SEQ ID NO: 60804 - DNA, 19 bp, Homo sapiens
  misc_feature 1..19: note = chr4:48378645-48378664
  misc_feature 1..19: note = hypo
  source 1..19: mol_type = genomic DNA
tttttttttttgagacgga

SEQ ID NO: 60805 - DNA, 37 bp, Homo sapiens; identical to SEQ ID NO: 40291
  misc_feature 1..37: note = chr4:52892695-52892732
  misc_feature 1..37: note = hypo
  source 1..37: mol_type = genomic DNA

SEQ ID NO: 60806 - DNA, 178 bp, Homo sapiens; identical to SEQ ID NO: 40292
  misc_feature 1..178: note = chr4:55393642-55393820
  misc_feature 1..178: note = hypo
  source 1..178: mol_type = genomic DNA

SEQ ID NO: 60807 - DNA, 31 bp, Homo sapiens; identical to SEQ ID NO: 40293
  misc_feature 1..31: note = chr4:55406444-55406475
  misc_feature 1..31: note = hypo
  source 1..31: mol_type = genomic DNA

SEQ ID NO: 60808 - DNA, 68 bp, Homo sapiens; identical to SEQ ID NO: 40294
  misc_feature 1..68: note = chr4:57182183-57182251
  misc_feature 1..68: note = hypo
  source 1..68: mol_type = genomic DNA

SEQ ID NO: 60809 - DNA, 16 bp, Homo sapiens
  misc_feature 1..16: note = chr4:61380678-61380694
  misc_feature 1..16: note = hypo
  source 1..16: mol_type = genomic DNA
gaagcagtctggatgc

SEQ ID NO: 60810 - DNA, 30 bp, Homo sapiens; identical to SEQ ID NO: 40296
  misc_feature 1..30: note = chr4:72226942-72226972
  misc_feature 1..30: note = hypo
  source 1..30: mol_type = genomic DNA

SEQ ID NO: 60811 - DNA, 32 bp, Homo sapiens; identical to SEQ ID NO: 40297
  misc_feature 1..32: note = chr4:74468507-74468539
  misc_feature 1..32: note = hypo
  source 1..32: mol_type = genomic DNA

SEQ ID NO: 60812 - DNA, 29 bp, Homo sapiens
  misc_feature 1..29: note = chr4:75241002-75241031
  misc_feature 1..29: note = hypo
  source 1..29: mol_type = genomic DNA
taaagtaatgactagcgattctttttttt

SEQ ID NO: 60813 - DNA, 44 bp, Homo sapiens; identical to SEQ ID NO: 24076
  misc_feature 1..44: note = chr4:75241435-75241479
  misc_feature 1..44: note = hypo
  source 1..44: mol_type = genomic DNA

SEQ ID NO: 60814 - DNA, 27 bp, Homo sapiens
  misc_feature 1..27: note = chr4:76912383-76912410
  misc_feature 1..27: note = hypo
  source 1..27: mol_type = genomic DNA
gtttatttttaatcccgcagtctaaaa

SEQ ID NO: 60815 - DNA, 184 bp, Homo sapiens
  misc_feature 1..184: note = chr4:76912733-76912917
  misc_feature 1..184: note = hypo
  source 1..184: mol_type = genomic DNA
ttccctcttaggaggaaaaaagagcaacgagggtcatataagttaatgtgtatgattttagatatgtttttattttggttttggttgtttcaacttagcgtgacccatacaagggaaaagagggctggataaaatgtgatcatgttgaccattaataaatgcaattaatcgttaaaattcaacc

SEQ ID NO: 60816 - DNA, 30 bp, Homo sapiens; identical to SEQ ID NO: 40302
  misc_feature 1..30: note = chr4:77156176-77156206
  misc_feature 1..30: note = hypo
  source 1..30: mol_type = genomic DNA

SEQ ID NO: 60817 - DNA, 30 bp, Homo sapiens; identical to SEQ ID NO: 40304
  misc_feature 1..30: note = chr4:79861382-79861412
  misc_feature 1..30: note = hypo
  source 1..30: mol_type = genomic DNA

SEQ ID NO: 60818 - DNA, 177 bp, Homo sapiens; identical to SEQ ID NO: 40305
  misc_feature 1..177: note = chr4:81307899-81308076
  misc_feature 1..177: note = hypo
  source 1..177: mol_type = genomic DNA

SEQ ID NO: 60819 - DNA, 30 bp, Homo sapiens; identical to SEQ ID NO: 40306
  misc_feature 1..30: note = chr4:82157454-82157484
  misc_feature 1..30: note = hypo
  source 1..30: mol_type = genomic DNA

SEQ ID NO: 60820 - DNA, 28 bp, Homo sapiens
  misc_feature 1..28: note = chr4:83149079-83149107
  misc_feature 1..28: note = hypo
  source 1..28: mol_type = genomic DNA
aacaggcaatgcagccgggcgcggtggc

SEQ ID NO: 60821 - DNA, 16 bp, Homo sapiens
  misc_feature 1..16: note = chr4:83301216-83301232
  misc_feature 1..16: note = hypo
  source 1..16: mol_type = genomic DNA
gcgacaggccatgaat

SEQ ID NO: 60822 - DNA, 70 bp, Homo sapiens
  misc_feature 1..70: note = chr4:83323436-83323506
  misc_feature 1..70: note = hypo
  source 1..70: mol_type = genomic DNA
tgcaaatgatctagacgcttgctggagttgacttgtttcatggtgagggctccttgaaacactggcacca

SEQ ID NO: 60823 - DNA, 152 bp, Homo sapiens; identical to SEQ ID NO: 40310
  misc_feature 1..152: note = chr4:83551716-83551868
  misc_feature 1..152: note = hypo
  source 1..152: mol_type = genomic DNA

SEQ ID NO: 60824 - DNA, 41 bp, Homo sapiens; identical to SEQ ID NO: 14696
  misc_feature 1..41: note = chr4:84169961-84170002
  misc_feature 1..41: note = hypo
  source 1..41: mol_type = genomic DNA

SEQ ID NO: 60825 - DNA, 30 bp, Homo sapiens; identical to SEQ ID NO: 40312
  misc_feature 1..30: note = chr4:86922651-86922681
  misc_feature 1..30: note = hypo
  source 1..30: mol_type = genomic DNA

SEQ ID NO: 60826 - DNA, 37 bp, Homo sapiens; identical to SEQ ID NO: 14697
  misc_feature 1..37: note = chr4:87899606-87899643
  misc_feature 1..37: note = hypo
  source 1..37: mol_type = genomic DNA

SEQ ID NO: 60827 - DNA, 22 bp, Homo sapiens
  misc_feature 1..22: note = chr4:88010193-88010215
  misc_feature 1..22: note = hypo
  source 1..22: mol_type = genomic DNA
cgcatgtcgagtattaagccag

SEQ ID NO: 60828 - DNA, 30 bp, Homo sapiens; identical to SEQ ID NO: 40315
  misc_feature 1..30: note = chr4:88025280-88025310
  misc_feature 1..30: note = hypo
  source 1..30: mol_type = genomic DNA

SEQ ID NO: 60829 - DNA, 128 bp, Homo sapiens; identical to SEQ ID NO: 40316
  misc_feature 1..128: note = chr4:89116521-89116649
  misc_feature 1..128: note = hypo
  source 1..128: mol_type = genomic DNA

SEQ ID NO: 60830 - DNA, 20 bp, Homo sapiens
  misc_feature 1..20: note = chr4:89912577-89912597
  misc_feature 1..20: note = hypo
  source 1..20: mol_type = genomic DNA
gactccgtctcaaaataaaa

SEQ ID NO: 60831 - DNA, 106 bp, Homo sapiens; identical to SEQ ID NO: 40318
  misc_feature 1..106: note = chr4:90043853-90043959
  misc_feature 1..106: note = hypo
  source 1..106: mol_type = genomic DNA

SEQ ID NO: 60832 - DNA, 203 bp, Homo sapiens; identical to SEQ ID NO: 40319
  misc_feature 1..203: note = chr4:91168356-91168559
  misc_feature 1..203: note = hypo
  source 1..203: mol_type = genomic DNA

SEQ ID NO: 60833 - DNA, 16 bp, Homo sapiens
  misc_feature 1..16: note = chr4:95127717-95127733
  misc_feature 1..16: note = hypo
  source 1..16: mol_type = genomic DNA
aatgaataagatctag

SEQ ID NO: 60834 - DNA, 17 bp, Homo sapiens
  misc_feature 1..17: note = chr4:95762912-95762929
  misc_feature 1..17: note = hypo
  source 1..17: mol_type = genomic DNA
ttcggccatcttggctc

SEQ ID NO: 60835 - DNA, 78 bp, Homo sapiens; identical to SEQ ID NO: 40322
  misc_feature 1..78: note = chr4:97118687-97118765
  misc_feature 1..78: note = hypo
  source 1..78: mol_type = genomic DNA

SEQ ID NO: 60836 - DNA, 17 bp, Homo sapiens
  misc_feature 1..17: note = chr4:97118825-97118842
  misc_feature 1..17: note = hypo
  source 1..17: mol_type = genomic DNA
cccgcggatctgacagg

SEQ ID NO: 60837 - DNA, 64 bp, Homo sapiens; identical to SEQ ID NO: 40324
  misc_feature 1..64: note = chr4:97442548-97442612
  misc_feature 1..64: note = hypo
  source 1..64: mol_type = genomic DNA

SEQ ID NO: 60838 - DNA, 106 bp, Homo sapiens; identical to SEQ ID NO: 40325
  misc_feature 1..106: note = chr4:99495888-99495994
  misc_feature 1..106: note = hypo
  source 1..106: mol_type = genomic DNA

SEQ ID NO: 60839 - DNA, 24 bp, Homo sapiens
  misc_feature 1..24: note = chr4:103350988-103351012
  misc_feature 1..24: note = hypo
  source 1..24: mol_type = genomic DNA
ctgaggcaggagaatcgcttgaac

SEQ ID NO: 60840 - DNA, 27 bp, Homo sapiens
  misc_feature 1..27: note = chr4:103811714-103811741
  misc_feature 1..27: note = hypo
  source 1..27: mol_type = genomic DNA
ggcttggtgcagtgacgacacacctgt

SEQ ID NO: 60841 - DNA, 30 bp, Homo sapiens; identical to SEQ ID NO: 40328
  misc_feature 1..30: note = chr4:107134495-107134525
  misc_feature 1..30: note = hypo
  source 1..30: mol_type = genomic DNA

SEQ ID NO: 60842 - DNA, 23 bp, Homo sapiens
  misc_feature 1..23: note = chr4:107994276-107994299
  misc_feature 1..23: note = hypo
  source 1..23: mol_type = genomic DNA
gggctacacgtggcacttgcagg

SEQ ID NO: 60843 - DNA, 122 bp, Homo sapiens; identical to SEQ ID NO: 40330
  misc_feature 1..122: note = chr4:108302152-108302274
  misc_feature 1..122: note = hypo
  source 1..122: mol_type = genomic DNA

SEQ ID NO: 60844 - DNA, 26 bp, Homo sapiens
  misc_feature 1..26: note = chr4:109311251-109311277
  misc_feature 1..26: note = hypo
  source 1..26: mol_type = genomic DNA
aataaaaacagccaacggcggccggg

SEQ ID NO: 60845 - DNA, 79 bp, Homo sapiens; identical to SEQ ID NO: 40332
  misc_feature 1..79: note = chr4:110735440-110735519
  misc_feature 1..79: note = hypo
  source 1..79: mol_type = genomic DNA

SEQ ID NO: 60846 - DNA, 19 bp, Homo sapiens
  misc_feature 1..19: note = chr4:110735819-110735838
  misc_feature 1..19: note = hypo
  source 1..19: mol_type = genomic DNA
gccccgcctacaaaggtat

SEQ ID NO: 60847 - DNA, 30 bp, Homo sapiens; identical to SEQ ID NO: 14701
  misc_feature 1..30: note = chr4:113154853-113154883
  misc_feature 1..30: note = hypo
  source 1..30: mol_type = genomic DNA

SEQ ID NO: 60848 - DNA, 30 bp, Homo sapiens; identical to SEQ ID NO: 40335
  misc_feature 1..30: note = chr4:113199029-113199059
  misc_feature 1..30: note = hypo
  source 1..30: mol_type = genomic DNA

SEQ ID NO: 60849 - DNA, 12 bp, Homo sapiens
  misc_feature 1..12: note = chr4:113559151-113559163
  misc_feature 1..12: note = hypo
  source 1..12: mol_type = genomic DNA
tattaaaacatt

SEQ ID NO: 60850 - DNA, 84 bp, Homo sapiens
  misc_feature 1..84: note = chr4:113559422-113559506
  misc_feature 1..84: note = hypo
  source 1..84: mol_type = genomic DNA
gcctgggccactgagagaggctgcgtctccaaacaaacatttttcatataatttcctcaggagaaattacgaaatacttttaaa

SEQ ID NO: 60851 - DNA, 30 bp, Homo sapiens; identical to SEQ ID NO: 40338
  misc_feature 1..30: note = chr4:114176916-114176946
  misc_feature 1..30: note = hypo
  source 1..30: mol_type = genomic DNA

SEQ ID NO: 60852 - DNA, 89 bp, Homo sapiens; identical to SEQ ID NO: 14704
  misc_feature 1..89: note = chr4:123866964-123867053
  misc_feature 1..89: note = hypo
  source 1..89: mol_type = genomic DNA

SEQ ID NO: 60853 - DNA, 34 bp, Homo sapiens; identical to SEQ ID NO: 40340
  misc_feature 1..34: note = chr4:124335284-124335318
  misc_feature 1..34: note = hypo
  source 1..34: mol_type = genomic DNA

SEQ ID NO: 60854 - DNA, 100 bp, Homo sapiens; identical to SEQ ID NO: 40341
  misc_feature 1..100: note = chr4:128984233-128984333
  misc_feature 1..100: note = hypo
  source 1..100: mol_type = genomic DNA

SEQ ID NO: 60855 - DNA, 30 bp, Homo sapiens; identical to SEQ ID NO: 40342
  misc_feature 1..30: note = chr4:136320705-136320735
  misc_feature 1..30: note = hypo
  source 1..30: mol_type = genomic DNA

SEQ ID NO: 60856 - DNA, 37 bp, Homo sapiens; identical to SEQ ID NO: 40343
  misc_feature 1..37: note = chr4:140566711-140566748
  misc_feature 1..37: note = hypo
  source 1..37: mol_type = genomic DNA

SEQ ID NO: 60857 - DNA, 30 bp, Homo sapiens; identical to SEQ ID NO: 40344
  misc_feature 1..30: note = chr4:140753539-140753569
  misc_feature 1..30: note = hypo
  source 1..30: mol_type = genomic DNA

SEQ ID NO: 60858 - DNA, 59 bp, Homo sapiens; identical to SEQ ID NO: 40345
  misc_feature 1..59: note = chr4:140754226-140754285
  misc_feature 1..59: note = hypo
  source 1..59: mol_type = genomic DNA

SEQ ID NO: 60859 - DNA, 30 bp, Homo sapiens; identical to SEQ ID NO: 40346
  misc_feature 1..30: note = chr4:141031335-141031365
  misc_feature 1..30: note = hypo
  source 1..30: mol_type = genomic DNA

SEQ ID NO: 60860 - DNA, 30 bp, Homo sapiens; identical to SEQ ID NO: 40347
  misc_feature 1..30: note = chr4:144100466-144100496
  misc_feature 1..30: note = hypo
  source 1..30: mol_type = genomic DNA

SEQ ID NO: 60861 - DNA, 43 bp, Homo sapiens; identical to SEQ ID NO: 40348
  misc_feature 1..43: note = chr4:146853888-146853931
  misc_feature 1..43: note = hypo
  source 1..43: mol_type = genomic DNA

SEQ ID NO: 60862 - DNA, 32 bp, Homo sapiens; identical to SEQ ID NO: 40349
  misc_feature 1..32: note = chr4:147048518-147048550
  misc_feature 1..32: note = hypo
  source 1..32: mol_type = genomic DNA

SEQ ID NO: 60863 - DNA, 20 bp, Homo sapiens
  misc_feature 1..20: note = chr4:153437373-153437393
  misc_feature 1..20: note = hypo
  source 1..20: mol_type = genomic DNA
caactggtactggtccgtgg

SEQ ID NO: 60864 - DNA, 100 bp, Homo sapiens; identical to SEQ ID NO: 40351
  misc_feature 1..100: note = chr4:153535608-153535708
  misc_feature 1..100: note = hypo
  source 1..100: mol_type = genomic DNA

SEQ ID NO: 60865 - DNA, 30 bp, Homo sapiens; identical to SEQ ID NO: 40352
  misc_feature 1..30: note = chr4:153702805-153702835
  misc_feature 1..30: note = hypo
  source 1..30: mol_type = genomic DNA

SEQ ID NO: 60866 - DNA, 181 bp, Homo sapiens; identical to SEQ ID NO: 40353
  misc_feature 1..181: note = chr4:153918964-153919145
  misc_feature 1..181: note = hypo
  source 1..181: mol_type = genomic DNA

SEQ ID NO: 60867 - DNA, 63 bp, Homo sapiens; identical to SEQ ID NO: 40354
  misc_feature 1..63: note = chr4:154216373-154216436
  misc_feature 1..63: note = hypo
  source 1..63: mol_type = genomic DNA

SEQ ID NO: 60868 - DNA, 163 bp, Homo sapiens; identical to SEQ ID NO: 40355
  misc_feature 1..163: note = chr4:154216735-154216898
  misc_feature 1..163: note = hypo
  source 1..163: mol_type = genomic DNA

SEQ ID NO: 60869 - DNA, 30 bp, Homo sapiens; identical to SEQ ID NO: 40356
  misc_feature 1..30: note = chr4:154372568-154372598
  misc_feature 1..30: note = hypo
  source 1..30: mol_type = genomic DNA

SEQ ID NO: 60870 - DNA, 115 bp, Homo sapiens; identical to SEQ ID NO: 40357
  misc_feature 1..115: note = chr4:154540115-154540230
  misc_feature 1..115: note = hypo
  source 1..115: mol_type = genomic DNA

SEQ ID NO: 60871 - DNA, 30 bp, Homo sapiens; identical to SEQ ID NO: 40358
  misc_feature 1..30: note = chr4:154702659-154702689
  misc_feature 1..30: note = hypo
  source 1..30: mol_type = genomic DNA

SEQ ID NO: 60872 - DNA, 40 bp, Homo sapiens; identical to SEQ ID NO: 40359
  misc_feature 1..40: note = chr4:155321157-155321197
  misc_feature 1..40: note = hypo
  source 1..40: mol_type = genomic DNA

SEQ ID NO: 60873 - DNA, 173 bp, Homo sapiens; identical to SEQ ID NO: 40360
  misc_feature 1..173: note = chr4:155677688-155677861
  misc_feature 1..173: note = hypo
  source 1..173: mol_type = genomic DNA

SEQ ID NO: 60874 - DNA, 89 bp, Homo sapiens; identical to SEQ ID NO: 40361
  misc_feature 1..89: note = chr4:156676888-156676977
  misc_feature 1..89: note = hypo
  source 1..89: mol_type = genomic DNA

SEQ ID NO: 60875 - DNA, 40 bp, Homo sapiens; identical to SEQ ID NO: 40362
  misc_feature 1..40: note = chr4:157119835-157119875
  misc_feature 1..40: note = hypo
  source 1..40: mol_type = genomic DNA

SEQ ID NO: 60876 - DNA, 169 bp, Homo sapiens; identical to SEQ ID NO: 40363
  misc_feature 1..169: note = chr4:158740667-158740836
  misc_feature 1..169: note = hypo
  source 1..169: mol_type = genomic DNA

SEQ ID NO: 60877 - DNA, 153 bp, Homo sapiens; identical to SEQ ID NO: 40364
  misc_feature 1..153: note = chr4:170484641-170484794
  misc_feature 1..153: note = hypo
  source 1..153: mol_type = genomic DNA

SEQ ID NO: 60878 - DNA, 30 bp, Homo sapiens; identical to SEQ ID NO: 40365
  misc_feature 1..30: note = chr4:170919945-170919975
  misc_feature 1..30: note = hypo
  source 1..30: mol_type = genomic DNA

SEQ ID NO: 60879 - DNA, 22 bp, Homo sapiens
  misc_feature 1..22: note = chr4:172596059-172596081
  misc_feature 1..22: note = hypo
  source 1..22: mol_type = genomic DNA
taacatacgcccacttgggctc

SEQ ID NO: 60880 - DNA, 31 bp, Homo sapiens; identical to SEQ ID NO: 40367
  misc_feature 1..31: note = chr4:172903760-172903791
  misc_feature 1..31: note = hypo
  source 1..31: mol_type = genomic DNA

SEQ ID NO: 60881 - DNA, 69 bp, Homo sapiens; identical to SEQ ID NO: 40368
  misc_feature 1..69: note = chr4:175940800-175940869
  misc_feature 1..69: note = hypo
  source 1..69: mol_type = genomic DNA

SEQ ID NO: 60882 - DNA, 21 bp, Homo sapiens
  misc_feature 1..21: note = chr4:178599688-178599709
  misc_feature 1..21: note = hypo
  source 1..21: mol_type = genomic DNA
ccactgcgcccagccgagtcc

SEQ ID NO: 60883 - DNA, 30 bp, Homo sapiens; identical to SEQ ID NO: 40370
  misc_feature 1..30: note = chr4:180818589-180818619
  misc_feature 1..30: note = hypo
  source 1..30: mol_type = genomic DNA

SEQ ID NO: 60884 - DNA, 30 bp, Homo sapiens; identical to SEQ ID NO: 40371
  misc_feature 1..30: note = chr4:183959079-183959109
  misc_feature 1..30: note = hypo
  source 1..30: mol_type = genomic DNA

SEQ ID NO: 60885 - DNA, 30 bp, Homo sapiens; identical to SEQ ID NO: 40372
  misc_feature 1..30: note = chr4:184205426-184205456
  misc_feature 1..30: note = hypo
  source 1..30: mol_type = genomic DNA

SEQ ID NO: 60886 - DNA, 30 bp, Homo sapiens; identical to SEQ ID NO: 40375
  misc_feature 1..30: note = chr4:185833058-185833088
  misc_feature 1..30: note = hypo
  source 1..30: mol_type = genomic DNA

SEQ ID NO: 60887 - DNA, 30 bp, Homo sapiens; identical to SEQ ID NO: 40376
  misc_feature 1..30: note = chr4:185913935-185913965
  misc_feature 1..30: note = hypo
  source 1..30: mol_type = genomic DNA

SEQ ID NO: 60888 - DNA, 161 bp, Homo sapiens; identical to SEQ ID NO: 40377
  misc_feature 1..161: note = chr4:186348467-186348628
  misc_feature 1..161: note = hypo
  source 1..161: mol_type = genomic DNA

SEQ ID NO: 60889 - DNA, 72 bp, Homo sapiens; identical to SEQ ID NO: 40378
  misc_feature 1..72: note = chr4:190474969-190475041
  misc_feature 1..72: note = hypo
  source 1..72: mol_type = genomic DNA

SEQ ID NO: 60890 - DNA, 36 bp, Homo sapiens; identical to SEQ ID NO: 40379
  misc_feature 1..36: note = chr5:109867-109903
  misc_feature 1..36: note = hypo
  source 1..36: mol_type = genomic DNA

SEQ ID NO: 60891 - DNA, 30 bp, Homo sapiens; identical to SEQ ID NO: 40380
  misc_feature 1..30: note = chr5:139715-139745
  misc_feature 1..30: note = hypo
  source 1..30: mol_type = genomic DNA

SEQ ID NO: 60892 - DNA, 37 bp, Homo sapiens; identical to SEQ ID NO: 40381
  misc_feature 1..37: note = chr5:140350-140387
  misc_feature 1..37: note = hypo
  source 1..37: mol_type = genomic DNA

SEQ ID NO: 60893 - DNA, 81 bp, Homo sapiens; identical to SEQ ID NO: 40382
  misc_feature 1..81: note = chr5:192215-192296
  misc_feature 1..81: note = hypo
  source 1..81: mol_type = genomic DNA

SEQ ID NO: 60894 - DNA, 46 bp, Homo sapiens; identical to SEQ ID NO: 40383
  misc_feature 1..46: note = chr5:429731-429777
  misc_feature 1..46: note = hypo
  source 1..46: mol_type = genomic DNA

SEQ ID NO: 60895 - DNA, 30 bp, Homo sapiens; identical to SEQ ID NO: 40384
  misc_feature 1..30: note = chr5:430228-430258
  misc_feature 1..30: note = hypo
  source 1..30: mol_type = genomic DNA

SEQ ID NO: 60896 - DNA, 75 bp, Homo sapiens; identical to SEQ ID NO: 40385
  misc_feature 1..75: note = chr5:435499-435574
  misc_feature 1..75: note = hypo
  source 1..75: mol_type = genomic DNA

SEQ ID NO: 60897 - DNA, 30 bp, Homo sapiens; identical to SEQ ID NO: 40386
  misc_feature 1..30: note = chr5:478182-478212
  misc_feature 1..30: note = hypo
  source 1..30: mol_type = genomic DNA

SEQ ID NO: 60898 - DNA, 286 bp, Homo sapiens; identical to SEQ ID NO: 40387
  misc_feature 1..286: note = chr5:479388-479674
  misc_feature 1..286: note = hypo
  source 1..286: mol_type = genomic DNA

SEQ ID NO: 60899 - DNA, 132 bp, Homo sapiens; identical to SEQ ID NO: 24090
  misc_feature 1..132: note = chr5:480880-481012
  misc_feature 1..132: note = hypo
  source 1..132: mol_type = genomic DNA

SEQ ID NO: 60900 - DNA, 30 bp, Homo sapiens; identical to SEQ ID NO: 40389
  misc_feature 1..30: note = chr5:484548-484578
  misc_feature 1..30: note = hypo
  source 1..30: mol_type = genomic DNA

SEQ ID NO: 60901 - DNA, 30 bp, Homo sapiens; identical to SEQ ID NO: 40390
  misc_feature 1..30: note = chr5:488495-488525
  misc_feature 1..30: note = hypo
  source 1..30: mol_type = genomic DNA

SEQ ID NO: 60902 - DNA, 146 bp, Homo sapiens; identical to SEQ ID NO: 40391
  misc_feature 1..146: note = chr5:488846-488992
  misc_feature 1..146: note = hypo
  source 1..146: mol_type = genomic DNA

SEQ ID NO: 60903 - DNA, 30 bp, Homo sapiens
  misc_feature 1..30: note = chr5:491305-491335
  misc_feature 1..30: note = hypo
  source 1..30: mol_type = genomic DNA
aagctgtagcatccccggcagcagcggcgg

SEQ ID NO: 60904 - DNA, 608 bp, Homo sapiens
  misc_feature 1..608: note = chr5:491536-492144
  misc_feature 1..608: note = hypo
  source 1..608: mol_type = genomic DNA
tgcagtcctcctcctctccctgggacctggtggccggcgagtgtggacggacccctacctctgcccagtgccggaggaagagcggcagcccctggccacctgcagcccccaagccgagctgccgagatgggaactcctccccaagcagaacacgtgctgggacctggggacgcgcaggggactggccttggtcacgagggcctacggggctgccagccacgtttctcacctgacacttaccgcctggaggccagggtgcggcaccccgacctttctgagatgaggcagcgccgcccctcccggaccccaccctgatcccggccggggcaacagtggcgcagactcacccatgagcccactgaggaagacgccgtagagggacagcccggtggtggccgcgttccacacggtacccacgacggcgtacaacaggatggtccccaggttgccgaagaagaggcggttgggcatgaagtagccggcgtccagcacgatggggggcagcaggtagaagaagaagacggtgggcgtcagtgtgaaggacgcgatgtggtcggccgcccagacgatgccgcccagcaccaggcccagcacgatgagcagggcgc

SEQ ID NO: 60905 - DNA, 197 bp, Homo sapiens; identical to SEQ ID NO: 40393
  misc_feature 1..197: note = chr5:516758-516955
  misc_feature 1..197: note = hypo
  source 1..197: mol_type = genomic DNA

SEQ ID NO: 60906 - DNA, 30 bp, Homo sapiens; identical to SEQ ID NO: 40394
  misc_feature 1..30: note = chr5:519988-520018
  misc_feature 1..30: note = hypo
  source 1..30: mol_type = genomic DNA

SEQ ID NO: 60907 - DNA, 49 bp, Homo sapiens; identical to SEQ ID NO: 40395
  misc_feature 1..49: note = chr5:537890-537939
  misc_feature 1..49: note = hypo
  source 1..49: mol_type = genomic DNA

SEQ ID NO: 60908 - DNA, 72 bp, Homo sapiens; identical to SEQ ID NO: 24094
  misc_feature 1..72: note = chr5:538686-538758
  misc_feature 1..72: note = hypo
  source 1..72: mol_type = genomic DNA

SEQ ID NO: 60909 - DNA, 145 bp, Homo sapiens; identical to SEQ ID NO: 24095
  misc_feature 1..145: note = chr5:538806-538951
  misc_feature 1..145: note = hypo
  source 1..145: mol_type = genomic DNA

SEQ ID NO: 60910 - DNA, 45 bp, Homo sapiens
  misc_feature 1..45: note = chr5:554538-554583
  misc_feature 1..45: note = hypo
  source 1..45: mol_type = genomic DNA
ggataaaccaggggtggggtctgggtcacaggatgacccgggggt

SEQ ID NO: 60911 - DNA, 48 bp, Homo sapiens
  misc_feature 1..48: note = chr5:554823-554871
  misc_feature 1..48: note = hypo
  source 1..48: mol_type = genomic DNA
cgggatgaacggggttgggggctgggtcacgggatgaaccggggggtg

SEQ ID NO: 60912 - DNA, 43 bp, Homo sapiens
  misc_feature 1..43: note = chr5:554900-554943
  misc_feature 1..43: note = hypo
  source 1..43: mol_type = genomic DNA
tcacgggctaaaccggggttgggggtgggtcacgggatgaacg

SEQ ID NO: 60913 - DNA, 30 bp, Homo sapiens; identical to SEQ ID NO: 40400
  misc_feature 1..30: note = chr5:555668-555698
  misc_feature 1..30: note = hypo
  source 1..30: mol_type = genomic DNA

SEQ ID NO: 60914 - DNA, 250 bp, Homo sapiens; identical to SEQ ID NO: 40401
  misc_feature 1..250: note = chr5:556065-556315
  misc_feature 1..250: note = hypo
  source 1..250: mol_type = genomic DNA

SEQ ID NO: 60915 - DNA, 30 bp, Homo sapiens; identical to SEQ ID NO: 40402
  misc_feature 1..30: note = chr5:583170-583200
  misc_feature 1..30: note = hypo
  source 1..30: mol_type = genomic DNA

SEQ ID NO: 60916 - DNA, 30 bp, Homo sapiens; identical to SEQ ID NO: 40403
  misc_feature 1..30: note = chr5:595300-595330
  misc_feature 1..30: note = hypo
  source 1..30: mol_type = genomic DNA

SEQ ID NO: 60917 - DNA, 30 bp, Homo sapiens; identical to SEQ ID NO: 40404
  misc_feature 1..30: note = chr5:601155-601185
  misc_feature 1..30: note = hypo
  source 1..30: mol_type = genomic DNA

SEQ ID NO: 60918 - DNA, 47 bp, Homo sapiens; identical to SEQ ID NO: 40405
  misc_feature 1..47: note = chr5:676852-676899
  misc_feature 1..47: note = hypo
  source 1..47: mol_type = genomic DNA

SEQ ID NO: 60919 - DNA, 24 bp, Homo sapiens
  misc_feature 1..24: note = chr5:677865-677889
  misc_feature 1..24: note = hypo
  source 1..24: mol_type = genomic DNA
tgatcttgctgaagacgatgtcca

SEQ ID NO: 60920 - DNA, 54 bp, Homo sapiens
  misc_feature 1..54: note = chr5:678006-678060
  misc_feature 1..54: note = hypo
  source 1..54: mol_type = genomic DNA
gccggaaggcctcctccagggcactgagctcaggggatgcggctgccccctcac

SEQ ID NO: 60921 - DNA, 54 bp, Homo sapiens; identical to SEQ ID NO: 40407
  misc_feature 1..54: note = chr5:684241-684295
  misc_feature 1..54: note = hypo
  source 1..54: mol_type = genomic DNA

SEQ ID NO: 60922 - DNA, 30 bp, Homo sapiens; identical to SEQ ID NO: 40408
  misc_feature 1..30: note = chr5:891092-891122
  misc_feature 1..30: note = hypo
  source 1..30: mol_type = genomic DNA

SEQ ID NO: 60923 - DNA, 36 bp, Homo sapiens; identical to SEQ ID NO: 40409
  misc_feature 1..36: note = chr5:891651-891687
  misc_feature 1..36: note = hypo
  source 1..36: mol_type = genomic DNA

SEQ ID NO: 60924 - DNA, 95 bp, Homo sapiens; identical to SEQ ID NO: 40410
  misc_feature 1..95: note = chr5:1003105-1003200
  misc_feature 1..95: note = hypo
  source 1..95: mol_type = genomic DNA

SEQ ID NO: 60925 - DNA, 135 bp, Homo sapiens; identical to SEQ ID NO: 40411
  misc_feature 1..135: note = chr5:1021355-1021490
  misc_feature 1..135: note = hypo
  source 1..135: mol_type = genomic DNA

SEQ ID NO: 60926 - DNA, 288 bp, Homo sapiens
  misc_feature 1..288: note = chr5:1034312-1034600
  misc_feature 1..288: note = hypo
  source 1..288: mol_type = genomic DNA
taggaggcgaggtcccggcccccacgtccccccacaggcactccagtgcgatgtctcggtggaggaggacgaccgccaggagtggacgttcacgctctatgactttgacaactgcgggaaggtcaccagggaggtaggtgagcttgtgtttgcgtcaggtccacagtagtagacagacggggcagacagactgtgctggcctcgcgatacctcagggggcaggaggggacctgcctgctgcgaggtcctcatgccagctgggcttgcgtctccccagggcccagttca

SEQ ID NO: 60927 - DNA, 82 bp, Homo sapiens
  misc_feature 1..82: note = chr5:1034653-1034735
  misc_feature 1..82: note = hypo
  source 1..82: mol_type = genomic DNA
cactgcaaggctgccctcagggcactggaggcgctcacagggccacctgggcagacccaggctgctccgagaagatgcctgt

SEQ ID NO: 60928 - DNA, 30 bp, Homo sapiens; identical to SEQ ID NO: 40413
  misc_feature 1..30: note = chr5:1039154-1039184
  misc_feature 1..30: note = hypo
  source 1..30: mol_type = genomic DNA

SEQ ID NO: 60929 - DNA, 836 bp, Homo sapiens; identical to SEQ ID NO: 40414
  misc_feature 1..836: note = chr5:1073480-1074316
  misc_feature 1..836: note = hypo
  source 1..836: mol_type = genomic DNA

SEQ ID NO: 60930 - skipped

SEQ ID NO: 60931 - DNA, 125 bp, Homo sapiens; identical to SEQ ID NO: 5026
  misc_feature 1..125: note = chr5:1174263-1174388
  misc_feature 1..125: note = hypo
  source 1..125: mol_type = genomic DNA

SEQ ID NO: 60932 - DNA, 70 bp, Homo sapiens; identical to SEQ ID NO: 40417
  misc_feature 1..70: note = chr5:1189557-1189627
  misc_feature 1..70: note = hypo
  source 1..70: mol_type = genomic DNA

SEQ ID NO: 60933 - DNA, 21 bp, Homo sapiens
  misc_feature 1..21: note = chr5:1193360-1193381
  misc_feature 1..21: note = hypo
  source 1..21: mol_type = genomic DNA
agaggagggacaggccgtgag

SEQ ID NO: 60934 - DNA, 108 bp, Homo sapiens
  misc_feature 1..108: note = chr5:1193772-1193880
  misc_feature 1..108: note = hypo
  source 1..108: mol_type = genomic DNA
tacctcggagaactccgggcatgaatgtgcgaaaggcaggaacagacgtccacggcggctttcatcctcatggcgcaaacgggacccctaccgtcagcaatggagccg

SEQ ID NO: 60935 - DNA, 43 bp, Homo sapiens
  misc_feature 1..43: note = chr5:1193944-1193987
  misc_feature 1..43: note = hypo
  source 1..43: mol_type = genomic DNA
tctgagcggaacagcgagccacctgcagcgtccagctcgagac

SEQ ID NO: 60936 - DNA, 55 bp, Homo sapiens
  misc_feature 1..55: note = chr5:1221142-1221197
  misc_feature 1..55: note = hypo
  source 1..55: mol_type = genomic DNA
ctggcaaggggaggccgggcacctcgcagcacaccatctgttcgggtagcagaac

SEQ ID NO: 60937 - DNA, 37 bp, Homo sapiens; identical to SEQ ID NO: 40421
  misc_feature 1..37: note = chr5:1223271-1223308
  misc_feature 1..37: note = hypo
  source 1..37: mol_type = genomic DNA

SEQ ID NO: 60938 - DNA, 343 bp, Homo sapiens; identical to SEQ ID NO: 40422
  misc_feature 1..343: note = chr5:1232902-1233245
  misc_feature 1..343: note = hypo
  source 1..343: mol_type = genomic DNA

SEQ ID NO: 60939 - DNA, 50 bp, Homo sapiens; identical to SEQ ID NO: 40424
  misc_feature 1..50: note = chr5:1346659-1346709
  misc_feature 1..50: note = hypo
  source 1..50: mol_type = genomic DNA

SEQ ID NO: 60940 - DNA, 30 bp, Homo sapiens; identical to SEQ ID NO: 40425
  misc_feature 1..30: note = chr5:1362773-1362803
  misc_feature 1..30: note = hypo
  source 1..30: mol_type = genomic DNA

SEQ ID NO: 60941 - DNA, 27 bp, Homo sapiens
  misc_feature 1..27: note = chr5:1381058-1381085
  misc_feature 1..27: note = hypo
  source 1..27: mol_type = genomic DNA
atgggacgccacatccgccagcaccct

SEQ ID NO: 60942 - DNA, 87 bp, Homo sapiens; identical to SEQ ID NO: 40427
  misc_feature 1..87: note = chr5:1381145-1381232
  misc_feature 1..87: note = hypo
  source 1..87: mol_type = genomic DNA

SEQ ID NO: 60943 - DNA, 41 bp, Homo sapiens; identical to SEQ ID NO: 40428
  misc_feature 1..41: note = chr5:1384936-1384977
  misc_feature 1..41: note = hypo
  source 1..41: mol_type = genomic DNA

SEQ ID NO: 60944 - DNA, 40 bp, Homo sapiens; identical to SEQ ID NO: 40429
  misc_feature 1..40: note = chr5:1406427-1406467
  misc_feature 1..40: note = hypo
  source 1..40: mol_type = genomic DNA

SEQ ID NO: 60945 - DNA, 30 bp, Homo sapiens; identical to SEQ ID NO: 40430
  misc_feature 1..30: note = chr5:1422106-1422136
  misc_feature 1..30: note = hypo
  source 1..30: mol_type = genomic DNA

SEQ ID NO: 60946 - DNA, 30 bp, Homo sapiens; identical to SEQ ID NO: 40431
  misc_feature 1..30: note = chr5:1662561-1662591
  misc_feature 1..30: note = hypo
  source 1..30: mol_type = genomic DNA

SEQ ID NO: 60947 - DNA, 90 bp, Homo sapiens; identical to SEQ ID NO: 40432
  misc_feature 1..90: note = chr5:1662801-1662891
  misc_feature 1..90: note = hypo
  source 1..90: mol_type = genomic DNA

SEQ ID NO: 60948 - DNA, 30 bp, Homo sapiens; identical to SEQ ID NO: 40433
  misc_feature 1..30: note = chr5:1704607-1704637
  misc_feature 1..30: note = hypo
  source 1..30: mol_type = genomic DNA

SEQ ID NO: 60949 - DNA, 35 bp, Homo sapiens; identical to SEQ ID NO: 40434
  misc_feature 1..35: note = chr5:1746022-1746057
  misc_feature 1..35: note = hypo
  source 1..35: mol_type = genomic DNA

SEQ ID NO: 60950 - DNA, 569 bp, Homo sapiens
  misc_feature 1..569: note = chr5:1746453-1747022
  misc_feature 1..569: note = hypo
  source 1..569: mol_type = genomic DNA
ccaaggagggcagttcgctccggggcacctgtcaggggccccacacggctgcttttaggccaggggtggcaaagacgctgctgccgcctgctctgggctcggctcccatggctgtgaaggaccctcgtcactccccgtcgcctgcctgggctgcccggggaccctcctgctgcgtcagcacagagcctggaaccgcggccaaggcaggaagctcccctgtgaaggcaccaagcacggcagacgccctcacatcgccggggcccgtttccctgtggacgggaagtgggaacgtgacgtggacgtgacgtgggaacgtaacgtgacgtgacgtgacgtgacgtggcatggcgcgaggacagcgcggcgggagcggcgcctcagatccagcagggagggagacgaaaggcggatggaagaggggcccccggaccccgcccctcgaggcttgtgtgccgccctggctgcggcgttctgggcgacgggaaacagagtcaggacacagaccagggagggccggggcagagccagggcacctgcgggcgaggacggctgggtgctgggtccccggc

SEQ ID NO: 60951 - DNA, 79 bp, Homo sapiens
  misc_feature 1..79: note = chr5:1747098-1747177
  misc_feature 1..79: note = hypo
  source 1..79: mol_type = genomic DNA
caccacagcggaagtcggtctctctcatcctggagtccgcgcggctgagggcgaggtgtccttccgggggccctgaggg

SEQ ID NO: 60952 - DNA, 86 bp, Homo sapiens; identical to SEQ ID NO: 40436
  misc_feature 1..86: note = chr5:1749854-1749940
  misc_feature 1..86: note = hypo
  source 1..86: mol_type = genomic DNA

SEQ ID NO: 60953 - DNA, 30 bp, Homo sapiens; identical to SEQ ID NO: 40437
  misc_feature 1..30: note = chr5:1750588-1750618
  misc_feature 1..30: note = hypo
  source 1..30: mol_type = genomic DNA

SEQ ID NO: 60954 - DNA, 30 bp, Homo sapiens; identical to SEQ ID NO: 40438
  misc_feature 1..30: note = chr5:1780761-1780791
  misc_feature 1..30: note = hypo
  source 1..30: mol_type = genomic DNA

SEQ ID NO: 60955 - DNA, 30 bp, Homo sapiens; identical to SEQ ID NO: 40439
  misc_feature 1..30: note = chr5:1794613-1794643
  misc_feature 1..30: note = hypo
  source 1..30: mol_type = genomic DNA

SEQ ID NO: 60956 - DNA, 228 bp, Homo sapiens; identical to SEQ ID NO: 40440
  misc_feature 1..228: note = chr5:1795233-1795461
  misc_feature 1..228: note = hypo
  source 1..228: mol_type = genomic DNA

SEQ ID NO: 60957 - DNA, 194 bp, Homo sapiens; identical to SEQ ID NO: 40441
  misc_feature 1..194: note = chr5:1865547-1865741
  misc_feature 1..194: note = hypo
  source 1..194: mol_type = genomic DNA

SEQ ID NO: 60958 - DNA, 34 bp, Homo sapiens; identical to SEQ ID NO: 40442
  misc_feature 1..34: note = chr5:1869209-1869243
  misc_feature 1..34: note = hypo
  source 1..34: mol_type = genomic DNA

SEQ ID NO: 60959 - DNA, 39 bp, Homo sapiens; identical to SEQ ID NO: 40443
  misc_feature 1..39: note = chr5:1923035-1923074
  misc_feature 1..39: note = hypo
  source 1..39: mol_type = genomic DNA

SEQ ID NO: 60960 - DNA, 138 bp, Homo sapiens; identical to SEQ ID NO: 40444
  misc_feature 1..138: note = chr5:1949531-1949669
  misc_feature 1..138: note = hypo
  source 1..138: mol_type = genomic DNA

SEQ ID NO: 60961 - DNA, 28 bp, Homo sapiens
  misc_feature 1..28: note = chr5:1950766-1950794
  misc_feature 1..28: note = hypo
  source 1..28: mol_type = genomic DNA
tctgaaacagcccctcggcagcttcacg

SEQ ID NO: 60962 - DNA, 277 bp, Homo sapiens
  misc_feature 1..277: note = chr5:1950960-1951237
  misc_feature 1..277: note = hypo
  source 1..277: mol_type = genomic DNA
gtgcatgcctgcgtcatctgctgtgtatgtgtcatctgttgtgcatgcgtgtgtcgtctgctgtgggcgcgtgagtcatctgctctgtgtgcttgtgccgtctgctgtgcctgcgtcatcgtctgctgtgcgtgtgtcatctgtgcgtgtgtcatctgctgtgcgtgagtcatctgctgtgcgtgtgtcatctgtgcgtgtgtcatctgctgtgcgtgcgtgtgccctctactgtgggtgtgttcatcatctgctgtgcgtgcgttgtctgctgtgc

SEQ ID NO: 60963 - DNA, 110 bp, Homo sapiens; identical to SEQ ID NO: 40446
  misc_feature 1..110: note = chr5:1951574-1951684
  misc_feature 1..110: note = hypo
  source 1..110: mol_type = genomic DNA

SEQ ID NO: 60964 - DNA, 35 bp, Homo sapiens; identical to SEQ ID NO: 40447
  misc_feature 1..35: note = chr5:2112239-2112274
  misc_feature 1..35: note = hypo
  source 1..35: mol_type = genomic DNA

SEQ ID NO: 60965 - DNA, 408 bp, Homo sapiens; identical to SEQ ID NO: 40448
  misc_feature 1..408: note = chr5:2136910-2137318
  misc_feature 1..408: note = hypo
  source 1..408: mol_type = genomic DNA

SEQ ID NO: 60966 - DNA, 37 bp, Homo sapiens; identical to SEQ ID NO: 40449
  misc_feature 1..37: note = chr5:2180638-2180675
  misc_feature 1..37: note = hypo
  source 1..37: mol_type = genomic DNA

SEQ ID NO: 60967 - DNA, 30 bp, Homo sapiens; identical to SEQ ID NO: 40450
  misc_feature 1..30: note = chr5:2199933-2199963
  misc_feature 1..30: note = hypo
  source 1..30: mol_type = genomic DNA

SEQ ID NO: 60968 - DNA, 127 bp, Homo sapiens; identical to SEQ ID NO: 40451
  misc_feature 1..127: note = chr5:2261622-2261749
  misc_feature 1..127: note = hypo
  source 1..127: mol_type = genomic DNA

SEQ ID NO: 60969 - DNA, 68 bp, Homo sapiens; identical to SEQ ID NO: 14739
  misc_feature 1..68: note = chr5:2369614-2369682
  misc_feature 1..68: note = hypo
  source 1..68: mol_type = genomic DNA

SEQ ID NO: 60970 - DNA, 164 bp, Homo sapiens; identical to SEQ ID NO: 40454
  misc_feature 1..164: note = chr5:2374826-2374990
  misc_feature 1..164: note = hypo
  source 1..164: mol_type = genomic DNA

SEQ ID NO: 60971 - DNA, 30 bp, Homo sapiens; identical to SEQ ID NO: 40455
  misc_feature 1..30: note = chr5:2493697-2493727
  misc_feature 1..30: note = hypo
  source 1..30: mol_type = genomic DNA

SEQ ID NO: 60972 - DNA, 184 bp, Homo sapiens; identical to SEQ ID NO: 40456
  misc_feature 1..184: note = chr5:2523567-2523751
  misc_feature 1..184: note = hypo
  source 1..184: mol_type = genomic DNA

SEQ ID NO: 60973 - skipped

SEQ ID NO: 60974 - DNA, 32 bp, Homo sapiens
  misc_feature 1..32: note = chr5:2541611-2541643
  misc_feature 1..32: note = hypo
  source 1..32: mol_type = genomic DNA
gtgccgactctgatgtgcgtgtctatgtattg

SEQ ID NO: 60975 - DNA, 30 bp, Homo sapiens; identical to SEQ ID NO: 40458
  misc_feature 1..30: note = chr5:2547162-2547192
  misc_feature 1..30: note = hypo
  source 1..30: mol_type = genomic DNA

SEQ ID NO: 60976 - DNA, 30 bp, Homo sapiens; identical to SEQ ID NO: 40459
  misc_feature 1..30: note = chr5:2865625-2865655
  misc_feature 1..30: note = hypo
  source 1..30: mol_type = genomic DNA

SEQ ID NO: 60977 - DNA, 50 bp, Homo sapiens; identical to SEQ ID NO: 40460
  misc_feature 1..50: note = chr5:2890843-2890893
  misc_feature 1..50: note = hypo
  source 1..50: mol_type = genomic DNA

SEQ ID NO: 60978 - DNA, 30 bp, Homo sapiens; identical to SEQ ID NO: 40461
  misc_feature 1..30: note = chr5:3027341-3027371
  misc_feature 1..30: note = hypo
  source 1..30: mol_type = genomic DNA

SEQ ID NO: 60979 - DNA, 36 bp, Homo sapiens
  misc_feature 1..36: note = chr5:3031843-3031879
  misc_feature 1..36: note = hypo
  source 1..36: mol_type = genomic DNA
ctgccaggggttcagcggggaggcagtgagcaggcc

SEQ ID NO: 60980 - DNA, 56 bp, Homo sapiens
  misc_feature 1..56: note = chr5:3032018-3032074
  misc_feature 1..56: note = hypo
  source 1..56: mol_type = genomic DNA
aatcacccgtcactgtggctcatcccttgtgaccaagctgccgcacagagcagggt

SEQ ID NO: 60981 - DNA, 134 bp, Homo sapiens; identical to SEQ ID NO: 40464
  misc_feature 1..134: note = chr5:3221047-3221181
  misc_feature 1..134: note = hypo
  source 1..134: mol_type = genomic DNA

SEQ ID NO: 60982 - DNA, 30 bp, Homo sapiens; identical to SEQ ID NO: 40465
  misc_feature 1..30: note = chr5:3269777-3269807
  misc_feature 1..30: note = hypo
  source 1..30: mol_type = genomic DNA

SEQ ID NO: 60983 - DNA, 198 bp, Homo sapiens; identical to SEQ ID NO: 24127
  misc_feature 1..198: note = chr5:3324844-3325042
  misc_feature 1..198: note = hypo
  source 1..198: mol_type = genomic DNA

SEQ ID NO: 60984 - DNA, 30 bp, Homo sapiens; identical to SEQ ID NO: 40467
  misc_feature 1..30: note = chr5:3422389-3422419
  misc_feature 1..30: note = hypo
  source 1..30: mol_type = genomic DNA

SEQ ID NO: 60985 - DNA, 75 bp, Homo sapiens; identical to SEQ ID NO: 40468
  misc_feature 1..75: note = chr5:3454354-3454429
  misc_feature 1..75: note = hypo
  source 1..75: mol_type = genomic DNA

SEQ ID NO: 60986 - skipped

SEQ ID NO: 60987 - DNA, 225 bp, Homo sapiens; identical to SEQ ID NO: 40470
  misc_feature 1..225: note = chr5:3740792-3741017
  misc_feature 1..225: note = hypo
  source 1..225: mol_type = genomic DNA

SEQ ID NO: 60988 - DNA, 30 bp, Homo sapiens; identical to SEQ ID NO: 40471
  misc_feature 1..30: note = chr5:3761119-3761149
  misc_feature 1..30: note = hypo
  source 1..30: mol_type = genomic DNA

SEQ ID NO: 60989 - DNA, 30 bp, Homo sapiens; identical to SEQ ID NO: 40472
  misc_feature 1..30: note = chr5:3761593-3761623
  misc_feature 1..30: note = hypo
  source 1..30: mol_type = genomic DNA

SEQ ID NO: 60990 - DNA, 64 bp, Homo sapiens; identical to SEQ ID NO: 40473
  misc_feature 1..64: note = chr5:3775375-3775439
  misc_feature 1..64: note = hypo
  source 1..64: mol_type = genomic DNA

SEQ ID NO: 60991 - DNA, 165 bp, Homo sapiens; identical to SEQ ID NO: 14745
  misc_feature 1..165: note = chr5:3806428-3806593
  misc_feature 1..165: note = hypo
  source 1..165: mol_type = genomic DNA

SEQ ID NO: 60992 - DNA, 149 bp, Homo sapiens; identical to SEQ ID NO: 40475
  misc_feature 1..149: note = chr5:3856433-3856582
  misc_feature 1..149: note = hypo
  source 1..149: mol_type = genomic DNA

SEQ ID NO: 60993 - DNA, 165 bp, Homo sapiens; identical to SEQ ID NO: 40476
  misc_feature 1..165: note = chr5:3859680-3859845
  misc_feature 1..165: note = hypo
  source 1..165: mol_type = genomic DNA

SEQ ID NO: 60994 - DNA, 19 bp, Homo sapiens
  misc_feature 1..19: note = chr5:3945363-3945382
  misc_feature 1..19: note = hypo
  source 1..19: mol_type = genomic DNA
taatcccagcagtttcgga

SEQ ID NO: 60995 - DNA, 186 bp, Homo sapiens; identical to SEQ ID NO: 40478
  misc_feature 1..186: note = chr5:4083874-4084060
  misc_feature 1..186: note = hypo
  source 1..186: mol_type = genomic DNA

SEQ ID NO: 60996 - DNA, 68 bp, Homo sapiens
  misc_feature 1..68: note = chr5:4144299-4144367
  misc_feature 1..68: note = hypo
  source 1..68: mol_type = genomic DNA
tcctctcaaagccgtgatattctatgcaagcaacattcatagaagcacagcttactacatgtgttctg

SEQ ID NO: 60997 - DNA, 34 bp, Homo sapiens; identical to SEQ ID NO: 40480
  misc_feature 1..34: note = chr5:4278472-4278506
  misc_feature 1..34: note = hypo
  source 1..34: mol_type = genomic DNA

SEQ ID NO: 60998 - DNA, 31 bp, Homo sapiens; identical to SEQ ID NO: 40481
  misc_feature 1..31: note = chr5:4279105-4279136
  misc_feature 1..31: note = hypo
  source 1..31: mol_type = genomic DNA

SEQ ID NO: 60999 - DNA, 33 bp, Homo sapiens; identical to SEQ ID NO: 40482
  misc_feature 1..33: note = chr5:4581296-4581329
  misc_feature 1..33: note = hypo
  source 1..33: mol_type = genomic DNA

SEQ ID NO: 61000 - DNA, 35 bp, Homo sapiens; identical to SEQ ID NO: 40483
  misc_feature 1..35: note = chr5:4629575-4629610
  misc_feature 1..35: note = hypo
  source 1..35: mol_type = genomic DNA

SEQ ID NO: 61001 - DNA, 30 bp, Homo sapiens; identical to SEQ ID NO: 40484
  misc_feature 1..30: note = chr5:4630470-4630500
  misc_feature 1..30: note = hypo
  source 1..30: mol_type = genomic DNA

SEQ ID NO: 61002 - DNA, 30 bp, Homo sapiens; identical to SEQ ID NO: 40485
  misc_feature 1..30: note = chr5:4866871-4866901
  misc_feature 1..30: note = hypo
  source 1..30: mol_type = genomic DNA

SEQ ID NO: 61003 - DNA, 30 bp, Homo sapiens; identical to SEQ ID NO: 40486
  misc_feature 1..30: note = chr5:4867541-4867571
  misc_feature 1..30: note = hypo
  source 1..30: mol_type = genomic DNA

SEQ ID NO: 61004 - DNA, 178 bp, Homo sapiens; identical to SEQ ID NO: 40487
  misc_feature 1..178: note = chr5:5296474-5296652
  misc_feature 1..178: note = hypo
  source 1..178: mol_type = genomic DNA

SEQ ID NO: 61005 - DNA, 30 bp, Homo sapiens; identical to SEQ ID NO: 40488
  misc_feature 1..30: note = chr5:5303702-5303732
  misc_feature 1..30: note = hypo
  source 1..30: mol_type = genomic DNA

SEQ ID NO: 61006 - DNA, 30 bp, Homo sapiens; identical to SEQ ID NO: 40489
  misc_feature 1..30: note = chr5:5571405-5571435
  misc_feature 1..30: note = hypo
  source 1..30: mol_type = genomic DNA

SEQ ID NO: 61007 - DNA, 30 bp, Homo sapiens; identical to SEQ ID NO: 40490
  misc_feature 1..30: note = chr5:5577581-5577611
  misc_feature 1..30: note = hypo
  source 1..30: mol_type = genomic DNA

SEQ ID NO: 61008 - DNA, 30 bp, Homo sapiens; identical to SEQ ID NO: 40491
  misc_feature 1..30: note = chr5:5652506-5652536
  misc_feature 1..30: note = hypo
  source 1..30: mol_type = genomic DNA

SEQ ID NO: 61009 - DNA, 211 bp, Homo sapiens; identical to SEQ ID NO: 40492
  misc_feature 1..211: note = chr5:5719870-5720081
  misc_feature 1..211: note = hypo
  source 1..211: mol_type = genomic DNA

SEQ ID NO: 61010 - DNA, 30 bp, Homo sapiens; identical to SEQ ID NO: 40493
  misc_feature 1..30: note = chr5:6219037-6219067
  misc_feature 1..30: note = hypo
  source 1..30: mol_type = genomic DNA

SEQ ID NO: 61011 - DNA, 30 bp, Homo sapiens; identical to SEQ ID NO: 40494
  misc_feature 1..30: note = chr5:6478603-6478633
  misc_feature 1..30: note = hypo
  source 1..30: mol_type = genomic DNA

SEQ ID NO: 61012 - DNA, 15 bp, Homo sapiens
  misc_feature 1..15: note = chr5:9011746-9011761
  misc_feature 1..15: note = hypo
  source 1..15: mol_type = genomic DNA
cgatagggggagact

SEQ ID NO: 61013 - DNA, 86 bp, Homo sapiens; identical to SEQ ID NO: 40496
  misc_feature 1..86: note = chr5:10248731-10248817
  misc_feature 1..86: note = hypo
  source 1..86: mol_type = genomic DNA

SEQ ID NO: 61014 - DNA, 167 bp, Homo sapiens; identical to SEQ ID NO: 14749
  misc_feature 1..167: note = chr5:10267279-10267446
  misc_feature 1..167: note = hypo
  source 1..167: mol_type = genomic DNA

SEQ ID NO: 61015 - DNA, 30 bp, Homo sapiens; identical to SEQ ID NO: 40498
  misc_feature 1..30: note = chr5:10269033-10269063
  misc_feature 1..30: note = hypo
  source 1..30: mol_type = genomic DNA

SEQ ID NO: 61016 - DNA, 30 bp, Homo sapiens; identical to SEQ ID NO: 40499
  misc_feature 1..30: note = chr5:10652405-10652435
  misc_feature 1..30: note = hypo
  source 1..30: mol_type = genomic DNA

SEQ ID NO: 61017 - DNA, 45 bp, Homo sapiens; identical to SEQ ID NO: 40500
  misc_feature 1..45: note = chr5:10675402-10675447
  misc_feature 1..45: note = hypo
  source 1..45: mol_type = genomic DNA

SEQ ID NO: 61018 - DNA, 30 bp, Homo sapiens; identical to SEQ ID NO: 40501
  misc_feature 1..30: note = chr5:10864262-10864292
  misc_feature 1..30: note = hypo
  source 1..30: mol_type = genomic DNA

SEQ ID NO: 61019 - DNA, 30 bp, Homo sapiens; identical to SEQ ID NO: 40502
  misc_feature 1..30: note = chr5:14501805-14501835
  misc_feature 1..30: note = hypo
  source 1..30: mol_type = genomic DNA

SEQ ID NO: 61020 - DNA, 32 bp, Homo sapiens; identical to SEQ ID NO: 40503
  misc_feature 1..32: note = chr5:14732032-14732064
  misc_feature 1..32: note = hypo
  source 1..32: mol_type = genomic DNA

SEQ ID NO: 61021 - DNA, 30 bp, Homo sapiens; identical to SEQ ID NO: 40504
  misc_feature 1..30: note = chr5:14756455-14756485
  misc_feature 1..30: note = hypo
  source 1..30: mol_type = genomic DNA

SEQ ID NO: 61022 - DNA, 83 bp, Homo sapiens; identical to SEQ ID NO: 40505
  misc_feature 1..83: note = chr5:14764724-14764807
  misc_feature 1..83: note = hypo
  source 1..83: mol_type = genomic DNA

SEQ ID NO: 61023 - DNA, 19 bp, Homo sapiens
  misc_feature 1..19: note = chr5:14774559-14774578
  misc_feature 1..19: note = hypo
  source 1..19: mol_type = genomic DNA
tcctcaagacacagtcgcg

SEQ ID NO: 61024 - DNA, 19 bp, Homo sapiens
  misc_feature 1..19: note = chr5:14774698-14774717
  misc_feature 1..19: note = hypo
  source 1..19: mol_type = genomic DNA
acaacgcctggctaatcat

SEQ ID NO: 61025 - DNA, 27 bp, Homo sapiens
  misc_feature 1..27: note = chr5:15503239-15503266
  misc_feature 1..27: note = hypo
  source 1..27: mol_type = genomic DNA
atagctgaggtcgggcgcggtggccca

SEQ ID NO: 61026 - DNA, 79 bp, Homo sapiens; identical to SEQ ID NO: 40509
  misc_feature 1..79: note = chr5:16032731-16032810
  misc_feature 1..79: note = hypo
  source 1..79: mol_type = genomic DNA

SEQ ID NO: 61027 - DNA, 78 bp, Homo sapiens; identical to SEQ ID NO: 14754
  misc_feature 1..78: note = chr5:16436327-16436405
  misc_feature 1..78: note = hypo
  source 1..78: mol_type = genomic DNA

SEQ ID NO: 61028 - DNA, 30 bp, Homo sapiens; identical to SEQ ID NO: 40511
  misc_feature 1..30: note = chr5:16744496-16744526
  misc_feature 1..30: note = hypo
  source 1..30: mol_type = genomic DNA

SEQ ID NO: 61029 - DNA, 182 bp, Homo sapiens; identical to SEQ ID NO: 40512
  misc_feature 1..182: note = chr5:16809241-16809423
  misc_feature 1..182: note = hypo
  source 1..182: mol_type = genomic DNA

SEQ ID NO: 61030 - DNA, 30 bp, Homo sapiens; identical to SEQ ID NO: 40514
  misc_feature 1..30: note = chr5:17327404-17327434
  misc_feature 1..30: note = hypo
  source 1..30: mol_type = genomic DNA

SEQ ID NO: 61031 - DNA, 30 bp, Homo sapiens; identical to SEQ ID NO: 40515
  misc_feature 1..30: note = chr5:17492138-17492168
  misc_feature 1..30: note = hypo
  source 1..30: mol_type = genomic DNA

SEQ ID NO: 61032 - DNA, 68 bp, Homo sapiens; identical to SEQ ID NO: 40516
  misc_feature 1..68: note = chr5:17502391-17502459
  misc_feature 1..68: note = hypo
  source 1..68: mol_type = genomic DNA

SEQ ID NO: 61033 - DNA, 30 bp, Homo sapiens; identical to SEQ ID NO: 40517
  misc_feature 1..30: note = chr5:17512058-17512088
  misc_feature 1..30: note = hypo
  source 1..30: mol_type = genomic DNA

SEQ ID NO: 61034 - DNA, 30 bp, Homo sapiens; identical to SEQ ID NO: 40518
  misc_feature 1..30: note = chr5:30694338-30694368
  misc_feature 1..30: note = hypo
  source 1..30: mol_type = genomic DNA

SEQ ID NO: 61035 - DNA, 147 bp, Homo sapiens; identical to SEQ ID NO: 40519
  misc_feature 1..147: note = chr5:31111601-31111748
  misc_feature 1..147: note = hypo
  source 1..147: mol_type = genomic DNA

SEQ ID NO: 61036 - DNA, 105 bp, Homo sapiens; identical to SEQ ID NO: 40520
  misc_feature 1..105: note = chr5:31572171-31572276
  misc_feature 1..105: note = hypo
  source 1..105: mol_type = genomic DNA

SEQ ID NO: 61037 - DNA, 28 bp, Homo sapiens
  misc_feature 1..28: note = chr5:31691652-31691680
  misc_feature 1..28: note = hypo
  source 1..28: mol_type = genomic DNA
ttctcttatctggcgccacctgctttta

SEQ ID NO: 61038 - DNA, 30 bp, Homo sapiens; identical to SEQ ID NO: 40522
  misc_feature 1..30: note = chr5:31889103-31889133
  misc_feature 1..30: note = hypo
  source 1..30: mol_type = genomic DNA

SEQ ID NO: 61039 - DNA, 30 bp, Homo sapiens; identical to SEQ ID NO: 40523
  misc_feature 1..30: note = chr5:31982994-31983024
  misc_feature 1..30: note = hypo
  source 1..30: mol_type = genomic DNA

SEQ ID NO: 61040 - DNA, 21 bp, Homo sapiens
  misc_feature 1..21: note = chr5:32526565-32526586
  misc_feature 1..21: note = hypo
  source 1..21: mol_type = genomic DNA
cttctccacgccgggcgcggt

SEQ ID NO: 61041 - DNA, 79 bp, Homo sapiens; identical to SEQ ID NO: 40525
  misc_feature 1..79: note = chr5:32750220-32750299
  misc_feature 1..79: note = hypo
  source 1..79: mol_type = genomic DNA

SEQ ID NO: 61042 - DNA, 30 bp, Homo sapiens; identical to SEQ ID NO: 40526
  misc_feature 1..30: note = chr5:32855659-32855689
  misc_feature 1..30: note = hypo
  source 1..30: mol_type = genomic DNA

SEQ ID NO: 61043 - DNA, 59 bp, Homo sapiens; identical to SEQ ID NO: 40527
  misc_feature 1..59: note = chr5:33162543-33162602
  misc_feature 1..59: note = hypo
  source 1..59: mol_type = genomic DNA

SEQ ID NO: 61044 - DNA, 25 bp, Homo sapiens
  misc_feature 1..25: note = chr5:33234426-33234451
  misc_feature 1..25: note = hypo
  source 1..25: mol_type = genomic DNA
tgagctgacacgcctggctgaattt

SEQ ID NO: 61045 - DNA, 38 bp, Homo sapiens; identical to SEQ ID NO: 40529
  misc_feature 1..38: note = chr5:33298113-33298151
  misc_feature 1..38: note = hypo
  source 1..38: mol_type = genomic DNA

SEQ ID NO: 61046 - DNA, 30 bp, Homo sapiens; identical to SEQ ID NO: 40530
  misc_feature 1..30: note = chr5:33443001-33443031
  misc_feature 1..30: note = hypo
  source 1..30: mol_type = genomic DNA

SEQ ID NO: 61047 - DNA, 197 bp, Homo sapiens; identical to SEQ ID NO: 40531
  misc_feature 1..197: note = chr5:33550087-33550284
  misc_feature 1..197: note = hypo
  source 1..197: mol_type = genomic DNA

SEQ ID NO: 61048 - DNA, 190 bp, Homo sapiens; identical to SEQ ID NO: 40532
  misc_feature 1..190: note = chr5:33880065-33880255
  misc_feature 1..190: note = hypo
  source 1..190: mol_type = genomic DNA

SEQ ID NO: 61049 - DNA, 105 bp, Homo sapiens; identical to SEQ ID NO: 40533
  misc_feature 1..105: note = chr5:34839939-34840044
  misc_feature 1..105: note = hypo
  source 1..105: mol_type = genomic DNA

SEQ ID NO: 61050 - DNA, 35 bp, Homo sapiens; identical to SEQ ID NO: 14761
  misc_feature 1..35: note = chr5:37255512-37255547
  misc_feature 1..35: note = hypo
  source 1..35: mol_type = genomic DNA

SEQ ID NO: 61051 - DNA, 16 bp, Homo sapiens
  misc_feature 1..16: note = chr5:39343165-39343181
  misc_feature 1..16: note = hypo
  source 1..16: mol_type = genomic DNA
tgaacaggaacagctc

SEQ ID NO: 61052 - DNA, 23 bp, Homo sapiens
  misc_feature 1..23: note = chr5:40190552-40190575
  misc_feature 1..23: note = hypo
  source 1..23: mol_type = genomic DNA
agccgagacggcaccagtatact

SEQ ID NO: 61053 - DNA, 30 bp, Homo sapiens; identical to SEQ ID NO: 40537
  misc_feature 1..30: note = chr5:40861757-40861787
  misc_feature 1..30: note = hypo
  source 1..30: mol_type = genomic DNA

SEQ ID NO: 61054 - DNA, 19 bp, Homo sapiens
  misc_feature 1..19: note = chr5:41777231-41777250
  misc_feature 1..19: note = hypo
  source 1..19: mol_type = genomic DNA
aaaaggggccgggtgcggt

SEQ ID NO: 61055 - DNA, 25 bp, Homo sapiens
  misc_feature 1..25: note = chr5:43105351-43105376
  misc_feature 1..25: note = hypo
  source 1..25: mol_type = genomic DNA
agcaagactccgtcccccccaaaaa

SEQ ID NO: 61056 - DNA, 17 bp, Homo sapiens
  misc_feature 1..17: note = chr5:43402630-43402647
  misc_feature 1..17: note = hypo
  source 1..17: mol_type = genomic DNA
aaaattggtgtgtgccg

SEQ ID NO: 61057 - DNA, 106 bp, Homo sapiens; identical to SEQ ID NO: 40541
  misc_feature 1..106: note = chr5:44492896-44493002
  misc_feature 1..106: note = hypo
  source 1..106: mol_type = genomic DNA

SEQ ID NO: 61058 - DNA, 43 bp, Homo sapiens; identical to SEQ ID NO: 40542
  misc_feature 1..43: note = chr5:44637083-44637126
  misc_feature 1..43: note = hypo
  source 1..43: mol_type = genomic DNA

SEQ ID NO: 61059 - DNA, 21 bp, Homo sapiens
  misc_feature 1..21: note = chr5:44939696-44939717
  misc_feature 1..21: note = hypo
  source 1..21: mol_type = genomic DNA
gaaggtggtgctgggcgcggt

SEQ ID NO: 61060 - DNA, 33 bp, Homo sapiens; identical to SEQ ID NO: 40544
  misc_feature 1..33: note = chr5:45225683-45225716
  misc_feature 1..33: note = hypo
  source 1..33: mol_type = genomic DNA

SEQ ID NO: 61061 - DNA, 39 bp, Homo sapiens; identical to SEQ ID NO: 40545
  misc_feature 1..39: note = chr5:52888052-52888091
  misc_feature 1..39: note = hypo
  source 1..39: mol_type = genomic DNA

SEQ ID NO: 61062 - DNA, 30 bp, Homo sapiens; identical to SEQ ID NO: 40546
  misc_feature 1..30: note = chr5:55309328-55309358
  misc_feature 1..30: note = hypo
  source 1..30: mol_type = genomic DNA

SEQ ID NO: 61063 - DNA, 21 bp, Homo sapiens
  misc_feature 1..21: note = chr5:63373765-63373786
  misc_feature 1..21: note = hypo
  source 1..21: mol_type = genomic DNA
taatttctggccgggcgagtt

SEQ ID NO: 61064 - DNA, 37 bp, Homo sapiens; identical to SEQ ID NO: 40548
  misc_feature 1..37: note = chr5:64860574-64860611
  misc_feature 1..37: note = hypo
  source 1..37: mol_type = genomic DNA

SEQ ID NO: 61065 - DNA, 33 bp, Homo sapiens; identical to SEQ ID NO: 40550
  misc_feature 1..33: note = chr5:67573348-67573381
  misc_feature 1..33: note = hypo
  source 1..33: mol_type = genomic DNA

SEQ ID NO: 61066 - DNA, 226 bp, Homo sapiens; identical to SEQ ID NO: 40551
  misc_feature 1..226: note = chr5:67840329-67840555
  misc_feature 1..226: note = hypo
  source 1..226: mol_type = genomic DNA

SEQ ID NO: 61067 - DNA, 17 bp, Homo sapiens
  misc_feature 1..17: note = chr5:68391002-68391019
  misc_feature 1..17: note = hypo
  source 1..17: mol_type = genomic DNA
gtaatagcattataacg

SEQ ID NO: 61068 - DNA, 35 bp, Homo sapiens; identical to SEQ ID NO: 40554
  misc_feature 1..35: note = chr5:68481446-68481481
  misc_feature 1..35: note = hypo
  source 1..35: mol_type = genomic DNA

SEQ ID NO: 61069 - DNA, 30 bp, Homo sapiens; identical to SEQ ID NO: 40555
  misc_feature 1..30: note = chr5:72175493-72175523
  misc_feature 1..30: note = hypo
  source 1..30: mol_type = genomic DNA

SEQ ID NO: 61070 - DNA, 240 bp, Homo sapiens; identical to SEQ ID NO: 40556
  misc_feature 1..240: note = chr5:72236805-72237045
  misc_feature 1..240: note = hypo
  source 1..240: mol_type = genomic DNA

SEQ ID NO: 61071 - DNA, 21 bp, Homo sapiens
  misc_feature 1..21: note = chr5:74536034-74536055
  misc_feature 1..21: note = hypo
  source 1..21: mol_type = genomic DNA
aatttttttttgagacggagt

SEQ ID NO: 61072 - DNA, 30 bp, Homo sapiens; identical to SEQ ID NO: 40558
  misc_feature 1..30: note = chr5:75819580-75819610
  misc_feature 1..30: note = hypo
  source 1..30: mol_type = genomic DNA

SEQ ID NO: 61073 - DNA, 89 bp, Homo sapiens; identical to SEQ ID NO: 40559
  misc_feature 1..89: note = chr5:75963986-75964075
  misc_feature 1..89: note = hypo
  source 1..89: mol_type = genomic DNA

SEQ ID NO: 61074 - DNA, 30 bp, Homo sapiens; identical to SEQ ID NO: 40560
  misc_feature 1..30: note = chr5:75969716-75969746
  misc_feature 1..30: note = hypo
  source 1..30: mol_type = genomic DNA

SEQ ID NO: 61075 - DNA, 30 bp, Homo sapiens; identical to SEQ ID NO: 40561
  misc_feature 1..30: note = chr5:76327167-76327197
  misc_feature 1..30: note = hypo
  source 1..30: mol_type = genomic DNA

SEQ ID NO: 61076 - DNA, 17 bp, Homo sapiens
  misc_feature 1..17: note = chr5:77047294-77047311
  misc_feature 1..17: note = hypo
  source 1..17: mol_type = genomic DNA
gccggccagcctgacca

SEQ ID NO: 61077 - DNA, 20 bp, Homo sapiens
  misc_feature 1..20: note = chr5:78469259-78469279
  misc_feature 1..20: note = hypo
  source 1..20: mol_type = genomic DNA
agtatttttctatttcgaaa

SEQ ID NO: 61078 - DNA, 115 bp, Homo sapiens; identical to SEQ ID NO: 40564
  misc_feature 1..115: note = chr5:78552615-78552730
  misc_feature 1..115: note = hypo
  source 1..115: mol_type = genomic DNA

SEQ ID NO: 61079 - DNA, 35 bp, Homo sapiens; identical to SEQ ID NO: 40565
  misc_feature 1..35: note = chr5:78881941-78881976
  misc_feature 1..35: note = hypo
  source 1..35: mol_type = genomic DNA

SEQ ID NO: 61080 - DNA, 95 bp, Homo sapiens; identical to SEQ ID NO: 40566
  misc_feature 1..95: note = chr5:78985096-78985191
  misc_feature 1..95: note = hypo
  source 1..95: mol_type = genomic DNA

SEQ ID NO: 61081 - DNA, 87 bp, Homo sapiens
  misc_feature 1..87: note = chr5:79947497-79947584
  misc_feature 1..87: note = hypo
  source 1..87: mol_type = genomic DNA
cgttaaagccactttcgtagtttattttgtatcaactggagttttttacaactcaggtgaattttagctttattgaggggaattgat

SEQ ID NO: 61082 - DNA, 77 bp, Homo sapiens
  misc_feature 1..77: note = chr5:79947707-79947784
  misc_feature 1..77: note = hypo
  source 1..77: mol_type = genomic DNA
gtttatcactgctgtctcccgtgggggtgtggctaggctaagcgttttgagctgcgttgctgcgtgcttgatacttg

SEQ ID NO: 61083 - DNA, 32 bp, Homo sapiens; identical to SEQ ID NO: 40569
  misc_feature 1..32: note = chr5:81266658-81266690
  misc_feature 1..32: note = hypo
  source 1..32: mol_type = genomic DNA

SEQ ID NO: 61084 - DNA, 16 bp, Homo sapiens
  misc_feature 1..16: note = chr5:81575049-81575065
  misc_feature 1..16: note = hypo
  source 1..16: mol_type = genomic DNA
gcgcctggccatttaa

SEQ ID NO: 61085 - DNA, 23 bp, Homo sapiens
  misc_feature 1..23: note = chr5:88304080-88304103
  misc_feature 1..23: note = hypo
  source 1..23: mol_type = genomic DNA
cgagagtccgtctcaaaaaaaaa

SEQ ID NO: 61086 - DNA, 19 bp, Homo sapiens
  misc_feature 1..19: note = chr5:88371483-88371502
  misc_feature 1..19: note = hypo
  source 1..19: mol_type = genomic DNA
cggatctcctgaggtcggg

SEQ ID NO: 61087 - skipped

SEQ ID NO: 61088 - DNA, 21 bp, Homo sapiens
  misc_feature 1..21: note = chr5:95117541-95117562
  misc_feature 1..21: note = hypo
  source 1..21: mol_type = genomic DNA
agactccgtctcaaaaaaaga

SEQ ID NO: 61089 - DNA, 30 bp, Homo sapiens; identical to SEQ ID NO: 14774
  misc_feature 1..30: note = chr5:98201074-98201104
  misc_feature 1..30: note = hypo
  source 1..30: mol_type = genomic DNA

SEQ ID NO: 61090 - DNA, 23 bp, Homo sapiens
  misc_feature 1..23: note = chr5:102048048-102048071
  misc_feature 1..23: note = hypo
  source 1..23: mol_type = genomic DNA
aagtgtggccgggcgcggtggct

SEQ ID NO: 61091 - DNA, 17 bp, Homo sapiens
  misc_feature 1..17: note = chr5:111306228-111306245
  misc_feature 1..17: note = hypo
  source 1..17: mol_type = genomic DNA
gaagtcttactgggtcg

SEQ ID NO: 61092 - DNA, 128 bp, Homo sapiens; identical to SEQ ID NO: 40578
  misc_feature 1..128: note = chr5:111813766-111813894
  misc_feature 1..128: note = hypo
  source 1..128: mol_type = genomic DNA

SEQ ID NO: 61093 - DNA, 79 bp, Homo sapiens; identical to SEQ ID NO: 40579
  misc_feature 1..79: note = chr5:111875281-111875360
  misc_feature 1..79: note = hypo
  source 1..79: mol_type = genomic DNA

SEQ ID NO: 61094 - DNA, 206 bp, Homo sapiens; identical to SEQ ID NO: 40581
  misc_feature 1..206: note = chr5:112198294-112198500
  misc_feature 1..206: note = hypo
  source 1..206: mol_type = genomic DNA

SEQ ID NO: 61095 - DNA, 32 bp, Homo sapiens; identical to SEQ ID NO: 40582
  misc_feature 1..32: note = chr5:115176272-115176304
  misc_feature 1..32: note = hypo
  source 1..32: mol_type = genomic DNA

SEQ ID NO: 61096 - DNA, 39 bp, Homo sapiens; identical to SEQ ID NO: 40583
  misc_feature 1..39: note = chr5:117258279-117258318
  misc_feature 1..39: note = hypo
  source 1..39: mol_type = genomic DNA

SEQ ID NO: 61097 - DNA, 30 bp, Homo sapiens; identical to SEQ ID NO: 14777
  misc_feature 1..30: note = chr5:126200056-126200086
  misc_feature 1..30: note = hypo
  source 1..30: mol_type = genomic DNA

SEQ ID NO: 61098 - DNA, 30 bp, Homo sapiens; identical to SEQ ID NO: 40585
  misc_feature 1..30: note = chr5:126409452-126409482
  misc_feature 1..30: note = hypo
  source 1..30: mol_type = genomic DNA

SEQ ID NO: 61099 - DNA, 30 bp, Homo sapiens; identical to SEQ ID NO: 40586
  misc_feature 1..30: note = chr5:126851264-126851294
  misc_feature 1..30: note = hypo
  source 1..30: mol_type = genomic DNA

SEQ ID NO: 61100 - DNA, 92 bp, Homo sapiens; identical to SEQ ID NO: 40587
  misc_feature 1..92: note = chr5:131305994-131306086
  misc_feature 1..92: note = hypo
  source 1..92: mol_type = genomic DNA

SEQ ID NO: 61101 - DNA, 193 bp, Homo sapiens; identical to SEQ ID NO: 40588
  misc_feature 1..193: note = chr5:131610019-131610212
  misc_feature 1..193: note = hypo
  source 1..193: mol_type = genomic DNA

SEQ ID NO: 61102 - DNA, 30 bp, Homo sapiens; identical to SEQ ID NO: 40589
  misc_feature 1..30: note = chr5:131787174-131787204
  misc_feature 1..30: note = hypo
  source 1..30: mol_type = genomic DNA

SEQ ID NO: 61103 - DNA, 83 bp, Homo sapiens; identical to SEQ ID NO: 40590
  misc_feature 1..83: note = chr5:132083881-132083964
  misc_feature 1..83: note = hypo
  source 1..83: mol_type = genomic DNA

SEQ ID NO: 61104 - DNA, 30 bp, Homo sapiens; identical to SEQ ID NO: 40591
  misc_feature 1..30: note = chr5:132201467-132201497
  misc_feature 1..30: note = hypo
  source 1..30: mol_type = genomic DNA

SEQ ID NO: 61105 - skipped

SEQ ID NO: 61106 - DNA, 46 bp, Homo sapiens; identical to SEQ ID NO: 40593
  misc_feature 1..46: note = chr5:134242196-134242242
  misc_feature 1..46: note = hypo
  source 1..46: mol_type = genomic DNA

SEQ ID NO: 61107 - DNA, 30 bp, Homo sapiens; identical to SEQ ID NO: 40594
  misc_feature 1..30: note = chr5:134583042-134583072
  misc_feature 1..30: note = hypo
  source 1..30: mol_type = genomic DNA

SEQ ID NO: 61108 - DNA, 33 bp, Homo sapiens; identical to SEQ ID NO: 40595
  misc_feature 1..33: note = chr5:137548023-137548056
  misc_feature 1..33: note = hypo
  source 1..33: mol_type = genomic DNA

SEQ ID NO: 61109 - DNA, 18 bp, Homo sapiens
  misc_feature 1..18: note = chr5:137769720-137769738
  misc_feature 1..18: note = hypo
  source 1..18: mol_type = genomic DNA
gcccgtccaacattggtg

SEQ ID NO: 61110 - DNA, 30 bp, Homo sapiens; identical to SEQ ID NO: 40597
  misc_feature 1..30: note = chr5:138273660-138273690
  misc_feature 1..30: note = hypo
  source 1..30: mol_type = genomic DNA

SEQ ID NO: 61111 - DNA, 105 bp, Homo sapiens; identical to SEQ ID NO: 40598
  misc_feature 1..105: note = chr5:138676299-138676404
  misc_feature 1..105: note = hypo
  source 1..105: mol_type = genomic DNA

SEQ ID NO: 61112 - DNA, 91 bp, Homo sapiens; identical to SEQ ID NO: 40599
  misc_feature 1..91: note = chr5:139556302-139556393
  misc_feature 1..91: note = hypo
  source 1..91: mol_type = genomic DNA

SEQ ID NO: 61113 - DNA, 29 bp, Homo sapiens
  misc_feature 1..29: note = chr5:139779106-139779135
  misc_feature 1..29: note = hypo
  source 1..29: mol_type = genomic DNA
tgagccactgcgcccggccattttttttt

SEQ ID NO: 61114 - DNA, 95 bp, Homo sapiens; identical to SEQ ID NO: 40602
  misc_feature 1..95: note = chr5:142070580-142070675
  misc_feature 1..95: note = hypo
  source 1..95: mol_type = genomic DNA

SEQ ID NO: 61115 - DNA, 158 bp, Homo sapiens; identical to SEQ ID NO: 40603
  misc_feature 1..158: note = chr5:142625575-142625733
  misc_feature 1..158: note = hypo
  source 1..158: mol_type = genomic DNA

SEQ ID NO: 61116 - DNA, 30 bp, Homo sapiens; identical to SEQ ID NO: 40604
  misc_feature 1..30: note = chr5:142689842-142689872
  misc_feature 1..30: note = hypo
  source 1..30: mol_type = genomic DNA

SEQ ID NO: 61117 - DNA, 21 bp, Homo sapiens
  misc_feature 1..21: note = chr5:147003406-147003427
  misc_feature 1..21: note = hypo
  source 1..21: mol_type = genomic DNA
gttttgtttttgaaacggaat

SEQ ID NO: 61118 - DNA, 149 bp, Homo sapiens; identical to SEQ ID NO: 40606
  misc_feature 1..149: note = chr5:149014648-149014797
  misc_feature 1..149: note = hypo
  source 1..149: mol_type = genomic DNA

SEQ ID NO: 61119 - DNA, 30 bp, Homo sapiens; identical to SEQ ID NO: 40607
  misc_feature 1..30: note = chr5:149624264-149624294
  misc_feature 1..30: note = hypo
  source 1..30: mol_type = genomic DNA

SEQ ID NO: 61120 - DNA, 30 bp, Homo sapiens; identical to SEQ ID NO: 40608
  misc_feature 1..30: note = chr5:150901687-150901717
  misc_feature 1..30: note = hypo
  source 1..30: mol_type = genomic DNA

SEQ ID NO: 61121 - DNA, 144 bp, Homo sapiens; identical to SEQ ID NO: 40609
  misc_feature 1..144: note = chr5:150911238-150911382
  misc_feature 1..144: note = hypo
  source 1..144: mol_type = genomic DNA

SEQ ID NO: 61122 - DNA, 30 bp, Homo sapiens; identical to SEQ ID NO: 14784
  misc_feature 1..30: note = chr5:151383730-151383760
  misc_feature 1..30: note = hypo
  source 1..30: mol_type = genomic DNA

SEQ ID NO: 61123 - DNA, 21 bp, Homo sapiens
  misc_feature 1..21: note = chr5:153118296-153118317
  misc_feature 1..21: note = hypo
  source 1..21: mol_type = genomic DNA
ttggagaaggcatttcgctct

SEQ ID NO: 61124 - DNA, 78 bp, Homo sapiens; identical to SEQ ID NO: 40612
  misc_feature 1..78: note = chr5:153785990-153786068
  misc_feature 1..78: note = hypo
  source 1..78: mol_type = genomic DNA

SEQ ID NO: 61125 - DNA, 193 bp, Homo sapiens
  misc_feature 1..193: note = chr5:154209733-154209926
  misc_feature 1..193: note = hypo
  source 1..193: mol_type = genomic DNA
ttgtgtaggaaaaggcgagccagactcagggaacagtgggacccacttcccggcgctgtgcaagtcagagttccttgtaagcagggtctgggcctcacttatcatggatttgccctggtgcctttcactattggtcgaattgagtatttcggaaggagaacttgtttaaaagacagccaccgcccacacattc

SEQ ID NO: 61126 - DNA, 60 bp, Homo sapiens
  misc_feature 1..60: note = chr5:154318088-154318148
  misc_feature 1..60: note = hypo
  source 1..60: mol_type = genomic DNA
ccaacgttttttgagcgctatgtgccagggcactttgctagttgtggaggtgttttaaag

SEQ ID NO: 61127 - DNA, 172 bp, Homo sapiens; identical to SEQ ID NO: 40615
  misc_feature 1..172: note = chr5:156874508-156874680
  misc_feature 1..172: note = hypo
  source 1..172: mol_type = genomic DNA

SEQ ID NO: 61128 - DNA, 12 bp, Homo sapiens
  misc_feature 1..12: note = chr5:157078407-157078419
  misc_feature 1..12: note = hypo
  source 1..12: mol_type = genomic DNA
cgagcctgcagt

SEQ ID NO: 61129 - DNA, 39 bp, Homo sapiens; identical to SEQ ID NO: 14789
  misc_feature 1..39: note = chr5:158612937-158612976
  misc_feature 1..39: note = hypo
  source 1..39: mol_type = genomic DNA

SEQ ID NO: 61130 - DNA, 28 bp, Homo sapiens
  misc_feature 1..28: note = chr5:159672080-159672108
  misc_feature 1..28: note = hypo
  source 1..28: mol_type = genomic DNA
ggtaggggctgggtgcggtggctcacgc

SEQ ID NO: 61131 - DNA, 30 bp, Homo sapiens; identical to SEQ ID NO: 40619
  misc_feature 1..30: note = chr5:159776532-159776562
  misc_feature 1..30: note = hypo
  source 1..30: mol_type = genomic DNA

SEQ ID NO: 61132 - DNA, 17 bp, Homo sapiens
  misc_feature 1..17: note = chr5:160498400-160498417
  misc_feature 1..17: note = hypo
  source 1..17: mol_type = genomic DNA
agtgccaagcatgagcg

SEQ ID NO: 61133 - DNA, 18 bp, Homo sapiens
  misc_feature 1..18: note = chr5:166363611-166363629
  misc_feature 1..18: note = hypo
  source 1..18: mol_type = genomic DNA
gcaagcagagggagccgg

SEQ ID NO: 61134 - DNA, 146 bp, Homo sapiens; identical to SEQ ID NO: 40622
  misc_feature 1..146: note = chr5:166461205-166461351
  misc_feature 1..146: note = hypo
  source 1..146: mol_type = genomic DNA

SEQ ID NO: 61135 - skipped

SEQ ID NO: 61136 - DNA, 141 bp, Homo sapiens; identical to SEQ ID NO: 14792
  misc_feature 1..141: note = chr5:168192180-168192321
  misc_feature 1..141: note = hypo
  source 1..141: mol_type = genomic DNA

SEQ ID NO: 61137 - DNA, 30 bp, Homo sapiens; identical to SEQ ID NO: 40625
  misc_feature 1..30: note = chr5:168231749-168231779
  misc_feature 1..30: note = hypo
  source 1..30: mol_type = genomic DNA

SEQ ID NO: 61138 - DNA, 48 bp, Homo sapiens
  misc_feature 1..48: note = chr5:168233348-168233396
  misc_feature 1..48: note = hypo
  source 1..48: mol_type = genomic DNA
tccagcagccccacacgctgatggcctagtgggtgatgggctgggaca

SEQ ID NO: 61139 - DNA, 47 bp, Homo sapiens
  misc_feature 1..47: note = chr5:168233482-168233529
  misc_feature 1..47: note = hypo
  source 1..47: mol_type = genomic DNA
aatctccatcaagccctttcctcgacagtccacgatgttattgctgc

SEQ ID NO: 61140 - DNA, 30 bp, Homo sapiens; identical to SEQ ID NO: 40627
  misc_feature 1..30: note = chr5:168253336-168253366
  misc_feature 1..30: note = hypo
  source 1..30: mol_type = genomic DNA

SEQ ID NO: 61141 - DNA, 30 bp, Homo sapiens; identical to SEQ ID NO: 14793
  misc_feature 1..30: note = chr5:168268106-168268136
  misc_feature 1..30: note = hypo
  source 1..30: mol_type = genomic DNA

SEQ ID NO: 61142 - DNA, 23 bp, Homo sapiens
  misc_feature 1..23: note = chr5:168289195-168289218
  misc_feature 1..23: note = hypo
  source 1..23: mol_type = genomic DNA
tggactttggggactcgggggaa

SEQ ID NO: 61143 - DNA, 33 bp, Homo sapiens; identical to SEQ ID NO: 40630
  misc_feature 1..33: note = chr5:168337451-168337484
  misc_feature 1..33: note = hypo
  source 1..33: mol_type = genomic DNA

SEQ ID NO: 61144 - DNA, 30 bp, Homo sapiens; identical to SEQ ID NO: 14795
  misc_feature 1..30: note = chr5:169157436-169157466
  misc_feature 1..30: note = hypo
  source 1..30: mol_type = genomic DNA

SEQ ID NO: 61145 - DNA, 143 bp, Homo sapiens; identical to SEQ ID NO: 40633
  misc_feature 1..143: note = chr5:169658356-169658499
  misc_feature 1..143: note = hypo
  source 1..143: mol_type = genomic DNA

SEQ ID NO: 61146 - DNA, 51 bp, Homo sapiens; identical to SEQ ID NO: 40634
  misc_feature 1..51: note = chr5:169660169-169660220
  misc_feature 1..51: note = hypo
  source 1..51: mol_type = genomic DNA

SEQ ID NO: 61147 - DNA, 30 bp, Homo sapiens; identical to SEQ ID NO: 40635
  misc_feature 1..30: note = chr5:169932029-169932059
  misc_feature 1..30: note = hypo
  source 1..30: mol_type = genomic DNA

SEQ ID NO: 61148 - DNA, 41 bp, Homo sapiens; identical to SEQ ID NO: 40636
  misc_feature 1..41: note = chr5:170811632-170811673
  misc_feature 1..41: note = hypo
  source 1..41: mol_type = genomic DNA

SEQ ID NO: 61149 - DNA, 71 bp, Homo sapiens; identical to SEQ ID NO: 40637
  misc_feature 1..71: note = chr5:170919575-170919646
  misc_feature 1..71: note = hypo
  source 1..71: mol_type = genomic DNA

SEQ ID NO: 61150 - DNA, 66 bp, Homo sapiens; identical to SEQ ID NO: 40638
  misc_feature 1..66: note = chr5:171247586-171247652
  misc_feature 1..66: note = hypo
  source 1..66: mol_type = genomic DNA

SEQ ID NO: 61151 - DNA, 39 bp, Homo sapiens; identical to SEQ ID NO: 40639
  misc_feature 1..39: note = chr5:171533619-171533658
  misc_feature 1..39: note = hypo
  source 1..39: mol_type = genomic DNA

SEQ ID NO: 61152 - DNA, 85 bp, Homo sapiens; identical to SEQ ID NO: 40640
  misc_feature 1..85: note = chr5:172235687-172235772
  misc_feature 1..85: note = hypo
  source 1..85: mol_type = genomic DNA

SEQ ID NO: 61153 - DNA, 21 bp, Homo sapiens
  misc_feature 1..21: note = chr5:172384977-172384998
  misc_feature 1..21: note = hypo
  source 1..21: mol_type = genomic DNA
tattagtaggccaggcgcagt

SEQ ID NO: 61154 - DNA, 81 bp, Homo sapiens; identical to SEQ ID NO: 40642
  misc_feature 1..81: note = chr5:172385298-172385379
  misc_feature 1..81: note = hypo
  source 1..81: mol_type = genomic DNA

SEQ ID NO: 61155 - DNA, 196 bp, Homo sapiens; identical to SEQ ID NO: 40643
  misc_feature 1..196: note = chr5:172704334-172704530
  misc_feature 1..196: note = hypo
  source 1..196: mol_type = genomic DNA

SEQ ID NO: 61156 - DNA, 30 bp, Homo sapiens; identical to SEQ ID NO: 40644
  misc_feature 1..30: note = chr5:174110957-174110987
  misc_feature 1..30: note = hypo
  source 1..30: mol_type = genomic DNA

SEQ ID NO: 61157 - DNA, 30 bp, Homo sapiens; identical to SEQ ID NO: 40645
  misc_feature 1..30: note = chr5:175115079-175115109
  misc_feature 1..30: note = hypo
  source 1..30: mol_type = genomic DNA

SEQ ID NO: 61158 - DNA, 136 bp, Homo sapiens; identical to SEQ ID NO: 40646
  misc_feature 1..136: note = chr5:175605006-175605142
  misc_feature 1..136: note = hypo
  source 1..136: mol_type = genomic DNA

SEQ ID NO: 61159 - DNA, 30 bp, Homo sapiens; identical to SEQ ID NO: 14798
  misc_feature 1..30: note = chr5:175610717-175610747
  misc_feature 1..30: note = hypo
  source 1..30: mol_type = genomic DNA

SEQ ID NO: 61160 - DNA, 17 bp, Homo sapiens
  misc_feature 1..17: note = chr5:175876289-175876306
  misc_feature 1..17: note = hypo
  source 1..17: mol_type = genomic DNA
cccccaggccaggagcg

SEQ ID NO: 61161 - DNA, 17 bp, Homo sapiens
  misc_feature 1..17: note = chr5:175876606-175876623
  misc_feature 1..17: note = hypo
  source 1..17: mol_type = genomic DNA
ttcgggagatcaaatgg

SEQ ID NO: 61162 - DNA, 19 bp, Homo sapiens
  misc_feature 1..19: note = chr5:175879322-175879341
  misc_feature 1..19: note = hypo
  source 1..19: mol_type = genomic DNA
tgctcggattacaggcgtg

SEQ ID NO: 61163 - DNA, 30 bp, Homo sapiens; identical to SEQ ID NO: 14801
  misc_feature 1..30: note = chr5:175924856-175924886
  misc_feature 1..30: note = hypo
  source 1..30: mol_type = genomic DNA

SEQ ID NO: 61164 - DNA, 64 bp, Homo sapiens; identical to SEQ ID NO: 40653
  misc_feature 1..64: note = chr5:175971806-175971870
  misc_feature 1..64: note = hypo
  source 1..64: mol_type = genomic DNA

SEQ ID NO: 61165 - DNA, 30 bp, Homo sapiens; identical to SEQ ID NO: 14803
  misc_feature 1..30: note = chr5:175975036-175975066
  misc_feature 1..30: note = hypo
  source 1..30: mol_type = genomic DNA

SEQ ID NO: 61166 - DNA, 32 bp, Homo sapiens; identical to SEQ ID NO: 40655
  misc_feature 1..32: note = chr5:175978988-175979020
  misc_feature 1..32: note = hypo
  source 1..32: mol_type = genomic DNA

SEQ ID NO: 61167 - DNA, 106 bp, Homo sapiens; identical to SEQ ID NO: 40656
  misc_feature 1..106: note = chr5:176225880-176225986
  misc_feature 1..106: note = hypo
  source 1..106: mol_type = genomic DNA

SEQ ID NO: 61168 - DNA, 30 bp, Homo sapiens; identical to SEQ ID NO: 40657
  misc_feature 1..30: note = chr5:176289703-176289733
  misc_feature 1..30: note = hypo
  source 1..30: mol_type = genomic DNA

SEQ ID NO: 61169 - DNA, 30 bp, Homo sapiens; identical to SEQ ID NO: 40658
  misc_feature 1..30: note = chr5:176295217-176295247
  misc_feature 1..30: note = hypo
  source 1..30: mol_type = genomic DNA

SEQ ID NO: 61170 - DNA, 188 bp, Homo sapiens; identical to SEQ ID NO: 40659
  misc_feature 1..188: note = chr5:176315326-176315514
  misc_feature 1..188: note = hypo
  source 1..188: mol_type = genomic DNA

SEQ ID NO: 61171 - DNA, 34 bp, Homo sapiens; identical to SEQ ID NO: 40660
  misc_feature 1..34: note = chr5:176558851-176558885
  misc_feature 1..34: note = hypo
  source 1..34: mol_type = genomic DNA

SEQ ID NO: 61172 - DNA, 163 bp, Homo sapiens; identical to SEQ ID NO: 40661
  misc_feature 1..163: note = chr5:176795125-176795288
  misc_feature 1..163: note = hypo
  source 1..163: mol_type = genomic DNA

SEQ ID NO: 61173 - DNA, 99 bp, Homo sapiens; identical to SEQ ID NO: 40662
  misc_feature 1..99: note = chr5:177019952-177020051
  misc_feature 1..99: note = hypo
  source 1..99: mol_type = genomic DNA

SEQ ID NO: 61174 - DNA, 207 bp, Homo sapiens
  misc_feature 1..207: note = chr5:177031197-177031404
  misc_feature 1..207: note = hypo
  source 1..207: mol_type = genomic DNA
cggcctccctcggaagtgttccgtcttccacctgttcgtggcctgcctctcgctgggcttcttctccctactctggctgcagctcagctgctctggggacgtggcccgggcagtcaggggacaagggcaggagacctcgggccctccccgtgcctgccccccagagccgccccctgagcactgggaagaagacgcatcctggggccc

SEQ ID NO: 61175 - DNA, 25 bp, Homo sapiens
  misc_feature 1..25: note = chr5:177513856-177513881
  misc_feature 1..25: note = hypo
  source 1..25: mol_type = genomic DNA
tatttttttttgagacggagtctgt

SEQ ID NO: 61176 - DNA, 30 bp, Homo sapiens; identical to SEQ ID NO: 40665
  misc_feature 1..30: note = chr5:177673744-177673774
  misc_feature 1..30: note = hypo
  source 1..30: mol_type = genomic DNA

SEQ ID NO: 61177 - DNA, 37 bp, Homo sapiens; identical to SEQ ID NO: 24183
  misc_feature 1..37: note = chr5:177713468-177713505
  misc_feature 1..37: note = hypo
  source 1..37: mol_type = genomic DNA

SEQ ID NO: 61178 - DNA, 181 bp, Homo sapiens; identical to SEQ ID NO: 40667
  misc_feature 1..181: note = chr5:177851456-177851637
  misc_feature 1..181: note = hypo
  source 1..181: mol_type = genomic DNA

SEQ ID NO: 61179 - DNA, 55 bp, Homo sapiens; identical to SEQ ID NO: 40668
  misc_feature 1..55: note = chr5:177890891-177890946
  misc_feature 1..55: note = hypo
  source 1..55: mol_type = genomic DNA

SEQ ID NO: 61180 - DNA, 30 bp, Homo sapiens; identical to SEQ ID NO: 14810
  misc_feature 1..30: note = chr5:177982679-177982709
  misc_feature 1..30: note = hypo
  source 1..30: mol_type = genomic DNA

SEQ ID NO: 61181 - DNA, 139 bp, Homo sapiens; identical to SEQ ID NO: 40670
  misc_feature 1..139: note = chr5:177984059-177984198
  misc_feature 1..139: note = hypo
  source 1..139: mol_type = genomic DNA

SEQ ID NO: 61182 - DNA, 153 bp, Homo sapiens; identical to SEQ ID NO: 40671
  misc_feature 1..153: note = chr5:178112320-178112473
  misc_feature 1..153: note = hypo
  source 1..153: mol_type = genomic DNA

SEQ ID NO: 61183 - DNA, 165 bp, Homo sapiens; identical to SEQ ID NO: 40672
  misc_feature 1..165: note = chr5:178288343-178288508
  misc_feature 1..165: note = hypo
  source 1..165: mol_type = genomic DNA

SEQ ID NO: 61184 - DNA, 30 bp, Homo sapiens; identical to SEQ ID NO: 40673
  misc_feature 1..30: note = chr5:178373124-178373154
  misc_feature 1..30: note = hypo
  source 1..30: mol_type = genomic DNA

SEQ ID NO: 61185 - DNA, 53 bp, Homo sapiens; identical to SEQ ID NO: 40674
  misc_feature 1..53: note = chr5:178409990-178410043
  misc_feature 1..53: note = hypo
  source 1..53: mol_type = genomic DNA

SEQ ID NO: 61186 - DNA, 110 bp, Homo sapiens; identical to SEQ ID NO: 40675
  misc_feature 1..110: note = chr5:178411620-178411730
  misc_feature 1..110: note = hypo
  source 1..110: mol_type = genomic DNA

SEQ ID NO: 61187 - DNA, 143 bp, Homo sapiens; identical to SEQ ID NO: 40676
  misc_feature 1..143: note = chr5:178416053-178416196
  misc_feature 1..143: note = hypo
  source 1..143: mol_type = genomic DNA

SEQ ID NO: 61188 - DNA, 99 bp, Homo sapiens; identical to SEQ ID NO: 40677
  misc_feature 1..99: note = chr5:178478886-178478985
  misc_feature 1..99: note = hypo
  source 1..99: mol_type = genomic DNA

SEQ ID NO: 61189 - DNA, 90 bp, Homo sapiens; identical to SEQ ID NO: 40678
  misc_feature 1..90: note = chr5:178481810-178481900
  misc_feature 1..90: note = hypo
  source 1..90: mol_type = genomic DNA

SEQ ID NO: 61190 - DNA, 130 bp, Homo sapiens; identical to SEQ ID NO: 40679
  misc_feature 1..130: note = chr5:178561609-178561739
  misc_feature 1..130: note = hypo
  source 1..130: mol_type = genomic DNA

SEQ ID NO: 61191 - DNA, 41 bp, Homo sapiens; identical to SEQ ID NO: 40680
  misc_feature 1..41: note = chr5:178565442-178565483
  misc_feature 1..41: note = hypo
  source 1..41: mol_type = genomic DNA

SEQ ID NO: 61192 - DNA, 27 bp, Homo sapiens
  misc_feature 1..27: note = chr5:178576499-178576526
  misc_feature 1..27: note = hypo
  source 1..27: mol_type = genomic DNA
gtcactggtggccgcaggaaccaggag

SEQ ID NO: 61193 - DNA, 55 bp, Homo sapiens
  misc_feature 1..55: note = chr5:178655698-178655753
  misc_feature 1..55: note = hypo
  source 1..55: mol_type = genomic DNA
actaaccaaagccagcggacatccactgcctgcggagcatctggggaaggctcct

SEQ ID NO: 61194 - DNA, 37 bp, Homo sapiens; identical to SEQ ID NO: 24187
  misc_feature 1..37: note = chr5:178655871-178655908
  misc_feature 1..37: note = hypo
  source 1..37: mol_type = genomic DNA

SEQ ID NO: 61195 - DNA, 78 bp, Homo sapiens; identical to SEQ ID NO: 40683
  misc_feature 1..78: note = chr5:178665413-178665491
  misc_feature 1..78: note = hypo
  source 1..78: mol_type = genomic DNA

SEQ ID NO: 61196 - DNA, 30 bp, Homo sapiens; identical to SEQ ID NO: 40684
  misc_feature 1..30: note = chr5:178737203-178737233
  misc_feature 1..30: note = hypo
  source 1..30: mol_type = genomic DNA

SEQ ID NO: 61197 - DNA, 49 bp, Homo sapiens; identical to SEQ ID NO: 40685
  misc_feature 1..49: note = chr5:178854790-178854839
  misc_feature 1..49: note = hypo
  source 1..49: mol_type = genomic DNA

SEQ ID NO: 61198 - DNA, 30 bp, Homo sapiens; identical to SEQ ID NO: 14816
  misc_feature 1..30: note = chr5:178878685-178878715
  misc_feature 1..30: note = hypo
  source 1..30: mol_type = genomic DNA

SEQ ID NO: 61199 - DNA, 30 bp, Homo sapiens; identical to SEQ ID NO: 40687
  misc_feature 1..30: note = chr5:178882544-178882574
  misc_feature 1..30: note = hypo
  source 1..30: mol_type = genomic DNA

SEQ ID NO: 61200 - DNA, 27 bp, Homo sapiens
  misc_feature 1..27: note = chr5:178969579-178969606
  misc_feature 1..27: note = hypo
  source 1..27: mol_type = genomic DNA
agaatgggccaggtgcggtggctcacg

SEQ ID NO: 61201 - DNA, 35 bp, Homo sapiens; identical to SEQ ID NO: 40689
  misc_feature 1..35: note = chr5:178987430-178987465
  misc_feature 1..35: note = hypo
  source 1..35: mol_type = genomic DNA

SEQ ID NO: 61202 - DNA, 209 bp, Homo sapiens
  misc_feature 1..209: note = chr5:179213904-179214113
  misc_feature 1..209: note = hypo
  source 1..209: mol_type = genomic DNA
ctgggcccaacgaaacgcaaatgatccctagcagctgacagcagtctgctgcaaacacagcaaagttgagtcccagttgcagctgcagtgaccaccagccagcctctgtcatggcccccgagtgctgggcccagcaaggcgggctcaagagcagtaagcagcagtggcaggggtggggcccagcgggatcccagcatcgtggctctggc

SEQ ID NO: 61203 - DNA, 82 bp, Homo sapiens
  misc_feature 1..82: note = chr5:179214196-179214278
  misc_feature 1..82: note = hypo
  source 1..82: mol_type = genomic DNA
gggactgagtgaggagaccagtcaccacccggtgcaaactgagtcccttccacgcgggaaagggccacgagcaattcatgtt

SEQ ID NO: 61204 - DNA, 50 bp, Homo sapiens; identical to SEQ ID NO: 40691
  misc_feature 1..50: note = chr5:179401725-179401775
  misc_feature 1..50: note = hypo
  source 1..50: mol_type = genomic DNA

SEQ ID NO: 61205 - DNA, 230 bp, Homo sapiens; identical to SEQ ID NO: 40692
  misc_feature 1..230: note = chr5:179564509-179564739
  misc_feature 1..230: note = hypo
  source 1..230: mol_type = genomic DNA

SEQ ID NO: 61206 - DNA, 30 bp, Homo sapiens; identical to SEQ ID NO: 40693
  misc_feature 1..30: note = chr5:180021394-180021424
  misc_feature 1..30: note = hypo
  source 1..30: mol_type = genomic DNA

SEQ ID NO: 61207 - DNA, 30 bp, Homo sapiens; identical to SEQ ID NO: 40694
  misc_feature 1..30: note = chr5:180028510-180028540
  misc_feature 1..30: note = hypo
  source 1..30: mol_type = genomic DNA

SEQ ID NO: 61208 - DNA, 47 bp, Homo sapiens; identical to SEQ ID NO: 40695
  misc_feature 1..47: note = chr5:180041104-180041151
  misc_feature 1..47: note = hypo
  source 1..47: mol_type = genomic DNA

SEQ ID NO: 61209 - DNA, 30 bp, Homo sapiens; identical to SEQ ID NO: 40696
  misc_feature 1..30: note = chr5:180042128-180042158
  misc_feature 1..30: note = hypo
  source 1..30: mol_type = genomic DNA

SEQ ID NO: 61210 - DNA, 81 bp, Homo sapiens; identical to SEQ ID NO: 40697
  misc_feature 1..81: note = chr5:180057500-180057581
  misc_feature 1..81: note = hypo
  source 1..81: mol_type = genomic DNA

SEQ ID NO: 61211 - DNA, 88 bp, Homo sapiens; identical to SEQ ID NO: 40698
  misc_feature 1..88: note = chr5:180111814-180111902
  misc_feature 1..88: note = hypo
  source 1..88: mol_type = genomic DNA

SEQ ID NO: 61212 - DNA, 90 bp, Homo sapiens; identical to SEQ ID NO: 40700
  misc_feature 1..90: note = chr5:180661538-180661628
  misc_feature 1..90: note = hypo
  source 1..90: mol_type = genomic DNA

SEQ ID NO: 61213 - DNA, 37 bp, Homo sapiens; identical to SEQ ID NO: 40701
  misc_feature 1..37: note = chr5:180708092-180708129
  misc_feature 1..37: note = hypo
  source 1..37: mol_type = genomic DNA

SEQ ID NO: 61214 - DNA, 213 bp, Homo sapiens; identical to SEQ ID NO: 40702
  misc_feature 1..213: note = chr5:180708822-180709035
  misc_feature 1..213: note = hypo
  source 1..213: mol_type = genomic DNA

SEQ ID NO: 61215 - DNA, 30 bp, Homo sapiens; identical to SEQ ID NO: 40703
  misc_feature 1..30: note = chr6:304250-304280
  misc_feature 1..30: note = hypo
  source 1..30: mol_type = genomic DNA

SEQ ID NO: 61216 - DNA, 35 bp, Homo sapiens; identical to SEQ ID NO: 14822
  misc_feature 1..35: note = chr6:348724-348759
  misc_feature 1..35: note = hypo
  source 1..35: mol_type = genomic DNA

SEQ ID NO: 61217 - DNA, 48 bp, Homo sapiens; identical to SEQ ID NO: 40705
  misc_feature 1..48: note = chr6:448927-448975
  misc_feature 1..48: note = hypo
  source 1..48: mol_type = genomic DNA

SEQ ID NO: 61218 - DNA, 17 bp, Homo sapiens
  misc_feature 1..17: note = chr6:736009-736026
  misc_feature 1..17: note = hypo
  source 1..17: mol_type = genomic DNA
aacgtattagctggccg

SEQ ID NO: 61219 - DNA, 49 bp, Homo sapiens; identical to SEQ ID NO: 40707
  misc_feature 1..49: note = chr6:1004242-1004291
  misc_feature 1..49: note = hypo
  source 1..49: mol_type = genomic DNA

SEQ ID NO: 61220 - DNA, 30 bp, Homo sapiens; identical to SEQ ID NO: 40708
  misc_feature 1..30: note = chr6:1637278-1637308
  misc_feature 1..30: note = hypo
  source 1..30: mol_type = genomic DNA

SEQ ID NO: 61221 - DNA, 30 bp, Homo sapiens; identical to SEQ ID NO: 40709
  misc_feature 1..30: note = chr6:1708613-1708643
  misc_feature 1..30: note = hypo
  source 1..30: mol_type = genomic DNA

SEQ ID NO: 61222 - DNA, 175 bp, Homo sapiens; identical to SEQ ID NO: 40710
  misc_feature 1..175: note = chr6:1726684-1726859
  misc_feature 1..175: note = hypo
  source 1..175: mol_type = genomic DNA

SEQ ID NO: 61223 - DNA, 30 bp, Homo sapiens; identical to SEQ ID NO: 40711
  misc_feature 1..30: note = chr6:2244454-2244484
  misc_feature 1..30: note = hypo
  source 1..30: mol_type = genomic DNA

SEQ ID NO: 61224 - DNA, 30 bp, Homo sapiens; identical to SEQ ID NO: 40712
  misc_feature 1..30: note = chr6:2684333-2684363
  misc_feature 1..30: note = hypo
  source 1..30: mol_type = genomic DNA

SEQ ID NO: 61225 - DNA, 72 bp, Homo sapiens; identical to SEQ ID NO: 40713
  misc_feature 1..72: note = chr6:2737187-2737259
  misc_feature 1..72: note = hypo
  source 1..72: mol_type = genomic DNA

SEQ ID NO: 61226 - DNA, 30 bp, Homo sapiens; identical to SEQ ID NO: 40714
  misc_feature 1..30: note = chr6:2920829-2920859
  misc_feature 1..30: note = hypo
  source 1..30: mol_type = genomic DNA

SEQ ID NO: 61227 - DNA, 30 bp, Homo sapiens; identical to SEQ ID NO: 40715
  misc_feature 1..30: note = chr6:2939086-2939116
  misc_feature 1..30: note = hypo
  source 1..30: mol_type = genomic DNA

SEQ ID NO: 61228 - DNA, 32 bp, Homo sapiens; identical to SEQ ID NO: 40717
  misc_feature 1..32: note = chr6:3065559-3065591
  misc_feature 1..32: note = hypo
  source 1..32: mol_type = genomic DNA

SEQ ID NO: 61229 - DNA, 94 bp, Homo sapiens; identical to SEQ ID NO: 40718
  misc_feature 1..94: note = chr6:3104457-3104551
  misc_feature 1..94: note = hypo
  source 1..94: mol_type = genomic DNA

SEQ ID NO: 61230 - DNA, 35 bp, Homo sapiens; identical to SEQ ID NO: 40719
  misc_feature 1..35: note = chr6:3225962-3225997
  misc_feature 1..35: note = hypo
  source 1..35: mol_type = genomic DNA

SEQ ID NO: 61231 - DNA, 83 bp, Homo sapiens
  misc_feature 1..83: note = chr6:3285139-3285222
  misc_feature 1..83: note = hypo
  source 1..83: mol_type = genomic DNA
gaatacaaatgtatccgtatagtgtccaacctacggccaacttcagctgcagttcttggagggcaacggggagaaagagaaaa

SEQ ID NO: 61232 - DNA, 30 bp, Homo sapiens; identical to SEQ ID NO: 40721
  misc_feature 1..30: note = chr6:3298330-3298360
  misc_feature 1..30: note = hypo
  source 1..30: mol_type = genomic DNA

SEQ ID NO: 61233 - DNA, 158 bp, Homo sapiens; identical to SEQ ID NO: 40722
  misc_feature 1..158: note = chr6:3307337-3307495
  misc_feature 1..158: note = hypo
  source 1..158: mol_type = genomic DNA

SEQ ID NO: 61234 - DNA, 30 bp, Homo sapiens; identical to SEQ ID NO: 40723
  misc_feature 1..30: note = chr6:3333125-3333155
  misc_feature 1..30: note = hypo
  source 1..30: mol_type = genomic DNA

SEQ ID NO: 61235 - DNA, 197 bp, Homo sapiens; identical to SEQ ID NO: 40724
  misc_feature 1..197: note = chr6:3363773-3363970
  misc_feature 1..197: note = hypo
  source 1..197: mol_type = genomic DNA

SEQ ID NO: 61236 - DNA, 43 bp, Homo sapiens; identical to SEQ ID NO: 40725
  misc_feature 1..43: note = chr6:4020326-4020369
  misc_feature 1..43: note = hypo
  source 1..43: mol_type = genomic DNA

SEQ ID NO: 61237 - DNA, 181 bp, Homo sapiens; identical to SEQ ID NO: 40726
  misc_feature 1..181: note = chr6:4804543-4804724
  misc_feature 1..181: note = hypo
  source 1..181: mol_type = genomic DNA

SEQ ID NO: 61238 - DNA, 33 bp, Homo sapiens; identical to SEQ ID NO: 40728
  misc_feature 1..33: note = chr6:4920708-4920741
  misc_feature 1..33: note = hypo
  source 1..33: mol_type = genomic DNA

SEQ ID NO: 61239 - DNA, 65 bp, Homo sapiens
  misc_feature 1..65: note = chr6:4951182-4951247
  misc_feature 1..65: note = hypo
  source 1..65: mol_type = genomic DNA
cttgcaaaccctcatgaggagcctgtccccagccctgttttccagcctctgcctgcatgggaggg

SEQ ID NO: 61240 - DNA, 31 bp, Homo sapiens
  misc_feature 1..31: note = chr6:5783294-5783325
  misc_feature 1..31: note = hypo
  source 1..31: mol_type = genomic DNA
agcctccctgcctcacgcctcggggctgact

SEQ ID NO: 61241 - DNA, 181 bp, Homo sapiens; identical to SEQ ID NO: 40731
  misc_feature 1..181: note = chr6:5892797-5892978
  misc_feature 1..181: note = hypo
  source 1..181: mol_type = genomic DNA

SEQ ID NO: 61242 - DNA, 30 bp, Homo sapiens; identical to SEQ ID NO: 14827
  misc_feature 1..30: note = chr6:6045657-6045687
  misc_feature 1..30: note = hypo
  source 1..30: mol_type = genomic DNA

SEQ ID NO: 61243 - DNA, 30 bp, Homo sapiens; identical to SEQ ID NO: 40733
  misc_feature 1..30: note = chr6:6055082-6055112
  misc_feature 1..30: note = hypo
  source 1..30: mol_type = genomic DNA

SEQ ID NO: 61244 - skipped

SEQ ID NO: 61245 - DNA, 130 bp, Homo sapiens; identical to SEQ ID NO: 40735
  misc_feature 1..130: note = chr6:6534781-6534911
  misc_feature 1..130: note = hypo
  source 1..130: mol_type = genomic DNA

SEQ ID NO: 61246 - DNA, 198 bp, Homo sapiens; identical to SEQ ID NO: 40736
  misc_feature 1..198: note = chr6:6891420-6891618
  misc_feature 1..198: note = hypo
  source 1..198: mol_type = genomic DNA

SEQ ID NO: 61247 - DNA, 30 bp, Homo sapiens; identical to SEQ ID NO: 40737
  misc_feature 1..30: note = chr6:7132823-7132853
  misc_feature 1..30: note = hypo
  source 1..30: mol_type = genomic DNA

SEQ ID NO: 61248 - DNA, 95 bp, Homo sapiens; identical to SEQ ID NO: 40738
  misc_feature 1..95: note = chr6:7204204-7204299
  misc_feature 1..95: note = hypo
  source 1..95: mol_type = genomic DNA

SEQ ID NO: 61249 - DNA, 27 bp, Homo sapiens
  misc_feature 1..27: note = chr6:7237769-7237796
  misc_feature 1..27: note = hypo
  source 1..27: mol_type = genomic DNA
tttaagcgctcgcgttggggcttgcag

SEQ ID NO: 61250 - DNA, 22 bp, Homo sapiens
  misc_feature 1..22: note = chr6:7279451-7279473
  misc_feature 1..22: note = hypo
  source 1..22: mol_type = genomic DNA
aatctatcttggggccgggtgc

SEQ ID NO: 61251 - DNA, 30 bp, Homo sapiens; identical to SEQ ID NO: 40741
  misc_feature 1..30: note = chr6:7911626-7911656
  misc_feature 1..30: note = hypo
  source 1..30: mol_type = genomic DNA

SEQ ID NO: 61252 - DNA, 32 bp, Homo sapiens; identical to SEQ ID NO: 40742
  misc_feature 1..32: note = chr6:7911956-7911988
  misc_feature 1..32: note = hypo
  source 1..32: mol_type = genomic DNA

SEQ ID NO: 61253 - DNA, 30 bp, Homo sapiens; identical to SEQ ID NO: 40743
  misc_feature 1..30: note = chr6:7920126-7920156
  misc_feature 1..30: note = hypo
  source 1..30: mol_type = genomic DNA

SEQ ID NO: 61254 - DNA, 38 bp, Homo sapiens; identical to SEQ ID NO: 40744
  misc_feature 1..38: note = chr6:10595814-10595852
  misc_feature 1..38: note = hypo
  source 1..38: mol_type = genomic DNA

SEQ ID NO: 61255 - DNA, 30 bp, Homo sapiens; identical to SEQ ID NO: 40745
  misc_feature 1..30: note = chr6:10776300-10776330
  misc_feature 1..30: note = hypo
  source 1..30: mol_type = genomic DNA

SEQ ID NO: 61256 - DNA, 81 bp, Homo sapiens; identical to SEQ ID NO: 40746
  misc_feature 1..81: note = chr6:12287998-12288079
  misc_feature 1..81: note = hypo
  source 1..81: mol_type = genomic DNA

SEQ ID NO: 61257 - DNA, 138 bp, Homo sapiens
  misc_feature 1..138: note = chr6:12288379-12288517
  misc_feature 1..138: note = hypo
  source 1..138: mol_type = genomic DNA
tggggagggcatgggcggtggtttccgggtaggggccttgagaacatgttggtcctgactgttgtcagtgtttggtcaaagttgccaaaaggttaaaaaaaaaaaagtagggggagtccctgccaagacatatttccc

SEQ ID NO: 61258 - DNA, 47 bp, Homo sapiens
  misc_feature 1..47: note = chr6:12288681-12288728
  misc_feature 1..47: note = hypo
  source 1..47: mol_type = genomic DNA
tgtcctccgggagctgtggcctccctgggccccggggctaggctgag

SEQ ID NO: 61259 - DNA, 159 bp, Homo sapiens; identical to SEQ ID NO: 40748
  misc_feature 1..159: note = chr6:13288514-13288673
  misc_feature 1..159: note = hypo
  source 1..159: mol_type = genomic DNA

SEQ ID NO: 61260 - DNA, 30 bp, Homo sapiens; identical to SEQ ID NO: 14834
  misc_feature 1..30: note = chr6:13293172-13293202
  misc_feature 1..30: note = hypo
  source 1..30: mol_type = genomic DNA

SEQ ID NO: 61261 - DNA, 156 bp, Homo sapiens; identical to SEQ ID NO: 40750
  misc_feature 1..156: note = chr6:14203256-14203412
  misc_feature 1..156: note = hypo
  source 1..156: mol_type = genomic DNA

SEQ ID NO: 61262 - DNA, 30 bp, Homo sapiens; identical to SEQ ID NO: 40751
  misc_feature 1..30: note = chr6:14999193-14999223
  misc_feature 1..30: note = hypo
  source 1..30: mol_type = genomic DNA

SEQ ID NO: 61263 - DNA, 75 bp, Homo sapiens; identical to SEQ ID NO: 40752
  misc_feature 1..75: note = chr6:15073578-15073653
  misc_feature 1..75: note = hypo
  source 1..75: mol_type = genomic DNA

SEQ ID NO: 61264 - DNA, 40 bp, Homo sapiens; identical to SEQ ID NO: 40753
  misc_feature 1..40: note = chr6:15456031-15456071
  misc_feature 1..40: note = hypo
  source 1..40: mol_type = genomic DNA

SEQ ID NO: 61265 - DNA, 21 bp, Homo sapiens
  misc_feature 1..21: note = chr6:16197009-16197030
  misc_feature 1..21: note = hypo
  source 1..21: mol_type = genomic DNA
agtagaaaacaaaagcgggct

SEQ ID NO: 61266 - DNA, 151 bp, Homo sapiens; identical to SEQ ID NO: 40755
  misc_feature 1..151: note = chr6:16218420-16218571
  misc_feature 1..151: note = hypo
  source 1..151: mol_type = genomic DNA

SEQ ID NO: 61267 - DNA, 145 bp, Homo sapiens; identical to SEQ ID NO: 40756
  misc_feature 1..145: note = chr6:16249815-16249960
  misc_feature 1..145: note = hypo
  source 1..145: mol_type = genomic DNA

SEQ ID NO: 61268 - DNA, 22 bp, Homo sapiens
  misc_feature 1..22: note = chr6:16288325-16288347
  misc_feature 1..22: note = hypo
  source 1..22: mol_type = genomic DNA
agccctcacagccctcgcttgc

SEQ ID NO: 61269 - DNA, 158 bp, Homo sapiens; identical to SEQ ID NO: 40758
  misc_feature 1..158: note = chr6:16293407-16293565
  misc_feature 1..158: note = hypo
  source 1..158: mol_type = genomic DNA

SEQ ID NO: 61270 - DNA, 17 bp, Homo sapiens
  misc_feature 1..17: note = chr6:18035850-18035867
  misc_feature 1..17: note = hypo
  source 1..17: mol_type = genomic DNA
gtcctcaccactctccg

SEQ ID NO: 61271 - DNA, 92 bp, Homo sapiens; identical to SEQ ID NO: 14840
  misc_feature 1..92: note = chr6:20239485-20239577
  misc_feature 1..92: note = hypo
  source 1..92: mol_type = genomic DNA

SEQ ID NO: 61272 - DNA, 30 bp, Homo sapiens; identical to SEQ ID NO: 40761
  misc_feature 1..30: note = chr6:20691518-20691548
  misc_feature 1..30: note = hypo
  source 1..30: mol_type = genomic DNA

SEQ ID NO: 61273 - DNA, 86 bp, Homo sapiens; identical to SEQ ID NO: 40762
  misc_feature 1..86: note = chr6:20702857-20702943
  misc_feature 1..86: note = hypo
  source 1..86: mol_type = genomic DNA

SEQ ID NO: 61274 - DNA, 16 bp, Homo sapiens
  misc_feature 1..16: note = chr6:21687666-21687682
  misc_feature 1..16: note = hypo
  source 1..16: mol_type = genomic DNA
ccgcctcaaaacaaaa

SEQ ID NO: 61275 - DNA, 30 bp, Homo sapiens; identical to SEQ ID NO: 40764
  misc_feature 1..30: note = chr6:24465059-24465089
  misc_feature 1..30: note = hypo
  source 1..30: mol_type = genomic DNA

SEQ ID NO: 61276 - DNA, 30 bp, Homo sapiens; identical to SEQ ID NO: 40766
  misc_feature 1..30: note = chr6:25218551-25218581
  misc_feature 1..30: note = hypo
  source 1..30: mol_type = genomic DNA

SEQ ID NO: 61277 - DNA, 61 bp, Homo sapiens; identical to SEQ ID NO: 40767
  misc_feature 1..61: note = chr6:25668982-25669043
  misc_feature 1..61: note = hypo
  source 1..61: mol_type = genomic DNA

SEQ ID NO: 61278 - DNA, 30 bp, Homo sapiens; identical to SEQ ID NO: 40768
  misc_feature 1..30: note = chr6:25710967-25710997
  misc_feature 1..30: note = hypo
  source 1..30: mol_type = genomic DNA

SEQ ID NO: 61279 - DNA, 74 bp, Homo sapiens; identical to SEQ ID NO: 40769
  misc_feature 1..74: note = chr6:25727962-25728036
  misc_feature 1..74: note = hypo
  source 1..74: mol_type = genomic DNA

SEQ ID NO: 61280 - DNA, 23 bp, Homo sapiens
  misc_feature 1..23: note = chr6:26047695-26047718
  misc_feature 1..23: note = hypo
  source 1..23: mol_type = genomic DNA
accgcgcccggcctccttgaagc

SEQ ID NO: 61281 - DNA, 27 bp, Homo sapiens
  misc_feature 1..27: note = chr6:26053446-26053473
  misc_feature 1..27: note = hypo
  source 1..27: mol_type = genomic DNA
cgtgagccaccgcgcccagcctttttt

SEQ ID NO: 61282 - DNA, 31 bp, Homo sapiens; identical to SEQ ID NO: 40773
  misc_feature 1..31: note = chr6:27102699-27102730
  misc_feature 1..31: note = hypo
  source 1..31: mol_type = genomic DNA

SEQ ID NO: 61283 - DNA, 30 bp, Homo sapiens; identical to SEQ ID NO: 40774
  misc_feature 1..30: note = chr6:27719898-27719928
  misc_feature 1..30: note = hypo
  source 1..30: mol_type = genomic DNA

SEQ ID NO: 61284 - DNA, 51 bp, Homo sapiens; identical to SEQ ID NO: 40775
  misc_feature 1..51: note = chr6:27934894-27934945
  misc_feature 1..51: note = hypo
  source 1..51: mol_type = genomic DNA

SEQ ID NO: 61285 - DNA, 30 bp, Homo sapiens; identical to SEQ ID NO: 40776
  misc_feature 1..30: note = chr6:28395568-28395598
  misc_feature 1..30: note = hypo
  source 1..30: mol_type = genomic DNA

SEQ ID NO: 61286 - DNA, 19 bp, Homo sapiens
  misc_feature 1..19: note = chr6:33955486-33955505
  misc_feature 1..19: note = hypo
  source 1..19: mol_type = genomic DNA
cgcatgtcaccctcacggc

SEQ ID NO: 61287 - DNA, 150 bp, Homo sapiens; identical to SEQ ID NO: 40778
  misc_feature 1..150: note = chr6:33995975-33996125
  misc_feature 1..150: note = hypo
  source 1..150: mol_type = genomic DNA

SEQ ID NO: 61288 - DNA, 30 bp, Homo sapiens; identical to SEQ ID NO: 40779
  misc_feature 1..30: note = chr6:34034624-34034654
  misc_feature 1..30: note = hypo
  source 1..30: mol_type = genomic DNA

SEQ ID NO: 61289 - DNA, 102 bp, Homo sapiens; identical to SEQ ID NO: 24213
  misc_feature 1..102: note = chr6:34170868-34170970
  misc_feature 1..102: note = hypo
  source 1..102: mol_type = genomic DNA

SEQ ID NO: 61290 - DNA, 18 bp, Homo sapiens
  misc_feature 1..18: note = chr6:34171061-34171079
  misc_feature 1..18: note = hypo
  source 1..18: mol_type = genomic DNA
caccgccaggagtgtggg

SEQ ID NO: 61291 - DNA, 30 bp, Homo sapiens; identical to SEQ ID NO: 40782
  misc_feature 1..30: note = chr6:34392006-34392036
  misc_feature 1..30: note = hypo
  source 1..30: mol_type = genomic DNA

SEQ ID NO: 61292 - DNA, 30 bp, Homo sapiens; identical to SEQ ID NO: 14846
  misc_feature 1..30: note = chr6:34514348-34514378
  misc_feature 1..30: note = hypo
  source 1..30: mol_type = genomic DNA

SEQ ID NO: 61293 - DNA, 29 bp, Homo sapiens
  misc_feature 1..29: note = chr6:34535577-34535606
  misc_feature 1..29: note = hypo
  source 1..29: mol_type = genomic DNA
gccctgccatcatagcgctgacagcggct

SEQ ID NO: 61294 - DNA, 29 bp, Homo sapiens
  misc_feature 1..29: note = chr6:34535906-34535935
  misc_feature 1..29: note = hypo
  source 1..29: mol_type = genomic DNA
ggcgtgagtcactgcgcccagccatatcc

SEQ ID NO: 61295 - DNA, 70 bp, Homo sapiens; identical to SEQ ID NO: 40786
  misc_feature 1..70: note = chr6:34671603-34671673
  misc_feature 1..70: note = hypo
  source 1..70: mol_type = genomic DNA

SEQ ID NO: 61296 - DNA, 19 bp, Homo sapiens
  misc_feature 1..19: note = chr6:34723890-34723909
  misc_feature 1..19: note = hypo
  source 1..19: mol_type = genomic DNA
gggcgcggtgggtcacgcc

SEQ ID NO: 61297 - DNA, 23 bp, Homo sapiens
  misc_feature 1..23: note = chr6:34854786-34854809
  misc_feature 1..23: note = hypo
  source 1..23: mol_type = genomic DNA
tgggtccctgatcaccgggtgcg

SEQ ID NO: 61298 - DNA, 33 bp, Homo sapiens; identical to SEQ ID NO: 40790
  misc_feature 1..33: note = chr6:35026986-35027019
  misc_feature 1..33: note = hypo
  source 1..33: mol_type = genomic DNA

SEQ ID NO: 61299 - DNA, 231 bp, Homo sapiens
  misc_feature 1..231: note = chr6:35149810-35150041
  misc_feature 1..231: note = hypo
  source 1..231: mol_type = genomic DNA
caaatgtttcttgagcgctggcaacgtgccaggctccttgctgggccccaaggagggagccacaaacacggacaaattccaggacctgctggagctgttctcgggctctaacgtgaggcaaaactgtgcacaaatcctggggcactctggacactgagctccggaccccgtgcaggcggtagtcgcctctgcgcggagtaggagctttgtgggcctcccacccagcatcag

SEQ ID NO: 61300 - DNA, 27 bp, Homo sapiens
  misc_feature 1..27: note = chr6:35150080-35150107
  misc_feature 1..27: note = hypo
  source 1..27: mol_type = genomic DNA
gcagccaccgggcgcccagctggggtc

SEQ ID NO: 61301 - DNA, 139 bp, Homo sapiens; identical to SEQ ID NO: 40792
  misc_feature 1..139: note = chr6:35309516-35309655
  misc_feature 1..139: note = hypo
  source 1..139: mol_type = genomic DNA

SEQ ID NO: 61302 - DNA, 30 bp, Homo sapiens; identical to SEQ ID NO: 40793
  misc_feature 1..30: note = chr6:35454542-35454572
  misc_feature 1..30: note = hypo
  source 1..30: mol_type = genomic DNA

SEQ ID NO: 61303 - DNA, 22 bp, Homo sapiens
  misc_feature 1..22: note = chr6:35895206-35895228
  misc_feature 1..22: note = hypo
  source 1..22: mol_type = genomic DNA
tgagccacggtgcccggccccc

SEQ ID NO: 61304 - DNA, 74 bp, Homo sapiens
  misc_feature 1..74: note = chr6:36165588-36165662
  misc_feature 1..74: note = hypo
  source 1..74: mol_type = genomic DNA
tctagagtttctccccggtgtctggaggcgtgggtgggacaaaacacgtctgtgtagagtcttgcatggtcgag

SEQ ID NO: 61305 - DNA, 130 bp, Homo sapiens; identical to SEQ ID NO: 40796
  misc_feature 1..130: note = chr6:36214662-36214792
  misc_feature 1..130: note = hypo
  source 1..130: mol_type = genomic DNA

SEQ ID NO: 61306 - DNA, 101 bp, Homo sapiens; identical to SEQ ID NO: 40797
  misc_feature 1..101: note = chr6:36238341-36238442
  misc_feature 1..101: note = hypo
  source 1..101: mol_type = genomic DNA

SEQ ID NO: 61307 - DNA, 30 bp, Homo sapiens; identical to SEQ ID NO: 14852
  misc_feature 1..30: note = chr6:36831576-36831606
  misc_feature 1..30: note = hypo
  source 1..30: mol_type = genomic DNA

SEQ ID NO: 61308 - DNA, 30 bp, Homo sapiens; identical to SEQ ID NO: 40799
  misc_feature 1..30: note = chr6:36881595-36881625
  misc_feature 1..30: note = hypo
  source 1..30: mol_type = genomic DNA

SEQ ID NO: 61309 - DNA, 42 bp, Homo sapiens; identical to SEQ ID NO: 40800
  misc_feature 1..42: note = chr6:36949243-36949285
  misc_feature 1..42: note = hypo
  source 1..42: mol_type = genomic DNA

SEQ ID NO: 61310 - DNA, 46 bp, Homo sapiens; identical to SEQ ID NO: 40801
  misc_feature 1..46: note = chr6:37004177-37004223
  misc_feature 1..46: note = hypo
  source 1..46: mol_type = genomic DNA

SEQ ID NO: 61311 - DNA, 177 bp, Homo sapiens; identical to SEQ ID NO: 24222
  misc_feature 1..177: note = chr6:37024382-37024559
  misc_feature 1..177: note = hypo
  source 1..177: mol_type = genomic DNA

SEQ ID NO: 61312 - DNA, 60 bp, Homo sapiens
  misc_feature 1..60: note = chr6:37024589-37024649
  misc_feature 1..60: note = hypo
  source 1..60: mol_type = genomic DNA
agcaggcaccctctgaggggcagagacctcgttccctcagctccccgtcctccatggtgt

SEQ ID NO: 61313 - DNA, 44 bp, Homo sapiens; identical to SEQ ID NO: 40803
  misc_feature 1..44: note = chr6:37053276-37053320
  misc_feature 1..44: note = hypo
  source 1..44: mol_type = genomic DNA

SEQ ID NO: 61314 - DNA, 30 bp, Homo sapiens; identical to SEQ ID NO: 40804
  misc_feature 1..30: note = chr6:37275453-37275483
  misc_feature 1..30: note = hypo
  source 1..30: mol_type = genomic DNA

SEQ ID NO: 61315 - DNA, 30 bp, Homo sapiens; identical to SEQ ID NO: 40805
  misc_feature 1..30: note = chr6:37358523-37358553
  misc_feature 1..30: note = hypo
  source 1..30: mol_type = genomic DNA

SEQ ID NO: 61316 - DNA, 180 bp, Homo sapiens; identical to SEQ ID NO: 40806
  misc_feature 1..180: note = chr6:37391410-37391590
  misc_feature 1..180: note = hypo
  source 1..180: mol_type = genomic DNA

SEQ ID NO: 61317 - DNA, 30 bp, Homo sapiens; identical to SEQ ID NO: 40807
  misc_feature 1..30: note = chr6:37557743-37557773
  misc_feature 1..30: note = hypo
  source 1..30: mol_type = genomic DNA

SEQ ID NO: 61318 - DNA, 30 bp, Homo sapiens; identical to SEQ ID NO: 40809
  misc_feature 1..30: note = chr6:37791835-37791865
  misc_feature 1..30: note = hypo
  source 1..30: mol_type = genomic DNA

SEQ ID NO: 61319 - DNA, 34 bp, Homo sapiens; identical to SEQ ID NO: 40810
  misc_feature 1..34: note = chr6:38018000-38018034
  misc_feature 1..34: note = hypo
  source 1..34: mol_type = genomic DNA

SEQ ID NO: 61320 - DNA, 30 bp, Homo sapiens; identical to SEQ ID NO: 40811
  misc_feature 1..30: note = chr6:38137726-38137756
  misc_feature 1..30: note = hypo
  source 1..30: mol_type = genomic DNA

SEQ ID NO: 61321 - DNA, 30 bp, Homo sapiens; identical to SEQ ID NO: 40812
  misc_feature 1..30: note = chr6:38183151-38183181
  misc_feature 1..30: note = hypo
  source 1..30: mol_type = genomic DNA

SEQ ID NO: 61322 - DNA, 30 bp, Homo sapiens; identical to SEQ ID NO: 40813
  misc_feature 1..30: note = chr6:38684078-38684108
  misc_feature 1..30: note = hypo
  source 1..30: mol_type = genomic DNA

SEQ ID NO: 61323 - DNA, 43 bp, Homo sapiens; identical to SEQ ID NO: 40814
  misc_feature 1..43: note = chr6:40244038-40244081
  misc_feature 1..43: note = hypo
  source 1..43: mol_type = genomic DNA

SEQ ID NO: 61324 - DNA, 133 bp, Homo sapiens; identical to SEQ ID NO: 40815
  misc_feature 1..133: note = chr6:41709850-41709983
  misc_feature 1..133: note = hypo
  source 1..133: mol_type = genomic DNA

SEQ ID NO: 61325 - DNA, 35 bp, Homo sapiens; identical to SEQ ID NO: 40816
  misc_feature 1..35: note = chr6:41715572-41715607
  misc_feature 1..35: note = hypo
  source 1..35: mol_type = genomic DNA

SEQ ID NO: 61326 - DNA, 17 bp, Homo sapiens
  misc_feature 1..17: note = chr6:42062066-42062083
  misc_feature 1..17: note = hypo
  source 1..17: mol_type = genomic DNA
gcctgagcaacacagcg

SEQ ID NO: 61327 - DNA, 29 bp, Homo sapiens
  misc_feature 1..29: note = chr6:42090829-42090858
  misc_feature 1..29: note = hypo
  source 1..29: mol_type = genomic DNA
gagggacaggccgggcgcggtggctcacg

SEQ ID NO: 61328 - DNA, 88 bp, Homo sapiens; identical to SEQ ID NO: 40820
  misc_feature 1..88: note = chr6:42110870-42110958
  misc_feature 1..88: note = hypo
  source 1..88: mol_type = genomic DNA

SEQ ID NO: 61329 - DNA, 36 bp, Homo sapiens; identical to SEQ ID NO: 40821
  misc_feature 1..36: note = chr6:42184577-42184613
  misc_feature 1..36: note = hypo
  source 1..36: mol_type = genomic DNA

SEQ ID NO: 61330 - DNA, 176 bp, Homo sapiens; identical to SEQ ID NO: 40822
  misc_feature 1..176: note = chr6:42190336-42190512
  misc_feature 1..176: note = hypo
  source 1..176: mol_type = genomic DNA

SEQ ID NO: 61331 - DNA, 224 bp, Homo sapiens; identical to SEQ ID NO: 40824
  misc_feature 1..224: note = chr6:42813314-42813538
  misc_feature 1..224: note = hypo
  source 1..224: mol_type = genomic DNA

SEQ ID NO: 61332 - DNA, 37 bp, Homo sapiens; identical to SEQ ID NO: 40825
  misc_feature 1..37: note = chr6:42846392-42846429
  misc_feature 1..37: note = hypo
  source 1..37: mol_type = genomic DNA

SEQ ID NO: 61333 - DNA, 53 bp, Homo sapiens
  misc_feature 1..53: note = chr6:42846609-42846662
  misc_feature 1..53: note = hypo
  source 1..53: mol_type = genomic DNA
attacaggtgaaagccaccggcccgacctactgtttttcaggattctatatag

SEQ ID NO: 61334 - DNA, 137 bp, Homo sapiens
  misc_feature 1..137: note = chr6:43424470-43424607
  misc_feature 1..137: note = hypo
  source 1..137: mol_type = genomic DNA
aaagacaaggacccagaacataatttctagtttgtgcaggacaacagggcagaggtcaggaacgctagcgcccatctctagtccttcagattgagatttcaccatctttaaattcaaaacatcggaaggagcagtcg

SEQ ID NO: 61335 - DNA, 30 bp, Homo sapiens; identical to SEQ ID NO: 14862
  misc_feature 1..30: note = chr6:43486338-43486368
  misc_feature 1..30: note = hypo
  source 1..30: mol_type = genomic DNA

SEQ ID NO: 61336 - DNA, 41 bp, Homo sapiens; identical to SEQ ID NO: 14865
  misc_feature 1..41: note = chr6:44437145-44437186
  misc_feature 1..41: note = hypo
  source 1..41: mol_type = genomic DNA

SEQ ID NO: 61337 - DNA, 30 bp, Homo sapiens; identical to SEQ ID NO: 40834
  misc_feature 1..30: note = chr6:44443992-44444022
  misc_feature 1..30: note = hypo
  source 1..30: mol_type = genomic DNA

SEQ ID NO: 61338 - DNA, 119 bp, Homo sapiens; identical to SEQ ID NO: 40835
  misc_feature 1..119: note = chr6:45609047-45609166
  misc_feature 1..119: note = hypo
  source 1..119: mol_type = genomic DNA

SEQ ID NO: 61339 - DNA, 26 bp, Homo sapiens
  misc_feature 1..26: note = chr6:47924456-47924482
  misc_feature 1..26: note = hypo
  source 1..26: mol_type = genomic DNA
ctgctcctggccgagagtatggtttt

SEQ ID NO: 61340 - DNA, 172 bp, Homo sapiens; identical to SEQ ID NO: 40837
  misc_feature 1..172: note = chr6:49464924-49465096
  misc_feature 1..172: note = hypo
  source 1..172: mol_type = genomic DNA

SEQ ID NO: 61341 - DNA, 142 bp, Homo sapiens
  misc_feature 1..142: note = chr6:49590413-49590555
  misc_feature 1..142: note = hypo
  source 1..142: mol_type = genomic DNA
ccagcagtgtgaaaacgaactaatacaccaactaattcaagaaattgttttatctaatttcataatttctgttagtggaacaattattctgcagatttcaccccccttcccctttgatggaaaaccagactttttttttttt

SEQ ID NO: 61342 - DNA, 43 bp, Homo sapiens; identical to SEQ ID NO: 40839
  misc_feature 1..43: note = chr6:49590817-49590860
  misc_feature 1..43: note = hypo
  source 1..43: mol_type = genomic DNA

SEQ ID NO: 61343 - DNA, 39 bp, Homo sapiens; identical to SEQ ID NO: 40840
  misc_feature 1..39: note = chr6:50207691-50207730
  misc_feature 1..39: note = hypo
  source 1..39: mol_type = genomic DNA

SEQ ID NO: 61344 - DNA, 30 bp, Homo sapiens; identical to SEQ ID NO: 40841
  misc_feature 1..30: note = chr6:52102871-52102901
  misc_feature 1..30: note = hypo
  source 1..30: mol_type = genomic DNA

SEQ ID NO: 61345 - DNA, 88 bp, Homo sapiens; identical to SEQ ID NO: 40842
  misc_feature 1..88: note = chr6:52156845-52156933
  misc_feature 1..88: note = hypo
  source 1..88: mol_type = genomic DNA

SEQ ID NO: 61346 - DNA, 107 bp, Homo sapiens; identical to SEQ ID NO: 40843
  misc_feature 1..107: note = chr6:52268182-52268289
  misc_feature 1..107: note = hypo
  source 1..107: mol_type = genomic DNA

SEQ ID NO: 61347 - DNA, 180 bp, Homo sapiens; identical to SEQ ID NO: 40844
  misc_feature 1..180: note = chr6:52928856-52929036
  misc_feature 1..180: note = hypo
  source 1..180: mol_type = genomic DNA

SEQ ID NO: 61348 - DNA, 34 bp, Homo sapiens; identical to SEQ ID NO: 40845
  misc_feature 1..34: note = chr6:52929276-52929310
  misc_feature 1..34: note = hypo
  source 1..34: mol_type = genomic DNA

SEQ ID NO: 61349 - DNA, 30 bp, Homo sapiens; identical to SEQ ID NO: 40846
  misc_feature 1..30: note = chr6:57979515-57979545
  misc_feature 1..30: note = hypo
  source 1..30: mol_type = genomic DNA

SEQ ID NO: 61350 - DNA, 35 bp, Homo sapiens; identical to SEQ ID NO: 40847
  misc_feature 1..35: note = chr6:58504069-58504104
  misc_feature 1..35: note = hypo
  source 1..35: mol_type = genomic DNA

SEQ ID NO: 61351 - DNA, 148 bp, Homo sapiens; identical to SEQ ID NO: 40848
  misc_feature 1..148: note = chr6:64150678-64150826
  misc_feature 1..148: note = hypo
  source 1..148: mol_type = genomic DNA

SEQ ID NO: 61352 - DNA, 20 bp, Homo sapiens
  misc_feature 1..20: note = chr6:71277673-71277693
  misc_feature 1..20: note = hypo
  source 1..20: mol_type = genomic DNA
caccgcgcccggtccgcaaa

SEQ ID NO: 61353 - DNA, 179 bp, Homo sapiens; identical to SEQ ID NO: 40850
  misc_feature 1..179: note = chr6:73764839-73765018
  misc_feature 1..179: note = hypo
  source 1..179: mol_type = genomic DNA

SEQ ID NO: 61354 - DNA, 103 bp, Homo sapiens; identical to SEQ ID NO: 40851
  misc_feature 1..103: note = chr6:74234126-74234229
  misc_feature 1..103: note = hypo
  source 1..103: mol_type = genomic DNA

SEQ ID NO: 61355 - DNA, 104 bp, Homo sapiens; identical to SEQ ID NO: 40852
  misc_feature 1..104: note = chr6:74698077-74698181
  misc_feature 1..104: note = hypo
  source 1..104: mol_type = genomic DNA

SEQ ID NO: 61356 - DNA, 30 bp, Homo sapiens; identical to SEQ ID NO: 40853
  misc_feature 1..30: note = chr6:79699310-79699340
  misc_feature 1..30: note = hypo
  source 1..30: mol_type = genomic DNA

SEQ ID NO: 61357 - DNA, 79 bp, Homo sapiens; identical to SEQ ID NO: 40855
  misc_feature 1..79: note = chr6:84513478-84513557
  misc_feature 1..79: note = hypo
  source 1..79: mol_type = genomic DNA

SEQ ID NO: 61358 - DNA, 68 bp, Homo sapiens; identical to SEQ ID NO: 24239
  misc_feature 1..68: note = chr6:86302345-86302413
  misc_feature 1..68: note = hypo
  source 1..68: mol_type = genomic DNA

SEQ ID NO: 61359 - DNA, 30 bp, Homo sapiens; identical to SEQ ID NO: 40857
  misc_feature 1..30: note = chr6:86415082-86415112
  misc_feature 1..30: note = hypo
  source 1..30: mol_type = genomic DNA

SEQ ID NO: 61360 - DNA, 38 bp, Homo sapiens; identical to SEQ ID NO: 40858
  misc_feature 1..38: note = chr6:89857352-89857390
  misc_feature 1..38: note = hypo
  source 1..38: mol_type = genomic DNA

SEQ ID NO: 61361 - DNA, 111 bp, Homo sapiens; identical to SEQ ID NO: 40859
  misc_feature 1..111: note = chr6:90367322-90367433
  misc_feature 1..111: note = hypo
  source 1..111: mol_type = genomic DNA

SEQ ID NO: 61362 - DNA, 51 bp, Homo sapiens; identical to SEQ ID NO: 40860
  misc_feature 1..51: note = chr6:90644578-90644629
  misc_feature 1..51: note = hypo
  source 1..51: mol_type = genomic DNA

SEQ ID NO: 61363 - DNA, 185 bp, Homo sapiens; identical to SEQ ID NO: 40861
  misc_feature 1..185: note = chr6:90661223-90661408
  misc_feature 1..185: note = hypo
  source 1..185: mol_type = genomic DNA

SEQ ID NO: 61364 - DNA, 16 bp, Homo sapiens
  misc_feature 1..16: note = chr6:97299315-97299331
  misc_feature 1..16: note = hypo
  source 1..16: mol_type = genomic DNA
ccgtctcaaaaaaaaa

SEQ ID NO: 61365 - DNA, 127 bp, Homo sapiens
  misc_feature 1..127: note = chr6:99396329-99396456
  misc_feature 1..127: note = hypo
  source 1..127: mol_type = genomic DNA
tcatttccataccaacgttcagaagcctctgaccattacctctgatgaagaagatggtctggcagcctctcttactcattttgatttatttttggtagattcagtatggcactttatttatttattt

SEQ ID NO: 61366 - DNA, 29 bp, Homo sapiens
  misc_feature 1..29: note = chr6:99396718-99396747
  misc_feature 1..29: note = hypo
  source 1..29: mol_type = genomic DNA
tgagccaccgcgcccgcccttggcacttt

SEQ ID NO: 61367 - DNA, 30 bp, Homo sapiens; identical to SEQ ID NO: 14876
  misc_feature 1..30: note = chr6:105750542-105750572
  misc_feature 1..30: note = hypo
  source 1..30: mol_type = genomic DNA

SEQ ID NO: 61368 - DNA, 44 bp, Homo sapiens; identical to SEQ ID NO: 40866
  misc_feature 1..44: note = chr6:107075561-107075605
  misc_feature 1..44: note = hypo
  source 1..44: mol_type = genomic DNA

SEQ ID NO: 61369 - DNA, 76 bp, Homo sapiens; identical to SEQ ID NO: 40867
  misc_feature 1..76: note = chr6:108274499-108274575
  misc_feature 1..76: note = hypo
  source 1..76: mol_type = genomic DNA

SEQ ID NO: 61370 - DNA, 68 bp, Homo sapiens
  misc_feature 1..68: note = chr6:108280352-108280420
  misc_feature 1..68: note = hypo
  source 1..68: mol_type = genomic DNA
gacagatttgaatctacgctgtgcccatcttgcagatgaagatttccccaagccgttacagatggttc

SEQ ID NO: 61371 - DNA, 38 bp, Homo sapiens; identical to SEQ ID NO: 40869
  misc_feature 1..38: note = chr6:109038585-109038623
  misc_feature 1..38: note = hypo
  source 1..38: mol_type = genomic DNA

SEQ ID NO: 61372 - DNA, 24 bp, Homo sapiens
  misc_feature 1..24: note = chr6:109057736-109057760
  misc_feature 1..24: note = hypo
  source 1..24: mol_type = genomic DNA
tgttaggaatattctcggcccggt

SEQ ID NO: 61373 - DNA, 82 bp, Homo sapiens; identical to SEQ ID NO: 14879
  misc_feature 1..82: note = chr6:109059835-109059917
  misc_feature 1..82: note = hypo
  source 1..82: mol_type = genomic DNA

SEQ ID NO: 61374 - DNA, 137 bp, Homo sapiens; identical to SEQ ID NO: 40872
  misc_feature 1..137: note = chr6:116574057-116574194
  misc_feature 1..137: note = hypo
  source 1..137: mol_type = genomic DNA

SEQ ID NO: 61375 - DNA, 30 bp, Homo sapiens; identical to SEQ ID NO: 40873
  misc_feature 1..30: note = chr6:118113403-118113433
  misc_feature 1..30: note = hypo
  source 1..30: mol_type = genomic DNA

SEQ ID NO: 61376 - DNA, 30 bp, Homo sapiens; identical to SEQ ID NO: 40874
  misc_feature 1..30: note = chr6:119240714-119240744
  misc_feature 1..30: note = hypo
  source 1..30: mol_type = genomic DNA

SEQ ID NO: 61377 - DNA, 30 bp, Homo sapiens; identical to SEQ ID NO: 40875
  misc_feature 1..30: note = chr6:119254223-119254253
  misc_feature 1..30: note = hypo
  source 1..30: mol_type = genomic DNA

SEQ ID NO: 61378 - DNA, 38 bp, Homo sapiens
  misc_feature 1..38: note = chr6:119254678-119254716
  misc_feature 1..38: note = hypo
  source 1..38: mol_type = genomic DNA
aaaaaagagagaaacacttatttcgtttggaaagagat

SEQ ID NO: 61379 - DNA, 20 bp, Homo sapiens
  misc_feature 1..20: note = chr6:119560062-119560082
  misc_feature 1..20: note = hypo
  source 1..20: mol_type = genomic DNA
ttattatttttgagacggag

SEQ ID NO: 61380 - DNA, 42 bp, Homo sapiens; identical to SEQ ID NO: 40878
  misc_feature 1..42: note = chr6:119689647-119689689
  misc_feature 1..42: note = hypo
  source 1..42: mol_type = genomic DNA

SEQ ID NO: 61381 - DNA, 30 bp, Homo sapiens; identical to SEQ ID NO: 40879
  misc_feature 1..30: note = chr6:119824210-119824240
  misc_feature 1..30: note = hypo
  source 1..30: mol_type = genomic DNA

SEQ ID NO: 61382 - DNA, 28 bp, Homo sapiens
  misc_feature 1..28: note = chr6:119888174-119888202
  misc_feature 1..28: note = hypo
  source 1..28: mol_type = genomic DNA
tgtctataaaatccggtgcactctgctg

SEQ ID NO: 61383 - DNA, 30 bp, Homo sapiens; identical to SEQ ID NO: 40881
  misc_feature 1..30: note = chr6:119888428-119888458
  misc_feature 1..30: note = hypo
  source 1..30: mol_type = genomic DNA

SEQ ID NO: 61384 - DNA, 30 bp, Homo sapiens; identical to SEQ ID NO: 40882
  misc_feature 1..30: note = chr6:119989053-119989083
  misc_feature 1..30: note = hypo
  source 1..30: mol_type = genomic DNA

SEQ ID NO: 61385 - DNA, 30 bp, Homo sapiens; identical to SEQ ID NO: 40883
  misc_feature 1..30: note = chr6:121370471-121370501
  misc_feature 1..30: note = hypo
  source 1..30: mol_type = genomic DNA

SEQ ID NO: 61386 - DNA, 17 bp, Homo sapiens
  misc_feature 1..17: note = chr6:125013694-125013711
  misc_feature 1..17: note = hypo
  source 1..17: mol_type = genomic DNA
gttcacacctgtaatcg

SEQ ID NO: 61387 - DNA, 77 bp, Homo sapiens; identical to SEQ ID NO: 40885
  misc_feature 1..77: note = chr6:125081173-125081250
  misc_feature 1..77: note = hypo
  source 1..77: mol_type = genomic DNA

SEQ ID NO: 61388 - DNA, 36 bp, Homo sapiens; identical to SEQ ID NO: 40886
  misc_feature 1..36: note = chr6:125286431-125286467
  misc_feature 1..36: note = hypo
  source 1..36: mol_type = genomic DNA

SEQ ID NO: 61389 - DNA, 105 bp, Homo sapiens; identical to SEQ ID NO: 40887
  misc_feature 1..105: note = chr6:125397724-125397829
  misc_feature 1..105: note = hypo
  source 1..105: mol_type = genomic DNA

SEQ ID NO: 61390 - DNA, 30 bp, Homo sapiens; identical to SEQ ID NO: 40888
  misc_feature 1..30: note = chr6:129480603-129480633
  misc_feature 1..30: note = hypo
  source 1..30: mol_type = genomic DNA

SEQ ID NO: 61391 - DNA, 30 bp, Homo sapiens; identical to SEQ ID NO: 40889
  misc_feature 1..30: note = chr6:130182604-130182634
  misc_feature 1..30: note = hypo
  source 1..30: mol_type = genomic DNA

SEQ ID NO: 61392 - DNA, 30 bp, Homo sapiens; identical to SEQ ID NO: 40890
  misc_feature 1..30: note = chr6:130241934-130241964
  misc_feature 1..30: note = hypo
  source 1..30: mol_type = genomic DNA

SEQ ID NO: 61393 - DNA, 149 bp, Homo sapiens; identical to SEQ ID NO: 40891
  misc_feature 1..149: note = chr6:130530028-130530177
  misc_feature 1..149: note = hypo
  source 1..149: mol_type = genomic DNA

SEQ ID NO: 61394 - DNA, 30 bp, Homo sapiens; identical to SEQ ID NO: 40892
  misc_feature 1..30: note = chr6:130808098-130808128
  misc_feature 1..30: note = hypo
  source 1..30: mol_type = genomic DNA

SEQ ID NO: 61395 - DNA, 32 bp, Homo sapiens; identical to SEQ ID NO: 40893
  misc_feature 1..32: note = chr6:131389791-131389823
  misc_feature 1..32: note = hypo
  source 1..32: mol_type = genomic DNA

SEQ ID NO: 61396 - DNA, 30 bp, Homo sapiens; identical to SEQ ID NO: 40894
  misc_feature 1..30: note = chr6:131455819-131455849
  misc_feature 1..30: note = hypo
  source 1..30: mol_type = genomic DNA

SEQ ID NO: 61397 - DNA, 61 bp, Homo sapiens; identical to SEQ ID NO: 40895
  misc_feature 1..61: note = chr6:131616389-131616450
  misc_feature 1..61: note = hypo
  source 1..61: mol_type = genomic DNA

SEQ ID NO: 61398 - DNA, 77 bp, Homo sapiens
  misc_feature 1..77: note = chr6:134067471-134067548
  misc_feature 1..77: note = hypo
  source 1..77: mol_type = genomic DNA
gagctctttaaagggctctgagcctgggattcttgggagagttccattgcattgtatggtcacggagattgacacag

SEQ ID NO: 61399 - DNA, 86 bp, Homo sapiens; identical to SEQ ID NO: 40898
  misc_feature 1..86: note = chr6:134589886-134589972
  misc_feature 1..86: note = hypo
  source 1..86: mol_type = genomic DNA

SEQ ID NO: 61400 - DNA, 137 bp, Homo sapiens; identical to SEQ ID NO: 40899
  misc_feature 1..137: note = chr6:137144480-137144617
  misc_feature 1..137: note = hypo
  source 1..137: mol_type = genomic DNA

SEQ ID NO: 61401 - DNA, 150 bp, Homo sapiens; identical to SEQ ID NO: 40900
  misc_feature 1..150: note = chr6:138790432-138790582
  misc_feature 1..150: note = hypo
  source 1..150: mol_type = genomic DNA

SEQ ID NO: 61402 - DNA, 60 bp, Homo sapiens; identical to SEQ ID NO: 40901
  misc_feature 1..60: note = chr6:143557423-143557483
  misc_feature 1..60: note = hypo
  source 1..60: mol_type = genomic DNA

SEQ ID NO: 61403 - DNA, 30 bp, Homo sapiens; identical to SEQ ID NO: 40902
  misc_feature 1..30: note = chr6:144522041-144522071
  misc_feature 1..30: note = hypo
  source 1..30: mol_type = genomic DNA

SEQ ID NO: 61404 - DNA, 30 bp, Homo sapiens; identical to SEQ ID NO: 40903
  misc_feature 1..30: note = chr6:147981884-147981914
  misc_feature 1..30: note = hypo
  source 1..30: mol_type = genomic DNA

SEQ ID NO: 61405 - DNA, 99 bp, Homo sapiens; identical to SEQ ID NO: 40904
  misc_feature 1..99: note = chr6:149177471-149177570
  misc_feature 1..99: note = hypo
  source 1..99: mol_type = genomic DNA

SEQ ID NO: 61406 - DNA, 30 bp, Homo sapiens; identical to SEQ ID NO: 40905
  misc_feature 1..30: note = chr6:149460105-149460135
  misc_feature 1..30: note = hypo
  source 1..30: mol_type = genomic DNA

SEQ ID NO: 61407 - DNA, 23 bp, Homo sapiens
  misc_feature 1..23: note = chr6:149498669-149498692
  misc_feature 1..23: note = hypo
  source 1..23: mol_type = genomic DNA
aattctccatccaatcgagtctt

SEQ ID NO: 61408 - DNA, 34 bp, Homo sapiens; identical to SEQ ID NO: 40907
  misc_feature 1..34: note = chr6:149772982-149773016
  misc_feature 1..34: note = hypo
  source 1..34: mol_type = genomic DNA

SEQ ID NO: 61409 - DNA, 30 bp, Homo sapiens; identical to SEQ ID NO: 40908
  misc_feature 1..30: note = chr6:149786129-149786159
  misc_feature 1..30: note = hypo
  source 1..30: mol_type = genomic DNA

SEQ ID NO: 61410 - DNA, 30 bp, Homo sapiens; identical to SEQ ID NO: 40909
  misc_feature 1..30: note = chr6:150985942-150985972
  misc_feature 1..30: note = hypo
  source 1..30: mol_type = genomic DNA

SEQ ID NO: 61411 - DNA, 151 bp, Homo sapiens; identical to SEQ ID NO: 40910
  misc_feature 1..151: note = chr6:152520849-152521000
  misc_feature 1..151: note = hypo
  source 1..151: mol_type = genomic DNA

SEQ ID NO: 61412 - DNA, 63 bp, Homo sapiens
  misc_feature 1..63: note = chr6:154970495-154970558
  misc_feature 1..63: note = hypo
  source 1..63: mol_type = genomic DNA
gtgtaagcatctaaacgccaaaatgcctcaacttcctacctgagctcaagaagtacaagaagt

SEQ ID NO: 61413 - DNA, 26 bp, Homo sapiens
  misc_feature 1..26: note = chr6:155568751-155568777
  misc_feature 1..26: note = hypo
  source 1..26: mol_type = genomic DNA
gcacctggccacgcttcatggctttt

SEQ ID NO: 61414 - DNA, 20 bp, Homo sapiens
  misc_feature 1..20: note = chr6:155569305-155569325
  misc_feature 1..20: note = hypo
  source 1..20: mol_type = genomic DNA
cctgacgggtgaggcggcgg

SEQ ID NO: 61415 - DNA, 30 bp, Homo sapiens; identical to SEQ ID NO: 14887
  misc_feature 1..30: note = chr6:155988231-155988261
  misc_feature 1..30: note = hypo
  source 1..30: mol_type = genomic DNA

SEQ ID NO: 61416 - DNA, 30 bp, Homo sapiens; identical to SEQ ID NO: 40915
  misc_feature 1..30: note = chr6:157283403-157283433
  misc_feature 1..30: note = hypo
  source 1..30: mol_type = genomic DNA

SEQ ID NO: 61417 - DNA, 30 bp, Homo sapiens; identical to SEQ ID NO: 40916
  misc_feature 1..30: note = chr6:157455406-157455436
  misc_feature 1..30: note = hypo
  source 1..30: mol_type = genomic DNA

SEQ ID NO: 61418 - DNA, 39 bp, Homo sapiens; identical to SEQ ID NO: 14888
  misc_feature 1..39: note = chr6:157478299-157478338
  misc_feature 1..39: note = hypo
  source 1..39: mol_type = genomic DNA

SEQ ID NO: 61419 - DNA, 48 bp, Homo sapiens; identical to SEQ ID NO: 40918
  misc_feature 1..48: note = chr6:157505817-157505865
  misc_feature 1..48: note = hypo
  source 1..48: mol_type = genomic DNA

SEQ ID NO: 61420 - DNA, 27 bp, Homo sapiens
  misc_feature 1..27: note = chr6:157637384-157637411
  misc_feature 1..27: note = hypo
  source 1..27: mol_type = genomic DNA
cagcttcctgtagctcgtcccaaggtc

SEQ ID NO: 61421 - DNA, 84 bp, Homo sapiens; identical to SEQ ID NO: 40920
  misc_feature 1..84: note = chr6:157638362-157638446
  misc_feature 1..84: note = hypo
  source 1..84: mol_type = genomic DNA

SEQ ID NO: 61422 - DNA, 105 bp, Homo sapiens; identical to SEQ ID NO: 40921
  misc_feature 1..105: note = chr6:157913083-157913188
  misc_feature 1..105: note = hypo
  source 1..105: mol_type = genomic DNA

SEQ ID NO: 61423 - DNA, 50 bp, Homo sapiens; identical to SEQ ID NO: 40922
  misc_feature 1..50: note = chr6:158093775-158093825
  misc_feature 1..50: note = hypo
  source 1..50: mol_type = genomic DNA

SEQ ID NO: 61424 - DNA, 30 bp, Homo sapiens; identical to SEQ ID NO: 14891
  misc_feature 1..30: note = chr6:158119028-158119058
  misc_feature 1..30: note = hypo
  source 1..30: mol_type = genomic DNA

SEQ ID NO: 61425 - DNA, 184 bp, Homo sapiens; identical to SEQ ID NO: 40924
  misc_feature 1..184: note = chr6:158489608-158489792
  misc_feature 1..184: note = hypo
  source 1..184: mol_type = genomic DNA

SEQ ID NO: 61426 - DNA, 30 bp, Homo sapiens; identical to SEQ ID NO: 40925
  misc_feature 1..30: note = chr6:158978998-158979028
  misc_feature 1..30: note = hypo
  source 1..30: mol_type = genomic DNA

SEQ ID NO: 61427 - DNA, 48 bp, Homo sapiens; identical to SEQ ID NO: 40926
  misc_feature 1..48: note = chr6:158982731-158982779
  misc_feature 1..48: note = hypo
  source 1..48: mol_type = genomic DNA

SEQ ID NO: 61428 - DNA, 100 bp, Homo sapiens; identical to SEQ ID NO: 40927
  misc_feature 1..100: note = chr6:159049783-159049883
  misc_feature 1..100: note = hypo
  source 1..100: mol_type = genomic DNA

SEQ ID NO: 61429 - DNA, 30 bp, Homo sapiens; identical to SEQ ID NO: 40928
  misc_feature 1..30: note = chr6:159113607-159113637
  misc_feature 1..30: note = hypo
  source 1..30: mol_type = genomic DNA

SEQ ID NO: 61430 - DNA, 28 bp, Homo sapiens
  misc_feature 1..28: note = chr6:159151645-159151673
  misc_feature 1..28: note = hypo
  source 1..28: mol_type = genomic DNA
actctcagcaacgcggaaagaaagcagc

SEQ ID NO: 61431 - DNA, 30 bp, Homo sapiens; identical to SEQ ID NO: 40930
  misc_feature 1..30: note = chr6:159194759-159194789
  misc_feature 1..30: note = hypo
  source 1..30: mol_type = genomic DNA

SEQ ID NO: 61432 - DNA, 30 bp, Homo sapiens; identical to SEQ ID NO: 40931
  misc_feature 1..30: note = chr6:159253019-159253049
  misc_feature 1..30: note = hypo
  source 1..30: mol_type = genomic DNA

SEQ ID NO: 61433 - DNA, 29 bp, Homo sapiens
  misc_feature 1..29: note = chr6:159270065-159270094
  misc_feature 1..29: note = hypo
  source 1..29: mol_type = genomic DNA
catgctggccaggcacggtggctcacacc

SEQ ID NO: 61434 - DNA, 30 bp, Homo sapiens; identical to SEQ ID NO: 40933
  misc_feature 1..30: note = chr6:159456960-159456990
  misc_feature 1..30: note = hypo
  source 1..30: mol_type = genomic DNA

SEQ ID NO: 61435 - DNA, 154 bp, Homo sapiens; identical to SEQ ID NO: 40934
  misc_feature 1..154: note = chr6:159569256-159569410
  misc_feature 1..154: note = hypo
  source 1..154: mol_type = genomic DNA

SEQ ID NO: 61436 - DNA, 30 bp, Homo sapiens; identical to SEQ ID NO: 40935
  misc_feature 1..30: note = chr6:160450704-160450734
  misc_feature 1..30: note = hypo
  source 1..30: mol_type = genomic DNA

SEQ ID NO: 61437 - DNA, 55 bp, Homo sapiens; identical to SEQ ID NO: 14894
  misc_feature 1..55: note = chr6:160511899-160511954
  misc_feature 1..55: note = hypo
  source 1..55: mol_type = genomic DNA

SEQ ID NO: 61438 - DNA, 32 bp, Homo sapiens; identical to SEQ ID NO: 40937
  misc_feature 1..32: note = chr6:161259532-161259564
  misc_feature 1..32: note = hypo
  source 1..32: mol_type = genomic DNA

SEQ ID NO: 61439 - DNA, 100 bp, Homo sapiens; identical to SEQ ID NO: 40938
  misc_feature 1..100: note = chr6:161609814-161609914
  misc_feature 1..100: note = hypo
  source 1..100: mol_type = genomic DNA

SEQ ID NO: 61440 - DNA, 63 bp, Homo sapiens; identical to SEQ ID NO: 40939
  misc_feature 1..63: note = chr6:161672733-161672796
  misc_feature 1..63: note = hypo
  source 1..63: mol_type = genomic DNA

SEQ ID NO: 61441 - DNA, 162 bp, Homo sapiens; identical to SEQ ID NO: 40940
  misc_feature 1..162: note = chr6:161685567-161685729
  misc_feature 1..162: note = hypo
  source 1..162: mol_type = genomic DNA

SEQ ID NO: 61442 - DNA, 32 bp, Homo sapiens; identical to SEQ ID NO: 14896
  misc_feature 1..32: note = chr6:161690517-161690549
  misc_feature 1..32: note = hypo
  source 1..32: mol_type = genomic DNA

SEQ ID NO: 61443 - DNA, 79 bp, Homo sapiens; identical to SEQ ID NO: 40942
  misc_feature 1..79: note = chr6:161780140-161780219
  misc_feature 1..79: note = hypo
  source 1..79: mol_type = genomic DNA

SEQ ID NO: 61444 - DNA, 25 bp, Homo sapiens
  misc_feature 1..25: note = chr6:161795264-161795289
  misc_feature 1..25: note = hypo
  source 1..25: mol_type = genomic DNA
tgtgttgtgtatatgcgtatgctgt

SEQ ID NO: 61445 - DNA, 24 bp, Homo sapiens
  misc_feature 1..24: note = chr6:161795349-161795373
  misc_feature 1..24: note = hypo
  source 1..24: mol_type = genomic DNA
tgtgtgtaacgcatggtgtgcatg

SEQ ID NO: 61446 - DNA, 36 bp, Homo sapiens; identical to SEQ ID NO: 40945
  misc_feature 1..36: note = chr6:161989335-161989371
  misc_feature 1..36: note = hypo
  source 1..36: mol_type = genomic DNA

SEQ ID NO: 61447 - DNA, 166 bp, Homo sapiens; identical to SEQ ID NO: 40946
  misc_feature 1..166: note = chr6:162257865-162258031
  misc_feature 1..166: note = hypo
  source 1..166: mol_type = genomic DNA

SEQ ID NO: 61448 - DNA, 30 bp, Homo sapiens; identical to SEQ ID NO: 40947
  misc_feature 1..30: note = chr6:162280335-162280365
  misc_feature 1..30: note = hypo
  source 1..30: mol_type = genomic DNA

SEQ ID NO: 61449 - DNA, 30 bp, Homo sapiens; identical to SEQ ID NO: 40948
  misc_feature 1..30: note = chr6:163673402-163673432
  misc_feature 1..30: note = hypo
  source 1..30: mol_type = genomic DNA

SEQ ID NO: 61450 - DNA, 30 bp, Homo sapiens; identical to SEQ ID NO: 40949
  misc_feature 1..30: note = chr6:163915349-163915379
  misc_feature 1..30: note = hypo
  source 1..30: mol_type = genomic DNA

SEQ ID NO: 61451 - DNA, 17 bp, Homo sapiens
  misc_feature 1..17: note = chr6:163945812-163945829
  misc_feature 1..17: note = hypo
  source 1..17: mol_type = genomic DNA
tacgatcatctattcta

SEQ ID NO: 61452 - DNA, 43 bp, Homo sapiens; identical to SEQ ID NO: 40951
  misc_feature 1..43: note = chr6:163946785-163946828
  misc_feature 1..43: note = hypo
  source 1..43: mol_type = genomic DNA

SEQ ID NO: 61453 - DNA, 30 bp, Homo sapiens; identical to SEQ ID NO: 40952
  misc_feature 1..30: note = chr6:164012441-164012471
  misc_feature 1..30: note = hypo
  source 1..30: mol_type = genomic DNA

SEQ ID NO: 61454 - DNA, 117 bp, Homo sapiens; identical to SEQ ID NO: 40953
  misc_feature 1..117: note = chr6:164064007-164064124
  misc_feature 1..117: note = hypo
  source 1..117: mol_type = genomic DNA

SEQ ID NO: 61455 - DNA, 18 bp, Homo sapiens
  misc_feature 1..18: note = chr6:164114295-164114313
  misc_feature 1..18: note = hypo
  source 1..18: mol_type = genomic DNA
ttatttttttgagaccga

SEQ ID NO: 61456 - DNA, 30 bp, Homo sapiens; identical to SEQ ID NO: 40955
  misc_feature 1..30: note = chr6:164121841-164121871
  misc_feature 1..30: note = hypo
  source 1..30: mol_type = genomic DNA

SEQ ID NO: 61457 - DNA, 30 bp, Homo sapiens; identical to SEQ ID NO: 40956
  misc_feature 1..30: note = chr6:164143599-164143629
  misc_feature 1..30: note = hypo
  source 1..30: mol_type = genomic DNA

SEQ ID NO: 61458 - DNA, 30 bp, Homo sapiens; identical to SEQ ID NO: 40957
  misc_feature 1..30: note = chr6:164145369-164145399
  misc_feature 1..30: note = hypo
  source 1..30: mol_type = genomic DNA

SEQ ID NO: 61459 - DNA, 30 bp, Homo sapiens; identical to SEQ ID NO: 40958
  misc_feature 1..30: note = chr6:164149978-164150008
  misc_feature 1..30: note = hypo
  source 1..30: mol_type = genomic DNA

SEQ ID NO: 61460 - DNA, 92 bp, Homo sapiens; identical to SEQ ID NO: 40959
  misc_feature 1..92: note = chr6:164165801-164165893
  misc_feature 1..92: note = hypo
  source 1..92: mol_type = genomic DNA

SEQ ID NO: 61461 - DNA, 30 bp, Homo sapiens; identical to SEQ ID NO: 40960
  misc_feature 1..30: note = chr6:164173782-164173812
  misc_feature 1..30: note = hypo
  source 1..30: mol_type = genomic DNA

SEQ ID NO: 61462 - DNA, 77 bp, Homo sapiens; identical to SEQ ID NO: 40961
  misc_feature 1..77: note = chr6:164182851-164182928
  misc_feature 1..77: note = hypo
  source 1..77: mol_type = genomic DNA

SEQ ID NO: 61463 - DNA, 44 bp, Homo sapiens; identical to SEQ ID NO: 14900
  misc_feature 1..44: note = chr6:164183729-164183773
  misc_feature 1..44: note = hypo
  source 1..44: mol_type = genomic DNA

SEQ ID NO: 61464 - DNA, 15 bp, Homo sapiens
  misc_feature 1..15: note = chr6:164197003-164197018
  misc_feature 1..15: note = hypo
  source 1..15: mol_type = genomic DNA
cgtcttctgacaaac

SEQ ID NO: 61465 - DNA, 64 bp, Homo sapiens; identical to SEQ ID NO: 24267
  misc_feature 1..64: note = chr6:164228363-164228427
  misc_feature 1..64: note = hypo
  source 1..64: mol_type = genomic DNA

SEQ ID NO: 61466 - DNA, 30 bp, Homo sapiens; identical to SEQ ID NO: 40965
  misc_feature 1..30: note = chr6:164228847-164228877
  misc_feature 1..30: note = hypo
  source 1..30: mol_type = genomic DNA

SEQ ID NO: 61467 - DNA, 94 bp, Homo sapiens; identical to SEQ ID NO: 40966
  misc_feature 1..94: note = chr6:164241357-164241451
  misc_feature 1..94: note = hypo
  source 1..94: mol_type = genomic DNA

SEQ ID NO: 61468 - DNA, 30 bp, Homo sapiens; identical to SEQ ID NO: 40967
  misc_feature 1..30: note = chr6:164243378-164243408
  misc_feature 1..30: note = hypo
  source 1..30: mol_type = genomic DNA

SEQ ID NO: 61469 - DNA, 38 bp, Homo sapiens
  misc_feature 1..38: note = chr6:164283216-164283254
  misc_feature 1..38: note = hypo
  source 1..38: mol_type = genomic DNA
gggaggaggcattgccgggaagcatgtccccagcgtgg

SEQ ID NO: 61470 - DNA, 30 bp, Homo sapiens; identical to SEQ ID NO: 14906
  misc_feature 1..30: note = chr6:164288079-164288109
  misc_feature 1..30: note = hypo
  source 1..30: mol_type = genomic DNA

SEQ ID NO: 61471 - DNA, 310 bp, Homo sapiens
  misc_feature 1..310: note = chr6:164322356-164322666
  misc_feature 1..310: note = hypo
  source 1..310: mol_type = genomic DNA
aagtagaagtcctcacgggcaactccctgccatccacaccaacctccccttcttgttctctccttctcatcttaaactttcgagaggaagaagggttggtcaagggtgaacgttcctgggcatggtgagaggctgctctgtggtgcccactcacactgagagggaccagctggggacgcctgatggtgccactgaggctttggggtcccctttcagaggggggcatcttaacgcgagtcttacggtctttcctgggttcccatgctcggcggcggctcctccacaggcctgtcttccctttgttctggag

SEQ ID NO: 61472 - DNA, 86 bp, Homo sapiens; identical to SEQ ID NO: 40973
  misc_feature 1..86: note = chr6:164323845-164323931
  misc_feature 1..86: note = hypo
  source 1..86: mol_type = genomic DNA

SEQ ID NO: 61473 - DNA, 108 bp, Homo sapiens; identical to SEQ ID NO: 40974
  misc_feature 1..108: note = chr6:164334224-164334332
  misc_feature 1..108: note = hypo
  source 1..108: mol_type = genomic DNA

SEQ ID NO: 61474 - DNA, 16 bp, Homo sapiens
  misc_feature 1..16: note = chr6:166487246-166487262
  misc_feature 1..16: note = hypo
  source 1..16: mol_type = genomic DNA
gcgcccggccgaagta

SEQ ID NO: 61475 - DNA, 46 bp, Homo sapiens; identical to SEQ ID NO: 40976
  misc_feature 1..46: note = chr6:166571891-166571937
  misc_feature 1..46: note = hypo
  source 1..46: mol_type = genomic DNA

SEQ ID NO: 61476 - DNA, 34 bp, Homo sapiens; identical to SEQ ID NO: 40977
  misc_feature 1..34: note = chr6:166635593-166635627
  misc_feature 1..34: note = hypo
  source 1..34: mol_type = genomic DNA

SEQ ID NO: 61477 - DNA, 127 bp, Homo sapiens; identical to SEQ ID NO: 40978
  misc_feature 1..127: note = chr6:166711375-166711502
  misc_feature 1..127: note = hypo
  source 1..127: mol_type = genomic DNA

SEQ ID NO: 61478 - DNA, 32 bp, Homo sapiens; identical to SEQ ID NO: 40979
  misc_feature 1..32: note = chr6:166888304-166888336
  misc_feature 1..32: note = hypo
  source 1..32: mol_type = genomic DNA

SEQ ID NO: 61479 - DNA, 191 bp, Homo sapiens; identical to SEQ ID NO: 40980
  misc_feature 1..191: note = chr6:166891668-166891859
  misc_feature 1..191: note = hypo
  source 1..191: mol_type = genomic DNA

SEQ ID NO: 61480 - DNA, 11 bp, Homo sapiens
  misc_feature 1..11: note = chr6:166944356-166944367
  misc_feature 1..11: note = hypo
  source 1..11: mol_type = genomic DNA
aaaaccgagtg

SEQ ID NO: 61481 - DNA, 109 bp, Homo sapiens; identical to SEQ ID NO: 24273
  misc_feature 1..109: note = chr6:166944403-166944512
  misc_feature 1..109: note = hypo
  source 1..109: mol_type = genomic DNA

SEQ ID NO: 61482 - DNA, 30 bp, Homo sapiens; identical to SEQ ID NO: 40982
  misc_feature 1..30: note = chr6:166982961-166982991
  misc_feature 1..30: note = hypo
  source 1..30: mol_type = genomic DNA

SEQ ID NO: 61483 - DNA, 79 bp, Homo sapiens; identical to SEQ ID NO: 40983
  misc_feature 1..79: note = chr6:167038238-167038317
  misc_feature 1..79: note = hypo
  source 1..79: mol_type = genomic DNA

SEQ ID NO: 61484 - DNA, 210 bp, Homo sapiens; identical to SEQ ID NO: 40984
  misc_feature 1..210: note = chr6:167139240-167139450
  misc_feature 1..210: note = hypo
  source 1..210: mol_type = genomic DNA

SEQ ID NO: 61485 - DNA, 159 bp, Homo sapiens; identical to SEQ ID NO: 40985
  misc_feature 1..159: note = chr6:167140362-167140521
  misc_feature 1..159: note = hypo
  source 1..159: mol_type = genomic DNA

SEQ ID NO: 61486 - DNA, 79 bp, Homo sapiens; identical to SEQ ID NO: 40986
  misc_feature 1..79: note = chr6:167835047-167835126
  misc_feature 1..79: note = hypo
  source 1..79: mol_type = genomic DNA

SEQ ID NO: 61487 - DNA, 33 bp, Homo sapiens; identical to SEQ ID NO: 40987
  misc_feature 1..33: note = chr6:168122617-168122650
  misc_feature 1..33: note = hypo
  source 1..33: mol_type = genomic DNA

SEQ ID NO: 61488 - DNA, 62 bp, Homo sapiens; identical to SEQ ID NO: 40988
  misc_feature 1..62: note = chr6:168376121-168376183
  misc_feature 1..62: note = hypo
  source 1..62: mol_type = genomic DNA

SEQ ID NO: 61489 - DNA, 131 bp, Homo sapiens; identical to SEQ ID NO: 40989
  misc_feature 1..131: note = chr6:168377422-168377553
  misc_feature 1..131: note = hypo
  source 1..131: mol_type = genomic DNA

SEQ ID NO: 61490 - DNA, 33 bp, Homo sapiens; identical to SEQ ID NO: 40990
  misc_feature 1..33: note = chr6:168399961-168399994
  misc_feature 1..33: note = hypo
  source 1..33: mol_type = genomic DNA

SEQ ID NO: 61491 - DNA, 196 bp, Homo sapiens; identical to SEQ ID NO: 40991
  misc_feature 1..196: note = chr6:168453289-168453485
  misc_feature 1..196: note = hypo
  source 1..196: mol_type = genomic DNA

SEQ ID NO: 61492 - DNA, 30 bp, Homo sapiens; identical to SEQ ID NO: 40992
  misc_feature 1..30: note = chr6:168760650-168760680
  misc_feature 1..30: note = hypo
  source 1..30: mol_type = genomic DNA

SEQ ID NO: 61493 - DNA, 18 bp, Homo sapiens
  misc_feature 1..18: note = chr6:168858296-168858314
  misc_feature 1..18: note = hypo
  source 1..18: mol_type = genomic DNA
tgccggggtgggagcctg

SEQ ID NO: 61494 - DNA, 157 bp, Homo sapiens; identical to SEQ ID NO: 40994
  misc_feature 1..157: note = chr6:168947642-168947799
  misc_feature 1..157: note = hypo
  source 1..157: mol_type = genomic DNA

SEQ ID NO: 61495 - DNA, 30 bp, Homo sapiens; identical to SEQ ID NO: 40995
  misc_feature 1..30: note = chr6:169400246-169400276
  misc_feature 1..30: note = hypo
  source 1..30: mol_type = genomic DNA

SEQ ID NO: 61496 - DNA, 50 bp, Homo sapiens; identical to SEQ ID NO: 40996
  misc_feature 1..50: note = chr6:169562391-169562441
  misc_feature 1..50: note = hypo
  source 1..50: mol_type = genomic DNA

SEQ ID NO: 61497 - DNA, 30 bp, Homo sapiens; identical to SEQ ID NO: 40997
  misc_feature 1..30: note = chr6:169562792-169562822
  misc_feature 1..30: note = hypo
  source 1..30: mol_type = genomic DNA

SEQ ID NO: 61498 - DNA, 415 bp, Homo sapiens; identical to SEQ ID NO: 40998
  misc_feature 1..415: note = chr6:169632421-169632836
  misc_feature 1..415: note = hypo
  source 1..415: mol_type = genomic DNA

SEQ ID NO: 61499 - DNA, 35 bp, Homo sapiens; identical to SEQ ID NO: 40999
  misc_feature 1..35: note = chr6:169637816-169637851
  misc_feature 1..35: note = hypo
  source 1..35: mol_type = genomic DNA

SEQ ID NO: 61500 - DNA, 30 bp, Homo sapiens; identical to SEQ ID NO: 41000
  misc_feature 1..30: note = chr6:169713660-169713690
  misc_feature 1..30: note = hypo
  source 1..30: mol_type = genomic DNA

SEQ ID NO: 61501 - DNA, 30 bp, Homo sapiens; identical to SEQ ID NO: 41001
  misc_feature 1..30: note = chr6:169740776-169740806
  misc_feature 1..30: note = hypo
  source 1..30: mol_type = genomic DNA

SEQ ID NO: 61502 - DNA, 30 bp, Homo sapiens; identical to SEQ ID NO: 41002
  misc_feature 1..30: note = chr6:170065367-170065397
  misc_feature 1..30: note = hypo
  source 1..30: mol_type = genomic DNA

SEQ ID NO: 61503 - DNA, 30 bp, Homo sapiens; identical to SEQ ID NO: 41003
  misc_feature 1..30: note = chr6:170201723-170201753
  misc_feature 1..30: note = hypo
  source 1..30: mol_type = genomic DNA

SEQ ID NO: 61504 - DNA, 30 bp, Homo sapiens; identical to SEQ ID NO: 41004
  misc_feature 1..30: note = chr6:170240081-170240111
  misc_feature 1..30: note = hypo
  source 1..30: mol_type = genomic DNA

SEQ ID NO: 61505 - DNA, 30 bp, Homo sapiens; identical to SEQ ID NO: 41005
  misc_feature 1..30: note = chr6:170263220-170263250
  misc_feature 1..30: note = hypo
  source 1..30: mol_type = genomic DNA

SEQ ID NO: 61506 - DNA, 30 bp, Homo sapiens; identical to SEQ ID NO: 41006
  misc_feature 1..30: note = chr6:170361487-170361517
  misc_feature 1..30: note = hypo
  source 1..30: mol_type = genomic DNA

SEQ ID NO: 61507 - DNA, 30 bp, Homo sapiens; identical to SEQ ID NO: 41007
  misc_feature 1..30: note = chr6:170368767-170368797
  misc_feature 1..30: note = hypo
  source 1..30: mol_type = genomic DNA

SEQ ID NO: 61508 - DNA, 30 bp, Homo sapiens; identical to SEQ ID NO: 41008
  misc_feature 1..30: note = chr6:170402505-170402535
  misc_feature 1..30: note = hypo
  source 1..30: mol_type = genomic DNA

SEQ ID NO: 61509 - DNA, 30 bp, Homo sapiens; identical to SEQ ID NO: 41009
  misc_feature 1..30: note = chr6:170408290-170408320
  misc_feature 1..30: note = hypo
  source 1..30: mol_type = genomic DNA

SEQ ID NO: 61510 - DNA, 40 bp, Homo sapiens; identical to SEQ ID NO: 41010
  misc_feature 1..40: note = chr6:170454160-170454200
  misc_feature 1..40: note = hypo
  source 1..40: mol_type = genomic DNA

SEQ ID NO: 61511 - DNA, 77 bp, Homo sapiens; identical to SEQ ID NO: 24277
  misc_feature 1..77: note = chr6:170475028-170475105
  misc_feature 1..77: note = hypo
  source 1..77: mol_type = genomic DNA

SEQ ID NO: 61512 - DNA, 357 bp, Homo sapiens
  misc_feature 1..357: note = chr6:170475267-170475624
  misc_feature 1..357: note = hypo
  source 1..357: mol_type = genomic DNA
ggcactgagagaccggtgccgccccccgccgtccacacaacccgggcctcgggcagcaccagcaggacttttattcctcaccccgcacgccgccgtccatctcctaggccagcgtgattcttctgagtgcagctgggtctcctcctgggagatccggtggctctagcagcgtgggtgctgggaacaggaccagcctcgccggcggacagtgtggacgcctgagggcaaaccctggaccactctctccccgggggactccgttcccgcctccagggagctgcgaacgctccttctgggacacctgttggcaagaaaccagttcaatcgtctcacttccagaaacgattctgtgttttg

SEQ ID NO: 61513 - DNA, 118 bp, Homo sapiens; identical to SEQ ID NO: 41012
  misc_feature 1..118: note = chr6:170493059-170493177
  misc_feature 1..118: note = hypo
  source 1..118: mol_type = genomic DNA

SEQ ID NO: 61514 - DNA, 30 bp, Homo sapiens; identical to SEQ ID NO: 41013
  misc_feature 1..30: note = chr6:170569817-170569847
  misc_feature 1..30: note = hypo
  source 1..30: mol_type = genomic DNA

SEQ ID NO: 61515 - DNA, 167 bp, Homo sapiens; identical to SEQ ID NO: 41015
  misc_feature 1..167: note = chr7:131076-131243
  misc_feature 1..167: note = hypo
  source 1..167: mol_type = genomic DNA

SEQ ID NO: 61516 - DNA, 159 bp, Homo sapiens; identical to SEQ ID NO: 41016
  misc_feature 1..159: note = chr7:171340-171499
  misc_feature 1..159: note = hypo
  source 1..159: mol_type = genomic DNA

SEQ ID NO: 61517 - DNA, 30 bp, Homo sapiens; identical to SEQ ID NO: 41017
  misc_feature 1..30: note = chr7:306966-306996
  misc_feature 1..30: note = hypo
  source 1..30: mol_type = genomic DNA

SEQ ID NO: 61518 - DNA, 30 bp, Homo sapiens; identical to SEQ ID NO: 41018
  misc_feature 1..30: note = chr7:322785-322815
  misc_feature 1..30: note = hypo
  source 1..30: mol_type = genomic DNA

SEQ ID NO: 61519 - DNA, 44 bp, Homo sapiens; identical to SEQ ID NO: 41019
  misc_feature 1..44: note = chr7:328564-328608
  misc_feature 1..44: note = hypo
  source 1..44: mol_type = genomic DNA

SEQ ID NO: 61520 - DNA, 30 bp, Homo sapiens; identical to SEQ ID NO: 41021
  misc_feature 1..30: note = chr7:381568-381598
  misc_feature 1..30: note = hypo
  source 1..30: mol_type = genomic DNA

SEQ ID NO: 61521 - DNA, 179 bp, Homo sapiens; identical to SEQ ID NO: 41023
  misc_feature 1..179: note = chr7:409602-409781
  misc_feature 1..179: note = hypo
  source 1..179: mol_type = genomic DNA

SEQ ID NO: 61522 - DNA, 30 bp, Homo sapiens; identical to SEQ ID NO: 41024
  misc_feature 1..30: note = chr7:410011-410041
  misc_feature 1..30: note = hypo
  source 1..30: mol_type = genomic DNA

SEQ ID NO: 61523 - DNA, 37 bp, Homo sapiens; identical to SEQ ID NO: 41025
  misc_feature 1..37: note = chr7:430257-430294
  misc_feature 1..37: note = hypo
  source 1..37: mol_type = genomic DNA

SEQ ID NO: 61524 - DNA, 228 bp, Homo sapiens
  misc_feature 1..228: note = chr7:431492-431720
  misc_feature 1..228: note = hypo
  source 1..228: mol_type = genomic DNA
agggagcggccgccagccgctaggatcccgatgccgccgcaagtaaggacaggcccgggtgctgccgcaggaggccaggcctgcgctcgccgctgtggaatgtgtgtttgtctgatgagcatccctgcagggccccagatggagggtgtgacaaggatgggggctgagtctccagggcccgggggcacctgcacgctgcccctggcaggggcccgggcatcccacctg

SEQ ID NO: 61525 - DNA, 45 bp, Homo sapiens; identical to SEQ ID NO: 41027
  misc_feature 1..45: note = chr7:476438-476483
  misc_feature 1..45: note = hypo
  source 1..45: mol_type = genomic DNA

SEQ ID NO: 61526 - DNA, 30 bp, Homo sapiens; identical to SEQ ID NO: 41028
  misc_feature 1..30: note = chr7:494982-495012
  misc_feature 1..30: note = hypo
  source 1..30: mol_type = genomic DNA

SEQ ID NO: 61527 - DNA, 40 bp, Homo sapiens
  misc_feature 1..40: note = chr7:497742-497782
  misc_feature 1..40: note = hypo
  source 1..40: mol_type = genomic DNA
ctgggttaagagcagcgacaactgttcctattcataccgc

SEQ ID NO: 61528 - DNA, 30 bp, Homo sapiens; identical to SEQ ID NO: 41030
  misc_feature 1..30: note = chr7:502286-502316
  misc_feature 1..30: note = hypo
  source 1..30: mol_type = genomic DNA

SEQ ID NO: 61529 - DNA, 279 bp, Homo sapiens; identical to SEQ ID NO: 41031
  misc_feature 1..279: note = chr7:502708-502987
  misc_feature 1..279: note = hypo
  source 1..279: mol_type = genomic DNA

SEQ ID NO: 61530 - DNA, 135 bp, Homo sapiens
  misc_feature 1..135: note = chr7:503676-503811
  misc_feature 1..135: note = hypo
  source 1..135: mol_type = genomic DNA
cagcccgggagggagcgtgaagtggaggatctcggcaggcgtggctgtgtccaggcaggcgggtgctgccgcgtccccggctgcagggtcttggttccccggagccacaggacggcagggcttcacggctccccg

SEQ ID NO: 61531 - DNA, 30 bp, Homo sapiens; identical to SEQ ID NO: 41033
  misc_feature 1..30: note = chr7:543015-543045
  misc_feature 1..30: note = hypo
  source 1..30: mol_type = genomic DNA

SEQ ID NO: 61532 - DNA, 27 bp, Homo sapiens
  misc_feature 1..27: note = chr7:551572-551599
  misc_feature 1..27: note = hypo
  source 1..27: mol_type = genomic DNA
caccagttcagcagccggcgcaggagc

SEQ ID NO: 61533 - DNA, 47 bp, Homo sapiens; identical to SEQ ID NO: 41035
  misc_feature 1..47: note = chr7:551972-552019
  misc_feature 1..47: note = hypo
  source 1..47: mol_type = genomic DNA

SEQ ID NO: 61534 - DNA, 28 bp, Homo sapiens
  misc_feature 1..28: note = chr7:579020-579048
  misc_feature 1..28: note = hypo
  source 1..28: mol_type = genomic DNA
ctcctgaggccggcgagtagattcctga

SEQ ID NO: 61535 - DNA, 70 bp, Homo sapiens; identical to SEQ ID NO: 41037
  misc_feature 1..70: note = chr7:803490-803560
  misc_feature 1..70: note = hypo
  source 1..70: mol_type = genomic DNA

SEQ ID NO: 61536 - DNA, 30 bp, Homo sapiens; identical to SEQ ID NO: 41038
  misc_feature 1..30: note = chr7:808547-808577
  misc_feature 1..30: note = hypo
  source 1..30: mol_type = genomic DNA

SEQ ID NO: 61537 - DNA, 75 bp, Homo sapiens; identical to SEQ ID NO: 41039
  misc_feature 1..75: note = chr7:819623-819698
  misc_feature 1..75: note = hypo
  source 1..75: mol_type = genomic DNA

SEQ ID NO: 61538 - DNA, 520 bp, Homo sapiens; identical to SEQ ID NO: 41040
  misc_feature 1..520: note = chr7:834330-834850
  misc_feature 1..520: note = hypo
  source 1..520: mol_type = genomic DNA

SEQ ID NO: 61539 - DNA, 59 bp, Homo sapiens; identical to SEQ ID NO: 41042
  misc_feature 1..59: note = chr7:915323-915382
  misc_feature 1..59: note = hypo
  source 1..59: mol_type = genomic DNA

SEQ ID NO: 61540 - DNA, 68 bp, Homo sapiens; identical to SEQ ID NO: 41043
  misc_feature 1..68: note = chr7:959576-959644
  misc_feature 1..68: note = hypo
  source 1..68: mol_type = genomic DNA

SEQ ID NO: 61541 - DNA, 73 bp, Homo sapiens; identical to SEQ ID NO: 41044
  misc_feature 1..73: note = chr7:959899-959972
  misc_feature 1..73: note = hypo
  source 1..73: mol_type = genomic DNA

SEQ ID NO: 61542 - DNA, 44 bp, Homo sapiens; identical to SEQ ID NO: 41045
  misc_feature 1..44: note = chr7:966875-966919
  misc_feature 1..44: note = hypo
  source 1..44: mol_type = genomic DNA

SEQ ID NO: 61543 - DNA, 60 bp, Homo sapiens; identical to SEQ ID NO: 41046
  misc_feature 1..60: note = chr7:986276-986336
  misc_feature 1..60: note = hypo
  source 1..60: mol_type = genomic DNA

SEQ ID NO: 61544 - DNA, 34 bp, Homo sapiens; identical to SEQ ID NO: 41047
  misc_feature 1..34: note = chr7:1022042-1022076
  misc_feature 1..34: note = hypo
  source 1..34: mol_type = genomic DNA

SEQ ID NO: 61545 - DNA, 48 bp, Homo sapiens; identical to SEQ ID NO: 41048
  misc_feature 1..48: note = chr7:1022919-1022967
  misc_feature 1..48: note = hypo
  source 1..48: mol_type = genomic DNA

SEQ ID NO: 61546 - DNA, 30 bp, Homo sapiens; identical to SEQ ID NO: 41049
  misc_feature 1..30: note = chr7:1023349-1023379
  misc_feature 1..30: note = hypo
  source 1..30: mol_type = genomic DNA

SEQ ID NO: 61547 - DNA, 54 bp, Homo sapiens; identical to SEQ ID NO: 41050
  misc_feature 1..54: note = chr7:1026923-1026977
  misc_feature 1..54: note = hypo
  source 1..54: mol_type = genomic DNA

SEQ ID NO: 61548 - DNA, 190 bp, Homo sapiens; identical to SEQ ID NO: 41051
  misc_feature 1..190: note = chr7:1027200-1027390
  misc_feature 1..190: note = hypo
  source 1..190: mol_type = genomic DNA

SEQ ID NO: 61549 - DNA, 167 bp, Homo sapiens
  misc_feature 1..167: note = chr7:1030005-1030172
  misc_feature 1..167: note = hypo
  source 1..167: mol_type = genomic DNA
tggcgcgtgtgctgggggcggtgtgatgggacacctgctgtctgagacggccctggcccccgtcccagcgctgaccatgcacgtgagcggcaggcggcccctcaccgagaagagaggataagccgtggcacattcccacctgcgccacgtgaagcggcgccccaagg

SEQ ID NO: 61550 - DNA, 72 bp, Homo sapiens; identical to SEQ ID NO: 41053
  misc_feature 1..72: note = chr7:1037234-1037306
  misc_feature 1..72: note = hypo
  source 1..72: mol_type = genomic DNA

SEQ ID NO: 61551 - DNA, 135 bp, Homo sapiens
  misc_feature 1..135: note = chr7:1054444-1054579
  misc_feature 1..135: note = hypo
  source 1..135: mol_type = genomic DNA
gccacggcagcgttccggttggtgtcaccctgtcccggcctgagcccagctctcagatccgagcaccaattctgtctacagccccttcctgcctgcgggccctccctgccctgcagggacggtgcagtgagcaca

SEQ ID NO: 61552 - DNA, 350 bp, Homo sapiens; identical to SEQ ID NO: 41055
  misc_feature 1..350: note = chr7:1066042-1066392
  misc_feature 1..350: note = hypo
  source 1..350: mol_type = genomic DNA

SEQ ID NO: 61553 - DNA, 30 bp, Homo sapiens; identical to SEQ ID NO: 41057
  misc_feature 1..30: note = chr7:1115722-1115752
  misc_feature 1..30: note = hypo
  source 1..30: mol_type = genomic DNA

SEQ ID NO: 61554 - DNA, 37 bp, Homo sapiens; identical to SEQ ID NO: 41058
  misc_feature 1..37: note = chr7:1303471-1303508
  misc_feature 1..37: note = hypo
  source 1..37: mol_type = genomic DNA

SEQ ID NO: 61555 - DNA, 38 bp, Homo sapiens; identical to SEQ ID NO: 24287
  misc_feature 1..38: note = chr7:1308497-1308535
  misc_feature 1..38: note = hypo
  source 1..38: mol_type = genomic DNA

SEQ ID NO: 61556 - DNA, 30 bp, Homo sapiens; identical to SEQ ID NO: 41060
  misc_feature 1..30: note = chr7:1313980-1314010
  misc_feature 1..30: note = hypo
  source 1..30: mol_type = genomic DNA

SEQ ID NO: 61557 - DNA, 68 bp, Homo sapiens; identical to SEQ ID NO: 41061
  misc_feature 1..68: note = chr7:1315892-1315960
  misc_feature 1..68: note = hypo
  source 1..68: mol_type = genomic DNA

SEQ ID NO: 61558 - DNA, 30 bp, Homo sapiens; identical to SEQ ID NO: 41062
  misc_feature 1..30: note = chr7:1318952-1318982
  misc_feature 1..30: note = hypo
  source 1..30: mol_type = genomic DNA

SEQ ID NO: 61559 - DNA, 167 bp, Homo sapiens
  misc_feature 1..167: note = chr7:1325643-1325810
  misc_feature 1..167: note = hypo
  source 1..167: mol_type = genomic DNA
tcgcctggggacacacgtggtgcgtgtggcttttcagctgctcaacactcacttctgaggcccccgcggcgtggcacggcctgggcgttggatgcagcagtgaacgggacccacgcggggactcagggtatgacgggcagaggggtaggtggggtgggggcaggtga

SEQ ID NO: 61560 - DNA, 59 bp, Homo sapiens
  misc_feature 1..59: note = chr7:1325882-1325941
  misc_feature 1..59: note = hypo
  source 1..59: mol_type = genomic DNA
aacccgggcgcactgggaggcacgatccaggcggagggagcagccgtgccagggccctg

SEQ ID NO: 61561 - DNA, 33 bp, Homo sapiens; identical to SEQ ID NO: 41064
  misc_feature 1..33: note = chr7:1331244-1331277
  misc_feature 1..33: note = hypo
  source 1..33: mol_type = genomic DNA

SEQ ID NO: 61562 - DNA, 82 bp, Homo sapiens; identical to SEQ ID NO: 41065
  misc_feature 1..82: note = chr7:1333580-1333662
  misc_feature 1..82: note = hypo
  source 1..82: mol_type = genomic DNA

SEQ ID NO: 61563 - DNA, 83 bp, Homo sapiens; identical to SEQ ID NO: 41066
  misc_feature 1..83: note = chr7:1351523-1351606
  misc_feature 1..83: note = hypo
  source 1..83: mol_type = genomic DNA

SEQ ID NO: 61564 - DNA, 34 bp, Homo sapiens; identical to SEQ ID NO: 41067
  misc_feature 1..34: note = chr7:1363593-1363627
  misc_feature 1..34: note = hypo
  source 1..34: mol_type = genomic DNA

SEQ ID NO: 61565 - DNA, 144 bp, Homo sapiens; identical to SEQ ID NO: 41068
  misc_feature 1..144: note = chr7:1365367-1365511
  misc_feature 1..144: note = hypo
  source 1..144: mol_type = genomic DNA

SEQ ID NO: 61566 - DNA, 81 bp, Homo sapiens; identical to SEQ ID NO: 41069
  misc_feature 1..81: note = chr7:1368971-1369052
  misc_feature 1..81: note = hypo
  source 1..81: mol_type = genomic DNA

SEQ ID NO: 61567 - DNA, 61 bp, Homo sapiens; identical to SEQ ID NO: 41070
  misc_feature 1..61: note = chr7:1384815-1384876
  misc_feature 1..61: note = hypo
  source 1..61: mol_type = genomic DNA

SEQ ID NO: 61568 - DNA, 185 bp, Homo sapiens; identical to SEQ ID NO: 41071
  misc_feature 1..185: note = chr7:1395730-1395915
  misc_feature 1..185: note = hypo
  source 1..185: mol_type = genomic DNA

SEQ ID NO: 61569 - DNA, 89 bp, Homo sapiens
  misc_feature 1..89: note = chr7:1416131-1416220
  misc_feature 1..89: note = hypo
  source 1..89: mol_type = genomic DNA
agggcatcgtgcaggcactaaactcaatgctacaggagaattcctcgtggcacaggaaaggtctcatcgtataccgttgcgggaaaagg

SEQ ID NO: 61570 - DNA, 26 bp, Homo sapiens
  misc_feature 1..26: note = chr7:1423606-1423632
  misc_feature 1..26: note = hypo
  source 1..26: mol_type = genomic DNA
ttgctgccttccccccgcccagtccc

SEQ ID NO: 61571 - DNA, 79 bp, Homo sapiens; identical to SEQ ID NO: 41074
  misc_feature 1..79: note = chr7:1451244-1451323
  misc_feature 1..79: note = hypo
  source 1..79: mol_type = genomic DNA

SEQ ID NO: 61572 - DNA, 30 bp, Homo sapiens; identical to SEQ ID NO: 41075
  misc_feature 1..30: note = chr7:1453817-1453847
  misc_feature 1..30: note = hypo
  source 1..30: mol_type = genomic DNA

SEQ ID NO: 61573 - DNA, 82 bp, Homo sapiens
  misc_feature 1..82: note = chr7:1458959-1459041
  misc_feature 1..82: note = hypo
  source 1..82: mol_type = genomic DNA
cagctcccataaccccgtctcctcctcctcctcgccctcctcctcctcgctgtctctgcaccacttccacctgcccgggcct

SEQ ID NO: 61574 - DNA, 63 bp, Homo sapiens; identical to SEQ ID NO: 41077
  misc_feature 1..63: note = chr7:1460807-1460870
  misc_feature 1..63: note = hypo
  source 1..63: mol_type = genomic DNA

SEQ ID NO: 61575 - DNA, 30 bp, Homo sapiens; identical to SEQ ID NO: 41078
  misc_feature 1..30: note = chr7:1503320-1503350
  misc_feature 1..30: note = hypo
  source 1..30: mol_type = genomic DNA

SEQ ID NO: 61576 - DNA, 171 bp, Homo sapiens
  misc_feature 1..171: note = chr7:1503596-1503767
  misc_feature 1..171: note = hypo
  source 1..171: mol_type = genomic DNA
agggaggtgtcctggccgagtggtgtttcccgcgggacttctcagagccttcatcacctgatacgcacctccactcttccagggagaggacacactgcacagtggttcccaaactgacttgcccacaggacccctgtggacggttgtggggcaccacgtcagcccccctgc

SEQ ID NO: 61577 - DNA, 63 bp, Homo sapiens; identical to SEQ ID NO: 41080
  misc_feature 1..63: note = chr7:1516637-1516700
  misc_feature 1..63: note = hypo
  source 1..63: mol_type = genomic DNA

SEQ ID NO: 61578 - DNA, 42 bp, Homo sapiens; identical to SEQ ID NO: 41081
  misc_feature 1..42: note = chr7:1532979-1533021
  misc_feature 1..42: note = hypo
  source 1..42: mol_type = genomic DNA

SEQ ID NO: 61579 - DNA, 49 bp, Homo sapiens
  misc_feature 1..49: note = chr7:1547262-1547311
  misc_feature 1..49: note = hypo
  source 1..49: mol_type = genomic DNA
gggcaggaccacaggcgttccgtcatcctgggggggtgtgcagggtctg

SEQ ID NO: 61580 - DNA, 65 bp, Homo sapiens
  misc_feature 1..65: note = chr7:1547394-1547459
  misc_feature 1..65: note = hypo
  source 1..65: mol_type = genomic DNA
ttggtgtctgttcaaattgtttgctcactttttgaaaatattttttatggccaggcgcgatggct

SEQ ID NO: 61581 - DNA, 30 bp, Homo sapiens; identical to SEQ ID NO: 14938
  misc_feature 1..30: note = chr7:1598982-1599012
  misc_feature 1..30: note = hypo
  source 1..30: mol_type = genomic DNA

SEQ ID NO: 61582 - DNA, 159 bp, Homo sapiens; identical to SEQ ID NO: 41085
  misc_feature 1..159: note = chr7:1600538-1600697
  misc_feature 1..159: note = hypo
  source 1..159: mol_type = genomic DNA

SEQ ID NO: 61583 - DNA, 30 bp, Homo sapiens; identical to SEQ ID NO: 41086
  misc_feature 1..30: note = chr7:1607585-1607615
  misc_feature 1..30: note = hypo
  source 1..30: mol_type = genomic DNA

SEQ ID NO: 61584 - DNA, 73 bp, Homo sapiens; identical to SEQ ID NO: 41088
  misc_feature 1..73: note = chr7:1624815-1624888
  misc_feature 1..73: note = hypo
  source 1..73: mol_type = genomic DNA

SEQ ID NO: 61585 - DNA, 66 bp, Homo sapiens
  misc_feature 1..66: note = chr7:1641708-1641774
  misc_feature 1..66: note = hypo
  source 1..66: mol_type = genomic DNA
ctcgggatgcacctccgcactgtggggccatctgggtcagcccggacgcaccggcctctgtctggg

SEQ ID NO: 61586 - DNA, 34 bp, Homo sapiens
  misc_feature 1..34: note = chr7:1641923-1641957
  misc_feature 1..34: note = hypo
  source 1..34: mol_type = genomic DNA
tgccttccaggtgaggcctcggtcattccaggtg

SEQ ID NO: 61587 - DNA, 30 bp, Homo sapiens; identical to SEQ ID NO: 41090
  misc_feature 1..30: note = chr7:1680203-1680233
  misc_feature 1..30: note = hypo
  source 1..30: mol_type = genomic DNA

SEQ ID NO: 61588 - DNA, 100 bp, Homo sapiens; identical to SEQ ID NO: 41092
  misc_feature 1..100: note = chr7:1684968-1685068
  misc_feature 1..100: note = hypo
  source 1..100: mol_type = genomic DNA

SEQ ID NO: 61589 - DNA, 27 bp, Homo sapiens
  misc_feature 1..27: note = chr7:1688950-1688977
  misc_feature 1..27: note = hypo
  source 1..27: mol_type = genomic DNA
cctccctggatctcacgtcctcatttg

SEQ ID NO: 61590 - DNA, 65 bp, Homo sapiens; identical to SEQ ID NO: 41094
  misc_feature 1..65: note = chr7:1694007-1694072
  misc_feature 1..65: note = hypo
  source 1..65: mol_type = genomic DNA

SEQ ID NO: 61591 - DNA, 34 bp, Homo sapiens; identical to SEQ ID NO: 41095
  misc_feature 1..34: note = chr7:1694952-1694986
  misc_feature 1..34: note = hypo
  source 1..34: mol_type = genomic DNA

SEQ ID NO: 61592 - DNA, 50 bp, Homo sapiens; identical to SEQ ID NO: 41096
  misc_feature 1..50: note = chr7:1714947-1714997
  misc_feature 1..50: note = hypo
  source 1..50: mol_type = genomic DNA

SEQ ID NO: 61593 - DNA, 57 bp, Homo sapiens; identical to SEQ ID NO: 41097
  misc_feature 1..57: note = chr7:1718027-1718084
  misc_feature 1..57: note = hypo
  source 1..57: mol_type = genomic DNA

SEQ ID NO: 61594 - DNA, 206 bp, Homo sapiens; identical to SEQ ID NO: 41098
  misc_feature 1..206: note = chr7:1731744-1731950
  misc_feature 1..206: note = hypo
  source 1..206: mol_type = genomic DNA

SEQ ID NO: 61595 - DNA, 59 bp, Homo sapiens
  misc_feature 1..59: note = chr7:1733378-1733437
  misc_feature 1..59: note = hypo
  source 1..59: mol_type = genomic DNA
cccagagcaggtgtctgggagaccctgatcagtgctgacagacacggggtgcgggacac

SEQ ID NO: 61596 - DNA, 286 bp, Homo sapiens; identical to SEQ ID NO: 41100
  misc_feature 1..286: note = chr7:1734709-1734995
  misc_feature 1..286: note = hypo
  source 1..286: mol_type = genomic DNA

SEQ ID NO: 61597 - DNA, 180 bp, Homo sapiens
  misc_feature 1..180: note = chr7:1775651-1775831
  misc_feature 1..180: note = hypo
  source 1..180: mol_type = genomic DNA
cagcaggtgcacaggcgggccccccacctgctcctagctgggccgggtcaccgtggcaggccttgcggctcgaggcccaactgccctgatatgcctatcacagcctcatgggctctgcggcagagcccagggagacagacagggcgagagccaagctgcagaggcaggcagacgttagca

SEQ ID NO: 61598 - DNA, 30 bp, Homo sapiens; identical to SEQ ID NO: 41102
  misc_feature 1..30: note = chr7:1779654-1779684
  misc_feature 1..30: note = hypo
  source 1..30: mol_type = genomic DNA

SEQ ID NO: 61599 - DNA, 90 bp, Homo sapiens; identical to SEQ ID NO: 41103
  misc_feature 1..90: note = chr7:1783212-1783302
  misc_feature 1..90: note = hypo
  source 1..90: mol_type = genomic DNA

SEQ ID NO: 61600 - DNA, 69 bp, Homo sapiens; identical to SEQ ID NO: 41104
  misc_feature 1..69: note = chr7:1784330-1784399
  misc_feature 1..69: note = hypo
  source 1..69: mol_type = genomic DNA

SEQ ID NO: 61601 - DNA, 186 bp, Homo sapiens; identical to SEQ ID NO: 41105
  misc_feature 1..186: note = chr7:1784690-1784876
  misc_feature 1..186: note = hypo
  source 1..186: mol_type = genomic DNA

SEQ ID NO: 61602 - DNA, 104 bp, Homo sapiens
  misc_feature 1..104: note = chr7:1786410-1786514
  misc_feature 1..104: note = hypo
  source 1..104: mol_type = genomic DNA
cacgagggcctggggcgcaaggcgtccatcctggagccactcacccggccgcggccccgcgacctcgcctactcgcagctgtccccgcagtaccacagcctgag

SEQ ID NO: 61603 - DNA, 14 bp, Homo sapiens
  misc_feature 1..14: note = chr7:1787152-1787166
  misc_feature 1..14: note = hypo
  source 1..14: mol_type = genomic DNA
cgtggggggtgtgg

SEQ ID NO: 61604 - DNA, 95 bp, Homo sapiens
  misc_feature 1..95: note = chr7:1787324-1787419
  misc_feature 1..95: note = hypo
  source 1..95: mol_type = genomic DNA
agccctgctggactcagggtgggtggaggctgtgcctgtggacggccggggtggccaggacggccaagggctgggaggcacgtcccccagcccag

SEQ ID NO: 61605 - DNA, 30 bp, Homo sapiens; identical to SEQ ID NO: 41108
  misc_feature 1..30: note = chr7:1795180-1795210
  misc_feature 1..30: note = hypo
  source 1..30: mol_type = genomic DNA

SEQ ID NO: 61606 - DNA, 30 bp, Homo sapiens; identical to SEQ ID NO: 41110
  misc_feature 1..30: note = chr7:1838908-1838938
  misc_feature 1..30: note = hypo
  source 1..30: mol_type = genomic DNA

SEQ ID NO: 61607 - DNA, 42 bp, Homo sapiens; identical to SEQ ID NO: 41111
  misc_feature 1..42: note = chr7:1849747-1849789
  misc_feature 1..42: note = hypo
  source 1..42: mol_type = genomic DNA

SEQ ID NO: 61608 - DNA, 53 bp, Homo sapiens; identical to SEQ ID NO: 41112
  misc_feature 1..53: note = chr7:1931869-1931922
  misc_feature 1..53: note = hypo
  source 1..53: mol_type = genomic DNA

SEQ ID NO: 61609 - DNA, 138 bp, Homo sapiens; identical to SEQ ID NO: 41113
  misc_feature 1..138: note = chr7:1962373-1962511
  misc_feature 1..138: note = hypo
  source 1..138: mol_type = genomic DNA

SEQ ID NO: 61610 - DNA, 30 bp, Homo sapiens; identical to SEQ ID NO: 41114
  misc_feature 1..30: note = chr7:2024812-2024842
  misc_feature 1..30: note = hypo
  source 1..30: mol_type = genomic DNA

SEQ ID NO: 61611 - DNA, 113 bp, Homo sapiens; identical to SEQ ID NO: 41115
  misc_feature 1..113: note = chr7:2056573-2056686
  misc_feature 1..113: note = hypo
  source 1..113: mol_type = genomic DNA

SEQ ID NO: 61612 - DNA, 104 bp, Homo sapiens; identical to SEQ ID NO: 41116
  misc_feature 1..104: note = chr7:2110154-2110258
  misc_feature 1..104: note = hypo
  source 1..104: mol_type = genomic DNA

SEQ ID NO: 61613 - DNA, 135 bp, Homo sapiens; identical to SEQ ID NO: 41118
  misc_feature 1..135: note = chr7:2206533-2206668
  misc_feature 1..135: note = hypo
  source 1..135: mol_type = genomic DNA

SEQ ID NO: 61614 - DNA, 45 bp, Homo sapiens
  misc_feature 1..45: note = chr7:2232918-2232963
  misc_feature 1..45: note = hypo
  source 1..45: mol_type = genomic DNA
agggccacccagctccgacagccaccacgtcctggagagaaagcg

SEQ ID NO: 61615 - DNA, 72 bp, Homo sapiens
  misc_feature 1..72: note = chr7:2238235-2238307
  misc_feature 1..72: note = hypo
  source 1..72: mol_type = genomic DNA
ggtcaagagcatggaacacacacttcaggccccctctccaggctgcaggccaacaggcgtccatgagacaga

SEQ ID NO: 61616 - DNA, 85 bp, Homo sapiens; identical to SEQ ID NO: 41123
  misc_feature 1..85: note = chr7:2265530-2265615
  misc_feature 1..85: note = hypo
  source 1..85: mol_type = genomic DNA

SEQ ID NO: 61617 - DNA, 30 bp, Homo sapiens; identical to SEQ ID NO: 41125
  misc_feature 1..30: note = chr7:2349402-2349432
  misc_feature 1..30: note = hypo
  source 1..30: mol_type = genomic DNA

SEQ ID NO: 61618 - DNA, 83 bp, Homo sapiens; identical to SEQ ID NO: 41126
  misc_feature 1..83: note = chr7:2420313-2420396
  misc_feature 1..83: note = hypo
  source 1..83: mol_type = genomic DNA

SEQ ID NO: 61619 - DNA, 30 bp, Homo sapiens; identical to SEQ ID NO: 41127
  misc_feature 1..30: note = chr7:2480354-2480384
  misc_feature 1..30: note = hypo
  source 1..30: mol_type = genomic DNA

SEQ ID NO: 61620 - DNA, 30 bp, Homo sapiens; identical to SEQ ID NO: 41128
  misc_feature 1..30: note = chr7:2499688-2499718
  misc_feature 1..30: note = hypo
  source 1..30: mol_type = genomic DNA

SEQ ID NO: 61621 - DNA, 38 bp, Homo sapiens; identical to SEQ ID NO: 41129
  misc_feature 1..38: note = chr7:2544589-2544627
  misc_feature 1..38: note = hypo
  source 1..38: mol_type = genomic DNA

SEQ ID NO: 61622 - DNA, 194 bp, Homo sapiens; identical to SEQ ID NO: 41130
  misc_feature 1..194: note = chr7:2564711-2564905
  misc_feature 1..194: note = hypo
  source 1..194: mol_type = genomic DNA

SEQ ID NO: 61623 - DNA, 186 bp, Homo sapiens; identical to SEQ ID NO: 41131
  misc_feature 1..186: note = chr7:2566041-2566227
  misc_feature 1..186: note = hypo
  source 1..186: mol_type = genomic DNA

SEQ ID NO: 61624 - DNA, 113 bp, Homo sapiens
  misc_feature 1..113: note = chr7:2566487-2566600
  misc_feature 1..113: note = hypo
  source 1..113: mol_type = genomic DNA
atgtttgaaaacaagcggaacgccgtccacgtgaaggggcccttctcggtggaggccgacccatccaggtaaggaaaccccggcccagatgggcttgcgtagggtggcctagg

SEQ ID NO: 61625 - DNA, 28 bp, Homo sapiens
  misc_feature 1..28: note = chr7:2566630-2566658
  misc_feature 1..28: note = hypo
  source 1..28: mol_type = genomic DNA
gggtctctctaagcggcatgactctaca

SEQ ID NO: 61626 - DNA, 372 bp, Homo sapiens; identical to SEQ ID NO: 41133
  misc_feature 1..372: note = chr7:2686448-2686820
  misc_feature 1..372: note = hypo
  source 1..372: mol_type = genomic DNA

SEQ ID NO: 61627 - DNA, 54 bp, Homo sapiens; identical to SEQ ID NO: 41134
  misc_feature 1..54: note = chr7:2700087-2700141
  misc_feature 1..54: note = hypo
  source 1..54: mol_type = genomic DNA

SEQ ID NO: 61628 - DNA, 182 bp, Homo sapiens; identical to SEQ ID NO: 41135
  misc_feature 1..182: note = chr7:2718487-2718669
  misc_feature 1..182: note = hypo
  source 1..182: mol_type = genomic DNA

SEQ ID NO: 61629 - DNA, 28 bp, Homo sapiens
  misc_feature 1..28: note = chr7:2731870-2731898
  misc_feature 1..28: note = hypo
  source 1..28: mol_type = genomic DNA
gggttgaaagaggaccgagcttggccgg

SEQ ID NO: 61630 - DNA, 30 bp, Homo sapiens; identical to SEQ ID NO: 41138
  misc_feature 1..30: note = chr7:2747171-2747201
  misc_feature 1..30: note = hypo
  source 1..30: mol_type = genomic DNA

SEQ ID NO: 61631 - DNA, 35 bp, Homo sapiens; identical to SEQ ID NO: 14955
  misc_feature 1..35: note = chr7:2798456-2798491
  misc_feature 1..35: note = hypo
  source 1..35: mol_type = genomic DNA

SEQ ID NO: 61632 - DNA, 30 bp, Homo sapiens; identical to SEQ ID NO: 41140
  misc_feature 1..30: note = chr7:2916072-2916102
  misc_feature 1..30: note = hypo
  source 1..30: mol_type = genomic DNA

SEQ ID NO: 61633 - DNA, 180 bp, Homo sapiens; identical to SEQ ID NO: 41141
  misc_feature 1..180: note = chr7:2923749-2923929
  misc_feature 1..180: note = hypo
  source 1..180: mol_type = genomic DNA

SEQ ID NO: 61634 - DNA, 30 bp, Homo sapiens; identical to SEQ ID NO: 41142
  misc_feature 1..30: note = chr7:2958507-2958537
  misc_feature 1..30: note = hypo
  source 1..30: mol_type = genomic DNA

SEQ ID NO: 61635 - DNA, 73 bp, Homo sapiens; identical to SEQ ID NO: 41143
  misc_feature 1..73: note = chr7:2966469-2966542
  misc_feature 1..73: note = hypo
  source 1..73: mol_type = genomic DNA

SEQ ID NO: 61636 - DNA, 30 bp, Homo sapiens; identical to SEQ ID NO: 41144
  misc_feature 1..30: note = chr7:2976839-2976869
  misc_feature 1..30: note = hypo
  source 1..30: mol_type = genomic DNA

SEQ ID NO: 61637 - DNA, 46 bp, Homo sapiens; identical to SEQ ID NO: 41145
  misc_feature 1..46: note = chr7:3026293-3026339
  misc_feature 1..46: note = hypo
  source 1..46: mol_type = genomic DNA

SEQ ID NO: 61638 - DNA, 181 bp, Homo sapiens
  misc_feature 1..181: note = chr7:3033477-3033658
  misc_feature 1..181: note = hypo
  source 1..181: mol_type = genomic DNA
gtctcccttctagctcgccaaatgctcagggttcctatattttaaaaaatcttgtcccatcaaactctgctttcaggaatggcacgaagagccgacacgcacggtgagcagctgccttctgcagatggaacgcctcacctgggacgcctcacctgggacgcctcacctgggacgcaggcgt

SEQ ID NO: 61639 - DNA, 110 bp, Homo sapiens
  misc_feature 1..110: note = chr7:3033688-3033798
  misc_feature 1..110: note = hypo
  source 1..110: mol_type = genomic DNA
attcctgcccaagctcacatagcagggactggcccagccccattcactcatgcatgtctgaccccaaggcagggctggtggcctctaaatcctcccgctagggtttcagc

SEQ ID NO: 61640 - DNA, 206 bp, Homo sapiens
  misc_feature 1..206: note = chr7:3283498-3283704
  misc_feature 1..206: note = hypo
  source 1..206: mol_type = genomic DNA
aatggagaaacagcccagagaggaaaagcgatttgcacagagtcacgcagctgaagactggcagatccaggctgtttgctgtcagtctgagctctcgaattctaagacgagccacttctctcgggaagccaggaaggctcctcgcaaatcctggtggagaagtggttacctcaaagccctttaagcacagtcataaacttaccttg

SEQ ID NO: 61641 - DNA, 38 bp, Homo sapiens; identical to SEQ ID NO: 41148
  misc_feature 1..38: note = chr7:3727142-3727180
  misc_feature 1..38: note = hypo
  source 1..38: mol_type = genomic DNA

SEQ ID NO: 61642 - DNA, 34 bp, Homo sapiens; identical to SEQ ID NO: 41149
  misc_feature 1..34: note = chr7:4096353-4096387
  misc_feature 1..34: note = hypo
  source 1..34: mol_type = genomic DNA

SEQ ID NO: 61643 - DNA, 30 bp, Homo sapiens; identical to SEQ ID NO: 41150
  misc_feature 1..30: note = chr7:4187836-4187866
  misc_feature 1..30: note = hypo
  source 1..30: mol_type = genomic DNA

SEQ ID NO: 61644 - DNA, 93 bp, Homo sapiens; identical to SEQ ID NO: 41151
  misc_feature 1..93: note = chr7:4214921-4215014
  misc_feature 1..93: note = hypo
  source 1..93: mol_type = genomic DNA

SEQ ID NO: 61645 - DNA, 30 bp, Homo sapiens; identical to SEQ ID NO: 41152
  misc_feature 1..30: note = chr7:4260867-4260897
  misc_feature 1..30: note = hypo
  source 1..30: mol_type = genomic DNA

SEQ ID NO: 61646 - DNA, 30 bp, Homo sapiens; identical to SEQ ID NO: 41153
  misc_feature 1..30: note = chr7:4275488-4275518
  misc_feature 1..30: note = hypo
  source 1..30: mol_type = genomic DNA

SEQ ID NO: 61647 - DNA, 86 bp, Homo sapiens; identical to SEQ ID NO: 41154
  misc_feature 1..86: note = chr7:4342691-4342777
  misc_feature 1..86: note = hypo
  source 1..86: mol_type = genomic DNA

SEQ ID NO: 61648 - DNA, 73 bp, Homo sapiens; identical to SEQ ID NO: 41155
  misc_feature 1..73: note = chr7:4751426-4751499
  misc_feature 1..73: note = hypo
  source 1..73: mol_type = genomic DNA

SEQ ID NO: 61649 - DNA, 30 bp, Homo sapiens; identical to SEQ ID NO: 41156
  misc_feature 1..30: note = chr7:4771572-4771602
  misc_feature 1..30: note = hypo
  source 1..30: mol_type = genomic DNA

SEQ ID NO: 61650 - DNA, 90 bp, Homo sapiens; identical to SEQ ID NO: 41157
  misc_feature 1..90: note = chr7:4781955-4782045
  misc_feature 1..90: note = hypo
  source 1..90: mol_type = genomic DNA

SEQ ID NO: 61651 - DNA, 87 bp, Homo sapiens; identical to SEQ ID NO: 14961
  misc_feature 1..87: note = chr7:4813783-4813870
  misc_feature 1..87: note = hypo
  source 1..87: mol_type = genomic DNA

SEQ ID NO: 61652 - DNA, 114 bp, Homo sapiens; identical to SEQ ID NO: 41159
  misc_feature 1..114: note = chr7:4839337-4839451
  misc_feature 1..114: note = hypo
  source 1..114: mol_type = genomic DNA

SEQ ID NO: 61653 - DNA, 175 bp, Homo sapiens; identical to SEQ ID NO: 41160
  misc_feature 1..175: note = chr7:4840176-4840351
  misc_feature 1..175: note = hypo
  source 1..175: mol_type = genomic DNA

SEQ ID NO: 61654 - DNA, 30 bp, Homo sapiens; identical to SEQ ID NO: 41161
  misc_feature 1..30: note = chr7:4840692-4840722
  misc_feature 1..30: note = hypo
  source 1..30: mol_type = genomic DNA

SEQ ID NO: 61655 - DNA, 104 bp, Homo sapiens; identical to SEQ ID NO: 41162
  misc_feature 1..104: note = chr7:4841057-4841161
  misc_feature 1..104: note = hypo
  source 1..104: mol_type = genomic DNA

SEQ ID NO: 61656 - DNA, 141 bp, Homo sapiens
  misc_feature 1..141: note = chr7:4856843-4856984
  misc_feature 1..141: note = hypo
  source 1..141: mol_type = genomic DNA
tgcagaagcagagcccgtccgtgcaccttggagacatagtagacgcactgctggaaggcgtacagcaccacctcctccagcaccgccatggcctcctcgctggccgtcagcgtgcaggagaacagcgattccttcgagcct

SEQ ID NO: 61657 - DNA, 144 bp, Homo sapiens; identical to SEQ ID NO: 41164
  misc_feature 1..144: note = chr7:4858153-4858297
  misc_feature 1..144: note = hypo
  source 1..144: mol_type = genomic DNA

SEQ ID NO: 61658 - DNA, 59 bp, Homo sapiens; identical to SEQ ID NO: 41165
  misc_feature 1..59: note = chr7:4875008-4875067
  misc_feature 1..59: note = hypo
  source 1..59: mol_type = genomic DNA

SEQ ID NO: 61659 - DNA, 30 bp, Homo sapiens; identical to SEQ ID NO: 41166
  misc_feature 1..30: note = chr7:4876594-4876624
  misc_feature 1..30: note = hypo
  source 1..30: mol_type = genomic DNA

SEQ ID NO: 61660 - DNA, 111 bp, Homo sapiens; identical to SEQ ID NO: 41167
  misc_feature 1..111: note = chr7:4918378-4918489
  misc_feature 1..111: note = hypo
  source 1..111: mol_type = genomic DNA

SEQ ID NO: 61661 - DNA, 39 bp, Homo sapiens; identical to SEQ ID NO: 41168
  misc_feature 1..39: note = chr7:4931853-4931892
  misc_feature 1..39: note = hypo
  source 1..39: mol_type = genomic DNA

SEQ ID NO: 61662 - DNA, 22 bp, Homo sapiens
  misc_feature 1..22: note = chr7:4985877-4985899
  misc_feature 1..22: note = hypo
  source 1..22: mol_type = genomic DNA
cccaccccgtgcacacaatccc

SEQ ID NO: 61663 - DNA, 30 bp, Homo sapiens; identical to SEQ ID NO: 14965
  misc_feature 1..30: note = chr7:5316401-5316431
  misc_feature 1..30: note = hypo
  source 1..30: mol_type = genomic DNA

SEQ ID NO: 61664 - DNA, 30 bp, Homo sapiens; identical to SEQ ID NO: 41171
  misc_feature 1..30: note = chr7:5342905-5342935
  misc_feature 1..30: note = hypo
  source 1..30: mol_type = genomic DNA

SEQ ID NO: 61665 - DNA, 30 bp, Homo sapiens; identical to SEQ ID NO: 41172
  misc_feature 1..30: note = chr7:5343856-5343886
  misc_feature 1..30: note = hypo
  source 1..30: mol_type = genomic DNA

SEQ ID NO: 61666 - DNA, 142 bp, Homo sapiens; identical to SEQ ID NO: 41173
  misc_feature 1..142: note = chr7:5441304-5441446
  misc_feature 1..142: note = hypo
  source 1..142: mol_type = genomic DNA

SEQ ID NO: 61667 - DNA, 116 bp, Homo sapiens; identical to SEQ ID NO: 41174
  misc_feature 1..116: note = chr7:5529839-5529955
  misc_feature 1..116: note = hypo
  source 1..116: mol_type = genomic DNA

SEQ ID NO: 61668 - DNA, 34 bp, Homo sapiens; identical to SEQ ID NO: 41175
  misc_feature 1..34: note = chr7:5589502-5589536
  misc_feature 1..34: note = hypo
  source 1..34: mol_type = genomic DNA

SEQ ID NO: 61669 - DNA, 30 bp, Homo sapiens; identical to SEQ ID NO: 41176
  misc_feature 1..30: note = chr7:5626228-5626258
  misc_feature 1..30: note = hypo
  source 1..30: mol_type = genomic DNA

SEQ ID NO: 61670 - DNA, 30 bp, Homo sapiens; identical to SEQ ID NO: 41177
  misc_feature 1..30: note = chr7:5629903-5629933
  misc_feature 1..30: note = hypo
  source 1..30: mol_type = genomic DNA

SEQ ID NO: 61671 - DNA, 201 bp, Homo sapiens; identical to SEQ ID NO: 41178
  misc_feature 1..201: note = chr7:5647869-5648070
  misc_feature 1..201: note = hypo
  source 1..201: mol_type = genomic DNA

SEQ ID NO: 61672 - DNA, 26 bp, Homo sapiens
  misc_feature 1..26: note = chr7:5648393-5648419
  misc_feature 1..26: note = hypo
  source 1..26: mol_type = genomic DNA
accccataccccgagggtggctcctc

SEQ ID NO: 61673 - DNA, 56 bp, Homo sapiens; identical to SEQ ID NO: 41180
  misc_feature 1..56: note = chr7:6060716-6060772
  misc_feature 1..56: note = hypo
  source 1..56: mol_type = genomic DNA

SEQ ID NO: 61674 - DNA, 36 bp, Homo sapiens; identical to SEQ ID NO: 41183
  misc_feature 1..36: note = chr7:6143243-6143279
  misc_feature 1..36: note = hypo
  source 1..36: mol_type = genomic DNA

SEQ ID NO: 61675 - DNA, 64 bp, Homo sapiens; identical to SEQ ID NO: 41184
  misc_feature 1..64: note = chr7:6241990-6242054
  misc_feature 1..64: note = hypo
  source 1..64: mol_type = genomic DNA

SEQ ID NO: 61676 - DNA, 60 bp, Homo sapiens; identical to SEQ ID NO: 24319
  misc_feature 1..60: note = chr7:6443376-6443436
  misc_feature 1..60: note = hypo
  source 1..60: mol_type = genomic DNA

SEQ ID NO: 61677 - DNA, 34 bp, Homo sapiens; identical to SEQ ID NO: 41186
  misc_feature 1..34: note = chr7:6443956-6443990
  misc_feature 1..34: note = hypo
  source 1..34: mol_type = genomic DNA

SEQ ID NO: 61678 - DNA, 93 bp, Homo sapiens; identical to SEQ ID NO: 41187
  misc_feature 1..93: note = chr7:6444050-6444143
  misc_feature 1..93: note = hypo
  source 1..93: mol_type = genomic DNA

SEQ ID NO: 61679 - DNA, 273 bp, Homo sapiens; identical to SEQ ID NO: 41188
  misc_feature 1..273: note = chr7:6499118-6499391
  misc_feature 1..273: note = hypo
  source 1..273: mol_type = genomic DNA

SEQ ID NO: 61680 - DNA, 66 bp, Homo sapiens
  misc_feature 1..66: note = chr7:6524911-6524977
  misc_feature 1..66: note = hypo
  source 1..66: mol_type = genomic DNA
ttgaatatttctacgggatggggacgtcacaagaaattgcaaacaaaaaaagctgacaaacaggat

SEQ ID NO: 61681 - DNA, 79 bp, Homo sapiens
  misc_feature 1..79: note = chr7:6525012-6525091
  misc_feature 1..79: note = hypo
  source 1..79: mol_type = genomic DNA
aaacgcacagttcgcagttcaaaaagcagggcgggggcgaggacctggtgcggtggctcatgcctgtagtcccaacact

SEQ ID NO: 61682 - DNA, 166 bp, Homo sapiens; identical to SEQ ID NO: 41191
  misc_feature 1..166: note = chr7:6545837-6546003
  misc_feature 1..166: note = hypo
  source 1..166: mol_type = genomic DNA

SEQ ID NO: 61683 - DNA, 62 bp, Homo sapiens
  misc_feature 1..62: note = chr7:6560173-6560235
  misc_feature 1..62: note = hypo
  source 1..62: mol_type = genomic DNA
agggcagggccccaccgcggctttggcccggccacctgtgctggaagaagctctcgagggcc

SEQ ID NO: 61684 - DNA, 56 bp, Homo sapiens; identical to SEQ ID NO: 24324
  misc_feature 1..56: note = chr7:6560345-6560401
  misc_feature 1..56: note = hypo
  source 1..56: mol_type = genomic DNA

SEQ ID NO: 61685 - DNA, 30 bp, Homo sapiens; identical to SEQ ID NO: 14975
  misc_feature 1..30: note = chr7:7102938-7102968
  misc_feature 1..30: note = hypo
  source 1..30: mol_type = genomic DNA

SEQ ID NO: 61686 - DNA, 30 bp, Homo sapiens; identical to SEQ ID NO: 41194
  misc_feature 1..30: note = chr7:7105800-7105830
  misc_feature 1..30: note = hypo
  source 1..30: mol_type = genomic DNA

SEQ ID NO: 61687 - DNA, 61 bp, Homo sapiens; identical to SEQ ID NO: 41195
  misc_feature 1..61: note = chr7:7109343-7109404
  misc_feature 1..61: note = hypo
  source 1..61: mol_type = genomic DNA

SEQ ID NO: 61688 - DNA, 52 bp, Homo sapiens; identical to SEQ ID NO: 41196
  misc_feature 1..52: note = chr7:7111788-7111840
  misc_feature 1..52: note = hypo
  source 1..52: mol_type = genomic DNA

SEQ ID NO: 61689 - DNA, 42 bp, Homo sapiens; identical to SEQ ID NO: 41197
  misc_feature 1..42: note = chr7:7113636-7113678
  misc_feature 1..42: note = hypo
  source 1..42: mol_type = genomic DNA

SEQ ID NO: 61690 - DNA, 279 bp, Homo sapiens; identical to SEQ ID NO: 41198
  misc_feature 1..279: note = chr7:7605145-7605424
  misc_feature 1..279: note = hypo
  source 1..279: mol_type = genomic DNA

SEQ ID NO: 61691 - DNA, 32 bp, Homo sapiens; identical to SEQ ID NO: 41200
  misc_feature 1..32: note = chr7:8391330-8391362
  misc_feature 1..32: note = hypo
  source 1..32: mol_type = genomic DNA

SEQ ID NO: 61692 - DNA, 23 bp, Homo sapiens
  misc_feature 1..23: note = chr7:10730863-10730886
  misc_feature 1..23: note = hypo
  source 1..23: mol_type = genomic DNA
aaacatttgggaggccgggtgcg

SEQ ID NO: 61693 - DNA, 37 bp, Homo sapiens; identical to SEQ ID NO: 41202
  misc_feature 1..37: note = chr7:10819400-10819437
  misc_feature 1..37: note = hypo
  source 1..37: mol_type = genomic DNA

SEQ ID NO: 61694 - DNA, 30 bp, Homo sapiens; identical to SEQ ID NO: 41203
  misc_feature 1..30: note = chr7:10929379-10929409
  misc_feature 1..30: note = hypo
  source 1..30: mol_type = genomic DNA

SEQ ID NO: 61695 - DNA, 37 bp, Homo sapiens; identical to SEQ ID NO: 41204
  misc_feature 1..37: note = chr7:12776917-12776954
  misc_feature 1..37: note = hypo
  source 1..37: mol_type = genomic DNA

SEQ ID NO: 61696 - DNA, 43 bp, Homo sapiens; identical to SEQ ID NO: 41205
  misc_feature 1..43: note = chr7:16566510-16566553
  misc_feature 1..43: note = hypo
  source 1..43: mol_type = genomic DNA

SEQ ID NO: 61697 - DNA, 180 bp, Homo sapiens; identical to SEQ ID NO: 41206
  misc_feature 1..180: note = chr7:16844151-16844331
  misc_feature 1..180: note = hypo
  source 1..180: mol_type = genomic DNA

SEQ ID NO: 61698 - DNA, 27 bp, Homo sapiens
  misc_feature 1..27: note = chr7:17413241-17413268
  misc_feature 1..27: note = hypo
  source 1..27: mol_type = genomic DNA
tgtgagccgccgcgcccaaccgcaaag

SEQ ID NO: 61699 - DNA, 24 bp, Homo sapiens
  misc_feature 1..24: note = chr7:20710238-20710262
  misc_feature 1..24: note = hypo
  source 1..24: mol_type = genomic DNA
aagaagcaagctggccgggtgcgg

SEQ ID NO: 61700 - DNA, 18 bp, Homo sapiens
  misc_feature 1..18: note = chr7:20719888-20719906
  misc_feature 1..18: note = hypo
  source 1..18: mol_type = genomic DNA
agagtgacttgaggccga

SEQ ID NO: 61701 - DNA, 139 bp, Homo sapiens; identical to SEQ ID NO: 41210
  misc_feature 1..139: note = chr7:20720174-20720313
  misc_feature 1..139: note = hypo
  source 1..139: mol_type = genomic DNA

SEQ ID NO: 61702 - DNA, 43 bp, Homo sapiens; identical to SEQ ID NO: 41211
  misc_feature 1..43: note = chr7:20757794-20757837
  misc_feature 1..43: note = hypo
  source 1..43: mol_type = genomic DNA

SEQ ID NO: 61703 - DNA, 173 bp, Homo sapiens; identical to SEQ ID NO: 41212
  misc_feature 1..173: note = chr7:22981026-22981199
  misc_feature 1..173: note = hypo
  source 1..173: mol_type = genomic DNA

SEQ ID NO: 61704 - DNA, 30 bp, Homo sapiens; identical to SEQ ID NO: 41213
  misc_feature 1..30: note = chr7:23220685-23220715
  misc_feature 1..30: note = hypo
  source 1..30: mol_type = genomic DNA

SEQ ID NO: 61705 - DNA, 36 bp, Homo sapiens; identical to SEQ ID NO: 41214
  misc_feature 1..36: note = chr7:23525036-23525072
  misc_feature 1..36: note = hypo
  source 1..36: mol_type = genomic DNA

SEQ ID NO: 61706 - DNA, 30 bp, Homo sapiens; identical to SEQ ID NO: 41215
  misc_feature 1..30: note = chr7:23568103-23568133
  misc_feature 1..30: note = hypo
  source 1..30: mol_type = genomic DNA

SEQ ID NO: 61707 - DNA, 30 bp, Homo sapiens; identical to SEQ ID NO: 41216
  misc_feature 1..30: note = chr7:23569271-23569301
  misc_feature 1..30: note = hypo
  source 1..30: mol_type = genomic DNA

SEQ ID NO: 61708 - DNA, 48 bp, Homo sapiens; identical to SEQ ID NO: 41218
  misc_feature 1..48: note = chr7:23749757-23749805
  misc_feature 1..48: note = hypo
  source 1..48: mol_type = genomic DNA

SEQ ID NO: 61709 - DNA, 120 bp, Homo sapiens; identical to SEQ ID NO: 41219
  misc_feature 1..120: note = chr7:24099277-24099397
  misc_feature 1..120: note = hypo
  source 1..120: mol_type = genomic DNA

SEQ ID NO: 61710 - DNA, 224 bp, Homo sapiens; identical to SEQ ID NO: 41221
  misc_feature 1..224: note = chr7:24761204-24761428
  misc_feature 1..224: note = hypo
  source 1..224: mol_type = genomic DNA

SEQ ID NO: 61711 - DNA, 30 bp, Homo sapiens; identical to SEQ ID NO: 41222
  misc_feature 1..30: note = chr7:24799881-24799911
  misc_feature 1..30: note = hypo
  source 1..30: mol_type = genomic DNA

SEQ ID NO: 61712 - DNA, 30 bp, Homo sapiens; identical to SEQ ID NO: 41223
  misc_feature 1..30: note = chr7:24845483-24845513
  misc_feature 1..30: note = hypo
  source 1..30: mol_type = genomic DNA

SEQ ID NO: 61713 - DNA, 190 bp, Homo sapiens; identical to SEQ ID NO: 41224
  misc_feature 1..190: note = chr7:25495487-25495677
  misc_feature 1..190: note = hypo
  source 1..190: mol_type = genomic DNA

SEQ ID NO: 61714 - DNA, 84 bp, Homo sapiens; identical to SEQ ID NO: 41225
  misc_feature 1..84: note = chr7:25530809-25530893
  misc_feature 1..84: note = hypo
  source 1..84: mol_type = genomic DNA

SEQ ID NO: 61715 - DNA, 186 bp, Homo sapiens; identical to SEQ ID NO: 41226
  misc_feature 1..186: note = chr7:25802276-25802462
  misc_feature 1..186: note = hypo
  source 1..186: mol_type = genomic DNA

SEQ ID NO: 61716 - DNA, 42 bp, Homo sapiens; identical to SEQ ID NO: 41227
  misc_feature 1..42: note = chr7:26217181-26217223
  misc_feature 1..42: note = hypo
  source 1..42: mol_type = genomic DNA

SEQ ID NO: 61717 - DNA, 17 bp, Homo sapiens
  misc_feature 1..17: note = chr7:26222458-26222475
  misc_feature 1..17: note = hypo
  source 1..17: mol_type = genomic DNA
gctggagtgtggcagcg

SEQ ID NO: 61718 - DNA, 129 bp, Homo sapiens; identical to SEQ ID NO: 41230
  misc_feature 1..129: note = chr7:26652555-26652684
  misc_feature 1..129: note = hypo
  source 1..129: mol_type = genomic DNA

SEQ ID NO: 61719 - DNA, 35 bp, Homo sapiens; identical to SEQ ID NO: 41231
  misc_feature 1..35: note = chr7:26762298-26762333
  misc_feature 1..35: note = hypo
  source 1..35: mol_type = genomic DNA

SEQ ID NO: 61720 - DNA, 30 bp, Homo sapiens; identical to SEQ ID NO: 41232
  misc_feature 1..30: note = chr7:27531223-27531253
  misc_feature 1..30: note = hypo
  source 1..30: mol_type = genomic DNA

SEQ ID NO: 61721 - DNA, 170 bp, Homo sapiens; identical to SEQ ID NO: 41233
  misc_feature 1..170: note = chr7:27555618-27555788
  misc_feature 1..170: note = hypo
  source 1..170: mol_type = genomic DNA

SEQ ID NO: 61722 - DNA, 16 bp, Homo sapiens
  misc_feature 1..16: note = chr7:27686784-27686800
  misc_feature 1..16: note = hypo
  source 1..16: mol_type = genomic DNA
gcgatatcacaacacc

SEQ ID NO: 61723 - DNA, 32 bp, Homo sapiens; identical to SEQ ID NO: 41235
  misc_feature 1..32: note = chr7:27903816-27903848
  misc_feature 1..32: note = hypo
  source 1..32: mol_type = genomic DNA

SEQ ID NO: 61724 - DNA, 43 bp, Homo sapiens; identical to SEQ ID NO: 41236
  misc_feature 1..43: note = chr7:27907997-27908040
  misc_feature 1..43: note = hypo
  source 1..43: mol_type = genomic DNA

SEQ ID NO: 61725 - DNA, 93 bp, Homo sapiens; identical to SEQ ID NO: 41237
  misc_feature 1..93: note = chr7:27916674-27916767
  misc_feature 1..93: note = hypo
  source 1..93: mol_type = genomic DNA

SEQ ID NO: 61726 - DNA, 30 bp, Homo sapiens; identical to SEQ ID NO: 41238
  misc_feature 1..30: note = chr7:28050662-28050692
  misc_feature 1..30: note = hypo
  source 1..30: mol_type = genomic DNA

SEQ ID NO: 61727 - DNA, 30 bp, Homo sapiens; identical to SEQ ID NO: 41239
  misc_feature 1..30: note = chr7:28055637-28055667
  misc_feature 1..30: note = hypo
  source 1..30: mol_type = genomic DNA

SEQ ID NO: 61728 - DNA, 30 bp, Homo sapiens; identical to SEQ ID NO: 41240
  misc_feature 1..30: note = chr7:28266792-28266822
  misc_feature 1..30: note = hypo
  source 1..30: mol_type = genomic DNA

SEQ ID NO: 61729 - DNA, 22 bp, Homo sapiens
  misc_feature 1..22: note = chr7:28988955-28988977
  misc_feature 1..22: note = hypo
  source 1..22: mol_type = genomic DNA
gggcgcagtggctcacgcctgt

SEQ ID NO: 61730 - DNA, 141 bp, Homo sapiens; identical to SEQ ID NO: 41242
  misc_feature 1..141: note = chr7:28989217-28989358
  misc_feature 1..141: note = hypo
  source 1..141: mol_type = genomic DNA

SEQ ID NO: 61731 - DNA, 30 bp, Homo sapiens; identical to SEQ ID NO: 41243
  misc_feature 1..30: note = chr7:29482512-29482542
  misc_feature 1..30: note = hypo
  source 1..30: mol_type = genomic DNA

SEQ ID NO: 61732 - DNA, 38 bp, Homo sapiens; identical to SEQ ID NO: 41244
  misc_feature 1..38: note = chr7:29876677-29876715
  misc_feature 1..38: note = hypo
  source 1..38: mol_type = genomic DNA

SEQ ID NO: 61733 - DNA, 30 bp, Homo sapiens; identical to SEQ ID NO: 41245
  misc_feature 1..30: note = chr7:30206504-30206534
  misc_feature 1..30: note = hypo
  source 1..30: mol_type = genomic DNA

SEQ ID NO: 61734 - DNA, 30 bp, Homo sapiens; identical to SEQ ID NO: 41246
  misc_feature 1..30: note = chr7:30603406-30603436
  misc_feature 1..30: note = hypo
  source 1..30: mol_type = genomic DNA

SEQ ID NO: 61735 - DNA, 163 bp, Homo sapiens; identical to SEQ ID NO: 41247
  misc_feature 1..163: note = chr7:30687826-30687989
  misc_feature 1..163: note = hypo
  source 1..163: mol_type = genomic DNA

SEQ ID NO: 61736 - DNA, 30 bp, Homo sapiens; identical to SEQ ID NO: 41248
  misc_feature 1..30: note = chr7:30699730-30699760
  misc_feature 1..30: note = hypo
  source 1..30: mol_type = genomic DNA

SEQ ID NO: 61737 - DNA, 133 bp, Homo sapiens; identical to SEQ ID NO: 41249
  misc_feature 1..133: note = chr7:30744677-30744810
  misc_feature 1..133: note = hypo
  source 1..133: mol_type = genomic DNA

SEQ ID NO: 61738 - DNA, 92 bp, Homo sapiens; identical to SEQ ID NO: 41250
  misc_feature 1..92: note = chr7:30899935-30900027
  misc_feature 1..92: note = hypo
  source 1..92: mol_type = genomic DNA

SEQ ID NO: 61739 - DNA, 84 bp, Homo sapiens; identical to SEQ ID NO: 41251
  misc_feature 1..84: note = chr7:31116600-31116684
  misc_feature 1..84: note = hypo
  source 1..84: mol_type = genomic DNA

SEQ ID NO: 61740 - DNA, 238 bp, Homo sapiens; identical to SEQ ID NO: 41252
  misc_feature 1..238: note = chr7:31118297-31118535
  misc_feature 1..238: note = hypo
  source 1..238: mol_type = genomic DNA

SEQ ID NO: 61741 - DNA, 158 bp, Homo sapiens; identical to SEQ ID NO: 41253
  misc_feature 1..158: note = chr7:32128181-32128339
  misc_feature 1..158: note = hypo
  source 1..158: mol_type = genomic DNA

SEQ ID NO: 61742 - DNA, 15 bp, Homo sapiens
  misc_feature 1..15: note = chr7:32276919-32276934
  misc_feature 1..15: note = hypo
  source 1..15: mol_type = genomic DNA
cgatctcctgacctc

SEQ ID NO: 61743 - DNA, 30 bp, Homo sapiens; identical to SEQ ID NO: 41255
  misc_feature 1..30: note = chr7:32323599-32323629
  misc_feature 1..30: note = hypo
  source 1..30: mol_type = genomic DNA

SEQ ID NO: 61744 - DNA, 25 bp, Homo sapiens
  misc_feature 1..25: note = chr7:35190140-35190165
  misc_feature 1..25: note = hypo
  source 1..25: mol_type = genomic DNA
atcttttttttgagacggggtcttg

SEQ ID NO: 61745 - DNA, 88 bp, Homo sapiens; identical to SEQ ID NO: 41257
  misc_feature 1..88: note = chr7:36428640-36428728
  misc_feature 1..88: note = hypo
  source 1..88: mol_type = genomic DNA

SEQ ID NO: 61746 - DNA, 26 bp, Homo sapiens
  misc_feature 1..26: note = chr7:37025520-37025546
  misc_feature 1..26: note = hypo
  source 1..26: mol_type = genomic DNA
tactcaccaagctcccgtaagtccat

SEQ ID NO: 61747 - DNA, 30 bp, Homo sapiens; identical to SEQ ID NO: 14984
  misc_feature 1..30: note = chr7:37264509-37264539
  misc_feature 1..30: note = hypo
  source 1..30: mol_type = genomic DNA

SEQ ID NO: 61748 - DNA, 181 bp, Homo sapiens; identical to SEQ ID NO: 14985
  misc_feature 1..181: note = chr7:37279183-37279364
  misc_feature 1..181: note = hypo
  source 1..181: mol_type = genomic DNA

SEQ ID NO: 61749 - DNA, 119 bp, Homo sapiens; identical to SEQ ID NO: 41261
  misc_feature 1..119: note = chr7:37399153-37399272
  misc_feature 1..119: note = hypo
  source 1..119: mol_type = genomic DNA

SEQ ID NO: 61750 - DNA, 17 bp, Homo sapiens
  misc_feature 1..17: note = chr7:37423714-37423731
  misc_feature 1..17: note = hypo
  source 1..17: mol_type = genomic DNA
gccgaaacatacaggtt

SEQ ID NO: 61751 - DNA, 146 bp, Homo sapiens; identical to SEQ ID NO: 41263
  misc_feature 1..146: note = chr7:37424328-37424474
  misc_feature 1..146: note = hypo
  source 1..146: mol_type = genomic DNA

SEQ ID NO: 61752 - DNA, 30 bp, Homo sapiens; identical to SEQ ID NO: 41264
  misc_feature 1..30: note = chr7:37446822-37446852
  misc_feature 1..30: note = hypo
  source 1..30: mol_type = genomic DNA

SEQ ID NO: 61753 - DNA, 30 bp, Homo sapiens; identical to SEQ ID NO: 41265
  misc_feature 1..30: note = chr7:37686948-37686978
  misc_feature 1..30: note = hypo
  source 1..30: mol_type = genomic DNA

SEQ ID NO: 61754 - DNA, 148 bp, Homo sapiens; identical to SEQ ID NO: 41266
  misc_feature 1..148: note = chr7:37770953-37771101
  misc_feature 1..148: note = hypo
  source 1..148: mol_type = genomic DNA

SEQ ID NO: 61755 - DNA, 175 bp, Homo sapiens; identical to SEQ ID NO: 41267
  misc_feature 1..175: note = chr7:37868787-37868962
  misc_feature 1..175: note = hypo
  source 1..175: mol_type = genomic DNA

SEQ ID NO: 61756 - DNA, 30 bp, Homo sapiens; identical to SEQ ID NO: 41269
  misc_feature 1..30: note = chr7:37969938-37969968
  misc_feature 1..30: note = hypo
  source 1..30: mol_type = genomic DNA

SEQ ID NO: 61757 - DNA, 37 bp, Homo sapiens; identical to SEQ ID NO: 41270
  misc_feature 1..37: note = chr7:38170685-38170722
  misc_feature 1..37: note = hypo
  source 1..37: mol_type = genomic DNA

SEQ ID NO: 61758 - DNA, 24 bp, Homo sapiens
  misc_feature 1..24: note = chr7:38508456-38508480
  misc_feature 1..24: note = hypo
  source 1..24: mol_type = genomic DNA
agtagaacatacagacggccgggc

SEQ ID NO: 61759 - DNA, 189 bp, Homo sapiens; identical to SEQ ID NO: 41272
  misc_feature 1..189: note = chr7:38740329-38740518
  misc_feature 1..189: note = hypo
  source 1..189: mol_type = genomic DNA

SEQ ID NO: 61760 - DNA, 30 bp, Homo sapiens; identical to SEQ ID NO: 41273
  misc_feature 1..30: note = chr7:39192698-39192728
  misc_feature 1..30: note = hypo
  source 1..30: mol_type = genomic DNA

SEQ ID NO: 61761 - DNA, 30 bp, Homo sapiens; identical to SEQ ID NO: 41274
  misc_feature 1..30: note = chr7:39317801-39317831
  misc_feature 1..30: note = hypo
  source 1..30: mol_type = genomic DNA

SEQ ID NO: 61762 - DNA, 101 bp, Homo sapiens; identical to SEQ ID NO: 41275
  misc_feature 1..101: note = chr7:39921805-39921906
  misc_feature 1..101: note = hypo
  source 1..101: mol_type = genomic DNA

SEQ ID NO: 61763 - DNA, 91 bp, Homo sapiens; identical to SEQ ID NO: 41276
  misc_feature 1..91: note = chr7:40157087-40157178
  misc_feature 1..91: note = hypo
  source 1..91: mol_type = genomic DNA

SEQ ID NO: 61764 - DNA, 93 bp, Homo sapiens; identical to SEQ ID NO: 41277
  misc_feature 1..93: note = chr7:40407726-40407819
  misc_feature 1..93: note = hypo
  source 1..93: mol_type = genomic DNA

SEQ ID NO: 61765 - DNA, 30 bp, Homo sapiens; identical to SEQ ID NO: 41278
  misc_feature 1..30: note = chr7:40943582-40943612
  misc_feature 1..30: note = hypo
  source 1..30: mol_type = genomic DNA

SEQ ID NO: 61766 - DNA, 27 bp, Homo sapiens
  misc_feature 1..27: note = chr7:41814148-41814175
  misc_feature 1..27: note = hypo
  source 1..27: mol_type = genomic DNA
ggaggccgaggtgggcggatcacgagg

SEQ ID NO: 61767 - DNA, 30 bp, Homo sapiens; identical to SEQ ID NO: 41280
  misc_feature 1..30: note = chr7:41923780-41923810
  misc_feature 1..30: note = hypo
  source 1..30: mol_type = genomic DNA

SEQ ID NO: 61768 - DNA, 30 bp, Homo sapiens; identical to SEQ ID NO: 41281
  misc_feature 1..30: note = chr7:41943672-41943702
  misc_feature 1..30: note = hypo
  source 1..30: mol_type = genomic DNA

SEQ ID NO: 61769 - DNA, 17 bp, Homo sapiens
  misc_feature 1..17: note = chr7:41981795-41981812
  misc_feature 1..17: note = hypo
  source 1..17: mol_type = genomic DNA
gggcgtggtggctcacg

SEQ ID NO: 61770 - DNA, 30 bp, Homo sapiens; identical to SEQ ID NO: 41283
  misc_feature 1..30: note = chr7:42005469-42005499
  misc_feature 1..30: note = hypo
  source 1..30: mol_type = genomic DNA

SEQ ID NO: 61771 - DNA, 177 bp, Homo sapiens; identical to SEQ ID NO: 41284
  misc_feature 1..177: note = chr7:43237814-43237991
  misc_feature 1..177: note = hypo
  source 1..177: mol_type = genomic DNA

SEQ ID NO: 61772 - DNA, 25 bp, Homo sapiens
  misc_feature 1..25: note = chr7:43767877-43767902
  misc_feature 1..25: note = hypo
  source 1..25: mol_type = genomic DNA
gtgaactctacggtaggtgaactat

SEQ ID NO: 61773 - DNA, 202 bp, Homo sapiens; identical to SEQ ID NO: 41286
  misc_feature 1..202: note = chr7:43865061-43865263
  misc_feature 1..202: note = hypo
  source 1..202: mol_type = genomic DNA

SEQ ID NO: 61774 - DNA, 25 bp, Homo sapiens
  misc_feature 1..25: note = chr7:44083435-44083460
  misc_feature 1..25: note = hypo
  source 1..25: mol_type = genomic DNA
ccaccgtgcccggcaggatttatat

SEQ ID NO: 61775 - DNA, 113 bp, Homo sapiens
  misc_feature 1..113: note = chr7:44151285-44151398
  misc_feature 1..113: note = hypo
  source 1..113: mol_type = genomic DNA
gcctcccgcctgttccggagcctctctggggattctggcttgtcttacagggccctaggagccccagctgtcccccagaccctcgggtatgaggtgggtctgggtccttcctc

SEQ ID NO: 61776 - DNA, 299 bp, Homo sapiens
  misc_feature 1..299: note = chr7:44151428-44151727
  misc_feature 1..299: note = hypo
  source 1..299: mol_type = genomic DNA
tcactgaggctcccgcccttgcaggggagcccgagttccgctacactgctgggatccatggcaacgaggtgctgggccgagagctgttgctgctgctcatgcagtacctgtgccgagagtaccgcgatgggaacccacgtgtgcgcagcctggtgcaggacacacgcatccacctggtgccctcactgaaccctgatggctacgaggtggcagcgcagatggtgggttgaagggtgaggctggccagggtccaggcagctgggggttgtgggggtgtgggtagccgatgcctaccctgc

SEQ ID NO: 61777 - DNA, 61 bp, Homo sapiens; identical to SEQ ID NO: 41289
  misc_feature 1..61: note = chr7:44152191-44152252
  misc_feature 1..61: note = hypo
  source 1..61: mol_type = genomic DNA

SEQ ID NO: 61778 - DNA, 30 bp, Homo sapiens; identical to SEQ ID NO: 41290
  misc_feature 1..30: note = chr7:44193301-44193331
  misc_feature 1..30: note = hypo
  source 1..30: mol_type = genomic DNA

SEQ ID NO: 61779 - DNA, 183 bp, Homo sapiens; identical to SEQ ID NO: 41291
  misc_feature 1..183: note = chr7:44258471-44258654
  misc_feature 1..183: note = hypo
  source 1..183: mol_type = genomic DNA

SEQ ID NO: 61780 - DNA, 53 bp, Homo sapiens; identical to SEQ ID NO: 41292
  misc_feature 1..53: note = chr7:44259286-44259339
  misc_feature 1..53: note = hypo
  source 1..53: mol_type = genomic DNA

SEQ ID NO: 61781 - DNA, 30 bp, Homo sapiens; identical to SEQ ID NO: 41293
  misc_feature 1..30: note = chr7:44275594-44275624
  misc_feature 1..30: note = hypo
  source 1..30: mol_type = genomic DNA

SEQ ID NO: 61782 - DNA, 30 bp, Homo sapiens; identical to SEQ ID NO: 41294
  misc_feature 1..30: note = chr7:44431004-44431034
  misc_feature 1..30: note = hypo
  source 1..30: mol_type = genomic DNA

SEQ ID NO: 61783 - DNA, 34 bp, Homo sapiens; identical to SEQ ID NO: 41295
  misc_feature 1..34: note = chr7:44517861-44517895
  misc_feature 1..34: note = hypo
  source 1..34: mol_type = genomic DNA

SEQ ID NO: 61784 - DNA, 30 bp, Homo sapiens; identical to SEQ ID NO: 41296
  misc_feature 1..30: note = chr7:44717883-44717913
  misc_feature 1..30: note = hypo
  source 1..30: mol_type = genomic DNA

SEQ ID NO: 61785 - DNA, 30 bp, Homo sapiens; identical to SEQ ID NO: 41297
  misc_feature 1..30: note = chr7:44801185-44801215
  misc_feature 1..30: note = hypo
  source 1..30: mol_type = genomic DNA

SEQ ID NO: 61786 - DNA, 27 bp, Homo sapiens
  misc_feature 1..27: note = chr7:45027184-45027211
  misc_feature 1..27: note = hypo
  source 1..27: mol_type = genomic DNA
attgttaagggacgaaagggccaagag

SEQ ID NO: 61787 - DNA, 34 bp, Homo sapiens; identical to SEQ ID NO: 41301
  misc_feature 1..34: note = chr7:45125675-45125709
  misc_feature 1..34: note = hypo
  source 1..34: mol_type = genomic DNA

SEQ ID NO: 61788 - DNA, 61 bp, Homo sapiens; identical to SEQ ID NO: 41302
  misc_feature 1..61: note = chr7:45222910-45222971
  misc_feature 1..61: note = hypo
  source 1..61: mol_type = genomic DNA

SEQ ID NO: 61789 - DNA, 44 bp, Homo sapiens; identical to SEQ ID NO: 41303
  misc_feature 1..44: note = chr7:45807457-45807501
  misc_feature 1..44: note = hypo
  source 1..44: mol_type = genomic DNA

SEQ ID NO: 61790 - DNA, 113 bp, Homo sapiens; identical to SEQ ID NO: 41304
  misc_feature 1..113: note = chr7:47394819-47394932
  misc_feature 1..113: note = hypo
  source 1..113: mol_type = genomic DNA

SEQ ID NO: 61791 - DNA, 30 bp, Homo sapiens; identical to SEQ ID NO: 41305
  misc_feature 1..30: note = chr7:47409179-47409209
  misc_feature 1..30: note = hypo
  source 1..30: mol_type = genomic DNA

SEQ ID NO: 61792 - DNA, 203 bp, Homo sapiens; identical to SEQ ID NO: 41306
  misc_feature 1..203: note = chr7:47420119-47420322
  misc_feature 1..203: note = hypo
  source 1..203: mol_type = genomic DNA

SEQ ID NO: 61793 - DNA, 142 bp, Homo sapiens; identical to SEQ ID NO: 41307
  misc_feature 1..142: note = chr7:47420382-47420524
  misc_feature 1..142: note = hypo
  source 1..142: mol_type = genomic DNA

SEQ ID NO: 61794 - DNA, 30 bp, Homo sapiens; identical to SEQ ID NO: 41308
  misc_feature 1..30: note = chr7:47449194-47449224
  misc_feature 1..30: note = hypo
  source 1..30: mol_type = genomic DNA

SEQ ID NO: 61795 - DNA, 61 bp, Homo sapiens; identical to SEQ ID NO: 41309
  misc_feature 1..61: note = chr7:47586473-47586534
  misc_feature 1..61: note = hypo
  source 1..61: mol_type = genomic DNA

SEQ ID NO: 61796 - DNA, 30 bp, Homo sapiens; identical to SEQ ID NO: 41310
  misc_feature 1..30: note = chr7:47702782-47702812
  misc_feature 1..30: note = hypo
  source 1..30: mol_type = genomic DNA

SEQ ID NO: 61797 - DNA, 16 bp, Homo sapiens
  misc_feature 1..16: note = chr7:49700766-49700782
  misc_feature 1..16: note = hypo
  source 1..16: mol_type = genomic DNA
gcgcccccggccggtc

SEQ ID NO: 61798 - DNA, 171 bp, Homo sapiens; identical to SEQ ID NO: 41312
  misc_feature 1..171: note = chr7:49740620-49740791
  misc_feature 1..171: note = hypo
  source 1..171: mol_type = genomic DNA

SEQ ID NO: 61799 - DNA, 30 bp, Homo sapiens; identical to SEQ ID NO: 41313
  misc_feature 1..30: note = chr7:50241354-50241384
  misc_feature 1..30: note = hypo
  source 1..30: mol_type = genomic DNA

SEQ ID NO: 61800 - DNA, 153 bp, Homo sapiens; identical to SEQ ID NO: 41314
  misc_feature 1..153: note = chr7:50243557-50243710
  misc_feature 1..153: note = hypo
  source 1..153: mol_type = genomic DNA

SEQ ID NO: 61801 - DNA, 30 bp, Homo sapiens; identical to SEQ ID NO: 41315
  misc_feature 1..30: note = chr7:50251382-50251412
  misc_feature 1..30: note = hypo
  source 1..30: mol_type = genomic DNA

SEQ ID NO: 61802 - DNA, 50 bp, Homo sapiens
  misc_feature 1..50: note = chr7:50294401-50294451
  misc_feature 1..50: note = hypo
  source 1..50: mol_type = genomic DNA
agactccatctcaaaaaaaaaaaaaaaaaaagattcctagtttcctaaga

SEQ ID NO: 61803 - DNA, 30 bp, Homo sapiens; identical to SEQ ID NO: 41317
  misc_feature 1..30: note = chr7:50337681-50337711
  misc_feature 1..30: note = hypo
  source 1..30: mol_type = genomic DNA

SEQ ID NO: 61804 - DNA, 30 bp, Homo sapiens; identical to SEQ ID NO: 41319
  misc_feature 1..30: note = chr7:50423094-50423124
  misc_feature 1..30: note = hypo
  source 1..30: mol_type = genomic DNA

SEQ ID NO: 61805 - DNA, 136 bp, Homo sapiens
  misc_feature 1..136: note = chr7:50438648-50438784
  misc_feature 1..136: note = hypo
  source 1..136: mol_type = genomic DNA
ggagtgagcgatttaggaactcacagaagggcacggccaggcaactcgggccctggcaaatgttccatagagacagcatccatggggttgaaccaagcacaatgcctgcaaatcgggcaggcgggttcatggaatt

SEQ ID NO: 61806 - DNA, 139 bp, Homo sapiens; identical to SEQ ID NO: 41321
  misc_feature 1..139: note = chr7:50444259-50444398
  misc_feature 1..139: note = hypo
  source 1..139: mol_type = genomic DNA

SEQ ID NO: 61807 - DNA, 30 bp, Homo sapiens; identical to SEQ ID NO: 41322
  misc_feature 1..30: note = chr7:50471189-50471219
  misc_feature 1..30: note = hypo
  source 1..30: mol_type = genomic DNA

SEQ ID NO: 61808 - DNA, 31 bp, Homo sapiens
  misc_feature 1..31: note = chr7:50560557-50560588
  misc_feature 1..31: note = hypo
  source 1..31: mol_type = genomic DNA
gcatcagctctgcagcgtctgcggcagcctc

SEQ ID NO: 61809 - DNA, 26 bp, Homo sapiens
  misc_feature 1..26: note = chr7:50560637-50560663
  misc_feature 1..26: note = hypo
  source 1..26: mol_type = genomic DNA
cttctcaccaccgcactgactaagca

SEQ ID NO: 61810 - DNA, 19 bp, Homo sapiens
  misc_feature 1..19: note = chr7:52268638-52268657
  misc_feature 1..19: note = hypo
  source 1..19: mol_type = genomic DNA
tttgtttgtttgagacgga

SEQ ID NO: 61811 - DNA, 30 bp, Homo sapiens; identical to SEQ ID NO: 41325
  misc_feature 1..30: note = chr7:52499272-52499302
  misc_feature 1..30: note = hypo
  source 1..30: mol_type = genomic DNA

SEQ ID NO: 61812 - DNA, 43 bp, Homo sapiens; identical to SEQ ID NO: 41326
  misc_feature 1..43: note = chr7:52736850-52736893
  misc_feature 1..43: note = hypo
  source 1..43: mol_type = genomic DNA

SEQ ID NO: 61813 - DNA, 30 bp, Homo sapiens; identical to SEQ ID NO: 41327
  misc_feature 1..30: note = chr7:53364402-53364432
  misc_feature 1..30: note = hypo
  source 1..30: mol_type = genomic DNA

SEQ ID NO: 61814 - DNA, 58 bp, Homo sapiens; identical to SEQ ID NO: 41328
  misc_feature 1..58: note = chr7:54794734-54794792
  misc_feature 1..58: note = hypo
  source 1..58: mol_type = genomic DNA

SEQ ID NO: 61815 - DNA, 30 bp, Homo sapiens; identical to SEQ ID NO: 41329
  misc_feature 1..30: note = chr7:54866907-54866937
  misc_feature 1..30: note = hypo
  source 1..30: mol_type = genomic DNA

SEQ ID NO: 61816 - DNA, 37 bp, Homo sapiens; identical to SEQ ID NO: 15001
  misc_feature 1..37: note = chr7:55145943-55145980
  misc_feature 1..37: note = hypo
  source 1..37: mol_type = genomic DNA

SEQ ID NO: 61817 - DNA, 42 bp, Homo sapiens; identical to SEQ ID NO: 41331
  misc_feature 1..42: note = chr7:55410245-55410287
  misc_feature 1..42: note = hypo
  source 1..42: mol_type = genomic DNA

SEQ ID NO: 61818 - DNA, 30 bp, Homo sapiens; identical to SEQ ID NO: 41332
  misc_feature 1..30: note = chr7:55838624-55838654
  misc_feature 1..30: note = hypo
  source 1..30: mol_type = genomic DNA

SEQ ID NO: 61819 - DNA, 267 bp, Homo sapiens
  misc_feature 1..267: note = chr7:56017856-56018123
  misc_feature 1..267: note = hypo
  source 1..267: mol_type = genomic DNA
gcagagcttgcagtgagccgagattgtgagcgagactccgtctgaaaaaaaaaaaaaaatctaattgtatagaatattgttacaaccacacagaagaaaaaaaaagaatcccaagaaatgttgaacacagtgctgtcattgtacactctaaggacaaaaagaaccacaaaaaataatctcacgcatcacttagaaagtttgtttttagtcgggatattgttagtacaactccaaaagcatatagtgtatactataggatttagcatt

SEQ ID NO: 61820 - DNA, 30 bp, Homo sapiens; identical to SEQ ID NO: 41334
  misc_feature 1..30: note = chr7:56144506-56144536
  misc_feature 1..30: note = hypo
  source 1..30: mol_type = genomic DNA

SEQ ID NO: 61821 - DNA, 42 bp, Homo sapiens; identical to SEQ ID NO: 41335
  misc_feature 1..42: note = chr7:57247720-57247762
  misc_feature 1..42: note = hypo
  source 1..42: mol_type = genomic DNA

SEQ ID NO: 61822 - DNA, 21 bp, Homo sapiens
  misc_feature 1..21: note = chr7:57655640-57655661
  misc_feature 1..21: note = hypo
  source 1..21: mol_type = genomic DNA
ccaccgcgcctggcccatata

SEQ ID NO: 61823 - DNA, 30 bp, Homo sapiens; identical to SEQ ID NO: 41337
  misc_feature 1..30: note = chr7:63393332-63393362
  misc_feature 1..30: note = hypo
  source 1..30: mol_type = genomic DNA

SEQ ID NO: 61824 - DNA, 30 bp, Homo sapiens; identical to SEQ ID NO: 41338
  misc_feature 1..30: note = chr7:63574716-63574746
  misc_feature 1..30: note = hypo
  source 1..30: mol_type = genomic DNA

SEQ ID NO: 61825 - DNA, 151 bp, Homo sapiens; identical to SEQ ID NO: 41339
  misc_feature 1..151: note = chr7:63666590-63666741
  misc_feature 1..151: note = hypo
  source 1..151: mol_type = genomic DNA

SEQ ID NO: 61826 - DNA, 28 bp, Homo sapiens
  misc_feature 1..28: note = chr7:65236287-65236315
  misc_feature 1..28: note = hypo
  source 1..28: mol_type = genomic DNA
tgaggctccctgggccgtgctatcccgg

SEQ ID NO: 61827 - DNA, 42 bp, Homo sapiens; identical to SEQ ID NO: 41341
  misc_feature 1..42: note = chr7:65879595-65879637
  misc_feature 1..42: note = hypo
  source 1..42: mol_type = genomic DNA

SEQ ID NO: 61828 - DNA, 81 bp, Homo sapiens; identical to SEQ ID NO: 41342
  misc_feature 1..81: note = chr7:65880043-65880124
  misc_feature 1..81: note = hypo
  source 1..81: mol_type = genomic DNA

SEQ ID NO: 61829 - DNA, 30 bp, Homo sapiens; identical to SEQ ID NO: 41343
  misc_feature 1..30: note = chr7:65969625-65969655
  misc_feature 1..30: note = hypo
  source 1..30: mol_type = genomic DNA

SEQ ID NO: 61830 - DNA, 40 bp, Homo sapiens; identical to SEQ ID NO: 41344
  misc_feature 1..40: note = chr7:66215014-66215054
  misc_feature 1..40: note = hypo
  source 1..40: mol_type = genomic DNA

SEQ ID NO: 61831 - DNA, 40 bp, Homo sapiens; identical to SEQ ID NO: 41345
  misc_feature 1..40: note = chr7:67161739-67161779
  misc_feature 1..40: note = hypo
  source 1..40: mol_type = genomic DNA

SEQ ID NO: 61832 - DNA, 49 bp, Homo sapiens; identical to SEQ ID NO: 41346
  misc_feature 1..49: note = chr7:68000342-68000391
  misc_feature 1..49: note = hypo
  source 1..49: mol_type = genomic DNA

SEQ ID NO: 61833 - DNA, 35 bp, Homo sapiens
  misc_feature 1..35: note = chr7:68204758-68204793
  misc_feature 1..35: note = hypo
  source 1..35: mol_type = genomic DNA
ttcagaagtgactttcgaggaaatttggtcccgtt

SEQ ID NO: 61834 - DNA, 27 bp, Homo sapiens
  misc_feature 1..27: note = chr7:68982718-68982745
  misc_feature 1..27: note = hypo
  source 1..27: mol_type = genomic DNA
tgtgagccaccgcgcctggccattgct

SEQ ID NO: 61835 - DNA, 100 bp, Homo sapiens; identical to SEQ ID NO: 41349
  misc_feature 1..100: note = chr7:69032251-69032351
  misc_feature 1..100: note = hypo
  source 1..100: mol_type = genomic DNA

SEQ ID NO: 61836 - DNA, 42 bp, Homo sapiens; identical to SEQ ID NO: 15004
  misc_feature 1..42: note = chr7:69036110-69036152
  misc_feature 1..42: note = hypo
  source 1..42: mol_type = genomic DNA

SEQ ID NO: 61837 - DNA, 179 bp, Homo sapiens; identical to SEQ ID NO: 15005
  misc_feature 1..179: note = chr7:69313694-69313873
  misc_feature 1..179: note = hypo
  source 1..179: mol_type = genomic DNA

SEQ ID NO: 61838 - DNA, 30 bp, Homo sapiens; identical to SEQ ID NO: 41352
  misc_feature 1..30: note = chr7:69698849-69698879
  misc_feature 1..30: note = hypo
  source 1..30: mol_type = genomic DNA

SEQ ID NO: 61839 - DNA, 18 bp, Homo sapiens
  misc_feature 1..18: note = chr7:70728615-70728633
  misc_feature 1..18: note = hypo
  source 1..18: mol_type = genomic DNA
cctcagtgatctggccgg

SEQ ID NO: 61840 - DNA, 19 bp, Homo sapiens
  misc_feature 1..19: note = chr7:71256983-71257002
  misc_feature 1..19: note = hypo
  source 1..19: mol_type = genomic DNA
actccgtctcaaaaaaaga

SEQ ID NO: 61841 - DNA, 30 bp, Homo sapiens; identical to SEQ ID NO: 41355
  misc_feature 1..30: note = chr7:71296085-71296115
  misc_feature 1..30: note = hypo
  source 1..30: mol_type = genomic DNA

SEQ ID NO: 61842 - DNA, 30 bp, Homo sapiens; identical to SEQ ID NO: 41356
  misc_feature 1..30: note = chr7:71880817-71880847
  misc_feature 1..30: note = hypo
  source 1..30: mol_type = genomic DNA

SEQ ID NO: 61843 - DNA, 30 bp, Homo sapiens; identical to SEQ ID NO: 41357
  misc_feature 1..30: note = chr7:75975426-75975456
  misc_feature 1..30: note = hypo
  source 1..30: mol_type = genomic DNA

SEQ ID NO: 61844 - DNA, 49 bp, Homo sapiens; identical to SEQ ID NO: 41358
  misc_feature 1..49: note = chr7:76106331-76106380
  misc_feature 1..49: note = hypo
  source 1..49: mol_type = genomic DNA

SEQ ID NO: 61845 - DNA, 28 bp, Homo sapiens
  misc_feature 1..28: note = chr7:77309374-77309402
  misc_feature 1..28: note = hypo
  source 1..28: mol_type = genomic DNA
tggagtgcagtggtccgcctcccgggtt

SEQ ID NO: 61846 - DNA, 28 bp, Homo sapiens
  misc_feature 1..28: note = chr7:77309582-77309610
  misc_feature 1..28: note = hypo
  source 1..28: mol_type = genomic DNA
aggcgtgagccatcgtgcccggccagac

SEQ ID NO: 61847 - DNA, 28 bp, Homo sapiens
  misc_feature 1..28: note = chr7:77928410-77928438
  misc_feature 1..28: note = hypo
  source 1..28: mol_type = genomic DNA
aggcgtgagctaccgtgcctggctataa

SEQ ID NO: 61848 - DNA, 23 bp, Homo sapiens
  misc_feature 1..23: note = chr7:84936791-84936814
  misc_feature 1..23: note = hypo
  source 1..23: mol_type = genomic DNA
accgcgctcggccttgtttacca

SEQ ID NO: 61849 - DNA, 39 bp, Homo sapiens; identical to SEQ ID NO: 41363
  misc_feature 1..39: note = chr7:86228129-86228168
  misc_feature 1..39: note = hypo
  source 1..39: mol_type = genomic DNA

SEQ ID NO: 61850 - DNA, 42 bp, Homo sapiens; identical to SEQ ID NO: 41364
  misc_feature 1..42: note = chr7:86416083-86416125
  misc_feature 1..42: note = hypo
  source 1..42: mol_type = genomic DNA

SEQ ID NO: 61851 - DNA, 16 bp, Homo sapiens
  misc_feature 1..16: note = chr7:90269563-90269579
  misc_feature 1..16: note = hypo
  source 1..16: mol_type = genomic DNA
tcggccatcttggctc

SEQ ID NO: 61852 - DNA, 30 bp, Homo sapiens; identical to SEQ ID NO: 41366
  misc_feature 1..30: note = chr7:91510852-91510882
  misc_feature 1..30: note = hypo
  source 1..30: mol_type = genomic DNA

SEQ ID NO: 61853 - DNA, 30 bp, Homo sapiens; identical to SEQ ID NO: 41367
  misc_feature 1..30: note = chr7:93055830-93055860
  misc_feature 1..30: note = hypo
  source 1..30: mol_type = genomic DNA

SEQ ID NO: 61854 - DNA, 83 bp, Homo sapiens; identical to SEQ ID NO: 41368
  misc_feature 1..83: note = chr7:94138070-94138153
  misc_feature 1..83: note = hypo
  source 1..83: mol_type = genomic DNA

SEQ ID NO: 61855 - DNA, 30 bp, Homo sapiens; identical to SEQ ID NO: 41369
  misc_feature 1..30: note = chr7:97591443-97591473
  misc_feature 1..30: note = hypo
  source 1..30: mol_type = genomic DNA

SEQ ID NO: 61856 - DNA, 15 bp, Homo sapiens
  misc_feature 1..15: note = chr7:97600089-97600104
  misc_feature 1..15: note = hypo
  source 1..15: mol_type = genomic DNA
cttagctattgaaaa

SEQ ID NO: 61857 - DNA, 41 bp, Homo sapiens; identical to SEQ ID NO: 15007
  misc_feature 1..41: note = chr7:97797757-97797798
  misc_feature 1..41: note = hypo
  source 1..41: mol_type = genomic DNA

SEQ ID NO: 61858 - DNA, 30 bp, Homo sapiens; identical to SEQ ID NO: 41372
  misc_feature 1..30: note = chr7:97804272-97804302
  misc_feature 1..30: note = hypo
  source 1..30: mol_type = genomic DNA

SEQ ID NO: 61859 - DNA, 30 bp, Homo sapiens; identical to SEQ ID NO: 41373
  misc_feature 1..30: note = chr7:97807742-97807772
  misc_feature 1..30: note = hypo
  source 1..30: mol_type = genomic DNA

SEQ ID NO: 61860 - DNA, 30 bp, Homo sapiens; identical to SEQ ID NO: 41374
  misc_feature 1..30: note = chr7:97834167-97834197
  misc_feature 1..30: note = hypo
  source 1..30: mol_type = genomic DNA

SEQ ID NO: 61861 - DNA, 27 bp, Homo sapiens
  misc_feature 1..27: note = chr7:97869134-97869161
  misc_feature 1..27: note = hypo
  source 1..27: mol_type = genomic DNA
gtgactggccaggcacggtggctcatg

SEQ ID NO: 61862 - DNA, 213 bp, Homo sapiens
  misc_feature 1..213: note = chr7:97869401-97869614
  misc_feature 1..213: note = hypo
  source 1..213: mol_type = genomic DNA
cagagcgacactccgtctcaaaaaaaacaaacaaaagaaaaaccctgtgagtaatcggaaatcggctggttttattggacttgccgctgataagatgcaaaagacaagcagtgactagaggatggggaggcgcttggttaatcaagggcttcaggaaattcgcttccgattcttcgaaatgttgcagcctattaggtgatacttgcagttgct

SEQ ID NO: 61863 - DNA, 23 bp, Homo sapiens
  misc_feature 1..23: note = chr7:97869644-97869667
  misc_feature 1..23: note = hypo
  source 1..23: mol_type = genomic DNA
ggattttacggcacaaaacgtcc

SEQ ID NO: 61864 - DNA, 42 bp, Homo sapiens; identical to SEQ ID NO: 41377
  misc_feature 1..42: note = chr7:97882348-97882390
  misc_feature 1..42: note = hypo
  source 1..42: mol_type = genomic DNA

SEQ ID NO: 61865 - DNA, 48 bp, Homo sapiens; identical to SEQ ID NO: 41378
  misc_feature 1..48: note = chr7:97899729-97899777
  misc_feature 1..48: note = hypo
  source 1..48: mol_type = genomic DNA

SEQ ID NO: 61866 - DNA, 48 bp, Homo sapiens; identical to SEQ ID NO: 41379
  misc_feature 1..48: note = chr7:98121881-98121929
  misc_feature 1..48: note = hypo
  source 1..48: mol_type = genomic DNA

SEQ ID NO: 61867 - DNA, 198 bp, Homo sapiens; identical to SEQ ID NO: 15009
  misc_feature 1..198: note = chr7:98183080-98183278
  misc_feature 1..198: note = hypo
  source 1..198: mol_type = genomic DNA

SEQ ID NO: 61868 - DNA, 30 bp, Homo sapiens; identical to SEQ ID NO: 41381
  misc_feature 1..30: note = chr7:98970776-98970806
  misc_feature 1..30: note = hypo
  source 1..30: mol_type = genomic DNA

SEQ ID NO: 61869 - DNA, 41 bp, Homo sapiens
  misc_feature 1..41: note = chr7:98971549-98971590
  misc_feature 1..41: note = hypo
  source 1..41: mol_type = genomic DNA
actggggtctcttccatctgcctggccgccaggccacgtat

SEQ ID NO: 61870 - DNA, 263 bp, Homo sapiens; identical to SEQ ID NO: 41383
  misc_feature 1..263: note = chr7:98991519-98991782
  misc_feature 1..263: note = hypo
  source 1..263: mol_type = genomic DNA

SEQ ID NO: 61871 - DNA, 389 bp, Homo sapiens; identical to SEQ ID NO: 41384
  misc_feature 1..389: note = chr7:99020748-99021137
  misc_feature 1..389: note = hypo
  source 1..389: mol_type = genomic DNA

SEQ ID NO: 61872 - DNA, 22 bp, Homo sapiens
  misc_feature 1..22: note = chr7:99649204-99649226
  misc_feature 1..22: note = hypo
  source 1..22: mol_type = genomic DNA
acggcgccgggccccctaggga

SEQ ID NO: 61873 - DNA, 43 bp, Homo sapiens; identical to SEQ ID NO: 41387
  misc_feature 1..43: note = chr7:99691859-99691902
  misc_feature 1..43: note = hypo
  source 1..43: mol_type = genomic DNA

SEQ ID NO: 61874 - DNA, 37 bp, Homo sapiens; identical to SEQ ID NO: 15013
  misc_feature 1..37: note = chr7:99700198-99700235
  misc_feature 1..37: note = hypo
  source 1..37: mol_type = genomic DNA

SEQ ID NO: 61875 - DNA, 87 bp, Homo sapiens; identical to SEQ ID NO: 41389
  misc_feature 1..87: note = chr7:99723146-99723233
  misc_feature 1..87: note = hypo
  source 1..87: mol_type = genomic DNA

SEQ ID NO: 61876 - DNA, 41 bp, Homo sapiens; identical to SEQ ID NO: 41390
  misc_feature 1..41: note = chr7:99839918-99839959
  misc_feature 1..41: note = hypo
  source 1..41: mol_type = genomic DNA

SEQ ID NO: 61877 - DNA, 21 bp, Homo sapiens
  misc_feature 1..21: note = chr7:99934962-99934983
  misc_feature 1..21: note = hypo
  source 1..21: mol_type = genomic DNA
ccaccacgcccagctgccttg

SEQ ID NO: 61878 - DNA, 55 bp, Homo sapiens
  misc_feature 1..55: note = chr7:100088128-100088183
  misc_feature 1..55: note = hypo
  source 1..55: mol_type = genomic DNA
catcccagcagaggtcgaggacggtgcccgggcctggaatggcagtgccgagggt

SEQ ID NO: 61879 - skipped

SEQ ID NO: 61880 - DNA, 89 bp, Homo sapiens; identical to SEQ ID NO: 41393
  misc_feature 1..89: note = chr7:100104071-100104160
  misc_feature 1..89: note = hypo
  source 1..89: mol_type = genomic DNA

SEQ ID NO: 61881 - DNA, 30 bp, Homo sapiens; identical to SEQ ID NO: 41394
  misc_feature 1..30: note = chr7:100118785-100118815
  misc_feature 1..30: note = hypo
  source 1..30: mol_type = genomic DNA

SEQ ID NO: 61882 - DNA, 89 bp, Homo sapiens; identical to SEQ ID NO: 41395
  misc_feature 1..89: note = chr7:100179713-100179802
  misc_feature 1..89: note = hypo
  source 1..89: mol_type = genomic DNA

SEQ ID NO: 61883 - DNA, 83 bp, Homo sapiens; identical to SEQ ID NO: 41396
  misc_feature 1..83: note = chr7:100279918-100280001
  misc_feature 1..83: note = hypo
  source 1..83: mol_type = genomic DNA

SEQ ID NO: 61884 - DNA, 39 bp, Homo sapiens; identical to SEQ ID NO: 41397
  misc_feature 1..39: note = chr7:100391505-100391544
  misc_feature 1..39: note = hypo
  source 1..39: mol_type = genomic DNA

SEQ ID NO: 61885 - DNA, 300 bp, Homo sapiens; identical to SEQ ID NO: 41398
  misc_feature 1..300: note = chr7:100490045-100490345
  misc_feature 1..300: note = hypo
  source 1..300: mol_type = genomic DNA

SEQ ID NO: 61886 - DNA, 22 bp, Homo sapiens
  misc_feature 1..22: note = chr7:100495308-100495330
  misc_feature 1..22: note = hypo
  source 1..22: mol_type = genomic DNA
agcactctgggaggccgagaca

SEQ ID NO: 61887 - DNA, 17 bp, Homo sapiens
  misc_feature 1..17: note = chr7:100723832-100723849
  misc_feature 1..17: note = hypo
  source 1..17: mol_type = genomic DNA
gtttgttttttgagacg

SEQ ID NO: 61888 - DNA, 145 bp, Homo sapiens; identical to SEQ ID NO: 41401
  misc_feature 1..145: note = chr7:100799106-100799251
  misc_feature 1..145: note = hypo
  source 1..145: mol_type = genomic DNA

SEQ ID NO: 61889 - DNA, 30 bp, Homo sapiens; identical to SEQ ID NO: 41402
  misc_feature 1..30: note = chr7:100858230-100858260
  misc_feature 1..30: note = hypo
  source 1..30: mol_type = genomic DNA

SEQ ID NO: 61890 - DNA, 39 bp, Homo sapiens; identical to SEQ ID NO: 41403
  misc_feature 1..39: note = chr7:100894771-100894810
  misc_feature 1..39: note = hypo
  source 1..39: mol_type = genomic DNA

SEQ ID NO: 61891 - DNA, 34 bp, Homo sapiens; identical to SEQ ID NO: 41404
  misc_feature 1..34: note = chr7:100897086-100897120
  misc_feature 1..34: note = hypo
  source 1..34: mol_type = genomic DNA

SEQ ID NO: 61892 - DNA, 30 bp, Homo sapiens; identical to SEQ ID NO: 41405
  misc_feature 1..30: note = chr7:100967105-100967135
  misc_feature 1..30: note = hypo
  source 1..30: mol_type = genomic DNA

SEQ ID NO: 61893 - DNA, 16 bp, Homo sapiens
  misc_feature 1..16: note = chr7:101056509-101056525
  misc_feature 1..16: note = hypo
  source 1..16: mol_type = genomic DNA
agacttgtggccgggc

SEQ ID NO: 61894 - DNA, 87 bp, Homo sapiens; identical to SEQ ID NO: 41407
  misc_feature 1..87: note = chr7:101131936-101132023
  misc_feature 1..87: note = hypo
  source 1..87: mol_type = genomic DNA

SEQ ID NO: 61895 - DNA, 147 bp, Homo sapiens
  misc_feature 1..147: note = chr7:101241846-101241993
  misc_feature 1..147: note = hypo
  source 1..147: mol_type = genomic DNA
cggaaactggcaagccgccggagggcctcgtcaaggctttgatgaccctgtgctgaggacgcaaatcctaggcctggccgacaccctgctccaaggaccaatgactgaggccagagagggtcccagatggagcctgggtaggggtga

SEQ ID NO: 61896 - DNA, 30 bp, Homo sapiens; identical to SEQ ID NO: 41410
  misc_feature 1..30: note = chr7:101627816-101627846
  misc_feature 1..30: note = hypo
  source 1..30: mol_type = genomic DNA

SEQ ID NO: 61897 - DNA, 34 bp, Homo sapiens; identical to SEQ ID NO: 41411
  misc_feature 1..34: note = chr7:101630517-101630551
  misc_feature 1..34: note = hypo
  source 1..34: mol_type = genomic DNA

SEQ ID NO: 61898 - DNA, 115 bp, Homo sapiens; identical to SEQ ID NO: 41412
  misc_feature 1..115: note = chr7:101652590-101652705
  misc_feature 1..115: note = hypo
  source 1..115: mol_type = genomic DNA

SEQ ID NO: 61899 - DNA, 78 bp, Homo sapiens; identical to SEQ ID NO: 15018
  misc_feature 1..78: note = chr7:101656381-101656459
  misc_feature 1..78: note = hypo
  source 1..78: mol_type = genomic DNA

SEQ ID NO: 61900 - DNA, 30 bp, Homo sapiens; identical to SEQ ID NO: 41414
  misc_feature 1..30: note = chr7:101707051-101707081
  misc_feature 1..30: note = hypo
  source 1..30: mol_type = genomic DNA

SEQ ID NO: 61901 - skipped

SEQ ID NO: 61902 - DNA, 38 bp, Homo sapiens; identical to SEQ ID NO: 41416
  misc_feature 1..38: note = chr7:101707600-101707638
  misc_feature 1..38: note = hypo
  source 1..38: mol_type = genomic DNA

SEQ ID NO: 61903 - DNA, 97 bp, Homo sapiens; identical to SEQ ID NO: 41417
  misc_feature 1..97: note = chr7:102097002-102097099
  misc_feature 1..97: note = hypo
  source 1..97: mol_type = genomic DNA

SEQ ID NO: 61904 - DNA, 29 bp, Homo sapiens
  misc_feature 1..29: note = chr7:102232246-102232275
  misc_feature 1..29: note = hypo
  source 1..29: mol_type = genomic DNA
acaacctggtaaggtcggatcaacttcct

SEQ ID NO: 61905 - DNA, 30 bp, Homo sapiens; identical to SEQ ID NO: 41420
  misc_feature 1..30: note = chr7:105280417-105280447
  misc_feature 1..30: note = hypo
  source 1..30: mol_type = genomic DNA

SEQ ID NO: 61906 - DNA, 30 bp, Homo sapiens; identical to SEQ ID NO: 41421
  misc_feature 1..30: note = chr7:105288193-105288223
  misc_feature 1..30: note = hypo
  source 1..30: mol_type = genomic DNA

SEQ ID NO: 61907 - DNA, 30 bp, Homo sapiens; identical to SEQ ID NO: 41422
  misc_feature 1..30: note = chr7:106123211-106123241
  misc_feature 1..30: note = hypo
  source 1..30: mol_type = genomic DNA

SEQ ID NO: 61908 - DNA, 90 bp, Homo sapiens; identical to SEQ ID NO: 41423
  misc_feature 1..90: note = chr7:106123301-106123391
  misc_feature 1..90: note = hypo
  source 1..90: mol_type = genomic DNA

SEQ ID NO: 61909 - DNA, 290 bp, Homo sapiens; identical to SEQ ID NO: 41424
  misc_feature 1..290: note = chr7:106508656-106508946
  misc_feature 1..290: note = hypo
  source 1..290: mol_type = genomic DNA

SEQ ID NO: 61910 - DNA, 32 bp, Homo sapiens; identical to SEQ ID NO: 41425
  misc_feature 1..32: note = chr7:106609365-106609397
  misc_feature 1..32: note = hypo
  source 1..32: mol_type = genomic DNA

SEQ ID NO: 61911 - DNA, 42 bp, Homo sapiens; identical to SEQ ID NO: 41426
  misc_feature 1..42: note = chr7:106651496-106651538
  misc_feature 1..42: note = hypo
  source 1..42: mol_type = genomic DNA

SEQ ID NO: 61912 - DNA, 37 bp, Homo sapiens; identical to SEQ ID NO: 41427
  misc_feature 1..37: note = chr7:106748373-106748410
  misc_feature 1..37: note = hypo
  source 1..37: mol_type = genomic DNA

SEQ ID NO: 61913 - DNA, 43 bp, Homo sapiens; identical to SEQ ID NO: 41428
  misc_feature 1..43: note = chr7:106796956-106796999
  misc_feature 1..43: note = hypo
  source 1..43: mol_type = genomic DNA

SEQ ID NO: 61914 - DNA, 41 bp, Homo sapiens; identical to SEQ ID NO: 41429
  misc_feature 1..41: note = chr7:106797653-106797694
  misc_feature 1..41: note = hypo
  source 1..41: mol_type = genomic DNA

SEQ ID NO: 61915 - DNA, 24 bp, Homo sapiens
  misc_feature 1..24: note = chr7:106802882-106802906
  misc_feature 1..24: note = hypo
  source 1..24: mol_type = genomic DNA
gcgagactccgtccataaaacaaa

SEQ ID NO: 61916 - DNA, 121 bp, Homo sapiens; identical to SEQ ID NO: 41431
  misc_feature 1..121: note = chr7:106837489-106837610
  misc_feature 1..121: note = hypo
  source 1..121: mol_type = genomic DNA

SEQ ID NO: 61917 - DNA, 90 bp, Homo sapiens; identical to SEQ ID NO: 41432
  misc_feature 1..90: note = chr7:107148303-107148393
  misc_feature 1..90: note = hypo
  source 1..90: mol_type = genomic DNA

SEQ ID NO: 61918 - DNA, 150 bp, Homo sapiens; identical to SEQ ID NO: 41434
  misc_feature 1..150: note = chr7:108515007-108515157
  misc_feature 1..150: note = hypo
  source 1..150: mol_type = genomic DNA

SEQ ID NO: 61919 - DNA, 30 bp, Homo sapiens; identical to SEQ ID NO: 41435
  misc_feature 1..30: note = chr7:111662581-111662611
  misc_feature 1..30: note = hypo
  source 1..30: mol_type = genomic DNA

SEQ ID NO: 61920 - DNA, 33 bp, Homo sapiens; identical to SEQ ID NO: 41436
  misc_feature 1..33: note = chr7:115738436-115738469
  misc_feature 1..33: note = hypo
  source 1..33: mol_type = genomic DNA

SEQ ID NO: 61921 - DNA, 16 bp, Homo sapiens
  misc_feature 1..16: note = chr7:116492607-116492623
  misc_feature 1..16: note = hypo
  source 1..16: mol_type = genomic DNA
ccgagtagctggaact

SEQ ID NO: 61922 - DNA, 16 bp, Homo sapiens
  misc_feature 1..16: note = chr7:123175665-123175681
  misc_feature 1..16: note = hypo
  source 1..16: mol_type = genomic DNA
agagtcttgctctgtc

SEQ ID NO: 61923 - DNA, 72 bp, Homo sapiens
  misc_feature 1..72: note = chr7:128096987-128097059
  misc_feature 1..72: note = hypo
  source 1..72: mol_type = genomic DNA
ttacaggtatgagccaccgcgcctggcctaagaaagtaaaagttttaagaagtgttcttgaattagtccaag

SEQ ID NO: 61924 - DNA, 30 bp, Homo sapiens; identical to SEQ ID NO: 1575
  misc_feature 1..30: note = chr7:128097589-128097619
  misc_feature 1..30: note = hypo
  source 1..30: mol_type = genomic DNA

SEQ ID NO: 61925 - DNA, 103 bp, Homo sapiens; identical to SEQ ID NO: 41442
  misc_feature 1..103: note = chr7:128315917-128316020
  misc_feature 1..103: note = hypo
  source 1..103: mol_type = genomic DNA

SEQ ID NO: 61926 - DNA, 30 bp, Homo sapiens; identical to SEQ ID NO: 41443
  misc_feature 1..30: note = chr7:128483019-128483049
  misc_feature 1..30: note = hypo
  source 1..30: mol_type = genomic DNA

SEQ ID NO: 61927 - DNA, 54 bp, Homo sapiens; identical to SEQ ID NO: 41444
  misc_feature 1..54: note = chr7:128486164-128486218
  misc_feature 1..54: note = hypo
  source 1..54: mol_type = genomic DNA

SEQ ID NO: 61928 - DNA, 40 bp, Homo sapiens; identical to SEQ ID NO: 41445
  misc_feature 1..40: note = chr7:128493190-128493230
  misc_feature 1..40: note = hypo
  source 1..40: mol_type = genomic DNA

SEQ ID NO: 61929 - DNA, 30 bp, Homo sapiens; identical to SEQ ID NO: 41446
  misc_feature 1..30: note = chr7:128525170-128525200
  misc_feature 1..30: note = hypo
  source 1..30: mol_type = genomic DNA

SEQ ID NO: 61930 - DNA, 47 bp, Homo sapiens; identical to SEQ ID NO: 41447
  misc_feature 1..47: note = chr7:128528840-128528887
  misc_feature 1..47: note = hypo
  source 1..47: mol_type = genomic DNA

SEQ ID NO: 61931 - DNA, 30 bp, Homo sapiens; identical to SEQ ID NO: 15026
  misc_feature 1..30: note = chr7:128529102-128529132
  misc_feature 1..30: note = hypo
  source 1..30: mol_type = genomic DNA

SEQ ID NO: 61932 - DNA, 30 bp, Homo sapiens; identical to SEQ ID NO: 41449
  misc_feature 1..30: note = chr7:128533290-128533320
  misc_feature 1..30: note = hypo
  source 1..30: mol_type = genomic DNA

SEQ ID NO: 61933 - DNA, 30 bp, Homo sapiens; identical to SEQ ID NO: 41451
  misc_feature 1..30: note = chr7:129297274-129297304
  misc_feature 1..30: note = hypo
  source 1..30: mol_type = genomic DNA

SEQ ID NO: 61934 - DNA, 30 bp, Homo sapiens; identical to SEQ ID NO: 41452
  misc_feature 1..30: note = chr7:129330294-129330324
  misc_feature 1..30: note = hypo
  source 1..30: mol_type = genomic DNA

SEQ ID NO: 61935 - DNA, 258 bp, Homo sapiens; identical to SEQ ID NO: 41453
  misc_feature 1..258: note = chr7:129381062-129381320
  misc_feature 1..258: note = hypo
  source 1..258: mol_type = genomic DNA

SEQ ID NO: 61936 - DNA, 30 bp, Homo sapiens; identical to SEQ ID NO: 41454
  misc_feature 1..30: note = chr7:129782524-129782554
  misc_feature 1..30: note = hypo
  source 1..30: mol_type = genomic DNA

SEQ ID NO: 61937 - DNA, 167 bp, Homo sapiens
  misc_feature 1..167: note = chr7:129794426-129794593
  misc_feature 1..167: note = hypo
  source 1..167: mol_type = genomic DNA
tccaagtgccagctgcgcagcctggcccagagtccgggcccaggagggcccgcagtgcctgcagctgcctggggaccacatgcgtgactggctggccccctgctcatcccgcctctctcctccgcctggcttcgcgccgcctgcctgccctcggggacaagcgtgcc

SEQ ID NO: 61938 - DNA, 18 bp, Homo sapiens
  misc_feature 1..18: note = chr7:129794721-129794739
  misc_feature 1..18: note = hypo
  source 1..18: mol_type = genomic DNA
gtgcgcccatcagggtgt

SEQ ID NO: 61939 - DNA, 30 bp, Homo sapiens; identical to SEQ ID NO: 41456
  misc_feature 1..30: note = chr7:129846079-129846109
  misc_feature 1..30: note = hypo
  source 1..30: mol_type = genomic DNA

SEQ ID NO: 61940 - DNA, 28 bp, Homo sapiens
  misc_feature 1..28: note = chr7:131011379-131011407
  misc_feature 1..28: note = hypo
  source 1..28: mol_type = genomic DNA
aggtgtgagccaccgtgccgggcctggc

SEQ ID NO: 61941 - DNA, 30 bp, Homo sapiens; identical to SEQ ID NO: 15029
  misc_feature 1..30: note = chr7:131231034-131231064
  misc_feature 1..30: note = hypo
  source 1..30: mol_type = genomic DNA

SEQ ID NO: 61942 - DNA, 35 bp, Homo sapiens; identical to SEQ ID NO: 41460
  misc_feature 1..35: note = chr7:132155933-132155968
  misc_feature 1..35: note = hypo
  source 1..35: mol_type = genomic DNA

SEQ ID NO: 61943 - DNA, 34 bp, Homo sapiens; identical to SEQ ID NO: 41461
  misc_feature 1..34: note = chr7:132156088-132156122
  misc_feature 1..34: note = hypo
  source 1..34: mol_type = genomic DNA

SEQ ID NO: 61944 - DNA, 117 bp, Homo sapiens; identical to SEQ ID NO: 41462
  misc_feature 1..117: note = chr7:132418949-132419066
  misc_feature 1..117: note = hypo
  source 1..117: mol_type = genomic DNA

SEQ ID NO: 61945 - DNA, 30 bp, Homo sapiens; identical to SEQ ID NO: 41463
  misc_feature 1..30: note = chr7:134116597-134116627
  misc_feature 1..30: note = hypo
  source 1..30: mol_type = genomic DNA

SEQ ID NO: 61946 - DNA, 30 bp, Homo sapiens; identical to SEQ ID NO: 41464
  misc_feature 1..30: note = chr7:134880911-134880941
  misc_feature 1..30: note = hypo
  source 1..30: mol_type = genomic DNA

SEQ ID NO: 61947 - DNA, 104 bp, Homo sapiens; identical to SEQ ID NO: 41465
  misc_feature 1..104: note = chr7:134885144-134885248
  misc_feature 1..104: note = hypo
  source 1..104: mol_type = genomic DNA

SEQ ID NO: 61948 - DNA, 30 bp, Homo sapiens; identical to SEQ ID NO: 41467
  misc_feature 1..30: note = chr7:134953117-134953147
  misc_feature 1..30: note = hypo
  source 1..30: mol_type = genomic DNA

SEQ ID NO: 61949 - DNA, 37 bp, Homo sapiens; identical to SEQ ID NO: 41468
  misc_feature 1..37: note = chr7:135125375-135125412
  misc_feature 1..37: note = hypo
  source 1..37: mol_type = genomic DNA

SEQ ID NO: 61950 - DNA, 84 bp, Homo sapiens; identical to SEQ ID NO: 41469
  misc_feature 1..84: note = chr7:135196033-135196117
  misc_feature 1..84: note = hypo
  source 1..84: mol_type = genomic DNA

SEQ ID NO: 61951 - DNA, 24 bp, Homo sapiens
  misc_feature 1..24: note = chr7:135196357-135196381
  misc_feature 1..24: note = hypo
  source 1..24: mol_type = genomic DNA
gattacagacgtgagccagggcac

SEQ ID NO: 61952 - DNA, 37 bp, Homo sapiens; identical to SEQ ID NO: 41471
  misc_feature 1..37: note = chr7:135234576-135234613
  misc_feature 1..37: note = hypo
  source 1..37: mol_type = genomic DNA

SEQ ID NO: 61953 - DNA, 30 bp, Homo sapiens; identical to SEQ ID NO: 41472
  misc_feature 1..30: note = chr7:135391578-135391608
  misc_feature 1..30: note = hypo
  source 1..30: mol_type = genomic DNA

SEQ ID NO: 61954 - DNA, 135 bp, Homo sapiens; identical to SEQ ID NO: 15032
  misc_feature 1..135: note = chr7:135401363-135401498
  misc_feature 1..135: note = hypo
  source 1..135: mol_type = genomic DNA

SEQ ID NO: 61955 - DNA, 30 bp, Homo sapiens; identical to SEQ ID NO: 41474
  misc_feature 1..30: note = chr7:135898077-135898107
  misc_feature 1..30: note = hypo
  source 1..30: mol_type = genomic DNA

SEQ ID NO: 61956 - DNA, 23 bp, Homo sapiens
  misc_feature 1..23: note = chr7:135965324-135965347
  misc_feature 1..23: note = hypo
  source 1..23: mol_type = genomic DNA
accatgcccggcatgactgctct

SEQ ID NO: 61957 - DNA, 36 bp, Homo sapiens; identical to SEQ ID NO: 41476
  misc_feature 1..36: note = chr7:137092635-137092671
  misc_feature 1..36: note = hypo
  source 1..36: mol_type = genomic DNA

SEQ ID NO: 61958 - DNA, 30 bp, Homo sapiens; identical to SEQ ID NO: 15033
  misc_feature 1..30: note = chr7:137664095-137664125
  misc_feature 1..30: note = hypo
  source 1..30: mol_type = genomic DNA

SEQ ID NO: 61959 - DNA, 18 bp, Homo sapiens
  misc_feature 1..18: note = chr7:137693378-137693396
  misc_feature 1..18: note = hypo
  source 1..18: mol_type = genomic DNA
acacggcctcggtgtgtt

SEQ ID NO: 61960 - DNA, 32 bp, Homo sapiens; identical to SEQ ID NO: 41479
  misc_feature 1..32: note = chr7:138845459-138845491
  misc_feature 1..32: note = hypo
  source 1..32: mol_type = genomic DNA

SEQ ID NO: 61961 - DNA, 55 bp, Homo sapiens; identical to SEQ ID NO: 41480
  misc_feature 1..55: note = chr7:138912533-138912588
  misc_feature 1..55: note = hypo
  source 1..55: mol_type = genomic DNA

SEQ ID NO: 61962 - DNA, 18 bp, Homo sapiens
  misc_feature 1..18: note = chr7:138913068-138913086
  misc_feature 1..18: note = hypo
  source 1..18: mol_type = genomic DNA
gctgaggcaggagaacgg

SEQ ID NO: 61963 - DNA, 17 bp, Homo sapiens
  misc_feature 1..17: note = chr7:138913146-138913163
  misc_feature 1..17: note = hypo
  source 1..17: mol_type = genomic DNA
ggcgacagagcaagact

SEQ ID NO: 61964 - DNA, 30 bp, Homo sapiens; identical to SEQ ID NO: 41483
  misc_feature 1..30: note = chr7:138957222-138957252
  misc_feature 1..30: note = hypo
  source 1..30: mol_type = genomic DNA

SEQ ID NO: 61965 - DNA, 38 bp, Homo sapiens; identical to SEQ ID NO: 41484
  misc_feature 1..38: note = chr7:139027295-139027333
  misc_feature 1..38: note = hypo
  source 1..38: mol_type = genomic DNA

SEQ ID NO: 61966 - DNA, 30 bp, Homo sapiens; identical to SEQ ID NO: 41485
  misc_feature 1..30: note = chr7:139112625-139112655
  misc_feature 1..30: note = hypo
  source 1..30: mol_type = genomic DNA

SEQ ID NO: 61967 - DNA, 30 bp, Homo sapiens; identical to SEQ ID NO: 41486
  misc_feature 1..30: note = chr7:139245499-139245529
  misc_feature 1..30: note = hypo
  source 1..30: mol_type = genomic DNA

SEQ ID NO: 61968 - DNA, 148 bp, Homo sapiens; identical to SEQ ID NO: 41487
  misc_feature 1..148: note = chr7:139650638-139650786
  misc_feature 1..148: note = hypo
  source 1..148: mol_type = genomic DNA

SEQ ID NO: 61969 - DNA, 30 bp, Homo sapiens; identical to SEQ ID NO: 41488
  misc_feature 1..30: note = chr7:139919897-139919927
  misc_feature 1..30: note = hypo
  source 1..30: mol_type = genomic DNA

SEQ ID NO: 61970 - DNA, 68 bp, Homo sapiens; identical to SEQ ID NO: 41490
  misc_feature 1..68: note = chr7:140007275-140007343
  misc_feature 1..68: note = hypo
  source 1..68: mol_type = genomic DNA

SEQ ID NO: 61971 - DNA, 21 bp, Homo sapiens
  misc_feature 1..21: note = chr7:140026923-140026944
  misc_feature 1..21: note = hypo
  source 1..21: mol_type = genomic DNA
acggagcgagattctgtctca

SEQ ID NO: 61972 - DNA, 31 bp, Homo sapiens; identical to SEQ ID NO: 41492
  misc_feature 1..31: note = chr7:140096707-140096738
  misc_feature 1..31: note = hypo
  source 1..31: mol_type = genomic DNA

SEQ ID NO: 61973 - DNA, 30 bp, Homo sapiens; identical to SEQ ID NO: 41493
  misc_feature 1..30: note = chr7:140097278-140097308
  misc_feature 1..30: note = hypo
  source 1..30: mol_type = genomic DNA

SEQ ID NO: 61974 - DNA, 80 bp, Homo sapiens; identical to SEQ ID NO: 41494
  misc_feature 1..80: note = chr7:140156598-140156678
  misc_feature 1..80: note = hypo
  source 1..80: mol_type = genomic DNA

SEQ ID NO: 61975 - DNA, 50 bp, Homo sapiens; identical to SEQ ID NO: 41495
  misc_feature 1..50: note = chr7:140192162-140192212
  misc_feature 1..50: note = hypo
  source 1..50: mol_type = genomic DNA

SEQ ID NO: 61976 - DNA, 30 bp, Homo sapiens; identical to SEQ ID NO: 41496
  misc_feature 1..30: note = chr7:144488206-144488236
  misc_feature 1..30: note = hypo
  source 1..30: mol_type = genomic DNA

SEQ ID NO: 61977 - DNA, 20 bp, Homo sapiens
  misc_feature 1..20: note = chr7:144565939-144565959
  misc_feature 1..20: note = hypo
  source 1..20: mol_type = genomic DNA
acaggcgtgagccaccgcgc

SEQ ID NO: 61978 - DNA, 22 bp, Homo sapiens
  misc_feature 1..22: note = chr7:146300226-146300248
  misc_feature 1..22: note = hypo
  source 1..22: mol_type = genomic DNA
gggcgaggtggctcacgcctgt

SEQ ID NO: 61979 - DNA, 30 bp, Homo sapiens; identical to SEQ ID NO: 41499
  misc_feature 1..30: note = chr7:148500594-148500624
  misc_feature 1..30: note = hypo
  source 1..30: mol_type = genomic DNA

SEQ ID NO: 61980 - DNA, 86 bp, Homo sapiens; identical to SEQ ID NO: 24374
  misc_feature 1..86: note = chr7:148640250-148640336
  misc_feature 1..86: note = hypo
  source 1..86: mol_type = genomic DNA

SEQ ID NO: 61981 - DNA, 53 bp, Homo sapiens; identical to SEQ ID NO: 41501
  misc_feature 1..53: note = chr7:148842138-148842191
  misc_feature 1..53: note = hypo
  source 1..53: mol_type = genomic DNA

SEQ ID NO: 61982 - DNA, 63 bp, Homo sapiens; identical to SEQ ID NO: 24375
  misc_feature 1..63: note = chr7:148846075-148846138
  misc_feature 1..63: note = hypo
  source 1..63: mol_type = genomic DNA

SEQ ID NO: 61983 - DNA, 44 bp, Homo sapiens
  misc_feature 1..44: note = chr7:148846180-148846224
  misc_feature 1..44: note = hypo
  source 1..44: mol_type = genomic DNA
agtccaggagttcgaggcagtccacaccgcgtctctaaaataaa

SEQ ID NO: 61984 - DNA, 38 bp, Homo sapiens; identical to SEQ ID NO: 41503
  misc_feature 1..38: note = chr7:148883975-148884013
  misc_feature 1..38: note = hypo
  source 1..38: mol_type = genomic DNA

SEQ ID NO: 61985 - DNA, 71 bp, Homo sapiens; identical to SEQ ID NO: 24376
  misc_feature 1..71: note = chr7:150049533-150049604
  misc_feature 1..71: note = hypo
  source 1..71: mol_type = genomic DNA

SEQ ID NO: 61986 - DNA, 56 bp, Homo sapiens; identical to SEQ ID NO: 41505
  misc_feature 1..56: note = chr7:150068969-150069025
  misc_feature 1..56: note = hypo
  source 1..56: mol_type = genomic DNA

SEQ ID NO: 61987 - DNA, 82 bp, Homo sapiens; identical to SEQ ID NO: 41506
  misc_feature 1..82: note = chr7:150069445-150069527
  misc_feature 1..82: note = hypo
  source 1..82: mol_type = genomic DNA

SEQ ID NO: 61988 - DNA, 143 bp, Homo sapiens; identical to SEQ ID NO: 41507
  misc_feature 1..143: note = chr7:150070146-150070289
  misc_feature 1..143: note = hypo
  source 1..143: mol_type = genomic DNA

SEQ ID NO: 61989 - DNA, 30 bp, Homo sapiens
  misc_feature 1..30: note = chr7:150081206-150081236
  misc_feature 1..30: note = hypo
  source 1..30: mol_type = genomic DNA
aactgcagcctgacccggtgcgcggagggc

SEQ ID NO: 61990 - DNA, 76 bp, Homo sapiens; identical to SEQ ID NO: 15042
  misc_feature 1..76: note = chr7:150746248-150746324
  misc_feature 1..76: note = hypo
  source 1..76: mol_type = genomic DNA

SEQ ID NO: 61991 - DNA, 193 bp, Homo sapiens; identical to SEQ ID NO: 41510
  misc_feature 1..193: note = chr7:150758966-150759159
  misc_feature 1..193: note = hypo
  source 1..193: mol_type = genomic DNA

SEQ ID NO: 61992 - DNA, 142 bp, Homo sapiens; identical to SEQ ID NO: 41511
  misc_feature 1..142: note = chr7:150773923-150774065
  misc_feature 1..142: note = hypo
  source 1..142: mol_type = genomic DNA

SEQ ID NO: 61993 - DNA, 33 bp, Homo sapiens; identical to SEQ ID NO: 41512
  misc_feature 1..33: note = chr7:150774325-150774358
  misc_feature 1..33: note = hypo
  source 1..33: mol_type = genomic DNA

SEQ ID NO: 61994 - DNA, 99 bp, Homo sapiens; identical to SEQ ID NO: 15043
  misc_feature 1..99: note = chr7:150774704-150774803
  misc_feature 1..99: note = hypo
  source 1..99: mol_type = genomic DNA

SEQ ID NO: 61995 - DNA, 73 bp, Homo sapiens; identical to SEQ ID NO: 41514
  misc_feature 1..73: note = chr7:150811286-150811359
  misc_feature 1..73: note = hypo
  source 1..73: mol_type = genomic DNA

SEQ ID NO: 61996 - DNA, 330 bp, Homo sapiens; identical to SEQ ID NO: 41515
  misc_feature 1..330: note = chr7:150823565-150823895
  misc_feature 1..330: note = hypo
  source 1..330: mol_type = genomic DNA

SEQ ID NO: 61997 - DNA, 310 bp, Homo sapiens
  misc_feature 1..310: note = chr7:150870889-150871199
  misc_feature 1..310: note = hypo
  source 1..310: mol_type = genomic DNA
tccccgtgccaagggccacagcctctgagatgcttcctaggcggctccagtgccatctccccagcaacggccttctgcttcccgttacttcctcgtcttccccatcttagcatctggcaccaccgtccaggggtccaagccaaaaacctgcgagtcgccctagacagcgctattctgcagccccctacatcccccccagcggcggccccccagttcttcccagggatcccgaatctcgcccgccgcgaccacctctggcctggaccaccgccgcaggtgccccccgacccacgcccgcagccaggacggt

SEQ ID NO: 61998 - DNA, 84 bp, Homo sapiens; identical to SEQ ID NO: 41517
  misc_feature 1..84: note = chr7:150872928-150873012
  misc_feature 1..84: note = hypo
  source 1..84: mol_type = genomic DNA

SEQ ID NO: 61999 - DNA, 47 bp, Homo sapiens; identical to SEQ ID NO: 41518
  misc_feature 1..47: note = chr7:151082165-151082212
  misc_feature 1..47: note = hypo
  source 1..47: mol_type = genomic DNA

SEQ ID NO: 62000 - DNA, 151 bp, Homo sapiens; identical to SEQ ID NO: 41519
  misc_feature 1..151: note = chr7:151553602-151553753
  misc_feature 1..151: note = hypo
  source 1..151: mol_type = genomic DNA

SEQ ID NO: 62001 - DNA, 30 bp, Homo sapiens; identical to SEQ ID NO: 41520
  misc_feature 1..30: note = chr7:151585396-151585426
  misc_feature 1..30: note = hypo
  source 1..30: mol_type = genomic DNA

SEQ ID NO: 62002 - DNA, 18 bp, Homo sapiens
  misc_feature 1..18: note = chr7:151591649-151591667
  misc_feature 1..18: note = hypo
  source 1..18: mol_type = genomic DNA
ggctcaagccctccccga

SEQ ID NO: 62003 - DNA, 30 bp, Homo sapiens; identical to SEQ ID NO: 41522
  misc_feature 1..30: note = chr7:152159631-152159661
  misc_feature 1..30: note = hypo
  source 1..30: mol_type = genomic DNA

SEQ ID NO: 62004 - DNA, 40 bp, Homo sapiens; identical to SEQ ID NO: 41523
  misc_feature 1..40: note = chr7:152337514-152337554
  misc_feature 1..40: note = hypo
  source 1..40: mol_type = genomic DNA

SEQ ID NO: 62005 - DNA, 175 bp, Homo sapiens; identical to SEQ ID NO: 15049
  misc_feature 1..175: note = chr7:152693809-152693984
  misc_feature 1..175: note = hypo
  source 1..175: mol_type = genomic DNA

SEQ ID NO: 62006 - DNA, 206 bp, Homo sapiens; identical to SEQ ID NO: 41525
  misc_feature 1..206: note = chr7:152782995-152783201
  misc_feature 1..206: note = hypo
  source 1..206: mol_type = genomic DNA

SEQ ID NO: 62007 - DNA, 34 bp, Homo sapiens; identical to SEQ ID NO: 41526
  misc_feature 1..34: note = chr7:152984071-152984105
  misc_feature 1..34: note = hypo
  source 1..34: mol_type = genomic DNA

SEQ ID NO: 62008 - DNA, 24 bp, Homo sapiens
  misc_feature 1..24: note = chr7:153041593-153041617
  misc_feature 1..24: note = hypo
  source 1..24: mol_type = genomic DNA
tttttttttttgagacggagtctc

SEQ ID NO: 62009 - DNA, 38 bp, Homo sapiens; identical to SEQ ID NO: 41528
  misc_feature 1..38: note = chr7:153102258-153102296
  misc_feature 1..38: note = hypo
  source 1..38: mol_type = genomic DNA

SEQ ID NO: 62010 - DNA, 80 bp, Homo sapiens; identical to SEQ ID NO: 41529
  misc_feature 1..80: note = chr7:153540019-153540099
  misc_feature 1..80: note = hypo
  source 1..80: mol_type = genomic DNA

SEQ ID NO: 62011 - DNA, 30 bp, Homo sapiens; identical to SEQ ID NO: 41530
  misc_feature 1..30: note = chr7:153641678-153641708
  misc_feature 1..30: note = hypo
  source 1..30: mol_type = genomic DNA

SEQ ID NO: 62012 - DNA, 30 bp, Homo sapiens; identical to SEQ ID NO: 41531
  misc_feature 1..30: note = chr7:153896397-153896427
  misc_feature 1..30: note = hypo
  source 1..30: mol_type = genomic DNA

SEQ ID NO: 62013 - DNA, 40 bp, Homo sapiens; identical to SEQ ID NO: 41532
  misc_feature 1..40: note = chr7:154088244-154088284
  misc_feature 1..40: note = hypo
  source 1..40: mol_type = genomic DNA

SEQ ID NO: 62014 - DNA, 30 bp, Homo sapiens; identical to SEQ ID NO: 41533
  misc_feature 1..30: note = chr7:154186455-154186485
  misc_feature 1..30: note = hypo
  source 1..30: mol_type = genomic DNA

SEQ ID NO: 62015 - DNA, 45 bp, Homo sapiens; identical to SEQ ID NO: 41535
  misc_feature 1..45: note = chr7:154665013-154665058
  misc_feature 1..45: note = hypo
  source 1..45: mol_type = genomic DNA

SEQ ID NO: 62016 - DNA, 41 bp, Homo sapiens; identical to SEQ ID NO: 41536
  misc_feature 1..41: note = chr7:154670093-154670134
  misc_feature 1..41: note = hypo
  source 1..41: mol_type = genomic DNA

SEQ ID NO: 62017 - DNA, 43 bp, Homo sapiens; identical to SEQ ID NO: 41537
  misc_feature 1..43: note = chr7:154922507-154922550
  misc_feature 1..43: note = hypo
  source 1..43: mol_type = genomic DNA

SEQ ID NO: 62018 - DNA, 30 bp, Homo sapiens; identical to SEQ ID NO: 41538
  misc_feature 1..30: note = chr7:155130764-155130794
  misc_feature 1..30: note = hypo
  source 1..30: mol_type = genomic DNA

SEQ ID NO: 62019 - DNA, 44 bp, Homo sapiens; identical to SEQ ID NO: 41539
  misc_feature 1..44: note = chr7:155133192-155133236
  misc_feature 1..44: note = hypo
  source 1..44: mol_type = genomic DNA

SEQ ID NO: 62020 - DNA, 30 bp, Homo sapiens; identical to SEQ ID NO: 41540
  misc_feature 1..30: note = chr7:155144931-155144961
  misc_feature 1..30: note = hypo
  source 1..30: mol_type = genomic DNA

SEQ ID NO: 62021 - DNA, 43 bp, Homo sapiens; identical to SEQ ID NO: 41541
  misc_feature 1..43: note = chr7:155202839-155202882
  misc_feature 1..43: note = hypo
  source 1..43: mol_type = genomic DNA

SEQ ID NO: 62022 - DNA, 16 bp, Homo sapiens
  misc_feature 1..16: note = chr7:155363288-155363304
  misc_feature 1..16: note = hypo
  source 1..16: mol_type = genomic DNA
tccacagaacacctcc

SEQ ID NO: 62023 - DNA, 87 bp, Homo sapiens
  misc_feature 1..87: note = chr7:155363417-155363504
  misc_feature 1..87: note = hypo
  source 1..87: mol_type = genomic DNA
cccctcacaggcccctccgcgagtgctgggcgtgcagcagacaaatggcatacaaaggtcctcgggccgcaccgccctagatacccg

SEQ ID NO: 62024 - DNA, 84 bp, Homo sapiens
  misc_feature 1..84: note = chr7:155580762-155580846
  misc_feature 1..84: note = hypo
  source 1..84: mol_type = genomic DNA
caccatctgtgtccacgcagagggtcgggccgtgggagccgcgagtgtctggcccacacttctgttcttaacctcgcaatgtat

SEQ ID NO: 62025 - DNA, 51 bp, Homo sapiens
  misc_feature 1..51: note = chr7:155580876-155580927
  misc_feature 1..51: note = hypo
  source 1..51: mol_type = genomic DNA
atcgacagctaaaaatccaaccaaggccgggcgcggtggttcacgcctgta

SEQ ID NO: 62026 - DNA, 212 bp, Homo sapiens
  misc_feature 1..212: note = chr7:155581553-155581765
  misc_feature 1..212: note = hypo
  source 1..212: mol_type = genomic DNA
acagccagggaaagggctgaggcagagcaacgctgggtgaaccccgtcttcctgaggccacgtttgcaccgggaagagaacacagtgaaccccctgagcaccaacacgctcccacaccccccacgagcagcccagccctggggaggagcccgtccttctccctgcttgccacaccggccacgtccgtaaccctgcccagcatcccacccagg

SEQ ID NO: 62027 - DNA, 45 bp, Homo sapiens
  misc_feature 1..45: note = chr7:155582232-155582277
  misc_feature 1..45: note = hypo
  source 1..45: mol_type = genomic DNA
gcggcctttgcttcccggtgctggctgtgcccagacgcctgggct

SEQ ID NO: 62028 - DNA, 37 bp, Homo sapiens; identical to SEQ ID NO: 41546
  misc_feature 1..37: note = chr7:155752556-155752593
  misc_feature 1..37: note = hypo
  source 1..37: mol_type = genomic DNA

SEQ ID NO: 62029 - DNA, 105 bp, Homo sapiens; identical to SEQ ID NO: 41547
  misc_feature 1..105: note = chr7:155753582-155753687
  misc_feature 1..105: note = hypo
  source 1..105: mol_type = genomic DNA

SEQ ID NO: 62030 - DNA, 34 bp, Homo sapiens; identical to SEQ ID NO: 41548
  misc_feature 1..34: note = chr7:155786790-155786824
  misc_feature 1..34: note = hypo
  source 1..34: mol_type = genomic DNA

SEQ ID NO: 62031 - DNA, 52 bp, Homo sapiens; identical to SEQ ID NO: 41549
  misc_feature 1..52: note = chr7:155854343-155854395
  misc_feature 1..52: note = hypo
  source 1..52: mol_type = genomic DNA

SEQ ID NO: 62032 - DNA, 30 bp, Homo sapiens; identical to SEQ ID NO: 41550
  misc_feature 1..30: note = chr7:155871902-155871932
  misc_feature 1..30: note = hypo
  source 1..30: mol_type = genomic DNA

SEQ ID NO: 62033 - DNA, 175 bp, Homo sapiens; identical to SEQ ID NO: 41551
  misc_feature 1..175: note = chr7:155898977-155899152
  misc_feature 1..175: note = hypo
  source 1..175: mol_type = genomic DNA

SEQ ID NO: 62034 - DNA, 24 bp, Homo sapiens
  misc_feature 1..24: note = chr7:155920548-155920572
  misc_feature 1..24: note = hypo
  source 1..24: mol_type = genomic DNA
acttcttacctggctcgctgcaaa

SEQ ID NO: 62035 - DNA, 38 bp, Homo sapiens; identical to SEQ ID NO: 41553
  misc_feature 1..38: note = chr7:156012968-156013006
  misc_feature 1..38: note = hypo
  source 1..38: mol_type = genomic DNA

SEQ ID NO: 62036 - DNA, 173 bp, Homo sapiens; identical to SEQ ID NO: 41554
  misc_feature 1..173: note = chr7:156025663-156025836
  misc_feature 1..173: note = hypo
  source 1..173: mol_type = genomic DNA

SEQ ID NO: 62037 - DNA, 44 bp, Homo sapiens; identical to SEQ ID NO: 41555
  misc_feature 1..44: note = chr7:156138347-156138391
  misc_feature 1..44: note = hypo
  source 1..44: mol_type = genomic DNA

SEQ ID NO: 62038 - DNA, 102 bp, Homo sapiens; identical to SEQ ID NO: 41556
  misc_feature 1..102: note = chr7:156177626-156177728
  misc_feature 1..102: note = hypo
  source 1..102: mol_type = genomic DNA

SEQ ID NO: 62039 - DNA, 86 bp, Homo sapiens; identical to SEQ ID NO: 24392
  misc_feature 1..86: note = chr7:156744713-156744799
  misc_feature 1..86: note = hypo
  source 1..86: mol_type = genomic DNA

SEQ ID NO: 62040 - DNA, 168 bp, Homo sapiens
  misc_feature 1..168: note = chr7:156832680-156832848
  misc_feature 1..168: note = hypo
  source 1..168: mol_type = genomic DNA
caagtgtgctgaagacgcaaacctaacacgcaggaggcaggaaccgtctgaggcagcccccggcaaacgtcaggctgtgtggctcagacccggcacagcctccgcgatgggagctccggggggggctggctggggacaaggacaagcggacttgggagcgacggggtt

SEQ ID NO: 62041 - DNA, 38 bp, Homo sapiens
  misc_feature 1..38: note = chr7:156880561-156880599
  misc_feature 1..38: note = hypo
  source 1..38: mol_type = genomic DNA
gcacggccctcggcgtggatatccggaaggcagccacc

SEQ ID NO: 62042 - DNA, 50 bp, Homo sapiens; identical to SEQ ID NO: 41561
  misc_feature 1..50: note = chr7:156883354-156883404
  misc_feature 1..50: note = hypo
  source 1..50: mol_type = genomic DNA

SEQ ID NO: 62043 - DNA, 30 bp, Homo sapiens; identical to SEQ ID NO: 41562
  misc_feature 1..30: note = chr7:156924103-156924133
  misc_feature 1..30: note = hypo
  source 1..30: mol_type = genomic DNA

SEQ ID NO: 62044 - DNA, 21 bp, Homo sapiens
  misc_feature 1..21: note = chr7:156929628-156929649
  misc_feature 1..21: note = hypo
  source 1..21: mol_type = genomic DNA
ttatttattttgagacggagt

SEQ ID NO: 62045 - DNA, 81 bp, Homo sapiens; identical to SEQ ID NO: 41564
  misc_feature 1..81: note = chr7:157075212-157075293
  misc_feature 1..81: note = hypo
  source 1..81: mol_type = genomic DNA

SEQ ID NO: 62046 - DNA, 171 bp, Homo sapiens; identical to SEQ ID NO: 41565
  misc_feature 1..171: note = chr7:157084426-157084597
  misc_feature 1..171: note = hypo
  source 1..171: mol_type = genomic DNA

SEQ ID NO: 62047 - DNA, 30 bp, Homo sapiens; identical to SEQ ID NO: 24396
  misc_feature 1..30: note = chr7:157085343-157085373
  misc_feature 1..30: note = hypo
  source 1..30: mol_type = genomic DNA

SEQ ID NO: 62048 - DNA, 108 bp, Homo sapiens
  misc_feature 1..108: note = chr7:157085487-157085595
  misc_feature 1..108: note = hypo
  source 1..108: mol_type = genomic DNA
ctccaggacacagcctcaccctatcagggcagcgagggctggggcggacaggggagccgtagacagcccgtccctgggtgggcctggccttcccggccctgactcagc

SEQ ID NO: 62049 - DNA, 37 bp, Homo sapiens
  misc_feature 1..37: note = chr7:157085926-157085963
  misc_feature 1..37: note = hypo
  source 1..37: mol_type = genomic DNA
gggagagctgctgcccggccgagcctctgctcccacg

SEQ ID NO: 62050 - DNA, 65 bp, Homo sapiens
  misc_feature 1..65: note = chr7:157086082-157086147
  misc_feature 1..65: note = hypo
  source 1..65: mol_type = genomic DNA
gttctccggatctccagacgtttaggctgaaagtgcagagatttagaagtcggacagggagttgg

SEQ ID NO: 62051 - DNA, 71 bp, Homo sapiens; identical to SEQ ID NO: 41568
  misc_feature 1..71: note = chr7:157099869-157099940
  misc_feature 1..71: note = hypo
  source 1..71: mol_type = genomic DNA

SEQ ID NO: 62052 - DNA, 30 bp, Homo sapiens; identical to SEQ ID NO: 41569
  misc_feature 1..30: note = chr7:157147812-157147842
  misc_feature 1..30: note = hypo
  source 1..30: mol_type = genomic DNA

SEQ ID NO: 62053 - DNA, 48 bp, Homo sapiens; identical to SEQ ID NO: 41570
  misc_feature 1..48: note = chr7:157217366-157217414
  misc_feature 1..48: note = hypo
  source 1..48: mol_type = genomic DNA

SEQ ID NO: 62054 - DNA, 46 bp, Homo sapiens; identical to SEQ ID NO: 41571
  misc_feature 1..46: note = chr7:157218481-157218527
  misc_feature 1..46: note = hypo
  source 1..46: mol_type = genomic DNA

SEQ ID NO: 62055 - DNA, 30 bp, Homo sapiens; identical to SEQ ID NO: 41572
  misc_feature 1..30: note = chr7:157220595-157220625
  misc_feature 1..30: note = hypo
  source 1..30: mol_type = genomic DNA

SEQ ID NO: 62056 - DNA, 30 bp, Homo sapiens; identical to SEQ ID NO: 41573
  misc_feature 1..30: note = chr7:157233964-157233994
  misc_feature 1..30: note = hypo
  source 1..30: mol_type = genomic DNA

SEQ ID NO: 62057 - DNA, 36 bp, Homo sapiens; identical to SEQ ID NO: 41574
  misc_feature 1..36: note = chr7:157235760-157235796
  misc_feature 1..36: note = hypo
  source 1..36: mol_type = genomic DNA

SEQ ID NO: 62058 - DNA, 261 bp, Homo sapiens; identical to SEQ ID NO: 41575
  misc_feature 1..261: note = chr7:157255061-157255322
  misc_feature 1..261: note = hypo
  source 1..261: mol_type = genomic DNA

SEQ ID NO: 62059 - DNA, 236 bp, Homo sapiens; identical to SEQ ID NO: 24400
  misc_feature 1..236: note = chr7:157262579-157262815
  misc_feature 1..236: note = hypo
  source 1..236: mol_type = genomic DNA

SEQ ID NO: 62060 - DNA, 276 bp, Homo sapiens; identical to SEQ ID NO: 24401
  misc_feature 1..276: note = chr7:157263018-157263294
  misc_feature 1..276: note = hypo
  source 1..276: mol_type = genomic DNA

SEQ ID NO: 62061 - DNA, 30 bp, Homo sapiens; identical to SEQ ID NO: 41577
  misc_feature 1..30: note = chr7:157276023-157276053
  misc_feature 1..30: note = hypo
  source 1..30: mol_type = genomic DNA

SEQ ID NO: 62062 - DNA, 143 bp, Homo sapiens; identical to SEQ ID NO: 41578
  misc_feature 1..143: note = chr7:157280216-157280359
  misc_feature 1..143: note = hypo
  source 1..143: mol_type = genomic DNA

SEQ ID NO: 62063 - DNA, 108 bp, Homo sapiens; identical to SEQ ID NO: 41579
  misc_feature 1..108: note = chr7:157280626-157280734
  misc_feature 1..108: note = hypo
  source 1..108: mol_type = genomic DNA

SEQ ID NO: 62064 - DNA, 30 bp, Homo sapiens; identical to SEQ ID NO: 41580
  misc_feature 1..30: note = chr7:157291421-157291451
  misc_feature 1..30: note = hypo
  source 1..30: mol_type = genomic DNA

SEQ ID NO: 62065 - DNA, 33 bp, Homo sapiens; identical to SEQ ID NO: 41581
  misc_feature 1..33: note = chr7:157294288-157294321
  misc_feature 1..33: note = hypo
  source 1..33: mol_type = genomic DNA

SEQ ID NO: 62066 - DNA, 30 bp, Homo sapiens; identical to SEQ ID NO: 41582
  misc_feature 1..30: note = chr7:157319640-157319670
  misc_feature 1..30: note = hypo
  source 1..30: mol_type = genomic DNA

SEQ ID NO: 62067 - DNA, 30 bp, Homo sapiens; identical to SEQ ID NO: 41583
  misc_feature 1..30: note = chr7:157320767-157320797
  misc_feature 1..30: note = hypo
  source 1..30: mol_type = genomic DNA

SEQ ID NO: 62068 - DNA, 142 bp, Homo sapiens; identical to SEQ ID NO: 41584
  misc_feature 1..142: note = chr7:157337964-157338106
  misc_feature 1..142: note = hypo
  source 1..142: mol_type = genomic DNA

SEQ ID NO: 62069 - DNA, 83 bp, Homo sapiens; identical to SEQ ID NO: 41585
  misc_feature 1..83: note = chr7:157338308-157338391
  misc_feature 1..83: note = hypo
  source 1..83: mol_type = genomic DNA

SEQ ID NO: 62070 - DNA, 30 bp, Homo sapiens; identical to SEQ ID NO: 41586
  misc_feature 1..30: note = chr7:157346704-157346734
  misc_feature 1..30: note = hypo
  source 1..30: mol_type = genomic DNA

SEQ ID NO: 62071 - DNA, 151 bp, Homo sapiens; identical to SEQ ID NO: 41587
  misc_feature 1..151: note = chr7:157346983-157347134
  misc_feature 1..151: note = hypo
  source 1..151: mol_type = genomic DNA

SEQ ID NO: 62072 - DNA, 37 bp, Homo sapiens; identical to SEQ ID NO: 41588
  misc_feature 1..37: note = chr7:157347797-157347834
  misc_feature 1..37: note = hypo
  source 1..37: mol_type = genomic DNA

SEQ ID NO: 62073 - DNA, 129 bp, Homo sapiens; identical to SEQ ID NO: 41589
  misc_feature 1..129: note = chr7:157352962-157353091
  misc_feature 1..129: note = hypo
  source 1..129: mol_type = genomic DNA

SEQ ID NO: 62074 - DNA, 69 bp, Homo sapiens; identical to SEQ ID NO: 41590
  misc_feature 1..69: note = chr7:157370495-157370564
  misc_feature 1..69: note = hypo
  source 1..69: mol_type = genomic DNA

SEQ ID NO: 62075 - DNA, 209 bp, Homo sapiens; identical to SEQ ID NO: 41591
  misc_feature 1..209: note = chr7:157396449-157396658
  misc_feature 1..209: note = hypo
  source 1..209: mol_type = genomic DNA

SEQ ID NO: 62076 - DNA, 189 bp, Homo sapiens; identical to SEQ ID NO: 41592
  misc_feature 1..189: note = chr7:157403604-157403793
  misc_feature 1..189: note = hypo
  source 1..189: mol_type = genomic DNA

SEQ ID NO: 62077 - DNA, 152 bp, Homo sapiens; identical to SEQ ID NO: 41593
  misc_feature 1..152: note = chr7:157408585-157408737
  misc_feature 1..152: note = hypo
  source 1..152: mol_type = genomic DNA

SEQ ID NO: 62078 - DNA, 101 bp, Homo sapiens; identical to SEQ ID NO: 41594
  misc_feature 1..101: note = chr7:157437497-157437598
  misc_feature 1..101: note = hypo
  source 1..101: mol_type = genomic DNA

SEQ ID NO: 62079 - DNA, 77 bp, Homo sapiens; identical to SEQ ID NO: 41595
  misc_feature 1..77: note = chr7:157443179-157443256
  misc_feature 1..77: note = hypo
  source 1..77: mol_type = genomic DNA

SEQ ID NO: 62080 - DNA, 88 bp, Homo sapiens; identical to SEQ ID NO: 41596
  misc_feature 1..88: note = chr7:157448438-157448526
  misc_feature 1..88: note = hypo
  source 1..88: mol_type = genomic DNA

SEQ ID NO: 62081 - DNA, 160 bp, Homo sapiens; identical to SEQ ID NO: 41597
  misc_feature 1..160: note = chr7:157449174-157449334
  misc_feature 1..160: note = hypo
  source 1..160: mol_type = genomic DNA

SEQ ID NO: 62082 - DNA, 93 bp, Homo sapiens; identical to SEQ ID NO: 41598
  misc_feature 1..93: note = chr7:157455478-157455571
  misc_feature 1..93: note = hypo
  source 1..93: mol_type = genomic DNA

SEQ ID NO: 62083 - DNA, 30 bp, Homo sapiens; identical to SEQ ID NO: 41599
  misc_feature 1..30: note = chr7:157455840-157455870
  misc_feature 1..30: note = hypo
  source 1..30: mol_type = genomic DNA

SEQ ID NO: 62084 - DNA, 44 bp, Homo sapiens; identical to SEQ ID NO: 41600
  misc_feature 1..44: note = chr7:157511451-157511495
  misc_feature 1..44: note = hypo
  source 1..44: mol_type = genomic DNA

SEQ ID NO: 62085 - DNA, 152 bp, Homo sapiens; identical to SEQ ID NO: 41601
  misc_feature 1..152: note = chr7:157512238-157512390
  misc_feature 1..152: note = hypo
  source 1..152: mol_type = genomic DNA

SEQ ID NO: 62086 - DNA, 52 bp, Homo sapiens; identical to SEQ ID NO: 41602
  misc_feature 1..52: note = chr7:157527557-157527609
  misc_feature 1..52: note = hypo
  source 1..52: mol_type = genomic DNA

SEQ ID NO: 62087 - DNA, 30 bp, Homo sapiens; identical to SEQ ID NO: 41603
  misc_feature 1..30: note = chr7:157530181-157530211
  misc_feature 1..30: note = hypo
  source 1..30: mol_type = genomic DNA

SEQ ID NO: 62088 - DNA, 30 bp, Homo sapiens; identical to SEQ ID NO: 41604
  misc_feature 1..30: note = chr7:157536702-157536732
  misc_feature 1..30: note = hypo
  source 1..30: mol_type = genomic DNA

SEQ ID NO: 62089 - DNA, 103 bp, Homo sapiens; identical to SEQ ID NO: 41605
  misc_feature 1..103: note = chr7:157551220-157551323
  misc_feature 1..103: note = hypo
  source 1..103: mol_type = genomic DNA

SEQ ID NO: 62090 - DNA, 48 bp, Homo sapiens; identical to SEQ ID NO: 15075
  misc_feature 1..48: note = chr7:157565500-157565548
  misc_feature 1..48: note = hypo
  source 1..48: mol_type = genomic DNA

SEQ ID NO: 62091 - DNA, 30 bp, Homo sapiens; identical to SEQ ID NO: 15076
  misc_feature 1..30: note = chr7:157568187-157568217
  misc_feature 1..30: note = hypo
  source 1..30: mol_type = genomic DNA

SEQ ID NO: 62092 - DNA, 30 bp, Homo sapiens; identical to SEQ ID NO: 41608
  misc_feature 1..30: note = chr7:157578615-157578645
  misc_feature 1..30: note = hypo
  source 1..30: mol_type = genomic DNA

SEQ ID NO: 62093 - DNA, 278 bp, Homo sapiens
  misc_feature 1..278: note = chr7:157583900-157584178
  misc_feature 1..278: note = hypo
  source 1..278: mol_type = genomic DNA
aagaagaatgagatacgtccatttgctgtgataagaaaagatattccacagtttcgtatttgttaagtattttcagcaaatcatggaacacgatgcaacacccgattccatgtttgaaaacagaacagaacaaaattcaacaagaaataagcgcccgcgtccacatattctcgtgcctggcgtgttttacgtgcttgggaagcggagcggccgctgggcttggctctgaggtcgggactggtgcaggcggatgcatgtatgtgcccgggtcccgcctc

SEQ ID NO: 62094 - DNA, 33 bp, Homo sapiens; identical to SEQ ID NO: 24410
  misc_feature 1..33: note = chr7:157584208-157584241
  misc_feature 1..33: note = hypo
  source 1..33: mol_type = genomic DNA

SEQ ID NO: 62095 - DNA, 30 bp, Homo sapiens; identical to SEQ ID NO: 41610
  misc_feature 1..30: note = chr7:157584643-157584673
  misc_feature 1..30: note = hypo
  source 1..30: mol_type = genomic DNA

SEQ ID NO: 62096 - DNA, 30 bp, Homo sapiens; identical to SEQ ID NO: 41611
  misc_feature 1..30: note = chr7:157585079-157585109
  misc_feature 1..30: note = hypo
  source 1..30: mol_type = genomic DNA

SEQ ID NO: 62097 - DNA, 202 bp, Homo sapiens
  misc_feature 1..202: note = chr7:157588791-157588993
  misc_feature 1..202: note = hypo
  source 1..202: mol_type = genomic DNA
tcagagggacctgcccagtcctgtcaattttccatctaaattacataactgtcctccttagagacgcggggatgcccaggcacaggcatgaaagatcggccttgaggttattttgtctctgcaagtattgatgcgaggacttgtggcgcttttctttcccggtgaactttcccaactgctgatgttacgtgcactaagcaca

SEQ ID NO: 62098 - DNA, 30 bp, Homo sapiens; identical to SEQ ID NO: 41613
  misc_feature 1..30: note = chr7:157601854-157601884
  misc_feature 1..30: note = hypo
  source 1..30: mol_type = genomic DNA

SEQ ID NO: 62099 - DNA, 212 bp, Homo sapiens
  misc_feature 1..212: note = chr7:157606494-157606706
  misc_feature 1..212: note = hypo
  source 1..212: mol_type = genomic DNA
cagaatggcctggagcgcgggtaaaacagctcggggccagccagagcttctgagccagggctgggcccaagaacgtgcatttgcgttgttccccaggtgatgctgctggtgaccccggggaccccgccgtgagagccccgacacaagtcgcggtttgtggtgctttggaggagtttgctccttagagtgagggggattgttctgccccaatg

SEQ ID NO: 62100 - DNA, 28 bp, Homo sapiens
  misc_feature 1..28: note = chr7:157606736-157606764
  misc_feature 1..28: note = hypo
  source 1..28: mol_type = genomic DNA
gcgaggcagtggtcgccacacccacact

SEQ ID NO: 62101 - DNA, 123 bp, Homo sapiens; identical to SEQ ID NO: 41615
  misc_feature 1..123: note = chr7:157633412-157633535
  misc_feature 1..123: note = hypo
  source 1..123: mol_type = genomic DNA

SEQ ID NO: 62102 - DNA, 30 bp, Homo sapiens; identical to SEQ ID NO: 41616
  misc_feature 1..30: note = chr7:157642058-157642088
  misc_feature 1..30: note = hypo
  source 1..30: mol_type = genomic DNA

SEQ ID NO: 62103 - DNA, 30 bp, Homo sapiens; identical to SEQ ID NO: 41617
  misc_feature 1..30: note = chr7:157654407-157654437
  misc_feature 1..30: note = hypo
  source 1..30: mol_type = genomic DNA

SEQ ID NO: 62104 - DNA, 30 bp, Homo sapiens; identical to SEQ ID NO: 41618
  misc_feature 1..30: note = chr7:157656677-157656707
  misc_feature 1..30: note = hypo
  source 1..30: mol_type = genomic DNA

SEQ ID NO: 62105 - DNA, 213 bp, Homo sapiens; identical to SEQ ID NO: 41619
  misc_feature 1..213: note = chr7:157659256-157659469
  misc_feature 1..213: note = hypo
  source 1..213: mol_type = genomic DNA

SEQ ID NO: 62106 - DNA, 30 bp, Homo sapiens; identical to SEQ ID NO: 41620
  misc_feature 1..30: note = chr7:157660091-157660121
  misc_feature 1..30: note = hypo
  source 1..30: mol_type = genomic DNA

SEQ ID NO: 62107 - DNA, 30 bp, Homo sapiens; identical to SEQ ID NO: 41621
  misc_feature 1..30: note = chr7:157690247-157690277
  misc_feature 1..30: note = hypo
  source 1..30: mol_type = genomic DNA

SEQ ID NO: 62108 - DNA, 30 bp, Homo sapiens; identical to SEQ ID NO: 41622
  misc_feature 1..30: note = chr7:157718446-157718476
  misc_feature 1..30: note = hypo
  source 1..30: mol_type = genomic DNA

SEQ ID NO: 62109 - DNA, 30 bp, Homo sapiens; identical to SEQ ID NO: 41623
  misc_feature 1..30: note = chr7:157722621-157722651
  misc_feature 1..30: note = hypo
  source 1..30: mol_type = genomic DNA

SEQ ID NO: 62110 - DNA, 161 bp, Homo sapiens; identical to SEQ ID NO: 15083
  misc_feature 1..161: note = chr7:157776781-157776942
  misc_feature 1..161: note = hypo
  source 1..161: mol_type = genomic DNA

SEQ ID NO: 62111 - DNA, 17 bp, Homo sapiens
  misc_feature 1..17: note = chr7:157793339-157793356
  misc_feature 1..17: note = hypo
  source 1..17: mol_type = genomic DNA
gtgggggctggtgtccg

SEQ ID NO: 62112 - DNA, 23 bp, Homo sapiens
  misc_feature 1..23: note = chr7:157793865-157793888
  misc_feature 1..23: note = hypo
  source 1..23: mol_type = genomic DNA
tggtgcaacgtggggctggggtc

SEQ ID NO: 62113 - DNA, 81 bp, Homo sapiens; identical to SEQ ID NO: 41627
  misc_feature 1..81: note = chr7:157794503-157794584
  misc_feature 1..81: note = hypo
  source 1..81: mol_type = genomic DNA

SEQ ID NO: 62114 - DNA, 30 bp, Homo sapiens; identical to SEQ ID NO: 15085
  misc_feature 1..30: note = chr7:157877477-157877507
  misc_feature 1..30: note = hypo
  source 1..30: mol_type = genomic DNA

SEQ ID NO: 62115 - DNA, 90 bp, Homo sapiens; identical to SEQ ID NO: 41629
  misc_feature 1..90: note = chr7:157958578-157958668
  misc_feature 1..90: note = hypo
  source 1..90: mol_type = genomic DNA

SEQ ID NO: 62116 - DNA, 78 bp, Homo sapiens; identical to SEQ ID NO: 41630
  misc_feature 1..78: note = chr7:157987024-157987102
  misc_feature 1..78: note = hypo
  source 1..78: mol_type = genomic DNA

SEQ ID NO: 62117 - DNA, 30 bp, Homo sapiens; identical to SEQ ID NO: 41631
  misc_feature 1..30: note = chr7:158040286-158040316
  misc_feature 1..30: note = hypo
  source 1..30: mol_type = genomic DNA

SEQ ID NO: 62118 - DNA, 50 bp, Homo sapiens; identical to SEQ ID NO: 41632
  misc_feature 1..50: note = chr7:158059313-158059363
  misc_feature 1..50: note = hypo
  source 1..50: mol_type = genomic DNA

SEQ ID NO: 62119 - DNA, 30 bp, Homo sapiens; identical to SEQ ID NO: 41633
  misc_feature 1..30: note = chr7:158059960-158059990
  misc_feature 1..30: note = hypo
  source 1..30: mol_type = genomic DNA

SEQ ID NO: 62120 - DNA, 39 bp, Homo sapiens; identical to SEQ ID NO: 41634
  misc_feature 1..39: note = chr7:158065365-158065404
  misc_feature 1..39: note = hypo
  source 1..39: mol_type = genomic DNA

SEQ ID NO: 62121 - DNA, 30 bp, Homo sapiens; identical to SEQ ID NO: 41635
  misc_feature 1..30: note = chr7:158113225-158113255
  misc_feature 1..30: note = hypo
  source 1..30: mol_type = genomic DNA

SEQ ID NO: 62122 - DNA, 30 bp, Homo sapiens; identical to SEQ ID NO: 41636
  misc_feature 1..30: note = chr7:158144262-158144292
  misc_feature 1..30: note = hypo
  source 1..30: mol_type = genomic DNA

SEQ ID NO: 62123 - DNA, 132 bp, Homo sapiens; identical to SEQ ID NO: 41637
  misc_feature 1..132: note = chr7:158187607-158187739
  misc_feature 1..132: note = hypo
  source 1..132: mol_type = genomic DNA

SEQ ID NO: 62124 - DNA, 30 bp, Homo sapiens; identical to SEQ ID NO: 41638
  misc_feature 1..30: note = chr7:158249183-158249213
  misc_feature 1..30: note = hypo
  source 1..30: mol_type = genomic DNA

SEQ ID NO: 62125 - DNA, 44 bp, Homo sapiens; identical to SEQ ID NO: 41639
  misc_feature 1..44: note = chr7:158283192-158283236
  misc_feature 1..44: note = hypo
  source 1..44: mol_type = genomic DNA

SEQ ID NO: 62126 - DNA, 436 bp, Homo sapiens; identical to SEQ ID NO: 41640
  misc_feature 1..436: note = chr7:158301251-158301687
  misc_feature 1..436: note = hypo
  source 1..436: mol_type = genomic DNA

SEQ ID NO: 62127 - DNA, 30 bp, Homo sapiens; identical to SEQ ID NO: 41641
  misc_feature 1..30: note = chr7:158332352-158332382
  misc_feature 1..30: note = hypo
  source 1..30: mol_type = genomic DNA

SEQ ID NO: 62128 - DNA, 65 bp, Homo sapiens; identical to SEQ ID NO: 41642
  misc_feature 1..65: note = chr7:158349464-158349529
  misc_feature 1..65: note = hypo
  source 1..65: mol_type = genomic DNA

SEQ ID NO: 62129 - DNA, 240 bp, Homo sapiens; identical to SEQ ID NO: 41643
  misc_feature 1..240: note = chr7:158550099-158550339
  misc_feature 1..240: note = hypo
  source 1..240: mol_type = genomic DNA

SEQ ID NO: 62130 - DNA, 30 bp, Homo sapiens; identical to SEQ ID NO: 41644
  misc_feature 1..30: note = chr7:158564374-158564404
  misc_feature 1..30: note = hypo
  source 1..30: mol_type = genomic DNA

SEQ ID NO: 62131 - DNA, 35 bp, Homo sapiens; identical to SEQ ID NO: 41645
  misc_feature 1..35: note = chr7:158857187-158857222
  misc_feature 1..35: note = hypo
  source 1..35: mol_type = genomic DNA

SEQ ID NO: 62132 - DNA, 30 bp, Homo sapiens; identical to SEQ ID NO: 41646
  misc_feature 1..30: note = chr7:158868457-158868487
  misc_feature 1..30: note = hypo
  source 1..30: mol_type = genomic DNA

SEQ ID NO: 62133 - DNA, 30 bp, Homo sapiens; identical to SEQ ID NO: 41647
  misc_feature 1..30: note = chr7:158963513-158963543
  misc_feature 1..30: note = hypo
  source 1..30: mol_type = genomic DNA

SEQ ID NO: 62134 - DNA, 128 bp, Homo sapiens; identical to SEQ ID NO: 41648
  misc_feature 1..128: note = chr8:245097-245225
  misc_feature 1..128: note = hypo
  source 1..128: mol_type = genomic DNA

SEQ ID NO: 62135 - DNA, 52 bp, Homo sapiens; identical to SEQ ID NO: 41649
  misc_feature 1..52: note = chr8:644647-644699
  misc_feature 1..52: note = hypo
  source 1..52: mol_type = genomic DNA

SEQ ID NO: 62136 - DNA, 30 bp, Homo sapiens; identical to SEQ ID NO: 41650
  misc_feature 1..30: note = chr8:700159-700189
  misc_feature 1..30: note = hypo
  source 1..30: mol_type = genomic DNA

SEQ ID NO: 62137 - DNA, 30 bp, Homo sapiens; identical to SEQ ID NO: 41651
  misc_feature 1..30: note = chr8:854787-854817
  misc_feature 1..30: note = hypo
  source 1..30: mol_type = genomic DNA

SEQ ID NO: 62138 - DNA, 30 bp, Homo sapiens; identical to SEQ ID NO: 41652
  misc_feature 1..30: note = chr8:889984-890014
  misc_feature 1..30: note = hypo
  source 1..30: mol_type = genomic DNA

SEQ ID NO: 62139 - DNA, 164 bp, Homo sapiens; identical to SEQ ID NO: 41653
  misc_feature 1..164: note = chr8:914966-915130
  misc_feature 1..164: note = hypo
  source 1..164: mol_type = genomic DNA

SEQ ID NO: 62140 - DNA, 70 bp, Homo sapiens; identical to SEQ ID NO: 41654
  misc_feature 1..70: note = chr8:962490-962560
  misc_feature 1..70: note = hypo
  source 1..70: mol_type = genomic DNA

SEQ ID NO: 62141 - DNA, 145 bp, Homo sapiens; identical to SEQ ID NO: 41655
  misc_feature 1..145: note = chr8:972705-972850
  misc_feature 1..145: note = hypo
  source 1..145: mol_type = genomic DNA

SEQ ID NO: 62142 - DNA, 126 bp, Homo sapiens; identical to SEQ ID NO: 41656
  misc_feature 1..126: note = chr8:976259-976385
  misc_feature 1..126: note = hypo
  source 1..126: mol_type = genomic DNA

SEQ ID NO: 62143 - DNA, 30 bp, Homo sapiens; identical to SEQ ID NO: 41657
  misc_feature 1..30: note = chr8:1043872-1043902
  misc_feature 1..30: note = hypo
  source 1..30: mol_type = genomic DNA

SEQ ID NO: 62144 - DNA, 47 bp, Homo sapiens; identical to SEQ ID NO: 41658
  misc_feature 1..47: note = chr8:1048584-1048631
  misc_feature 1..47: note = hypo
  source 1..47: mol_type = genomic DNA

SEQ ID NO: 62145 - DNA, 115 bp, Homo sapiens; identical to SEQ ID NO: 41659
  misc_feature 1..115: note = chr8:1051541-1051656
  misc_feature 1..115: note = hypo
  source 1..115: mol_type = genomic DNA

SEQ ID NO: 62146 - DNA, 53 bp, Homo sapiens; identical to SEQ ID NO: 41660
  misc_feature 1..53: note = chr8:1066123-1066176
  misc_feature 1..53: note = hypo
  source 1..53: mol_type = genomic DNA

SEQ ID NO: 62147 - DNA, 34 bp, Homo sapiens; identical to SEQ ID NO: 41661
  misc_feature 1..34: note = chr8:1133089-1133123
  misc_feature 1..34: note = hypo
  source 1..34: mol_type = genomic DNA

SEQ ID NO: 62148 - DNA, 39 bp, Homo sapiens; identical to SEQ ID NO: 41662
  misc_feature 1..39: note = chr8:1136184-1136223
  misc_feature 1..39: note = hypo
  source 1..39: mol_type = genomic DNA

SEQ ID NO: 62149 - DNA, 19 bp, Homo sapiens
  misc_feature 1..19: note = chr8:1137245-1137264
  misc_feature 1..19: note = hypo
  source 1..19: mol_type = genomic DNA
ggaatctcacacacacggg

SEQ ID NO: 62150 - DNA, 79 bp, Homo sapiens; identical to SEQ ID NO: 41664
  misc_feature 1..79: note = chr8:1139165-1139244
  misc_feature 1..79: note = hypo
  source 1..79: mol_type = genomic DNA

SEQ ID NO: 62151 - DNA, 58 bp, Homo sapiens; identical to SEQ ID NO: 41665
  misc_feature 1..58: note = chr8:1151131-1151189
  misc_feature 1..58: note = hypo
  source 1..58: mol_type = genomic DNA

SEQ ID NO: 62152 - DNA, 53 bp, Homo sapiens; identical to SEQ ID NO: 41666
  misc_feature 1..53: note = chr8:1153026-1153079
  misc_feature 1..53: note = hypo
  source 1..53: mol_type = genomic DNA

SEQ ID NO: 62153 - DNA, 118 bp, Homo sapiens; identical to SEQ ID NO: 41667
  misc_feature 1..118: note = chr8:1153298-1153416
  misc_feature 1..118: note = hypo
  source 1..118: mol_type = genomic DNA

SEQ ID NO: 62154 - DNA, 30 bp, Homo sapiens; identical to SEQ ID NO: 41668
  misc_feature 1..30: note = chr8:1201984-1202014
  misc_feature 1..30: note = hypo
  source 1..30: mol_type = genomic DNA

SEQ ID NO: 62155 - DNA, 162 bp, Homo sapiens; identical to SEQ ID NO: 41669
  misc_feature 1..162: note = chr8:1246678-1246840
  misc_feature 1..162: note = hypo
  source 1..162: mol_type = genomic DNA

SEQ ID NO: 62156 - DNA, 30 bp, Homo sapiens; identical to SEQ ID NO: 41670
  misc_feature 1..30: note = chr8:1269400-1269430
  misc_feature 1..30: note = hypo
  source 1..30: mol_type = genomic DNA

SEQ ID NO: 62157 - DNA, 42 bp, Homo sapiens; identical to SEQ ID NO: 41671
  misc_feature 1..42: note = chr8:1281668-1281710
  misc_feature 1..42: note = hypo
  source 1..42: mol_type = genomic DNA

SEQ ID NO: 62158 - DNA, 142 bp, Homo sapiens; identical to SEQ ID NO: 41672
  misc_feature 1..142: note = chr8:1302672-1302814
  misc_feature 1..142: note = hypo
  source 1..142: mol_type = genomic DNA

SEQ ID NO: 62159 - DNA, 30 bp, Homo sapiens; identical to SEQ ID NO: 41673
  misc_feature 1..30: note = chr8:1303386-1303416
  misc_feature 1..30: note = hypo
  source 1..30: mol_type = genomic DNA

SEQ ID NO: 62160 - DNA, 30 bp, Homo sapiens; identical to SEQ ID NO: 41674
  misc_feature 1..30: note = chr8:1306844-1306874
  misc_feature 1..30: note = hypo
  source 1..30: mol_type = genomic DNA

SEQ ID NO: 62161 - DNA, 30 bp, Homo sapiens; identical to SEQ ID NO: 41675
  misc_feature 1..30: note = chr8:1340176-1340206
  misc_feature 1..30: note = hypo
  source 1..30: mol_type = genomic DNA

SEQ ID NO: 62162 - DNA, 30 bp, Homo sapiens; identical to SEQ ID NO: 41676
  misc_feature 1..30: note = chr8:1362767-1362797
  misc_feature 1..30: note = hypo
  source 1..30: mol_type = genomic DNA

SEQ ID NO: 62163 - DNA, 49 bp, Homo sapiens; identical to SEQ ID NO: 41677
  misc_feature 1..49: note = chr8:1380107-1380156
  misc_feature 1..49: note = hypo
  source 1..49: mol_type = genomic DNA

SEQ ID NO: 62164 - DNA, 150 bp, Homo sapiens; identical to SEQ ID NO: 41678
  misc_feature 1..150: note = chr8:1423699-1423849
  misc_feature 1..150: note = hypo
  source 1..150: mol_type = genomic DNA

SEQ ID NO: 62165 - DNA, 30 bp, Homo sapiens; identical to SEQ ID NO: 41679
  misc_feature 1..30: note = chr8:1443699-1443729
  misc_feature 1..30: note = hypo
  source 1..30: mol_type = genomic DNA

SEQ ID NO: 62166 - DNA, 101 bp, Homo sapiens; identical to SEQ ID NO: 41680
  misc_feature 1..101: note = chr8:1471545-1471646
  misc_feature 1..101: note = hypo
  source 1..101: mol_type = genomic DNA

SEQ ID NO: 62167 - DNA, 74 bp, Homo sapiens; identical to SEQ ID NO: 41681
  misc_feature 1..74: note = chr8:1501600-1501674
  misc_feature 1..74: note = hypo
  source 1..74: mol_type = genomic DNA

SEQ ID NO: 62168 - DNA, 156 bp, Homo sapiens; identical to SEQ ID NO: 41682
  misc_feature 1..156: note = chr8:1574846-1575002
  misc_feature 1..156: note = hypo
  source 1..156: mol_type = genomic DNA

SEQ ID NO: 62169 - DNA, 30 bp, Homo sapiens; identical to SEQ ID NO: 41683
  misc_feature 1..30: note = chr8:1588688-1588718
  misc_feature 1..30: note = hypo
  source 1..30: mol_type = genomic DNA

SEQ ID NO: 62170 - DNA, 69 bp, Homo sapiens; identical to SEQ ID NO: 41684
  misc_feature 1..69: note = chr8:1588920-1588989
  misc_feature 1..69: note = hypo
  source 1..69: mol_type = genomic DNA

SEQ ID NO: 62171 - DNA, 30 bp, Homo sapiens; identical to SEQ ID NO: 41685
  misc_feature 1..30: note = chr8:1616193-1616223
  misc_feature 1..30: note = hypo
  source 1..30: mol_type = genomic DNA

SEQ ID NO: 62172 - DNA, 38 bp, Homo sapiens; identical to SEQ ID NO: 41686
  misc_feature 1..38: note = chr8:1645305-1645343
  misc_feature 1..38: note = hypo
  source 1..38: mol_type = genomic DNA

SEQ ID NO: 62173 - DNA, 76 bp, Homo sapiens; identical to SEQ ID NO: 41687
  misc_feature 1..76: note = chr8:1778994-1779070
  misc_feature 1..76: note = hypo
  source 1..76: mol_type = genomic DNA

SEQ ID NO: 62174 - DNA, 30 bp, Homo sapiens; identical to SEQ ID NO: 41688
  misc_feature 1..30: note = chr8:2536020-2536050
  misc_feature 1..30: note = hypo
  source 1..30: mol_type = genomic DNA

SEQ ID NO: 62175 - DNA, 56 bp, Homo sapiens; identical to SEQ ID NO: 41689
  misc_feature 1..56: note = chr8:2652772-2652828
  misc_feature 1..56: note = hypo
  source 1..56: mol_type = genomic DNA

SEQ ID NO: 62176 - DNA, 37 bp, Homo sapiens; identical to SEQ ID NO: 41690
  misc_feature 1..37: note = chr8:3769062-3769099
  misc_feature 1..37: note = hypo
  source 1..37: mol_type = genomic DNA

SEQ ID NO: 62177 - DNA, 24 bp, Homo sapiens
  misc_feature 1..24: note = chr8:5949419-5949443
  misc_feature 1..24: note = hypo
  source 1..24: mol_type = genomic DNA
ggcaaactccgtcttttctatccg

SEQ ID NO: 62178 - DNA, 21 bp, Homo sapiens
  misc_feature 1..21: note = chr8:6063185-6063206
  misc_feature 1..21: note = hypo
  source 1..21: mol_type = genomic DNA
ataagacgatgaacaaggatc

SEQ ID NO: 62179 - DNA, 196 bp, Homo sapiens; identical to SEQ ID NO: 41693
  misc_feature 1..196: note = chr8:6434295-6434491
  misc_feature 1..196: note = hypo
  source 1..196: mol_type = genomic DNA

SEQ ID NO: 62180 - DNA, 30 bp, Homo sapiens; identical to SEQ ID NO: 41694
  misc_feature 1..30: note = chr8:6542607-6542637
  misc_feature 1..30: note = hypo
  source 1..30: mol_type = genomic DNA

SEQ ID NO: 62181 - DNA, 30 bp, Homo sapiens; identical to SEQ ID NO: 41695
  misc_feature 1..30: note = chr8:6932550-6932580
  misc_feature 1..30: note = hypo
  source 1..30: mol_type = genomic DNA

SEQ ID NO: 62182 - DNA, 360 bp, Homo sapiens; identical to SEQ ID NO: 41696
  misc_feature 1..360: note = chr8:8639451-8639811
  misc_feature 1..360: note = hypo
  source 1..360: mol_type = genomic DNA

SEQ ID NO: 62183 - DNA, 45 bp, Homo sapiens
  misc_feature 1..45: note = chr8:8748377-8748422
  misc_feature 1..45: note = hypo
  source 1..45: mol_type = genomic DNA
tgaggttgtggaagacgtgctccttgagagccggactgtcctcaa

SEQ ID NO: 62184 - DNA, 206 bp, Homo sapiens
  misc_feature 1..206: note = chr8:8748713-8748919
  misc_feature 1..206: note = hypo
  source 1..206: mol_type = genomic DNA
gcagccggtggttgagcaggtattgaaaatgggccttgcgccgtcgaaggttcttgtccgaaacgccatagtaggctgcgtgggggctggcagagcgcagctcgaagtcccgggccagtgcctcgtccaccaccttggccaagcggctcagtccctccgcgtcgtgcttctcctgcagggcgatctggcggtgaatgtccagacat

SEQ ID NO: 62185 - DNA, 62 bp, Homo sapiens
  misc_feature 1..62: note = chr8:8748956-8749018
  misc_feature 1..62: note = hypo
  source 1..62: mol_type = genomic DNA
gggtgcccacgatgcacaccaccgcgtggggcactctcgccccgacccgatgcaagaaggag

SEQ ID NO: 62186 - DNA, 30 bp, Homo sapiens; identical to SEQ ID NO: 41699
  misc_feature 1..30: note = chr8:8898369-8898399
  misc_feature 1..30: note = hypo
  source 1..30: mol_type = genomic DNA

SEQ ID NO: 62187 - DNA, 30 bp, Homo sapiens; identical to SEQ ID NO: 41700
  misc_feature 1..30: note = chr8:8898687-8898717
  misc_feature 1..30: note = hypo
  source 1..30: mol_type = genomic DNA

SEQ ID NO: 62188 - DNA, 115 bp, Homo sapiens; identical to SEQ ID NO: 41701
  misc_feature 1..115: note = chr8:10005445-10005560
  misc_feature 1..115: note = hypo
  source 1..115: mol_type = genomic DNA

SEQ ID NO: 62189 - DNA, 32 bp, Homo sapiens; identical to SEQ ID NO: 41702
  misc_feature 1..32: note = chr8:10192893-10192925
  misc_feature 1..32: note = hypo
  source 1..32: mol_type = genomic DNA

SEQ ID NO: 62190 - DNA, 30 bp, Homo sapiens; identical to SEQ ID NO: 41703
  misc_feature 1..30: note = chr8:10261847-10261877
  misc_feature 1..30: note = hypo
  source 1..30: mol_type = genomic DNA

SEQ ID NO: 62191 - DNA, 142 bp, Homo sapiens; identical to SEQ ID NO: 41704
  misc_feature 1..142: note = chr8:10528983-10529125
  misc_feature 1..142: note = hypo
  source 1..142: mol_type = genomic DNA

SEQ ID NO: 62192 - DNA, 56 bp, Homo sapiens; identical to SEQ ID NO: 41705
  misc_feature 1..56: note = chr8:10548206-10548262
  misc_feature 1..56: note = hypo
  source 1..56: mol_type = genomic DNA

SEQ ID NO: 62193 - DNA, 30 bp, Homo sapiens; identical to SEQ ID NO: 41706
  misc_feature 1..30: note = chr8:11704567-11704597
  misc_feature 1..30: note = hypo
  source 1..30: mol_type = genomic DNA

SEQ ID NO: 62194 - DNA, 43 bp, Homo sapiens
  misc_feature 1..43: note = chr8:11705917-11705960
  misc_feature 1..43: note = hypo
  source 1..43: mol_type = genomic DNA
taccagaccaggctacgagtgcccttccgggtagaacactgat

SEQ ID NO: 62195 - DNA, 19 bp, Homo sapiens
  misc_feature 1..19: note = chr8:11706136-11706155
  misc_feature 1..19: note = hypo
  source 1..19: mol_type = genomic DNA
aaggcgaggctgcaggcag

SEQ ID NO: 62196 - DNA, 37 bp, Homo sapiens; identical to SEQ ID NO: 41708
  misc_feature 1..37: note = chr8:11708426-11708463
  misc_feature 1..37: note = hypo
  source 1..37: mol_type = genomic DNA

SEQ ID NO: 62197 - DNA, 149 bp, Homo sapiens; identical to SEQ ID NO: 41711
  misc_feature 1..149: note = chr8:12671777-12671926
  misc_feature 1..149: note = hypo
  source 1..149: mol_type = genomic DNA

SEQ ID NO: 62198 - DNA, 86 bp, Homo sapiens; identical to SEQ ID NO: 41712
  misc_feature 1..86: note = chr8:12831656-12831742
  misc_feature 1..86: note = hypo
  source 1..86: mol_type = genomic DNA

SEQ ID NO: 62199 - DNA, 89 bp, Homo sapiens; identical to SEQ ID NO: 41713
  misc_feature 1..89: note = chr8:12949930-12950019
  misc_feature 1..89: note = hypo
  source 1..89: mol_type = genomic DNA

SEQ ID NO: 62200 - DNA, 108 bp, Homo sapiens; identical to SEQ ID NO: 41714
  misc_feature 1..108: note = chr8:12952416-12952524
  misc_feature 1..108: note = hypo
  source 1..108: mol_type = genomic DNA

SEQ ID NO: 62201 - DNA, 90 bp, Homo sapiens; identical to SEQ ID NO: 41715
  misc_feature 1..90: note = chr8:12956998-12957088
  misc_feature 1..90: note = hypo
  source 1..90: mol_type = genomic DNA

SEQ ID NO: 62202 - DNA, 20 bp, Homo sapiens
  misc_feature 1..20: note = chr8:13003493-13003513
  misc_feature 1..20: note = hypo
  source 1..20: mol_type = genomic DNA
aatatactgtagggccgggc

SEQ ID NO: 62203 - DNA, 30 bp, Homo sapiens; identical to SEQ ID NO: 41718
  misc_feature 1..30: note = chr8:13654931-13654961
  misc_feature 1..30: note = hypo
  source 1..30: mol_type = genomic DNA

SEQ ID NO: 62204 - DNA, 80 bp, Homo sapiens; identical to SEQ ID NO: 41719
  misc_feature 1..80: note = chr8:14898122-14898202
  misc_feature 1..80: note = hypo
  source 1..80: mol_type = genomic DNA

SEQ ID NO: 62205 - DNA, 95 bp, Homo sapiens; identical to SEQ ID NO: 41720
  misc_feature 1..95: note = chr8:20317378-20317473
  misc_feature 1..95: note = hypo
  source 1..95: mol_type = genomic DNA

SEQ ID NO: 62206 - DNA, 125 bp, Homo sapiens; identical to SEQ ID NO: 41721
  misc_feature 1..125: note = chr8:20431789-20431914
  misc_feature 1..125: note = hypo
  source 1..125: mol_type = genomic DNA

SEQ ID NO: 62207 - DNA, 33 bp, Homo sapiens; identical to SEQ ID NO: 41722
  misc_feature 1..33: note = chr8:21302252-21302285
  misc_feature 1..33: note = hypo
  source 1..33: mol_type = genomic DNA

SEQ ID NO: 62208 - DNA, 173 bp, Homo sapiens; identical to SEQ ID NO: 41723
  misc_feature 1..173: note = chr8:21393876-21394049
  misc_feature 1..173: note = hypo
  source 1..173: mol_type = genomic DNA

SEQ ID NO: 62209 - DNA, 30 bp, Homo sapiens; identical to SEQ ID NO: 41724
  misc_feature 1..30: note = chr8:21563318-21563348
  misc_feature 1..30: note = hypo
  source 1..30: mol_type = genomic DNA

SEQ ID NO: 62210 - DNA, 101 bp, Homo sapiens; identical to SEQ ID NO: 41725
  misc_feature 1..101: note = chr8:21608043-21608144
  misc_feature 1..101: note = hypo
  source 1..101: mol_type = genomic DNA

SEQ ID NO: 62211 - DNA, 15 bp, Homo sapiens
  misc_feature 1..15: note = chr8:22101753-22101768
  misc_feature 1..15: note = hypo
  source 1..15: mol_type = genomic DNA
cgaaattgtgatacg

SEQ ID NO: 62212 - DNA, 233 bp, Homo sapiens; identical to SEQ ID NO: 41727
  misc_feature 1..233: note = chr8:23290404-23290637
  misc_feature 1..233: note = hypo
  source 1..233: mol_type = genomic DNA

SEQ ID NO: 62213 - DNA, 30 bp, Homo sapiens; identical to SEQ ID NO: 41728
  misc_feature 1..30: note = chr8:23331189-23331219
  misc_feature 1..30: note = hypo
  source 1..30: mol_type = genomic DNA

SEQ ID NO: 62214 - DNA, 30 bp, Homo sapiens; identical to SEQ ID NO: 41729
  misc_feature 1..30: note = chr8:23340639-23340669
  misc_feature 1..30: note = hypo
  source 1..30: mol_type = genomic DNA

SEQ ID NO: 62215 - DNA, 30 bp, Homo sapiens; identical to SEQ ID NO: 41730
  misc_feature 1..30: note = chr8:23380796-23380826
  misc_feature 1..30: note = hypo
  source 1..30: mol_type = genomic DNA

SEQ ID NO: 62216 - DNA, 30 bp, Homo sapiens; identical to SEQ ID NO: 41731
  misc_feature 1..30: note = chr8:23395420-23395450
  misc_feature 1..30: note = hypo
  source 1..30: mol_type = genomic DNA

SEQ ID NO: 62217 - DNA, 38 bp, Homo sapiens; identical to SEQ ID NO: 15103
  misc_feature 1..38: note = chr8:23399594-23399632
  misc_feature 1..38: note = hypo
  source 1..38: mol_type = genomic DNA

SEQ ID NO: 62218 - skipped

SEQ ID NO: 62219 - DNA, 96 bp, Homo sapiens; identical to SEQ ID NO: 24435
  misc_feature 1..96: note = chr8:23423974-23424070
  misc_feature 1..96: note = hypo
  source 1..96: mol_type = genomic DNA

SEQ ID NO: 62220 - DNA, 30 bp, Homo sapiens; identical to SEQ ID NO: 41734
  misc_feature 1..30: note = chr8:23430870-23430900
  misc_feature 1..30: note = hypo
  source 1..30: mol_type = genomic DNA

SEQ ID NO: 62221 - DNA, 41 bp, Homo sapiens; identical to SEQ ID NO: 41735
  misc_feature 1..41: note = chr8:25318815-25318856
  misc_feature 1..41: note = hypo
  source 1..41: mol_type = genomic DNA

SEQ ID NO: 62222 - DNA, 216 bp, Homo sapiens; identical to SEQ ID NO: 41736
  misc_feature 1..216: note = chr8:25397045-25397261
  misc_feature 1..216: note = hypo
  source 1..216: mol_type = genomic DNA

SEQ ID NO: 62223 - DNA, 30 bp, Homo sapiens; identical to SEQ ID NO: 41737
  misc_feature 1..30: note = chr8:26267175-26267205
  misc_feature 1..30: note = hypo
  source 1..30: mol_type = genomic DNA

SEQ ID NO: 62224 - DNA, 18 bp, Homo sapiens
  misc_feature 1..18: note = chr8:27914784-27914802
  misc_feature 1..18: note = hypo
  source 1..18: mol_type = genomic DNA
tgctattgataaatacgg

SEQ ID NO: 62225 - DNA, 30 bp, Homo sapiens; identical to SEQ ID NO: 41739
  misc_feature 1..30: note = chr8:27931084-27931114
  misc_feature 1..30: note = hypo
  source 1..30: mol_type = genomic DNA

SEQ ID NO: 62226 - DNA, 30 bp, Homo sapiens; identical to SEQ ID NO: 41740
  misc_feature 1..30: note = chr8:28938557-28938587
  misc_feature 1..30: note = hypo
  source 1..30: mol_type = genomic DNA

SEQ ID NO: 62227 - DNA, 30 bp, Homo sapiens; identical to SEQ ID NO: 41741
  misc_feature 1..30: note = chr8:29157762-29157792
  misc_feature 1..30: note = hypo
  source 1..30: mol_type = genomic DNA

SEQ ID NO: 62228 - DNA, 28 bp, Homo sapiens
  misc_feature 1..28: note = chr8:29596408-29596436
  misc_feature 1..28: note = hypo
  source 1..28: mol_type = genomic DNA
tttttaggctgggcacggtagttcatgc

SEQ ID NO: 62229 - DNA, 28 bp, Homo sapiens
  misc_feature 1..28: note = chr8:29596676-29596704
  misc_feature 1..28: note = hypo
  source 1..28: mol_type = genomic DNA
cagaacaagactccgtctcaaaaaaaaa

SEQ ID NO: 62230 - DNA, 148 bp, Homo sapiens; identical to SEQ ID NO: 41744
  misc_feature 1..148: note = chr8:32987430-32987578
  misc_feature 1..148: note = hypo
  source 1..148: mol_type = genomic DNA

SEQ ID NO: 62231 - DNA, 30 bp, Homo sapiens; identical to SEQ ID NO: 41745
  misc_feature 1..30: note = chr8:37706125-37706155
  misc_feature 1..30: note = hypo
  source 1..30: mol_type = genomic DNA

SEQ ID NO: 62232 - DNA, 30 bp, Homo sapiens; identical to SEQ ID NO: 41747
  misc_feature 1..30: note = chr8:38005823-38005853
  misc_feature 1..30: note = hypo
  source 1..30: mol_type = genomic DNA

SEQ ID NO: 62233 - DNA, 31 bp, Homo sapiens; identical to SEQ ID NO: 41748
  misc_feature 1..31: note = chr8:38786050-38786081
  misc_feature 1..31: note = hypo
  source 1..31: mol_type = genomic DNA

SEQ ID NO: 62234 - DNA, 148 bp, Homo sapiens; identical to SEQ ID NO: 41749
  misc_feature 1..148: note = chr8:41146864-41147012
  misc_feature 1..148: note = hypo
  source 1..148: mol_type = genomic DNA

SEQ ID NO: 62235 - DNA, 30 bp, Homo sapiens; identical to SEQ ID NO: 41750
  misc_feature 1..30: note = chr8:41510183-41510213
  misc_feature 1..30: note = hypo
  source 1..30: mol_type = genomic DNA

SEQ ID NO: 62236 - DNA, 82 bp, Homo sapiens; identical to SEQ ID NO: 41751
  misc_feature 1..82: note = chr8:41523651-41523733
  misc_feature 1..82: note = hypo
  source 1..82: mol_type = genomic DNA

SEQ ID NO: 62237 - DNA, 137 bp, Homo sapiens; identical to SEQ ID NO: 41752
  misc_feature 1..137: note = chr8:41554224-41554361
  misc_feature 1..137: note = hypo
  source 1..137: mol_type = genomic DNA

SEQ ID NO: 62238 - DNA, 61 bp, Homo sapiens; identical to SEQ ID NO: 41753
  misc_feature 1..61: note = chr8:41566351-41566412
  misc_feature 1..61: note = hypo
  source 1..61: mol_type = genomic DNA

SEQ ID NO: 62239 - DNA, 52 bp, Homo sapiens; identical to SEQ ID NO: 41754
  misc_feature 1..52: note = chr8:41594902-41594954
  misc_feature 1..52: note = hypo
  source 1..52: mol_type = genomic DNA

SEQ ID NO: 62240 - DNA, 64 bp, Homo sapiens; identical to SEQ ID NO: 41755
  misc_feature 1..64: note = chr8:41611241-41611305
  misc_feature 1..64: note = hypo
  source 1..64: mol_type = genomic DNA

SEQ ID NO: 62241 - DNA, 53 bp, Homo sapiens; identical to SEQ ID NO: 41756
  misc_feature 1..53: note = chr8:41668167-41668220
  misc_feature 1..53: note = hypo
  source 1..53: mol_type = genomic DNA

SEQ ID NO: 62242 - DNA, 30 bp, Homo sapiens; identical to SEQ ID NO: 41757
  misc_feature 1..30: note = chr8:41689306-41689336
  misc_feature 1..30: note = hypo
  source 1..30: mol_type = genomic DNA

SEQ ID NO: 62243 - DNA, 33 bp, Homo sapiens; identical to SEQ ID NO: 41759
  misc_feature 1..33: note = chr8:42036407-42036440
  misc_feature 1..33: note = hypo
  source 1..33: mol_type = genomic DNA

SEQ ID NO: 62244 - DNA, 127 bp, Homo sapiens; identical to SEQ ID NO: 41760
  misc_feature 1..127: note = chr8:42144632-42144759
  misc_feature 1..127: note = hypo
  source 1..127: mol_type = genomic DNA

SEQ ID NO: 62245 - DNA, 23 bp, Homo sapiens
  misc_feature 1..23: note = chr8:42333901-42333924
  misc_feature 1..23: note = hypo
  source 1..23: mol_type = genomic DNA
tgagccaccgtgcccggccggtt

SEQ ID NO: 62246 - DNA, 30 bp, Homo sapiens; identical to SEQ ID NO: 15108
  misc_feature 1..30: note = chr8:42699267-42699297
  misc_feature 1..30: note = hypo
  source 1..30: mol_type = genomic DNA

SEQ ID NO: 62247 - DNA, 42 bp, Homo sapiens; identical to SEQ ID NO: 41764
  misc_feature 1..42: note = chr8:43401723-43401765
  misc_feature 1..42: note = hypo
  source 1..42: mol_type = genomic DNA

SEQ ID NO: 62248 - DNA, 153 bp, Homo sapiens; identical to SEQ ID NO: 41765
  misc_feature 1..153: note = chr8:43416676-43416829
  misc_feature 1..153: note = hypo
  source 1..153: mol_type = genomic DNA

SEQ ID NO: 62249 - DNA, 30 bp, Homo sapiens; identical to SEQ ID NO: 41766
  misc_feature 1..30: note = chr8:47016307-47016337
  misc_feature 1..30: note = hypo
  source 1..30: mol_type = genomic DNA

SEQ ID NO: 62250 - DNA, 124 bp, Homo sapiens; identical to SEQ ID NO: 41767
  misc_feature 1..124: note = chr8:47093290-47093414
  misc_feature 1..124: note = hypo
  source 1..124: mol_type = genomic DNA

SEQ ID NO: 62251 - DNA, 183 bp, Homo sapiens; identical to SEQ ID NO: 41768
  misc_feature 1..183: note = chr8:47155037-47155220
  misc_feature 1..183: note = hypo
  source 1..183: mol_type = genomic DNA

SEQ ID NO: 62252 - DNA, 108 bp, Homo sapiens; identical to SEQ ID NO: 41769
  misc_feature 1..108: note = chr8:47334490-47334598
  misc_feature 1..108: note = hypo
  source 1..108: mol_type = genomic DNA

SEQ ID NO: 62253 - DNA, 30 bp, Homo sapiens; identical to SEQ ID NO: 41770
  misc_feature 1..30: note = chr8:47355877-47355907
  misc_feature 1..30: note = hypo
  source 1..30: mol_type = genomic DNA

SEQ ID NO: 62254 - DNA, 37 bp, Homo sapiens; identical to SEQ ID NO: 41771
  misc_feature 1..37: note = chr8:48045032-48045069
  misc_feature 1..37: note = hypo
  source 1..37: mol_type = genomic DNA

SEQ ID NO: 62255 - DNA, 168 bp, Homo sapiens; identical to SEQ ID NO: 15113
  misc_feature 1..168: note = chr8:48294168-48294336
  misc_feature 1..168: note = hypo
  source 1..168: mol_type = genomic DNA

SEQ ID NO: 62256 - DNA, 30 bp, Homo sapiens; identical to SEQ ID NO: 41773
  misc_feature 1..30: note = chr8:48676823-48676853
  misc_feature 1..30: note = hypo
  source 1..30: mol_type = genomic DNA

SEQ ID NO: 62257 - DNA, 45 bp, Homo sapiens; identical to SEQ ID NO: 41774
  misc_feature 1..45: note = chr8:48796372-48796417
  misc_feature 1..45: note = hypo
  source 1..45: mol_type = genomic DNA

SEQ ID NO: 62258 - DNA, 251 bp, Homo sapiens; identical to SEQ ID NO: 41775
  misc_feature 1..251: note = chr8:49334991-49335242
  misc_feature 1..251: note = hypo
  source 1..251: mol_type = genomic DNA

SEQ ID NO: 62259 - DNA, 45 bp, Homo sapiens; identical to SEQ ID NO: 41776
  misc_feature 1..45: note = chr8:49496375-49496420
  misc_feature 1..45: note = hypo
  source 1..45: mol_type = genomic DNA

SEQ ID NO: 62260 - DNA, 59 bp, Homo sapiens; identical to SEQ ID NO: 41777
  misc_feature 1..59: note = chr8:49572124-49572183
  misc_feature 1..59: note = hypo
  source 1..59: mol_type = genomic DNA

SEQ ID NO: 62261 - DNA, 267 bp, Homo sapiens; identical to SEQ ID NO: 41778
  misc_feature 1..267: note = chr8:49608941-49609208
  misc_feature 1..267: note = hypo
  source 1..267: mol_type = genomic DNA

SEQ ID NO: 62262 - DNA, 30 bp, Homo sapiens; identical to SEQ ID NO: 41779
  misc_feature 1..30: note = chr8:49773216-49773246
  misc_feature 1..30: note = hypo
  source 1..30: mol_type = genomic DNA

SEQ ID NO: 62263 - DNA, 137 bp, Homo sapiens; identical to SEQ ID NO: 41780
  misc_feature 1..137: note = chr8:49808681-49808818
  misc_feature 1..137: note = hypo
  source 1..137: mol_type = genomic DNA

SEQ ID NO: 62264 - DNA, 192 bp, Homo sapiens
  misc_feature 1..192: note = chr8:49959260-49959452
  misc_feature 1..192: note = hypo
  source 1..192: mol_type = genomic DNA
ggagtcgctgtactgtattcacggctcttgttatatgatttatgctggcattatctaaactgagaagcggacaatcctttattcaaaggcgagctccctctattttgtgttgccgctcatggagtcctaaggtcggagccccataggagctgccagcagagtcccaatggaggtgagcggctcatttcagct

SEQ ID NO: 62265 - DNA, 120 bp, Homo sapiens; identical to SEQ ID NO: 41782
  misc_feature 1..120: note = chr8:50015598-50015718
  misc_feature 1..120: note = hypo
  source 1..120: mol_type = genomic DNA

SEQ ID NO: 62266 - DNA, 156 bp, Homo sapiens; identical to SEQ ID NO: 41783
  misc_feature 1..156: note = chr8:50314445-50314601
  misc_feature 1..156: note = hypo
  source 1..156: mol_type = genomic DNA

SEQ ID NO: 62267 - DNA, 58 bp, Homo sapiens; identical to SEQ ID NO: 41784
  misc_feature 1..58: note = chr8:50377787-50377845
  misc_feature 1..58: note = hypo
  source 1..58: mol_type = genomic DNA

SEQ ID NO: 62268 - DNA, 34 bp, Homo sapiens; identical to SEQ ID NO: 15119
  misc_feature 1..34: note = chr8:52432891-52432925
  misc_feature 1..34: note = hypo
  source 1..34: mol_type = genomic DNA

SEQ ID NO: 62269 - DNA, 97 bp, Homo sapiens; identical to SEQ ID NO: 41786
  misc_feature 1..97: note = chr8:53352314-53352411
  misc_feature 1..97: note = hypo
  source 1..97: mol_type = genomic DNA

SEQ ID NO: 62270 - DNA, 30 bp, Homo sapiens; identical to SEQ ID NO: 41787
  misc_feature 1..30: note = chr8:53805607-53805637
  misc_feature 1..30: note = hypo
  source 1..30: mol_type = genomic DNA

SEQ ID NO: 62271 - DNA, 40 bp, Homo sapiens; identical to SEQ ID NO: 41788
  misc_feature 1..40: note = chr8:55191496-55191536
  misc_feature 1..40: note = hypo
  source 1..40: mol_type = genomic DNA

SEQ ID NO: 62272 - DNA, 30 bp, Homo sapiens; identical to SEQ ID NO: 41789
  misc_feature 1..30: note = chr8:55285908-55285938
  misc_feature 1..30: note = hypo
  source 1..30: mol_type = genomic DNA

SEQ ID NO: 62273 - DNA, 30 bp, Homo sapiens; identical to SEQ ID NO: 15120
  misc_feature 1..30: note = chr8:55689465-55689495
  misc_feature 1..30: note = hypo
  source 1..30: mol_type = genomic DNA

SEQ ID NO: 62274 - DNA, 32 bp, Homo sapiens; identical to SEQ ID NO: 41791
  misc_feature 1..32: note = chr8:55787831-55787863
  misc_feature 1..32: note = hypo
  source 1..32: mol_type = genomic DNA

SEQ ID NO: 62275 - DNA, 30 bp, Homo sapiens; identical to SEQ ID NO: 41792
  misc_feature 1..30: note = chr8:56362016-56362046
  misc_feature 1..30: note = hypo
  source 1..30: mol_type = genomic DNA

SEQ ID NO: 62276 - DNA, 78 bp, Homo sapiens; identical to SEQ ID NO: 41793
  misc_feature 1..78: note = chr8:56364255-56364333
  misc_feature 1..78: note = hypo
  source 1..78: mol_type = genomic DNA

SEQ ID NO: 62277 - DNA, 95 bp, Homo sapiens; identical to SEQ ID NO: 41794
  misc_feature 1..95: note = chr8:56539998-56540093
  misc_feature 1..95: note = hypo
  source 1..95: mol_type = genomic DNA

SEQ ID NO: 62278 - DNA, 27 bp, Homo sapiens
  misc_feature 1..27: note = chr8:56688545-56688572
  misc_feature 1..27: note = hypo
  source 1..27: mol_type = genomic DNA
ctaaatcccttggatcgattgactgta

SEQ ID NO: 62279 - DNA, 30 bp, Homo sapiens; identical to SEQ ID NO: 41796
  misc_feature 1..30: note = chr8:56883198-56883228
  misc_feature 1..30: note = hypo
  source 1..30: mol_type = genomic DNA

SEQ ID NO: 62280 - DNA, 78 bp, Homo sapiens; identical to SEQ ID NO: 41797
  misc_feature 1..78: note = chr8:56929748-56929826
  misc_feature 1..78: note = hypo
  source 1..78: mol_type = genomic DNA

SEQ ID NO: 62281 - DNA, 39 bp, Homo sapiens; identical to SEQ ID NO: 41798
  misc_feature 1..39: note = chr8:57566358-57566397
  misc_feature 1..39: note = hypo
  source 1..39: mol_type = genomic DNA

SEQ ID NO: 62282 - DNA, 30 bp, Homo sapiens; identical to SEQ ID NO: 41799
  misc_feature 1..30: note = chr8:57995953-57995983
  misc_feature 1..30: note = hypo
  source 1..30: mol_type = genomic DNA

SEQ ID NO: 62283 - DNA, 65 bp, Homo sapiens
  misc_feature 1..65: note = chr8:58106115-58106180
  misc_feature 1..65: note = hypo
  source 1..65: mol_type = genomic DNA
gggcagctggttgaggtgcgcatgcgcactggcacctaacggctcttcttcgagtcttctcagag

SEQ ID NO: 62284 - DNA, 35 bp, Homo sapiens; identical to SEQ ID NO: 41801
  misc_feature 1..35: note = chr8:58106674-58106709
  misc_feature 1..35: note = hypo
  source 1..35: mol_type = genomic DNA

SEQ ID NO: 62285 - DNA, 54 bp, Homo sapiens; identical to SEQ ID NO: 24452
  misc_feature 1..54: note = chr8:58116950-58117004
  misc_feature 1..54: note = hypo
  source 1..54: mol_type = genomic DNA

SEQ ID NO: 62286 - DNA, 63 bp, Homo sapiens; identical to SEQ ID NO: 24453
  misc_feature 1..63: note = chr8:58130301-58130364
  misc_feature 1..63: note = hypo
  source 1..63: mol_type = genomic DNA

SEQ ID NO: 62287 - DNA, 241 bp, Homo sapiens
  misc_feature 1..241: note = chr8:58130574-58130815
  misc_feature 1..241: note = hypo
  source 1..241: mol_type = genomic DNA
ctcagtgttgctggtggcaagagtgtggtacgagagtggttgggcgtggtttgaatatctagaaaaggcgagctgagggtagatttttgaacagtccggagtaggaggggtagagacatattctatgggccacagccacattctcaggatgctcgtggctgtaaatagtagatgacccaagtaagagcggctgaagccataggcaccagaattgtgttggcatcgtcgtgtcacgctcacg

SEQ ID NO: 62288 - DNA, 38 bp, Homo sapiens; identical to SEQ ID NO: 41804
  misc_feature 1..38: note = chr8:58716351-58716389
  misc_feature 1..38: note = hypo
  source 1..38: mol_type = genomic DNA

SEQ ID NO: 62289 - DNA, 30 bp, Homo sapiens; identical to SEQ ID NO: 41806
  misc_feature 1..30: note = chr8:61272270-61272300
  misc_feature 1..30: note = hypo
  source 1..30: mol_type = genomic DNA

SEQ ID NO: 62290 - DNA, 30 bp, Homo sapiens; identical to SEQ ID NO: 41807
  misc_feature 1..30: note = chr8:61777517-61777547
  misc_feature 1..30: note = hypo
  source 1..30: mol_type = genomic DNA

SEQ ID NO: 62291 - DNA, 97 bp, Homo sapiens
  misc_feature 1..97: note = chr8:61789877-61789974
  misc_feature 1..97: note = hypo
  source 1..97: mol_type = genomic DNA
tggtcgcaataatgacgacgaggcggatggcggcggggaggctagagcccatttcagaagcctgcagtgaggattccaccagttcacatgcatcggg

SEQ ID NO: 62292 - DNA, 30 bp, Homo sapiens; identical to SEQ ID NO: 41809
  misc_feature 1..30: note = chr8:63056935-63056965
  misc_feature 1..30: note = hypo
  source 1..30: mol_type = genomic DNA

SEQ ID NO: 62293 - DNA, 37 bp, Homo sapiens; identical to SEQ ID NO: 41810
  misc_feature 1..37: note = chr8:64023507-64023544
  misc_feature 1..37: note = hypo
  source 1..37: mol_type = genomic DNA

SEQ ID NO: 62294 - DNA, 22 bp, Homo sapiens
  misc_feature 1..22: note = chr8:64511304-64511326
  misc_feature 1..22: note = hypo
  source 1..22: mol_type = genomic DNA
aatagaacgaagaaaggaggac

SEQ ID NO: 62295 - DNA, 23 bp, Homo sapiens
  misc_feature 1..23: note = chr8:65385213-65385236
  misc_feature 1..23: note = hypo
  source 1..23: mol_type = genomic DNA
cgagactccgtctcaaaaaaaaa

SEQ ID NO: 62296 - DNA, 30 bp, Homo sapiens; identical to SEQ ID NO: 41813
  misc_feature 1..30: note = chr8:65519445-65519475
  misc_feature 1..30: note = hypo
  source 1..30: mol_type = genomic DNA

SEQ ID NO: 62297 - DNA, 90 bp, Homo sapiens; identical to SEQ ID NO: 15127
  misc_feature 1..90: note = chr8:65749819-65749909
  misc_feature 1..90: note = hypo
  source 1..90: mol_type = genomic DNA

SEQ ID NO: 62298 - DNA, 33 bp, Homo sapiens; identical to SEQ ID NO: 41815
  misc_feature 1..33: note = chr8:66055590-66055623
  misc_feature 1..33: note = hypo
  source 1..33: mol_type = genomic DNA

SEQ ID NO: 62299 - DNA, 162 bp, Homo sapiens; identical to SEQ ID NO: 41818
  misc_feature 1..162: note = chr8:67117765-67117927
  misc_feature 1..162: note = hypo
  source 1..162: mol_type = genomic DNA

SEQ ID NO: 62300 - DNA, 68 bp, Homo sapiens; identical to SEQ ID NO: 41819
  misc_feature 1..68: note = chr8:68347722-68347790
  misc_feature 1..68: note = hypo
  source 1..68: mol_type = genomic DNA

SEQ ID NO: 62301 - DNA, 260 bp, Homo sapiens; identical to SEQ ID NO: 41820
  misc_feature 1..260: note = chr8:71017232-71017492
  misc_feature 1..260: note = hypo
  source 1..260: mol_type = genomic DNA

SEQ ID NO: 62302 - DNA, 213 bp, Homo sapiens; identical to SEQ ID NO: 41821
  misc_feature 1..213: note = chr8:71368455-71368668
  misc_feature 1..213: note = hypo
  source 1..213: mol_type = genomic DNA

SEQ ID NO: 62303 - DNA, 43 bp, Homo sapiens; identical to SEQ ID NO: 41822
  misc_feature 1..43: note = chr8:74086196-74086239
  misc_feature 1..43: note = hypo
  source 1..43: mol_type = genomic DNA

SEQ ID NO: 62304 - DNA, 32 bp, Homo sapiens; identical to SEQ ID NO: 15130
  misc_feature 1..32: note = chr8:74332813-74332845
  misc_feature 1..32: note = hypo
  source 1..32: mol_type = genomic DNA

SEQ ID NO: 62305 - DNA, 30 bp, Homo sapiens; identical to SEQ ID NO: 41824
  misc_feature 1..30: note = chr8:74674435-74674465
  misc_feature 1..30: note = hypo
  source 1..30: mol_type = genomic DNA

SEQ ID NO: 62306 - DNA, 48 bp, Homo sapiens
  misc_feature 1..48: note = chr8:74759463-74759511
  misc_feature 1..48: note = hypo
  source 1..48: mol_type = genomic DNA
caccataatggctaataaaaacaggaaaagaaacgcaacctcactggt

SEQ ID NO: 62307 - DNA, 145 bp, Homo sapiens; identical to SEQ ID NO: 41827
  misc_feature 1..145: note = chr8:78532944-78533089
  misc_feature 1..145: note = hypo
  source 1..145: mol_type = genomic DNA

SEQ ID NO: 62308 - DNA, 162 bp, Homo sapiens; identical to SEQ ID NO: 41828
  misc_feature 1..162: note = chr8:80483857-80484019
  misc_feature 1..162: note = hypo
  source 1..162: mol_type = genomic DNA

SEQ ID NO: 62309 - DNA, 22 bp, Homo sapiens
  misc_feature 1..22: note = chr8:82903036-82903058
  misc_feature 1..22: note = hypo
  source 1..22: mol_type = genomic DNA
tggcagacgctcctccctcagc

SEQ ID NO: 62310 - DNA, 30 bp, Homo sapiens; identical to SEQ ID NO: 41830
  misc_feature 1..30: note = chr8:83282016-83282046
  misc_feature 1..30: note = hypo
  source 1..30: mol_type = genomic DNA

SEQ ID NO: 62311 - DNA, 114 bp, Homo sapiens; identical to SEQ ID NO: 41831
  misc_feature 1..114: note = chr8:86370822-86370936
  misc_feature 1..114: note = hypo
  source 1..114: mol_type = genomic DNA

SEQ ID NO: 62312 - DNA, 30 bp, Homo sapiens; identical to SEQ ID NO: 41832
  misc_feature 1..30: note = chr8:86389645-86389675
  misc_feature 1..30: note = hypo
  source 1..30: mol_type = genomic DNA

SEQ ID NO: 62313 - DNA, 40 bp, Homo sapiens; identical to SEQ ID NO: 41833
  misc_feature 1..40: note = chr8:86405563-86405603
  misc_feature 1..40: note = hypo
  source 1..40: mol_type = genomic DNA

SEQ ID NO: 62314 - DNA, 26 bp, Homo sapiens
  misc_feature 1..26: note = chr8:86417676-86417702
  misc_feature 1..26: note = hypo
  source 1..26: mol_type = genomic DNA
agaatcacaagcgtgagccactgtgc

SEQ ID NO: 62315 - skipped

SEQ ID NO: 62316 - DNA, 30 bp, Homo sapiens; identical to SEQ ID NO: 41837
  misc_feature 1..30: note = chr8:86849611-86849641
  misc_feature 1..30: note = hypo
  source 1..30: mol_type = genomic DNA

SEQ ID NO: 62317 - DNA, 19 bp, Homo sapiens
  misc_feature 1..19: note = chr8:86926063-86926082
  misc_feature 1..19: note = hypo
  source 1..19: mol_type = genomic DNA
accacgcctggctaatttt

SEQ ID NO: 62318 - DNA, 498 bp, Homo sapiens; identical to SEQ ID NO: 41839
  misc_feature 1..498: note = chr8:88885698-88886196
  misc_feature 1..498: note = hypo
  source 1..498: mol_type = genomic DNA

SEQ ID NO: 62319 - DNA, 17 bp, Homo sapiens
  misc_feature 1..17: note = chr8:89830498-89830515
  misc_feature 1..17: note = hypo
  source 1..17: mol_type = genomic DNA
gccggaaaacatatgtc

SEQ ID NO: 62320 - DNA, 36 bp, Homo sapiens; identical to SEQ ID NO: 41841
  misc_feature 1..36: note = chr8:90768546-90768582
  misc_feature 1..36: note = hypo
  source 1..36: mol_type = genomic DNA

SEQ ID NO: 62321 - DNA, 35 bp, Homo sapiens; identical to SEQ ID NO: 41842
  misc_feature 1..35: note = chr8:90768822-90768857
  misc_feature 1..35: note = hypo
  source 1..35: mol_type = genomic DNA

SEQ ID NO: 62322 - DNA, 30 bp, Homo sapiens; identical to SEQ ID NO: 15135
  misc_feature 1..30: note = chr8:91130098-91130128
  misc_feature 1..30: note = hypo
  source 1..30: mol_type = genomic DNA

SEQ ID NO: 62323 - DNA, 22 bp, Homo sapiens
  misc_feature 1..22: note = chr8:91163928-91163950
  misc_feature 1..22: note = hypo
  source 1..22: mol_type = genomic DNA
gtaatccctgcacttcggcagg

SEQ ID NO: 62324 - DNA, 195 bp, Homo sapiens; identical to SEQ ID NO: 41846
  misc_feature 1..195: note = chr8:91865364-91865559
  misc_feature 1..195: note = hypo
  source 1..195: mol_type = genomic DNA

SEQ ID NO: 62325 - DNA, 30 bp, Homo sapiens; identical to SEQ ID NO: 41848
  misc_feature 1..30: note = chr8:93449207-93449237
  misc_feature 1..30: note = hypo
  source 1..30: mol_type = genomic DNA

SEQ ID NO: 62326 - DNA, 226 bp, Homo sapiens; identical to SEQ ID NO: 41849
  misc_feature 1..226: note = chr8:93848232-93848458
  misc_feature 1..226: note = hypo
  source 1..226: mol_type = genomic DNA

SEQ ID NO: 62327 - DNA, 174 bp, Homo sapiens; identical to SEQ ID NO: 41850
  misc_feature 1..174: note = chr8:95211968-95212142
  misc_feature 1..174: note = hypo
  source 1..174: mol_type = genomic DNA

SEQ ID NO: 62328 - DNA, 77 bp, Homo sapiens; identical to SEQ ID NO: 15137
  misc_feature 1..77: note = chr8:95416054-95416131
  misc_feature 1..77: note = hypo
  source 1..77: mol_type = genomic DNA

SEQ ID NO: 62329 - DNA, 30 bp, Homo sapiens; identical to SEQ ID NO: 41852
  misc_feature 1..30: note = chr8:95622883-95622913
  misc_feature 1..30: note = hypo
  source 1..30: mol_type = genomic DNA

SEQ ID NO: 62330 - DNA, 25 bp, Homo sapiens
  misc_feature 1..25: note = chr8:95816428-95816453
  misc_feature 1..25: note = hypo
  source 1..25: mol_type = genomic DNA
tcaaaaaattaaatgcgggccgggc

SEQ ID NO: 62331 - DNA, 28 bp, Homo sapiens
  misc_feature 1..28: note = chr8:95837639-95837667
  misc_feature 1..28: note = hypo
  source 1..28: mol_type = genomic DNA
atagagtaagactcggaaaaaaaaaaaa

SEQ ID NO: 62332 - DNA, 30 bp, Homo sapiens; identical to SEQ ID NO: 41855
  misc_feature 1..30: note = chr8:95904181-95904211
  misc_feature 1..30: note = hypo
  source 1..30: mol_type = genomic DNA

SEQ ID NO: 62333 - DNA, 172 bp, Homo sapiens; identical to SEQ ID NO: 41856
  misc_feature 1..172: note = chr8:96208663-96208835
  misc_feature 1..172: note = hypo
  source 1..172: mol_type = genomic DNA

SEQ ID NO: 62334 - DNA, 30 bp, Homo sapiens; identical to SEQ ID NO: 41857
  misc_feature 1..30: note = chr8:97039387-97039417
  misc_feature 1..30: note = hypo
  source 1..30: mol_type = genomic DNA

SEQ ID NO: 62335 - DNA, 23 bp, Homo sapiens
  misc_feature 1..23: note = chr8:97272415-97272438
  misc_feature 1..23: note = hypo
  source 1..23: mol_type = genomic DNA
actgcgctcggcccattctgcga

SEQ ID NO: 62336-62337 - skipped (2 entries)

SEQ ID NO: 62338 - DNA, 37 bp, Homo sapiens; identical to SEQ ID NO: 41860
  misc_feature 1..37: note = chr8:97977869-97977906
  misc_feature 1..37: note = hypo
  source 1..37: mol_type = genomic DNA

SEQ ID NO: 62339 - DNA, 30 bp, Homo sapiens; identical to SEQ ID NO: 41861
  misc_feature 1..30: note = chr8:97982654-97982684
  misc_feature 1..30: note = hypo
  source 1..30: mol_type = genomic DNA

SEQ ID NO: 62340 - DNA, 39 bp, Homo sapiens; identical to SEQ ID NO: 41862
  misc_feature 1..39: note = chr8:98404793-98404832
  misc_feature 1..39: note = hypo
  source 1..39: mol_type = genomic DNA

SEQ ID NO: 62341 - DNA, 30 bp, Homo sapiens; identical to SEQ ID NO: 15140
  misc_feature 1..30: note = chr8:98738336-98738366
  misc_feature 1..30: note = hypo
  source 1..30: mol_type = genomic DNA

SEQ ID NO: 62342 - DNA, 22 bp, Homo sapiens
  misc_feature 1..22: note = chr8:98748478-98748500
  misc_feature 1..22: note = hypo
  source 1..22: mol_type = genomic DNA
gactgggcgacggagggagact

SEQ ID NO: 62343 - DNA, 79 bp, Homo sapiens; identical to SEQ ID NO: 41865
  misc_feature 1..79: note = chr8:99130932-99131011
  misc_feature 1..79: note = hypo
  source 1..79: mol_type = genomic DNA

SEQ ID NO: 62344 - DNA, 95 bp, Homo sapiens; identical to SEQ ID NO: 41866
  misc_feature 1..95: note = chr8:100026644-100026739
  misc_feature 1..95: note = hypo
  source 1..95: mol_type = genomic DNA

SEQ ID NO: 62345 - DNA, 36 bp, Homo sapiens; identical to SEQ ID NO: 41867
  misc_feature 1..36: note = chr8:100245127-100245163
  misc_feature 1..36: note = hypo
  source 1..36: mol_type = genomic DNA

SEQ ID NO: 62346 - DNA, 32 bp, Homo sapiens; identical to SEQ ID NO: 41868
  misc_feature 1..32: note = chr8:100359795-100359827
  misc_feature 1..32: note = hypo
  source 1..32: mol_type = genomic DNA

SEQ ID NO: 62347 - DNA, 103 bp, Homo sapiens; identical to SEQ ID NO: 41869
  misc_feature 1..103: note = chr8:100904181-100904284
  misc_feature 1..103: note = hypo
  source 1..103: mol_type = genomic DNA

SEQ ID NO: 62348 - DNA, 216 bp, Homo sapiens; identical to SEQ ID NO: 41870
  misc_feature 1..216: note = chr8:100906569-100906785
  misc_feature 1..216: note = hypo
  source 1..216: mol_type = genomic DNA

SEQ ID NO: 62349 - DNA, 150 bp, Homo sapiens; identical to SEQ ID NO: 41871
  misc_feature 1..150: note = chr8:101156747-101156897
  misc_feature 1..150: note = hypo
  source 1..150: mol_type = genomic DNA

SEQ ID NO: 62350 - DNA, 23 bp, Homo sapiens
  misc_feature 1..23: note = chr8:101241341-101241364
  misc_feature 1..23: note = hypo
  source 1..23: mol_type = genomic DNA
aatgaggaagtaggccgggcgtg

SEQ ID NO: 62351 - DNA, 30 bp, Homo sapiens; identical to SEQ ID NO: 41873
  misc_feature 1..30: note = chr8:101299821-101299851
  misc_feature 1..30: note = hypo
  source 1..30: mol_type = genomic DNA

SEQ ID NO: 62352 - DNA, 30 bp, Homo sapiens; identical to SEQ ID NO: 41874
  misc_feature 1..30: note = chr8:101438141-101438171
  misc_feature 1..30: note = hypo
  source 1..30: mol_type = genomic DNA

SEQ ID NO: 62353 - DNA, 78 bp, Homo sapiens; identical to SEQ ID NO: 41875
  misc_feature 1..78: note = chr8:101693784-101693862
  misc_feature 1..78: note = hypo
  source 1..78: mol_type = genomic DNA

SEQ ID NO: 62354 - DNA, 30 bp, Homo sapiens; identical to SEQ ID NO: 41876
  misc_feature 1..30: note = chr8:101717092-101717122
  misc_feature 1..30: note = hypo
  source 1..30: mol_type = genomic DNA

SEQ ID NO: 62355 - DNA, 42 bp, Homo sapiens; identical to SEQ ID NO: 41877
  misc_feature 1..42: note = chr8:101729504-101729546
  misc_feature 1..42: note = hypo
  source 1..42: mol_type = genomic DNA

SEQ ID NO: 62356 - DNA, 40 bp, Homo sapiens; identical to SEQ ID NO: 41878
  misc_feature 1..40: note = chr8:101872226-101872266
  misc_feature 1..40: note = hypo
  source 1..40: mol_type = genomic DNA

SEQ ID NO: 62357 - DNA, 51 bp, Homo sapiens; identical to SEQ ID NO: 41879
  misc_feature 1..51: note = chr8:102039492-102039543
  misc_feature 1..51: note = hypo
  source 1..51: mol_type = genomic DNA

SEQ ID NO: 62358 - DNA, 213 bp, Homo sapiens; identical to SEQ ID NO: 41880
  misc_feature 1..213: note = chr8:102155655-102155868
  misc_feature 1..213: note = hypo
  source 1..213: mol_type = genomic DNA

SEQ ID NO: 62359 - DNA, 30 bp, Homo sapiens; identical to SEQ ID NO: 41881
  misc_feature 1..30: note = chr8:103403324-103403354
  misc_feature 1..30: note = hypo
  source 1..30: mol_type = genomic DNA

SEQ ID NO: 62360 - DNA, 20 bp, Homo sapiens
  misc_feature 1..20: note = chr8:104235237-104235257
  misc_feature 1..20: note = hypo
  source 1..20: mol_type = genomic DNA
tttaaaactttttggcgggc

SEQ ID NO: 62361 - DNA, 165 bp, Homo sapiens; identical to SEQ ID NO: 41884
  misc_feature 1..165: note = chr8:104382635-104382800
  misc_feature 1..165: note = hypo
  source 1..165: mol_type = genomic DNA

SEQ ID NO: 62362 - DNA, 23 bp, Homo sapiens
  misc_feature 1..23: note = chr8:104488605-104488628
  misc_feature 1..23: note = hypo
  source 1..23: mol_type = genomic DNA
actgcgcccggcccataatatat

SEQ ID NO: 62363 - DNA, 30 bp, Homo sapiens; identical to SEQ ID NO: 41886
  misc_feature 1..30: note = chr8:105386063-105386093
  misc_feature 1..30: note = hypo
  source 1..30: mol_type = genomic DNA

SEQ ID NO: 62364 - DNA, 30 bp, Homo sapiens; identical to SEQ ID NO: 41887
  misc_feature 1..30: note = chr8:105456591-105456621
  misc_feature 1..30: note = hypo
  source 1..30: mol_type = genomic DNA

SEQ ID NO: 62365 - DNA, 20 bp, Homo sapiens
  misc_feature 1..20: note = chr8:105645632-105645652
  misc_feature 1..20: note = hypo
  source 1..20: mol_type = genomic DNA
gcgagcgagggctgttggca

SEQ ID NO: 62366 - DNA, 30 bp, Homo sapiens; identical to SEQ ID NO: 41889
  misc_feature 1..30: note = chr8:106433918-106433948
  misc_feature 1..30: note = hypo
  source 1..30: mol_type = genomic DNA

SEQ ID NO: 62367 - DNA, 30 bp, Homo sapiens; identical to SEQ ID NO: 15145
  misc_feature 1..30: note = chr8:106500552-106500582
  misc_feature 1..30: note = hypo
  source 1..30: mol_type = genomic DNA

SEQ ID NO: 62368 - DNA, 16 bp, Homo sapiens
  misc_feature 1..16: note = chr8:106706503-106706519
  misc_feature 1..16: note = hypo
  source 1..16: mol_type = genomic DNA
gcgcccagcctctcca

SEQ ID NO: 62369 - DNA, 30 bp, Homo sapiens; identical to SEQ ID NO: 41892
  misc_feature 1..30: note = chr8:107359293-107359323
  misc_feature 1..30: note = hypo
  source 1..30: mol_type = genomic DNA

SEQ ID NO: 62370 - DNA, 185 bp, Homo sapiens; identical to SEQ ID NO: 41893
  misc_feature 1..185: note = chr8:107531614-107531799
  misc_feature 1..185: note = hypo
  source 1..185: mol_type = genomic DNA

SEQ ID NO: 62371 - DNA, 150 bp, Homo sapiens; identical to SEQ ID NO: 41894
  misc_feature 1..150: note = chr8:108134676-108134826
  misc_feature 1..150: note = hypo
  source 1..150: mol_type = genomic DNA

SEQ ID NO: 62372 - DNA, 77 bp, Homo sapiens; identical to SEQ ID NO: 41895
  misc_feature 1..77: note = chr8:108582504-108582581
  misc_feature 1..77: note = hypo
  source 1..77: mol_type = genomic DNA

SEQ ID NO: 62373 - DNA, 17 bp, Homo sapiens
  misc_feature 1..17: note = chr8:108582641-108582658
  misc_feature 1..17: note = hypo
  source 1..17: mol_type = genomic DNA
ggcggagaaaatattac

SEQ ID NO: 62374 - DNA, 30 bp, Homo sapiens; identical to SEQ ID NO: 41897
  misc_feature 1..30: note = chr8:108588091-108588121
  misc_feature 1..30: note = hypo
  source 1..30: mol_type = genomic DNA

SEQ ID NO: 62375 - DNA, 41 bp, Homo sapiens; identical to SEQ ID NO: 41898
  misc_feature 1..41: note = chr8:108593714-108593755
  misc_feature 1..41: note = hypo
  source 1..41: mol_type = genomic DNA

SEQ ID NO: 62376 - DNA, 30 bp, Homo sapiens; identical to SEQ ID NO: 41899
  misc_feature 1..30: note = chr8:108601942-108601972
  misc_feature 1..30: note = hypo
  source 1..30: mol_type = genomic DNA

SEQ ID NO: 62377 - DNA, 30 bp, Homo sapiens; identical to SEQ ID NO: 41900
  misc_feature 1..30: note = chr8:108957755-108957785
  misc_feature 1..30: note = hypo
  source 1..30: mol_type = genomic DNA

SEQ ID NO: 62378 - DNA, 16 bp, Homo sapiens
  misc_feature 1..16: note = chr8:110274990-110275006
  misc_feature 1..16: note = hypo
  source 1..16: mol_type = genomic DNA
aaacctgaatgtggcc

SEQ ID NO: 62379 - DNA, 171 bp, Homo sapiens; identical to SEQ ID NO: 15148
  misc_feature 1..171: note = chr8:110548417-110548588
  misc_feature 1..171: note = hypo
  source 1..171: mol_type = genomic DNA

SEQ ID NO: 62380 - DNA, 30 bp, Homo sapiens; identical to SEQ ID NO: 15149
  misc_feature 1..30: note = chr8:110961977-110962007
  misc_feature 1..30: note = hypo
  source 1..30: mol_type = genomic DNA

SEQ ID NO: 62381 - DNA, 30 bp, Homo sapiens; identical to SEQ ID NO: 41905
  misc_feature 1..30: note = chr8:111586661-111586691
  misc_feature 1..30: note = hypo
  source 1..30: mol_type = genomic DNA

SEQ ID NO: 62382 - DNA, 34 bp, Homo sapiens; identical to SEQ ID NO: 41906
  misc_feature 1..34: note = chr8:112636593-112636627
  misc_feature 1..34: note = hypo
  source 1..34: mol_type = genomic DNA

SEQ ID NO: 62383 - DNA, 30 bp, Homo sapiens; identical to SEQ ID NO: 41907
  misc_feature 1..30: note = chr8:113146243-113146273
  misc_feature 1..30: note = hypo
  source 1..30: mol_type = genomic DNA

SEQ ID NO: 62384 - DNA, 191 bp, Homo sapiens; identical to SEQ ID NO: 41908
  misc_feature 1..191: note = chr8:113175066-113175257
  misc_feature 1..191: note = hypo
  source 1..191: mol_type = genomic DNA

SEQ ID NO: 62385 - DNA, 38 bp, Homo sapiens; identical to SEQ ID NO: 41909
  misc_feature 1..38: note = chr8:113221643-113221681
  misc_feature 1..38: note = hypo
  source 1..38: mol_type = genomic DNA

SEQ ID NO: 62386 - DNA, 30 bp, Homo sapiens; identical to SEQ ID NO: 41910
  misc_feature 1..30: note = chr8:115649508-115649538
  misc_feature 1..30: note = hypo
  source 1..30: mol_type = genomic DNA

SEQ ID NO: 62387 - DNA, 170 bp, Homo sapiens; identical to SEQ ID NO: 41911
  misc_feature 1..170: note = chr8:116710279-116710449
  misc_feature 1..170: note = hypo
  source 1..170: mol_type = genomic DNA

SEQ ID NO: 62388 - DNA, 30 bp, Homo sapiens; identical to SEQ ID NO: 15150
  misc_feature 1..30: note = chr8:117824014-117824044
  misc_feature 1..30: note = hypo
  source 1..30: mol_type = genomic DNA

SEQ ID NO: 62389 - DNA, 16 bp, Homo sapiens
  misc_feature 1..16: note = chr8:120695441-120695457
  misc_feature 1..16: note = hypo
  source 1..16: mol_type = genomic DNA
gcgcccagcctttata

SEQ ID NO: 62390 - DNA, 38 bp, Homo sapiens; identical to SEQ ID NO: 15151
  misc_feature 1..38: note = chr8:121206396-121206434
  misc_feature 1..38: note = hypo
  source 1..38: mol_type = genomic DNA

SEQ ID NO: 62391 - DNA, 30 bp, Homo sapiens; identical to SEQ ID NO: 41916
  misc_feature 1..30: note = chr8:121354745-121354775
  misc_feature 1..30: note = hypo
  source 1..30: mol_type = genomic DNA

SEQ ID NO: 62392 - DNA, 30 bp, Homo sapiens; identical to SEQ ID NO: 41917
  misc_feature 1..30: note = chr8:121566445-121566475
  misc_feature 1..30: note = hypo
  source 1..30: mol_type = genomic DNA

SEQ ID NO: 62393 - DNA, 30 bp, Homo sapiens; identical to SEQ ID NO: 41918
  misc_feature 1..30: note = chr8:121573169-121573199
  misc_feature 1..30: note = hypo
  source 1..30: mol_type = genomic DNA

SEQ ID NO: 62394 - DNA, 75 bp, Homo sapiens; identical to SEQ ID NO: 41919
  misc_feature 1..75: note = chr8:121712263-121712338
  misc_feature 1..75: note = hypo
  source 1..75: mol_type = genomic DNA

SEQ ID NO: 62395 - DNA, 183 bp, Homo sapiens; identical to SEQ ID NO: 41920
  misc_feature 1..183: note = chr8:121732132-121732315
  misc_feature 1..183: note = hypo
  source 1..183: mol_type = genomic DNA

SEQ ID NO: 62396 - DNA, 89 bp, Homo sapiens; identical to SEQ ID NO: 41921
  misc_feature 1..89: note = chr8:121825686-121825775
  misc_feature 1..89: note = hypo
  source 1..89: mol_type = genomic DNA

SEQ ID NO: 62397 - DNA, 144 bp, Homo sapiens; identical to SEQ ID NO: 41922
  misc_feature 1..144: note = chr8:121982491-121982635
  misc_feature 1..144: note = hypo
  source 1..144: mol_type = genomic DNA

SEQ ID NO: 62398 - DNA, 43 bp, Homo sapiens
  misc_feature 1..43: note = chr8:123695489-123695532
  misc_feature 1..43: note = hypo
  source 1..43: mol_type = genomic DNA
gagaaatttaaagggcgagagatggcggcaggccagttgcgcc

SEQ ID NO: 62399 - DNA, 39 bp, Homo sapiens
  misc_feature 1..39: note = chr8:123695660-123695699
  misc_feature 1..39: note = hypo
  source 1..39: mol_type = genomic DNA
ggtgagggagaagcagtggaggaacggtcagaagagatg

SEQ ID NO: 62400 - DNA, 347 bp, Homo sapiens; identical to SEQ ID NO: 41924
  misc_feature 1..347: note = chr8:123966045-123966392
  misc_feature 1..347: note = hypo
  source 1..347: mol_type = genomic DNA

SEQ ID NO: 62401 - DNA, 105 bp, Homo sapiens; identical to SEQ ID NO: 41925
  misc_feature 1..105: note = chr8:124055130-124055235
  misc_feature 1..105: note = hypo
  source 1..105: mol_type = genomic DNA

SEQ ID NO: 62402 - DNA, 45 bp, Homo sapiens; identical to SEQ ID NO: 41926
  misc_feature 1..45: note = chr8:124055535-124055580
  misc_feature 1..45: note = hypo
  source 1..45: mol_type = genomic DNA

SEQ ID NO: 62403 - DNA, 17 bp, Homo sapiens
  misc_feature 1..17: note = chr8:124288888-124288905
  misc_feature 1..17: note = hypo
  source 1..17: mol_type = genomic DNA
gccgatgactaggtttt

SEQ ID NO: 62404 - DNA, 20 bp, Homo sapiens
  misc_feature 1..20: note = chr8:124428122-124428142
  misc_feature 1..20: note = hypo
  source 1..20: mol_type = genomic DNA
gcacccggccctaaacacta

SEQ ID NO: 62405 - DNA, 64 bp, Homo sapiens
  misc_feature 1..64: note = chr8:125452302-125452366
  misc_feature 1..64: note = hypo
  source 1..64: mol_type = genomic DNA
tgccaaacacactcacgcacctgactatcctgtcagtaagggattgttttttggtgtttgtttg

SEQ ID NO: 62406 - DNA, 36 bp, Homo sapiens; identical to SEQ ID NO: 41930
  misc_feature 1..36: note = chr8:125452639-125452675
  misc_feature 1..36: note = hypo
  source 1..36: mol_type = genomic DNA

SEQ ID NO: 62407 - DNA, 30 bp, Homo sapiens; identical to SEQ ID NO: 41931
  misc_feature 1..30: note = chr8:125568984-125569014
  misc_feature 1..30: note = hypo
  source 1..30: mol_type = genomic DNA

SEQ ID NO: 62408 - DNA, 121 bp, Homo sapiens; identical to SEQ ID NO: 41932
  misc_feature 1..121: note = chr8:126267003-126267124
  misc_feature 1..121: note = hypo
  source 1..121: mol_type = genomic DNA

SEQ ID NO: 62409 - DNA, 30 bp, Homo sapiens; identical to SEQ ID NO: 41933
  misc_feature 1..30: note = chr8:126284175-126284205
  misc_feature 1..30: note = hypo
  source 1..30: mol_type = genomic DNA

SEQ ID NO: 62410 - DNA, 97 bp, Homo sapiens; identical to SEQ ID NO: 15154
  misc_feature 1..97: note = chr8:127305217-127305314
  misc_feature 1..97: note = hypo
  source 1..97: mol_type = genomic DNA

SEQ ID NO: 62411 - DNA, 39 bp, Homo sapiens; identical to SEQ ID NO: 41936
  misc_feature 1..39: note = chr8:128864120-128864159
  misc_feature 1..39: note = hypo
  source 1..39: mol_type = genomic DNA

SEQ ID NO: 62412 - DNA, 63 bp, Homo sapiens
  misc_feature 1..63: note = chr8:128872322-128872385
  misc_feature 1..63: note = hypo
  source 1..63: mol_type = genomic DNA
cagggctaccaggaacggtgtgtgtgcctctgggcagggccacttcctagaaccatggggctg

SEQ ID NO: 62413 - DNA, 24 bp, Homo sapiens
  misc_feature 1..24: note = chr8:128872415-128872439
  misc_feature 1..24: note = hypo
  source 1..24: mol_type = genomic DNA
tccaggagacgaggagcaggtcct

SEQ ID NO: 62414 - DNA, 265 bp, Homo sapiens; identical to SEQ ID NO: 41938
  misc_feature 1..265: note = chr8:128888983-128889248
  misc_feature 1..265: note = hypo
  source 1..265: mol_type = genomic DNA

SEQ ID NO: 62415 - DNA, 35 bp, Homo sapiens; identical to SEQ ID NO: 41940
  misc_feature 1..35: note = chr8:128962506-128962541
  misc_feature 1..35: note = hypo
  source 1..35: mol_type = genomic DNA

SEQ ID NO: 62416 - DNA, 202 bp, Homo sapiens; identical to SEQ ID NO: 41941
  misc_feature 1..202: note = chr8:129069803-129070005
  misc_feature 1..202: note = hypo
  source 1..202: mol_type = genomic DNA

SEQ ID NO: 62417 - DNA, 30 bp, Homo sapiens; identical to SEQ ID NO: 41942
  misc_feature 1..30: note = chr8:130080387-130080417
  misc_feature 1..30: note = hypo
  source 1..30: mol_type = genomic DNA

SEQ ID NO: 62418 - DNA, 30 bp, Homo sapiens; identical to SEQ ID NO: 15159
  misc_feature 1..30: note = chr8:130116433-130116463
  misc_feature 1..30: note = hypo
  source 1..30: mol_type = genomic DNA

SEQ ID NO: 62419 - DNA, 203 bp, Homo sapiens; identical to SEQ ID NO: 41944
  misc_feature 1..203: note = chr8:130288699-130288902
  misc_feature 1..203: note = hypo
  source 1..203: mol_type = genomic DNA

SEQ ID NO: 62420 - DNA, 209 bp, Homo sapiens; identical to SEQ ID NO: 41945
  misc_feature 1..209: note = chr8:130368840-130369049
  misc_feature 1..209: note = hypo
  source 1..209: mol_type = genomic DNA

SEQ ID NO: 62421 - DNA, 14 bp, Homo sapiens
  misc_feature 1..14: note = chr8:130369364-130369378
  misc_feature 1..14: note = hypo
  source 1..14: mol_type = genomic DNA
gaccctgagaagtt

SEQ ID NO: 62422 - DNA, 31 bp, Homo sapiens; identical to SEQ ID NO: 41947
  misc_feature 1..31: note = chr8:130461175-130461206
  misc_feature 1..31: note = hypo
  source 1..31: mol_type = genomic DNA

SEQ ID NO: 62423 - DNA, 201 bp, Homo sapiens; identical to SEQ ID NO: 41948
  misc_feature 1..201: note = chr8:130583277-130583478
  misc_feature 1..201: note = hypo
  source 1..201: mol_type = genomic DNA

SEQ ID NO: 62424 - DNA, 23 bp, Homo sapiens
  misc_feature 1..23: note = chr8:131922190-131922213
  misc_feature 1..23: note = hypo
  source 1..23: mol_type = genomic DNA
tttttttttttgagacggagttt

SEQ ID NO: 62425 - DNA, 30 bp, Homo sapiens; identical to SEQ ID NO: 41950
  misc_feature 1..30: note = chr8:132284091-132284121
  misc_feature 1..30: note = hypo
  source 1..30: mol_type = genomic DNA

SEQ ID NO: 62426 - DNA, 30 bp, Homo sapiens; identical to SEQ ID NO: 41951
  misc_feature 1..30: note = chr8:132783128-132783158
  misc_feature 1..30: note = hypo
  source 1..30: mol_type = genomic DNA

SEQ ID NO: 62427 - DNA, 36 bp, Homo sapiens; identical to SEQ ID NO: 41952
  misc_feature 1..36: note = chr8:133062829-133062865
  misc_feature 1..36: note = hypo
  source 1..36: mol_type = genomic DNA

SEQ ID NO: 62428 - DNA, 132 bp, Homo sapiens; identical to SEQ ID NO: 15163
  misc_feature 1..132: note = chr8:133811037-133811169
  misc_feature 1..132: note = hypo
  source 1..132: mol_type = genomic DNA

SEQ ID NO: 62429 - DNA, 179 bp, Homo sapiens; identical to SEQ ID NO: 41955
  misc_feature 1..179: note = chr8:134470121-134470300
  misc_feature 1..179: note = hypo
  source 1..179: mol_type = genomic DNA

SEQ ID NO: 62430 - DNA, 45 bp, Homo sapiens; identical to SEQ ID NO: 41956
  misc_feature 1..45: note = chr8:134541589-134541634
  misc_feature 1..45: note = hypo
  source 1..45: mol_type = genomic DNA

SEQ ID NO: 62431 - DNA, 34 bp, Homo sapiens; identical to SEQ ID NO: 41957
  misc_feature 1..34: note = chr8:135301251-135301285
  misc_feature 1..34: note = hypo
  source 1..34: mol_type = genomic DNA

SEQ ID NO: 62432 - DNA, 154 bp, Homo sapiens; identical to SEQ ID NO: 41958
  misc_feature 1..154: note = chr8:138910227-138910381
  misc_feature 1..154: note = hypo
  source 1..154: mol_type = genomic DNA

SEQ ID NO: 62433 - DNA, 30 bp, Homo sapiens; identical to SEQ ID NO: 41959
  misc_feature 1..30: note = chr8:140630956-140630986
  misc_feature 1..30: note = hypo
  source 1..30: mol_type = genomic DNA

SEQ ID NO: 62434 - DNA, 37 bp, Homo sapiens; identical to SEQ ID NO: 41960
  misc_feature 1..37: note = chr8:140691457-140691494
  misc_feature 1..37: note = hypo
  source 1..37: mol_type = genomic DNA

SEQ ID NO: 62435 - DNA, 89 bp, Homo sapiens; identical to SEQ ID NO: 24485
  misc_feature 1..89: note = chr8:140834148-140834237
  misc_feature 1..89: note = hypo
  source 1..89: mol_type = genomic DNA

SEQ ID NO: 62436 - DNA, 130 bp, Homo sapiens; identical to SEQ ID NO: 41962
  misc_feature 1..130: note = chr8:140834841-140834971
  misc_feature 1..130: note = hypo
  source 1..130: mol_type = genomic DNA

SEQ ID NO: 62437 - DNA, 30 bp, Homo sapiens; identical to SEQ ID NO: 41964
  misc_feature 1..30: note = chr8:141018127-141018157
  misc_feature 1..30: note = hypo
  source 1..30: mol_type = genomic DNA

SEQ ID NO: 62438 - DNA, 30 bp, Homo sapiens; identical to SEQ ID NO: 41965
  misc_feature 1..30: note = chr8:141054547-141054577
  misc_feature 1..30: note = hypo
  source 1..30: mol_type = genomic DNA

SEQ ID NO: 62439 - DNA, 41 bp, Homo sapiens; identical to SEQ ID NO: 41966
  misc_feature 1..41: note = chr8:141106960-141107001
  misc_feature 1..41: note = hypo
  source 1..41: mol_type = genomic DNA

SEQ ID NO: 62440 - DNA, 133 bp, Homo sapiens; identical to SEQ ID NO: 41967
  misc_feature 1..133: note = chr8:141107540-141107673
  misc_feature 1..133: note = hypo
  source 1..133: mol_type = genomic DNA

SEQ ID NO: 62441 - DNA, 218 bp, Homo sapiens; identical to SEQ ID NO: 41969
  misc_feature 1..218: note = chr8:141202517-141202735
  misc_feature 1..218: note = hypo
  source 1..218: mol_type = genomic DNA

SEQ ID NO: 62442 - DNA, 30 bp, Homo sapiens; identical to SEQ ID NO: 41970
  misc_feature 1..30: note = chr8:141249579-141249609
  misc_feature 1..30: note = hypo
  source 1..30: mol_type = genomic DNA

SEQ ID NO: 62443 - DNA, 196 bp, Homo sapiens; identical to SEQ ID NO: 41971
  misc_feature 1..196: note = chr8:141466557-141466753
  misc_feature 1..196: note = hypo
  source 1..196: mol_type = genomic DNA

SEQ ID NO: 62444 - DNA, 30 bp, Homo sapiens; identical to SEQ ID NO: 41972
  misc_feature 1..30: note = chr8:141566854-141566884
  misc_feature 1..30: note = hypo
  source 1..30: mol_type = genomic DNA

SEQ ID NO: 62445 - DNA, 47 bp, Homo sapiens
  misc_feature 1..47: note = chr8:141588132-141588179
  misc_feature 1..47: note = hypo
  source 1..47: mol_type = genomic DNA
cagacaatcctggccaccactcaggcctccgccgcccagagagagca

SEQ ID NO: 62446 - DNA, 30 bp, Homo sapiens; identical to SEQ ID NO: 41974
  misc_feature 1..30: note = chr8:141594857-141594887
  misc_feature 1..30: note = hypo
  source 1..30: mol_type = genomic DNA

SEQ ID NO: 62447 - DNA, 67 bp, Homo sapiens
  misc_feature 1..67: note = chr8:141596819-141596886
  misc_feature 1..67: note = hypo
  source 1..67: mol_type = genomic DNA
ctctctacgccacaccggagtagaacaaagcacttgccaacacgtggccctgttctcaggtggctcc

SEQ ID NO: 62448 - DNA, 75 bp, Homo sapiens
  misc_feature 1..75: note = chr8:141597022-141597097
  misc_feature 1..75: note = hypo
  source 1..75: mol_type = genomic DNA
tacaaggtgctcatgcagttacttaaccgagcctcacaaccataccacaaaggggcacaccgctggctgcaagaa

SEQ ID NO: 62449 - DNA, 30 bp, Homo sapiens; identical to SEQ ID NO: 41976
  misc_feature 1..30: note = chr8:141600227-141600257
  misc_feature 1..30: note = hypo
  source 1..30: mol_type = genomic DNA

SEQ ID NO: 62450 - DNA, 30 bp, Homo sapiens; identical to SEQ ID NO: 41977
  misc_feature 1..30: note = chr8:141602372-141602402
  misc_feature 1..30: note = hypo
  source 1..30: mol_type = genomic DNA

SEQ ID NO: 62451 - DNA, 35 bp, Homo sapiens; identical to SEQ ID NO: 41978
  misc_feature 1..35: note = chr8:141624396-141624431
  misc_feature 1..35: note = hypo
  source 1..35: mol_type = genomic DNA

SEQ ID NO: 62452 - DNA, 30 bp, Homo sapiens; identical to SEQ ID NO: 41979
  misc_feature 1..30: note = chr8:142231672-142231702
  misc_feature 1..30: note = hypo
  source 1..30: mol_type = genomic DNA

SEQ ID NO: 62453 - DNA, 30 bp, Homo sapiens; identical to SEQ ID NO: 41980
  misc_feature 1..30: note = chr8:142243948-142243978
  misc_feature 1..30: note = hypo
  source 1..30: mol_type = genomic DNA

SEQ ID NO: 62454 - DNA, 30 bp, Homo sapiens; identical to SEQ ID NO: 41981
  misc_feature 1..30: note = chr8:142244184-142244214
  misc_feature 1..30: note = hypo
  source 1..30: mol_type = genomic DNA

SEQ ID NO: 62455 - DNA, 22 bp, Homo sapiens
  misc_feature 1..22: note = chr8:142313512-142313534
  misc_feature 1..22: note = hypo
  source 1..22: mol_type = genomic DNA
gcaggaacgagcctctgtgccc

SEQ ID NO: 62456 - DNA, 30 bp, Homo sapiens; identical to SEQ ID NO: 41984
  misc_feature 1..30: note = chr8:142323052-142323082
  misc_feature 1..30: note = hypo
  source 1..30: mol_type = genomic DNA

SEQ ID NO: 62457 - DNA, 34 bp, Homo sapiens
  misc_feature 1..34: note = chr8:142367790-142367824
  misc_feature 1..34: note = hypo
  source 1..34: mol_type = genomic DNA
aagacgtacagcgccagcccgttgagcaccagcc

SEQ ID NO: 62458 - DNA, 72 bp, Homo sapiens; identical to SEQ ID NO: 41986
  misc_feature 1..72: note = chr8:142432225-142432297
  misc_feature 1..72: note = hypo
  source 1..72: mol_type = genomic DNA

SEQ ID NO: 62459 - DNA, 30 bp, Homo sapiens; identical to SEQ ID NO: 41987
  misc_feature 1..30: note = chr8:142439319-142439349
  misc_feature 1..30: note = hypo
  source 1..30: mol_type = genomic DNA

SEQ ID NO: 62460 - DNA, 42 bp, Homo sapiens; identical to SEQ ID NO: 41988
  misc_feature 1..42: note = chr8:142452256-142452298
  misc_feature 1..42: note = hypo
  source 1..42: mol_type = genomic DNA

SEQ ID NO: 62461 - DNA, 30 bp, Homo sapiens; identical to SEQ ID NO: 41989
  misc_feature 1..30: note = chr8:142501450-142501480
  misc_feature 1..30: note = hypo
  source 1..30: mol_type = genomic DNA

SEQ ID NO: 62462 - DNA, 15 bp, Homo sapiens
  misc_feature 1..15: note = chr8:142535328-142535343
  misc_feature 1..15: note = hypo
  source 1..15: mol_type = genomic DNA
gagagagggtcagga

SEQ ID NO: 62463 - DNA, 11 bp, Homo sapiens
  misc_feature 1..11: note = chr8:142535496-142535507
  misc_feature 1..11: note = hypo
  source 1..11: mol_type = genomic DNA
gacctgcctgc

SEQ ID NO: 62464 - DNA, 144 bp, Homo sapiens; identical to SEQ ID NO: 41991
  misc_feature 1..144: note = chr8:142553829-142553973
  misc_feature 1..144: note = hypo
  source 1..144: mol_type = genomic DNA

SEQ ID NO: 62465 - DNA, 37 bp, Homo sapiens; identical to SEQ ID NO: 41992
  misc_feature 1..37: note = chr8:142560165-142560202
  misc_feature 1..37: note = hypo
  source 1..37: mol_type = genomic DNA

SEQ ID NO: 62466 - DNA, 124 bp, Homo sapiens; identical to SEQ ID NO: 41994
  misc_feature 1..124: note = chr8:142583056-142583180
  misc_feature 1..124: note = hypo
  source 1..124: mol_type = genomic DNA

SEQ ID NO: 62467 - DNA, 144 bp, Homo sapiens; identical to SEQ ID NO: 41995
  misc_feature 1..144: note = chr8:142593584-142593728
  misc_feature 1..144: note = hypo
  source 1..144: mol_type = genomic DNA

SEQ ID NO: 62468 - DNA, 30 bp, Homo sapiens; identical to SEQ ID NO: 41996
  misc_feature 1..30: note = chr8:142680135-142680165
  misc_feature 1..30: note = hypo
  source 1..30: mol_type = genomic DNA

SEQ ID NO: 62469 - DNA, 30 bp, Homo sapiens; identical to SEQ ID NO: 15174
  misc_feature 1..30: note = chr8:142694812-142694842
  misc_feature 1..30: note = hypo
  source 1..30: mol_type = genomic DNA

SEQ ID NO: 62470 - DNA, 193 bp, Homo sapiens; identical to SEQ ID NO: 41998
  misc_feature 1..193: note = chr8:142706678-142706871
  misc_feature 1..193: note = hypo
  source 1..193: mol_type = genomic DNA

SEQ ID NO: 62471 - DNA, 114 bp, Homo sapiens; identical to SEQ ID NO: 41999
  misc_feature 1..114: note = chr8:142939132-142939246
  misc_feature 1..114: note = hypo
  source 1..114: mol_type = genomic DNA

SEQ ID NO: 62472 - DNA, 97 bp, Homo sapiens; identical to SEQ ID NO: 42000
  misc_feature 1..97: note = chr8:143054769-143054866
  misc_feature 1..97: note = hypo
  source 1..97: mol_type = genomic DNA

SEQ ID NO: 62473 - DNA, 97 bp, Homo sapiens; identical to SEQ ID NO: 42001
  misc_feature 1..97: note = chr8:143054986-143055083
  misc_feature 1..97: note = hypo
  source 1..97: mol_type = genomic DNA

SEQ ID NO: 62474 - DNA, 33 bp, Homo sapiens; identical to SEQ ID NO: 42002
  misc_feature 1..33: note = chr8:143088493-143088526
  misc_feature 1..33: note = hypo
  source 1..33: mol_type = genomic DNA

SEQ ID NO: 62475 - DNA, 31 bp, Homo sapiens
  misc_feature 1..31: note = chr8:143088999-143089030
  misc_feature 1..31: note = hypo
  source 1..31: mol_type = genomic DNA
ggactaaagtcccctcgagcgcctcagggtc

SEQ ID NO: 62476 - DNA, 30 bp, Homo sapiens; identical to SEQ ID NO: 42004
  misc_feature 1..30: note = chr8:143090706-143090736
  misc_feature 1..30: note = hypo
  source 1..30: mol_type = genomic DNA

SEQ ID NO: 62477 - DNA, 33 bp, Homo sapiens; identical to SEQ ID NO: 15178
  misc_feature 1..33: note = chr8:143097424-143097457
  misc_feature 1..33: note = hypo
  source 1..33: mol_type = genomic DNA

SEQ ID NO: 62478 - DNA, 33 bp, Homo sapiens
  misc_feature 1..33: note = chr8:143105211-143105244
  misc_feature 1..33: note = hypo
  source 1..33: mol_type = genomic DNA
ctgcgccagctcagccgtctgtctcaggcaggc

SEQ ID NO: 62479 - DNA, 30 bp, Homo sapiens; identical to SEQ ID NO: 42007
  misc_feature 1..30: note = chr8:143128771-143128801
  misc_feature 1..30: note = hypo
  source 1..30: mol_type = genomic DNA

SEQ ID NO: 62480 - DNA, 30 bp, Homo sapiens; identical to SEQ ID NO: 42008
  misc_feature 1..30: note = chr8:143156215-143156245
  misc_feature 1..30: note = hypo
  source 1..30: mol_type = genomic DNA

SEQ ID NO: 62481 - DNA, 102 bp, Homo sapiens; identical to SEQ ID NO: 42009
  misc_feature 1..102: note = chr8:143171156-143171258
  misc_feature 1..102: note = hypo
  source 1..102: mol_type = genomic DNA

SEQ ID NO: 62482 - DNA, 39 bp, Homo sapiens; identical to SEQ ID NO: 42010
  misc_feature 1..39: note = chr8:143198927-143198966
  misc_feature 1..39: note = hypo
  source 1..39: mol_type = genomic DNA

SEQ ID NO: 62483 - DNA, 144 bp, Homo sapiens; identical to SEQ ID NO: 42011
  misc_feature 1..144: note = chr8:143210699-143210843
  misc_feature 1..144: note = hypo
  source 1..144: mol_type = genomic DNA

SEQ ID NO: 62484 - DNA, 66 bp, Homo sapiens; identical to SEQ ID NO: 42012
  misc_feature 1..66: note = chr8:143217605-143217671
  misc_feature 1..66: note = hypo
  source 1..66: mol_type = genomic DNA

SEQ ID NO: 62485 - DNA, 30 bp, Homo sapiens; identical to SEQ ID NO: 42013
  misc_feature 1..30: note = chr8:143265172-143265202
  misc_feature 1..30: note = hypo
  source 1..30: mol_type = genomic DNA

SEQ ID NO: 62486 - DNA, 43 bp, Homo sapiens; identical to SEQ ID NO: 42014
  misc_feature 1..43: note = chr8:143314664-143314707
  misc_feature 1..43: note = hypo
  source 1..43: mol_type = genomic DNA

SEQ ID NO: 62487 - DNA, 365 bp, Homo sapiens; identical to SEQ ID NO: 42015
  misc_feature 1..365: note = chr8:143317093-143317458
  misc_feature 1..365: note = hypo
  source 1..365: mol_type = genomic DNA

SEQ ID NO: 62488 - DNA, 30 bp, Homo sapiens; identical to SEQ ID NO: 42016
  misc_feature 1..30: note = chr8:143326109-143326139
  misc_feature 1..30: note = hypo
  source 1..30: mol_type = genomic DNA

SEQ ID NO: 62489 - DNA, 32 bp, Homo sapiens; identical to SEQ ID NO: 42017
  misc_feature 1..32: note = chr8:143333080-143333112
  misc_feature 1..32: note = hypo
  source 1..32: mol_type = genomic DNA

SEQ ID NO: 62490 - DNA, 278 bp, Homo sapiens; identical to SEQ ID NO: 42018
  misc_feature 1..278: note = chr8:143333390-143333668
  misc_feature 1..278: note = hypo
  source 1..278: mol_type = genomic DNA

SEQ ID NO: 62491 - DNA, 76 bp, Homo sapiens; identical to SEQ ID NO: 42019
  misc_feature 1..76: note = chr8:143334563-143334639
  misc_feature 1..76: note = hypo
  source 1..76: mol_type = genomic DNA

SEQ ID NO: 62492 - DNA, 30 bp, Homo sapiens; identical to SEQ ID NO: 42020
  misc_feature 1..30: note = chr8:143386910-143386940
  misc_feature 1..30: note = hypo
  source 1..30: mol_type = genomic DNA

SEQ ID NO: 62493 - DNA, 179 bp, Homo sapiens; identical to SEQ ID NO: 42021
  misc_feature 1..179: note = chr8:143405792-143405971
  misc_feature 1..179: note = hypo
  source 1..179: mol_type = genomic DNA

SEQ ID NO: 62494 - DNA, 241 bp, Homo sapiens; identical to SEQ ID NO: 42022
  misc_feature 1..241: note = chr8:143436977-143437218
  misc_feature 1..241: note = hypo
  source 1..241: mol_type = genomic DNA

SEQ ID NO: 62495 - DNA, 52 bp, Homo sapiens; identical to SEQ ID NO: 42023
  misc_feature 1..52: note = chr8:143463629-143463681
  misc_feature 1..52: note = hypo
  source 1..52: mol_type = genomic DNA

SEQ ID NO: 62496 - DNA, 268 bp, Homo sapiens
  misc_feature 1..268: note = chr8:143509189-143509457
  misc_feature 1..268: note = hypo
  source 1..268: mol_type = genomic DNA
cgctccctttctccacggcacctctgtgattctcgtcacctgccaacaccagcaccagggctgcccctcctgacggccccctcgccgtctttctgggcacactccatcggcacagcgtcttcactgtcctcctgacaaacctcgtgccacccccatcagcttcagcaccacctccacagcagccgtggccagcaccgacgtccttttccgtcaccgtcaagcctcaaaactgggaccgtgggtaatggcgtcaccccatccgccgtct

SEQ ID NO: 62497 - DNA, 64 bp, Homo sapiens; identical to SEQ ID NO: 42025
  misc_feature 1..64: note = chr8:143511468-143511532
  misc_feature 1..64: note = hypo
  source 1..64: mol_type = genomic DNA

SEQ ID NO: 62498 - DNA, 40 bp, Homo sapiens; identical to SEQ ID NO: 42026
  misc_feature 1..40: note = chr8:143535787-143535827
  misc_feature 1..40: note = hypo
  source 1..40: mol_type = genomic DNA

SEQ ID NO: 62499 - DNA, 49 bp, Homo sapiens; identical to SEQ ID NO: 42027
  misc_feature 1..49: note = chr8:143538439-143538488
  misc_feature 1..49: note = hypo
  source 1..49: mol_type = genomic DNA

SEQ ID NO: 62500 - DNA, 205 bp, Homo sapiens; identical to SEQ ID NO: 42028
  misc_feature 1..205: note = chr8:143556064-143556269
  misc_feature 1..205: note = hypo
  source 1..205: mol_type = genomic DNA

SEQ ID NO: 62501 - DNA, 257 bp, Homo sapiens
  misc_feature 1..257: note = chr8:143557723-143557980
  misc_feature 1..257: note = hypo
  source 1..257: mol_type = genomic DNA
cagtgagggaggtggcgcggggtatgggagacaggacccacaggaagggtcccctggtgaccagatgagggctggtgccaggctgggcactctggtccctggctcccagctgcccagtggagccaggtggcccagtgctgccgaactcagagcactgtggccacagagagagaggacgggggcaaagaaccgctcctgtgctgacctaagcccgtcctgcagccgctgggcgcaccagctcccggagccagtccctg

SEQ ID NO: 62502 - DNA, 80 bp, Homo sapiens; identical to SEQ ID NO: 42030
  misc_feature 1..80: note = chr8:143558389-143558469
  misc_feature 1..80: note = hypo
  source 1..80: mol_type = genomic DNA

SEQ ID NO: 62503 - DNA, 294 bp, Homo sapiens; identical to SEQ ID NO: 42031
  misc_feature 1..294: note = chr8:143561118-143561412
  misc_feature 1..294: note = hypo
  source 1..294: mol_type = genomic DNA

SEQ ID NO: 62504 - DNA, 150 bp, Homo sapiens; identical to SEQ ID NO: 42032
  misc_feature 1..150: note = chr8:143567944-143568094
  misc_feature 1..150: note = hypo
  source 1..150: mol_type = genomic DNA

SEQ ID NO: 62505 - DNA, 30 bp, Homo sapiens; identical to SEQ ID NO: 42033
  misc_feature 1..30: note = chr8:143573208-143573238
  misc_feature 1..30: note = hypo
  source 1..30: mol_type = genomic DNA

SEQ ID NO: 62506 - DNA, 109 bp, Homo sapiens
  misc_feature 1..109: note = chr8:143587382-143587491
  misc_feature 1..109: note = hypo
  source 1..109: mol_type = genomic DNA
gcgcctgtgggcgcctgtgggactgtcatgcaccagaatgtgtccctggggccacatgtgtgagcagcgtgctgactgagcacctgggcgaccccgaggtggagtaaac

SEQ ID NO: 62507 - DNA, 242 bp, Homo sapiens; identical to SEQ ID NO: 42035
  misc_feature 1..242: note = chr8:143595579-143595821
  misc_feature 1..242: note = hypo
  source 1..242: mol_type = genomic DNA

SEQ ID NO: 62508 - DNA, 30 bp, Homo sapiens; identical to SEQ ID NO: 42036
  misc_feature 1..30: note = chr8:143599108-143599138
  misc_feature 1..30: note = hypo
  source 1..30: mol_type = genomic DNA

SEQ ID NO: 62509 - DNA, 30 bp, Homo sapiens; identical to SEQ ID NO: 42037
  misc_feature 1..30: note = chr8:143599572-143599602
  misc_feature 1..30: note = hypo
  source 1..30: mol_type = genomic DNA

SEQ ID NO: 62510 - DNA, 47 bp, Homo sapiens; identical to SEQ ID NO: 42038
  misc_feature 1..47: note = chr8:143618365-143618412
  misc_feature 1..47: note = hypo
  source 1..47: mol_type = genomic DNA

SEQ ID NO: 62511 - DNA, 34 bp, Homo sapiens; identical to SEQ ID NO: 42039
  misc_feature 1..34: note = chr8:143620764-143620798
  misc_feature 1..34: note = hypo
  source 1..34: mol_type = genomic DNA

SEQ ID NO: 62512 - DNA, 24 bp, Homo sapiens
  misc_feature 1..24: note = chr8:143621956-143621980
  misc_feature 1..24: note = hypo
  source 1..24: mol_type = genomic DNA
caaggtgggtacatgcgagggagg

SEQ ID NO: 62513 - DNA, 21 bp, Homo sapiens
  misc_feature 1..21: note = chr8:143622096-143622117
  misc_feature 1..21: note = hypo
  source 1..21: mol_type = genomic DNA
gcgtcccgagagtgctgtggc

SEQ ID NO: 62514 - DNA, 61 bp, Homo sapiens; identical to SEQ ID NO: 42041
  misc_feature 1..61: note = chr8:143623394-143623455
  misc_feature 1..61: note = hypo
  source 1..61: mol_type = genomic DNA

SEQ ID NO: 62515 - DNA, 30 bp, Homo sapiens; identical to SEQ ID NO: 42042
  misc_feature 1..30: note = chr8:143623905-143623935
  misc_feature 1..30: note = hypo
  source 1..30: mol_type = genomic DNA

SEQ ID NO: 62516 - DNA, 30 bp, Homo sapiens; identical to SEQ ID NO: 42043
  misc_feature 1..30: note = chr8:143624997-143625027
  misc_feature 1..30: note = hypo
  source 1..30: mol_type = genomic DNA

SEQ ID NO: 62517 - DNA, 34 bp, Homo sapiens; identical to SEQ ID NO: 42044
  misc_feature 1..34: note = chr8:143631480-143631514
  misc_feature 1..34: note = hypo
  source 1..34: mol_type = genomic DNA

SEQ ID NO: 62518 - DNA, 30 bp, Homo sapiens; identical to SEQ ID NO: 42045
  misc_feature 1..30: note = chr8:143656193-143656223
  misc_feature 1..30: note = hypo
  source 1..30: mol_type = genomic DNA

SEQ ID NO: 62519 - DNA, 30 bp, Homo sapiens; identical to SEQ ID NO: 42048
  misc_feature 1..30: note = chr8:143827179-143827209
  misc_feature 1..30: note = hypo
  source 1..30: mol_type = genomic DNA

SEQ ID NO: 62520 - DNA, 61 bp, Homo sapiens; identical to SEQ ID NO: 42049
  misc_feature 1..61: note = chr8:143833212-143833273
  misc_feature 1..61: note = hypo
  source 1..61: mol_type = genomic DNA

SEQ ID NO: 62521 - DNA, 99 bp, Homo sapiens; identical to SEQ ID NO: 42050
  misc_feature 1..99: note = chr8:143855667-143855766
  misc_feature 1..99: note = hypo
  source 1..99: mol_type = genomic DNA

SEQ ID NO: 62522 - skipped

SEQ ID NO: 62523 - DNA, 33 bp, Homo sapiens; identical to SEQ ID NO: 42052
  misc_feature 1..33: note = chr8:143879185-143879218
  misc_feature 1..33: note = hypo
  source 1..33: mol_type = genomic DNA

SEQ ID NO: 62524 - DNA, 30 bp, Homo sapiens; identical to SEQ ID NO: 42053
  misc_feature 1..30: note = chr8:143882149-143882179
  misc_feature 1..30: note = hypo
  source 1..30: mol_type = genomic DNA

SEQ ID NO: 62525 - DNA, 138 bp, Homo sapiens; identical to SEQ ID NO: 42054
  misc_feature 1..138: note = chr8:143960027-143960165
  misc_feature 1..138: note = hypo
  source 1..138: mol_type = genomic DNA

SEQ ID NO: 62526 - skipped

SEQ ID NO: 62527 - DNA, 34 bp, Homo sapiens; identical to SEQ ID NO: 42056
  misc_feature 1..34: note = chr8:143996499-143996533
  misc_feature 1..34: note = hypo
  source 1..34: mol_type = genomic DNA

SEQ ID NO: 62528 - DNA, 33 bp, Homo sapiens; identical to SEQ ID NO: 42057
  misc_feature 1..33: note = chr8:144015246-144015279
  misc_feature 1..33: note = hypo
  source 1..33: mol_type = genomic DNA

SEQ ID NO: 62529 - DNA, 141 bp, Homo sapiens; identical to SEQ ID NO: 42058
  misc_feature 1..141: note = chr8:144027680-144027821
  misc_feature 1..141: note = hypo
  source 1..141: mol_type = genomic DNA

SEQ ID NO: 62530 - DNA, 14 bp, Homo sapiens
  misc_feature 1..14: note = chr8:144069651-144069665
  misc_feature 1..14: note = hypo
  source 1..14: mol_type = genomic DNA
ggtgcaggtggcat

SEQ ID NO: 62531 - DNA, 151 bp, Homo sapiens; identical to SEQ ID NO: 42060
  misc_feature 1..151: note = chr8:144070508-144070659
  misc_feature 1..151: note = hypo
  source 1..151: mol_type = genomic DNA

SEQ ID NO: 62532 - DNA, 30 bp, Homo sapiens; identical to SEQ ID NO: 42061
  misc_feature 1..30: note = chr8:144090641-144090671
  misc_feature 1..30: note = hypo
  source 1..30: mol_type = genomic DNA

SEQ ID NO: 62533 - DNA, 128 bp, Homo sapiens; identical to SEQ ID NO: 42062
  misc_feature 1..128: note = chr8:144164496-144164624
  misc_feature 1..128: note = hypo
  source 1..128: mol_type = genomic DNA

SEQ ID NO: 62534 - DNA, 234 bp, Homo sapiens
  misc_feature 1..234: note = chr8:144203708-144203942
  misc_feature 1..234: note = hypo
  source 1..234: mol_type = genomic DNA
gaaggagccgactcaaggctgagtcccgcagccccgtgagggcggagtggaggttacggggcgggagcgggacgggaatctgagctcccagcagccgagccgagaggaaacccctgctcctgcccatgagcccagcagagcacatgccctggatgtcgagacgcggtccacagagagatgggctcctgtgactgtcctcggataggcctctggacgccacgccctagtgcagct

SEQ ID NO: 62535 - DNA, 30 bp, Homo sapiens; identical to SEQ ID NO: 15194
  misc_feature 1..30: note = chr8:144208784-144208814
  misc_feature 1..30: note = hypo
  source 1..30: mol_type = genomic DNA

SEQ ID NO: 62536 - DNA, 20 bp, Homo sapiens
  misc_feature 1..20: note = chr8:144226154-144226174
  misc_feature 1..20: note = hypo
  source 1..20: mol_type = genomic DNA
tggctcagcgctgcccgcac

SEQ ID NO: 62537 - DNA, 16 bp, Homo sapiens
  misc_feature 1..16: note = chr8:144238806-144238822
  misc_feature 1..16: note = hypo
  source 1..16: mol_type = genomic DNA
agacatgggcatgcac

SEQ ID NO: 62538 - DNA, 132 bp, Homo sapiens
  misc_feature 1..132: note = chr8:144238901-144239033
  misc_feature 1..132: note = hypo
  source 1..132: mol_type = genomic DNA
cctggggtgtgtgtgtgtgaaggagcagggcgggcacgggtgtgtgtgcacatgctggctgcgtgggcaccgtttgtatgcttgtctgggcatgagtgtgtgtgcacatgctggctgcgtgggcaccactgt

SEQ ID NO: 62539 - DNA, 67 bp, Homo sapiens; identical to SEQ ID NO: 42068
  misc_feature 1..67: note = chr8:144292403-144292470
  misc_feature 1..67: note = hypo
  source 1..67: mol_type = genomic DNA

SEQ ID NO: 62540 - DNA, 184 bp, Homo sapiens; identical to SEQ ID NO: 42069
  misc_feature 1..184: note = chr8:144293655-144293839
  misc_feature 1..184: note = hypo
  source 1..184: mol_type = genomic DNA

SEQ ID NO: 62541 - DNA, 147 bp, Homo sapiens; identical to SEQ ID NO: 42070
  misc_feature 1..147: note = chr8:144312859-144313006
  misc_feature 1..147: note = hypo
  source 1..147: mol_type = genomic DNA

SEQ ID NO: 62542 - DNA, 214 bp, Homo sapiens; identical to SEQ ID NO: 42071
  misc_feature 1..214: note = chr8:144326825-144327039
  misc_feature 1..214: note = hypo
  source 1..214: mol_type = genomic DNA

SEQ ID NO: 62543 - DNA, 38 bp, Homo sapiens
  misc_feature 1..38: note = chr8:144330380-144330418
  misc_feature 1..38: note = hypo
  source 1..38: mol_type = genomic DNA
agcctaagttgagtcgacagagccgttatggagaatgt

SEQ ID NO: 62544 - DNA, 511 bp, Homo sapiens; identical to SEQ ID NO: 42073
  misc_feature 1..511: note = chr8:144343481-144343992
  misc_feature 1..511: note = hypo
  source 1..511: mol_type = genomic DNA

SEQ ID NO: 62545 - DNA, 49 bp, Homo sapiens
  misc_feature 1..49: note = chr8:144344244-144344293
  misc_feature 1..49: note = hypo
  source 1..49: mol_type = genomic DNA
cctctgcacctcccacgcccctctccggcagcccctgcccacacccgca

SEQ ID NO: 62546 - DNA, 101 bp, Homo sapiens; identical to SEQ ID NO: 24521
  misc_feature 1..101: note = chr8:144344442-144344543
  misc_feature 1..101: note = hypo
  source 1..101: mol_type = genomic DNA

SEQ ID NO: 62547 - DNA, 30 bp, Homo sapiens; identical to SEQ ID NO: 42075
  misc_feature 1..30: note = chr8:144347029-144347059
  misc_feature 1..30: note = hypo
  source 1..30: mol_type = genomic DNA

SEQ ID NO: 62548 - DNA, 92 bp, Homo sapiens
  misc_feature 1..92: note = chr8:144360302-144360394
  misc_feature 1..92: note = hypo
  source 1..92: mol_type = genomic DNA
ccctatggccaccagcgctctggacgccccactctgccaggtgagaacgagtttaggggtgcgggctggaggtcagtgtgtctgtccgaagt

SEQ ID NO: 62549 - DNA, 92 bp, Homo sapiens
  misc_feature 1..92: note = chr8:144360453-144360545
  misc_feature 1..92: note = hypo
  source 1..92: mol_type = genomic DNA
tcagactgtctgcctgaaaggtaagggtgaggacgcctgcattctccttgttcagtaacacgcgtgggcagccaggccgaggtgctggctct

SEQ ID NO: 62550 - DNA, 12 bp, Homo sapiens
  misc_feature 1..12: note = chr8:144361823-144361835
  misc_feature 1..12: note = hypo
  source 1..12: mol_type = genomic DNA
accgcacatggc

SEQ ID NO: 62551 - DNA, 57 bp, Homo sapiens; identical to SEQ ID NO: 15204
  misc_feature 1..57: note = chr8:144383350-144383407
  misc_feature 1..57: note = hypo
  source 1..57: mol_type = genomic DNA

SEQ ID NO: 62552 - DNA, 35 bp, Homo sapiens; identical to SEQ ID NO: 42080
  misc_feature 1..35: note = chr8:144386583-144386618
  misc_feature 1..35: note = hypo
  source 1..35: mol_type = genomic DNA

SEQ ID NO: 62553 - DNA, 30 bp, Homo sapiens; identical to SEQ ID NO: 42081
  misc_feature 1..30: note = chr8:144452062-144452092
  misc_feature 1..30: note = hypo
  source 1..30: mol_type = genomic DNA

SEQ ID NO: 62554 - DNA, 34 bp, Homo sapiens; identical to SEQ ID NO: 42082
  misc_feature 1..34: note = chr8:144457801-144457835
  misc_feature 1..34: note = hypo
  source 1..34: mol_type = genomic DNA

SEQ ID NO: 62555 - DNA, 179 bp, Homo sapiens; identical to SEQ ID NO: 15205
  misc_feature 1..179: note = chr8:144471637-144471816
  misc_feature 1..179: note = hypo
  source 1..179: mol_type = genomic DNA

SEQ ID NO: 62556 - DNA, 32 bp, Homo sapiens; identical to SEQ ID NO: 42084
  misc_feature 1..32: note = chr8:144552577-144552609
  misc_feature 1..32: note = hypo
  source 1..32: mol_type = genomic DNA

SEQ ID NO: 62557 - DNA, 30 bp, Homo sapiens; identical to SEQ ID NO: 42085
  misc_feature 1..30: note = chr8:144573375-144573405
  misc_feature 1..30: note = hypo
  source 1..30: mol_type = genomic DNA

SEQ ID NO: 62558 - DNA, 83 bp, Homo sapiens; identical to SEQ ID NO: 15206
  misc_feature 1..83: note = chr8:144589999-144590082
  misc_feature 1..83: note = hypo
  source 1..83: mol_type = genomic DNA

SEQ ID NO: 62559 - DNA, 175 bp, Homo sapiens; identical to SEQ ID NO: 42087
  misc_feature 1..175: note = chr8:144656770-144656945
  misc_feature 1..175: note = hypo
  source 1..175: mol_type = genomic DNA

SEQ ID NO: 62560 - DNA, 95 bp, Homo sapiens
  misc_feature 1..95: note = chr8:144668814-144668909
  misc_feature 1..95: note = hypo
  source 1..95: mol_type = genomic DNA
tggcctggctgaatccgctttgtgtgccccggccactcctgtcgggcagcagagccgcccagccgccccacgtgcagctctcacctggcgggagg

SEQ ID NO: 62561 - DNA, 37 bp, Homo sapiens; identical to SEQ ID NO: 42089
  misc_feature 1..37: note = chr8:144675999-144676036
  misc_feature 1..37: note = hypo
  source 1..37: mol_type = genomic DNA

SEQ ID NO: 62562 - DNA, 177 bp, Homo sapiens; identical to SEQ ID NO: 42090
  misc_feature 1..177: note = chr8:144677837-144678014
  misc_feature 1..177: note = hypo
  source 1..177: mol_type = genomic DNA

SEQ ID NO: 62563 - DNA, 79 bp, Homo sapiens; identical to SEQ ID NO: 42091
  misc_feature 1..79: note = chr8:144681634-144681713
  misc_feature 1..79: note = hypo
  source 1..79: mol_type = genomic DNA

SEQ ID NO: 62564 - DNA, 122 bp, Homo sapiens; identical to SEQ ID NO: 42092
  misc_feature 1..122: note = chr8:144685577-144685699
  misc_feature 1..122: note = hypo
  source 1..122: mol_type = genomic DNA

SEQ ID NO: 62565 - DNA, 185 bp, Homo sapiens; identical to SEQ ID NO: 42093
  misc_feature 1..185: note = chr8:145739768-145739953
  misc_feature 1..185: note = hypo
  source 1..185: mol_type = genomic DNA

SEQ ID NO: 62566 - DNA, 30 bp, Homo sapiens; identical to SEQ ID NO: 42094
  misc_feature 1..30: note = chr8:145745121-145745151
  misc_feature 1..30: note = hypo
  source 1..30: mol_type = genomic DNA

SEQ ID NO: 62567 - DNA, 27 bp, Homo sapiens
  misc_feature 1..27: note = chr8:145753490-145753517
  misc_feature 1..27: note = hypo
  source 1..27: mol_type = genomic DNA
gcgtgcaggtgggggcggggaagctca

SEQ ID NO: 62568 - DNA, 20 bp, Homo sapiens
  misc_feature 1..20: note = chr8:145753547-145753567
  misc_feature 1..20: note = hypo
  source 1..20: mol_type = genomic DNA
cggcccgagcccacttttcc

SEQ ID NO: 62569 - DNA, 18 bp, Homo sapiens
  misc_feature 1..18: note = chr8:145919061-145919079
  misc_feature 1..18: note = hypo
  source 1..18: mol_type = genomic DNA
ggccgtaaaattctttga

SEQ ID NO: 62570 - DNA, 192 bp, Homo sapiens; identical to SEQ ID NO: 42098
  misc_feature 1..192: note = chr8:145979452-145979644
  misc_feature 1..192: note = hypo
  source 1..192: mol_type = genomic DNA

SEQ ID NO: 62571 - DNA, 30 bp, Homo sapiens; identical to SEQ ID NO: 15213
  misc_feature 1..30: note = chr8:146013567-146013597
  misc_feature 1..30: note = hypo
  source 1..30: mol_type = genomic DNA

SEQ ID NO: 62572 - DNA, 30 bp, Homo sapiens; identical to SEQ ID NO: 42100
  misc_feature 1..30: note = chr8:146050247-146050277
  misc_feature 1..30: note = hypo
  source 1..30: mol_type = genomic DNA

SEQ ID NO: 62573 - DNA, 35 bp, Homo sapiens; identical to SEQ ID NO: 42102
  misc_feature 1..35: note = chr9:2727012-2727047
  misc_feature 1..35: note = hypo
  source 1..35: mol_type = genomic DNA

SEQ ID NO: 62574 - DNA, 17 bp, Homo sapiens
  misc_feature 1..17: note = chr9:5230606-5230623
  misc_feature 1..17: note = hypo
  source 1..17: mol_type = genomic DNA
caaacctttttgaaacg

SEQ ID NO: 62575 - DNA, 30 bp, Homo sapiens; identical to SEQ ID NO: 15216
  misc_feature 1..30: note = chr9:7164747-7164777
  misc_feature 1..30: note = hypo
  source 1..30: mol_type = genomic DNA

SEQ ID NO: 62576 - DNA, 17 bp, Homo sapiens
  misc_feature 1..17: note = chr9:15277136-15277153
  misc_feature 1..17: note = hypo
  source 1..17: mol_type = genomic DNA
aatttatgggctgggcg

SEQ ID NO: 62577 - DNA, 29 bp, Homo sapiens
  misc_feature 1..29: note = chr9:15533122-15533151
  misc_feature 1..29: note = hypo
  source 1..29: mol_type = genomic DNA
cccggccagaaagacgtgtttactacaaa

SEQ ID NO: 62578 - DNA, 30 bp, Homo sapiens; identical to SEQ ID NO: 42109
  misc_feature 1..30: note = chr9:26958024-26958054
  misc_feature 1..30: note = hypo
  source 1..30: mol_type = genomic DNA

SEQ ID NO: 62579 - DNA, 21 bp, Homo sapiens
  misc_feature 1..21: note = chr9:26976277-26976298
  misc_feature 1..21: note = hypo
  source 1..21: mol_type = genomic DNA
aagaaagcttgaagtcgtaaa

SEQ ID NO: 62580 - DNA, 31 bp, Homo sapiens; identical to SEQ ID NO: 42111
  misc_feature 1..31: note = chr9:28641312-28641343
  misc_feature 1..31: note = hypo
  source 1..31: mol_type = genomic DNA

SEQ ID NO: 62581 - DNA, 145 bp, Homo sapiens; identical to SEQ ID NO: 42112
  misc_feature 1..145: note = chr9:32999975-33000120
  misc_feature 1..145: note = hypo
  source 1..145: mol_type = genomic DNA

SEQ ID NO: 62582 - DNA, 24 bp, Homo sapiens
  misc_feature 1..24: note = chr9:33647199-33647223
  misc_feature 1..24: note = hypo
  source 1..24: mol_type = genomic DNA
gcgagactgcgtctcaaaaaaaaa

SEQ ID NO: 62583 - DNA, 30 bp, Homo sapiens; identical to SEQ ID NO: 42114
  misc_feature 1..30: note = chr9:33862299-33862329
  misc_feature 1..30: note = hypo
  source 1..30: mol_type = genomic DNA

SEQ ID NO: 62584 - DNA, 20 bp, Homo sapiens
  misc_feature 1..20: note = chr9:34046353-34046373
  misc_feature 1..20: note = hypo
  source 1..20: mol_type = genomic DNA
gtaaaggcttcatgccgggc

SEQ ID NO: 62585 - DNA, 39 bp, Homo sapiens; identical to SEQ ID NO: 42116
  misc_feature 1..39: note = chr9:34062515-34062554
  misc_feature 1..39: note = hypo
  source 1..39: mol_type = genomic DNA

SEQ ID NO: 62586 - DNA, 99 bp, Homo sapiens; identical to SEQ ID NO: 42117
  misc_feature 1..99: note = chr9:34063196-34063295
  misc_feature 1..99: note = hypo
  source 1..99: mol_type = genomic DNA

SEQ ID NO: 62587 - DNA, 56 bp, Homo sapiens; identical to SEQ ID NO: 42119
  misc_feature 1..56: note = chr9:34574808-34574864
  misc_feature 1..56: note = hypo
  source 1..56: mol_type = genomic DNA

SEQ ID NO: 62588 - DNA, 30 bp, Homo sapiens; identical to SEQ ID NO: 42120
  misc_feature 1..30: note = chr9:35696547-35696577
  misc_feature 1..30: note = hypo
  source 1..30: mol_type = genomic DNA

SEQ ID NO: 62589 - DNA, 95 bp, Homo sapiens; identical to SEQ ID NO: 42121
  misc_feature 1..95: note = chr9:35816242-35816337
  misc_feature 1..95: note = hypo
  source 1..95: mol_type = genomic DNA

SEQ ID NO: 62590 - DNA, 22 bp, Homo sapiens
  misc_feature 1..22: note = chr9:36036080-36036102
  misc_feature 1..22: note = hypo
  source 1..22: mol_type = genomic DNA
aggcacagtggctcacgcctgc

SEQ ID NO: 62591 - DNA, 53 bp, Homo sapiens; identical to SEQ ID NO: 42123
  misc_feature 1..53: note = chr9:36257376-36257429
  misc_feature 1..53: note = hypo
  source 1..53: mol_type = genomic DNA

SEQ ID NO: 62592 - DNA, 23 bp, Homo sapiens
  misc_feature 1..23: note = chr9:36274726-36274749
  misc_feature 1..23: note = hypo
  source 1..23: mol_type = genomic DNA
ttttttctcttgagacggagtct

SEQ ID NO: 62593 - DNA, 30 bp, Homo sapiens; identical to SEQ ID NO: 42125
  misc_feature 1..30: note = chr9:37134066-37134096
  misc_feature 1..30: note = hypo
  source 1..30: mol_type = genomic DNA

SEQ ID NO: 62594 - DNA, 30 bp, Homo sapiens; identical to SEQ ID NO: 5090
  misc_feature 1..30: note = chr9:37467940-37467970
  misc_feature 1..30: note = hypo
  source 1..30: mol_type = genomic DNA

SEQ ID NO: 62595 - DNA, 31 bp, Homo sapiens; identical to SEQ ID NO: 42128
  misc_feature 1..31: note = chr9:38646913-38646944
  misc_feature 1..31: note = hypo
  source 1..31: mol_type = genomic DNA

SEQ ID NO: 62596 - DNA, 117 bp, Homo sapiens; identical to SEQ ID NO: 42129
  misc_feature 1..117: note = chr9:71223828-71223945
  misc_feature 1..117: note = hypo
  source 1..117: mol_type = genomic DNA

SEQ ID NO: 62597 - DNA, 106 bp, Homo sapiens; identical to SEQ ID NO: 42130
  misc_feature 1..106: note = chr9:71425241-71425347
  misc_feature 1..106: note = hypo
  source 1..106: mol_type = genomic DNA

SEQ ID NO: 62598 - DNA, 19 bp, Homo sapiens
  misc_feature 1..19: note = chr9:71501084-71501103
  misc_feature 1..19: note = hypo
  source 1..19: mol_type = genomic DNA
actccgtctgaaaaaaaaa

SEQ ID NO: 62599 - DNA, 26 bp, Homo sapiens
  misc_feature 1..26: note = chr9:71655284-71655310
  misc_feature 1..26: note = hypo
  source 1..26: mol_type = genomic DNA
atgtaaatatttatacgctgccgggc

SEQ ID NO: 62600 - DNA, 14 bp, Homo sapiens
  misc_feature 1..14: note = chr9:71734802-71734816
  misc_feature 1..14: note = hypo
  source 1..14: mol_type = genomic DNA
cagtaacctggccc

SEQ ID NO: 62601 - DNA, 27 bp, Homo sapiens
  misc_feature 1..27: note = chr9:71921187-71921214
  misc_feature 1..27: note = hypo
  source 1..27: mol_type = genomic DNA
tctgggcaagatgatcgccctgaataa

SEQ ID NO: 62602 - DNA, 44 bp, Homo sapiens; identical to SEQ ID NO: 42135
  misc_feature 1..44: note = chr9:72819967-72820011
  misc_feature 1..44: note = hypo
  source 1..44: mol_type = genomic DNA

SEQ ID NO: 62603 - DNA, 173 bp, Homo sapiens; identical to SEQ ID NO: 42137
  misc_feature 1..173: note = chr9:74469850-74470023
  misc_feature 1..173: note = hypo
  source 1..173: mol_type = genomic DNA

SEQ ID NO: 62604 - DNA, 30 bp, Homo sapiens; identical to SEQ ID NO: 42138
  misc_feature 1..30: note = chr9:78557098-78557128
  misc_feature 1..30: note = hypo
  source 1..30: mol_type = genomic DNA

SEQ ID NO: 62605 - DNA, 44 bp, Homo sapiens; identical to SEQ ID NO: 42139
  misc_feature 1..44: note = chr9:79073406-79073450
  misc_feature 1..44: note = hypo
  source 1..44: mol_type = genomic DNA

SEQ ID NO: 62606 - DNA, 30 bp, Homo sapiens; identical to SEQ ID NO: 15224
  misc_feature 1..30: note = chr9:79231349-79231379
  misc_feature 1..30: note = hypo
  source 1..30: mol_type = genomic DNA

SEQ ID NO: 62607 - DNA, 17 bp, Homo sapiens
  misc_feature 1..17: note = chr9:79448387-79448404
  misc_feature 1..17: note = hypo
  source 1..17: mol_type = genomic DNA
aaaccaaatacaggccg

SEQ ID NO: 62608 - DNA, 140 bp, Homo sapiens; identical to SEQ ID NO: 42142
  misc_feature 1..140: note = chr9:80852180-80852320
  misc_feature 1..140: note = hypo
  source 1..140: mol_type = genomic DNA

SEQ ID NO: 62609 - DNA, 30 bp, Homo sapiens; identical to SEQ ID NO: 42143
  misc_feature 1..30: note = chr9:81359075-81359105
  misc_feature 1..30: note = hypo
  source 1..30: mol_type = genomic DNA

SEQ ID NO: 62610 - DNA, 30 bp, Homo sapiens; identical to SEQ ID NO: 42144
  misc_feature 1..30: note = chr9:84294960-84294990
  misc_feature 1..30: note = hypo
  source 1..30: mol_type = genomic DNA

SEQ ID NO: 62611 - DNA, 30 bp, Homo sapiens; identical to SEQ ID NO: 42145
  misc_feature 1..30: note = chr9:87326719-87326749
  misc_feature 1..30: note = hypo
  source 1..30: mol_type = genomic DNA

SEQ ID NO: 62612 - DNA, 30 bp, Homo sapiens; identical to SEQ ID NO: 42146
  misc_feature 1..30: note = chr9:88832474-88832504
  misc_feature 1..30: note = hypo
  source 1..30: mol_type = genomic DNA

SEQ ID NO: 62613 - DNA, 165 bp, Homo sapiens; identical to SEQ ID NO: 42147
  misc_feature 1..165: note = chr9:90322123-90322288
  misc_feature 1..165: note = hypo
  source 1..165: mol_type = genomic DNA

SEQ ID NO: 62614 - DNA, 132 bp, Homo sapiens; identical to SEQ ID NO: 42148
  misc_feature 1..132: note = chr9:90421580-90421712
  misc_feature 1..132: note = hypo
  source 1..132: mol_type = genomic DNA

SEQ ID NO: 62615 - DNA, 39 bp, Homo sapiens; identical to SEQ ID NO: 15227
  misc_feature 1..39: note = chr9:91914149-91914188
  misc_feature 1..39: note = hypo
  source 1..39: mol_type = genomic DNA

SEQ ID NO: 62616 - DNA, 138 bp, Homo sapiens; identical to SEQ ID NO: 42150
  misc_feature 1..138: note = chr9:91995955-91996093
  misc_feature 1..138: note = hypo
  source 1..138: mol_type = genomic DNA

SEQ ID NO: 62617 - DNA, 159 bp, Homo sapiens; identical to SEQ ID NO: 42151
  misc_feature 1..159: note = chr9:92897057-92897216
  misc_feature 1..159: note = hypo
  source 1..159: mol_type = genomic DNA

SEQ ID NO: 62618 - DNA, 77 bp, Homo sapiens; identical to SEQ ID NO: 15229
  misc_feature 1..77: note = chr9:92980516-92980593
  misc_feature 1..77: note = hypo
  source 1..77: mol_type = genomic DNA

SEQ ID NO: 62619 - DNA, 16 bp, Homo sapiens
  misc_feature 1..16: note = chr9:93462711-93462727
  misc_feature 1..16: note = hypo
  source 1..16: mol_type = genomic DNA
ccgttctcctgcctca

SEQ ID NO: 62620 - DNA, 30 bp, Homo sapiens; identical to SEQ ID NO: 42155
  misc_feature 1..30: note = chr9:94572598-94572628
  misc_feature 1..30: note = hypo
  source 1..30: mol_type = genomic DNA

SEQ ID NO: 62621 - DNA, 53 bp, Homo sapiens; identical to SEQ ID NO: 42156
  misc_feature 1..53: note = chr9:94573085-94573138
  misc_feature 1..53: note = hypo
  source 1..53: mol_type = genomic DNA

SEQ ID NO: 62622 - DNA, 141 bp, Homo sapiens; identical to SEQ ID NO: 42157
  misc_feature 1..141: note = chr9:94658109-94658250
  misc_feature 1..141: note = hypo
  source 1..141: mol_type = genomic DNA

SEQ ID NO: 62623 - DNA, 81 bp, Homo sapiens; identical to SEQ ID NO: 42158
  misc_feature 1..81: note = chr9:94863469-94863550
  misc_feature 1..81: note = hypo
  source 1..81: mol_type = genomic DNA

SEQ ID NO: 62624 - DNA, 69 bp, Homo sapiens
  misc_feature 1..69: note = chr9:95417482-95417551
  misc_feature 1..69: note = hypo
  source 1..69: mol_type = genomic DNA
ctttgcctaactcaccgacacatctgttcttccctcacgtggccctgtgtggccctgcagatgcagcga

SEQ ID NO: 62625 - DNA, 30 bp, Homo sapiens; identical to SEQ ID NO: 42160
  misc_feature 1..30: note = chr9:95485122-95485152
  misc_feature 1..30: note = hypo
  source 1..30: mol_type = genomic DNA

SEQ ID NO: 62626 - DNA, 17 bp, Homo sapiens
  misc_feature 1..17: note = chr9:96230169-96230186
  misc_feature 1..17: note = hypo
  source 1..17: mol_type = genomic DNA
cttttttttttgagacg

SEQ ID NO: 62627 - DNA, 54 bp, Homo sapiens; identical to SEQ ID NO: 42162
  misc_feature 1..54: note = chr9:96362025-96362079
  misc_feature 1..54: note = hypo
  source 1..54: mol_type = genomic DNA

SEQ ID NO: 62628 - DNA, 327 bp, Homo sapiens; identical to SEQ ID NO: 42163
  misc_feature 1..327: note = chr9:97317331-97317658
  misc_feature 1..327: note = hypo
  source 1..327: mol_type = genomic DNA

SEQ ID NO: 62629 - DNA, 30 bp, Homo sapiens; identical to SEQ ID NO: 42164
  misc_feature 1..30: note = chr9:97682189-97682219
  misc_feature 1..30: note = hypo
  source 1..30: mol_type = genomic DNA

SEQ ID NO: 62630 - DNA, 30 bp, Homo sapiens; identical to SEQ ID NO: 42165
  misc_feature 1..30: note = chr9:97807798-97807828
  misc_feature 1..30: note = hypo
  source 1..30: mol_type = genomic DNA

SEQ ID NO: 62631 - DNA, 30 bp, Homo sapiens; identical to SEQ ID NO: 42166
  misc_feature 1..30: note = chr9:97863868-97863898
  misc_feature 1..30: note = hypo
  source 1..30: mol_type = genomic DNA

SEQ ID NO: 62632 - DNA, 96 bp, Homo sapiens; identical to SEQ ID NO: 42167
  misc_feature 1..96: note = chr9:97864916-97865012
  misc_feature 1..96: note = hypo
  source 1..96: mol_type = genomic DNA

SEQ ID NO: 62633 - DNA, 30 bp, Homo sapiens; identical to SEQ ID NO: 42168
  misc_feature 1..30: note = chr9:97887619-97887649
  misc_feature 1..30: note = hypo
  source 1..30: mol_type = genomic DNA

SEQ ID NO: 62634 - DNA, 317 bp, Homo sapiens; identical to SEQ ID NO: 42169
  misc_feature 1..317: note = chr9:100397395-100397712
  misc_feature 1..317: note = hypo
  source 1..317: mol_type = genomic DNA

SEQ ID NO: 62635 - DNA, 41 bp, Homo sapiens; identical to SEQ ID NO: 42170
  misc_feature 1..41: note = chr9:100843360-100843401
  misc_feature 1..41: note = hypo
  source 1..41: mol_type = genomic DNA

SEQ ID NO: 62636 - DNA, 120 bp, Homo sapiens; identical to SEQ ID NO: 42171
  misc_feature 1..120: note = chr9:100935554-100935674
  misc_feature 1..120: note = hypo
  source 1..120: mol_type = genomic DNA

SEQ ID NO: 62637 - DNA, 30 bp, Homo sapiens; identical to SEQ ID NO: 42172
  misc_feature 1..30: note = chr9:100981193-100981223
  misc_feature 1..30: note = hypo
  source 1..30: mol_type = genomic DNA

SEQ ID NO: 62638 - DNA, 94 bp, Homo sapiens; identical to SEQ ID NO: 42173
  misc_feature 1..94: note = chr9:100981840-100981934
  misc_feature 1..94: note = hypo
  source 1..94: mol_type = genomic DNA

SEQ ID NO: 62639 - DNA, 30 bp, Homo sapiens; identical to SEQ ID NO: 42174
  misc_feature 1..30: note = chr9:101557939-101557969
  misc_feature 1..30: note = hypo
  source 1..30: mol_type = genomic DNA

SEQ ID NO: 62640 - DNA, 19 bp, Homo sapiens
  misc_feature 1..19: note = chr9:101982656-101982675
  misc_feature 1..19: note = hypo
  source 1..19: mol_type = genomic DNA
tacataagaatgtcccggc

SEQ ID NO: 62641 - DNA, 30 bp, Homo sapiens; identical to SEQ ID NO: 42176
  misc_feature 1..30: note = chr9:102107331-102107361
  misc_feature 1..30: note = hypo
  source 1..30: mol_type = genomic DNA

SEQ ID NO: 62642 - DNA, 24 bp, Homo sapiens
  misc_feature 1..24: note = chr9:103174730-103174754
  misc_feature 1..24: note = hypo
  source 1..24: mol_type = genomic DNA
aaatgtccccgtataaatgataaa

SEQ ID NO: 62643 - DNA, 101 bp, Homo sapiens; identical to SEQ ID NO: 42178
  misc_feature 1..101: note = chr9:103176794-103176895
  misc_feature 1..101: note = hypo
  source 1..101: mol_type = genomic DNA

SEQ ID NO: 62644 - DNA, 196 bp, Homo sapiens; identical to SEQ ID NO: 42179
  misc_feature 1..196: note = chr9:107221358-107221554
  misc_feature 1..196: note = hypo
  source 1..196: mol_type = genomic DNA

SEQ ID NO: 62645 - DNA, 76 bp, Homo sapiens; identical to SEQ ID NO: 42180
  misc_feature 1..76: note = chr9:107396386-107396462
  misc_feature 1..76: note = hypo
  source 1..76: mol_type = genomic DNA

SEQ ID NO: 62646 - DNA, 30 bp, Homo sapiens; identical to SEQ ID NO: 42181
  misc_feature 1..30: note = chr9:114710299-114710329
  misc_feature 1..30: note = hypo
  source 1..30: mol_type = genomic DNA

SEQ ID NO: 62647 - skipped

SEQ ID NO: 62648 - DNA, 30 bp, Homo sapiens; identical to SEQ ID NO: 42183
  misc_feature 1..30: note = chr9:115087309-115087339
  misc_feature 1..30: note = hypo
  source 1..30: mol_type = genomic DNA

SEQ ID NO: 62649 - DNA, 18 bp, Homo sapiens
  misc_feature 1..18: note = chr9:115087597-115087615
  misc_feature 1..18: note = hypo
  source 1..18: mol_type = genomic DNA
gcccgtctgcacactggg

SEQ ID NO: 62650 - DNA, 146 bp, Homo sapiens; identical to SEQ ID NO: 42185
  misc_feature 1..146: note = chr9:115172301-115172447
  misc_feature 1..146: note = hypo
  source 1..146: mol_type = genomic DNA

SEQ ID NO: 62651 - DNA, 30 bp, Homo sapiens; identical to SEQ ID NO: 42187
  misc_feature 1..30: note = chr9:115599305-115599335
  misc_feature 1..30: note = hypo
  source 1..30: mol_type = genomic DNA

SEQ ID NO: 62652 - DNA, 30 bp, Homo sapiens; identical to SEQ ID NO: 42188
  misc_feature 1..30: note = chr9:115773781-115773811
  misc_feature 1..30: note = hypo
  source 1..30: mol_type = genomic DNA

SEQ ID NO: 62653 - DNA, 30 bp, Homo sapiens; identical to SEQ ID NO: 42189
  misc_feature 1..30: note = chr9:116065790-116065820
  misc_feature 1..30: note = hypo
  source 1..30: mol_type = genomic DNA

SEQ ID NO: 62654 - DNA, 30 bp, Homo sapiens; identical to SEQ ID NO: 42190
  misc_feature 1..30: note = chr9:116128876-116128906
  misc_feature 1..30: note = hypo
  source 1..30: mol_type = genomic DNA

SEQ ID NO: 62655 - DNA, 30 bp, Homo sapiens; identical to SEQ ID NO: 15237
  misc_feature 1..30: note = chr9:116331277-116331307
  misc_feature 1..30: note = hypo
  source 1..30: mol_type = genomic DNA

SEQ ID NO: 62656 - DNA, 19 bp, Homo sapiens
  misc_feature 1..19: note = chr9:116633864-116633883
  misc_feature 1..19: note = hypo
  source 1..19: mol_type = genomic DNA
aattccacctgccgacgtg

SEQ ID NO: 62657 - DNA, 30 bp, Homo sapiens; identical to SEQ ID NO: 42194
  misc_feature 1..30: note = chr9:123150500-123150530
  misc_feature 1..30: note = hypo
  source 1..30: mol_type = genomic DNA

SEQ ID NO: 62658 - DNA, 30 bp, Homo sapiens; identical to SEQ ID NO: 42195
  misc_feature 1..30: note = chr9:123272513-123272543
  misc_feature 1..30: note = hypo
  source 1..30: mol_type = genomic DNA

SEQ ID NO: 62659 - DNA, 30 bp, Homo sapiens; identical to SEQ ID NO: 15239
  misc_feature 1..30: note = chr9:123287840-123287870
  misc_feature 1..30: note = hypo
  source 1..30: mol_type = genomic DNA

SEQ ID NO: 62660 - DNA, 30 bp, Homo sapiens; identical to SEQ ID NO: 42197
  misc_feature 1..30: note = chr9:123294978-123295008
  misc_feature 1..30: note = hypo
  source 1..30: mol_type = genomic DNA

SEQ ID NO: 62661 - DNA, 30 bp, Homo sapiens; identical to SEQ ID NO: 42198
  misc_feature 1..30: note = chr9:123295496-123295526
  misc_feature 1..30: note = hypo
  source 1..30: mol_type = genomic DNA

SEQ ID NO: 62662 - DNA, 30 bp, Homo sapiens; identical to SEQ ID NO: 42199
  misc_feature 1..30: note = chr9:125551770-125551800
  misc_feature 1..30: note = hypo
  source 1..30: mol_type = genomic DNA

SEQ ID NO: 62663 - DNA, 39 bp, Homo sapiens; identical to SEQ ID NO: 42200
  misc_feature 1..39: note = chr9:125623471-125623510
  misc_feature 1..39: note = hypo
  source 1..39: mol_type = genomic DNA

SEQ ID NO: 62664 - DNA, 30 bp, Homo sapiens; identical to SEQ ID NO: 42201
  misc_feature 1..30: note = chr9:126110108-126110138
  misc_feature 1..30: note = hypo
  source 1..30: mol_type = genomic DNA

SEQ ID NO: 62665 - DNA, 30 bp, Homo sapiens; identical to SEQ ID NO: 15240
  misc_feature 1..30: note = chr9:126125543-126125573
  misc_feature 1..30: note = hypo
  source 1..30: mol_type = genomic DNA

SEQ ID NO: 62666 - DNA, 103 bp, Homo sapiens; identical to SEQ ID NO: 42203
  misc_feature 1..103: note = chr9:126132916-126133019
  misc_feature 1..103: note = hypo
  source 1..103: mol_type = genomic DNA

SEQ ID NO: 62667 - DNA, 62 bp, Homo sapiens
  misc_feature 1..62: note = chr9:126133716-126133778
  misc_feature 1..62: note = hypo
  source 1..62: mol_type = genomic DNA
tgcctccaggacctgcgactcgatggctgccacctccccttctttcctctgccactggataa

SEQ ID NO: 62668 - DNA, 84 bp, Homo sapiens
  misc_feature 1..84: note = chr9:126133856-126133940
  misc_feature 1..84: note = hypo
  source 1..84: mol_type = genomic DNA
tgtaagtgtctggtggcggtggtggtggtggggtggggagtccttttcccaggatctgtcctgtgtcaccggggcttagtgtgt

SEQ ID NO: 62669 - DNA, 162 bp, Homo sapiens; identical to SEQ ID NO: 42205
  misc_feature 1..162: note = chr9:126140319-126140481
  misc_feature 1..162: note = hypo
  source 1..162: mol_type = genomic DNA

SEQ ID NO: 62670 - DNA, 36 bp, Homo sapiens; identical to SEQ ID NO: 42206
  misc_feature 1..36: note = chr9:126141357-126141393
  misc_feature 1..36: note = hypo
  source 1..36: mol_type = genomic DNA

SEQ ID NO: 62671 - DNA, 30 bp, Homo sapiens; identical to SEQ ID NO: 42207
  misc_feature 1..30: note = chr9:126145363-126145393
  misc_feature 1..30: note = hypo
  source 1..30: mol_type = genomic DNA

SEQ ID NO: 62672 - DNA, 37 bp, Homo sapiens; identical to SEQ ID NO: 42208
  misc_feature 1..37: note = chr9:126153029-126153066
  misc_feature 1..37: note = hypo
  source 1..37: mol_type = genomic DNA

SEQ ID NO: 62673 - DNA, 50 bp, Homo sapiens; identical to SEQ ID NO: 24556
  misc_feature 1..50: note = chr9:126154254-126154304
  misc_feature 1..50: note = hypo
  source 1..50: mol_type = genomic DNA

SEQ ID NO: 62674 - DNA, 34 bp, Homo sapiens; identical to SEQ ID NO: 15243
  misc_feature 1..34: note = chr9:126158010-126158044
  misc_feature 1..34: note = hypo
  source 1..34: mol_type = genomic DNA

SEQ ID NO: 62675 - DNA, 17 bp, Homo sapiens
  misc_feature 1..17: note = chr9:126160660-126160677
  misc_feature 1..17: note = hypo
  source 1..17: mol_type = genomic DNA
cttttttatttgagacg

SEQ ID NO: 62676 - DNA, 44 bp, Homo sapiens; identical to SEQ ID NO: 15244
  misc_feature 1..44: note = chr9:126169447-126169491
  misc_feature 1..44: note = hypo
  source 1..44: mol_type = genomic DNA

SEQ ID NO: 62677 - DNA, 23 bp, Homo sapiens
  misc_feature 1..23: note = chr9:127950771-127950794
  misc_feature 1..23: note = hypo
  source 1..23: mol_type = genomic DNA
gcagtatacctaggccggcgcgg

SEQ ID NO: 62678 - DNA, 30 bp, Homo sapiens; identical to SEQ ID NO: 42214
  misc_feature 1..30: note = chr9:128750886-128750916
  misc_feature 1..30: note = hypo
  source 1..30: mol_type = genomic DNA

SEQ ID NO: 62679 - DNA, 20 bp, Homo sapiens
  misc_feature 1..20: note = chr9:128759954-128759974
  misc_feature 1..20: note = hypo
  source 1..20: mol_type = genomic DNA
aggatcggaaggaatcacac

SEQ ID NO: 62680 - DNA, 30 bp, Homo sapiens; identical to SEQ ID NO: 42216
  misc_feature 1..30: note = chr9:128777807-128777837
  misc_feature 1..30: note = hypo
  source 1..30: mol_type = genomic DNA

SEQ ID NO: 62681 - DNA, 166 bp, Homo sapiens; identical to SEQ ID NO: 42217
  misc_feature 1..166: note = chr9:128824568-128824734
  misc_feature 1..166: note = hypo
  source 1..166: mol_type = genomic DNA

SEQ ID NO: 62682 - DNA, 113 bp, Homo sapiens; identical to SEQ ID NO: 42218
  misc_feature 1..113: note = chr9:130179969-130180082
  misc_feature 1..113: note = hypo
  source 1..113: mol_type = genomic DNA

SEQ ID NO: 62683 - DNA, 38 bp, Homo sapiens; identical to SEQ ID NO: 42219
  misc_feature 1..38: note = chr9:130248346-130248384
  misc_feature 1..38: note = hypo
  source 1..38: mol_type = genomic DNA

SEQ ID NO: 62684 - DNA, 21 bp, Homo sapiens
  misc_feature 1..21: note = chr9:130326077-130326098
  misc_feature 1..21: note = hypo
  source 1..21: mol_type = genomic DNA
tcaccgcgcccagcagagagg

SEQ ID NO: 62685 - DNA, 18 bp, Homo sapiens
  misc_feature 1..18: note = chr9:130505479-130505497
  misc_feature 1..18: note = hypo
  source 1..18: mol_type = genomic DNA
ttaaatattcagttacgg

SEQ ID NO: 62686 - DNA, 30 bp, Homo sapiens; identical to SEQ ID NO: 42222
  misc_feature 1..30: note = chr9:130534900-130534930
  misc_feature 1..30: note = hypo
  source 1..30: mol_type = genomic DNA

SEQ ID NO: 62687 - DNA, 30 bp, Homo sapiens; identical to SEQ ID NO: 42223
  misc_feature 1..30: note = chr9:130676213-130676243
  misc_feature 1..30: note = hypo
  source 1..30: mol_type = genomic DNA

SEQ ID NO: 62688 - DNA, 30 bp, Homo sapiens; identical to SEQ ID NO: 42224
  misc_feature 1..30: note = chr9:130857460-130857490
  misc_feature 1..30: note = hypo
  source 1..30: mol_type = genomic DNA

SEQ ID NO: 62689 - DNA, 21 bp, Homo sapiens
  misc_feature 1..21: note = chr9:131060946-131060967
  misc_feature 1..21: note = hypo
  source 1..21: mol_type = genomic DNA
ccaccgcgcctggccccttgg

SEQ ID NO: 62690 - DNA, 30 bp, Homo sapiens; identical to SEQ ID NO: 42226
  misc_feature 1..30: note = chr9:131095785-131095815
  misc_feature 1..30: note = hypo
  source 1..30: mol_type = genomic DNA

SEQ ID NO: 62691 - DNA, 20 bp, Homo sapiens
  misc_feature 1..20: note = chr9:131417485-131417505
  misc_feature 1..20: note = hypo
  source 1..20: mol_type = genomic DNA
aaagttagcctgggccggcg

SEQ ID NO: 62692 - DNA, 278 bp, Homo sapiens; identical to SEQ ID NO: 42228
  misc_feature 1..278: note = chr9:131504870-131505148
  misc_feature 1..278: note = hypo
  source 1..278: mol_type = genomic DNA

SEQ ID NO: 62693 - DNA, 39 bp, Homo sapiens
  misc_feature 1..39: note = chr9:131579999-131580038
  misc_feature 1..39: note = hypo
  source 1..39: mol_type = genomic DNA
gttttttggaatattcgccccaggtttctgttccagcca

SEQ ID NO: 62694 - DNA, 34 bp, Homo sapiens; identical to SEQ ID NO: 42230
  misc_feature 1..34: note = chr9:131822149-131822183
  misc_feature 1..34: note = hypo
  source 1..34: mol_type = genomic DNA

SEQ ID NO: 62695 - DNA, 115 bp, Homo sapiens
  misc_feature 1..115: note = chr9:131854116-131854231
  misc_feature 1..115: note = hypo
  source 1..115: mol_type = genomic DNA
caggaaactataaggcgagccctggcctcgaatcatagctaaaaaacaaggatccgagaggtagatttaacagcagatgagagagagttaaaaaggaaaagcaaactggagggtg

SEQ ID NO: 62696 - DNA, 126 bp, Homo sapiens
  misc_feature 1..126: note = chr9:131854328-131854454
  misc_feature 1..126: note = hypo
  source 1..126: mol_type = genomic DNA
cacactcacctgcttaccctgaccccgctccaacctgcccaaggtgcggtgctgggcagaagcccaactcttcaagccctcagaagcctctttgaaatatccacttttcgcggctgggcgcggtgg

SEQ ID NO: 62697 - DNA, 32 bp, Homo sapiens; identical to SEQ ID NO: 42232
  misc_feature 1..32: note = chr9:131868926-131868958
  misc_feature 1..32: note = hypo
  source 1..32: mol_type = genomic DNA

SEQ ID NO: 62698 - DNA, 144 bp, Homo sapiens; identical to SEQ ID NO: 42233
  misc_feature 1..144: note = chr9:132040507-132040651
  misc_feature 1..144: note = hypo
  source 1..144: mol_type = genomic DNA

SEQ ID NO: 62699 - DNA, 75 bp, Homo sapiens
  misc_feature 1..75: note = chr9:132402765-132402840
  misc_feature 1..75: note = hypo
  source 1..75: mol_type = genomic DNA
cccagcgtcgggccgcgtttaagccacctgcccacccccggggctctcgctgaccttcaaagttgagattggccc

SEQ ID NO: 62700 - DNA, 266 bp, Homo sapiens
  misc_feature 1..266: note = chr9:132402883-132403149
  misc_feature 1..266: note = hypo
  source 1..266: mol_type = genomic DNA
agccatcttgagcagggcgttgctcacgccttcctggtaaaagggagagtgggctttcctctccagcagctcagtgagaacaaggattcggctctcctcgctggcgacataactgggcctgggacaggagagaggctgagggtaggcacagctgtgggaccgggtgaccgcgcagcctgtgggttggtgggctttagtcctgctatcatcatcagcaagcagggccctggctctgtgggtcacaggggcttgggggaagctctgaa

SEQ ID NO: 62701 - DNA, 93 bp, Homo sapiens; identical to SEQ ID NO: 42235
  misc_feature 1..93: note = chr9:132491528-132491621
  misc_feature 1..93: note = hypo
  source 1..93: mol_type = genomic DNA

SEQ ID NO: 62702 - DNA, 27 bp, Homo sapiens
  misc_feature 1..27: note = chr9:132815103-132815130
  misc_feature 1..27: note = hypo
  source 1..27: mol_type = genomic DNA
ccaaagcaggttgggcgcagtgactca

SEQ ID NO: 62703 - DNA, 30 bp, Homo sapiens; identical to SEQ ID NO: 42237
  misc_feature 1..30: note = chr9:133510031-133510061
  misc_feature 1..30: note = hypo
  source 1..30: mol_type = genomic DNA

SEQ ID NO: 62704 - DNA, 30 bp, Homo sapiens; identical to SEQ ID NO: 15253
  misc_feature 1..30: note = chr9:133518455-133518485
  misc_feature 1..30: note = hypo
  source 1..30: mol_type = genomic DNA

SEQ ID NO: 62705 - DNA, 30 bp, Homo sapiens; identical to SEQ ID NO: 42239
  misc_feature 1..30: note = chr9:133767827-133767857
  misc_feature 1..30: note = hypo
  source 1..30: mol_type = genomic DNA

SEQ ID NO: 62706 - DNA, 36 bp, Homo sapiens
  misc_feature 1..36: note = chr9:133773730-133773766
  misc_feature 1..36: note = hypo
  source 1..36: mol_type = genomic DNA
gggtggcatggtgcccgcttaggcagtgttcactgc

SEQ ID NO: 62707 - DNA, 126 bp, Homo sapiens; identical to SEQ ID NO: 42241
  misc_feature 1..126: note = chr9:133779518-133779644
  misc_feature 1..126: note = hypo
  source 1..126: mol_type = genomic DNA

SEQ ID NO: 62708 - DNA, 30 bp, Homo sapiens; identical to SEQ ID NO: 42242
  misc_feature 1..30: note = chr9:133782157-133782187
  misc_feature 1..30: note = hypo
  source 1..30: mol_type = genomic DNA

SEQ ID NO: 62709 - DNA, 64 bp, Homo sapiens; identical to SEQ ID NO: 42243
  misc_feature 1..64: note = chr9:133864850-133864914
  misc_feature 1..64: note = hypo
  source 1..64: mol_type = genomic DNA

SEQ ID NO: 62710 - DNA, 189 bp, Homo sapiens; identical to SEQ ID NO: 42244
  misc_feature 1..189: note = chr9:133865355-133865544
  misc_feature 1..189: note = hypo
  source 1..189: mol_type = genomic DNA

SEQ ID NO: 62711 - DNA, 30 bp, Homo sapiens; identical to SEQ ID NO: 42246
  misc_feature 1..30: note = chr9:133936721-133936751
  misc_feature 1..30: note = hypo
  source 1..30: mol_type = genomic DNA

SEQ ID NO: 62712 - DNA, 31 bp, Homo sapiens; identical to SEQ ID NO: 42247
  misc_feature 1..31: note = chr9:134119973-134120004
  misc_feature 1..31: note = hypo
  source 1..31: mol_type = genomic DNA

SEQ ID NO: 62713 - DNA, 126 bp, Homo sapiens; identical to SEQ ID NO: 42248
  misc_feature 1..126: note = chr9:134135879-134136005
  misc_feature 1..126: note = hypo
  source 1..126: mol_type = genomic DNA

SEQ ID NO: 62714 - DNA, 41 bp, Homo sapiens; identical to SEQ ID NO: 42249
  misc_feature 1..41: note = chr9:134136231-134136272
  misc_feature 1..41: note = hypo
  source 1..41: mol_type = genomic DNA

SEQ ID NO: 62715 - DNA, 271 bp, Homo sapiens; identical to SEQ ID NO: 42251
  misc_feature 1..271: note = chr9:134191463-134191734
  misc_feature 1..271: note = hypo
  source 1..271: mol_type = genomic DNA

SEQ ID NO: 62716 - DNA, 44 bp, Homo sapiens; identical to SEQ ID NO: 24568
  misc_feature 1..44: note = chr9:134717269-134717313
  misc_feature 1..44: note = hypo
  source 1..44: mol_type = genomic DNA

SEQ ID NO: 62717 - DNA, 30 bp, Homo sapiens; identical to SEQ ID NO: 42254
  misc_feature 1..30: note = chr9:134724244-134724274
  misc_feature 1..30: note = hypo
  source 1..30: mol_type = genomic DNA

SEQ ID NO: 62718 - DNA, 30 bp, Homo sapiens; identical to SEQ ID NO: 42255
  misc_feature 1..30: note = chr9:134818649-134818679
  misc_feature 1..30: note = hypo
  source 1..30: mol_type = genomic DNA

SEQ ID NO: 62719 - DNA, 198 bp, Homo sapiens; identical to SEQ ID NO: 42256
  misc_feature 1..198: note = chr9:134913048-134913246
  misc_feature 1..198: note = hypo
  source 1..198: mol_type = genomic DNA

SEQ ID NO: 62720 - DNA, 30 bp, Homo sapiens; identical to SEQ ID NO: 42257
  misc_feature 1..30: note = chr9:135027845-135027875
  misc_feature 1..30: note = hypo
  source 1..30: mol_type = genomic DNA

SEQ ID NO: 62721 - DNA, 30 bp, Homo sapiens; identical to SEQ ID NO: 42258
  misc_feature 1..30: note = chr9:135054774-135054804
  misc_feature 1..30: note = hypo
  source 1..30: mol_type = genomic DNA

SEQ ID NO: 62722 - DNA, 114 bp, Homo sapiens; identical to SEQ ID NO: 42259
  misc_feature 1..114: note = chr9:135102332-135102446
  misc_feature 1..114: note = hypo
  source 1..114: mol_type = genomic DNA

SEQ ID NO: 62723 - DNA, 204 bp, Homo sapiens; identical to SEQ ID NO: 42260
  misc_feature 1..204: note = chr9:135512910-135513114
  misc_feature 1..204: note = hypo
  source 1..204: mol_type = genomic DNA

SEQ ID NO: 62724 - DNA, 74 bp, Homo sapiens; identical to SEQ ID NO: 42262
  misc_feature 1..74: note = chr9:135768018-135768092
  misc_feature 1..74: note = hypo
  source 1..74: mol_type = genomic DNA

SEQ ID NO: 62725 - DNA, 30 bp, Homo sapiens; identical to SEQ ID NO: 42263
  misc_feature 1..30: note = chr9:135833429-135833459
  misc_feature 1..30: note = hypo
  source 1..30: mol_type = genomic DNA

SEQ ID NO: 62726 - DNA, 48 bp, Homo sapiens
  misc_feature 1..48: note = chr9:135865042-135865090
  misc_feature 1..48: note = hypo
  source 1..48: mol_type = genomic DNA
tggagtgtcctgttccgcaggggatcccggccgggtccagtcctgagc

SEQ ID NO: 62727 - DNA, 34 bp, Homo sapiens
  misc_feature 1..34: note = chr9:135865161-135865195
  misc_feature 1..34: note = hypo
  source 1..34: mol_type = genomic DNA
gccttcaagcgctcgtccacgctgtccacccacc

SEQ ID NO: 62728 - DNA, 33 bp, Homo sapiens
  misc_feature 1..33: note = chr9:135898878-135898911
  misc_feature 1..33: note = hypo
  source 1..33: mol_type = genomic DNA
gggatctggatgcagcggctggggttggcaggg

SEQ ID NO: 62729 - DNA, 56 bp, Homo sapiens; identical to SEQ ID NO: 42266
  misc_feature 1..56: note = chr9:135908143-135908199
  misc_feature 1..56: note = hypo
  source 1..56: mol_type = genomic DNA

SEQ ID NO: 62730 - DNA, 138 bp, Homo sapiens; identical to SEQ ID NO: 42267
  misc_feature 1..138: note = chr9:136375595-136375733
  misc_feature 1..138: note = hypo
  source 1..138: mol_type = genomic DNA

SEQ ID NO: 62731 - DNA, 70 bp, Homo sapiens; identical to SEQ ID NO: 42268
  misc_feature 1..70: note = chr9:136383935-136384005
  misc_feature 1..70: note = hypo
  source 1..70: mol_type = genomic DNA

SEQ ID NO: 62732 - DNA, 30 bp, Homo sapiens; identical to SEQ ID NO: 42269
  misc_feature 1..30: note = chr9:136521608-136521638
  misc_feature 1..30: note = hypo
  source 1..30: mol_type = genomic DNA

SEQ ID NO: 62733 - DNA, 30 bp, Homo sapiens; identical to SEQ ID NO: 42270
  misc_feature 1..30: note = chr9:136559282-136559312
  misc_feature 1..30: note = hypo
  source 1..30: mol_type = genomic DNA

SEQ ID NO: 62734 - DNA, 45 bp, Homo sapiens; identical to SEQ ID NO: 42271
  misc_feature 1..45: note = chr9:136573425-136573470
  misc_feature 1..45: note = hypo
  source 1..45: mol_type = genomic DNA

SEQ ID NO: 62735 - DNA, 30 bp, Homo sapiens; identical to SEQ ID NO: 15265
  misc_feature 1..30: note = chr9:136999528-136999558
  misc_feature 1..30: note = hypo
  source 1..30: mol_type = genomic DNA

SEQ ID NO: 62736 - DNA, 30 bp, Homo sapiens; identical to SEQ ID NO: 42273
  misc_feature 1..30: note = chr9:137248217-137248247
  misc_feature 1..30: note = hypo
  source 1..30: mol_type = genomic DNA

SEQ ID NO: 62737 - DNA, 33 bp, Homo sapiens; identical to SEQ ID NO: 42274
  misc_feature 1..33: note = chr9:137427038-137427071
  misc_feature 1..33: note = hypo
  source 1..33: mol_type = genomic DNA

SEQ ID NO: 62738 - DNA, 93 bp, Homo sapiens; identical to SEQ ID NO: 42275
  misc_feature 1..93: note = chr9:137457467-137457560
  misc_feature 1..93: note = hypo
  source 1..93: mol_type = genomic DNA

SEQ ID NO: 62739 - DNA, 30 bp, Homo sapiens; identical to SEQ ID NO: 42276
  misc_feature 1..30: note = chr9:137539456-137539486
  misc_feature 1..30: note = hypo
  source 1..30: mol_type = genomic DNA

SEQ ID NO: 62740 - DNA, 174 bp, Homo sapiens; identical to SEQ ID NO: 42277
  misc_feature 1..174: note = chr9:137580733-137580907
  misc_feature 1..174: note = hypo
  source 1..174: mol_type = genomic DNA

SEQ ID NO: 62741 - DNA, 35 bp, Homo sapiens; identical to SEQ ID NO: 42278
  misc_feature 1..35: note = chr9:137602268-137602303
  misc_feature 1..35: note = hypo
  source 1..35: mol_type = genomic DNA

SEQ ID NO: 62742 - DNA, 30 bp, Homo sapiens; identical to SEQ ID NO: 42279
  misc_feature 1..30: note = chr9:137624178-137624208
  misc_feature 1..30: note = hypo
  source 1..30: mol_type = genomic DNA

SEQ ID NO: 62743 - DNA, 30 bp, Homo sapiens; identical to SEQ ID NO: 42280
  misc_feature 1..30: note = chr9:137631987-137632017
  misc_feature 1..30: note = hypo
  source 1..30: mol_type = genomic DNA

SEQ ID NO: 62744 - DNA, 30 bp, Homo sapiens; identical to SEQ ID NO: 42281
  misc_feature 1..30: note = chr9:137638965-137638995
  misc_feature 1..30: note = hypo
  source 1..30: mol_type = genomic DNA

SEQ ID NO: 62745 - DNA, 33 bp, Homo sapiens
  misc_feature 1..33: note = chr9:137656925-137656958
  misc_feature 1..33: note = hypo
  source 1..33: mol_type = genomic DNA
acgagcctcgccgaccggagagggcgtgccagc

SEQ ID NO: 62746 - DNA, 18 bp, Homo sapiens
  misc_feature 1..18: note = chr9:137657128-137657146
  misc_feature 1..18: note = hypo
  source 1..18: mol_type = genomic DNA
gagcgagccggtaatgag

SEQ ID NO: 62747 - DNA, 35 bp, Homo sapiens; identical to SEQ ID NO: 42284
  misc_feature 1..35: note = chr9:137685677-137685712
  misc_feature 1..35: note = hypo
  source 1..35: mol_type = genomic DNA

SEQ ID NO: 62748 - DNA, 119 bp, Homo sapiens; identical to SEQ ID NO: 42285
  misc_feature 1..119: note = chr9:137694532-137694651
  misc_feature 1..119: note = hypo
  source 1..119: mol_type = genomic DNA

SEQ ID NO: 62749 - DNA, 347 bp, Homo sapiens; identical to SEQ ID NO: 42286
  misc_feature 1..347: note = chr9:137710245-137710592
  misc_feature 1..347: note = hypo
  source 1..347: mol_type = genomic DNA

SEQ ID NO: 62750 - DNA, 30 bp, Homo sapiens; identical to SEQ ID NO: 42287
  misc_feature 1..30: note = chr9:137711104-137711134
  misc_feature 1..30: note = hypo
  source 1..30: mol_type = genomic DNA

SEQ ID NO: 62751 - DNA, 30 bp, Homo sapiens; identical to SEQ ID NO: 42288
  misc_feature 1..30: note = chr9:137716969-137716999
  misc_feature 1..30: note = hypo
  source 1..30: mol_type = genomic DNA

SEQ ID NO: 62752 - DNA, 51 bp, Homo sapiens
  misc_feature 1..51: note = chr9:137718850-137718901
  misc_feature 1..51: note = hypo
  source 1..51: mol_type = genomic DNA
caagcctgcagctctcgtgcccctgcatcagcttgaacggcctctccttca

SEQ ID NO: 62753 - DNA, 89 bp, Homo sapiens; identical to SEQ ID NO: 24575
  misc_feature 1..89: note = chr9:137719001-137719090
  misc_feature 1..89: note = hypo
  source 1..89: mol_type = genomic DNA

SEQ ID NO: 62754 - DNA, 78 bp, Homo sapiens; identical to SEQ ID NO: 42290
  misc_feature 1..78: note = chr9:137719540-137719618
  misc_feature 1..78: note = hypo
  source 1..78: mol_type = genomic DNA

SEQ ID NO: 62755 - DNA, 40 bp, Homo sapiens; identical to SEQ ID NO: 42291
  misc_feature 1..40: note = chr9:137724640-137724680
  misc_feature 1..40: note = hypo
  source 1..40: mol_type = genomic DNA

SEQ ID NO: 62756 - DNA, 30 bp, Homo sapiens; identical to SEQ ID NO: 42292
  misc_feature 1..30: note = chr9:137726926-137726956
  misc_feature 1..30: note = hypo
  source 1..30: mol_type = genomic DNA

SEQ ID NO: 62757 - DNA, 30 bp, Homo sapiens; identical to SEQ ID NO: 42293
  misc_feature 1..30: note = chr9:137730841-137730871
  misc_feature 1..30: note = hypo
  source 1..30: mol_type = genomic DNA

SEQ ID NO: 62758 - DNA, 60 bp, Homo sapiens; identical to SEQ ID NO: 42294
  misc_feature 1..60: note = chr9:137734084-137734144
  misc_feature 1..60: note = hypo
  source 1..60: mol_type = genomic DNA

SEQ ID NO: 62759 - DNA, 30 bp, Homo sapiens; identical to SEQ ID NO: 42295
  misc_feature 1..30: note = chr9:137851369-137851399
  misc_feature 1..30: note = hypo
  source 1..30: mol_type = genomic DNA

SEQ ID NO: 62760 - DNA, 17 bp, Homo sapiens
  misc_feature 1..17: note = chr9:137854747-137854764
  misc_feature 1..17: note = hypo
  source 1..17: mol_type = genomic DNA
cccggccgctccttaac

SEQ ID NO: 62761 - DNA, 21 bp, Homo sapiens
  misc_feature 1..21: note = chr9:138265251-138265272
  misc_feature 1..21: note = hypo
  source 1..21: mol_type = genomic DNA
catggtcgcccactccctctg

SEQ ID NO: 62762 - DNA, 34 bp, Homo sapiens; identical to SEQ ID NO: 15269
  misc_feature 1..34: note = chr9:138289547-138289581
  misc_feature 1..34: note = hypo
  source 1..34: mol_type = genomic DNA

SEQ ID NO: 62763 - DNA, 30 bp, Homo sapiens; identical to SEQ ID NO: 42299
  misc_feature 1..30: note = chr9:138290031-138290061
  misc_feature 1..30: note = hypo
  source 1..30: mol_type = genomic DNA

SEQ ID NO: 62764 - DNA, 235 bp, Homo sapiens; identical to SEQ ID NO: 42300
  misc_feature 1..235: note = chr9:138393554-138393789
  misc_feature 1..235: note = hypo
  source 1..235: mol_type = genomic DNA

SEQ ID NO: 62765 - DNA, 30 bp, Homo sapiens; identical to SEQ ID NO: 42301
  misc_feature 1..30: note = chr9:138416397-138416427
  misc_feature 1..30: note = hypo
  source 1..30: mol_type = genomic DNA

SEQ ID NO: 62766 - DNA, 30 bp, Homo sapiens; identical to SEQ ID NO: 42302
  misc_feature 1..30: note = chr9:138506224-138506254
  misc_feature 1..30: note = hypo
  source 1..30: mol_type = genomic DNA

SEQ ID NO: 62767 - DNA, 123 bp, Homo sapiens; identical to SEQ ID NO: 42303
  misc_feature 1..123: note = chr9:138557664-138557787
  misc_feature 1..123: note = hypo
  source 1..123: mol_type = genomic DNA

SEQ ID NO: 62768 - DNA, 78 bp, Homo sapiens; identical to SEQ ID NO: 42304
  misc_feature 1..78: note = chr9:138562725-138562803
  misc_feature 1..78: note = hypo
  source 1..78: mol_type = genomic DNA

SEQ ID NO: 62769 - DNA, 30 bp, Homo sapiens; identical to SEQ ID NO: 42306
  misc_feature 1..30: note = chr9:138577404-138577434
  misc_feature 1..30: note = hypo
  source 1..30: mol_type = genomic DNA

SEQ ID NO: 62770 - DNA, 168 bp, Homo sapiens; identical to SEQ ID NO: 42307
  misc_feature 1..168: note = chr9:138577710-138577878
  misc_feature 1..168: note = hypo
  source 1..168: mol_type = genomic DNA

SEQ ID NO: 62771 - DNA, 30 bp, Homo sapiens; identical to SEQ ID NO: 42308
  misc_feature 1..30: note = chr9:138587151-138587181
  misc_feature 1..30: note = hypo
  source 1..30: mol_type = genomic DNA

SEQ ID NO: 62772 - DNA, 30 bp, Homo sapiens; identical to SEQ ID NO: 42309
  misc_feature 1..30: note = chr9:138591441-138591471
  misc_feature 1..30: note = hypo
  source 1..30: mol_type = genomic DNA

SEQ ID NO: 62773 - DNA, 30 bp, Homo sapiens; identical to SEQ ID NO: 42310
  misc_feature 1..30: note = chr9:138598276-138598306
  misc_feature 1..30: note = hypo
  source 1..30: mol_type = genomic DNA

SEQ ID NO: 62774 - DNA, 21 bp, Homo sapiens
  misc_feature 1..21: note = chr9:138627615-138627636
  misc_feature 1..21: note = hypo
  source 1..21: mol_type = genomic DNA
gagggctctgccacccggcac

SEQ ID NO: 62775 - DNA, 50 bp, Homo sapiens; identical to SEQ ID NO: 42312
  misc_feature 1..50: note = chr9:138634173-138634223
  misc_feature 1..50: note = hypo
  source 1..50: mol_type = genomic DNA

SEQ ID NO: 62776 - DNA, 30 bp, Homo sapiens; identical to SEQ ID NO: 42313
  misc_feature 1..30: note = chr9:138637950-138637980
  misc_feature 1..30: note = hypo
  source 1..30: mol_type = genomic DNA

SEQ ID NO: 62777 - DNA, 30 bp, Homo sapiens; identical to SEQ ID NO: 42314
  misc_feature 1..30: note = chr9:138642836-138642866
  misc_feature 1..30: note = hypo
  source 1..30: mol_type = genomic DNA

SEQ ID NO: 62778 - DNA, 48 bp, Homo sapiens; identical to SEQ ID NO: 42315
  misc_feature 1..48: note = chr9:138650116-138650164
  misc_feature 1..48: note = hypo
  source 1..48: mol_type = genomic DNA

SEQ ID NO: 62779 - DNA, 30 bp, Homo sapiens; identical to SEQ ID NO: 42316
  misc_feature 1..30: note = chr9:138651295-138651325
  misc_feature 1..30: note = hypo
  source 1..30: mol_type = genomic DNA

SEQ ID NO: 62780 - DNA, 39 bp, Homo sapiens; identical to SEQ ID NO: 42317
  misc_feature 1..39: note = chr9:138651662-138651701
  misc_feature 1..39: note = hypo
  source 1..39: mol_type = genomic DNA

SEQ ID NO: 62781 - DNA, 30 bp, Homo sapiens; identical to SEQ ID NO: 42318
  misc_feature 1..30: note = chr9:138655771-138655801
  misc_feature 1..30: note = hypo
  source 1..30: mol_type = genomic DNA

SEQ ID NO: 62782 - DNA, 73 bp, Homo sapiens
  misc_feature 1..73: note = chr9:138659727-138659800
  misc_feature 1..73: note = hypo
  source 1..73: mol_type = genomic DNA
gctcccactcagggccgtggccaggagaagctgtcagctggtgtctccaggacacaccatccatagcatctga

SEQ ID NO: 62783 - DNA, 62 bp, Homo sapiens
  misc_feature 1..62: note = chr9:138659905-138659967
  misc_feature 1..62: note = hypo
  source 1..62: mol_type = genomic DNA
tgtggctcctgaaccctgcccccaccctctgtcagcctgcacacgctcgggggacaggtgtg

SEQ ID NO: 62784 - DNA, 172 bp, Homo sapiens
  misc_feature 1..172: note = chr9:138660771-138660943
  misc_feature 1..172: note = hypo
  source 1..172: mol_type = genomic DNA
tcaagtttgctggtgcgtctggggcacacgtgggtgatggtgtatctggggcagggcacgtgtgcacacgtgggtgatggtgcatctggggcagggcgcatgtgcacatgtgtgacggtgcgtctggggcaggacgcgtgtgcacacgtgggtgacggtgcgtctggggcag

SEQ ID NO: 62785 - DNA, 198 bp, Homo sapiens
  misc_feature 1..198: note = chr9:138661012-138661210
  misc_feature 1..198: note = hypo
  source 1..198: mol_type = genomic DNA
gtctggggcagggcgcgtgtgcacacgtgggtgacagtgcatctggggcagggcacgtgtgcacgtgtgtgtcggtgtgtctggggcagggcgcgtgtgcatgctgttgggtgatggtgcgtctggggcagggcgcgtgtgcacacgtgggtgacggtgtgtctggggcagggcgcatgtgcacgcagttaggcgagc

SEQ ID NO: 62786 - DNA, 220 bp, Homo sapiens
  misc_feature 1..220: note = chr9:138661428-138661648
  misc_feature 1..220: note = hypo
  source 1..220: mol_type = genomic DNA
gggcagggaccatgccgggtgcccggggaacggggggcaggccccatgccaggtgcccaggggacaggggtcagggcccacatggagtgcccaaggcacaggggccagggcctgccccgccctggaactcctcgctgagctgggagagaagcacaggagcgatggaaggtccaccgaggctcagaccaagtagggggttgaggtccacagactctcgggg

SEQ ID NO: 62787 - DNA, 71 bp, Homo sapiens
  misc_feature 1..71: note = chr9:138661870-138661941
  misc_feature 1..71: note = hypo
  source 1..71: mol_type = genomic DNA
tcaccctgctggtgcacacgtcccgcggccagtgagtgccccgtgccccgggggaccgacctccatggcgg

SEQ ID NO: 62788 - DNA, 45 bp, Homo sapiens
  misc_feature 1..45: note = chr9:138666558-138666603
  misc_feature 1..45: note = hypo
  source 1..45: mol_type = genomic DNA
atttctgtgcgcatgtgttgtgtgtgtgtccgggtgtgtccattt

SEQ ID NO: 62789 - DNA, 73 bp, Homo sapiens; identical to SEQ ID NO: 42323
  misc_feature 1..73: note = chr9:138671215-138671288
  misc_feature 1..73: note = hypo
  source 1..73: mol_type = genomic DNA

SEQ ID NO: 62790 - DNA, 50 bp, Homo sapiens; identical to SEQ ID NO: 42324
  misc_feature 1..50: note = chr9:138675763-138675813
  misc_feature 1..50: note = hypo
  source 1..50: mol_type = genomic DNA

SEQ ID NO: 62791 - DNA, 38 bp, Homo sapiens; identical to SEQ ID NO: 42325
  misc_feature 1..38: note = chr9:138678379-138678417
  misc_feature 1..38: note = hypo
  source 1..38: mol_type = genomic DNA

SEQ ID NO: 62792 - DNA, 74 bp, Homo sapiens; identical to SEQ ID NO: 42326
  misc_feature 1..74: note = chr9:138743697-138743771
  misc_feature 1..74: note = hypo
  source 1..74: mol_type = genomic DNA

SEQ ID NO: 62793 - DNA, 284 bp, Homo sapiens; identical to SEQ ID NO: 42327
  misc_feature 1..284: note = chr9:138780586-138780870
  misc_feature 1..284: note = hypo
  source 1..284: mol_type = genomic DNA

SEQ ID NO: 62794 - DNA, 30 bp, Homo sapiens; identical to SEQ ID NO: 42328
  misc_feature 1..30: note = chr9:138781904-138781934
  misc_feature 1..30: note = hypo
  source 1..30: mol_type = genomic DNA

SEQ ID NO: 62795 - DNA, 66 bp, Homo sapiens; identical to SEQ ID NO: 42329
  misc_feature 1..66: note = chr9:138831936-138832002
  misc_feature 1..66: note = hypo
  source 1..66: mol_type = genomic DNA

SEQ ID NO: 62796 - DNA, 30 bp, Homo sapiens; identical to SEQ ID NO: 42330
  misc_feature 1..30: note = chr9:138851606-138851636
  misc_feature 1..30: note = hypo
  source 1..30: mol_type = genomic DNA

SEQ ID NO: 62797 - DNA, 30 bp, Homo sapiens; identical to SEQ ID NO: 42331
  misc_feature 1..30: note = chr9:138873468-138873498
  misc_feature 1..30: note = hypo
  source 1..30: mol_type = genomic DNA

SEQ ID NO: 62798 - DNA, 87 bp, Homo sapiens; identical to SEQ ID NO: 42332
  misc_feature 1..87: note = chr9:138994353-138994440
  misc_feature 1..87: note = hypo
  source 1..87: mol_type = genomic DNA

SEQ ID NO: 62799 - DNA, 170 bp, Homo sapiens
  misc_feature 1..170: note = chr9:139000396-139000566
  misc_feature 1..170: note = hypo
  source 1..170: mol_type = genomic DNA
aggcctgtcccatcccgagggaggcagatcctggctggagctggcggagacttacggccacaccctgccaaggtgtgcccactgggacccgggcccagcctgtcacggcgcctctccctgtgccatccgccagcccaggcttgattgagctccatatgaatattcataca

SEQ ID NO: 62800 - DNA, 99 bp, Homo sapiens; identical to SEQ ID NO: 42336
  misc_feature 1..99: note = chr9:139077555-139077654
  misc_feature 1..99: note = hypo
  source 1..99: mol_type = genomic DNA

SEQ ID NO: 62801 - DNA, 141 bp, Homo sapiens; identical to SEQ ID NO: 42337
  misc_feature 1..141: note = chr9:139078960-139079101
  misc_feature 1..141: note = hypo
  source 1..141: mol_type = genomic DNA

SEQ ID NO: 62802 - DNA, 30 bp, Homo sapiens; identical to SEQ ID NO: 15282
  misc_feature 1..30: note = chr9:139100397-139100427
  misc_feature 1..30: note = hypo
  source 1..30: mol_type = genomic DNA

SEQ ID NO: 62803 - DNA, 40 bp, Homo sapiens; identical to SEQ ID NO: 42339
  misc_feature 1..40: note = chr9:139103561-139103601
  misc_feature 1..40: note = hypo
  source 1..40: mol_type = genomic DNA

SEQ ID NO: 62804 - DNA, 30 bp, Homo sapiens; identical to SEQ ID NO: 42341
  misc_feature 1..30: note = chr9:139133153-139133183
  misc_feature 1..30: note = hypo
  source 1..30: mol_type = genomic DNA

SEQ ID NO: 62805 - DNA, 136 bp, Homo sapiens; identical to SEQ ID NO: 42342
  misc_feature 1..136: note = chr9:139265293-139265429
  misc_feature 1..136: note = hypo
  source 1..136: mol_type = genomic DNA

SEQ ID NO: 62806 - DNA, 30 bp, Homo sapiens; identical to SEQ ID NO: 42343
  misc_feature 1..30: note = chr9:139268822-139268852
  misc_feature 1..30: note = hypo
  source 1..30: mol_type = genomic DNA

SEQ ID NO: 62807 - DNA, 65 bp, Homo sapiens; identical to SEQ ID NO: 42344
  misc_feature 1..65: note = chr9:139317772-139317837
  misc_feature 1..65: note = hypo
  source 1..65: mol_type = genomic DNA

SEQ ID NO: 62808 - DNA, 28 bp, Homo sapiens
  misc_feature 1..28: note = chr9:139375871-139375899
  misc_feature 1..28: note = hypo
  source 1..28: mol_type = genomic DNA
gagccaccgcgcccggcccagggaattt

SEQ ID NO: 62809 - DNA, 30 bp, Homo sapiens; identical to SEQ ID NO: 42346
  misc_feature 1..30: note = chr9:139412504-139412534
  misc_feature 1..30: note = hypo
  source 1..30: mol_type = genomic DNA

SEQ ID NO: 62810 - DNA, 30 bp, Homo sapiens; identical to SEQ ID NO: 42347
  misc_feature 1..30: note = chr9:139419942-139419972
  misc_feature 1..30: note = hypo
  source 1..30: mol_type = genomic DNA

SEQ ID NO: 62811 - DNA, 23 bp, Homo sapiens
  misc_feature 1..23: note = chr9:139421932-139421955
  misc_feature 1..23: note = hypo
  source 1..23: mol_type = genomic DNA
cttccatgagtgacccgcacccc

SEQ ID NO: 62812 - DNA, 128 bp, Homo sapiens
  misc_feature 1..128: note = chr9:139421985-139422113
  misc_feature 1..128: note = hypo
  source 1..128: mol_type = genomic DNA
caggggcggtggggagacccctctggggctaaaaagtgaggcttgagatagggaacgccagtctcccccgactggacgagagagctgccctgtccaccaagccacccagctctcgggctcccacggag

SEQ ID NO: 62813 - DNA, 40 bp, Homo sapiens; identical to SEQ ID NO: 15284
  misc_feature 1..40: note = chr9:139472499-139472539
  misc_feature 1..40: note = hypo
  source 1..40: mol_type = genomic DNA

SEQ ID NO: 62814 - DNA, 30 bp, Homo sapiens; identical to SEQ ID NO: 42350
  misc_feature 1..30: note = chr9:139487465-139487495
  misc_feature 1..30: note = hypo
  source 1..30: mol_type = genomic DNA

SEQ ID NO: 62815 - DNA, 30 bp, Homo sapiens; identical to SEQ ID NO: 42351
  misc_feature 1..30: note = chr9:139504374-139504404
  misc_feature 1..30: note = hypo
  source 1..30: mol_type = genomic DNA

SEQ ID NO: 62816 - DNA, 157 bp, Homo sapiens; identical to SEQ ID NO: 42352
  misc_feature 1..157: note = chr9:139504823-139504980
  misc_feature 1..157: note = hypo
  source 1..157: mol_type = genomic DNA

SEQ ID NO: 62817 - DNA, 101 bp, Homo sapiens; identical to SEQ ID NO: 42353
  misc_feature 1..101: note = chr9:139505621-139505722
  misc_feature 1..101: note = hypo
  source 1..101: mol_type = genomic DNA

SEQ ID NO: 62818 - DNA, 76 bp, Homo sapiens; identical to SEQ ID NO: 42354
  misc_feature 1..76: note = chr9:139506440-139506516
  misc_feature 1..76: note = hypo
  source 1..76: mol_type = genomic DNA

SEQ ID NO: 62819 - DNA, 30 bp, Homo sapiens; identical to SEQ ID NO: 42355
  misc_feature 1..30: note = chr9:139517238-139517268
  misc_feature 1..30: note = hypo
  source 1..30: mol_type = genomic DNA

SEQ ID NO: 62820 - DNA, 46 bp, Homo sapiens; identical to SEQ ID NO: 42356
  misc_feature 1..46: note = chr9:139546557-139546603
  misc_feature 1..46: note = hypo
  source 1..46: mol_type = genomic DNA

SEQ ID NO: 62821 - DNA, 51 bp, Homo sapiens; identical to SEQ ID NO: 15286
  misc_feature 1..51: note = chr9:139634047-139634098
  misc_feature 1..51: note = hypo
  source 1..51: mol_type = genomic DNA

SEQ ID NO: 62822 - DNA, 130 bp, Homo sapiens; identical to SEQ ID NO: 42358
  misc_feature 1..130: note = chr9:139638401-139638531
  misc_feature 1..130: note = hypo
  source 1..130: mol_type = genomic DNA

SEQ ID NO: 62823 - DNA, 138 bp, Homo sapiens; identical to SEQ ID NO: 42359
  misc_feature 1..138: note = chr9:139654706-139654844
  misc_feature 1..138: note = hypo
  source 1..138: mol_type = genomic DNA

SEQ ID NO: 62824 - DNA, 30 bp, Homo sapiens; identical to SEQ ID NO: 42360
  misc_feature 1..30: note = chr9:139662292-139662322
  misc_feature 1..30: note = hypo
  source 1..30: mol_type = genomic DNA

SEQ ID NO: 62825 - DNA, 267 bp, Homo sapiens
  misc_feature 1..267: note = chr9:139698658-139698925
  misc_feature 1..267: note = hypo
  source 1..267: mol_type = genomic DNA
ggctgaatgcacttccgtgagttctaggtggacctggccaggaggcagctgggggccagcggctggagggcagcagagcgtctgggctggcacatgctctgaggcatgggcaaggagggccgtgagctgaggggccacgggcacaagtggtttaggaaaagggtgtggccattggccggggatgcagttccaaagtctagtaaggtgagcatggccaaccgcccgctggctttactgccattaggggccttgttgagacagctcccc

SEQ ID NO: 62826 - DNA, 202 bp, Homo sapiens
  misc_feature 1..202: note = chr9:139699051-139699253
  misc_feature 1..202: note = hypo
  source 1..202: mol_type = genomic DNA
gaaggagaccagcgagaagtaccgccgggtaagccccaggccagggcctggctggctgcccatccccatgacagctgggtggacacaggctcagggccaccactcagggcccactccctgccaaggatgtctcatcccttccccgcccccacctcccatcagggccagatggacttggacttcccctcgaacctgatgagca

SEQ ID NO: 62827 - DNA, 41 bp, Homo sapiens; identical to SEQ ID NO: 42362
  misc_feature 1..41: note = chr9:139703929-139703970
  misc_feature 1..41: note = hypo
  source 1..41: mol_type = genomic DNA

SEQ ID NO: 62828 - DNA, 151 bp, Homo sapiens
  misc_feature 1..151: note = chr9:139704279-139704430
  misc_feature 1..151: note = hypo
  source 1..151: mol_type = genomic DNA
acccaagcatcaaaggaacttgtggctggggagaaggcttgactatttgaaatctcaggactcctctgtccaggagctcccagactcccgtggagtggaagcctgggggctcgctgaagaagtcacgtgactggaacgtgcttaatgcttg

SEQ ID NO: 62829 - DNA, 99 bp, Homo sapiens; identical to SEQ ID NO: 42364
  misc_feature 1..99: note = chr9:139705312-139705411
  misc_feature 1..99: note = hypo
  source 1..99: mol_type = genomic DNA

SEQ ID NO: 62830 - DNA, 98 bp, Homo sapiens; identical to SEQ ID NO: 42365
  misc_feature 1..98: note = chr9:139714085-139714183
  misc_feature 1..98: note = hypo
  source 1..98: mol_type = genomic DNA

SEQ ID NO: 62831 - DNA, 216 bp, Homo sapiens; identical to SEQ ID NO: 42366
  misc_feature 1..216: note = chr9:139717731-139717947
  misc_feature 1..216: note = hypo
  source 1..216: mol_type = genomic DNA

SEQ ID NO: 62832 - DNA, 175 bp, Homo sapiens; identical to SEQ ID NO: 42367
  misc_feature 1..175: note = chr9:139734923-139735098
  misc_feature 1..175: note = hypo
  source 1..175: mol_type = genomic DNA

SEQ ID NO: 62833 - DNA, 30 bp, Homo sapiens; identical to SEQ ID NO: 42368
  misc_feature 1..30: note = chr9:139779368-139779398
  misc_feature 1..30: note = hypo
  source 1..30: mol_type = genomic DNA

SEQ ID NO: 62834 - DNA, 104 bp, Homo sapiens; identical to SEQ ID NO: 42369
  misc_feature 1..104: note = chr9:139794879-139794983
  misc_feature 1..104: note = hypo
  source 1..104: mol_type = genomic DNA

SEQ ID NO: 62835 - DNA, 312 bp, Homo sapiens; identical to SEQ ID NO: 42370
  misc_feature 1..312: note = chr9:139809779-139810091
  misc_feature 1..312: note = hypo
  source 1..312: mol_type = genomic DNA

SEQ ID NO: 62836 - DNA, 282 bp, Homo sapiens; identical to SEQ ID NO: 42371
  misc_feature 1..282: note = chr9:139818340-139818622
  misc_feature 1..282: note = hypo
  source 1..282: mol_type = genomic DNA

SEQ ID NO: 62837 - DNA, 181 bp, Homo sapiens
  misc_feature 1..181: note = chr9:139888764-139888945
  misc_feature 1..181: note = hypo
  source 1..181: mol_type = genomic DNA
actggaagtgccctgcggggaggggagcgcctgccccgggacaggattgaggaatgtgccagcccccatccacctggggcaccccgccccaccccggcctgactggtttgggagcccagtccggtcctggagatccctgaggccaccggttgcaggaggcctggagtctgcgccttcttag

SEQ ID NO: 62838 - DNA, 83 bp, Homo sapiens
  misc_feature 1..83: note = chr9:139888980-139889063
  misc_feature 1..83: note = hypo
  source 1..83: mol_type = genomic DNA
ctgcccctgtggttctgggctatcgggctgagcgtcccaccctggggtttggggatgggaagtgatcccgagacctctggccc

SEQ ID NO: 62839 - DNA, 30 bp, Homo sapiens; identical to SEQ ID NO: 42374
  misc_feature 1..30: note = chr9:139904297-139904327
  misc_feature 1..30: note = hypo
  source 1..30: mol_type = genomic DNA

SEQ ID NO: 62840 - DNA, 30 bp, Homo sapiens; identical to SEQ ID NO: 42375
  misc_feature 1..30: note = chr9:139913362-139913392
  misc_feature 1..30: note = hypo
  source 1..30: mol_type = genomic DNA

SEQ ID NO: 62841 - DNA, 30 bp, Homo sapiens; identical to SEQ ID NO: 42376
  misc_feature 1..30: note = chr9:139916163-139916193
  misc_feature 1..30: note = hypo
  source 1..30: mol_type = genomic DNA

SEQ ID NO: 62842 - DNA, 82 bp, Homo sapiens; identical to SEQ ID NO: 42377
  misc_feature 1..82: note = chr9:139978914-139978996
  misc_feature 1..82: note = hypo
  source 1..82: mol_type = genomic DNA

SEQ ID NO: 62843 - DNA, 49 bp, Homo sapiens; identical to SEQ ID NO: 42378
  misc_feature 1..49: note = chr9:140030248-140030297
  misc_feature 1..49: note = hypo
  source 1..49: mol_type = genomic DNA

SEQ ID NO: 62844 - DNA, 11 bp, Homo sapiens
  misc_feature 1..11: note = chr9:140030528-140030539
  misc_feature 1..11: note = hypo
  source 1..11: mol_type = genomic DNA
aggtgctcagt

SEQ ID NO: 62845 - DNA, 40 bp, Homo sapiens; identical to SEQ ID NO: 42380
  misc_feature 1..40: note = chr9:140041778-140041818
  misc_feature 1..40: note = hypo
  source 1..40: mol_type = genomic DNA

SEQ ID NO: 62846 - DNA, 119 bp, Homo sapiens; identical to SEQ ID NO: 42381
  misc_feature 1..119: note = chr9:140043219-140043338
  misc_feature 1..119: note = hypo
  source 1..119: mol_type = genomic DNA

SEQ ID NO: 62847 - DNA, 30 bp, Homo sapiens; identical to SEQ ID NO: 42382
  misc_feature 1..30: note = chr9:140052371-140052401
  misc_feature 1..30: note = hypo
  source 1..30: mol_type = genomic DNA

SEQ ID NO: 62848 - DNA, 196 bp, Homo sapiens; identical to SEQ ID NO: 42383
  misc_feature 1..196: note = chr9:140107128-140107324
  misc_feature 1..196: note = hypo
  source 1..196: mol_type = genomic DNA

SEQ ID NO: 62849 - DNA, 177 bp, Homo sapiens; identical to SEQ ID NO: 42384
  misc_feature 1..177: note = chr9:140108225-140108402
  misc_feature 1..177: note = hypo
  source 1..177: mol_type = genomic DNA

SEQ ID NO: 62850 - DNA, 30 bp, Homo sapiens; identical to SEQ ID NO: 42385
  misc_feature 1..30: note = chr9:140115123-140115153
  misc_feature 1..30: note = hypo
  source 1..30: mol_type = genomic DNA

SEQ ID NO: 62851 - DNA, 229 bp, Homo sapiens
  misc_feature 1..229: note = chr9:140127654-140127883
  misc_feature 1..229: note = hypo
  source 1..229: mol_type = genomic DNA
ccacagggctttcagcggctcggcggtgcacgggatcttcaactggctcacagtgctggtcctgctgccactggagagcgccacggccctgctggagaggctaagtgagctagccctgggtgccgccagcctgacacccagggcgcaggcgcccgacatcctcaaggtgctgacgaagccgctcacacacctcatcgtgcaggtgaggacggccaccgcccccgcccag

SEQ ID NO: 62852 - DNA, 90 bp, Homo sapiens
  misc_feature 1..90: note = chr9:140128080-140128170
  misc_feature 1..90: note = hypo
  source 1..90: mol_type = genomic DNA
ccagttggactccgacatgatcatgagcagtgccacaggcaacgccactaacagcagtctcattaagcactggtgcggcaccacggggca

SEQ ID NO: 62853 - DNA, 80 bp, Homo sapiens
  misc_feature 1..80: note = chr9:140137230-140137310
  misc_feature 1..80: note = hypo
  source 1..80: mol_type = genomic DNA
ctcagtccaccagctcgtagaaaacacagacgagacctactgcattgataacgaagctctctacgacatttgcttcagaa

SEQ ID NO: 62854 - DNA, 180 bp, Homo sapiens; identical to SEQ ID NO: 42388
  misc_feature 1..180: note = chr9:140137557-140137737
  misc_feature 1..180: note = hypo
  source 1..180: mol_type = genomic DNA

SEQ ID NO: 62855 - DNA, 30 bp, Homo sapiens; identical to SEQ ID NO: 42389
  misc_feature 1..30: note = chr9:140140759-140140789
  misc_feature 1..30: note = hypo
  source 1..30: mol_type = genomic DNA

SEQ ID NO: 62856 - DNA, 54 bp, Homo sapiens; identical to SEQ ID NO: 42390
  misc_feature 1..54: note = chr9:140144171-140144225
  misc_feature 1..54: note = hypo
  source 1..54: mol_type = genomic DNA

SEQ ID NO: 62857 - DNA, 56 bp, Homo sapiens; identical to SEQ ID NO: 42391
  misc_feature 1..56: note = chr9:140147052-140147108
  misc_feature 1..56: note = hypo
  source 1..56: mol_type = genomic DNA

SEQ ID NO: 62858 - DNA, 30 bp, Homo sapiens; identical to SEQ ID NO: 42392
  misc_feature 1..30: note = chr9:140167020-140167050
  misc_feature 1..30: note = hypo
  source 1..30: mol_type = genomic DNA

SEQ ID NO: 62859 - DNA, 30 bp, Homo sapiens; identical to SEQ ID NO: 42393
  misc_feature 1..30: note = chr9:140198590-140198620
  misc_feature 1..30: note = hypo
  source 1..30: mol_type = genomic DNA

SEQ ID NO: 62860 - DNA, 207 bp, Homo sapiens
  misc_feature 1..207: note = chr9:140245670-140245877
  misc_feature 1..207: note = hypo
  source 1..207: mol_type = genomic DNA
acccagcaccctccccggggcacacggagggaagggtcaggcaggggtgcgggctgctttctttctggactgggcagggggccccagggcttcactcacccagcttggtgatagaggggtccgagaggagctgggccaccagccgggaaaaggcctgggctccctgccctgttggtggctgcgagagtgccaggacgtccagaagga

SEQ ID NO: 62861 - DNA, 120 bp, Homo sapiens; identical to SEQ ID NO: 42395
  misc_feature 1..120: note = chr9:140265734-140265854
  misc_feature 1..120: note = hypo
  source 1..120: mol_type = genomic DNA

SEQ ID NO: 62862 - DNA, 30 bp, Homo sapiens; identical to SEQ ID NO: 42396
  misc_feature 1..30: note = chr9:140266433-140266463
  misc_feature 1..30: note = hypo
  source 1..30: mol_type = genomic DNA

SEQ ID NO: 62863 - DNA, 61 bp, Homo sapiens; identical to SEQ ID NO: 15304
  misc_feature 1..61: note = chr9:140267262-140267323
  misc_feature 1..61: note = hypo
  source 1..61: mol_type = genomic DNA

SEQ ID NO: 62864 - DNA, 158 bp, Homo sapiens; identical to SEQ ID NO: 42398
  misc_feature 1..158: note = chr9:140274104-140274262
  misc_feature 1..158: note = hypo
  source 1..158: mol_type = genomic DNA

SEQ ID NO: 62865 - DNA, 30 bp, Homo sapiens; identical to SEQ ID NO: 42399
  misc_feature 1..30: note = chr9:140274632-140274662
  misc_feature 1..30: note = hypo
  source 1..30: mol_type = genomic DNA

SEQ ID NO: 62866 - DNA, 30 bp, Homo sapiens; identical to SEQ ID NO: 42400
  misc_feature 1..30: note = chr9:140325615-140325645
  misc_feature 1..30: note = hypo
  source 1..30: mol_type = genomic DNA

SEQ ID NO: 62867 - DNA, 30 bp, Homo sapiens; identical to SEQ ID NO: 42401
  misc_feature 1..30: note = chr9:140327964-140327994
  misc_feature 1..30: note = hypo
  source 1..30: mol_type = genomic DNA

SEQ ID NO: 62868 - DNA, 41 bp, Homo sapiens; identical to SEQ ID NO: 42402
  misc_feature 1..41: note = chr9:140332500-140332541
  misc_feature 1..41: note = hypo
  source 1..41: mol_type = genomic DNA

SEQ ID NO: 62869 - DNA, 128 bp, Homo sapiens
  misc_feature 1..128: note = chr9:140333018-140333146
  misc_feature 1..128: note = hypo
  source 1..128: mol_type = genomic DNA
ctcccgtggccatagaggcatccccggggctcagacggcctcccgtggccatagaggcatccccggggctcagacggtctcccgtggccatagaggcatccccggggctcagacgcctcccgtggcca

SEQ ID NO: 62870 - DNA, 48 bp, Homo sapiens; identical to SEQ ID NO: 42404
  misc_feature 1..48: note = chr9:140352105-140352153
  misc_feature 1..48: note = hypo
  source 1..48: mol_type = genomic DNA

SEQ ID NO: 62871 - DNA, 29 bp, Homo sapiens
  misc_feature 1..29: note = chr9:140382596-140382625
  misc_feature 1..29: note = hypo
  source 1..29: mol_type = genomic DNA
ctgatgtctcgtcccgagcttcacttgca

SEQ ID NO: 62872 - DNA, 178 bp, Homo sapiens; identical to SEQ ID NO: 42406
  misc_feature 1..178: note = chr9:140389309-140389487
  misc_feature 1..178: note = hypo
  source 1..178: mol_type = genomic DNA

SEQ ID NO: 62873 - DNA, 77 bp, Homo sapiens; identical to SEQ ID NO: 24613
  misc_feature 1..77: note = chr9:140392377-140392454
  misc_feature 1..77: note = hypo
  source 1..77: mol_type = genomic DNA

SEQ ID NO: 62874 - DNA, 157 bp, Homo sapiens
  misc_feature 1..157: note = chr9:140392484-140392641
  misc_feature 1..157: note = hypo
  source 1..157: mol_type = genomic DNA
cggtaaccgtgctttgcccatccccagctcctgcatgccagggcagcatggatgcggagtgtgtggcacccacggcctcacctgtatattgctcgcccggcctccacctccacccagtccagggcaaagtcgatttgccgcacgaaggacgacatcc

SEQ ID NO: 62875 - DNA, 167 bp, Homo sapiens; identical to SEQ ID NO: 15310
  misc_feature 1..167: note = chr9:140396560-140396727
  misc_feature 1..167: note = hypo
  source 1..167: mol_type = genomic DNA

SEQ ID NO: 62876 - DNA, 71 bp, Homo sapiens; identical to SEQ ID NO: 15312
  misc_feature 1..71: note = chr9:140400208-140400279
  misc_feature 1..71: note = hypo
  source 1..71: mol_type = genomic DNA

SEQ ID NO: 62877 - DNA, 30 bp, Homo sapiens; identical to SEQ ID NO: 42411
  misc_feature 1..30: note = chr9:140401540-140401570
  misc_feature 1..30: note = hypo
  source 1..30: mol_type = genomic DNA

SEQ ID NO: 62878 - DNA, 30 bp, Homo sapiens; identical to SEQ ID NO: 42413
  misc_feature 1..30: note = chr9:140508520-140508550
  misc_feature 1..30: note = hypo
  source 1..30: mol_type = genomic DNA

SEQ ID NO: 62879 - DNA, 23 bp, Homo sapiens
  misc_feature 1..23: note = chr9:140511850-140511873
  misc_feature 1..23: note = hypo
  source 1..23: mol_type = genomic DNA
accgcacccggcccagtcaacaa

SEQ ID NO: 62880 - DNA, 152 bp, Homo sapiens; identical to SEQ ID NO: 42415
  misc_feature 1..152: note = chr9:140512180-140512332
  misc_feature 1..152: note = hypo
  source 1..152: mol_type = genomic DNA

SEQ ID NO: 62881 - DNA, 33 bp, Homo sapiens; identical to SEQ ID NO: 42416
  misc_feature 1..33: note = chr9:140615444-140615477
  misc_feature 1..33: note = hypo
  source 1..33: mol_type = genomic DNA

SEQ ID NO: 62882 - DNA, 207 bp, Homo sapiens; identical to SEQ ID NO: 42417
  misc_feature 1..207: note = chr9:140657710-140657917
  misc_feature 1..207: note = hypo
  source 1..207: mol_type = genomic DNA

SEQ ID NO: 62883 - DNA, 76 bp, Homo sapiens; identical to SEQ ID NO: 42418
  misc_feature 1..76: note = chr9:140664584-140664660
  misc_feature 1..76: note = hypo
  source 1..76: mol_type = genomic DNA

SEQ ID NO: 62884 - DNA, 45 bp, Homo sapiens; identical to SEQ ID NO: 15313
  misc_feature 1..45: note = chr9:140680320-140680365
  misc_feature 1..45: note = hypo
  source 1..45: mol_type = genomic DNA

SEQ ID NO: 62885 - DNA, 34 bp, Homo sapiens; identical to SEQ ID NO: 42420
  misc_feature 1..34: note = chr9:140682888-140682922
  misc_feature 1..34: note = hypo
  source 1..34: mol_type = genomic DNA

SEQ ID NO: 62886 - DNA, 30 bp, Homo sapiens; identical to SEQ ID NO: 42421
  misc_feature 1..30: note = chr9:140693933-140693963
  misc_feature 1..30: note = hypo
  source 1..30: mol_type = genomic DNA

SEQ ID NO: 62887 - DNA, 60 bp, Homo sapiens
  misc_feature 1..60: note = chr9:140708986-140709046
  misc_feature 1..60: note = hypo
  source 1..60: mol_type = genomic DNA
tcaggtggtaagtgccgctggtccgggtctgcaaaaacagtgcaggcgtctgtgacccca

SEQ ID NO: 62888 - DNA, 60 bp, Homo sapiens; identical to SEQ ID NO: 42423
  misc_feature 1..60: note = chr9:140727525-140727585
  misc_feature 1..60: note = hypo
  source 1..60: mol_type = genomic DNA

SEQ ID NO: 62889 - DNA, 82 bp, Homo sapiens; identical to SEQ ID NO: 42424
  misc_feature 1..82: note = chr9:140770013-140770095
  misc_feature 1..82: note = hypo
  source 1..82: mol_type = genomic DNA

SEQ ID NO: 62890 - DNA, 37 bp, Homo sapiens; identical to SEQ ID NO: 42425
  misc_feature 1..37: note = chr9:140793786-140793823
  misc_feature 1..37: note = hypo
  source 1..37: mol_type = genomic DNA

SEQ ID NO: 62891 - DNA, 58 bp, Homo sapiens; identical to SEQ ID NO: 42426
  misc_feature 1..58: note = chr9:140969282-140969340
  misc_feature 1..58: note = hypo
  source 1..58: mol_type = genomic DNA

SEQ ID NO: 62892 - DNA, 177 bp, Homo sapiens; identical to SEQ ID NO: 42427
  misc_feature 1..177: note = chr9:141022582-141022759
  misc_feature 1..177: note = hypo
  source 1..177: mol_type = genomic DNA

SEQ ID NO: 62893 - DNA, 30 bp, Homo sapiens; identical to SEQ ID NO: 42428
  misc_feature 1..30: note = chr10:482288-482318
  misc_feature 1..30: note = hypo
  source 1..30: mol_type = genomic DNA

SEQ ID NO: 62894 - DNA, 60 bp, Homo sapiens; identical to SEQ ID NO: 42429
  misc_feature 1..60: note = chr10:524611-524671
  misc_feature 1..60: note = hypo
  source 1..60: mol_type = genomic DNA

SEQ ID NO: 62895 - DNA, 35 bp, Homo sapiens; identical to SEQ ID NO: 42430
  misc_feature 1..35: note = chr10:769828-769863
  misc_feature 1..35: note = hypo
  source 1..35: mol_type = genomic DNA

SEQ ID NO: 62896 - DNA, 44 bp, Homo sapiens; identical to SEQ ID NO: 42432
  misc_feature 1..44: note = chr10:851432-851476
  misc_feature 1..44: note = hypo
  source 1..44: mol_type = genomic DNA

SEQ ID NO: 62897 - DNA, 67 bp, Homo sapiens
  misc_feature 1..67: note = chr10:978811-978878
  misc_feature 1..67: note = hypo
  source 1..67: mol_type = genomic DNA
ctgggatcaaggccccggcccttccccaaacccccaacccacacccgggaccaaaaggccccggccc

SEQ ID NO: 62898 - DNA, 72 bp, Homo sapiens
  misc_feature 1..72: note = chr10:978933-979005
  misc_feature 1..72: note = hypo
  source 1..72: mol_type = genomic DNA
tggtagctcagggaggtgttcacactcctgccgtttccgtgaggatggtgacgactccgaactatagcagca

SEQ ID NO: 62899 - DNA, 149 bp, Homo sapiens; identical to SEQ ID NO: 42434
  misc_feature 1..149: note = chr10:1156723-1156872
  misc_feature 1..149: note = hypo
  source 1..149: mol_type = genomic DNA

SEQ ID NO: 62900 - DNA, 52 bp, Homo sapiens; identical to SEQ ID NO: 42435
  misc_feature 1..52: note = chr10:1209169-1209221
  misc_feature 1..52: note = hypo
  source 1..52: mol_type = genomic DNA

SEQ ID NO: 62901 - DNA, 132 bp, Homo sapiens; identical to SEQ ID NO: 42436
  misc_feature 1..132: note = chr10:1233108-1233240
  misc_feature 1..132: note = hypo
  source 1..132: mol_type = genomic DNA

SEQ ID NO: 62902 - DNA, 30 bp, Homo sapiens; identical to SEQ ID NO: 42437
  misc_feature 1..30: note = chr10:1248527-1248557
  misc_feature 1..30: note = hypo
  source 1..30: mol_type = genomic DNA

SEQ ID NO: 62903 - DNA, 41 bp, Homo sapiens; identical to SEQ ID NO: 42438
  misc_feature 1..41: note = chr10:1252314-1252355
  misc_feature 1..41: note = hypo
  source 1..41: mol_type = genomic DNA

SEQ ID NO: 62904 - DNA, 221 bp, Homo sapiens; identical to SEQ ID NO: 42439
  misc_feature 1..221: note = chr10:1259797-1260018
  misc_feature 1..221: note = hypo
  source 1..221: mol_type = genomic DNA

SEQ ID NO: 62905 - DNA, 30 bp, Homo sapiens; identical to SEQ ID NO: 42440
  misc_feature 1..30: note = chr10:1438451-1438481
  misc_feature 1..30: note = hypo
  source 1..30: mol_type = genomic DNA

SEQ ID NO: 62906 - DNA, 127 bp, Homo sapiens; identical to SEQ ID NO: 42441
  misc_feature 1..127: note = chr10:1506252-1506379
  misc_feature 1..127: note = hypo
  source 1..127: mol_type = genomic DNA

SEQ ID NO: 62907 - DNA, 30 bp, Homo sapiens; identical to SEQ ID NO: 42442
  misc_feature 1..30: note = chr10:1555620-1555650
  misc_feature 1..30: note = hypo
  source 1..30: mol_type = genomic DNA

SEQ ID NO: 62908 - DNA, 40 bp, Homo sapiens; identical to SEQ ID NO: 42443
  misc_feature 1..40: note = chr10:1558592-1558632
  misc_feature 1..40: note = hypo
  source 1..40: mol_type = genomic DNA

SEQ ID NO: 62909 - DNA, 46 bp, Homo sapiens; identical to SEQ ID NO: 42444
  misc_feature 1..46: note = chr10:1585353-1585399
  misc_feature 1..46: note = hypo
  source 1..46: mol_type = genomic DNA

SEQ ID NO: 62910 - DNA, 140 bp, Homo sapiens; identical to SEQ ID NO: 42445
  misc_feature 1..140: note = chr10:1669194-1669334
  misc_feature 1..140: note = hypo
  source 1..140: mol_type = genomic DNA

SEQ ID NO: 62911 - DNA, 180 bp, Homo sapiens; identical to SEQ ID NO: 42446
  misc_feature 1..180: note = chr10:1716300-1716480
  misc_feature 1..180: note = hypo
  source 1..180: mol_type = genomic DNA

SEQ ID NO: 62912 - DNA, 90 bp, Homo sapiens; identical to SEQ ID NO: 42447
  misc_feature 1..90: note = chr10:1850230-1850320
  misc_feature 1..90: note = hypo
  source 1..90: mol_type = genomic DNA

SEQ ID NO: 62913 - DNA, 80 bp, Homo sapiens; identical to SEQ ID NO: 42448
  misc_feature 1..80: note = chr10:1995028-1995108
  misc_feature 1..80: note = hypo
  source 1..80: mol_type = genomic DNA

SEQ ID NO: 62914 - DNA, 30 bp, Homo sapiens; identical to SEQ ID NO: 15322
  misc_feature 1..30: note = chr10:2283030-2283060
  misc_feature 1..30: note = hypo
  source 1..30: mol_type = genomic DNA

SEQ ID NO: 62915 - DNA, 102 bp, Homo sapiens; identical to SEQ ID NO: 42450
  misc_feature 1..102: note = chr10:2452926-2453028
  misc_feature 1..102: note = hypo
  source 1..102: mol_type = genomic DNA

SEQ ID NO: 62916 - DNA, 30 bp, Homo sapiens; identical to SEQ ID NO: 42451
  misc_feature 1..30: note = chr10:2706731-2706761
  misc_feature 1..30: note = hypo
  source 1..30: mol_type = genomic DNA

SEQ ID NO: 62917 - DNA, 193 bp, Homo sapiens; identical to SEQ ID NO: 42452
  misc_feature 1..193: note = chr10:2758979-2759172
  misc_feature 1..193: note = hypo
  source 1..193: mol_type = genomic DNA

SEQ ID NO: 62918 - DNA, 30 bp, Homo sapiens; identical to SEQ ID NO: 42453
  misc_feature 1..30: note = chr10:2775311-2775341
  misc_feature 1..30: note = hypo
  source 1..30: mol_type = genomic DNA

SEQ ID NO: 62919 - DNA, 78 bp, Homo sapiens; identical to SEQ ID NO: 15323
  misc_feature 1..78: note = chr10:3161042-3161120
  misc_feature 1..78: note = hypo
  source 1..78: mol_type = genomic DNA

SEQ ID NO: 62920 - DNA, 84 bp, Homo sapiens; identical to SEQ ID NO: 42455
  misc_feature 1..84: note = chr10:3216467-3216551
  misc_feature 1..84: note = hypo
  source 1..84: mol_type = genomic DNA

SEQ ID NO: 62921 - DNA, 19 bp, Homo sapiens
  misc_feature 1..19: note = chr10:3285550-3285569
  misc_feature 1..19: note = hypo
  source 1..19: mol_type = genomic DNA
agccaggcgtgctggcgct

SEQ ID NO: 62922 - DNA, 70 bp, Homo sapiens
  misc_feature 1..70: note = chr10:3285698-3285768
  misc_feature 1..70: note = hypo
  source 1..70: mol_type = genomic DNA
taacaataaatagcaaacagcagagagcatcatcttaaggttttgaaaatacatacgtattactattatg

SEQ ID NO: 62923 - DNA, 74 bp, Homo sapiens; identical to SEQ ID NO: 42458
  misc_feature 1..74: note = chr10:3329710-3329784
  misc_feature 1..74: note = hypo
  source 1..74: mol_type = genomic DNA

SEQ ID NO: 62924 - DNA, 72 bp, Homo sapiens
  misc_feature 1..72: note = chr10:3330427-3330499
  misc_feature 1..72: note = hypo
  source 1..72: mol_type = genomic DNA
agcgagcaggtgccacgtccacaccgggtgaggcgtgaggtgagggctcccccgcgccgccctggcgtccag

SEQ ID NO: 62925 - skipped

SEQ ID NO: 62926 - DNA, 195 bp, Homo sapiens
  misc_feature 1..195: note = chr10:3678637-3678832
  misc_feature 1..195: note = hypo
  source 1..195: mol_type = genomic DNA
gagatgtttttatgtggttcaccttcgaccttcatcagggtgactcaggaggcacattctgaagccactctccaacacttaagttttttgccaggtatttttcacaaagcaacgatttgaacaatgaaggagaaaatgtagcctcgcaacttcattcgtaaataatccagactaaccgcacggagtataatggat

SEQ ID NO: 62927 - DNA, 56 bp, Homo sapiens
  misc_feature 1..56: note = chr10:3895354-3895410
  misc_feature 1..56: note = hypo
  source 1..56: mol_type = genomic DNA
gttcccaccacacagcggcggctcaactgcccaggctgtggggtttccagctgtgt

SEQ ID NO: 62928 - DNA, 128 bp, Homo sapiens
  misc_feature 1..128: note = chr10:4599789-4599917
  misc_feature 1..128: note = hypo
  source 1..128: mol_type = genomic DNA
aagcgtttcacagtgcggtgacgatgggatccgcccatgtttgcacgtgccaggagcagcggtagcagcagctccagggaggtgcacacttgtcagcggcagtggggtgctggcgggtgccagagggc

SEQ ID NO: 62929 - DNA, 40 bp, Homo sapiens
  misc_feature 1..40: note = chr10:4599965-4600005
  misc_feature 1..40: note = hypo
  source 1..40: mol_type = genomic DNA
ggtggagggcctgctggcagctgtgcgtgcagtgacactg

SEQ ID NO: 62930 - DNA, 185 bp, Homo sapiens; identical to SEQ ID NO: 42464
  misc_feature 1..185: note = chr10:5507960-5508145
  misc_feature 1..185: note = hypo
  source 1..185: mol_type = genomic DNA

SEQ ID NO: 62931 - DNA, 30 bp, Homo sapiens; identical to SEQ ID NO: 42465
  misc_feature 1..30: note = chr10:5523260-5523290
  misc_feature 1..30: note = hypo
  source 1..30: mol_type = genomic DNA

SEQ ID NO: 62932 - DNA, 70 bp, Homo sapiens; identical to SEQ ID NO: 42467
  misc_feature 1..70: note = chr10:5531049-5531119
  misc_feature 1..70: note = hypo
  source 1..70: mol_type = genomic DNA

SEQ ID NO: 62933 - DNA, 48 bp, Homo sapiens; identical to SEQ ID NO: 42468
  misc_feature 1..48: note = chr10:5538890-5538938
  misc_feature 1..48: note = hypo
  source 1..48: mol_type = genomic DNA

SEQ ID NO: 62934 - DNA, 877 bp, Homo sapiens; identical to SEQ ID NO: 42469
  misc_feature 1..877: note = chr10:5540651-5541528
  misc_feature 1..877: note = hypo
  source 1..877: mol_type = genomic DNA

SEQ ID NO: 62935 - DNA, 47 bp, Homo sapiens; identical to SEQ ID NO: 42470
  misc_feature 1..47: note = chr10:5553281-5553328
  misc_feature 1..47: note = hypo
  source 1..47: mol_type = genomic DNA

SEQ ID NO: 62936 - DNA, 74 bp, Homo sapiens; identical to SEQ ID NO: 42471
  misc_feature 1..74: note = chr10:5567136-5567210
  misc_feature 1..74: note = hypo
  source 1..74: mol_type = genomic DNA

SEQ ID NO: 62937 - DNA, 30 bp, Homo sapiens; identical to SEQ ID NO: 42472
  misc_feature 1..30: note = chr10:5588268-5588298
  misc_feature 1..30: note = hypo
  source 1..30: mol_type = genomic DNA

SEQ ID NO: 62938 - DNA, 160 bp, Homo sapiens; identical to SEQ ID NO: 42473
  misc_feature 1..160: note = chr10:5868078-5868238
  misc_feature 1..160: note = hypo
  source 1..160: mol_type = genomic DNA

SEQ ID NO: 62939 - DNA, 365 bp, Homo sapiens
  misc_feature 1..365: note = chr10:5874775-5875140
  misc_feature 1..365: note = hypo
  source 1..365: mol_type = genomic DNA
tcagcagttcaaaaccgtgctgacctgccagtacaagcaggccttgaggtcagtaaaaggtaacattacagacatcaaaagcaaattaaaaacccacagcctcagagaataactcctgatgccagctccttctcatggcaccccctgccccatcccaccagtgtcaggtcacaaagccccacactgcgccgggtggggatttaagattcccgctcccccacccctgccaccctgtagaacaaggcgctgccactcaagccagttccctgagaaccagtcggaccaggacaggcccctgaccacacccggcaaactggagtcctggccaaaggtgctgtgagtccatgaggtgctggcagggaggt

SEQ ID NO: 62940 - DNA, 48 bp, Homo sapiens; identical to SEQ ID NO: 42475
  misc_feature 1..48: note = chr10:5952951-5952999
  misc_feature 1..48: note = hypo
  source 1..48: mol_type = genomic DNA

SEQ ID NO: 62941 - DNA, 21 bp, Homo sapiens
  misc_feature 1..21: note = chr10:6009743-6009764
  misc_feature 1..21: note = hypo
  source 1..21: mol_type = genomic DNA
gggtgcggtagctcacgcctg

SEQ ID NO: 62942 - DNA, 30 bp, Homo sapiens; identical to SEQ ID NO: 42478
  misc_feature 1..30: note = chr10:6024581-6024611
  misc_feature 1..30: note = hypo
  source 1..30: mol_type = genomic DNA

SEQ ID NO: 62943 - DNA, 24 bp, Homo sapiens
  misc_feature 1..24: note = chr10:6127024-6127048
  misc_feature 1..24: note = hypo
  source 1..24: mol_type = genomic DNA
gagccaccgcgcccagccttcttt

SEQ ID NO: 62944 - DNA, 159 bp, Homo sapiens; identical to SEQ ID NO: 42481
  misc_feature 1..159: note = chr10:6159807-6159966
  misc_feature 1..159: note = hypo
  source 1..159: mol_type = genomic DNA

SEQ ID NO: 62945 - DNA, 21 bp, Homo sapiens
  misc_feature 1..21: note = chr10:6162138-6162159
  misc_feature 1..21: note = hypo
  source 1..21: mol_type = genomic DNA
ttttatggcacttgacgctgg

SEQ ID NO: 62946 - DNA, 24 bp, Homo sapiens
  misc_feature 1..24: note = chr10:6199196-6199220
  misc_feature 1..24: note = hypo
  source 1..24: mol_type = genomic DNA
tttttttttttgagacggagtctc

SEQ ID NO: 62947 - DNA, 133 bp, Homo sapiens; identical to SEQ ID NO: 42484
  misc_feature 1..133: note = chr10:6462190-6462323
  misc_feature 1..133: note = hypo
  source 1..133: mol_type = genomic DNA

SEQ ID NO: 62948 - DNA, 186 bp, Homo sapiens; identical to SEQ ID NO: 42485
  misc_feature 1..186: note = chr10:6505370-6505556
  misc_feature 1..186: note = hypo
  source 1..186: mol_type = genomic DNA

SEQ ID NO: 62949 - DNA, 30 bp, Homo sapiens; identical to SEQ ID NO: 42486
  misc_feature 1..30: note = chr10:6528008-6528038
  misc_feature 1..30: note = hypo
  source 1..30: mol_type = genomic DNA

SEQ ID NO: 62950 - DNA, 140 bp, Homo sapiens; identical to SEQ ID NO: 42487
  misc_feature 1..140: note = chr10:6531036-6531176
  misc_feature 1..140: note = hypo
  source 1..140: mol_type = genomic DNA

SEQ ID NO: 62951 - DNA, 15 bp, Homo sapiens
  misc_feature 1..15: note = chr10:6564170-6564185
  misc_feature 1..15: note = hypo
  source 1..15: mol_type = genomic DNA
cgggattacaagagt

SEQ ID NO: 62952 - DNA, 88 bp, Homo sapiens
  misc_feature 1..88: note = chr10:6577673-6577761
  misc_feature 1..88: note = hypo
  source 1..88: mol_type = genomic DNA
tcttggtcttttgaagtctcccctcgccgcgcctctttagacgcacctgagatccatcaaagcggacagatcccgattacagtcccct

SEQ ID NO: 62953 - DNA, 21 bp, Homo sapiens
  misc_feature 1..21: note = chr10:6586866-6586887
  misc_feature 1..21: note = hypo
  source 1..21: mol_type = genomic DNA
ccactgcgcccagacccacat

SEQ ID NO: 62954 - DNA, 171 bp, Homo sapiens; identical to SEQ ID NO: 42491
  misc_feature 1..171: note = chr10:7139938-7140109
  misc_feature 1..171: note = hypo
  source 1..171: mol_type = genomic DNA

SEQ ID NO: 62955 - DNA, 65 bp, Homo sapiens; identical to SEQ ID NO: 42492
  misc_feature 1..65: note = chr10:7203062-7203127
  misc_feature 1..65: note = hypo
  source 1..65: mol_type = genomic DNA

SEQ ID NO: 62956 - DNA, 28 bp, Homo sapiens
  misc_feature 1..28: note = chr10:7205705-7205733
  misc_feature 1..28: note = hypo
  source 1..28: mol_type = genomic DNA
taatgggccacctcccgagggcagactc

SEQ ID NO: 62957 - DNA, 45 bp, Homo sapiens
  misc_feature 1..45: note = chr10:7213064-7213109
  misc_feature 1..45: note = hypo
  source 1..45: mol_type = genomic DNA
gctgggtcctctccagcactctccaggcctcggccgttcctggcc

SEQ ID NO: 62958 - DNA, 30 bp, Homo sapiens; identical to SEQ ID NO: 15344
  misc_feature 1..30: note = chr10:7213658-7213688
  misc_feature 1..30: note = hypo
  source 1..30: mol_type = genomic DNA

SEQ ID NO: 62959 - DNA, 108 bp, Homo sapiens; identical to SEQ ID NO: 42496
  misc_feature 1..108: note = chr10:7214167-7214275
  misc_feature 1..108: note = hypo
  source 1..108: mol_type = genomic DNA

SEQ ID NO: 62960 - DNA, 30 bp, Homo sapiens; identical to SEQ ID NO: 42497
  misc_feature 1..30: note = chr10:7215974-7216004
  misc_feature 1..30: note = hypo
  source 1..30: mol_type = genomic DNA

SEQ ID NO: 62961 - DNA, 121 bp, Homo sapiens
  misc_feature 1..121: note = chr10:7236090-7236211
  misc_feature 1..121: note = hypo
  source 1..121: mol_type = genomic DNA
cgccaaggcctgcttcgttctgagtttgcttatggggtacgtctggacctcagtggaccattgagtgactctggttccagcttctcccaggtcccctacctcccctcgctgcaccccctcg

SEQ ID NO: 62962 - DNA, 30 bp, Homo sapiens; identical to SEQ ID NO: 42499
  misc_feature 1..30: note = chr10:7258531-7258561
  misc_feature 1..30: note = hypo
  source 1..30: mol_type = genomic DNA

SEQ ID NO: 62963 - DNA, 22 bp, Homo sapiens
  misc_feature 1..22: note = chr10:7288388-7288410
  misc_feature 1..22: note = hypo
  source 1..22: mol_type = genomic DNA
gaatgtgagagaggccgggtgc

SEQ ID NO: 62964 - DNA, 37 bp, Homo sapiens; identical to SEQ ID NO: 42501
  misc_feature 1..37: note = chr10:7290469-7290506
  misc_feature 1..37: note = hypo
  source 1..37: mol_type = genomic DNA

SEQ ID NO: 62965 - DNA, 70 bp, Homo sapiens; identical to SEQ ID NO: 42502
  misc_feature 1..70: note = chr10:7339992-7340062
  misc_feature 1..70: note = hypo
  source 1..70: mol_type = genomic DNA

SEQ ID NO: 62966 - DNA, 30 bp, Homo sapiens; identical to SEQ ID NO: 42503
  misc_feature 1..30: note = chr10:7391910-7391940
  misc_feature 1..30: note = hypo
  source 1..30: mol_type = genomic DNA

SEQ ID NO: 62967 - DNA, 23 bp, Homo sapiens
  misc_feature 1..23: note = chr10:7414166-7414189
  misc_feature 1..23: note = hypo
  source 1..23: mol_type = genomic DNA
gccacgcccggccttcttgaaat

SEQ ID NO: 62968 - DNA, 34 bp, Homo sapiens; identical to SEQ ID NO: 42506
  misc_feature 1..34: note = chr10:7472551-7472585
  misc_feature 1..34: note = hypo
  source 1..34: mol_type = genomic DNA

SEQ ID NO: 62969 - DNA, 30 bp, Homo sapiens; identical to SEQ ID NO: 42507
  misc_feature 1..30: note = chr10:7608124-7608154
  misc_feature 1..30: note = hypo
  source 1..30: mol_type = genomic DNA

SEQ ID NO: 62970 - DNA, 58 bp, Homo sapiens; identical to SEQ ID NO: 42508
  misc_feature 1..58: note = chr10:7765067-7765125
  misc_feature 1..58: note = hypo
  source 1..58: mol_type = genomic DNA

SEQ ID NO: 62971 - DNA, 30 bp, Homo sapiens; identical to SEQ ID NO: 42509
  misc_feature 1..30: note = chr10:7780425-7780455
  misc_feature 1..30: note = hypo
  source 1..30: mol_type = genomic DNA

SEQ ID NO: 62972 - DNA, 34 bp, Homo sapiens; identical to SEQ ID NO: 42510
  misc_feature 1..34: note = chr10:7985160-7985194
  misc_feature 1..34: note = hypo
  source 1..34: mol_type = genomic DNA

SEQ ID NO: 62973 - DNA, 30 bp, Homo sapiens; identical to SEQ ID NO: 42511
  misc_feature 1..30: note = chr10:8025070-8025100
  misc_feature 1..30: note = hypo
  source 1..30: mol_type = genomic DNA

SEQ ID NO: 62974 - DNA, 30 bp, Homo sapiens; identical to SEQ ID NO: 42512
  misc_feature 1..30: note = chr10:8067803-8067833
  misc_feature 1..30: note = hypo
  source 1..30: mol_type = genomic DNA

SEQ ID NO: 62975 - DNA, 30 bp, Homo sapiens; identical to SEQ ID NO: 42513
  misc_feature 1..30: note = chr10:10770967-10770997
  misc_feature 1..30: note = hypo
  source 1..30: mol_type = genomic DNA

SEQ ID NO: 62976 - DNA, 35 bp, Homo sapiens; identical to SEQ ID NO: 42514
  misc_feature 1..35: note = chr10:10867443-10867478
  misc_feature 1..35: note = hypo
  source 1..35: mol_type = genomic DNA

SEQ ID NO: 62977 - DNA, 30 bp, Homo sapiens; identical to SEQ ID NO: 42515
  misc_feature 1..30: note = chr10:11344374-11344404
  misc_feature 1..30: note = hypo
  source 1..30: mol_type = genomic DNA

SEQ ID NO: 62978 - DNA, 136 bp, Homo sapiens; identical to SEQ ID NO: 42516
  misc_feature 1..136: note = chr10:11357646-11357782
  misc_feature 1..136: note = hypo
  source 1..136: mol_type = genomic DNA

SEQ ID NO: 62979 - DNA, 151 bp, Homo sapiens; identical to SEQ ID NO: 42517
  misc_feature 1..151: note = chr10:11472842-11472993
  misc_feature 1..151: note = hypo
  source 1..151: mol_type = genomic DNA

SEQ ID NO: 62980 - DNA, 30 bp, Homo sapiens; identical to SEQ ID NO: 42518
  misc_feature 1..30: note = chr10:11486576-11486606
  misc_feature 1..30: note = hypo
  source 1..30: mol_type = genomic DNA

SEQ ID NO: 62981 - DNA, 30 bp, Homo sapiens; identical to SEQ ID NO: 42519
  misc_feature 1..30: note = chr10:12139715-12139745
  misc_feature 1..30: note = hypo
  source 1..30: mol_type = genomic DNA

SEQ ID NO: 62982 - DNA, 47 bp, Homo sapiens; identical to SEQ ID NO: 42520
  misc_feature 1..47: note = chr10:12531976-12532023
  misc_feature 1..47: note = hypo
  source 1..47: mol_type = genomic DNA

SEQ ID NO: 62983 - DNA, 29 bp, Homo sapiens
  misc_feature 1..29: note = chr10:12554507-12554536
  misc_feature 1..29: note = hypo
  source 1..29: mol_type = genomic DNA
cctcagcagctgcccgttgggagactcgg

SEQ ID NO: 62984 - DNA, 30 bp, Homo sapiens; identical to SEQ ID NO: 42522
  misc_feature 1..30: note = chr10:12844882-12844912
  misc_feature 1..30: note = hypo
  source 1..30: mol_type = genomic DNA

SEQ ID NO: 62985 - DNA, 17 bp, Homo sapiens
  misc_feature 1..17: note = chr10:13130744-13130761
  misc_feature 1..17: note = hypo
  source 1..17: mol_type = genomic DNA
gggcgcagtggctcacg

SEQ ID NO: 62986 - DNA, 78 bp, Homo sapiens; identical to SEQ ID NO: 42524
  misc_feature 1..78: note = chr10:13137622-13137700
  misc_feature 1..78: note = hypo
  source 1..78: mol_type = genomic DNA

SEQ ID NO: 62987 - DNA, 30 bp, Homo sapiens; identical to SEQ ID NO: 42525
  misc_feature 1..30: note = chr10:13140531-13140561
  misc_feature 1..30: note = hypo
  source 1..30: mol_type = genomic DNA

SEQ ID NO: 62988 - DNA, 126 bp, Homo sapiens; identical to SEQ ID NO: 15352
  misc_feature 1..126: note = chr10:13355078-13355204
  misc_feature 1..126: note = hypo
  source 1..126: mol_type = genomic DNA

SEQ ID NO: 62989 - DNA, 43 bp, Homo sapiens; identical to SEQ ID NO: 42528
  misc_feature 1..43: note = chr10:13426126-13426169
  misc_feature 1..43: note = hypo
  source 1..43: mol_type = genomic DNA

SEQ ID NO: 62990 - DNA, 149 bp, Homo sapiens; identical to SEQ ID NO: 42529
  misc_feature 1..149: note = chr10:13751257-13751406
  misc_feature 1..149: note = hypo
  source 1..149: mol_type = genomic DNA

SEQ ID NO: 62991 - DNA, 161 bp, Homo sapiens; identical to SEQ ID NO: 42530
  misc_feature 1..161: note = chr10:13898478-13898639
  misc_feature 1..161: note = hypo
  source 1..161: mol_type = genomic DNA

SEQ ID NO: 62992 - DNA, 86 bp, Homo sapiens; identical to SEQ ID NO: 42531
  misc_feature 1..86: note = chr10:14997207-14997293
  misc_feature 1..86: note = hypo
  source 1..86: mol_type = genomic DNA

SEQ ID NO: 62993 - DNA, 38 bp, Homo sapiens; identical to SEQ ID NO: 42532
  misc_feature 1..38: note = chr10:15000601-15000639
  misc_feature 1..38: note = hypo
  source 1..38: mol_type = genomic DNA

SEQ ID NO: 62994 - DNA, 98 bp, Homo sapiens; identical to SEQ ID NO: 42533
  misc_feature 1..98: note = chr10:15003062-15003160
  misc_feature 1..98: note = hypo
  source 1..98: mol_type = genomic DNA

SEQ ID NO: 62995 - DNA, 19 bp, Homo sapiens
  misc_feature 1..19: note = chr10:15131223-15131242
  misc_feature 1..19: note = hypo
  source 1..19: mol_type = genomic DNA
taaatatgtattggccggg

SEQ ID NO: 62996 - DNA, 30 bp, Homo sapiens; identical to SEQ ID NO: 42535
  misc_feature 1..30: note = chr10:15255872-15255902
  misc_feature 1..30: note = hypo
  source 1..30: mol_type = genomic DNA

SEQ ID NO: 62997 - DNA, 30 bp, Homo sapiens; identical to SEQ ID NO: 42536
  misc_feature 1..30: note = chr10:15484112-15484142
  misc_feature 1..30: note = hypo
  source 1..30: mol_type = genomic DNA

SEQ ID NO: 62998 - DNA, 25 bp, Homo sapiens
  misc_feature 1..25: note = chr10:15568453-15568478
  misc_feature 1..25: note = hypo
  source 1..25: mol_type = genomic DNA
tgtgagccaccgcacccggcccatt

SEQ ID NO: 62999 - DNA, 29 bp, Homo sapiens
  misc_feature 1..29: note = chr10:15783189-15783218
  misc_feature 1..29: note = hypo
  source 1..29: mol_type = genomic DNA
tgagccactatgcccggccgtgattatta

SEQ ID NO: 63000 - DNA, 16 bp, Homo sapiens
  misc_feature 1..16: note = chr10:15932019-15932035
  misc_feature 1..16: note = hypo
  source 1..16: mol_type = genomic DNA
acgatgccaagcatta

SEQ ID NO: 63001 - DNA, 30 bp, Homo sapiens; identical to SEQ ID NO: 42540
  misc_feature 1..30: note = chr10:16714330-16714360
  misc_feature 1..30: note = hypo
  source 1..30: mol_type = genomic DNA

SEQ ID NO: 63002 - DNA, 30 bp, Homo sapiens; identical to SEQ ID NO: 15355
  misc_feature 1..30: note = chr10:16715583-16715613
  misc_feature 1..30: note = hypo
  source 1..30: mol_type = genomic DNA

SEQ ID NO: 63003 - DNA, 35 bp, Homo sapiens; identical to SEQ ID NO: 24653
  misc_feature 1..35: note = chr10:17429622-17429657
  misc_feature 1..35: note = hypo
  source 1..35: mol_type = genomic DNA

SEQ ID NO: 63004 - DNA, 95 bp, Homo sapiens; identical to SEQ ID NO: 42544
  misc_feature 1..95: note = chr10:17579985-17580080
  misc_feature 1..95: note = hypo
  source 1..95: mol_type = genomic DNA

SEQ ID NO: 63005 - DNA, 139 bp, Homo sapiens; identical to SEQ ID NO: 42545
  misc_feature 1..139: note = chr10:20069005-20069144
  misc_feature 1..139: note = hypo
  source 1..139: mol_type = genomic DNA

SEQ ID NO: 63006 - DNA, 137 bp, Homo sapiens; identical to SEQ ID NO: 42546
  misc_feature 1..137: note = chr10:22033212-22033349
  misc_feature 1..137: note = hypo
  source 1..137: mol_type = genomic DNA

SEQ ID NO: 63007 - DNA, 41 bp, Homo sapiens; identical to SEQ ID NO: 42547
  misc_feature 1..41: note = chr10:22450029-22450070
  misc_feature 1..41: note = hypo
  source 1..41: mol_type = genomic DNA

SEQ ID NO: 63008 - DNA, 33 bp, Homo sapiens; identical to SEQ ID NO: 42548
  misc_feature 1..33: note = chr10:22567375-22567408
  misc_feature 1..33: note = hypo
  source 1..33: mol_type = genomic DNA

SEQ ID NO: 63009 - DNA, 30 bp, Homo sapiens; identical to SEQ ID NO: 42549
  misc_feature 1..30: note = chr10:22823530-22823560
  misc_feature 1..30: note = hypo
  source 1..30: mol_type = genomic DNA

SEQ ID NO: 63010 - DNA, 30 bp, Homo sapiens; identical to SEQ ID NO: 42550
  misc_feature 1..30: note = chr10:22833980-22834010
  misc_feature 1..30: note = hypo
  source 1..30: mol_type = genomic DNA

SEQ ID NO: 63011 - DNA, 30 bp, Homo sapiens; identical to SEQ ID NO: 42551
  misc_feature 1..30: note = chr10:22870025-22870055
  misc_feature 1..30: note = hypo
  source 1..30: mol_type = genomic DNA

SEQ ID NO: 63012 - DNA, 41 bp, Homo sapiens; identical to SEQ ID NO: 42552
  misc_feature 1..41: note = chr10:24841812-24841853
  misc_feature 1..41: note = hypo
  source 1..41: mol_type = genomic DNA

SEQ ID NO: 63013 - DNA, 24 bp, Homo sapiens
  misc_feature 1..24: note = chr10:24842550-24842574
  misc_feature 1..24: note = hypo
  source 1..24: mol_type = genomic DNA
caggaaagggccaggcgaggtggc

SEQ ID NO: 63014 - DNA, 30 bp, Homo sapiens; identical to SEQ ID NO: 42554
  misc_feature 1..30: note = chr10:24908432-24908462
  misc_feature 1..30: note = hypo
  source 1..30: mol_type = genomic DNA

SEQ ID NO: 63015 - DNA, 42 bp, Homo sapiens; identical to SEQ ID NO: 42555
  misc_feature 1..42: note = chr10:24988521-24988563
  misc_feature 1..42: note = hypo
  source 1..42: mol_type = genomic DNA

SEQ ID NO: 63016 - DNA, 148 bp, Homo sapiens; identical to SEQ ID NO: 42556
  misc_feature 1..148: note = chr10:25592447-25592595
  misc_feature 1..148: note = hypo
  source 1..148: mol_type = genomic DNA

SEQ ID NO: 63017 - DNA, 32 bp, Homo sapiens; identical to SEQ ID NO: 42557
  misc_feature 1..32: note = chr10:26127993-26128025
  misc_feature 1..32: note = hypo
  source 1..32: mol_type = genomic DNA

SEQ ID NO: 63018 - DNA, 30 bp, Homo sapiens; identical to SEQ ID NO: 42558
  misc_feature 1..30: note = chr10:26211012-26211042
  misc_feature 1..30: note = hypo
  source 1..30: mol_type = genomic DNA

SEQ ID NO: 63019 - DNA, 80 bp, Homo sapiens; identical to SEQ ID NO: 42559
  misc_feature 1..80: note = chr10:26638401-26638481
  misc_feature 1..80: note = hypo
  source 1..80: mol_type = genomic DNA

SEQ ID NO: 63020 - DNA, 30 bp, Homo sapiens; identical to SEQ ID NO: 42560
  misc_feature 1..30: note = chr10:26720842-26720872
  misc_feature 1..30: note = hypo
  source 1..30: mol_type = genomic DNA

SEQ ID NO: 63021 - DNA, 132 bp, Homo sapiens; identical to SEQ ID NO: 42561
  misc_feature 1..132: note = chr10:26733284-26733416
  misc_feature 1..132: note = hypo
  source 1..132: mol_type = genomic DNA

SEQ ID NO: 63022 - DNA, 30 bp, Homo sapiens; identical to SEQ ID NO: 15362
  misc_feature 1..30: note = chr10:26739045-26739075
  misc_feature 1..30: note = hypo
  source 1..30: mol_type = genomic DNA

SEQ ID NO: 63023 - DNA, 21 bp, Homo sapiens
  misc_feature 1..21: note = chr10:26791280-26791301
  misc_feature 1..21: note = hypo
  source 1..21: mol_type = genomic DNA
gtctcttgggccaggcgtggt

SEQ ID NO: 63024 - DNA, 39 bp, Homo sapiens; identical to SEQ ID NO: 42564
  misc_feature 1..39: note = chr10:26801561-26801600
  misc_feature 1..39: note = hypo
  source 1..39: mol_type = genomic DNA

SEQ ID NO: 63025 - DNA, 99 bp, Homo sapiens; identical to SEQ ID NO: 42565
  misc_feature 1..99: note = chr10:26801660-26801759
  misc_feature 1..99: note = hypo
  source 1..99: mol_type = genomic DNA

SEQ ID NO: 63026 - DNA, 20 bp, Homo sapiens
  misc_feature 1..20: note = chr10:26832097-26832117
  misc_feature 1..20: note = hypo
  source 1..20: mol_type = genomic DNA
atgtttgttgaatgacggcc

SEQ ID NO: 63027 - DNA, 41 bp, Homo sapiens; identical to SEQ ID NO: 42567
  misc_feature 1..41: note = chr10:26877719-26877760
  misc_feature 1..41: note = hypo
  source 1..41: mol_type = genomic DNA

SEQ ID NO: 63028 - DNA, 21 bp, Homo sapiens
  misc_feature 1..21: note = chr10:26907322-26907343
  misc_feature 1..21: note = hypo
  source 1..21: mol_type = genomic DNA
agccaccgcacccggcccaaa

SEQ ID NO: 63029 - DNA, 30 bp, Homo sapiens; identical to SEQ ID NO: 15364
  misc_feature 1..30: note = chr10:26926812-26926842
  misc_feature 1..30: note = hypo
  source 1..30: mol_type = genomic DNA

SEQ ID NO: 63030 - DNA, 45 bp, Homo sapiens; identical to SEQ ID NO: 42570
  misc_feature 1..45: note = chr10:26942249-26942294
  misc_feature 1..45: note = hypo
  source 1..45: mol_type = genomic DNA

SEQ ID NO: 63031 - DNA, 22 bp, Homo sapiens
  misc_feature 1..22: note = chr10:28791009-28791031
  misc_feature 1..22: note = hypo
  source 1..22: mol_type = genomic DNA
gccaccacgccctgccagtatg

SEQ ID NO: 63032 - DNA, 30 bp, Homo sapiens; identical to SEQ ID NO: 42572
  misc_feature 1..30: note = chr10:29164934-29164964
  misc_feature 1..30: note = hypo
  source 1..30: mol_type = genomic DNA

SEQ ID NO: 63033 - DNA, 32 bp, Homo sapiens; identical to SEQ ID NO: 42573
  misc_feature 1..32: note = chr10:31006068-31006100
  misc_feature 1..32: note = hypo
  source 1..32: mol_type = genomic DNA

SEQ ID NO: 63034 - DNA, 41 bp, Homo sapiens
  misc_feature 1..41: note = chr10:31892881-31892922
  misc_feature 1..41: note = hypo
  source 1..41: mol_type = genomic DNA
catgctgcaaattcccgtggccagcacccgaggcctgctgg

SEQ ID NO: 63035 - DNA, 10 bp, Homo sapiens
  misc_feature 1..10: note = chr10:31893079-31893089
  misc_feature 1..10: note = hypo
  source 1..10: mol_type = genomic DNA
gtccgctcca

SEQ ID NO: 63036 - DNA, 16 bp, Homo sapiens
  misc_feature 1..16: note = chr10:32171091-32171107
  misc_feature 1..16: note = hypo
  source 1..16: mol_type = genomic DNA
tcggcctcccaaagtg

SEQ ID NO: 63037 - DNA, 19 bp, Homo sapiens
  misc_feature 1..19: note = chr10:32499025-32499044
  misc_feature 1..19: note = hypo
  source 1..19: mol_type = genomic DNA
caaattctccagtcccgcc

SEQ ID NO: 63038 - DNA, 30 bp, Homo sapiens; identical to SEQ ID NO: 42577
  misc_feature 1..30: note = chr10:32638913-32638943
  misc_feature 1..30: note = hypo
  source 1..30: mol_type = genomic DNA

SEQ ID NO: 63039 - DNA, 21 bp, Homo sapiens
  misc_feature 1..21: note = chr10:32736537-32736558
  misc_feature 1..21: note = hypo
  source 1..21: mol_type = genomic DNA
taaaagggagcagggcgcaca

SEQ ID NO: 63040 - DNA, 30 bp, Homo sapiens; identical to SEQ ID NO: 42579
  misc_feature 1..30: note = chr10:33233494-33233524
  misc_feature 1..30: note = hypo
  source 1..30: mol_type = genomic DNA

SEQ ID NO: 63041 - DNA, 31 bp, Homo sapiens; identical to SEQ ID NO: 15367
  misc_feature 1..31: note = chr10:38078895-38078926
  misc_feature 1..31: note = hypo
  source 1..31: mol_type = genomic DNA

SEQ ID NO: 63042 - DNA, 61 bp, Homo sapiens; identical to SEQ ID NO: 42581
  misc_feature 1..61: note = chr10:38445833-38445894
  misc_feature 1..61: note = hypo
  source 1..61: mol_type = genomic DNA

SEQ ID NO: 63043 - DNA, 30 bp, Homo sapiens; identical to SEQ ID NO: 42582
  misc_feature 1..30: note = chr10:42777495-42777525
  misc_feature 1..30: note = hypo
  source 1..30: mol_type = genomic DNA

SEQ ID NO: 63044 - DNA, 30 bp, Homo sapiens; identical to SEQ ID NO: 42583
  misc_feature 1..30: note = chr10:43047017-43047047
  misc_feature 1..30: note = hypo
  source 1..30: mol_type = genomic DNA

SEQ ID NO: 63045 - DNA, 36 bp, Homo sapiens; identical to SEQ ID NO: 42584
  misc_feature 1..36: note = chr10:43265217-43265253
  misc_feature 1..36: note = hypo
  source 1..36: mol_type = genomic DNA

SEQ ID NO: 63046 - DNA, 30 bp, Homo sapiens; identical to SEQ ID NO: 42585
  misc_feature 1..30: note = chr10:43615515-43615545
  misc_feature 1..30: note = hypo
  source 1..30: mol_type = genomic DNA

SEQ ID NO: 63047 - DNA, 24 bp, Homo sapiens
  misc_feature 1..24: note = chr10:43858319-43858343
  misc_feature 1..24: note = hypo
  source 1..24: mol_type = genomic DNA
gagtccagtagtcctcgtggagac

SEQ ID NO: 63048 - DNA, 38 bp, Homo sapiens
  misc_feature 1..38: note = chr10:43905839-43905877
  misc_feature 1..38: note = hypo
  source 1..38: mol_type = genomic DNA
gccctgtcattcaggcgggagtgcagtggtacaatcac

SEQ ID NO: 63049 - DNA, 44 bp, Homo sapiens; identical to SEQ ID NO: 42588
  misc_feature 1..44: note = chr10:43906064-43906108
  misc_feature 1..44: note = hypo
  source 1..44: mol_type = genomic DNA

SEQ ID NO: 63050 - DNA, 118 bp, Homo sapiens; identical to SEQ ID NO: 42589
  misc_feature 1..118: note = chr10:44197833-44197951
  misc_feature 1..118: note = hypo
  source 1..118: mol_type = genomic DNA

SEQ ID NO: 63051 - DNA, 30 bp, Homo sapiens; identical to SEQ ID NO: 42590
  misc_feature 1..30: note = chr10:44433895-44433925
  misc_feature 1..30: note = hypo
  source 1..30: mol_type = genomic DNA

SEQ ID NO: 63052 - DNA, 37 bp, Homo sapiens; identical to SEQ ID NO: 42591
  misc_feature 1..37: note = chr10:44500784-44500821
  misc_feature 1..37: note = hypo
  source 1..37: mol_type = genomic DNA

SEQ ID NO: 63053 - DNA, 86 bp, Homo sapiens; identical to SEQ ID NO: 42592
  misc_feature 1..86: note = chr10:44547328-44547414
  misc_feature 1..86: note = hypo
  source 1..86: mol_type = genomic DNA

SEQ ID NO: 63054 - DNA, 38 bp, Homo sapiens; identical to SEQ ID NO: 42593
  misc_feature 1..38: note = chr10:44594208-44594246
  misc_feature 1..38: note = hypo
  source 1..38: mol_type = genomic DNA

SEQ ID NO: 63055 - DNA, 34 bp, Homo sapiens; identical to SEQ ID NO: 42594
  misc_feature 1..34: note = chr10:44869035-44869069
  misc_feature 1..34: note = hypo
  source 1..34: mol_type = genomic DNA

SEQ ID NO: 63056 - DNA, 30 bp, Homo sapiens; identical to SEQ ID NO: 42595
  misc_feature 1..30: note = chr10:46009848-46009878
  misc_feature 1..30: note = hypo
  source 1..30: mol_type = genomic DNA

SEQ ID NO: 63057 - DNA, 28 bp, Homo sapiens
  misc_feature 1..28: note = chr10:46221028-46221056
  misc_feature 1..28: note = hypo
  source 1..28: mol_type = genomic DNA
acaaacaaacaaacgacaacaaaaaaaa

SEQ ID NO: 63058 - DNA, 162 bp, Homo sapiens; identical to SEQ ID NO: 42597
  misc_feature 1..162: note = chr10:49393632-49393794
  misc_feature 1..162: note = hypo
  source 1..162: mol_type = genomic DNA

SEQ ID NO: 63059 - DNA, 30 bp, Homo sapiens; identical to SEQ ID NO: 42598
  misc_feature 1..30: note = chr10:49541963-49541993
  misc_feature 1..30: note = hypo
  source 1..30: mol_type = genomic DNA

SEQ ID NO: 63060 - DNA, 28 bp, Homo sapiens
  misc_feature 1..28: note = chr10:49652949-49652977
  misc_feature 1..28: note = hypo
  source 1..28: mol_type = genomic DNA
cccagacggctggctcgcgtgtcagtgg

SEQ ID NO: 63061 - DNA, 30 bp, Homo sapiens; identical to SEQ ID NO: 15370
  misc_feature 1..30: note = chr10:49929928-49929958
  misc_feature 1..30: note = hypo
  source 1..30: mol_type = genomic DNA

SEQ ID NO: 63062 - DNA, 30 bp, Homo sapiens; identical to SEQ ID NO: 42601
  misc_feature 1..30: note = chr10:50007569-50007599
  misc_feature 1..30: note = hypo
  source 1..30: mol_type = genomic DNA

SEQ ID NO: 63063 - DNA, 30 bp, Homo sapiens; identical to SEQ ID NO: 42602
  misc_feature 1..30: note = chr10:50105263-50105293
  misc_feature 1..30: note = hypo
  source 1..30: mol_type = genomic DNA

SEQ ID NO: 63064 - DNA, 88 bp, Homo sapiens
  misc_feature 1..88: note = chr10:50507469-50507557
  misc_feature 1..88: note = hypo
  source 1..88: mol_type = genomic DNA
ctgagcagctggacacgcagagagcggaaggtacagcccagacacttgtctggctccttagcgtgggcagggaggctcaagttcatgg

SEQ ID NO: 63065 - DNA, 103 bp, Homo sapiens
  misc_feature 1..103: note = chr10:50507619-50507722
  misc_feature 1..103: note = hypo
  source 1..103: mol_type = genomic DNA
gtgcagggtggtatgtgtgtgccgggagcccattggtgttggggctaaggttcttggtgtgctggatgggcctcggggaccacgtacccggaaccgtgtacat

SEQ ID NO: 63066 - DNA, 41 bp, Homo sapiens; identical to SEQ ID NO: 42604
  misc_feature 1..41: note = chr10:50748353-50748394
  misc_feature 1..41: note = hypo
  source 1..41: mol_type = genomic DNA

SEQ ID NO: 63067 - DNA, 17 bp, Homo sapiens
  misc_feature 1..17: note = chr10:57918195-57918212
  misc_feature 1..17: note = hypo
  source 1..17: mol_type = genomic DNA
atttgaatgtaaggccg

SEQ ID NO: 63068 - DNA, 47 bp, Homo sapiens; identical to SEQ ID NO: 42606
  misc_feature 1..47: note = chr10:69310972-69311019
  misc_feature 1..47: note = hypo
  source 1..47: mol_type = genomic DNA

SEQ ID NO: 63069 - DNA, 30 bp, Homo sapiens; identical to SEQ ID NO: 42607
  misc_feature 1..30: note = chr10:69578014-69578044
  misc_feature 1..30: note = hypo
  source 1..30: mol_type = genomic DNA

SEQ ID NO: 63070 - DNA, 80 bp, Homo sapiens; identical to SEQ ID NO: 15373
  misc_feature 1..80: note = chr10:70288112-70288192
  misc_feature 1..80: note = hypo
  source 1..80: mol_type = genomic DNA

SEQ ID NO: 63071 - DNA, 96 bp, Homo sapiens; identical to SEQ ID NO: 15374
  misc_feature 1..96: note = chr10:70476540-70476636
  misc_feature 1..96: note = hypo
  source 1..96: mol_type = genomic DNA

SEQ ID NO: 63072 - DNA, 18 bp, Homo sapiens
  misc_feature 1..18: note = chr10:70483311-70483329
  misc_feature 1..18: note = hypo
  source 1..18: mol_type = genomic DNA
taaaagtaaatgggccgg

SEQ ID NO: 63073 - DNA, 30 bp, Homo sapiens; identical to SEQ ID NO: 42612
  misc_feature 1..30: note = chr10:72489875-72489905
  misc_feature 1..30: note = hypo
  source 1..30: mol_type = genomic DNA

SEQ ID NO: 63074 - DNA, 136 bp, Homo sapiens; identical to SEQ ID NO: 42613
  misc_feature 1..136: note = chr10:73466313-73466449
  misc_feature 1..136: note = hypo
  source 1..136: mol_type = genomic DNA

SEQ ID NO: 63075 - DNA, 30 bp, Homo sapiens; identical to SEQ ID NO: 42614
  misc_feature 1..30: note = chr10:73553133-73553163
  misc_feature 1..30: note = hypo
  source 1..30: mol_type = genomic DNA

SEQ ID NO: 63076 - DNA, 23 bp, Homo sapiens
  misc_feature 1..23: note = chr10:73976938-73976961
  misc_feature 1..23: note = hypo
  source 1..23: mol_type = genomic DNA
aatgaaagtgtaggccgggcgcg

SEQ ID NO: 63077 - DNA, 84 bp, Homo sapiens; identical to SEQ ID NO: 42616
  misc_feature 1..84: note = chr10:75501525-75501609
  misc_feature 1..84: note = hypo
  source 1..84: mol_type = genomic DNA

SEQ ID NO: 63078 - DNA, 36 bp, Homo sapiens; identical to SEQ ID NO: 42617
  misc_feature 1..36: note = chr10:76784730-76784766
  misc_feature 1..36: note = hypo
  source 1..36: mol_type = genomic DNA

SEQ ID NO: 63079 - DNA, 23 bp, Homo sapiens
  misc_feature 1..23: note = chr10:76997760-76997783
  misc_feature 1..23: note = hypo
  source 1..23: mol_type = genomic DNA
accgcacccggccaagaatccat

SEQ ID NO: 63080 - DNA, 212 bp, Homo sapiens; identical to SEQ ID NO: 42619
  misc_feature 1..212: note = chr10:77022117-77022329
  misc_feature 1..212: note = hypo
  source 1..212: mol_type = genomic DNA

SEQ ID NO: 63081 - DNA, 187 bp, Homo sapiens; identical to SEQ ID NO: 42620
  misc_feature 1..187: note = chr10:77893300-77893487
  misc_feature 1..187: note = hypo
  source 1..187: mol_type = genomic DNA

SEQ ID NO: 63082 - DNA, 38 bp, Homo sapiens; identical to SEQ ID NO: 42621
  misc_feature 1..38: note = chr10:78600985-78601023
  misc_feature 1..38: note = hypo
  source 1..38: mol_type = genomic DNA

SEQ ID NO: 63083 - DNA, 71 bp, Homo sapiens; identical to SEQ ID NO: 42622
  misc_feature 1..71: note = chr10:81070800-81070871
  misc_feature 1..71: note = hypo
  source 1..71: mol_type = genomic DNA

SEQ ID NO: 63084 - DNA, 32 bp, Homo sapiens; identical to SEQ ID NO: 42623
  misc_feature 1..32: note = chr10:81921303-81921335
  misc_feature 1..32: note = hypo
  source 1..32: mol_type = genomic DNA

SEQ ID NO: 63085 - DNA, 25 bp, Homo sapiens
  misc_feature 1..25: note = chr10:81966571-81966596
  misc_feature 1..25: note = hypo
  source 1..25: mol_type = genomic DNA
aacaagctgctggttcgattttcct

SEQ ID NO: 63086 - DNA, 30 bp, Homo sapiens; identical to SEQ ID NO: 42625
  misc_feature 1..30: note = chr10:82607464-82607494
  misc_feature 1..30: note = hypo
  source 1..30: mol_type = genomic DNA

SEQ ID NO: 63087 - DNA, 42 bp, Homo sapiens; identical to SEQ ID NO: 42626
  misc_feature 1..42: note = chr10:85949293-85949335
  misc_feature 1..42: note = hypo
  source 1..42: mol_type = genomic DNA

SEQ ID NO: 63088 - DNA, 23 bp, Homo sapiens
  misc_feature 1..23: note = chr10:87967335-87967358
  misc_feature 1..23: note = hypo
  source 1..23: mol_type = genomic DNA
tactaatggtttatgcgatggca

SEQ ID NO: 63089 - DNA, 40 bp, Homo sapiens; identical to SEQ ID NO: 42628
  misc_feature 1..40: note = chr10:88414219-88414259
  misc_feature 1..40: note = hypo
  source 1..40: mol_type = genomic DNA

SEQ ID NO: 63090 - DNA, 30 bp, Homo sapiens; identical to SEQ ID NO: 15378
  misc_feature 1..30: note = chr10:89605951-89605981
  misc_feature 1..30: note = hypo
  source 1..30: mol_type = genomic DNA

SEQ ID NO: 63091 - DNA, 23 bp, Homo sapiens
  misc_feature 1..23: note = chr10:94603312-94603335
  misc_feature 1..23: note = hypo
  source 1..23: mol_type = genomic DNA
aagcatgcatttggccgggcgcg

SEQ ID NO: 63092 - DNA, 30 bp, Homo sapiens; identical to SEQ ID NO: 42632
  misc_feature 1..30: note = chr10:97202907-97202937
  misc_feature 1..30: note = hypo
  source 1..30: mol_type = genomic DNA

SEQ ID NO: 63093 - DNA, 41 bp, Homo sapiens; identical to SEQ ID NO: 24677
  misc_feature 1..41: note = chr10:98129781-98129822
  misc_feature 1..41: note = hypo
  source 1..41: mol_type = genomic DNA

SEQ ID NO: 63094 - DNA, 48 bp, Homo sapiens
  misc_feature 1..48: note = chr10:98130033-98130081
  misc_feature 1..48: note = hypo
  source 1..48: mol_type = genomic DNA
ctttggtctgcacttcagccttcagcctgcccccgcactctggagcag

SEQ ID NO: 63095 - DNA, 59 bp, Homo sapiens; identical to SEQ ID NO: 42634
  misc_feature 1..59: note = chr10:98808749-98808808
  misc_feature 1..59: note = hypo
  source 1..59: mol_type = genomic DNA

SEQ ID NO: 63096 - DNA, 30 bp, Homo sapiens; identical to SEQ ID NO: 42635
  misc_feature 1..30: note = chr10:100217214-100217244
  misc_feature 1..30: note = hypo
  source 1..30: mol_type = genomic DNA

SEQ ID NO: 63097 - DNA, 30 bp, Homo sapiens; identical to SEQ ID NO: 42637
  misc_feature 1..30: note = chr10:103814237-103814267
  misc_feature 1..30: note = hypo
  source 1..30: mol_type = genomic DNA

SEQ ID NO: 63098 - DNA, 18 bp, Homo sapiens
  misc_feature 1..18: note = chr10:103818196-103818214
  misc_feature 1..18: note = hypo
  source 1..18: mol_type = genomic DNA
acacgaagagaaaaccca

SEQ ID NO: 63099 - DNA, 30 bp, Homo sapiens; identical to SEQ ID NO: 42640
  misc_feature 1..30: note = chr10:104160106-104160136
  misc_feature 1..30: note = hypo
  source 1..30: mol_type = genomic DNA

SEQ ID NO: 63100 - DNA, 30 bp, Homo sapiens; identical to SEQ ID NO: 42641
  misc_feature 1..30: note = chr10:104161739-104161769
  misc_feature 1..30: note = hypo
  source 1..30: mol_type = genomic DNA

SEQ ID NO: 63101 - DNA, 70 bp, Homo sapiens; identical to SEQ ID NO: 42642
  misc_feature 1..70: note = chr10:104823178-104823248
  misc_feature 1..70: note = hypo
  source 1..70: mol_type = genomic DNA

SEQ ID NO: 63102 - DNA, 23 bp, Homo sapiens
  misc_feature 1..23: note = chr10:105119651-105119674
  misc_feature 1..23: note = hypo
  source 1..23: mol_type = genomic DNA
aaaattgaacacagccgggcgtg

SEQ ID NO: 63103 - DNA, 133 bp, Homo sapiens
  misc_feature 1..133: note = chr10:105413784-105413917
  misc_feature 1..133: note = hypo
  source 1..133: mol_type = genomic DNA
atcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 63104 - DNA, 30 bp, Homo sapiens; identical to SEQ ID NO: 42647
  misc_feature 1..30: note = chr10:105796706-105796736
  misc_feature 1..30: note = hypo
  source 1..30: mol_type = genomic DNA

SEQ ID NO: 63105 - DNA, 21 bp, Homo sapiens
  misc_feature 1..21: note = chr10:108522437-108522458
  misc_feature 1..21: note = hypo
  source 1..21: mol_type = genomic DNA
agccaccgtgcccagcctatt

SEQ ID NO: 63106 - DNA, 143 bp, Homo sapiens; identical to SEQ ID NO: 42649
  misc_feature 1..143: note = chr10:108578381-108578524
  misc_feature 1..143: note = hypo
  source 1..143: mol_type = genomic DNA

SEQ ID NO: 63107 - DNA, 36 bp, Homo sapiens; identical to SEQ ID NO: 42650
  misc_feature 1..36: note = chr10:110168394-110168430
  misc_feature 1..36: note = hypo
  source 1..36: mol_type = genomic DNA

SEQ ID NO: 63108 - DNA, 54 bp, Homo sapiens; identical to SEQ ID NO: 42651
  misc_feature 1..54: note = chr10:111902849-111902903
  misc_feature 1..54: note = hypo
  source 1..54: mol_type = genomic DNA

SEQ ID NO: 63109 - DNA, 33 bp, Homo sapiens; identical to SEQ ID NO: 42652
  misc_feature 1..33: note = chr10:111946090-111946123
  misc_feature 1..33: note = hypo
  source 1..33: mol_type = genomic DNA

SEQ ID NO: 63110 - DNA, 32 bp, Homo sapiens; identical to SEQ ID NO: 42653
  misc_feature 1..32: note = chr10:111979836-111979868
  misc_feature 1..32: note = hypo
  source 1..32: mol_type = genomic DNA

SEQ ID NO: 63111 - DNA, 30 bp, Homo sapiens; identical to SEQ ID NO: 42654
  misc_feature 1..30: note = chr10:112079213-112079243
  misc_feature 1..30: note = hypo
  source 1..30: mol_type = genomic DNA

SEQ ID NO: 63112 - DNA, 79 bp, Homo sapiens; identical to SEQ ID NO: 42655
  misc_feature 1..79: note = chr10:112524488-112524567
  misc_feature 1..79: note = hypo
  source 1..79: mol_type = genomic DNA

SEQ ID NO: 63113 - DNA, 30 bp, Homo sapiens; identical to SEQ ID NO: 42656
  misc_feature 1..30: note = chr10:112553736-112553766
  misc_feature 1..30: note = hypo
  source 1..30: mol_type = genomic DNA

SEQ ID NO: 63114 - DNA, 30 bp, Homo sapiens; identical to SEQ ID NO: 42657
  misc_feature 1..30: note = chr10:112582575-112582605
  misc_feature 1..30: note = hypo
  source 1..30: mol_type = genomic DNA

SEQ ID NO: 63115 - DNA, 83 bp, Homo sapiens; identical to SEQ ID NO: 15387
  misc_feature 1..83: note = chr10:113623006-113623089
  misc_feature 1..83: note = hypo
  source 1..83: mol_type = genomic DNA

SEQ ID NO: 63116 - DNA, 30 bp, Homo sapiens; identical to SEQ ID NO: 42659
  misc_feature 1..30: note = chr10:113748400-113748430
  misc_feature 1..30: note = hypo
  source 1..30: mol_type = genomic DNA

SEQ ID NO: 63117 - DNA, 26 bp, Homo sapiens
  misc_feature 1..26: note = chr10:114571159-114571185
  misc_feature 1..26: note = hypo
  source 1..26: mol_type = genomic DNA
aaggtgagtgcagaccgggcgcggtg

SEQ ID NO: 63118 - DNA, 34 bp, Homo sapiens; identical to SEQ ID NO: 42661
  misc_feature 1..34: note = chr10:114752064-114752098
  misc_feature 1..34: note = hypo
  source 1..34: mol_type = genomic DNA

SEQ ID NO: 63119 - DNA, 213 bp, Homo sapiens; identical to SEQ ID NO: 42662
  misc_feature 1..213: note = chr10:114829478-114829691
  misc_feature 1..213: note = hypo
  source 1..213: mol_type = genomic DNA

SEQ ID NO: 63120 - DNA, 30 bp, Homo sapiens; identical to SEQ ID NO: 42663
  misc_feature 1..30: note = chr10:115479125-115479155
  misc_feature 1..30: note = hypo
  source 1..30: mol_type = genomic DNA

SEQ ID NO: 63121 - DNA, 34 bp, Homo sapiens; identical to SEQ ID NO: 15388
  misc_feature 1..34: note = chr10:115844821-115844855
  misc_feature 1..34: note = hypo
  source 1..34: mol_type = genomic DNA

SEQ ID NO: 63122 - DNA, 42 bp, Homo sapiens
  misc_feature 1..42: note = chr10:116331156-116331198
  misc_feature 1..42: note = hypo
  source 1..42: mol_type = genomic DNA
aacgggcgcctggaggcagaaagacatcgccctcaaggttat

SEQ ID NO: 63123 - DNA, 30 bp, Homo sapiens; identical to SEQ ID NO: 42666
  misc_feature 1..30: note = chr10:117011803-117011833
  misc_feature 1..30: note = hypo
  source 1..30: mol_type = genomic DNA

SEQ ID NO: 63124 - DNA, 43 bp, Homo sapiens
  misc_feature 1..43: note = chr10:119807056-119807099
  misc_feature 1..43: note = hypo
  source 1..43: mol_type = genomic DNA
gttctacctcatgtctaagactccatcacgactctatgggctc

SEQ ID NO: 63125 - DNA, 101 bp, Homo sapiens; identical to SEQ ID NO: 42668
  misc_feature 1..101: note = chr10:120767098-120767199
  misc_feature 1..101: note = hypo
  source 1..101: mol_type = genomic DNA

SEQ ID NO: 63126 - DNA, 42 bp, Homo sapiens; identical to SEQ ID NO: 42669
  misc_feature 1..42: note = chr10:120791236-120791278
  misc_feature 1..42: note = hypo
  source 1..42: mol_type = genomic DNA

SEQ ID NO: 63127 - DNA, 30 bp, Homo sapiens; identical to SEQ ID NO: 42670
  misc_feature 1..30: note = chr10:120922882-120922912
  misc_feature 1..30: note = hypo
  source 1..30: mol_type = genomic DNA

SEQ ID NO: 63128 - DNA, 30 bp, Homo sapiens; identical to SEQ ID NO: 42671
  misc_feature 1..30: note = chr10:121249991-121250021
  misc_feature 1..30: note = hypo
  source 1..30: mol_type = genomic DNA

SEQ ID NO: 63129 - DNA, 43 bp, Homo sapiens; identical to SEQ ID NO: 42672
  misc_feature 1..43: note = chr10:121256846-121256889
  misc_feature 1..43: note = hypo
  source 1..43: mol_type = genomic DNA

SEQ ID NO: 63130 - DNA, 17 bp, Homo sapiens
  misc_feature 1..17: note = chr10:121354427-121354444
  misc_feature 1..17: note = hypo
  source 1..17: mol_type = genomic DNA
cccggcctgaaggacaa

SEQ ID NO: 63131 - DNA, 30 bp, Homo sapiens; identical to SEQ ID NO: 42674
  misc_feature 1..30: note = chr10:121398024-121398054
  misc_feature 1..30: note = hypo
  source 1..30: mol_type = genomic DNA

SEQ ID NO: 63132 - DNA, 98 bp, Homo sapiens; identical to SEQ ID NO: 42675
  misc_feature 1..98: note = chr10:121651072-121651170
  misc_feature 1..98: note = hypo
  source 1..98: mol_type = genomic DNA

SEQ ID NO: 63133 - DNA, 30 bp, Homo sapiens; identical to SEQ ID NO: 42676
  misc_feature 1..30: note = chr10:122394238-122394268
  misc_feature 1..30: note = hypo
  source 1..30: mol_type = genomic DNA

SEQ ID NO: 63134 - DNA, 120 bp, Homo sapiens; identical to SEQ ID NO: 15393
  misc_feature 1..120: note = chr10:122492432-122492552
  misc_feature 1..120: note = hypo
  source 1..120: mol_type = genomic DNA

SEQ ID NO: 63135 - DNA, 139 bp, Homo sapiens; identical to SEQ ID NO: 42678
  misc_feature 1..139: note = chr10:123820813-123820952
  misc_feature 1..139: note = hypo
  source 1..139: mol_type = genomic DNA

SEQ ID NO: 63136 - DNA, 38 bp, Homo sapiens; identical to SEQ ID NO: 42679
  misc_feature 1..38: note = chr10:125919683-125919721
  misc_feature 1..38: note = hypo
  source 1..38: mol_type = genomic DNA

SEQ ID NO: 63137 - DNA, 58 bp, Homo sapiens; identical to SEQ ID NO: 24689
  misc_feature 1..58: note = chr10:126199077-126199135
  misc_feature 1..58: note = hypo
  source 1..58: mol_type = genomic DNA

SEQ ID NO: 63138 - DNA, 30 bp, Homo sapiens; identical to SEQ ID NO: 42681
  misc_feature 1..30: note = chr10:126314006-126314036
  misc_feature 1..30: note = hypo
  source 1..30: mol_type = genomic DNA

SEQ ID NO: 63139 - DNA, 73 bp, Homo sapiens; identical to SEQ ID NO: 42682
  misc_feature 1..73: note = chr10:126314814-126314887
  misc_feature 1..73: note = hypo
  source 1..73: mol_type = genomic DNA

SEQ ID NO: 63140 - DNA, 28 bp, Homo sapiens
  misc_feature 1..28: note = chr10:126479341-126479369
  misc_feature 1..28: note = hypo
  source 1..28: mol_type = genomic DNA
cttctttttttgagacggagtcacgctc

SEQ ID NO: 63141 - DNA, 28 bp, Homo sapiens
  misc_feature 1..28: note = chr10:126479609-126479637
  misc_feature 1..28: note = hypo
  source 1..28: mol_type = genomic DNA
gcgtaagccaccacgcacccggccctct

SEQ ID NO: 63142 - DNA, 45 bp, Homo sapiens; identical to SEQ ID NO: 42686
  misc_feature 1..45: note = chr10:126712043-126712088
  misc_feature 1..45: note = hypo
  source 1..45: mol_type = genomic DNA

SEQ ID NO: 63143 - DNA, 87 bp, Homo sapiens; identical to SEQ ID NO: 42687
  misc_feature 1..87: note = chr10:126809890-126809977
  misc_feature 1..87: note = hypo
  source 1..87: mol_type = genomic DNA

SEQ ID NO: 63144 - DNA, 30 bp, Homo sapiens; identical to SEQ ID NO: 42688
  misc_feature 1..30: note = chr10:126814656-126814686
  misc_feature 1..30: note = hypo
  source 1..30: mol_type = genomic DNA

SEQ ID NO: 63145 - DNA, 194 bp, Homo sapiens; identical to SEQ ID NO: 42689
  misc_feature 1..194: note = chr10:127380217-127380411
  misc_feature 1..194: note = hypo
  source 1..194: mol_type = genomic DNA

SEQ ID NO: 63146 - DNA, 36 bp, Homo sapiens; identical to SEQ ID NO: 42690
  misc_feature 1..36: note = chr10:127451959-127451995
  misc_feature 1..36: note = hypo
  source 1..36: mol_type = genomic DNA

SEQ ID NO: 63147 - DNA, 75 bp, Homo sapiens; identical to SEQ ID NO: 42691
  misc_feature 1..75: note = chr10:127463306-127463381
  misc_feature 1..75: note = hypo
  source 1..75: mol_type = genomic DNA

SEQ ID NO: 63148 - DNA, 30 bp, Homo sapiens; identical to SEQ ID NO: 42692
  misc_feature 1..30: note = chr10:127475463-127475493
  misc_feature 1..30: note = hypo
  source 1..30: mol_type = genomic DNA

SEQ ID NO: 63149 - DNA, 29 bp, Homo sapiens
  misc_feature 1..29: note = chr10:127601468-127601497
  misc_feature 1..29: note = hypo
  source 1..29: mol_type = genomic DNA
gttgggattacaggcgtaagccatcgtgt

SEQ ID NO: 63150 - DNA, 30 bp, Homo sapiens; identical to SEQ ID NO: 42694
  misc_feature 1..30: note = chr10:128888749-128888779
  misc_feature 1..30: note = hypo
  source 1..30: mol_type = genomic DNA

SEQ ID NO: 63151 - DNA, 105 bp, Homo sapiens
  misc_feature 1..105: note = chr10:129888885-129888990
  misc_feature 1..105: note = hypo
  source 1..105: mol_type = genomic DNA
atttctttggctctgtatggcagtcacagctctaaagcttctagttgcagaagttactccagtgggaatactccaagtatgcctcgtcctcgcttgccttggctt

SEQ ID NO: 63152 - DNA, 107 bp, Homo sapiens; identical to SEQ ID NO: 42696
  misc_feature 1..107: note = chr10:129925726-129925833
  misc_feature 1..107: note = hypo
  source 1..107: mol_type = genomic DNA

SEQ ID NO: 63153 - DNA, 30 bp, Homo sapiens; identical to SEQ ID NO: 42697
  misc_feature 1..30: note = chr10:129947242-129947272
  misc_feature 1..30: note = hypo
  source 1..30: mol_type = genomic DNA

SEQ ID NO: 63154 - DNA, 24 bp, Homo sapiens
  misc_feature 1..24: note = chr10:130065702-130065726
  misc_feature 1..24: note = hypo
  source 1..24: mol_type = genomic DNA
gcctagcagcgaggtctggaggct

SEQ ID NO: 63155 - DNA, 73 bp, Homo sapiens
  misc_feature 1..73: note = chr10:130203362-130203435
  misc_feature 1..73: note = hypo
  source 1..73: mol_type = genomic DNA
ggcccacagtgtgaacggcgccctccaagatgagcagtgtgatgctccgcagagtcgtagacaggaaaagtgg

SEQ ID NO: 63156 - DNA, 71 bp, Homo sapiens
  misc_feature 1..71: note = chr10:130203480-130203551
  misc_feature 1..71: note = hypo
  source 1..71: mol_type = genomic DNA
aatggacaacagggaaaatggaggcgcaggtgagaaaggaaggcaggtgaagcgcccgactcactccaagc

SEQ ID NO: 63157 - DNA, 25 bp, Homo sapiens
  misc_feature 1..25: note = chr10:130577739-130577764
  misc_feature 1..25: note = hypo
  source 1..25: mol_type = genomic DNA
agcctccgaggattccgcctgagga

SEQ ID NO: 63158 - DNA, 20 bp, Homo sapiens
  misc_feature 1..20: note = chr10:130754356-130754376
  misc_feature 1..20: note = hypo
  source 1..20: mol_type = genomic DNA
gacgccgatgctcctgcaga

SEQ ID NO: 63159 - DNA, 179 bp, Homo sapiens; identical to SEQ ID NO: 42702
  misc_feature 1..179: note = chr10:130946123-130946302
  misc_feature 1..179: note = hypo
  source 1..179: mol_type = genomic DNA

SEQ ID NO: 63160 - DNA, 30 bp, Homo sapiens; identical to SEQ ID NO: 42703
  misc_feature 1..30: note = chr10:130946893-130946923
  misc_feature 1..30: note = hypo
  source 1..30: mol_type = genomic DNA

SEQ ID NO: 63161 - DNA, 208 bp, Homo sapiens; identical to SEQ ID NO: 42704
  misc_feature 1..208: note = chr10:131058908-131059116
  misc_feature 1..208: note = hypo
  source 1..208: mol_type = genomic DNA

SEQ ID NO: 63162 - DNA, 185 bp, Homo sapiens; identical to SEQ ID NO: 42705
  misc_feature 1..185: note = chr10:131606695-131606880
  misc_feature 1..185: note = hypo
  source 1..185: mol_type = genomic DNA

SEQ ID NO: 63163 - DNA, 120 bp, Homo sapiens; identical to SEQ ID NO: 42706
  misc_feature 1..120: note = chr10:131641071-131641191
  misc_feature 1..120: note = hypo
  source 1..120: mol_type = genomic DNA

SEQ ID NO: 63164 - DNA, 184 bp, Homo sapiens
  misc_feature 1..184: note = chr10:131647719-131647903
  misc_feature 1..184: note = hypo
  source 1..184: mol_type = genomic DNA
atttgatgattaacacgccccacctcagcaggtgtgcaaggtgcgggggcggacacaaagactgcggcttccggagaggacggctagggggccgcctttgcaagtgctctccaaaataattggtcaccgttctcgagtgcttgggcgtcggcgcatcttgtaagcaacgcaggaagcctcgcac

SEQ ID NO: 63165 - skipped

SEQ ID NO: 63166 - DNA, 118 bp, Homo sapiens; identical to SEQ ID NO: 42708
  misc_feature 1..118: note = chr10:131739072-131739190
  misc_feature 1..118: note = hypo
  source 1..118: mol_type = genomic DNA

SEQ ID NO: 63167 - DNA, 30 bp, Homo sapiens; identical to SEQ ID NO: 42709
  misc_feature 1..30: note = chr10:131739627-131739657
  misc_feature 1..30: note = hypo
  source 1..30: mol_type = genomic DNA

SEQ ID NO: 63168 - DNA, 242 bp, Homo sapiens; identical to SEQ ID NO: 42710
  misc_feature 1..242: note = chr10:131825216-131825458
  misc_feature 1..242: note = hypo
  source 1..242: mol_type = genomic DNA

SEQ ID NO: 63169 - DNA, 284 bp, Homo sapiens; identical to SEQ ID NO: 42711
  misc_feature 1..284: note = chr10:131844059-131844343
  misc_feature 1..284: note = hypo
  source 1..284: mol_type = genomic DNA

SEQ ID NO: 63170 - DNA, 92 bp, Homo sapiens; identical to SEQ ID NO: 42712
  misc_feature 1..92: note = chr10:131844600-131844692
  misc_feature 1..92: note = hypo
  source 1..92: mol_type = genomic DNA

SEQ ID NO: 63171 - DNA, 192 bp, Homo sapiens; identical to SEQ ID NO: 42713
  misc_feature 1..192: note = chr10:131845044-131845236
  misc_feature 1..192: note = hypo
  source 1..192: mol_type = genomic DNA

SEQ ID NO: 63172 - DNA, 40 bp, Homo sapiens
  misc_feature 1..40: note = chr10:131936626-131936666
  misc_feature 1..40: note = hypo
  source 1..40: mol_type = genomic DNA
tgatctaaattgagtgaaattttgccgactgaatttgaat

SEQ ID NO: 63173 - DNA, 30 bp, Homo sapiens; identical to SEQ ID NO: 42716
  misc_feature 1..30: note = chr10:132050805-132050835
  misc_feature 1..30: note = hypo
  source 1..30: mol_type = genomic DNA

SEQ ID NO: 63174 - DNA, 30 bp, Homo sapiens; identical to SEQ ID NO: 42717
  misc_feature 1..30: note = chr10:132317215-132317245
  misc_feature 1..30: note = hypo
  source 1..30: mol_type = genomic DNA

SEQ ID NO: 63175 - DNA, 207 bp, Homo sapiens; identical to SEQ ID NO: 42718
  misc_feature 1..207: note = chr10:132365689-132365896
  misc_feature 1..207: note = hypo
  source 1..207: mol_type = genomic DNA

SEQ ID NO: 63176 - DNA, 174 bp, Homo sapiens; identical to SEQ ID NO: 42719
  misc_feature 1..174: note = chr10:132525800-132525974
  misc_feature 1..174: note = hypo
  source 1..174: mol_type = genomic DNA

SEQ ID NO: 63177 - DNA, 165 bp, Homo sapiens; identical to SEQ ID NO: 42720
  misc_feature 1..165: note = chr10:132586486-132586651
  misc_feature 1..165: note = hypo
  source 1..165: mol_type = genomic DNA

SEQ ID NO: 63178 - DNA, 30 bp, Homo sapiens; identical to SEQ ID NO: 42721
  misc_feature 1..30: note = chr10:132609284-132609314
  misc_feature 1..30: note = hypo
  source 1..30: mol_type = genomic DNA

SEQ ID NO: 63179 - DNA, 167 bp, Homo sapiens; identical to SEQ ID NO: 42722
  misc_feature 1..167: note = chr10:132811738-132811905
  misc_feature 1..167: note = hypo
  source 1..167: mol_type = genomic DNA

SEQ ID NO: 63180 - DNA, 164 bp, Homo sapiens; identical to SEQ ID NO: 42723
  misc_feature 1..164: note = chr10:132818146-132818310
  misc_feature 1..164: note = hypo
  source 1..164: mol_type = genomic DNA

SEQ ID NO: 63181 - DNA, 30 bp, Homo sapiens; identical to SEQ ID NO: 42724
  misc_feature 1..30: note = chr10:132873813-132873843
  misc_feature 1..30: note = hypo
  source 1..30: mol_type = genomic DNA

SEQ ID NO: 63182 - DNA, 119 bp, Homo sapiens; identical to SEQ ID NO: 15408
  misc_feature 1..119: note = chr10:132976493-132976612
  misc_feature 1..119: note = hypo
  source 1..119: mol_type = genomic DNA

SEQ ID NO: 63183 - DNA, 191 bp, Homo sapiens; identical to SEQ ID NO: 42726
  misc_feature 1..191: note = chr10:132977044-132977235
  misc_feature 1..191: note = hypo
  source 1..191: mol_type = genomic DNA

SEQ ID NO: 63184 - DNA, 57 bp, Homo sapiens; identical to SEQ ID NO: 42727
  misc_feature 1..57: note = chr10:133058363-133058420
  misc_feature 1..57: note = hypo
  source 1..57: mol_type = genomic DNA

SEQ ID NO: 63185 - DNA, 30 bp, Homo sapiens; identical to SEQ ID NO: 42728
  misc_feature 1..30: note = chr10:133516048-133516078
  misc_feature 1..30: note = hypo
  source 1..30: mol_type = genomic DNA

SEQ ID NO: 63186 - DNA, 186 bp, Homo sapiens; identical to SEQ ID NO: 42729
  misc_feature 1..186: note = chr10:133532610-133532796
  misc_feature 1..186: note = hypo
  source 1..186: mol_type = genomic DNA

SEQ ID NO: 63187 - DNA, 30 bp, Homo sapiens; identical to SEQ ID NO: 42730
  misc_feature 1..30: note = chr10:133555035-133555065
  misc_feature 1..30: note = hypo
  source 1..30: mol_type = genomic DNA

SEQ ID NO: 63188 - DNA, 251 bp, Homo sapiens; identical to SEQ ID NO: 42731
  misc_feature 1..251: note = chr10:133913806-133914057
  misc_feature 1..251: note = hypo
  source 1..251: mol_type = genomic DNA

SEQ ID NO: 63189 - DNA, 30 bp, Homo sapiens; identical to SEQ ID NO: 42732
  misc_feature 1..30: note = chr10:133921177-133921207
  misc_feature 1..30: note = hypo
  source 1..30: mol_type = genomic DNA

SEQ ID NO: 63190 - DNA, 119 bp, Homo sapiens; identical to SEQ ID NO: 42733
  misc_feature 1..119: note = chr10:133947276-133947395
  misc_feature 1..119: note = hypo
  source 1..119: mol_type = genomic DNA

SEQ ID NO: 63191 - DNA, 86 bp, Homo sapiens; identical to SEQ ID NO: 42734
  misc_feature 1..86: note = chr10:133949349-133949435
  misc_feature 1..86: note = hypo
  source 1..86: mol_type = genomic DNA

SEQ ID NO: 63192 - DNA, 133 bp, Homo sapiens
  misc_feature 1..133: note = chr10:133951469-133951602
  misc_feature 1..133: note = hypo
  source 1..133: mol_type = genomic DNA
ggagccagggcctcccgctgtggtgtggggacaagccagcccagacaccgtcttccctgtcatccaaatgatggcacacgggcagtaaaccgtggactgaaaccggtggagctgctctaccacttacacaacc

SEQ ID NO: 63193 - DNA, 77 bp, Homo sapiens; identical to SEQ ID NO: 42736
  misc_feature 1..77: note = chr10:133955427-133955504
  misc_feature 1..77: note = hypo
  source 1..77: mol_type = genomic DNA

SEQ ID NO: 63194 - DNA, 176 bp, Homo sapiens; identical to SEQ ID NO: 42737
  misc_feature 1..176: note = chr10:133962619-133962795
  misc_feature 1..176: note = hypo
  source 1..176: mol_type = genomic DNA

SEQ ID NO: 63195 - DNA, 35 bp, Homo sapiens; identical to SEQ ID NO: 42738
  misc_feature 1..35: note = chr10:133979192-133979227
  misc_feature 1..35: note = hypo
  source 1..35: mol_type = genomic DNA

SEQ ID NO: 63196 - DNA, 52 bp, Homo sapiens; identical to SEQ ID NO: 42739
  misc_feature 1..52: note = chr10:133982909-133982961
  misc_feature 1..52: note = hypo
  source 1..52: mol_type = genomic DNA

SEQ ID NO: 63197 - DNA, 171 bp, Homo sapiens; identical to SEQ ID NO: 42740
  misc_feature 1..171: note = chr10:133984033-133984204
  misc_feature 1..171: note = hypo
  source 1..171: mol_type = genomic DNA

SEQ ID NO: 63198 - DNA, 153 bp, Homo sapiens; identical to SEQ ID NO: 42741
  misc_feature 1..153: note = chr10:134012330-134012483
  misc_feature 1..153: note = hypo
  source 1..153: mol_type = genomic DNA

SEQ ID NO: 63199 - DNA, 220 bp, Homo sapiens; identical to SEQ ID NO: 42742
  misc_feature 1..220: note = chr10:134014330-134014550
  misc_feature 1..220: note = hypo
  source 1..220: mol_type = genomic DNA

SEQ ID NO: 63200 - DNA, 67 bp, Homo sapiens
  misc_feature 1..67: note = chr10:134016136-134016203
  misc_feature 1..67: note = hypo
  source 1..67: mol_type = genomic DNA
cctctctccccagaacgtggagtacaacatcttcgagggagtggagtgccggggagcgcctgccgtg

SEQ ID NO: 63201 - DNA, 51 bp, Homo sapiens
  misc_feature 1..51: note = chr10:134016388-134016439
  misc_feature 1..51: note = hypo
  source 1..51: mol_type = genomic DNA
ccagaacgcacccctggtcaacctggcccggcctcccgaggggtcaggaag

SEQ ID NO: 63202 - DNA, 30 bp, Homo sapiens; identical to SEQ ID NO: 42744
  misc_feature 1..30: note = chr10:134016763-134016793
  misc_feature 1..30: note = hypo
  source 1..30: mol_type = genomic DNA

SEQ ID NO: 63203 - DNA, 30 bp, Homo sapiens; identical to SEQ ID NO: 42745
  misc_feature 1..30: note = chr10:134019334-134019364
  misc_feature 1..30: note = hypo
  source 1..30: mol_type = genomic DNA

SEQ ID NO: 63204 - DNA, 66 bp, Homo sapiens
  misc_feature 1..66: note = chr10:134022875-134022941
  misc_feature 1..66: note = hypo
  source 1..66: mol_type = genomic DNA
accaggcagaagctgttctctgcgggactttgctggaaaccactcccttgccgggcctttcccgtc

SEQ ID NO: 63205 - DNA, 30 bp, Homo sapiens; identical to SEQ ID NO: 42747
  misc_feature 1..30: note = chr10:134058791-134058821
  misc_feature 1..30: note = hypo
  source 1..30: mol_type = genomic DNA

SEQ ID NO: 63206 - DNA, 119 bp, Homo sapiens; identical to SEQ ID NO: 42748
  misc_feature 1..119: note = chr10:134093662-134093781
  misc_feature 1..119: note = hypo
  source 1..119: mol_type = genomic DNA

SEQ ID NO: 63207 - DNA, 243 bp, Homo sapiens; identical to SEQ ID NO: 42749
  misc_feature 1..243: note = chr10:134094008-134094251
  misc_feature 1..243: note = hypo
  source 1..243: mol_type = genomic DNA

SEQ ID NO: 63208 - DNA, 31 bp, Homo sapiens
  misc_feature 1..31: note = chr10:134095563-134095594
  misc_feature 1..31: note = hypo
  source 1..31: mol_type = genomic DNA
aggcagcagcccagccgctccgggggtgggg

SEQ ID NO: 63209 - DNA, 30 bp, Homo sapiens; identical to SEQ ID NO: 42751
  misc_feature 1..30: note = chr10:134118399-134118429
  misc_feature 1..30: note = hypo
  source 1..30: mol_type = genomic DNA

SEQ ID NO: 63210 - DNA, 230 bp, Homo sapiens; identical to SEQ ID NO: 42752
  misc_feature 1..230: note = chr10:134123040-134123270
  misc_feature 1..230: note = hypo
  source 1..230: mol_type = genomic DNA

SEQ ID NO: 63211 - DNA, 140 bp, Homo sapiens; identical to SEQ ID NO: 42753
  misc_feature 1..140: note = chr10:134272738-134272878
  misc_feature 1..140: note = hypo
  source 1..140: mol_type = genomic DNA

SEQ ID NO: 63212 - DNA, 30 bp, Homo sapiens; identical to SEQ ID NO: 42754
  misc_feature 1..30: note = chr10:134292599-134292629
  misc_feature 1..30: note = hypo
  source 1..30: mol_type = genomic DNA

SEQ ID NO: 63213 - DNA, 78 bp, Homo sapiens
  misc_feature 1..78: note = chr10:134301017-134301095
  misc_feature 1..78: note = hypo
  source 1..78: mol_type = genomic DNA
gtcctgttttgtcttcgatgcttctctccggtgagctgcaggtggccacagagtcaggcttgggaagctgtgccgcaa

SEQ ID NO: 63214 - DNA, 104 bp, Homo sapiens; identical to SEQ ID NO: 24714
  misc_feature 1..104: note = chr10:134301212-134301316
  misc_feature 1..104: note = hypo
  source 1..104: mol_type = genomic DNA

SEQ ID NO: 63215 - DNA, 29 bp, Homo sapiens
  misc_feature 1..29: note = chr10:134315613-134315642
  misc_feature 1..29: note = hypo
  source 1..29: mol_type = genomic DNA
cgatctcctgacctcgtgatctgctggcc

SEQ ID NO: 63216 - DNA, 30 bp, Homo sapiens; identical to SEQ ID NO: 42757
  misc_feature 1..30: note = chr10:134341480-134341510
  misc_feature 1..30: note = hypo
  source 1..30: mol_type = genomic DNA

SEQ ID NO: 63217 - DNA, 195 bp, Homo sapiens
  misc_feature 1..195: note = chr10:134481125-134481320
  misc_feature 1..195: note = hypo
  source 1..195: mol_type = genomic DNA
taatgacatttgaatcgagcattaacaggcttaattactttaaaattgtcattttaatttacactgatatagtattgatcatacaagcagagattaagctgttcagtggagcagatgatggggaattaaacattaaagggtcctcagggggccgtgtgcgctgcccggcgcgagccggaagagggatgatatttc

SEQ ID NO: 63218 - DNA, 63 bp, Homo sapiens
  misc_feature 1..63: note = chr10:134481433-134481496
  misc_feature 1..63: note = hypo
  source 1..63: mol_type = genomic DNA
ctccagtgattcatccgcctcaccaacatttatttatccagcaaattccggagctttgacctt

SEQ ID NO: 63219 - DNA, 30 bp, Homo sapiens; identical to SEQ ID NO: 42759
  misc_feature 1..30: note = chr10:134499348-134499378
  misc_feature 1..30: note = hypo
  source 1..30: mol_type = genomic DNA

SEQ ID NO: 63220 - DNA, 167 bp, Homo sapiens; identical to SEQ ID NO: 42760
  misc_feature 1..167: note = chr10:134518611-134518778
  misc_feature 1..167: note = hypo
  source 1..167: mol_type = genomic DNA

SEQ ID NO: 63221 - DNA, 60 bp, Homo sapiens; identical to SEQ ID NO: 42761
  misc_feature 1..60: note = chr10:134542152-134542212
  misc_feature 1..60: note = hypo
  source 1..60: mol_type = genomic DNA

SEQ ID NO: 63222 - DNA, 152 bp, Homo sapiens; identical to SEQ ID NO: 42762
  misc_feature 1..152: note = chr10:134566190-134566342
  misc_feature 1..152: note = hypo
  source 1..152: mol_type = genomic DNA

SEQ ID NO: 63223 - DNA, 72 bp, Homo sapiens
  misc_feature 1..72: note = chr10:134607898-134607970
  misc_feature 1..72: note = hypo
  source 1..72: mol_type = genomic DNA
ctgagccccaccctgcgagggtgctctgagctctcagggcgttgcttctttgcccatttatcccgggtcttg

SEQ ID NO: 63224 - DNA, 13 bp, Homo sapiens
  misc_feature 1..13: note = chr10:134608183-134608196
  misc_feature 1..13: note = hypo
  source 1..13: mol_type = genomic DNA
aaagaggggagga

SEQ ID NO: 63225 - DNA, 221 bp, Homo sapiens; identical to SEQ ID NO: 42764
  misc_feature 1..221: note = chr10:134610702-134610923
  misc_feature 1..221: note = hypo
  source 1..221: mol_type = genomic DNA

SEQ ID NO: 63226 - DNA, 30 bp, Homo sapiens; identical to SEQ ID NO: 42765
  misc_feature 1..30: note = chr10:134640686-134640716
  misc_feature 1..30: note = hypo
  source 1..30: mol_type = genomic DNA

SEQ ID NO: 63227 - DNA, 30 bp, Homo sapiens; identical to SEQ ID NO: 42766
  misc_feature 1..30: note = chr10:134647659-134647689
  misc_feature 1..30: note = hypo
  source 1..30: mol_type = genomic DNA

SEQ ID NO: 63228 - DNA, 57 bp, Homo sapiens; identical to SEQ ID NO: 42767
  misc_feature 1..57: note = chr10:134648015-134648072
  misc_feature 1..57: note = hypo
  source 1..57: mol_type = genomic DNA

SEQ ID NO: 63229 - DNA, 87 bp, Homo sapiens; identical to SEQ ID NO: 42768
  misc_feature 1..87: note = chr10:134662545-134662632
  misc_feature 1..87: note = hypo
  source 1..87: mol_type = genomic DNA

SEQ ID NO: 63230 - DNA, 30 bp, Homo sapiens; identical to SEQ ID NO: 42769
  misc_feature 1..30: note = chr10:134664613-134664643
  misc_feature 1..30: note = hypo
  source 1..30: mol_type = genomic DNA

SEQ ID NO: 63231 - DNA, 118 bp, Homo sapiens
  misc_feature 1..118: note = chr10:134665029-134665147
  misc_feature 1..118: note = hypo
  source 1..118: mol_type = genomic DNA
cctcatgttccctcccggtcacctagctgcctgccggcaccctgcattccttggcattttccagaaccgtacctaagtggaggcgcacagagtgctgtctttccgtctggttcatttt

SEQ ID NO: 63232 - DNA, 30 bp, Homo sapiens
  misc_feature 1..30: note = chr10:134665202-134665232
  misc_feature 1..30: note = hypo
  source 1..30: mol_type = genomic DNA
tctcacagccggcgtcggtgcaccgtgtgc

SEQ ID NO: 63233 - DNA, 51 bp, Homo sapiens; identical to SEQ ID NO: 42771
  misc_feature 1..51: note = chr10:134671588-134671639
  misc_feature 1..51: note = hypo
  source 1..51: mol_type = genomic DNA

SEQ ID NO: 63234 - DNA, 30 bp, Homo sapiens; identical to SEQ ID NO: 42772
  misc_feature 1..30: note = chr10:134672451-134672481
  misc_feature 1..30: note = hypo
  source 1..30: mol_type = genomic DNA

SEQ ID NO: 63235 - DNA, 162 bp, Homo sapiens; identical to SEQ ID NO: 42773
  misc_feature 1..162: note = chr10:134682685-134682847
  misc_feature 1..162: note = hypo
  source 1..162: mol_type = genomic DNA

SEQ ID NO: 63236 - DNA, 21 bp, Homo sapiens
  misc_feature 1..21: note = chr10:134683679-134683700
  misc_feature 1..21: note = hypo
  source 1..21: mol_type = genomic DNA
atgagacggtgaactgagtcg

SEQ ID NO: 63237 - DNA, 38 bp, Homo sapiens; identical to SEQ ID NO: 15428
  misc_feature 1..38: note = chr10:134690510-134690548
  misc_feature 1..38: note = hypo
  source 1..38: mol_type = genomic DNA

SEQ ID NO: 63238 - DNA, 156 bp, Homo sapiens; identical to SEQ ID NO: 42776
  misc_feature 1..156: note = chr10:134692252-134692408
  misc_feature 1..156: note = hypo
  source 1..156: mol_type = genomic DNA

SEQ ID NO: 63239 - DNA, 34 bp, Homo sapiens
  misc_feature 1..34: note = chr10:134693709-134693743
  misc_feature 1..34: note = hypo
  source 1..34: mol_type = genomic DNA
gactctccgtgcgcacctgcgctccccacagagt

SEQ ID NO: 63240 - DNA, 42 bp, Homo sapiens; identical to SEQ ID NO: 42778
  misc_feature 1..42: note = chr10:134699364-134699406
  misc_feature 1..42: note = hypo
  source 1..42: mol_type = genomic DNA

SEQ ID NO: 63241 - DNA, 144 bp, Homo sapiens; identical to SEQ ID NO: 24724
  misc_feature 1..144: note = chr10:134699728-134699872
  misc_feature 1..144: note = hypo
  source 1..144: mol_type = genomic DNA

SEQ ID NO: 63242 - DNA, 164 bp, Homo sapiens
  misc_feature 1..164: note = chr10:134699909-134700073
  misc_feature 1..164: note = hypo
  source 1..164: mol_type = genomic DNA
agtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 63243 - DNA, 32 bp, Homo sapiens; identical to SEQ ID NO: 42780
  misc_feature 1..32: note = chr10:134726267-134726299
  misc_feature 1..32: note = hypo
  source 1..32: mol_type = genomic DNA

SEQ ID NO: 63244 - DNA, 30 bp, Homo sapiens; identical to SEQ ID NO: 42781
  misc_feature 1..30: note = chr10:134729962-134729992
  misc_feature 1..30: note = hypo
  source 1..30: mol_type = genomic DNA

SEQ ID NO: 63245 - DNA, 30 bp, Homo sapiens; identical to SEQ ID NO: 42782
  misc_feature 1..30: note = chr10:134730720-134730750
  misc_feature 1..30: note = hypo
  source 1..30: mol_type = genomic DNA

SEQ ID NO: 63246 - DNA, 177 bp, Homo sapiens; identical to SEQ ID NO: 42783
  misc_feature 1..177: note = chr10:134731838-134732015
  misc_feature 1..177: note = hypo
  source 1..177: mol_type = genomic DNA

SEQ ID NO: 63247 - DNA, 337 bp, Homo sapiens
  misc_feature 1..337: note = chr10:134732884-134733221
  misc_feature 1..337: note = hypo
  source 1..337: mol_type = genomic DNA
gacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgc

SEQ ID NO: 63248 - DNA, 222 bp, Homo sapiens; identical to SEQ ID NO: 24727
  misc_feature 1..222: note = chr10:134733275-134733497
  misc_feature 1..222: note = hypo
  source 1..222: mol_type = genomic DNA

SEQ ID NO: 63249 - DNA, 132 bp, Homo sapiens
  misc_feature 1..132: note = chr10:134733617-134733749
  misc_feature 1..132: note = hypo
  source 1..132: mol_type = genomic DNA
cgctgacggtgtggtgccacgccttcgcacagaggtaggtgaaccggcccctgttcttcccggtggagactgagggcggaaatgcaaaggcaggtgttgcagctgctggccaagggccggggacgtgcccat

SEQ ID NO: 63250 - DNA, 193 bp, Homo sapiens; identical to SEQ ID NO: 42785
  misc_feature 1..193: note = chr10:134734077-134734270
  misc_feature 1..193: note = hypo
  source 1..193: mol_type = genomic DNA

SEQ ID NO: 63251 - DNA, 233 bp, Homo sapiens
  misc_feature 1..233: note = chr10:134738145-134738378
  misc_feature 1..233: note = hypo
  source 1..233: mol_type = genomic DNA
tcctcctatgcgccacgccctctgtggaggacacagcacaggtgagcgccccacctgtccagcttctccagcacgtccgcaacgccagccaggggcttccgcaggtggtgccgcaggttgtgctgcagcaggggcaggcaggtgttccactgcgtggcgcacaccacgtggatgacccgggggtcgcccaggcgcacggctcgctgcagcgcgacgtctagcctctgtatgat

SEQ ID NO: 63252 - DNA, 46 bp, Homo sapiens
  misc_feature 1..46: note = chr10:134738642-134738688
  misc_feature 1..46: note = hypo
  source 1..46: mol_type = genomic DNA
gactcagcgggcgctgctcccttcctgatcccgtctctttcctggg

SEQ ID NO: 63253 - DNA, 87 bp, Homo sapiens; identical to SEQ ID NO: 42787
  misc_feature 1..87: note = chr10:134739185-134739272
  misc_feature 1..87: note = hypo
  source 1..87: mol_type = genomic DNA

SEQ ID NO: 63254 - DNA, 30 bp, Homo sapiens; identical to SEQ ID NO: 42788
  misc_feature 1..30: note = chr10:134757661-134757691
  misc_feature 1..30: note = hypo
  source 1..30: mol_type = genomic DNA

SEQ ID NO: 63255 - DNA, 67 bp, Homo sapiens; identical to SEQ ID NO: 42789
  misc_feature 1..67: note = chr10:134773913-134773980
  misc_feature 1..67: note = hypo
  source 1..67: mol_type = genomic DNA

SEQ ID NO: 63256 - DNA, 32 bp, Homo sapiens; identical to SEQ ID NO: 42791
  misc_feature 1..32: note = chr10:134793940-134793972
  misc_feature 1..32: note = hypo
  source 1..32: mol_type = genomic DNA

SEQ ID NO: 63257 - DNA, 30 bp, Homo sapiens; identical to SEQ ID NO: 42792
  misc_feature 1..30: note = chr10:134794902-134794932
  misc_feature 1..30: note = hypo
  source 1..30: mol_type = genomic DNA

SEQ ID NO: 63258 - DNA, 44 bp, Homo sapiens; identical to SEQ ID NO: 42793
  misc_feature 1..44: note = chr10:134797644-134797688
  misc_feature 1..44: note = hypo
  source 1..44: mol_type = genomic DNA

SEQ ID NO: 63259 - DNA, 54 bp, Homo sapiens; identical to SEQ ID NO: 42794
  misc_feature 1..54: note = chr10:134832061-134832115
  misc_feature 1..54: note = hypo
  source 1..54: mol_type = genomic DNA

SEQ ID NO: 63260 - DNA, 30 bp, Homo sapiens; identical to SEQ ID NO: 42795
  misc_feature 1..30: note = chr10:134834266-134834296
  misc_feature 1..30: note = hypo
  source 1..30: mol_type = genomic DNA

SEQ ID NO: 63261 - DNA, 304 bp, Homo sapiens; identical to SEQ ID NO: 42796
  misc_feature 1..304: note = chr10:134834639-134834943
  misc_feature 1..304: note = hypo
  source 1..304: mol_type = genomic DNA

SEQ ID NO: 63262 - DNA, 95 bp, Homo sapiens; identical to SEQ ID NO: 42797
  misc_feature 1..95: note = chr10:134855674-134855769
  misc_feature 1..95: note = hypo
  source 1..95: mol_type = genomic DNA

SEQ ID NO: 63263 - DNA, 60 bp, Homo sapiens; identical to SEQ ID NO: 42798
  misc_feature 1..60: note = chr10:134875820-134875880
  misc_feature 1..60: note = hypo
  source 1..60: mol_type = genomic DNA

SEQ ID NO: 63264 - DNA, 41 bp, Homo sapiens; identical to SEQ ID NO: 42799
  misc_feature 1..41: note = chr10:134886279-134886320
  misc_feature 1..41: note = hypo
  source 1..41: mol_type = genomic DNA

SEQ ID NO: 63265 - DNA, 49 bp, Homo sapiens; identical to SEQ ID NO: 15439
  misc_feature 1..49: note = chr10:134895296-134895345
  misc_feature 1..49: note = hypo
  source 1..49: mol_type = genomic DNA

SEQ ID NO: 63266 - DNA, 177 bp, Homo sapiens; identical to SEQ ID NO: 42801
  misc_feature 1..177: note = chr10:134898411-134898588
  misc_feature 1..177: note = hypo
  source 1..177: mol_type = genomic DNA

SEQ ID NO: 63267 - DNA, 96 bp, Homo sapiens; identical to SEQ ID NO: 42802
  misc_feature 1..96: note = chr10:134912118-134912214
  misc_feature 1..96: note = hypo
  source 1..96: mol_type = genomic DNA

SEQ ID NO: 63268 - DNA, 216 bp, Homo sapiens; identical to SEQ ID NO: 42803
  misc_feature 1..216: note = chr10:134913796-134914012
  misc_feature 1..216: note = hypo
  source 1..216: mol_type = genomic DNA

SEQ ID NO: 63269 - DNA, 102 bp, Homo sapiens; identical to SEQ ID NO: 42805
  misc_feature 1..102: note = chr10:134930914-134931016
  misc_feature 1..102: note = hypo
  source 1..102: mol_type = genomic DNA

SEQ ID NO: 63270 - DNA, 255 bp, Homo sapiens; identical to SEQ ID NO: 42806
  misc_feature 1..255: note = chr10:134937581-134937836
  misc_feature 1..255: note = hypo
  source 1..255: mol_type = genomic DNA

SEQ ID NO: 63271 - DNA, 232 bp, Homo sapiens
  misc_feature 1..232: note = chr10:134940913-134941145
  misc_feature 1..232: note = hypo
  source 1..232: mol_type = genomic DNA
tggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaac

SEQ ID NO: 63272 - DNA, 106 bp, Homo sapiens
  misc_feature 1..106: note = chr10:134941178-134941284
  misc_feature 1..106: note = hypo
  source 1..106: mol_type = genomic DNA
tgcccagagccagcctggaacctctcattcagggccctcagttccttctgcggccccaggatggcccgcccgtctgccctccgccttgccccgcccacccagctcc

SEQ ID NO: 63273 - DNA, 187 bp, Homo sapiens; identical to SEQ ID NO: 42808
  misc_feature 1..187: note = chr10:134941647-134941834
  misc_feature 1..187: note = hypo
  source 1..187: mol_type = genomic DNA

SEQ ID NO: 63274 - DNA, 357 bp, Homo sapiens
  misc_feature 1..357: note = chr10:134942483-134942840
  misc_feature 1..357: note = hypo
  source 1..357: mol_type = genomic DNA
cgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcaggga

SEQ ID NO: 63275 - DNA, 25 bp, Homo sapiens
  misc_feature 1..25: note = chr10:134943114-134943139
  misc_feature 1..25: note = hypo
  source 1..25: mol_type = genomic DNA
tttcagaagccgttcacacccctgc

SEQ ID NO: 63276 - DNA, 30 bp, Homo sapiens; identical to SEQ ID NO: 42810
  misc_feature 1..30: note = chr10:134943582-134943612
  misc_feature 1..30: note = hypo
  source 1..30: mol_type = genomic DNA

SEQ ID NO: 63277 - DNA, 30 bp, Homo sapiens; identical to SEQ ID NO: 42811
  misc_feature 1..30: note = chr10:134945693-134945723
  misc_feature 1..30: note = hypo
  source 1..30: mol_type = genomic DNA

SEQ ID NO: 63278 - DNA, 104 bp, Homo sapiens; identical to SEQ ID NO: 42812
  misc_feature 1..104: note = chr10:134955053-134955157
  misc_feature 1..104: note = hypo
  source 1..104: mol_type = genomic DNA

SEQ ID NO: 63279 - DNA, 30 bp, Homo sapiens; identical to SEQ ID NO: 42813
  misc_feature 1..30: note = chr10:134970630-134970660
  misc_feature 1..30: note = hypo
  source 1..30: mol_type = genomic DNA

SEQ ID NO: 63280 - DNA, 30 bp, Homo sapiens; identical to SEQ ID NO: 42814
  misc_feature 1..30: note = chr10:134992431-134992461
  misc_feature 1..30: note = hypo
  source 1..30: mol_type = genomic DNA

SEQ ID NO: 63281 - DNA, 651 bp, Homo sapiens; identical to SEQ ID NO: 42815
  misc_feature 1..651: note = chr10:134996258-134996909
  misc_feature 1..651: note = hypo
  source 1..651: mol_type = genomic DNA

SEQ ID NO: 63282 - DNA, 35 bp, Homo sapiens; identical to SEQ ID NO: 42816
  misc_feature 1..35: note = chr10:135001392-135001427
  misc_feature 1..35: note = hypo
  source 1..35: mol_type = genomic DNA

SEQ ID NO: 63283 - DNA, 56 bp, Homo sapiens; identical to SEQ ID NO: 24744
  misc_feature 1..56: note = chr10:135002007-135002063
  misc_feature 1..56: note = hypo
  source 1..56: mol_type = genomic DNA

SEQ ID NO: 63284 - DNA, 46 bp, Homo sapiens
  misc_feature 1..46: note = chr10:135002156-135002202
  misc_feature 1..46: note = hypo
  source 1..46: mol_type = genomic DNA
ggtgacgcacgcaccatcccatcccccccgccgtccccacccccca

SEQ ID NO: 63285 - DNA, 30 bp, Homo sapiens; identical to SEQ ID NO: 42818
  misc_feature 1..30: note = chr10:135010585-135010615
  misc_feature 1..30: note = hypo
  source 1..30: mol_type = genomic DNA

SEQ ID NO: 63286 - DNA, 225 bp, Homo sapiens; identical to SEQ ID NO: 42819
  misc_feature 1..225: note = chr10:135011834-135012059
  misc_feature 1..225: note = hypo
  source 1..225: mol_type = genomic DNA

SEQ ID NO: 63287 - DNA, 42 bp, Homo sapiens; identical to SEQ ID NO: 42820
  misc_feature 1..42: note = chr10:135012659-135012701
  misc_feature 1..42: note = hypo
  source 1..42: mol_type = genomic DNA

SEQ ID NO: 63288 - DNA, 175 bp, Homo sapiens
  misc_feature 1..175: note = chr10:135014788-135014963
  misc_feature 1..175: note = hypo
  source 1..175: mol_type = genomic DNA
cctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccac

SEQ ID NO: 63289 - DNA, 257 bp, Homo sapiens
  misc_feature 1..257: note = chr10:135015132-135015389
  misc_feature 1..257: note = hypo
  source 1..257: mol_type = genomic DNA
gtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccga

SEQ ID NO: 63290 - DNA, 297 bp, Homo sapiens
  misc_feature 1..297: note = chr10:135017129-135017426
  misc_feature 1..297: note = hypo
  source 1..297: mol_type = genomic DNA
tgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagt

SEQ ID NO: 63291 - DNA, 42 bp, Homo sapiens; identical to SEQ ID NO: 42823
  misc_feature 1..42: note = chr10:135018357-135018399
  misc_feature 1..42: note = hypo
  source 1..42: mol_type = genomic DNA

SEQ ID NO: 63292 - DNA, 30 bp, Homo sapiens; identical to SEQ ID NO: 42824
  misc_feature 1..30: note = chr10:135018962-135018992
  misc_feature 1..30: note = hypo
  source 1..30: mol_type = genomic DNA

SEQ ID NO: 63293 - DNA, 97 bp, Homo sapiens
  misc_feature 1..97: note = chr10:135020704-135020801
  misc_feature 1..97: note = hypo
  source 1..97: mol_type = genomic DNA
ccgcaccctgcgacacgctggacttcagccccctggacgagtcctcctcgctcatcttctacaacgtcaacaagcacccgggcggccggcagaaggc

SEQ ID NO: 63294 - DNA, 30 bp, Homo sapiens; identical to SEQ ID NO: 15452
  misc_feature 1..30: note = chr10:135023111-135023141
  misc_feature 1..30: note = hypo
  source 1..30: mol_type = genomic DNA

SEQ ID NO: 63295 - DNA, 36 bp, Homo sapiens; identical to SEQ ID NO: 24752
  misc_feature 1..36: note = chr10:135023434-135023470
  misc_feature 1..36: note = hypo
  source 1..36: mol_type = genomic DNA

SEQ ID NO: 63296 - DNA, 98 bp, Homo sapiens
  misc_feature 1..98: note = chr10:135023500-135023598
  misc_feature 1..98: note = hypo
  source 1..98: mol_type = genomic DNA
ccggtcccgaggcaccagctccctcagcttcccgagctaacgggtcctgcgagtggagacgtcacaaagccctgcatagggctgcgttcagaaaggcc

SEQ ID NO: 63297 - DNA, 26 bp, Homo sapiens
  misc_feature 1..26: note = chr10:135025729-135025755
  misc_feature 1..26: note = hypo
  source 1..26: mol_type = genomic DNA
acgtgtgcaccctcacgcaatccaca

SEQ ID NO: 63298 - DNA, 30 bp, Homo sapiens; identical to SEQ ID NO: 15454
  misc_feature 1..30: note = chr10:135035009-135035039
  misc_feature 1..30: note = hypo
  source 1..30: mol_type = genomic DNA

SEQ ID NO: 63299 - DNA, 30 bp, Homo sapiens; identical to SEQ ID NO: 42830
  misc_feature 1..30: note = chr10:135035302-135035332
  misc_feature 1..30: note = hypo
  source 1..30: mol_type = genomic DNA

SEQ ID NO: 63300 - DNA, 42 bp, Homo sapiens; identical to SEQ ID NO: 42831
  misc_feature 1..42: note = chr10:135037546-135037588
  misc_feature 1..42: note = hypo
  source 1..42: mol_type = genomic DNA

SEQ ID NO: 63301 - DNA, 100 bp, Homo sapiens; identical to SEQ ID NO: 42832
  misc_feature 1..100: note = chr10:135069848-135069948
  misc_feature 1..100: note = hypo
  source 1..100: mol_type = genomic DNA

SEQ ID NO: 63302 - DNA, 144 bp, Homo sapiens; identical to SEQ ID NO: 42833
  misc_feature 1..144: note = chr10:135087501-135087645
  misc_feature 1..144: note = hypo
  source 1..144: mol_type = genomic DNA

SEQ ID NO: 63303 - DNA, 34 bp, Homo sapiens; identical to SEQ ID NO: 42834
  misc_feature 1..34: note = chr10:135124157-135124191
  misc_feature 1..34: note = hypo
  source 1..34: mol_type = genomic DNA

SEQ ID NO: 63304 - DNA, 27 bp, Homo sapiens
  misc_feature 1..27: note = chr10:135159617-135159644
  misc_feature 1..27: note = hypo
  source 1..27: mol_type = genomic DNA
agggtgtgccagggacggctaaagaag

SEQ ID NO: 63305 - DNA, 30 bp, Homo sapiens; identical to SEQ ID NO: 42836
  misc_feature 1..30: note = chr10:135162912-135162942
  misc_feature 1..30: note = hypo
  source 1..30: mol_type = genomic DNA

SEQ ID NO: 63306 - DNA, 18 bp, Homo sapiens
  misc_feature 1..18: note = chr10:135208606-135208624
  misc_feature 1..18: note = hypo
  source 1..18: mol_type = genomic DNA
acccgtggaagggcccgg

SEQ ID NO: 63307 - DNA, 30 bp, Homo sapiens; identical to SEQ ID NO: 42838
  misc_feature 1..30: note = chr11:197439-197469
  misc_feature 1..30: note = hypo
  source 1..30: mol_type = genomic DNA

SEQ ID NO: 63308 - DNA, 30 bp, Homo sapiens; identical to SEQ ID NO: 42839
  misc_feature 1..30: note = chr11:299379-299409
  misc_feature 1..30: note = hypo
  source 1..30: mol_type = genomic DNA

SEQ ID NO: 63309 - DNA, 14 bp, Homo sapiens
  misc_feature 1..14: note = chr11:394801-394815
  misc_feature 1..14: note = hypo
  source 1..14: mol_type = genomic DNA
ttggcacatggcag

SEQ ID NO: 63310 - DNA, 173 bp, Homo sapiens; identical to SEQ ID NO: 42841
  misc_feature 1..173: note = chr11:429466-429639
  misc_feature 1..173: note = hypo
  source 1..173: mol_type = genomic DNA

SEQ ID NO: 63311 - DNA, 278 bp, Homo sapiens; identical to SEQ ID NO: 42842
  misc_feature 1..278: note = chr11:445925-446203
  misc_feature 1..278: note = hypo
  source 1..278: mol_type = genomic DNA

SEQ ID NO: 63312 - DNA, 39 bp, Homo sapiens; identical to SEQ ID NO: 42843
  misc_feature 1..39: note = chr11:449334-449373
  misc_feature 1..39: note = hypo
  source 1..39: mol_type = genomic DNA

SEQ ID NO: 63313 - DNA, 103 bp, Homo sapiens; identical to SEQ ID NO: 42844
  misc_feature 1..103: note = chr11:449589-449692
  misc_feature 1..103: note = hypo
  source 1..103: mol_type = genomic DNA

SEQ ID NO: 63314 - DNA, 59 bp, Homo sapiens; identical to SEQ ID NO: 42845
  misc_feature 1..59: note = chr11:486036-486095
  misc_feature 1..59: note = hypo
  source 1..59: mol_type = genomic DNA

SEQ ID NO: 63315 - DNA, 245 bp, Homo sapiens; identical to SEQ ID NO: 42846
  misc_feature 1..245: note = chr11:487303-487548
  misc_feature 1..245: note = hypo
  source 1..245: mol_type = genomic DNA

SEQ ID NO: 63316 - DNA, 54 bp, Homo sapiens; identical to SEQ ID NO: 42847
  misc_feature 1..54: note = chr11:493145-493199
  misc_feature 1..54: note = hypo
  source 1..54: mol_type = genomic DNA

SEQ ID NO: 63317 - DNA, 600 bp, Homo sapiens; identical to SEQ ID NO: 42848
  misc_feature 1..600: note = chr11:562246-562846
  misc_feature 1..600: note = hypo
  source 1..600: mol_type = genomic DNA

SEQ ID NO: 63318 - DNA, 30 bp, Homo sapiens; identical to SEQ ID NO: 42849
  misc_feature 1..30: note = chr11:571791-571821
  misc_feature 1..30: note = hypo
  source 1..30: mol_type = genomic DNA

SEQ ID NO: 63319 - DNA, 42 bp, Homo sapiens; identical to SEQ ID NO: 42850
  misc_feature 1..42: note = chr11:707906-707948
  misc_feature 1..42: note = hypo
  source 1..42: mol_type = genomic DNA

SEQ ID NO: 63320 - DNA, 30 bp, Homo sapiens; identical to SEQ ID NO: 15461
  misc_feature 1..30: note = chr11:762939-762969
  misc_feature 1..30: note = hypo
  source 1..30: mol_type = genomic DNA

SEQ ID NO: 63321 - DNA, 21 bp, Homo sapiens
  misc_feature 1..21: note = chr11:763302-763323
  misc_feature 1..21: note = hypo
  source 1..21: mol_type = genomic DNA
cgccctcacctgccccgccct

SEQ ID NO: 63322 - DNA, 281 bp, Homo sapiens; identical to SEQ ID NO: 42854
  misc_feature 1..281: note = chr11:782269-782550
  misc_feature 1..281: note = hypo
  source 1..281: mol_type = genomic DNA

SEQ ID NO: 63323 - DNA, 104 bp, Homo sapiens; identical to SEQ ID NO: 42855
  misc_feature 1..104: note = chr11:823903-824007
  misc_feature 1..104: note = hypo
  source 1..104: mol_type = genomic DNA

SEQ ID NO: 63324 - DNA, 132 bp, Homo sapiens; identical to SEQ ID NO: 42856
  misc_feature 1..132: note = chr11:824852-824984
  misc_feature 1..132: note = hypo
  source 1..132: mol_type = genomic DNA

SEQ ID NO: 63325 - skipped

SEQ ID NO: 63326 - DNA, 30 bp, Homo sapiens; identical to SEQ ID NO: 42858
  misc_feature 1..30: note = chr11:851077-851107
  misc_feature 1..30: note = hypo
  source 1..30: mol_type = genomic DNA

SEQ ID NO: 63327 - DNA, 58 bp, Homo sapiens; identical to SEQ ID NO: 42859
  misc_feature 1..58: note = chr11:858498-858556
  misc_feature 1..58: note = hypo
  source 1..58: mol_type = genomic DNA

SEQ ID NO: 63328 - DNA, 383 bp, Homo sapiens; identical to SEQ ID NO: 42860
  misc_feature 1..383: note = chr11:859019-859402
  misc_feature 1..383: note = hypo
  source 1..383: mol_type = genomic DNA

SEQ ID NO: 63329 - DNA, 33 bp, Homo sapiens; identical to SEQ ID NO: 42861
  misc_feature 1..33: note = chr11:860888-860921
  misc_feature 1..33: note = hypo
  source 1..33: mol_type = genomic DNA

SEQ ID NO: 63330 - DNA, 446 bp, Homo sapiens
  misc_feature 1..446: note = chr11:862616-863062
  misc_feature 1..446: note = hypo
  source 1..446: mol_type = genomic DNA
tgtcctcttccttcccgtccctgtcggctgccaacttgctcatcatcaccggcgcctttgtcatggccatcggcttcgtgggctgcctgggtgccatcaaggagaacaagtgcctcctgctcactgtgagtgccggggcccaagcgatgctccgggtgggaccacgcagggtggggctccggtggcccccaggccttggctgccgcagtgaccccccagacgtgggcaccacctctggggccggacctccaggctggcagtgtggcccggggccctggccactgttgggtcttccaggccacactggggctggggggtgatttgcagagcggtgtgggggtcactcaagagaacgtgctgtaccttgtcaggggcctcccctgacgggacactggccctggtgagtgcaggcacagccccgcacacacgtacacacgcatgcgcag

SEQ ID NO: 63331 - DNA, 68 bp, Homo sapiens; identical to SEQ ID NO: 15467
  misc_feature 1..68: note = chr11:864749-864817
  misc_feature 1..68: note = hypo
  source 1..68: mol_type = genomic DNA

SEQ ID NO: 63332 - DNA, 470 bp, Homo sapiens; identical to SEQ ID NO: 42864
  misc_feature 1..470: note = chr11:865657-866127
  misc_feature 1..470: note = hypo
  source 1..470: mol_type = genomic DNA

SEQ ID NO: 63333 - DNA, 30 bp, Homo sapiens; identical to SEQ ID NO: 15469
  misc_feature 1..30: note = chr11:866956-866986
  misc_feature 1..30: note = hypo
  source 1..30: mol_type = genomic DNA

SEQ ID NO: 63334 - DNA, 30 bp, Homo sapiens; identical to SEQ ID NO: 15470
  misc_feature 1..30: note = chr11:875487-875517
  misc_feature 1..30: note = hypo
  source 1..30: mol_type = genomic DNA

SEQ ID NO: 63335 - DNA, 152 bp, Homo sapiens; identical to SEQ ID NO: 42867
  misc_feature 1..152: note = chr11:985308-985460
  misc_feature 1..152: note = hypo
  source 1..152: mol_type = genomic DNA

SEQ ID NO: 63336 - DNA, 107 bp, Homo sapiens; identical to SEQ ID NO: 42868
  misc_feature 1..107: note = chr11:986906-987013
  misc_feature 1..107: note = hypo
  source 1..107: mol_type = genomic DNA

SEQ ID NO: 63337 - DNA, 30 bp, Homo sapiens; identical to SEQ ID NO: 42869
  misc_feature 1..30: note = chr11:1008527-1008557
  misc_feature 1..30: note = hypo
  source 1..30: mol_type = genomic DNA

SEQ ID NO: 63338 - DNA, 344 bp, Homo sapiens; identical to SEQ ID NO: 42870
  misc_feature 1..344: note = chr11:1024866-1025210
  misc_feature 1..344: note = hypo
  source 1..344: mol_type = genomic DNA

SEQ ID NO: 63339 - DNA, 293 bp, Homo sapiens; identical to SEQ ID NO: 42871
  misc_feature 1..293: note = chr11:1025896-1026189
  misc_feature 1..293: note = hypo
  source 1..293: mol_type = genomic DNA

SEQ ID NO: 63340 - DNA, 125 bp, Homo sapiens
  misc_feature 1..125: note = chr11:1027415-1027540
  misc_feature 1..125: note = hypo
  source 1..125: mol_type = genomic DNA
cgctgtggtggcactcggtggcacggtccgacagcgacaggcaggtgcgctcacaggcttggctgttgtagctgaaggtggtgttacccgtgcaggggatggctgtgggggacccgggcatcaga

SEQ ID NO: 63341 - DNA, 61 bp, Homo sapiens; identical to SEQ ID NO: 42873
  misc_feature 1..61: note = chr11:1028309-1028370
  misc_feature 1..61: note = hypo
  source 1..61: mol_type = genomic DNA

SEQ ID NO: 63342 - DNA, 60 bp, Homo sapiens
  misc_feature 1..60: note = chr11:1029178-1029238
  misc_feature 1..60: note = hypo
  source 1..60: mol_type = genomic DNA
tggggtcaccgggagcgcccctccccacgggccacagggctcgtcctacctggaggagga

SEQ ID NO: 63343 - DNA, 18 bp, Homo sapiens
  misc_feature 1..18: note = chr11:1029403-1029421
  misc_feature 1..18: note = hypo
  source 1..18: mol_type = genomic DNA
ggccgctggagccagaca

SEQ ID NO: 63344 - DNA, 50 bp, Homo sapiens
  misc_feature 1..50: note = chr11:1030165-1030215
  misc_feature 1..50: note = hypo
  source 1..50: mol_type = genomic DNA
tctctctaggggtcccggggagagagagtgcctgcgactgccctcacctt

SEQ ID NO: 63345 - DNA, 12 bp, Homo sapiens
  misc_feature 1..12: note = chr11:1030296-1030308
  misc_feature 1..12: note = hypo
  source 1..12: mol_type = genomic DNA
actcctggtaca

SEQ ID NO: 63346 - DNA, 33 bp, Homo sapiens; identical to SEQ ID NO: 42876
  misc_feature 1..33: note = chr11:1043870-1043903
  misc_feature 1..33: note = hypo
  source 1..33: mol_type = genomic DNA

SEQ ID NO: 63347 - DNA, 151 bp, Homo sapiens; identical to SEQ ID NO: 42877
  misc_feature 1..151: note = chr11:1075796-1075947
  misc_feature 1..151: note = hypo
  source 1..151: mol_type = genomic DNA

SEQ ID NO: 63348 - DNA, 155 bp, Homo sapiens; identical to SEQ ID NO: 42878
  misc_feature 1..155: note = chr11:1077593-1077748
  misc_feature 1..155: note = hypo
  source 1..155: mol_type = genomic DNA

SEQ ID NO: 63349 - DNA, 16 bp, Homo sapiens
  misc_feature 1..16: note = chr11:1079536-1079552
  misc_feature 1..16: note = hypo
  source 1..16: mol_type = genomic DNA
ccgggcaccgggagct

SEQ ID NO: 63350 - DNA, 30 bp, Homo sapiens; identical to SEQ ID NO: 42880
  misc_feature 1..30: note = chr11:1080245-1080275
  misc_feature 1..30: note = hypo
  source 1..30: mol_type = genomic DNA

SEQ ID NO: 63351 - DNA, 41 bp, Homo sapiens; identical to SEQ ID NO: 42881
  misc_feature 1..41: note = chr11:1083467-1083508
  misc_feature 1..41: note = hypo
  source 1..41: mol_type = genomic DNA

SEQ ID NO: 63352 - DNA, 30 bp, Homo sapiens; identical to SEQ ID NO: 42882
  misc_feature 1..30: note = chr11:1085664-1085694
  misc_feature 1..30: note = hypo
  source 1..30: mol_type = genomic DNA

SEQ ID NO: 63353 - DNA, 198 bp, Homo sapiens; identical to SEQ ID NO: 42883
  misc_feature 1..198: note = chr11:1094942-1095140
  misc_feature 1..198: note = hypo
  source 1..198: mol_type = genomic DNA

SEQ ID NO: 63354 - DNA, 30 bp, Homo sapiens; identical to SEQ ID NO: 42884
  misc_feature 1..30: note = chr11:1095639-1095669
  misc_feature 1..30: note = hypo
  source 1..30: mol_type = genomic DNA

SEQ ID NO: 63355 - DNA, 199 bp, Homo sapiens; identical to SEQ ID NO: 42885
  misc_feature 1..199: note = chr11:1103985-1104184
  misc_feature 1..199: note = hypo
  source 1..199: mol_type = genomic DNA

SEQ ID NO: 63356 - DNA, 62 bp, Homo sapiens; identical to SEQ ID NO: 42886
  misc_feature 1..62: note = chr11:1115115-1115177
  misc_feature 1..62: note = hypo
  source 1..62: mol_type = genomic DNA

SEQ ID NO: 63357 - DNA, 73 bp, Homo sapiens; identical to SEQ ID NO: 42887
  misc_feature 1..73: note = chr11:1140450-1140523
  misc_feature 1..73: note = hypo
  source 1..73: mol_type = genomic DNA

SEQ ID NO: 63358 - DNA, 30 bp, Homo sapiens; identical to SEQ ID NO: 15479
  misc_feature 1..30: note = chr11:1142462-1142492
  misc_feature 1..30: note = hypo
  source 1..30: mol_type = genomic DNA

SEQ ID NO: 63359 - DNA, 30 bp, Homo sapiens; identical to SEQ ID NO: 42889
  misc_feature 1..30: note = chr11:1148164-1148194
  misc_feature 1..30: note = hypo
  source 1..30: mol_type = genomic DNA

SEQ ID NO: 63360 - DNA, 54 bp, Homo sapiens; identical to SEQ ID NO: 42890
  misc_feature 1..54: note = chr11:1151771-1151825
  misc_feature 1..54: note = hypo
  source 1..54: mol_type = genomic DNA

SEQ ID NO: 63361 - DNA, 30 bp, Homo sapiens; identical to SEQ ID NO: 42891
  misc_feature 1..30: note = chr11:1152610-1152640
  misc_feature 1..30: note = hypo
  source 1..30: mol_type = genomic DNA

SEQ ID NO: 63362 - DNA, 30 bp, Homo sapiens; identical to SEQ ID NO: 42892
  misc_feature 1..30: note = chr11:1155200-1155230
  misc_feature 1..30: note = hypo
  source 1..30: mol_type = genomic DNA

SEQ ID NO: 63363 - DNA, 123 bp, Homo sapiens; identical to SEQ ID NO: 42893
  misc_feature 1..123: note = chr11:1155629-1155752
  misc_feature 1..123: note = hypo
  source 1..123: mol_type = genomic DNA

SEQ ID NO: 63364 - DNA, 50 bp, Homo sapiens
  misc_feature 1..50: note = chr11:1214917-1214967
  misc_feature 1..50: note = hypo
  source 1..50: mol_type = genomic DNA
ccggggcagccactccccacccaggtggaaatgggcggggcagaggaggg

SEQ ID NO: 63365 - DNA, 30 bp, Homo sapiens; identical to SEQ ID NO: 42895
  misc_feature 1..30: note = chr11:1215395-1215425
  misc_feature 1..30: note = hypo
  source 1..30: mol_type = genomic DNA

SEQ ID NO: 63366 - DNA, 83 bp, Homo sapiens
  misc_feature 1..83: note = chr11:1215816-1215899
  misc_feature 1..83: note = hypo
  source 1..83: mol_type = genomic DNA
ccaggtcatgttctccggcctcatcttctccgtggaggtgcccttcagcaagtttgccaacaacaccgagggccagtgcggtg

SEQ ID NO: 63367 - DNA, 30 bp, Homo sapiens; identical to SEQ ID NO: 42898
  misc_feature 1..30: note = chr11:1241768-1241798
  misc_feature 1..30: note = hypo
  source 1..30: mol_type = genomic DNA

SEQ ID NO: 63368 - DNA, 33 bp, Homo sapiens
  misc_feature 1..33: note = chr11:1244348-1244381
  misc_feature 1..33: note = hypo
  source 1..33: mol_type = genomic DNA
ccaggatgggtgccccgagcgcgtgccggacgc

SEQ ID NO: 63369 - DNA, 66 bp, Homo sapiens; identical to SEQ ID NO: 24782
  misc_feature 1..66: note = chr11:1244465-1244531
  misc_feature 1..66: note = hypo
  source 1..66: mol_type = genomic DNA

SEQ ID NO: 63370 - DNA, 67 bp, Homo sapiens; identical to SEQ ID NO: 15484
  misc_feature 1..67: note = chr11:1247815-1247882
  misc_feature 1..67: note = hypo
  source 1..67: mol_type = genomic DNA

SEQ ID NO: 63371 - DNA, 24 bp, Homo sapiens
  misc_feature 1..24: note = chr11:1250865-1250889
  misc_feature 1..24: note = hypo
  source 1..24: mol_type = genomic DNA
gaccttggtgtcccccgtgcatgg

SEQ ID NO: 63372 - DNA, 259 bp, Homo sapiens
  misc_feature 1..259: note = chr11:1250924-1251183
  misc_feature 1..259: note = hypo
  source 1..259: mol_type = genomic DNA
gtgctggatgacatcacgcactctggctgcctgcccctcgggcagtgcccctgcacccacggcggccgcacctacagcccgggcacctccttcaacaccacctgcagctcctggtacttatgagcccaccagcctccgcctggggtggggtgtggagctcctggtatttatgaacccgccagcctctgcctggggtgggggtgtggagctcctggtgtgcacccaccagcctccgcctgcggtgggggtgtggagggtg

SEQ ID NO: 63373 - DNA, 178 bp, Homo sapiens; identical to SEQ ID NO: 42902
  misc_feature 1..178: note = chr11:1252902-1253080
  misc_feature 1..178: note = hypo
  source 1..178: mol_type = genomic DNA

SEQ ID NO: 63374 - DNA, 30 bp, Homo sapiens; identical to SEQ ID NO: 42903
  misc_feature 1..30: note = chr11:1254339-1254369
  misc_feature 1..30: note = hypo
  source 1..30: mol_type = genomic DNA

SEQ ID NO: 63375 - DNA, 321 bp, Homo sapiens; identical to SEQ ID NO: 42904
  misc_feature 1..321: note = chr11:1254973-1255294
  misc_feature 1..321: note = hypo
  source 1..321: mol_type = genomic DNA

SEQ ID NO: 63376 - DNA, 48 bp, Homo sapiens; identical to SEQ ID NO: 42905
  misc_feature 1..48: note = chr11:1256469-1256517
  misc_feature 1..48: note = hypo
  source 1..48: mol_type = genomic DNA

SEQ ID NO: 63377 - DNA, 141 bp, Homo sapiens; identical to SEQ ID NO: 42906
  misc_feature 1..141: note = chr11:1257678-1257819
  misc_feature 1..141: note = hypo
  source 1..141: mol_type = genomic DNA

SEQ ID NO: 63378 - DNA, 178 bp, Homo sapiens; identical to SEQ ID NO: 42907
  misc_feature 1..178: note = chr11:1263199-1263377
  misc_feature 1..178: note = hypo
  source 1..178: mol_type = genomic DNA

SEQ ID NO: 63379 - DNA, 57 bp, Homo sapiens
  misc_feature 1..57: note = chr11:1263644-1263701
  misc_feature 1..57: note = hypo
  source 1..57: mol_type = genomic DNA
ggtgctgacctgcagcctggagacggggctgacctgcaagaacgaagaccagacagg

SEQ ID NO: 63380 - DNA, 30 bp, Homo sapiens; identical to SEQ ID NO: 42909
  misc_feature 1..30: note = chr11:1274002-1274032
  misc_feature 1..30: note = hypo
  source 1..30: mol_type = genomic DNA

SEQ ID NO: 63381 - DNA, 35 bp, Homo sapiens; identical to SEQ ID NO: 42910
  misc_feature 1..35: note = chr11:1275653-1275688
  misc_feature 1..35: note = hypo
  source 1..35: mol_type = genomic DNA

SEQ ID NO: 63382 - DNA, 445 bp, Homo sapiens; identical to SEQ ID NO: 42911
  misc_feature 1..445: note = chr11:1276293-1276738
  misc_feature 1..445: note = hypo
  source 1..445: mol_type = genomic DNA

SEQ ID NO: 63383 - DNA, 20 bp, Homo sapiens
  misc_feature 1..20: note = chr11:1359706-1359726
  misc_feature 1..20: note = hypo
  source 1..20: mol_type = genomic DNA
aatctcgggaccaggtggag

SEQ ID NO: 63384 - DNA, 40 bp, Homo sapiens; identical to SEQ ID NO: 42913
  misc_feature 1..40: note = chr11:1368324-1368364
  misc_feature 1..40: note = hypo
  source 1..40: mol_type = genomic DNA

SEQ ID NO: 63385 - DNA, 183 bp, Homo sapiens; identical to SEQ ID NO: 42915
  misc_feature 1..183: note = chr11:1382225-1382408
  misc_feature 1..183: note = hypo
  source 1..183: mol_type = genomic DNA

SEQ ID NO: 63386 - DNA, 120 bp, Homo sapiens; identical to SEQ ID NO: 42916
  misc_feature 1..120: note = chr11:1393300-1393420
  misc_feature 1..120: note = hypo
  source 1..120: mol_type = genomic DNA

SEQ ID NO: 63387 - DNA, 30 bp, Homo sapiens; identical to SEQ ID NO: 42917
  misc_feature 1..30: note = chr11:1420766-1420796
  misc_feature 1..30: note = hypo
  source 1..30: mol_type = genomic DNA

SEQ ID NO: 63388 - DNA, 30 bp, Homo sapiens; identical to SEQ ID NO: 42918
  misc_feature 1..30: note = chr11:1422084-1422114
  misc_feature 1..30: note = hypo
  source 1..30: mol_type = genomic DNA

SEQ ID NO: 63389 - DNA, 328 bp, Homo sapiens
  misc_feature 1..328: note = chr11:1430794-1431122
  misc_feature 1..328: note = hypo
  source 1..328: mol_type = genomic DNA
gtgcggtgtggttctgtttatgggtgttgtagagaaggcgccgtccagagacagagccactgctgaggtgggtggggggtgtatgaagggcacaaggacgctttgggggtgtcaggtatgatggccctcaggtcatggtttcacacgcgtgtgctttaaatgcgtgctggctgtcacgtgtcagtcgtgcctccacagagcttcaggaaccaccgagatggggagcctgccggagacacaggttttctgagcgcaccagcggctccaaaagcagagggaagagccctgcgtgcaggtggggcgctcatggcgtcggcctcgcagagcg

SEQ ID NO: 63390 - DNA, 42 bp, Homo sapiens; identical to SEQ ID NO: 42920
  misc_feature 1..42: note = chr11:1433065-1433107
  misc_feature 1..42: note = hypo
  source 1..42: mol_type = genomic DNA

SEQ ID NO: 63391 - DNA, 30 bp, Homo sapiens; identical to SEQ ID NO: 42921
  misc_feature 1..30: note = chr11:1434266-1434296
  misc_feature 1..30: note = hypo
  source 1..30: mol_type = genomic DNA

SEQ ID NO: 63392 - DNA, 128 bp, Homo sapiens; identical to SEQ ID NO: 42922
  misc_feature 1..128: note = chr11:1442699-1442827
  misc_feature 1..128: note = hypo
  source 1..128: mol_type = genomic DNA

SEQ ID NO: 63393 - DNA, 373 bp, Homo sapiens; identical to SEQ ID NO: 42923
  misc_feature 1..373: note = chr11:1444579-1444952
  misc_feature 1..373: note = hypo
  source 1..373: mol_type = genomic DNA

SEQ ID NO: 63394 - DNA, 61 bp, Homo sapiens; identical to SEQ ID NO: 42924
  misc_feature 1..61: note = chr11:1446330-1446391
  misc_feature 1..61: note = hypo
  source 1..61: mol_type = genomic DNA

SEQ ID NO: 63395 - DNA, 30 bp, Homo sapiens; identical to SEQ ID NO: 42925
  misc_feature 1..30: note = chr11:1447472-1447502
  misc_feature 1..30: note = hypo
  source 1..30: mol_type = genomic DNA

SEQ ID NO: 63396 - DNA, 35 bp, Homo sapiens; identical to SEQ ID NO: 42926
  misc_feature 1..35: note = chr11:1450725-1450760
  misc_feature 1..35: note = hypo
  source 1..35: mol_type = genomic DNA

SEQ ID NO: 63397 - DNA, 66 bp, Homo sapiens; identical to SEQ ID NO: 42927
  misc_feature 1..66: note = chr11:1455198-1455264
  misc_feature 1..66: note = hypo
  source 1..66: mol_type = genomic DNA

SEQ ID NO: 63398 - DNA, 30 bp, Homo sapiens; identical to SEQ ID NO: 42928
  misc_feature 1..30: note = chr11:1455520-1455550
  misc_feature 1..30: note = hypo
  source 1..30: mol_type = genomic DNA

SEQ ID NO: 63399 - DNA, 65 bp, Homo sapiens; identical to SEQ ID NO: 42929
  misc_feature 1..65: note = chr11:1461955-1462020
  misc_feature 1..65: note = hypo
  source 1..65: mol_type = genomic DNA

SEQ ID NO: 63400 - DNA, 30 bp, Homo sapiens; identical to SEQ ID NO: 42930
  misc_feature 1..30: note = chr11:1463761-1463791
  misc_feature 1..30: note = hypo
  source 1..30: mol_type = genomic DNA

SEQ ID NO: 63401 - DNA, 76 bp, Homo sapiens; identical to SEQ ID NO: 24795
  misc_feature 1..76: note = chr11:1464204-1464280
  misc_feature 1..76: note = hypo
  source 1..76: mol_type = genomic DNA

SEQ ID NO: 63402 - DNA, 543 bp, Homo sapiens
  misc_feature 1..543: note = chr11:1464428-1464971
  misc_feature 1..543: note = hypo
  source 1..543: mol_type = genomic DNA
ggtgggaccccagcctgccgcacccccaggtgctgctaggctgcctgtccccgggccgactccctctgagcccaggccctccaaggcccccgccctgccctgcgccccccaacagcccgggcactgctgtccacagggggagaagtatgacggccggaaggcggacgtgtggagctgcggcgtcatcctgttcgccttgctggtggtgagaccctggccccctcaaccctgccctggcctctccccaaacctgcccccccacgctgacccccacacccggccgcccgcagggggctctgcccttcgacgatgacaacttgcgacagctgctggagaaggtgaagcggggcgtgttccacatgccgcactttatcccgcccgactgccagagtctgctacggggcatgatcgaggtggacgccgcacgccgcctcacggtgcgtgccctcggagcggggcggccccagagcgtggcgggggggcgcgggggcgggcgtgtgcctgtgtgtgcacaggtgtgtgcccagacgtgtgggcacccag

SEQ ID NO: 63403 - DNA, 292 bp, Homo sapiens; identical to SEQ ID NO: 42932
  misc_feature 1..292: note = chr11:1466910-1467202
  misc_feature 1..292: note = hypo
  source 1..292: mol_type = genomic DNA

SEQ ID NO: 63404 - DNA, 105 bp, Homo sapiens
  misc_feature 1..105: note = chr11:1469123-1469228
  misc_feature 1..105: note = hypo
  source 1..105: mol_type = genomic DNA
tcccagccccagacacgctgtcctgcctcaggccgggcaggcacatgggcgggtctggtggcgggctgggctgcagggctcctgctgcggtgaagccagccagca

SEQ ID NO: 63405 - DNA, 254 bp, Homo sapiens
  misc_feature 1..254: note = chr11:1469379-1469633
  misc_feature 1..254: note = hypo
  source 1..254: mol_type = genomic DNA
gccagcccctgtgctgtgtccggtgggcctcggtggccctgctgcccctggggccggccagagttgaagccgagcagccgtcctgtgcccacctgcaggagctgaggagggcaggaggcgccgccgtcaagaggggcctctacctggggccagttttgcgagcctgggcgggtggcgccgcccccaaggctgcagtgtgctggctgccggtcggggtccttctctttgagccctggccccgtgcctacctggga

SEQ ID NO: 63406 - DNA, 47 bp, Homo sapiens; identical to SEQ ID NO: 42934
  misc_feature 1..47: note = chr11:1471413-1471460
  misc_feature 1..47: note = hypo
  source 1..47: mol_type = genomic DNA

SEQ ID NO: 63407 - DNA, 55 bp, Homo sapiens
  misc_feature 1..55: note = chr11:1471865-1471920
  misc_feature 1..55: note = hypo
  source 1..55: mol_type = genomic DNA
ggacacctgtccacacgccaaaggagagcccggctggcacgcccaaccccacgcc

SEQ ID NO: 63408 - DNA, 127 bp, Homo sapiens; identical to SEQ ID NO: 42936
  misc_feature 1..127: note = chr11:1473513-1473640
  misc_feature 1..127: note = hypo
  source 1..127: mol_type = genomic DNA

SEQ ID NO: 63409 - DNA, 140 bp, Homo sapiens; identical to SEQ ID NO: 42937
  misc_feature 1..140: note = chr11:1477763-1477903
  misc_feature 1..140: note = hypo
  source 1..140: mol_type = genomic DNA

SEQ ID NO: 63410 - DNA, 168 bp, Homo sapiens; identical to SEQ ID NO: 42938
  misc_feature 1..168: note = chr11:1478164-1478332
  misc_feature 1..168: note = hypo
  source 1..168: mol_type = genomic DNA

SEQ ID NO: 63411 - DNA, 399 bp, Homo sapiens; identical to SEQ ID NO: 42939
  misc_feature 1..399: note = chr11:1483506-1483905
  misc_feature 1..399: note = hypo
  source 1..399: mol_type = genomic DNA

SEQ ID NO: 63412 - DNA, 30 bp, Homo sapiens; identical to SEQ ID NO: 42940
  misc_feature 1..30: note = chr11:1517598-1517628
  misc_feature 1..30: note = hypo
  source 1..30: mol_type = genomic DNA

SEQ ID NO: 63413 - DNA, 47 bp, Homo sapiens; identical to SEQ ID NO: 42941
  misc_feature 1..47: note = chr11:1553685-1553732
  misc_feature 1..47: note = hypo
  source 1..47: mol_type = genomic DNA

SEQ ID NO: 63414 - DNA, 35 bp, Homo sapiens; identical to SEQ ID NO: 42942
  misc_feature 1..35: note = chr11:1560806-1560841
  misc_feature 1..35: note = hypo
  source 1..35: mol_type = genomic DNA

SEQ ID NO: 63415 - DNA, 176 bp, Homo sapiens; identical to SEQ ID NO: 42943
  misc_feature 1..176: note = chr11:1669565-1669741
  misc_feature 1..176: note = hypo
  source 1..176: mol_type = genomic DNA

SEQ ID NO: 63416 - DNA, 84 bp, Homo sapiens; identical to SEQ ID NO: 42944
  misc_feature 1..84: note = chr11:1760346-1760430
  misc_feature 1..84: note = hypo
  source 1..84: mol_type = genomic DNA

SEQ ID NO: 63417 - DNA, 30 bp, Homo sapiens; identical to SEQ ID NO: 42945
  misc_feature 1..30: note = chr11:1790238-1790268
  misc_feature 1..30: note = hypo
  source 1..30: mol_type = genomic DNA

SEQ ID NO: 63418 - DNA, 91 bp, Homo sapiens; identical to SEQ ID NO: 42946
  misc_feature 1..91: note = chr11:1795195-1795286
  misc_feature 1..91: note = hypo
  source 1..91: mol_type = genomic DNA

SEQ ID NO: 63419 - DNA, 30 bp, Homo sapiens; identical to SEQ ID NO: 42947
  misc_feature 1..30: note = chr11:1801108-1801138
  misc_feature 1..30: note = hypo
  source 1..30: mol_type = genomic DNA

SEQ ID NO: 63420 - DNA, 45 bp, Homo sapiens; identical to SEQ ID NO: 42948
  misc_feature 1..45: note = chr11:1825207-1825252
  misc_feature 1..45: note = hypo
  source 1..45: mol_type = genomic DNA

SEQ ID NO: 63421 - DNA, 57 bp, Homo sapiens; identical to SEQ ID NO: 42949
  misc_feature 1..57: note = chr11:1856532-1856589
  misc_feature 1..57: note = hypo
  source 1..57: mol_type = genomic DNA

SEQ ID NO: 63422 - DNA, 102 bp, Homo sapiens; identical to SEQ ID NO: 42950
  misc_feature 1..102: note = chr11:1857426-1857528
  misc_feature 1..102: note = hypo
  source 1..102: mol_type = genomic DNA

SEQ ID NO: 63423 - DNA, 30 bp, Homo sapiens; identical to SEQ ID NO: 42951
  misc_feature 1..30: note = chr11:1857873-1857903
  misc_feature 1..30: note = hypo
  source 1..30: mol_type = genomic DNA

SEQ ID NO: 63424 - DNA, 30 bp, Homo sapiens; identical to SEQ ID NO: 42952
  misc_feature 1..30: note = chr11:1863098-1863128
  misc_feature 1..30: note = hypo
  source 1..30: mol_type = genomic DNA

SEQ ID NO: 63425 - DNA, 30 bp, Homo sapiens; identical to SEQ ID NO: 42953
  misc_feature 1..30: note = chr11:1867693-1867723
  misc_feature 1..30: note = hypo
  source 1..30: mol_type = genomic DNA

SEQ ID NO: 63426 - DNA, 28 bp, Homo sapiens
  misc_feature 1..28: note = chr11:1868053-1868081
  misc_feature 1..28: note = hypo
  source 1..28: mol_type = genomic DNA
catttgttcactgtccgtctcttcctct

SEQ ID NO: 63427 - DNA, 73 bp, Homo sapiens
  misc_feature 1..73: note = chr11:1868237-1868310
  misc_feature 1..73: note = hypo
  source 1..73: mol_type = genomic DNA
gtacactggagtcctctggcagccagtgttccccgttgtgcggggctggccgtgaccacgctggaaacccccc

SEQ ID NO: 63428 - DNA, 58 bp, Homo sapiens; identical to SEQ ID NO: 42955
  misc_feature 1..58: note = chr11:1935022-1935080
  misc_feature 1..58: note = hypo
  source 1..58: mol_type = genomic DNA

SEQ ID NO: 63429 - DNA, 30 bp, Homo sapiens; identical to SEQ ID NO: 42956
  misc_feature 1..30: note = chr11:1949952-1949982
  misc_feature 1..30: note = hypo
  source 1..30: mol_type = genomic DNA

SEQ ID NO: 63430 - DNA, 83 bp, Homo sapiens; identical to SEQ ID NO: 42957
  misc_feature 1..83: note = chr11:1955308-1955391
  misc_feature 1..83: note = hypo
  source 1..83: mol_type = genomic DNA

SEQ ID NO: 63431 - DNA, 19 bp, Homo sapiens
  misc_feature 1..19: note = chr11:1957372-1957391
  misc_feature 1..19: note = hypo
  source 1..19: mol_type = genomic DNA
aagctagcccacagccggg

SEQ ID NO: 63432 - DNA, 482 bp, Homo sapiens; identical to SEQ ID NO: 42959
  misc_feature 1..482: note = chr11:1957864-1958346
  misc_feature 1..482: note = hypo
  source 1..482: mol_type = genomic DNA

SEQ ID NO: 63433 - DNA, 192 bp, Homo sapiens
  misc_feature 1..192: note = chr11:1958885-1959077
  misc_feature 1..192: note = hypo
  source 1..192: mol_type = genomic DNA
ggctacttggagtttcgatgttttctgggattcttctccctcctcctgtcgccttggcttccctgcggcgcccagggcgggctcctccgtggtgcacgtgacctcacggcctccctgttgtgccgtcaggggtcattgcagacccctctgagggtgggcagtcggcgtggtgtgcatgtgcctgcgtgtgtg

SEQ ID NO: 63434 - DNA, 52 bp, Homo sapiens
  misc_feature 1..52: note = chr11:1959187-1959239
  misc_feature 1..52: note = hypo
  source 1..52: mol_type = genomic DNA
aagcactcctgtcctccacccgccttcacccctcacccgcacccagctcctc

SEQ ID NO: 63435 - DNA, 88 bp, Homo sapiens; identical to SEQ ID NO: 42961
  misc_feature 1..88: note = chr11:1959951-1960039
  misc_feature 1..88: note = hypo
  source 1..88: mol_type = genomic DNA

SEQ ID NO: 63436 - DNA, 30 bp, Homo sapiens; identical to SEQ ID NO: 42962
  misc_feature 1..30: note = chr11:1976039-1976069
  misc_feature 1..30: note = hypo
  source 1..30: mol_type = genomic DNA

SEQ ID NO: 63437 - DNA, 335 bp, Homo sapiens; identical to SEQ ID NO: 42963
  misc_feature 1..335: note = chr11:1981002-1981337
  misc_feature 1..335: note = hypo
  source 1..335: mol_type = genomic DNA

SEQ ID NO: 63438 - DNA, 133 bp, Homo sapiens; identical to SEQ ID NO: 42964
  misc_feature 1..133: note = chr11:2036968-2037101
  misc_feature 1..133: note = hypo
  source 1..133: mol_type = genomic DNA

SEQ ID NO: 63439 - DNA, 78 bp, Homo sapiens
  misc_feature 1..78: note = chr11:2040029-2040107
  misc_feature 1..78: note = hypo
  source 1..78: mol_type = genomic DNA
cctccagaggggccccgccacagtccatccccttcgcccaggtcccctcggatcagggcctgccagggtggtgtggca

SEQ ID NO: 63440 - DNA, 41 bp, Homo sapiens
  misc_feature 1..41: note = chr11:2040148-2040189
  misc_feature 1..41: note = hypo
  source 1..41: mol_type = genomic DNA
ggtgcagccaggctctggcccccacacgcttgggctttgct

SEQ ID NO: 63441 - DNA, 220 bp, Homo sapiens; identical to SEQ ID NO: 42966
  misc_feature 1..220: note = chr11:2042281-2042501
  misc_feature 1..220: note = hypo
  source 1..220: mol_type = genomic DNA

SEQ ID NO: 63442 - DNA, 71 bp, Homo sapiens; identical to SEQ ID NO: 42967
  misc_feature 1..71: note = chr11:2048987-2049058
  misc_feature 1..71: note = hypo
  source 1..71: mol_type = genomic DNA

SEQ ID NO: 63443 - DNA, 30 bp, Homo sapiens; identical to SEQ ID NO: 42968
  misc_feature 1..30: note = chr11:2108079-2108109
  misc_feature 1..30: note = hypo
  source 1..30: mol_type = genomic DNA

SEQ ID NO: 63444 - DNA, 30 bp, Homo sapiens; identical to SEQ ID NO: 42969
  misc_feature 1..30: note = chr11:2110642-2110672
  misc_feature 1..30: note = hypo
  source 1..30: mol_type = genomic DNA

SEQ ID NO: 63445 - DNA, 30 bp, Homo sapiens; identical to SEQ ID NO: 42970
  misc_feature 1..30: note = chr11:2133297-2133327
  misc_feature 1..30: note = hypo
  source 1..30: mol_type = genomic DNA

SEQ ID NO: 63446 - DNA, 94 bp, Homo sapiens; identical to SEQ ID NO: 42971
  misc_feature 1..94: note = chr11:2151140-2151234
  misc_feature 1..94: note = hypo
  source 1..94: mol_type = genomic DNA

SEQ ID NO: 63447 - DNA, 30 bp, Homo sapiens; identical to SEQ ID NO: 42972
  misc_feature 1..30: note = chr11:2152412-2152442
  misc_feature 1..30: note = hypo
  source 1..30: mol_type = genomic DNA

SEQ ID NO: 63448 - DNA, 39 bp, Homo sapiens; identical to SEQ ID NO: 42973
  misc_feature 1..39: note = chr11:2156080-2156119
  misc_feature 1..39: note = hypo
  source 1..39: mol_type = genomic DNA

SEQ ID NO: 63449 - DNA, 31 bp, Homo sapiens
  misc_feature 1..31: note = chr11:2209876-2209907
  misc_feature 1..31: note = hypo
  source 1..31: mol_type = genomic DNA
tcggggagtagtacccggaacccacagagaa

SEQ ID NO: 63450 - DNA, 42 bp, Homo sapiens
  misc_feature 1..42: note = chr11:2210278-2210320
  misc_feature 1..42: note = hypo
  source 1..42: mol_type = genomic DNA
gaaatgaaacctatgtccacccaggaacgtgtgtgtgactgc

SEQ ID NO: 63451 - DNA, 128 bp, Homo sapiens; identical to SEQ ID NO: 42975
  misc_feature 1..128: note = chr11:2224689-2224817
  misc_feature 1..128: note = hypo
  source 1..128: mol_type = genomic DNA

SEQ ID NO: 63452 - DNA, 339 bp, Homo sapiens
  misc_feature 1..339: note = chr11:2278369-2278708
  misc_feature 1..339: note = hypo
  source 1..339: mol_type = genomic DNA
ggaatccagccccagcgggcgggcggcagcagcagtgccggccctgcccagaacaggttcgacctgagccggcactgcccggctgccctggggctagggaggctgagacagagaagggaagccagagggtgggggtgggggcccggcactggcagagctgcctgccctcaacgaccgcccctgccggagacccccgccccacccgctgtggttctgctggcccaggtttcgctgggcccactcccagggtttggcatcactggagcccagggtcccccccgcaccctccccacagccttggccctgctgctgcctgcctcctccagggtaccccgaggc

SEQ ID NO: 63453 - DNA, 76 bp, Homo sapiens; identical to SEQ ID NO: 42978
  misc_feature 1..76: note = chr11:2289224-2289300
  misc_feature 1..76: note = hypo
  source 1..76: mol_type = genomic DNA

SEQ ID NO: 63454 - DNA, 35 bp, Homo sapiens; identical to SEQ ID NO: 42979
  misc_feature 1..35: note = chr11:2428079-2428114
  misc_feature 1..35: note = hypo
  source 1..35: mol_type = genomic DNA

SEQ ID NO: 63455 - DNA, 30 bp, Homo sapiens; identical to SEQ ID NO: 42980
  misc_feature 1..30: note = chr11:2435384-2435414
  misc_feature 1..30: note = hypo
  source 1..30: mol_type = genomic DNA

SEQ ID NO: 63456 - DNA, 42 bp, Homo sapiens; identical to SEQ ID NO: 42981
  misc_feature 1..42: note = chr11:2436543-2436585
  misc_feature 1..42: note = hypo
  source 1..42: mol_type = genomic DNA

SEQ ID NO: 63457 - DNA, 54 bp, Homo sapiens
  misc_feature 1..54: note = chr11:2438144-2438198
  misc_feature 1..54: note = hypo
  source 1..54: mol_type = genomic DNA
atgaagcatggaatggcatacgcttcaacacggaggaaccgtcaaaccctcccg

SEQ ID NO: 63458 - DNA, 44 bp, Homo sapiens; identical to SEQ ID NO: 42983
  misc_feature 1..44: note = chr11:2491365-2491409
  misc_feature 1..44: note = hypo
  source 1..44: mol_type = genomic DNA

SEQ ID NO: 63459 - DNA, 135 bp, Homo sapiens; identical to SEQ ID NO: 42984
  misc_feature 1..135: note = chr11:2541224-2541359
  misc_feature 1..135: note = hypo
  source 1..135: mol_type = genomic DNA

SEQ ID NO: 63460 - DNA, 167 bp, Homo sapiens; identical to SEQ ID NO: 42985
  misc_feature 1..167: note = chr11:2543288-2543455
  misc_feature 1..167: note = hypo
  source 1..167: mol_type = genomic DNA

SEQ ID NO: 63461 - DNA, 207 bp, Homo sapiens; identical to SEQ ID NO: 42986
  misc_feature 1..207: note = chr11:2596517-2596724
  misc_feature 1..207: note = hypo
  source 1..207: mol_type = genomic DNA

SEQ ID NO: 63462 - DNA, 213 bp, Homo sapiens; identical to SEQ ID NO: 42987
  misc_feature 1..213: note = chr11:2753802-2754015
  misc_feature 1..213: note = hypo
  source 1..213: mol_type = genomic DNA

SEQ ID NO: 63463 - DNA, 30 bp, Homo sapiens; identical to SEQ ID NO: 42988
  misc_feature 1..30: note = chr11:2770653-2770683
  misc_feature 1..30: note = hypo
  source 1..30: mol_type = genomic DNA

SEQ ID NO: 63464 - DNA, 178 bp, Homo sapiens; identical to SEQ ID NO: 42989
  misc_feature 1..178: note = chr11:2818207-2818385
  misc_feature 1..178: note = hypo
  source 1..178: mol_type = genomic DNA

SEQ ID NO: 63465 - DNA, 30 bp, Homo sapiens; identical to SEQ ID NO: 15520
  misc_feature 1..30: note = chr11:2829204-2829234
  misc_feature 1..30: note = hypo
  source 1..30: mol_type = genomic DNA

SEQ ID NO: 63466 - DNA, 30 bp, Homo sapiens; identical to SEQ ID NO: 42991
  misc_feature 1..30: note = chr11:2933495-2933525
  misc_feature 1..30: note = hypo
  source 1..30: mol_type = genomic DNA

SEQ ID NO: 63467 - DNA, 30 bp, Homo sapiens; identical to SEQ ID NO: 42992
  misc_feature 1..30: note = chr11:3150813-3150843
  misc_feature 1..30: note = hypo
  source 1..30: mol_type = genomic DNA

SEQ ID NO: 63468 - DNA, 381 bp, Homo sapiens; identical to SEQ ID NO: 42993
  misc_feature 1..381: note = chr11:3164562-3164943
  misc_feature 1..381: note = hypo
  source 1..381: mol_type = genomic DNA

SEQ ID NO: 63469 - DNA, 52 bp, Homo sapiens
  misc_feature 1..52: note = chr11:3169835-3169887
  misc_feature 1..52: note = hypo
  source 1..52: mol_type = genomic DNA
tgtacatctttgacattttctatcatacgaagccaaacgggagaggacacag

SEQ ID NO: 63470 - DNA, 48 bp, Homo sapiens; identical to SEQ ID NO: 42995
  misc_feature 1..48: note = chr11:3187905-3187953
  misc_feature 1..48: note = hypo
  source 1..48: mol_type = genomic DNA

SEQ ID NO: 63471 - DNA, 162 bp, Homo sapiens; identical to SEQ ID NO: 42996
  misc_feature 1..162: note = chr11:3249641-3249803
  misc_feature 1..162: note = hypo
  source 1..162: mol_type = genomic DNA

SEQ ID NO: 63472 - DNA, 30 bp, Homo sapiens; identical to SEQ ID NO: 42997
  misc_feature 1..30: note = chr11:3398724-3398754
  misc_feature 1..30: note = hypo
  source 1..30: mol_type = genomic DNA

SEQ ID NO: 63473 - DNA, 93 bp, Homo sapiens; identical to SEQ ID NO: 42998
  misc_feature 1..93: note = chr11:3697398-3697491
  misc_feature 1..93: note = hypo
  source 1..93: mol_type = genomic DNA

SEQ ID NO: 63474 - DNA, 30 bp, Homo sapiens; identical to SEQ ID NO: 42999
  misc_feature 1..30: note = chr11:3766731-3766761
  misc_feature 1..30: note = hypo
  source 1..30: mol_type = genomic DNA

SEQ ID NO: 63475 - DNA, 159 bp, Homo sapiens; identical to SEQ ID NO: 43000
  misc_feature 1..159: note = chr11:3828803-3828962
  misc_feature 1..159: note = hypo
  source 1..159: mol_type = genomic DNA

SEQ ID NO: 63476 - DNA, 21 bp, Homo sapiens
  misc_feature 1..21: note = chr11:4785810-4785831
  misc_feature 1..21: note = hypo
  source 1..21: mol_type = genomic DNA
gaatactgggcagggcgcagt

SEQ ID NO: 63477 - DNA, 26 bp, Homo sapiens
  misc_feature 1..26: note = chr11:5169023-5169049
  misc_feature 1..26: note = hypo
  source 1..26: mol_type = genomic DNA
tttttttttttttttcggagacagag

SEQ ID NO: 63478 - DNA, 27 bp, Homo sapiens
  misc_feature 1..27: note = chr11:5177841-5177868
  misc_feature 1..27: note = hypo
  source 1..27: mol_type = genomic DNA
agccactgcacccggcctactgaatat

SEQ ID NO: 63479 - DNA, 159 bp, Homo sapiens; identical to SEQ ID NO: 15524
  misc_feature 1..159: note = chr11:5192016-5192175
  misc_feature 1..159: note = hypo
  source 1..159: mol_type = genomic DNA

SEQ ID NO: 63480 - DNA, 30 bp, Homo sapiens; identical to SEQ ID NO: 43005
  misc_feature 1..30: note = chr11:5192457-5192487
  misc_feature 1..30: note = hypo
  source 1..30: mol_type = genomic DNA

SEQ ID NO: 63481 - DNA, 83 bp, Homo sapiens; identical to SEQ ID NO: 43006
  misc_feature 1..83: note = chr11:5330681-5330764
  misc_feature 1..83: note = hypo
  source 1..83: mol_type = genomic DNA

SEQ ID NO: 63482 - DNA, 104 bp, Homo sapiens; identical to SEQ ID NO: 43007
  misc_feature 1..104: note = chr11:6257172-6257276
  misc_feature 1..104: note = hypo
  source 1..104: mol_type = genomic DNA

SEQ ID NO: 63483 - DNA, 82 bp, Homo sapiens; identical to SEQ ID NO: 43008
  misc_feature 1..82: note = chr11:6497227-6497309
  misc_feature 1..82: note = hypo
  source 1..82: mol_type = genomic DNA

SEQ ID NO: 63484 - DNA, 30 bp, Homo sapiens; identical to SEQ ID NO: 15526
  misc_feature 1..30: note = chr11:6731043-6731073
  misc_feature 1..30: note = hypo
  source 1..30: mol_type = genomic DNA

SEQ ID NO: 63485 - DNA, 30 bp, Homo sapiens; identical to SEQ ID NO: 43010
  misc_feature 1..30: note = chr11:7439190-7439220
  misc_feature 1..30: note = hypo
  source 1..30: mol_type = genomic DNA

SEQ ID NO: 63486 - DNA, 37 bp, Homo sapiens; identical to SEQ ID NO: 43012
  misc_feature 1..37: note = chr11:9405789-9405826
  misc_feature 1..37: note = hypo
  source 1..37: mol_type = genomic DNA

SEQ ID NO: 63487 - DNA, 30 bp, Homo sapiens; identical to SEQ ID NO: 43013
  misc_feature 1..30: note = chr11:9830639-9830669
  misc_feature 1..30: note = hypo
  source 1..30: mol_type = genomic DNA

SEQ ID NO: 63488 - DNA, 30 bp, Homo sapiens; identical to SEQ ID NO: 43014
  misc_feature 1..30: note = chr11:10509593-10509623
  misc_feature 1..30: note = hypo
  source 1..30: mol_type = genomic DNA

SEQ ID NO: 63489 - DNA, 100 bp, Homo sapiens; identical to SEQ ID NO: 43016
  misc_feature 1..100: note = chr11:10865202-10865302
  misc_feature 1..100: note = hypo
  source 1..100: mol_type = genomic DNA

SEQ ID NO: 63490 - DNA, 30 bp, Homo sapiens; identical to SEQ ID NO: 43017
  misc_feature 1..30: note = chr11:12288561-12288591
  misc_feature 1..30: note = hypo
  source 1..30: mol_type = genomic DNA

SEQ ID NO: 63491 - DNA, 18 bp, Homo sapiens
  misc_feature 1..18: note = chr11:13691880-13691898
  misc_feature 1..18: note = hypo
  source 1..18: mol_type = genomic DNA
gctggagtgcagtgacgc

SEQ ID NO: 63492 - DNA, 23 bp, Homo sapiens
  misc_feature 1..23: note = chr11:14558164-14558187
  misc_feature 1..23: note = hypo
  source 1..23: mol_type = genomic DNA
tttttatttttgagacggagtct

SEQ ID NO: 63493 - DNA, 42 bp, Homo sapiens; identical to SEQ ID NO: 43020
  misc_feature 1..42: note = chr11:14564357-14564399
  misc_feature 1..42: note = hypo
  source 1..42: mol_type = genomic DNA

SEQ ID NO: 63494 - DNA, 84 bp, Homo sapiens; identical to SEQ ID NO: 43021
  misc_feature 1..84: note = chr11:15084438-15084522
  misc_feature 1..84: note = hypo
  source 1..84: mol_type = genomic DNA

SEQ ID NO: 63495 - DNA, 23 bp, Homo sapiens
  misc_feature 1..23: note = chr11:16255262-16255285
  misc_feature 1..23: note = hypo
  source 1..23: mol_type = genomic DNA
aacataaaacaggcccggtgcgg

SEQ ID NO: 63496 - DNA, 108 bp, Homo sapiens; identical to SEQ ID NO: 43023
  misc_feature 1..108: note = chr11:16988399-16988507
  misc_feature 1..108: note = hypo
  source 1..108: mol_type = genomic DNA

SEQ ID NO: 63497 - DNA, 16 bp, Homo sapiens
  misc_feature 1..16: note = chr11:17037317-17037333
  misc_feature 1..16: note = hypo
  source 1..16: mol_type = genomic DNA
ccgagatcgcgccgct

SEQ ID NO: 63498 - DNA, 154 bp, Homo sapiens; identical to SEQ ID NO: 43025
  misc_feature 1..154: note = chr11:17100671-17100825
  misc_feature 1..154: note = hypo
  source 1..154: mol_type = genomic DNA

SEQ ID NO: 63499 - DNA, 33 bp, Homo sapiens; identical to SEQ ID NO: 43026
  misc_feature 1..33: note = chr11:17566248-17566281
  misc_feature 1..33: note = hypo
  source 1..33: mol_type = genomic DNA

SEQ ID NO: 63500 - DNA, 97 bp, Homo sapiens; identical to SEQ ID NO: 43027
  misc_feature 1..97: note = chr11:17633812-17633909
  misc_feature 1..97: note = hypo
  source 1..97: mol_type = genomic DNA

SEQ ID NO: 63501 - DNA, 44 bp, Homo sapiens; identical to SEQ ID NO: 43028
  misc_feature 1..44: note = chr11:17784927-17784971
  misc_feature 1..44: note = hypo
  source 1..44: mol_type = genomic DNA

SEQ ID NO: 63502 - DNA, 43 bp, Homo sapiens; identical to SEQ ID NO: 43029
  misc_feature 1..43: note = chr11:18656839-18656882
  misc_feature 1..43: note = hypo
  source 1..43: mol_type = genomic DNA

SEQ ID NO: 63503 - DNA, 30 bp, Homo sapiens; identical to SEQ ID NO: 43030
  misc_feature 1..30: note = chr11:18950570-18950600
  misc_feature 1..30: note = hypo
  source 1..30: mol_type = genomic DNA

SEQ ID NO: 63504 - DNA, 179 bp, Homo sapiens; identical to SEQ ID NO: 43031
  misc_feature 1..179: note = chr11:19567961-19568140
  misc_feature 1..179: note = hypo
  source 1..179: mol_type = genomic DNA

SEQ ID NO: 63505 - DNA, 30 bp, Homo sapiens; identical to SEQ ID NO: 43032
  misc_feature 1..30: note = chr11:23326534-23326564
  misc_feature 1..30: note = hypo
  source 1..30: mol_type = genomic DNA

SEQ ID NO: 63506 - DNA, 138 bp, Homo sapiens; identical to SEQ ID NO: 43033
  misc_feature 1..138: note = chr11:27495243-27495381
  misc_feature 1..138: note = hypo
  source 1..138: mol_type = genomic DNA

SEQ ID NO: 63507 - DNA, 210 bp, Homo sapiens; identical to SEQ ID NO: 43034
  misc_feature 1..210: note = chr11:32728943-32729153
  misc_feature 1..210: note = hypo
  source 1..210: mol_type = genomic DNA

SEQ ID NO: 63508 - DNA, 17 bp, Homo sapiens
  misc_feature 1..17: note = chr11:32859995-32860012
  misc_feature 1..17: note = hypo
  source 1..17: mol_type = genomic DNA
tccggaaaaaaaaaaaa

SEQ ID NO: 63509 - DNA, 37 bp, Homo sapiens; identical to SEQ ID NO: 43036
  misc_feature 1..37: note = chr11:32935022-32935059
  misc_feature 1..37: note = hypo
  source 1..37: mol_type = genomic DNA

SEQ ID NO: 63510 - DNA, 104 bp, Homo sapiens; identical to SEQ ID NO: 43037
  misc_feature 1..104: note = chr11:33181185-33181289
  misc_feature 1..104: note = hypo
  source 1..104: mol_type = genomic DNA

SEQ ID NO: 63511 - DNA, 29 bp, Homo sapiens
  misc_feature 1..29: note = chr11:33202774-33202803
  misc_feature 1..29: note = hypo
  source 1..29: mol_type = genomic DNA
acacctgtaattagccgggtgtggtggtg

SEQ ID NO: 63512 - DNA, 15 bp, Homo sapiens
  misc_feature 1..15: note = chr11:33262877-33262892
  misc_feature 1..15: note = hypo
  source 1..15: mol_type = genomic DNA
cgcaaagaaattaat

SEQ ID NO: 63513 - DNA, 224 bp, Homo sapiens; identical to SEQ ID NO: 43040
  misc_feature 1..224: note = chr11:33269863-33270087
  misc_feature 1..224: note = hypo
  source 1..224: mol_type = genomic DNA

SEQ ID NO: 63514 - DNA, 37 bp, Homo sapiens; identical to SEQ ID NO: 43041
  misc_feature 1..37: note = chr11:33277673-33277710
  misc_feature 1..37: note = hypo
  source 1..37: mol_type = genomic DNA

SEQ ID NO: 63515 - DNA, 32 bp, Homo sapiens; identical to SEQ ID NO: 43042
  misc_feature 1..32: note = chr11:33874352-33874384
  misc_feature 1..32: note = hypo
  source 1..32: mol_type = genomic DNA

SEQ ID NO: 63516 - DNA, 33 bp, Homo sapiens; identical to SEQ ID NO: 43043
  misc_feature 1..33: note = chr11:33880993-33881026
  misc_feature 1..33: note = hypo
  source 1..33: mol_type = genomic DNA

SEQ ID NO: 63517 - DNA, 23 bp, Homo sapiens
  misc_feature 1..23: note = chr11:33951225-33951248
  misc_feature 1..23: note = hypo
  source 1..23: mol_type = genomic DNA
gggcacggtggctcacgcctgta

SEQ ID NO: 63518 - DNA, 30 bp, Homo sapiens; identical to SEQ ID NO: 43045
  misc_feature 1..30: note = chr11:33976661-33976691
  misc_feature 1..30: note = hypo
  source 1..30: mol_type = genomic DNA

SEQ ID NO: 63519 - DNA, 30 bp, Homo sapiens; identical to SEQ ID NO: 43046
  misc_feature 1..30: note = chr11:33993944-33993974
  misc_feature 1..30: note = hypo
  source 1..30: mol_type = genomic DNA

SEQ ID NO: 63520 - DNA, 30 bp, Homo sapiens; identical to SEQ ID NO: 43047
  misc_feature 1..30: note = chr11:34517691-34517721
  misc_feature 1..30: note = hypo
  source 1..30: mol_type = genomic DNA

SEQ ID NO: 63521 - DNA, 30 bp, Homo sapiens; identical to SEQ ID NO: 15538
  misc_feature 1..30: note = chr11:34534277-34534307
  misc_feature 1..30: note = hypo
  source 1..30: mol_type = genomic DNA

SEQ ID NO: 63522 - DNA, 40 bp, Homo sapiens
  misc_feature 1..40: note = chr11:34535053-34535093
  misc_feature 1..40: note = hypo
  source 1..40: mol_type = genomic DNA
gcaagccgtcacatccgtgtcaaacagctcccggaggccc

SEQ ID NO: 63523 - DNA, 125 bp, Homo sapiens
  misc_feature 1..125: note = chr11:34535123-34535248
  misc_feature 1..125: note = hypo
  source 1..125: mol_type = genomic DNA
tggagctggagatggacgagcagacccaggccccaggccgagcctctgagccctgacaccccttacgattcatccaaaaaagcaaagaaaaggcgcttacgtgagggcagcggtggctaggtcca

SEQ ID NO: 63524 - DNA, 30 bp, Homo sapiens; identical to SEQ ID NO: 43050
  misc_feature 1..30: note = chr11:34536053-34536083
  misc_feature 1..30: note = hypo
  source 1..30: mol_type = genomic DNA

SEQ ID NO: 63525 - DNA, 20 bp, Homo sapiens
  misc_feature 1..20: note = chr11:34577250-34577270
  misc_feature 1..20: note = hypo
  source 1..20: mol_type = genomic DNA
aactcaaatctgaagcgtcc

SEQ ID NO: 63526 - DNA, 166 bp, Homo sapiens; identical to SEQ ID NO: 43052
  misc_feature 1..166: note = chr11:35134173-35134339
  misc_feature 1..166: note = hypo
  source 1..166: mol_type = genomic DNA

SEQ ID NO: 63527 - DNA, 36 bp, Homo sapiens
  misc_feature 1..36: note = chr11:35684922-35684958
  misc_feature 1..36: note = hypo
  source 1..36: mol_type = genomic DNA
gagggagatagaaagcgaggcaggggaagagagtga

SEQ ID NO: 63528 - DNA, 81 bp, Homo sapiens
  misc_feature 1..81: note = chr11:35685131-35685212
  misc_feature 1..81: note = hypo
  source 1..81: mol_type = genomic DNA
aggcagaaagtgaatttgacccagaaatagaaatggaagcagagagagtggccaagaggaagtgtccggaccatgggcttg

SEQ ID NO: 63529 - DNA, 98 bp, Homo sapiens; identical to SEQ ID NO: 43054
  misc_feature 1..98: note = chr11:36687119-36687217
  misc_feature 1..98: note = hypo
  source 1..98: mol_type = genomic DNA

SEQ ID NO: 63530 - DNA, 36 bp, Homo sapiens; identical to SEQ ID NO: 43055
  misc_feature 1..36: note = chr11:43544024-43544060
  misc_feature 1..36: note = hypo
  source 1..36: mol_type = genomic DNA

SEQ ID NO: 63531 - DNA, 83 bp, Homo sapiens; identical to SEQ ID NO: 15542
  misc_feature 1..83: note = chr11:44922891-44922974
  misc_feature 1..83: note = hypo
  source 1..83: mol_type = genomic DNA

SEQ ID NO: 63532 - DNA, 33 bp, Homo sapiens; identical to SEQ ID NO: 43057
  misc_feature 1..33: note = chr11:46298483-46298516
  misc_feature 1..33: note = hypo
  source 1..33: mol_type = genomic DNA

SEQ ID NO: 63533 - DNA, 30 bp, Homo sapiens; identical to SEQ ID NO: 43058
  misc_feature 1..30: note = chr11:46405775-46405805
  misc_feature 1..30: note = hypo
  source 1..30: mol_type = genomic DNA

SEQ ID NO: 63534 - DNA, 17 bp, Homo sapiens
  misc_feature 1..17: note = chr11:46614283-46614300
  misc_feature 1..17: note = hypo
  source 1..17: mol_type = genomic DNA
ggcgacagagctagcct

SEQ ID NO: 63535 - DNA, 30 bp, Homo sapiens; identical to SEQ ID NO: 43060
  misc_feature 1..30: note = chr11:46774904-46774934
  misc_feature 1..30: note = hypo
  source 1..30: mol_type = genomic DNA

SEQ ID NO: 63536 - DNA, 19 bp, Homo sapiens
  misc_feature 1..19: note = chr11:46777041-46777060
  misc_feature 1..19: note = hypo
  source 1..19: mol_type = genomic DNA
ccaccgcacctggccccat

SEQ ID NO: 63537 - DNA, 30 bp, Homo sapiens; identical to SEQ ID NO: 43062
  misc_feature 1..30: note = chr11:46916192-46916222
  misc_feature 1..30: note = hypo
  source 1..30: mol_type = genomic DNA

SEQ ID NO: 63538 - DNA, 65 bp, Homo sapiens; identical to SEQ ID NO: 43064
  misc_feature 1..65: note = chr11:47367760-47367825
  misc_feature 1..65: note = hypo
  source 1..65: mol_type = genomic DNA

SEQ ID NO: 63539 - DNA, 56 bp, Homo sapiens; identical to SEQ ID NO: 43065
  misc_feature 1..56: note = chr11:47599259-47599315
  misc_feature 1..56: note = hypo
  source 1..56: mol_type = genomic DNA

SEQ ID NO: 63540 - DNA, 35 bp, Homo sapiens; identical to SEQ ID NO: 43066
  misc_feature 1..35: note = chr11:49212608-49212643
  misc_feature 1..35: note = hypo
  source 1..35: mol_type = genomic DNA

SEQ ID NO: 63541 - DNA, 30 bp, Homo sapiens; identical to SEQ ID NO: 43067
  misc_feature 1..30: note = chr11:50205839-50205869
  misc_feature 1..30: note = hypo
  source 1..30: mol_type = genomic DNA

SEQ ID NO: 63542 - DNA, 156 bp, Homo sapiens; identical to SEQ ID NO: 43068
  misc_feature 1..156: note = chr11:50256725-50256881
  misc_feature 1..156: note = hypo
  source 1..156: mol_type = genomic DNA

SEQ ID NO: 63543 - DNA, 35 bp, Homo sapiens; identical to SEQ ID NO: 43069
  misc_feature 1..35: note = chr11:55743005-55743040
  misc_feature 1..35: note = hypo
  source 1..35: mol_type = genomic DNA

SEQ ID NO: 63544 - DNA, 30 bp, Homo sapiens; identical to SEQ ID NO: 15545
  misc_feature 1..30: note = chr11:57150498-57150528
  misc_feature 1..30: note = hypo
  source 1..30: mol_type = genomic DNA

SEQ ID NO: 63545 - DNA, 151 bp, Homo sapiens
  misc_feature 1..151: note = chr11:57235255-57235406
  misc_feature 1..151: note = hypo
  source 1..151: mol_type = genomic DNA
acaacctcatccgcacgctgcggccaggcacctttgggtccaacctgctcaccctgtggctcttctccaacaacctctccaccatctacccgggcactttccgccacttgcaagccctggaggagctggacctcggtgacaaccggcacct

SEQ ID NO: 63546 - DNA, 22 bp, Homo sapiens
  misc_feature 1..22: note = chr11:57235436-57235458
  misc_feature 1..22: note = hypo
  source 1..22: mol_type = genomic DNA
cctggagcggctgcagtcgctg

SEQ ID NO: 63547 - DNA, 30 bp, Homo sapiens; identical to SEQ ID NO: 43072
  misc_feature 1..30: note = chr11:57311435-57311465
  misc_feature 1..30: note = hypo
  source 1..30: mol_type = genomic DNA

SEQ ID NO: 63548 - DNA, 37 bp, Homo sapiens; identical to SEQ ID NO: 43073
  misc_feature 1..37: note = chr11:57423900-57423937
  misc_feature 1..37: note = hypo
  source 1..37: mol_type = genomic DNA

SEQ ID NO: 63549 - DNA, 41 bp, Homo sapiens; identical to SEQ ID NO: 43076
  misc_feature 1..41: note = chr11:57548681-57548722
  misc_feature 1..41: note = hypo
  source 1..41: mol_type = genomic DNA

SEQ ID NO: 63550 - DNA, 16 bp, Homo sapiens
  misc_feature 1..16: note = chr11:58821650-58821666
  misc_feature 1..16: note = hypo
  source 1..16: mol_type = genomic DNA
gcgtggcctcctattc

SEQ ID NO: 63551 - DNA, 139 bp, Homo sapiens; identical to SEQ ID NO: 43078
  misc_feature 1..139: note = chr11:58835182-58835321
  misc_feature 1..139: note = hypo
  source 1..139: mol_type = genomic DNA

SEQ ID NO: 63552 - DNA, 30 bp, Homo sapiens; identical to SEQ ID NO: 15547
  misc_feature 1..30: note = chr11:59312651-59312681
  misc_feature 1..30: note = hypo
  source 1..30: mol_type = genomic DNA

SEQ ID NO: 63553 - DNA, 19 bp, Homo sapiens
  misc_feature 1..19: note = chr11:59328895-59328914
  misc_feature 1..19: note = hypo
  source 1..19: mol_type = genomic DNA
accttaaaggctgggcgcg

SEQ ID NO: 63554 - DNA, 112 bp, Homo sapiens
  misc_feature 1..112: note = chr11:59329240-59329352
  misc_feature 1..112: note = hypo
  source 1..112: mol_type = genomic DNA
agcaaattgtgggaaagcaaatatatgggaaattaatgttagataaaggcaggttcctaaagcttgttaaatgtacttctgtggtcccctctgttcacgtctccaagctgtt

SEQ ID NO: 63555 - DNA, 30 bp, Homo sapiens; identical to SEQ ID NO: 15548
  misc_feature 1..30: note = chr11:59609810-59609840
  misc_feature 1..30: note = hypo
  source 1..30: mol_type = genomic DNA

SEQ ID NO: 63556 - DNA, 170 bp, Homo sapiens; identical to SEQ ID NO: 43083
  misc_feature 1..170: note = chr11:59807961-59808131
  misc_feature 1..170: note = hypo
  source 1..170: mol_type = genomic DNA

SEQ ID NO: 63557 - skipped

SEQ ID NO: 63558 - DNA, 30 bp, Homo sapiens; identical to SEQ ID NO: 43085
  misc_feature 1..30: note = chr11:60282848-60282878
  misc_feature 1..30: note = hypo
  source 1..30: mol_type = genomic DNA

SEQ ID NO: 63559 - DNA, 33 bp, Homo sapiens; identical to SEQ ID NO: 43086
  misc_feature 1..33: note = chr11:60409097-60409130
  misc_feature 1..33: note = hypo
  source 1..33: mol_type = genomic DNA

SEQ ID NO: 63560 - DNA, 30 bp, Homo sapiens; identical to SEQ ID NO: 43087
  misc_feature 1..30: note = chr11:60892552-60892582
  misc_feature 1..30: note = hypo
  source 1..30: mol_type = genomic DNA

SEQ ID NO: 63561 - DNA, 47 bp, Homo sapiens; identical to SEQ ID NO: 43088
  misc_feature 1..47: note = chr11:60897862-60897909
  misc_feature 1..47: note = hypo
  source 1..47: mol_type = genomic DNA

SEQ ID NO: 63562 - DNA, 171 bp, Homo sapiens; identical to SEQ ID NO: 5117
  misc_feature 1..171: note = chr11:60941596-60941767
  misc_feature 1..171: note = hypo
  source 1..171: mol_type = genomic DNA

SEQ ID NO: 63563 - DNA, 335 bp, Homo sapiens; identical to SEQ ID NO: 43090
  misc_feature 1..335: note = chr11:61038940-61039275
  misc_feature 1..335: note = hypo
  source 1..335: mol_type = genomic DNA

SEQ ID NO: 63564 - DNA, 124 bp, Homo sapiens; identical to SEQ ID NO: 43091
  misc_feature 1..124: note = chr11:61049497-61049621
  misc_feature 1..124: note = hypo
  source 1..124: mol_type = genomic DNA

SEQ ID NO: 63565 - DNA, 71 bp, Homo sapiens
  misc_feature 1..71: note = chr11:61058212-61058283
  misc_feature 1..71: note = hypo
  source 1..71: mol_type = genomic DNA
aggagatataattcccgctgtccccctccccctcccccaccactcccaggcgtctcacctgtacacctgat

SEQ ID NO: 63566 - DNA, 89 bp, Homo sapiens; identical to SEQ ID NO: 43093
  misc_feature 1..89: note = chr11:61058795-61058884
  misc_feature 1..89: note = hypo
  source 1..89: mol_type = genomic DNA

SEQ ID NO: 63567 - DNA, 30 bp, Homo sapiens; identical to SEQ ID NO: 43094
  misc_feature 1..30: note = chr11:61633635-61633665
  misc_feature 1..30: note = hypo
  source 1..30: mol_type = genomic DNA

SEQ ID NO: 63568 - DNA, 81 bp, Homo sapiens; identical to SEQ ID NO: 43095
  misc_feature 1..81: note = chr11:61641410-61641491
  misc_feature 1..81: note = hypo
  source 1..81: mol_type = genomic DNA

SEQ ID NO: 63569 - DNA, 143 bp, Homo sapiens
  misc_feature 1..143: note = chr11:61664512-61664655
  misc_feature 1..143: note = hypo
  source 1..143: mol_type = genomic DNA
gcaggccaccagccacggggagagggaggcctggctcatcccccagtaacccacagccctctgaatactaagggaggactcaaatagtcctccccacagcaagtaagtggtgatggcggaggtggggtggcttcaggatttgg

SEQ ID NO: 63570 - DNA, 196 bp, Homo sapiens
  misc_feature 1..196: note = chr11:61664770-61664966
  misc_feature 1..196: note = hypo
  source 1..196: mol_type = genomic DNA
tgtaccaacaaagcctgcctttattaaatagagatcgcgttacattccatccaaagaaggaaatccggacgtggtgagggatgcgtccaggtgggagctccgaacgctggtcctgagtgggctctgatgggtgggagggcccaggtcctgcctgcccacccaggccccacatgccagggcgcgtgtctgcatggcc

SEQ ID NO: 63571 - DNA, 59 bp, Homo sapiens; identical to SEQ ID NO: 43097
  misc_feature 1..59: note = chr11:61665728-61665787
  misc_feature 1..59: note = hypo
  source 1..59: mol_type = genomic DNA

SEQ ID NO: 63572 - DNA, 18 bp, Homo sapiens
  misc_feature 1..18: note = chr11:61666088-61666106
  misc_feature 1..18: note = hypo
  source 1..18: mol_type = genomic DNA
agacaagcaggtacacgc

SEQ ID NO: 63573 - DNA, 134 bp, Homo sapiens; identical to SEQ ID NO: 43099
  misc_feature 1..134: note = chr11:61669877-61670011
  misc_feature 1..134: note = hypo
  source 1..134: mol_type = genomic DNA

SEQ ID NO: 63574 - DNA, 87 bp, Homo sapiens; identical to SEQ ID NO: 43100
  misc_feature 1..87: note = chr11:61675013-61675100
  misc_feature 1..87: note = hypo
  source 1..87: mol_type = genomic DNA

SEQ ID NO: 63575 - DNA, 23 bp, Homo sapiens
  misc_feature 1..23: note = chr11:61736670-61736693
  misc_feature 1..23: note = hypo
  source 1..23: mol_type = genomic DNA
ttgcctggggctgggcgcggtgg

SEQ ID NO: 63576 - DNA, 82 bp, Homo sapiens; identical to SEQ ID NO: 43102
  misc_feature 1..82: note = chr11:61736993-61737075
  misc_feature 1..82: note = hypo
  source 1..82: mol_type = genomic DNA

SEQ ID NO: 63577 - DNA, 30 bp, Homo sapiens; identical to SEQ ID NO: 43103
  misc_feature 1..30: note = chr11:61784772-61784802
  misc_feature 1..30: note = hypo
  source 1..30: mol_type = genomic DNA

SEQ ID NO: 63578 - DNA, 198 bp, Homo sapiens
  misc_feature 1..198: note = chr11:62370522-62370720
  misc_feature 1..198: note = hypo
  source 1..198: mol_type = genomic DNA
tggactctcacccaacgacacacgcccagcgttccaagcccaaactgggctccaccttgtcccccacccttccagcaggtttccacgcccctgctcaccgtagacgtgaaagcccagcacacaggtgtaggtagcccattcccggtctcggctctcatagcgattcttcagctgcttgcagcctccagccacgtcccc

SEQ ID NO: 63579 - DNA, 95 bp, Homo sapiens; identical to SEQ ID NO: 43105
  misc_feature 1..95: note = chr11:62421710-62421805
  misc_feature 1..95: note = hypo
  source 1..95: mol_type = genomic DNA

SEQ ID NO: 63580 - DNA, 30 bp, Homo sapiens; identical to SEQ ID NO: 43106
  misc_feature 1..30: note = chr11:62440622-62440652
  misc_feature 1..30: note = hypo
  source 1..30: mol_type = genomic DNA

SEQ ID NO: 63581 - DNA, 60 bp, Homo sapiens; identical to SEQ ID NO: 43107
  misc_feature 1..60: note = chr11:62445431-62445491
  misc_feature 1..60: note = hypo
  source 1..60: mol_type = genomic DNA

SEQ ID NO: 63582 - DNA, 46 bp, Homo sapiens; identical to SEQ ID NO: 43108
  misc_feature 1..46: note = chr11:63572099-63572145
  misc_feature 1..46: note = hypo
  source 1..46: mol_type = genomic DNA

SEQ ID NO: 63583 - DNA, 102 bp, Homo sapiens; identical to SEQ ID NO: 43110
  misc_feature 1..102: note = chr11:63779116-63779218
  misc_feature 1..102: note = hypo
  source 1..102: mol_type = genomic DNA

SEQ ID NO: 63584 - DNA, 30 bp, Homo sapiens; identical to SEQ ID NO: 43111
  misc_feature 1..30: note = chr11:63780950-63780980
  misc_feature 1..30: note = hypo
  source 1..30: mol_type = genomic DNA

SEQ ID NO: 63585 - DNA, 82 bp, Homo sapiens; identical to SEQ ID NO: 43112
  misc_feature 1..82: note = chr11:63783734-63783816
  misc_feature 1..82: note = hypo
  source 1..82: mol_type = genomic DNA

SEQ ID NO: 63586 - skipped

SEQ ID NO: 63587 - DNA, 194 bp, Homo sapiens
  misc_feature 1..194: note = chr11:63849426-63849620
  misc_feature 1..194: note = hypo
  source 1..194: mol_type = genomic DNA
gttctaaatggacatgccatccccacagctgtgtcaataaagcagccatttacagagcgggcgccggatcccgtgacaggttgaaaagtgtgtgagctgcagcgtcctgggctggggcagaggggccgtggcgagaacagatggggctgtgcccatctccccaggccctcctgtggctgcgcctggagcctccc

SEQ ID NO: 63588 - DNA, 79 bp, Homo sapiens; identical to SEQ ID NO: 43114
  misc_feature 1..79: note = chr11:63955145-63955224
  misc_feature 1..79: note = hypo
  source 1..79: mol_type = genomic DNA

SEQ ID NO: 63589 - DNA, 47 bp, Homo sapiens; identical to SEQ ID NO: 43115
  misc_feature 1..47: note = chr11:63978814-63978861
  misc_feature 1..47: note = hypo
  source 1..47: mol_type = genomic DNA

SEQ ID NO: 63590 - DNA, 30 bp, Homo sapiens; identical to SEQ ID NO: 43116
  misc_feature 1..30: note = chr11:64042980-64043010
  misc_feature 1..30: note = hypo
  source 1..30: mol_type = genomic DNA

SEQ ID NO: 63591 - DNA, 30 bp, Homo sapiens; identical to SEQ ID NO: 43117
  misc_feature 1..30: note = chr11:64054355-64054385
  misc_feature 1..30: note = hypo
  source 1..30: mol_type = genomic DNA

SEQ ID NO: 63592 - DNA, 38 bp, Homo sapiens; identical to SEQ ID NO: 43119
  misc_feature 1..38: note = chr11:64120222-64120260
  misc_feature 1..38: note = hypo
  source 1..38: mol_type = genomic DNA

SEQ ID NO: 63593 - DNA, 54 bp, Homo sapiens; identical to SEQ ID NO: 43121
  misc_feature 1..54: note = chr11:64124704-64124758
  misc_feature 1..54: note = hypo
  source 1..54: mol_type = genomic DNA

SEQ ID NO: 63594 - DNA, 30 bp, Homo sapiens; identical to SEQ ID NO: 43122
  misc_feature 1..30: note = chr11:64292470-64292500
  misc_feature 1..30: note = hypo
  source 1..30: mol_type = genomic DNA

SEQ ID NO: 63595 - DNA, 82 bp, Homo sapiens; identical to SEQ ID NO: 43123
  misc_feature 1..82: note = chr11:64488590-64488672
  misc_feature 1..82: note = hypo
  source 1..82: mol_type = genomic DNA

SEQ ID NO: 63596 - DNA, 30 bp, Homo sapiens; identical to SEQ ID NO: 43124
  misc_feature 1..30: note = chr11:64507459-64507489
  misc_feature 1..30: note = hypo
  source 1..30: mol_type = genomic DNA

SEQ ID NO: 63597 - DNA, 30 bp, Homo sapiens; identical to SEQ ID NO: 43125
  misc_feature 1..30: note = chr11:64572043-64572073
  misc_feature 1..30: note = hypo
  source 1..30: mol_type = genomic DNA

SEQ ID NO: 63598 - DNA, 30 bp, Homo sapiens; identical to SEQ ID NO: 43127
  misc_feature 1..30: note = chr11:64610130-64610160
  misc_feature 1..30: note = hypo
  source 1..30: mol_type = genomic DNA

SEQ ID NO: 63599 - DNA, 87 bp, Homo sapiens; identical to SEQ ID NO: 43128
  misc_feature 1..87: note = chr11:64667987-64668074
  misc_feature 1..87: note = hypo
  source 1..87: mol_type = genomic DNA

SEQ ID NO: 63600 - DNA, 96 bp, Homo sapiens; identical to SEQ ID NO: 43129
  misc_feature 1..96: note = chr11:64669480-64669576
  misc_feature 1..96: note = hypo
  source 1..96: mol_type = genomic DNA

SEQ ID NO: 63601 - DNA, 30 bp, Homo sapiens; identical to SEQ ID NO: 43132
  misc_feature 1..30: note = chr11:64878823-64878853
  misc_feature 1..30: note = hypo
  source 1..30: mol_type = genomic DNA

SEQ ID NO: 63602 - DNA, 142 bp, Homo sapiens; identical to SEQ ID NO: 43133
  misc_feature 1..142: note = chr11:64883942-64884084
  misc_feature 1..142: note = hypo
  source 1..142: mol_type = genomic DNA

SEQ ID NO: 63603 - DNA, 44 bp, Homo sapiens; identical to SEQ ID NO: 43134
  misc_feature 1..44: note = chr11:64903259-64903303
  misc_feature 1..44: note = hypo
  source 1..44: mol_type = genomic DNA

SEQ ID NO: 63604 - DNA, 44 bp, Homo sapiens; identical to SEQ ID NO: 43135
  misc_feature 1..44: note = chr11:64903423-64903467
  misc_feature 1..44: note = hypo
  source 1..44: mol_type = genomic DNA

SEQ ID NO: 63605 - DNA, 102 bp, Homo sapiens; identical to SEQ ID NO: 43137
  misc_feature 1..102: note = chr11:64951749-64951851
  misc_feature 1..102: note = hypo
  source 1..102: mol_type = genomic DNA

SEQ ID NO: 63606 - DNA, 40 bp, Homo sapiens; identical to SEQ ID NO: 43138
  misc_feature 1..40: note = chr11:64975460-64975500
  misc_feature 1..40: note = hypo
  source 1..40: mol_type = genomic DNA

SEQ ID NO: 63607 - DNA, 52 bp, Homo sapiens; identical to SEQ ID NO: 43139
  misc_feature 1..52: note = chr11:64977482-64977534
  misc_feature 1..52: note = hypo
  source 1..52: mol_type = genomic DNA

SEQ ID NO: 63608 - DNA, 81 bp, Homo sapiens; identical to SEQ ID NO: 43140
  misc_feature 1..81: note = chr11:65028546-65028627
  misc_feature 1..81: note = hypo
  source 1..81: mol_type = genomic DNA

SEQ ID NO: 63609 - DNA, 71 bp, Homo sapiens
  misc_feature 1..71: note = chr11:65091369-65091440
  misc_feature 1..71: note = hypo
  source 1..71: mol_type = genomic DNA
ggaacacaggctggcggcagcagggaagagtttcgctggccaggctgacgctgaggcgatggggtgctgct

SEQ ID NO: 63610 - DNA, 169 bp, Homo sapiens; identical to SEQ ID NO: 43142
  misc_feature 1..169: note = chr11:65127486-65127655
  misc_feature 1..169: note = hypo
  source 1..169: mol_type = genomic DNA

SEQ ID NO: 63611 - DNA, 30 bp, Homo sapiens; identical to SEQ ID NO: 43143
  misc_feature 1..30: note = chr11:65306390-65306420
  misc_feature 1..30: note = hypo
  source 1..30: mol_type = genomic DNA

SEQ ID NO: 63612 - DNA, 30 bp, Homo sapiens; identical to SEQ ID NO: 43144
  misc_feature 1..30: note = chr11:65309028-65309058
  misc_feature 1..30: note = hypo
  source 1..30: mol_type = genomic DNA

SEQ ID NO: 63613 - DNA, 232 bp, Homo sapiens; identical to SEQ ID NO: 43145
  misc_feature 1..232: note = chr11:65413881-65414113
  misc_feature 1..232: note = hypo
  source 1..232: mol_type = genomic DNA

SEQ ID NO: 63614 - DNA, 30 bp, Homo sapiens; identical to SEQ ID NO: 43146
  misc_feature 1..30: note = chr11:65463016-65463046
  misc_feature 1..30: note = hypo
  source 1..30: mol_type = genomic DNA

SEQ ID NO: 63615 - skipped

SEQ ID NO: 63616 - DNA, 154 bp, Homo sapiens; identical to SEQ ID NO: 43150
  misc_feature 1..154: note = chr11:65551581-65551735
  misc_feature 1..154: note = hypo
  source 1..154: mol_type = genomic DNA

SEQ ID NO: 63617 - DNA, 69 bp, Homo sapiens; identical to SEQ ID NO: 43151
  misc_feature 1..69: note = chr11:65629450-65629519
  misc_feature 1..69: note = hypo
  source 1..69: mol_type = genomic DNA

SEQ ID NO: 63618 - DNA, 87 bp, Homo sapiens; identical to SEQ ID NO: 43152
  misc_feature 1..87: note = chr11:65685085-65685172
  misc_feature 1..87: note = hypo
  source 1..87: mol_type = genomic DNA

SEQ ID NO: 63619 - DNA, 41 bp, Homo sapiens; identical to SEQ ID NO: 43153
  misc_feature 1..41: note = chr11:65722778-65722819
  misc_feature 1..41: note = hypo
  source 1..41: mol_type = genomic DNA

SEQ ID NO: 63620 - DNA, 30 bp, Homo sapiens; identical to SEQ ID NO: 43154
  misc_feature 1..30: note = chr11:65741409-65741439
  misc_feature 1..30: note = hypo
  source 1..30: mol_type = genomic DNA

SEQ ID NO: 63621 - DNA, 101 bp, Homo sapiens; identical to SEQ ID NO: 43155
  misc_feature 1..101: note = chr11:66048072-66048173
  misc_feature 1..101: note = hypo
  source 1..101: mol_type = genomic DNA

SEQ ID NO: 63622 - DNA, 33 bp, Homo sapiens; identical to SEQ ID NO: 43156
  misc_feature 1..33: note = chr11:66324511-66324544
  misc_feature 1..33: note = hypo
  source 1..33: mol_type = genomic DNA

SEQ ID NO: 63623 - DNA, 124 bp, Homo sapiens; identical to SEQ ID NO: 43157
  misc_feature 1..124: note = chr11:66325272-66325396
  misc_feature 1..124: note = hypo
  source 1..124: mol_type = genomic DNA

SEQ ID NO: 63624 - DNA, 189 bp, Homo sapiens; identical to SEQ ID NO: 43158
  misc_feature 1..189: note = chr11:66411368-66411557
  misc_feature 1..189: note = hypo
  source 1..189: mol_type = genomic DNA

SEQ ID NO: 63625 - DNA, 29 bp, Homo sapiens
  misc_feature 1..29: note = chr11:66511194-66511223
  misc_feature 1..29: note = hypo
  source 1..29: mol_type = genomic DNA
ttcagtgcagtcaaacgtggaaaggggcc

SEQ ID NO: 63626 - DNA, 58 bp, Homo sapiens
  misc_feature 1..58: note = chr11:66513159-66513217
  misc_feature 1..58: note = hypo
  source 1..58: mol_type = genomic DNA
cattttacaaataaccgaacctaggctagaacccagggcgctgactcataggccagtg

SEQ ID NO: 63627 - DNA, 16 bp, Homo sapiens
  misc_feature 1..16: note = chr11:66515380-66515396
  misc_feature 1..16: note = hypo
  source 1..16: mol_type = genomic DNA
gcgcagggcagcatta

SEQ ID NO: 63628 - DNA, 82 bp, Homo sapiens; identical to SEQ ID NO: 43163
  misc_feature 1..82: note = chr11:66557367-66557449
  misc_feature 1..82: note = hypo
  source 1..82: mol_type = genomic DNA

SEQ ID NO: 63629 - DNA, 59 bp, Homo sapiens; identical to SEQ ID NO: 24864
  misc_feature 1..59: note = chr11:66625148-66625207
  misc_feature 1..59: note = hypo
  source 1..59: mol_type = genomic DNA

SEQ ID NO: 63630 - DNA, 772 bp, Homo sapiens
  misc_feature 1..772: note = chr11:66625240-66626012
  misc_feature 1..772: note = hypo
  source 1..772: mol_type = genomic DNA
tgctggccagtggagcggccgcctgcccgctgccctgcgtctgccagaacctgtccgagtcgctcagcaccctctgtgcccaccgaggcctgctgtttgtgccgcccaacgtggaccggcgcacagtggagctgcggctggctgacaacttcatccaggccctggggccccctgacttccgcaacatgacgggactggtggacctgacactgtctcgcaatgccatcacccgcattggggcccgcgcctttggggacctcgagagcctgcgttccctccaccttgacggcaacaggctggtggagctgggcaccgggagcctccggggccccgtcaatctgcagcacctcatcctcagcggcaaccagctgggccgcatcgcgccgggagccttcgacgacttcctagagagcctggaggacctggacctgtcctacaacaacctccggcaggtgccctgggccggcatcggcgccatgcctgccctgcacaccctcaacctggaccataaccttattgacgcactgcccccaggcgccttcgcccagctcggtcagctctcccgcctggacctcacctccaaccgcctggccacgctggctccggacccgcttttctctcgtgggcgtgatgcagaggcctctcccgcccccctggtgctgagctttagcgggaaccccctgcactgcaactgtgagctgctgtggctgcggcggctggcgcggccggacgacctggaaacgtgcgcctccccgcccggcctggccggccg

SEQ ID NO: 63631 - DNA, 96 bp, Homo sapiens; identical to SEQ ID NO: 43165
  misc_feature 1..96: note = chr11:66626839-66626935
  misc_feature 1..96: note = hypo
  source 1..96: mol_type = genomic DNA

SEQ ID NO: 63632 - DNA, 250 bp, Homo sapiens; identical to SEQ ID NO: 43166
  misc_feature 1..250: note = chr11:66631300-66631550
  misc_feature 1..250: note = hypo
  source 1..250: mol_type = genomic DNA

SEQ ID NO: 63633 - DNA, 67 bp, Homo sapiens; identical to SEQ ID NO: 43167
  misc_feature 1..67: note = chr11:66648961-66649028
  misc_feature 1..67: note = hypo
  source 1..67: mol_type = genomic DNA

SEQ ID NO: 63634 - DNA, 149 bp, Homo sapiens; identical to SEQ ID NO: 43168
  misc_feature 1..149: note = chr11:66897593-66897742
  misc_feature 1..149: note = hypo
  source 1..149: mol_type = genomic DNA

SEQ ID NO: 63635 - DNA, 138 bp, Homo sapiens
  misc_feature 1..138: note = chr11:67072101-67072239
  misc_feature 1..138: note = hypo
  source 1..138: mol_type = genomic DNA
ccactctagacctatcgaccgcgtgggggcccatgaatccgtgtagacaagggctgcaggtgaatgtgatgcatgctagactttgagagcccctaccctaaggggaatgaggagccatgacagttgcccactgccctg

SEQ ID NO: 63636 - DNA, 30 bp, Homo sapiens; identical to SEQ ID NO: 43171
  misc_feature 1..30: note = chr11:67442110-67442140
  misc_feature 1..30: note = hypo
  source 1..30: mol_type = genomic DNA

SEQ ID NO: 63637 - DNA, 15 bp, Homo sapiens
  misc_feature 1..15: note = chr11:67462628-67462643
  misc_feature 1..15: note = hypo
  source 1..15: mol_type = genomic DNA
agatccgccttaagc

SEQ ID NO: 63638 - DNA, 92 bp, Homo sapiens
  misc_feature 1..92: note = chr11:67764095-67764187
  misc_feature 1..92: note = hypo
  source 1..92: mol_type = genomic DNA
agagcacctcgaagccgctgtagataaagaaaggcacgaggtggcgcaggcggtagtcacgcacgtgcttgaagggcagctggaagatgttg

SEQ ID NO: 63639 - DNA, 45 bp, Homo sapiens; identical to SEQ ID NO: 24869
  misc_feature 1..45: note = chr11:67781564-67781609
  misc_feature 1..45: note = hypo
  source 1..45: mol_type = genomic DNA

SEQ ID NO: 63640 - DNA, 65 bp, Homo sapiens
  misc_feature 1..65: note = chr11:67797137-67797202
  misc_feature 1..65: note = hypo
  source 1..65: mol_type = genomic DNA
tgtcctccctctgcacgggcatgggacatgccctctgcctccttcctgtcctggcctgcccaact

SEQ ID NO: 63641 - DNA, 119 bp, Homo sapiens; identical to SEQ ID NO: 43176
  misc_feature 1..119: note = chr11:67811705-67811824
  misc_feature 1..119: note = hypo
  source 1..119: mol_type = genomic DNA

SEQ ID NO: 63642 - DNA, 30 bp, Homo sapiens; identical to SEQ ID NO: 43177
  misc_feature 1..30: note = chr11:67915948-67915978
  misc_feature 1..30: note = hypo
  source 1..30: mol_type = genomic DNA

SEQ ID NO: 63643 - DNA, 154 bp, Homo sapiens; identical to SEQ ID NO: 15587
  misc_feature 1..154: note = chr11:68111091-68111245
  misc_feature 1..154: note = hypo
  source 1..154: mol_type = genomic DNA

SEQ ID NO: 63644 - DNA, 227 bp, Homo sapiens; identical to SEQ ID NO: 43179
  misc_feature 1..227: note = chr11:68132977-68133204
  misc_feature 1..227: note = hypo
  source 1..227: mol_type = genomic DNA

SEQ ID NO: 63645 - DNA, 30 bp, Homo sapiens; identical to SEQ ID NO: 43180
  misc_feature 1..30: note = chr11:68210102-68210132
  misc_feature 1..30: note = hypo
  source 1..30: mol_type = genomic DNA

SEQ ID NO: 63646 - DNA, 30 bp, Homo sapiens; identical to SEQ ID NO: 43181
  misc_feature 1..30: note = chr11:68225302-68225332
  misc_feature 1..30: note = hypo
  source 1..30: mol_type = genomic DNA

SEQ ID NO: 63647 - DNA, 37 bp, Homo sapiens; identical to SEQ ID NO: 43182
  misc_feature 1..37: note = chr11:68226712-68226749
  misc_feature 1..37: note = hypo
  source 1..37: mol_type = genomic DNA

SEQ ID NO: 63648 - DNA, 82 bp, Homo sapiens; identical to SEQ ID NO: 43183
  misc_feature 1..82: note = chr11:68385159-68385241
  misc_feature 1..82: note = hypo
  source 1..82: mol_type = genomic DNA

SEQ ID NO: 63649 - DNA, 143 bp, Homo sapiens; identical to SEQ ID NO: 43184
  misc_feature 1..143: note = chr11:68385590-68385733
  misc_feature 1..143: note = hypo
  source 1..143: mol_type = genomic DNA

SEQ ID NO: 63650 - DNA, 30 bp, Homo sapiens; identical to SEQ ID NO: 43185
  misc_feature 1..30: note = chr11:68412854-68412884
  misc_feature 1..30: note = hypo
  source 1..30: mol_type = genomic DNA

SEQ ID NO: 63651 - DNA, 161 bp, Homo sapiens; identical to SEQ ID NO: 43186
  misc_feature 1..161: note = chr11:68417837-68417998
  misc_feature 1..161: note = hypo
  source 1..161: mol_type = genomic DNA

SEQ ID NO: 63652 - DNA, 242 bp, Homo sapiens; identical to SEQ ID NO: 43187
  misc_feature 1..242: note = chr11:68432989-68433231
  misc_feature 1..242: note = hypo
  source 1..242: mol_type = genomic DNA

SEQ ID NO: 63653 - DNA, 30 bp, Homo sapiens; identical to SEQ ID NO: 43188
  misc_feature 1..30: note = chr11:68564345-68564375
  misc_feature 1..30: note = hypo
  source 1..30: mol_type = genomic DNA

SEQ ID NO: 63654 - DNA, 30 bp, Homo sapiens; identical to SEQ ID NO: 43189
  misc_feature 1..30: note = chr11:68672906-68672936
  misc_feature 1..30: note = hypo
  source 1..30: mol_type = genomic DNA

SEQ ID NO: 63655 - DNA, 30 bp, Homo sapiens; identical to SEQ ID NO: 43190
  misc_feature 1..30: note = chr11:68692056-68692086
  misc_feature 1..30: note = hypo
  source 1..30: mol_type = genomic DNA

SEQ ID NO: 63656 - DNA, 38 bp, Homo sapiens; identical to SEQ ID NO: 43191
  misc_feature 1..38: note = chr11:68771669-68771707
  misc_feature 1..38: note = hypo
  source 1..38: mol_type = genomic DNA

SEQ ID NO: 63657 - DNA, 28 bp, Homo sapiens
  misc_feature 1..28: note = chr11:68804776-68804804
  misc_feature 1..28: note = hypo
  source 1..28: mol_type = genomic DNA
ctgcggggacgctcgggtccttcttggg

SEQ ID NO: 63658 - DNA, 161 bp, Homo sapiens; identical to SEQ ID NO: 43193
  misc_feature 1..161: note = chr11:68965052-68965213
  misc_feature 1..161: note = hypo
  source 1..161: mol_type = genomic DNA

SEQ ID NO: 63659 - DNA, 80 bp, Homo sapiens
  misc_feature 1..80: note = chr11:69192486-69192566
  misc_feature 1..80: note = hypo
  source 1..80: mol_type = genomic DNA
tggcagaggctgttccgaggctgctccgatgtgtgggaactgagggggttcccaggatgtgagactttcagtgctgaaac

SEQ ID NO: 63660 - DNA, 36 bp, Homo sapiens
  misc_feature 1..36: note = chr11:69192784-69192820
  misc_feature 1..36: note = hypo
  source 1..36: mol_type = genomic DNA
taacacagagcacccaacgggcgcagccgcccccat

SEQ ID NO: 63661 - DNA, 30 bp, Homo sapiens; identical to SEQ ID NO: 43195
  misc_feature 1..30: note = chr11:69206384-69206414
  misc_feature 1..30: note = hypo
  source 1..30: mol_type = genomic DNA

SEQ ID NO: 63662 - DNA, 32 bp, Homo sapiens
  misc_feature 1..32: note = chr11:69280529-69280561
  misc_feature 1..32: note = hypo
  source 1..32: mol_type = genomic DNA
tctccaggtgattctcgtgtgcagccaagtta

SEQ ID NO: 63663 - DNA, 67 bp, Homo sapiens; identical to SEQ ID NO: 43197
  misc_feature 1..67: note = chr11:69339948-69340015
  misc_feature 1..67: note = hypo
  source 1..67: mol_type = genomic DNA

SEQ ID NO: 63664 - DNA, 167 bp, Homo sapiens; identical to SEQ ID NO: 43198
  misc_feature 1..167: note = chr11:69360946-69361113
  misc_feature 1..167: note = hypo
  source 1..167: mol_type = genomic DNA

SEQ ID NO: 63665 - DNA, 30 bp, Homo sapiens; identical to SEQ ID NO: 43199
  misc_feature 1..30: note = chr11:69458784-69458814
  misc_feature 1..30: note = hypo
  source 1..30: mol_type = genomic DNA

SEQ ID NO: 63666 - DNA, 30 bp, Homo sapiens; identical to SEQ ID NO: 43200
  misc_feature 1..30: note = chr11:69466053-69466083
  misc_feature 1..30: note = hypo
  source 1..30: mol_type = genomic DNA

SEQ ID NO: 63667 - DNA, 147 bp, Homo sapiens; identical to SEQ ID NO: 43201
  misc_feature 1..147: note = chr11:69498970-69499117
  misc_feature 1..147: note = hypo
  source 1..147: mol_type = genomic DNA

SEQ ID NO: 63668 - DNA, 75 bp, Homo sapiens; identical to SEQ ID NO: 43202
  misc_feature 1..75: note = chr11:69970448-69970523
  misc_feature 1..75: note = hypo
  source 1..75: mol_type = genomic DNA

SEQ ID NO: 63669 - DNA, 30 bp, Homo sapiens; identical to SEQ ID NO: 43203
  misc_feature 1..30: note = chr11:70005678-70005708
  misc_feature 1..30: note = hypo
  source 1..30: mol_type = genomic DNA

SEQ ID NO: 63670 - DNA, 30 bp, Homo sapiens; identical to SEQ ID NO: 43204
  misc_feature 1..30: note = chr11:70022959-70022989
  misc_feature 1..30: note = hypo
  source 1..30: mol_type = genomic DNA

SEQ ID NO: 63671 - DNA, 258 bp, Homo sapiens; identical to SEQ ID NO: 43205
  misc_feature 1..258: note = chr11:70050908-70051166
  misc_feature 1..258: note = hypo
  source 1..258: mol_type = genomic DNA

SEQ ID NO: 63672 - DNA, 30 bp, Homo sapiens; identical to SEQ ID NO: 43206
  misc_feature 1..30: note = chr11:71098989-71099019
  misc_feature 1..30: note = hypo
  source 1..30: mol_type = genomic DNA

SEQ ID NO: 63673 - DNA, 57 bp, Homo sapiens; identical to SEQ ID NO: 43207
  misc_feature 1..57: note = chr11:71117658-71117715
  misc_feature 1..57: note = hypo
  source 1..57: mol_type = genomic DNA

SEQ ID NO: 63674 - DNA, 24 bp, Homo sapiens
  misc_feature 1..24: note = chr11:71192722-71192746
  misc_feature 1..24: note = hypo
  source 1..24: mol_type = genomic DNA
tgcgtatctgcagttcgtcggtgg

SEQ ID NO: 63675 - DNA, 30 bp, Homo sapiens; identical to SEQ ID NO: 43209
  misc_feature 1..30: note = chr11:71507973-71508003
  misc_feature 1..30: note = hypo
  source 1..30: mol_type = genomic DNA

SEQ ID NO: 63676 - DNA, 29 bp, Homo sapiens
  misc_feature 1..29: note = chr11:71781578-71781607
  misc_feature 1..29: note = hypo
  source 1..29: mol_type = genomic DNA
cccagtggctcacagcggtaatcccagca

SEQ ID NO: 63677 - DNA, 30 bp, Homo sapiens; identical to SEQ ID NO: 43211
  misc_feature 1..30: note = chr11:72109516-72109546
  misc_feature 1..30: note = hypo
  source 1..30: mol_type = genomic DNA

SEQ ID NO: 63678 - DNA, 12 bp, Homo sapiens
  misc_feature 1..12: note = chr11:72475711-72475723
  misc_feature 1..12: note = hypo
  source 1..12: mol_type = genomic DNA
cccaaaggtgta

SEQ ID NO: 63679 - DNA, 48 bp, Homo sapiens
  misc_feature 1..48: note = chr11:72532300-72532348
  misc_feature 1..48: note = hypo
  source 1..48: mol_type = genomic DNA
ctgggaacatcatggcgcccgagggccggatgggcatttggcagcctc

SEQ ID NO: 63680 - DNA, 30 bp, Homo sapiens; identical to SEQ ID NO: 43214
  misc_feature 1..30: note = chr11:72532613-72532643
  misc_feature 1..30: note = hypo
  source 1..30: mol_type = genomic DNA

SEQ ID NO: 63681 - DNA, 30 bp, Homo sapiens; identical to SEQ ID NO: 15597
  misc_feature 1..30: note = chr11:72905832-72905862
  misc_feature 1..30: note = hypo
  source 1..30: mol_type = genomic DNA

SEQ ID NO: 63682 - DNA, 155 bp, Homo sapiens; identical to SEQ ID NO: 43216
  misc_feature 1..155: note = chr11:73073174-73073329
  misc_feature 1..155: note = hypo
  source 1..155: mol_type = genomic DNA

SEQ ID NO: 63683 - DNA, 25 bp, Homo sapiens
  misc_feature 1..25: note = chr11:73310342-73310367
  misc_feature 1..25: note = hypo
  source 1..25: mol_type = genomic DNA
gggtgtcagattgcacgtaggtttt

SEQ ID NO: 63684 - DNA, 30 bp, Homo sapiens; identical to SEQ ID NO: 43218
  misc_feature 1..30: note = chr11:73805524-73805554
  misc_feature 1..30: note = hypo
  source 1..30: mol_type = genomic DNA

SEQ ID NO: 63685 - DNA, 40 bp, Homo sapiens; identical to SEQ ID NO: 43219
  misc_feature 1..40: note = chr11:74246636-74246676
  misc_feature 1..40: note = hypo
  source 1..40: mol_type = genomic DNA

SEQ ID NO: 63686 - DNA, 48 bp, Homo sapiens; identical to SEQ ID NO: 43220
  misc_feature 1..48: note = chr11:74302595-74302643
  misc_feature 1..48: note = hypo
  source 1..48: mol_type = genomic DNA

SEQ ID NO: 63687 - DNA, 35 bp, Homo sapiens; identical to SEQ ID NO: 43221
  misc_feature 1..35: note = chr11:75100584-75100619
  misc_feature 1..35: note = hypo
  source 1..35: mol_type = genomic DNA

SEQ ID NO: 63688 - DNA, 56 bp, Homo sapiens; identical to SEQ ID NO: 43222
  misc_feature 1..56: note = chr11:75152480-75152536
  misc_feature 1..56: note = hypo
  source 1..56: mol_type = genomic DNA

SEQ ID NO: 63689 - DNA, 13 bp, Homo sapiens
  misc_feature 1..13: note = chr11:75459473-75459486
  misc_feature 1..13: note = hypo
  source 1..13: mol_type = genomic DNA
cagataaacaaaa

SEQ ID NO: 63690 - DNA, 30 bp, Homo sapiens; identical to SEQ ID NO: 43224
  misc_feature 1..30: note = chr11:75879446-75879476
  misc_feature 1..30: note = hypo
  source 1..30: mol_type = genomic DNA

SEQ ID NO: 63691 - DNA, 111 bp, Homo sapiens
  misc_feature 1..111: note = chr11:76371627-76371738
  misc_feature 1..111: note = hypo
  source 1..111: mol_type = genomic DNA
gctcaagaaagctgtcggggatgagctcaatctcattgtagctcaaatccagattcaagagctgggaaagggggcggccgctggcattcccgctgggggctgagaggggca

SEQ ID NO: 63692 - DNA, 159 bp, Homo sapiens
  misc_feature 1..159: note = chr11:76372077-76372236
  misc_feature 1..159: note = hypo
  source 1..159: mol_type = genomic DNA
ccatcagcacgttgctatgcaggtcaagctgctccagcgcaggcatgtcccggaaggtgtggcgggtgaggcgagtcagactgttctccgccagtgagagggtatgcaggctgggtgcctcccccagcagccgctccagcaggccgctgtacaggctgt

SEQ ID NO: 63693 - DNA, 169 bp, Homo sapiens; identical to SEQ ID NO: 43226
  misc_feature 1..169: note = chr11:76902500-76902669
  misc_feature 1..169: note = hypo
  source 1..169: mol_type = genomic DNA

SEQ ID NO: 63694 - DNA, 18 bp, Homo sapiens
  misc_feature 1..18: note = chr11:77025115-77025133
  misc_feature 1..18: note = hypo
  source 1..18: mol_type = genomic DNA
aaaaatatttaaggccgg

SEQ ID NO: 63695 - DNA, 85 bp, Homo sapiens; identical to SEQ ID NO: 43228
  misc_feature 1..85: note = chr11:82214234-82214319
  misc_feature 1..85: note = hypo
  source 1..85: mol_type = genomic DNA

SEQ ID NO: 63696 - DNA, 30 bp, Homo sapiens; identical to SEQ ID NO: 43229
  misc_feature 1..30: note = chr11:83561479-83561509
  misc_feature 1..30: note = hypo
  source 1..30: mol_type = genomic DNA

SEQ ID NO: 63697 - DNA, 30 bp, Homo sapiens; identical to SEQ ID NO: 43230
  misc_feature 1..30: note = chr11:85359853-85359883
  misc_feature 1..30: note = hypo
  source 1..30: mol_type = genomic DNA

SEQ ID NO: 63698 - DNA, 24 bp, Homo sapiens
  misc_feature 1..24: note = chr11:85379748-85379772
  misc_feature 1..24: note = hypo
  source 1..24: mol_type = genomic DNA
agattaagaaacatgcggccgggc

SEQ ID NO: 63699 - DNA, 150 bp, Homo sapiens; identical to SEQ ID NO: 43232
  misc_feature 1..150: note = chr11:85564833-85564983
  misc_feature 1..150: note = hypo
  source 1..150: mol_type = genomic DNA

SEQ ID NO: 63700 - DNA, 30 bp, Homo sapiens; identical to SEQ ID NO: 43233
  misc_feature 1..30: note = chr11:85906245-85906275
  misc_feature 1..30: note = hypo
  source 1..30: mol_type = genomic DNA

SEQ ID NO: 63701 - DNA, 21 bp, Homo sapiens
  misc_feature 1..21: note = chr11:92929514-92929535
  misc_feature 1..21: note = hypo
  source 1..21: mol_type = genomic DNA
aattgctgggtcaaacgataa

SEQ ID NO: 63702 - DNA, 20 bp, Homo sapiens
  misc_feature 1..20: note = chr11:94064787-94064807
  misc_feature 1..20: note = hypo
  source 1..20: mol_type = genomic DNA
gccaccgcgcctggcccaag

SEQ ID NO: 63703 - DNA, 26 bp, Homo sapiens
  misc_feature 1..26: note = chr11:94892054-94892080
  misc_feature 1..26: note = hypo
  source 1..26: mol_type = genomic DNA
tcctccctgggcgacaaagcaagact

SEQ ID NO: 63704 - DNA, 30 bp, Homo sapiens; identical to SEQ ID NO: 43237
  misc_feature 1..30: note = chr11:94924721-94924751
  misc_feature 1..30: note = hypo
  source 1..30: mol_type = genomic DNA

SEQ ID NO: 63705 - DNA, 41 bp, Homo sapiens; identical to SEQ ID NO: 43238
  misc_feature 1..41: note = chr11:95020639-95020680
  misc_feature 1..41: note = hypo
  source 1..41: mol_type = genomic DNA

SEQ ID NO: 63706 - DNA, 30 bp, Homo sapiens; identical to SEQ ID NO: 15603
  misc_feature 1..30: note = chr11:95488699-95488729
  misc_feature 1..30: note = hypo
  source 1..30: mol_type = genomic DNA

SEQ ID NO: 63707 - DNA, 30 bp, Homo sapiens; identical to SEQ ID NO: 15604
  misc_feature 1..30: note = chr11:95658721-95658751
  misc_feature 1..30: note = hypo
  source 1..30: mol_type = genomic DNA

SEQ ID NO: 63708 - DNA, 17 bp, Homo sapiens
  misc_feature 1..17: note = chr11:102158484-102158501
  misc_feature 1..17: note = hypo
  source 1..17: mol_type = genomic DNA
cccggcccctgtttact

SEQ ID NO: 63709 - DNA, 30 bp, Homo sapiens; identical to SEQ ID NO: 43243
  misc_feature 1..30: note = chr11:109880267-109880297
  misc_feature 1..30: note = hypo
  source 1..30: mol_type = genomic DNA

SEQ ID NO: 63710 - DNA, 40 bp, Homo sapiens; identical to SEQ ID NO: 43244
  misc_feature 1..40: note = chr11:111154502-111154542
  misc_feature 1..40: note = hypo
  source 1..40: mol_type = genomic DNA

SEQ ID NO: 63711 - DNA, 100 bp, Homo sapiens; identical to SEQ ID NO: 43245
  misc_feature 1..100: note = chr11:111156679-111156779
  misc_feature 1..100: note = hypo
  source 1..100: mol_type = genomic DNA

SEQ ID NO: 63712 - DNA, 23 bp, Homo sapiens
  misc_feature 1..23: note = chr11:113373844-113373867
  misc_feature 1..23: note = hypo
  source 1..23: mol_type = genomic DNA
cgagactccgtctcaaaaaaaaa

SEQ ID NO: 63713 - DNA, 185 bp, Homo sapiens; identical to SEQ ID NO: 15606
  misc_feature 1..185: note = chr11:113552799-113552984
  misc_feature 1..185: note = hypo
  source 1..185: mol_type = genomic DNA

SEQ ID NO: 63714 - DNA, 151 bp, Homo sapiens; identical to SEQ ID NO: 43248
  misc_feature 1..151: note = chr11:113560972-113561123
  misc_feature 1..151: note = hypo
  source 1..151: mol_type = genomic DNA

SEQ ID NO: 63715 - DNA, 67 bp, Homo sapiens; identical to SEQ ID NO: 43249
  misc_feature 1..67: note = chr11:113800743-113800810
  misc_feature 1..67: note = hypo
  source 1..67: mol_type = genomic DNA

SEQ ID NO: 63716 - DNA, 171 bp, Homo sapiens; identical to SEQ ID NO: 43250
  misc_feature 1..171: note = chr11:114115465-114115636
  misc_feature 1..171: note = hypo
  source 1..171: mol_type = genomic DNA

SEQ ID NO: 63717 - DNA, 30 bp, Homo sapiens; identical to SEQ ID NO: 43251
  misc_feature 1..30: note = chr11:114121201-114121231
  misc_feature 1..30: note = hypo
  source 1..30: mol_type = genomic DNA

SEQ ID NO: 63718 - DNA, 30 bp, Homo sapiens; identical to SEQ ID NO: 43252
  misc_feature 1..30: note = chr11:115763341-115763371
  misc_feature 1..30: note = hypo
  source 1..30: mol_type = genomic DNA

SEQ ID NO: 63719 - DNA, 32 bp, Homo sapiens; identical to SEQ ID NO: 15607
  misc_feature 1..32: note = chr11:116890012-116890044
  misc_feature 1..32: note = hypo
  source 1..32: mol_type = genomic DNA

SEQ ID NO: 63720 - DNA, 75 bp, Homo sapiens; identical to SEQ ID NO: 43254
  misc_feature 1..75: note = chr11:116952331-116952406
  misc_feature 1..75: note = hypo
  source 1..75: mol_type = genomic DNA

SEQ ID NO: 63721 - DNA, 30 bp, Homo sapiens; identical to SEQ ID NO: 43255
  misc_feature 1..30: note = chr11:117010343-117010373
  misc_feature 1..30: note = hypo
  source 1..30: mol_type = genomic DNA

SEQ ID NO: 63722 - DNA, 30 bp, Homo sapiens; identical to SEQ ID NO: 43256
  misc_feature 1..30: note = chr11:117054963-117054993
  misc_feature 1..30: note = hypo
  source 1..30: mol_type = genomic DNA

SEQ ID NO: 63723 - DNA, 52 bp, Homo sapiens; identical to SEQ ID NO: 43257
  misc_feature 1..52: note = chr11:118768516-118768568
  misc_feature 1..52: note = hypo
  source 1..52: mol_type = genomic DNA

SEQ ID NO: 63724 - DNA, 32 bp, Homo sapiens; identical to SEQ ID NO: 43258
  misc_feature 1..32: note = chr11:118781045-118781077
  misc_feature 1..32: note = hypo
  source 1..32: mol_type = genomic DNA

SEQ ID NO: 63725 - DNA, 46 bp, Homo sapiens; identical to SEQ ID NO: 43259
  misc_feature 1..46: note = chr11:119524180-119524226
  misc_feature 1..46: note = hypo
  source 1..46: mol_type = genomic DNA

SEQ ID NO: 63726 - DNA, 34 bp, Homo sapiens
  misc_feature 1..34: note = chr11:120008071-120008105
  misc_feature 1..34: note = hypo
  source 1..34: mol_type = genomic DNA
cgggcctcaaagtcccggatgggctcgagcagct

SEQ ID NO: 63727 - DNA, 63 bp, Homo sapiens; identical to SEQ ID NO: 43261
  misc_feature 1..63: note = chr11:120008655-120008718
  misc_feature 1..63: note = hypo
  source 1..63: mol_type = genomic DNA

SEQ ID NO: 63728 - DNA, 30 bp, Homo sapiens; identical to SEQ ID NO: 15610
  misc_feature 1..30: note = chr11:120367603-120367633
  misc_feature 1..30: note = hypo
  source 1..30: mol_type = genomic DNA

SEQ ID NO: 63729 - DNA, 30 bp, Homo sapiens; identical to SEQ ID NO: 43263
  misc_feature 1..30: note = chr11:120384093-120384123
  misc_feature 1..30: note = hypo
  source 1..30: mol_type = genomic DNA

SEQ ID NO: 63730 - DNA, 30 bp, Homo sapiens; identical to SEQ ID NO: 43264
  misc_feature 1..30: note = chr11:120410117-120410147
  misc_feature 1..30: note = hypo
  source 1..30: mol_type = genomic DNA

SEQ ID NO: 63731 - DNA, 109 bp, Homo sapiens; identical to SEQ ID NO: 43265
  misc_feature 1..109: note = chr11:120748772-120748881
  misc_feature 1..109: note = hypo
  source 1..109: mol_type = genomic DNA

SEQ ID NO: 63732 - DNA, 32 bp, Homo sapiens; identical to SEQ ID NO: 43266
  misc_feature 1..32: note = chr11:120772673-120772705
  misc_feature 1..32: note = hypo
  source 1..32: mol_type = genomic DNA

SEQ ID NO: 63733 - DNA, 30 bp, Homo sapiens; identical to SEQ ID NO: 43267
  misc_feature 1..30: note = chr11:120837904-120837934
  misc_feature 1..30: note = hypo
  source 1..30: mol_type = genomic DNA

SEQ ID NO: 63734 - skipped

SEQ ID NO: 63735 - DNA, 30 bp, Homo sapiens; identical to SEQ ID NO: 43269
  misc_feature 1..30: note = chr11:121000904-121000934
  misc_feature 1..30: note = hypo
  source 1..30: mol_type = genomic DNA

SEQ ID NO: 63736 - DNA, 162 bp, Homo sapiens; identical to SEQ ID NO: 43270
  misc_feature 1..162: note = chr11:121023638-121023800
  misc_feature 1..162: note = hypo
  source 1..162: mol_type = genomic DNA

SEQ ID NO: 63737 - DNA, 82 bp, Homo sapiens
  misc_feature 1..82: note = chr11:121152203-121152285
  misc_feature 1..82: note = hypo
  source 1..82: mol_type = genomic DNA
gccactttatgtactcttaacttgtcttgtctcattcctttgactatgccagactttgtagcccccacggcctggtgttggg

SEQ ID NO: 63738 - DNA, 30 bp, Homo sapiens; identical to SEQ ID NO: 43272
  misc_feature 1..30: note = chr11:121910451-121910481
  misc_feature 1..30: note = hypo
  source 1..30: mol_type = genomic DNA

SEQ ID NO: 63739 - DNA, 21 bp, Homo sapiens
  misc_feature 1..21: note = chr11:122402739-122402760
  misc_feature 1..21: note = hypo
  source 1..21: mol_type = genomic DNA
aagacatattgttgccgggca

SEQ ID NO: 63740 - DNA, 95 bp, Homo sapiens; identical to SEQ ID NO: 43274
  misc_feature 1..95: note = chr11:123169348-123169443
  misc_feature 1..95: note = hypo
  source 1..95: mol_type = genomic DNA

SEQ ID NO: 63741 - DNA, 30 bp, Homo sapiens; identical to SEQ ID NO: 43275
  misc_feature 1..30: note = chr11:123457234-123457264
  misc_feature 1..30: note = hypo
  source 1..30: mol_type = genomic DNA

SEQ ID NO: 63742 - DNA, 30 bp, Homo sapiens; identical to SEQ ID NO: 43276
  misc_feature 1..30: note = chr11:124526915-124526945
  misc_feature 1..30: note = hypo
  source 1..30: mol_type = genomic DNA

SEQ ID NO: 63743 - DNA, 30 bp, Homo sapiens; identical to SEQ ID NO: 43277
  misc_feature 1..30: note = chr11:124743216-124743246
  misc_feature 1..30: note = hypo
  source 1..30: mol_type = genomic DNA

SEQ ID NO: 63744 - DNA, 39 bp, Homo sapiens
  misc_feature 1..39: note = chr11:125220643-125220682
  misc_feature 1..39: note = hypo
  source 1..39: mol_type = genomic DNA
ggacgggtgagccctggggaggggcgagcttggtgcttg

SEQ ID NO: 63745 - DNA, 43 bp, Homo sapiens; identical to SEQ ID NO: 24891
  misc_feature 1..43: note = chr11:125755569-125755612
  misc_feature 1..43: note = hypo
  source 1..43: mol_type = genomic DNA

SEQ ID NO: 63746 - DNA, 81 bp, Homo sapiens; identical to SEQ ID NO: 43280
  misc_feature 1..81: note = chr11:126083885-126083966
  misc_feature 1..81: note = hypo
  source 1..81: mol_type = genomic DNA

SEQ ID NO: 63747 - DNA, 20 bp, Homo sapiens
  misc_feature 1..20: note = chr11:126154214-126154234
  misc_feature 1..20: note = hypo
  source 1..20: mol_type = genomic DNA
cactgcgcccagcccttcat

SEQ ID NO: 63748 - DNA, 231 bp, Homo sapiens; identical to SEQ ID NO: 43282
  misc_feature 1..231: note = chr11:126273042-126273273
  misc_feature 1..231: note = hypo
  source 1..231: mol_type = genomic DNA

SEQ ID NO: 63749 - DNA, 66 bp, Homo sapiens; identical to SEQ ID NO: 43284
  misc_feature 1..66: note = chr11:129866993-129867059
  misc_feature 1..66: note = hypo
  source 1..66: mol_type = genomic DNA

SEQ ID NO: 63750 - DNA, 35 bp, Homo sapiens; identical to SEQ ID NO: 43285
  misc_feature 1..35: note = chr11:130058066-130058101
  misc_feature 1..35: note = hypo
  source 1..35: mol_type = genomic DNA

SEQ ID NO: 63751 - DNA, 102 bp, Homo sapiens; identical to SEQ ID NO: 43286
  misc_feature 1..102: note = chr11:130060305-130060407
  misc_feature 1..102: note = hypo
  source 1..102: mol_type = genomic DNA

SEQ ID NO: 63752 - DNA, 30 bp, Homo sapiens; identical to SEQ ID NO: 43287
  misc_feature 1..30: note = chr11:130090184-130090214
  misc_feature 1..30: note = hypo
  source 1..30: mol_type = genomic DNA

SEQ ID NO: 63753 - DNA, 190 bp, Homo sapiens; identical to SEQ ID NO: 43288
  misc_feature 1..190: note = chr11:130515653-130515843
  misc_feature 1..190: note = hypo
  source 1..190: mol_type = genomic DNA

SEQ ID NO: 63754 - DNA, 30 bp, Homo sapiens; identical to SEQ ID NO: 15616
  misc_feature 1..30: note = chr11:130717573-130717603
  misc_feature 1..30: note = hypo
  source 1..30: mol_type = genomic DNA

SEQ ID NO: 63755 - DNA, 29 bp, Homo sapiens
  misc_feature 1..29: note = chr11:130785458-130785487
  misc_feature 1..29: note = hypo
  source 1..29: mol_type = genomic DNA
ctggctcctggctcacggaacggtaccaa

SEQ ID NO: 63756 - DNA, 62 bp, Homo sapiens
  misc_feature 1..62: note = chr11:130785622-130785684
  misc_feature 1..62: note = hypo
  source 1..62: mol_type = genomic DNA
ccagcgaggctggagcccagccatcctcccagcaccactagcaatgccgacagaaggcacag

SEQ ID NO: 63757 - skipped

SEQ ID NO: 63758 - DNA, 169 bp, Homo sapiens; identical to SEQ ID NO: 43292
  misc_feature 1..169: note = chr11:131631013-131631182
  misc_feature 1..169: note = hypo
  source 1..169: mol_type = genomic DNA

SEQ ID NO: 63759 - DNA, 18 bp, Homo sapiens
  misc_feature 1..18: note = chr11:131766960-131766978
  misc_feature 1..18: note = hypo
  source 1..18: mol_type = genomic DNA
atgcgttgctgcgtctct

SEQ ID NO: 63760 - DNA, 38 bp, Homo sapiens; identical to SEQ ID NO: 43294
  misc_feature 1..38: note = chr11:131799626-131799664
  misc_feature 1..38: note = hypo
  source 1..38: mol_type = genomic DNA

SEQ ID NO: 63761 - DNA, 18 bp, Homo sapiens
  misc_feature 1..18: note = chr11:132484404-132484422
  misc_feature 1..18: note = hypo
  source 1..18: mol_type = genomic DNA
taccgcttgtgtgtctgt

SEQ ID NO: 63762 - DNA, 30 bp, Homo sapiens; identical to SEQ ID NO: 43296
  misc_feature 1..30: note = chr11:132792371-132792401
  misc_feature 1..30: note = hypo
  source 1..30: mol_type = genomic DNA

SEQ ID NO: 63763 - DNA, 11 bp, Homo sapiens
  misc_feature 1..11: note = chr11:133231728-133231739
  misc_feature 1..11: note = hypo
  source 1..11: mol_type = genomic DNA
aatgagctcag

SEQ ID NO: 63764 - DNA, 192 bp, Homo sapiens; identical to SEQ ID NO: 43298
  misc_feature 1..192: note = chr11:133386010-133386202
  misc_feature 1..192: note = hypo
  source 1..192: mol_type = genomic DNA

SEQ ID NO: 63765 - DNA, 30 bp, Homo sapiens; identical to SEQ ID NO: 43299
  misc_feature 1..30: note = chr11:133805206-133805236
  misc_feature 1..30: note = hypo
  source 1..30: mol_type = genomic DNA

SEQ ID NO: 63766 - DNA, 219 bp, Homo sapiens; identical to SEQ ID NO: 43300
  misc_feature 1..219: note = chr11:134011075-134011294
  misc_feature 1..219: note = hypo
  source 1..219: mol_type = genomic DNA

SEQ ID NO: 63767 - DNA, 34 bp, Homo sapiens; identical to SEQ ID NO: 43301
  misc_feature 1..34: note = chr11:134274891-134274925
  misc_feature 1..34: note = hypo
  source 1..34: mol_type = genomic DNA

SEQ ID NO: 63768 - DNA, 30 bp, Homo sapiens; identical to SEQ ID NO: 43302
  misc_feature 1..30: note = chr11:134458505-134458535
  misc_feature 1..30: note = hypo
  source 1..30: mol_type = genomic DNA

SEQ ID NO: 63769 - DNA, 30 bp, Homo sapiens; identical to SEQ ID NO: 43303
  misc_feature 1..30: note = chr11:134526234-134526264
  misc_feature 1..30: note = hypo
  source 1..30: mol_type = genomic DNA

SEQ ID NO: 63770 - DNA, 30 bp, Homo sapiens; identical to SEQ ID NO: 43304
  misc_feature 1..30: note = chr11:134607499-134607529
  misc_feature 1..30: note = hypo
  source 1..30: mol_type = genomic DNA

SEQ ID NO: 63771 - DNA, 94 bp, Homo sapiens; identical to SEQ ID NO: 43305
  misc_feature 1..94: note = chr11:134608582-134608676
  misc_feature 1..94: note = hypo
  source 1..94: mol_type = genomic DNA

SEQ ID NO: 63772 - DNA, 30 bp, Homo sapiens; identical to SEQ ID NO: 43306
  misc_feature 1..30: note = chr12:299633-299663
  misc_feature 1..30: note = hypo
  source 1..30: mol_type = genomic DNA

SEQ ID NO: 63773 - DNA, 35 bp, Homo sapiens; identical to SEQ ID NO: 43307
  misc_feature 1..35: note = chr12:709027-709062
  misc_feature 1..35: note = hypo
  source 1..35: mol_type = genomic DNA

SEQ ID NO: 63774 - DNA, 34 bp, Homo sapiens; identical to SEQ ID NO: 43308
  misc_feature 1..34: note = chr12:1650728-1650762
  misc_feature 1..34: note = hypo
  source 1..34: mol_type = genomic DNA

SEQ ID NO: 63775 - DNA, 76 bp, Homo sapiens; identical to SEQ ID NO: 43309
  misc_feature 1..76: note = chr12:1651130-1651206
  misc_feature 1..76: note = hypo
  source 1..76: mol_type = genomic DNA

SEQ ID NO: 63776 - DNA, 34 bp, Homo sapiens; identical to SEQ ID NO: 43310
  misc_feature 1..34: note = chr12:1716758-1716792
  misc_feature 1..34: note = hypo
  source 1..34: mol_type = genomic DNA

SEQ ID NO: 63777 - DNA, 42 bp, Homo sapiens; identical to SEQ ID NO: 43311
  misc_feature 1..42: note = chr12:1948142-1948184
  misc_feature 1..42: note = hypo
  source 1..42: mol_type = genomic DNA

SEQ ID NO: 63778 - DNA, 173 bp, Homo sapiens; identical to SEQ ID NO: 43312
  misc_feature 1..173: note = chr12:1948419-1948592
  misc_feature 1..173: note = hypo
  source 1..173: mol_type = genomic DNA

SEQ ID NO: 63779 - DNA, 45 bp, Homo sapiens; identical to SEQ ID NO: 43313
  misc_feature 1..45: note = chr12:2017790-2017835
  misc_feature 1..45: note = hypo
  source 1..45: mol_type = genomic DNA

SEQ ID NO: 63780 - DNA, 32 bp, Homo sapiens; identical to SEQ ID NO: 43314
  misc_feature 1..32: note = chr12:2018113-2018145
  misc_feature 1..32: note = hypo
  source 1..32: mol_type = genomic DNA

SEQ ID NO: 63781 - DNA, 134 bp, Homo sapiens; identical to SEQ ID NO: 43315
  misc_feature 1..134: note = chr12:2040511-2040645
  misc_feature 1..134: note = hypo
  source 1..134: mol_type = genomic DNA

SEQ ID NO: 63782 - DNA, 30 bp, Homo sapiens; identical to SEQ ID NO: 43316
  misc_feature 1..30: note = chr12:2046347-2046377
  misc_feature 1..30: note = hypo
  source 1..30: mol_type = genomic DNA

SEQ ID NO: 63783 - DNA, 53 bp, Homo sapiens; identical to SEQ ID NO: 43317
  misc_feature 1..53: note = chr12:2088785-2088838
  misc_feature 1..53: note = hypo
  source 1..53: mol_type = genomic DNA

SEQ ID NO: 63784 - DNA, 40 bp, Homo sapiens; identical to SEQ ID NO: 43318
  misc_feature 1..40: note = chr12:2245461-2245501
  misc_feature 1..40: note = hypo
  source 1..40: mol_type = genomic DNA

SEQ ID NO: 63785 - DNA, 30 bp, Homo sapiens; identical to SEQ ID NO: 15624
  misc_feature 1..30: note = chr12:2590465-2590495
  misc_feature 1..30: note = hypo
  source 1..30: mol_type = genomic DNA

SEQ ID NO: 63786 - DNA, 37 bp, Homo sapiens; identical to SEQ ID NO: 43321
  misc_feature 1..37: note = chr12:2921106-2921143
  misc_feature 1..37: note = hypo
  source 1..37: mol_type = genomic DNA

SEQ ID NO: 63787 - DNA, 235 bp, Homo sapiens
  misc_feature 1..235: note = chr12:2964577-2964812
  misc_feature 1..235: note = hypo
  source 1..235: mol_type = genomic DNA
tgggagggtgggagggactcgctggcctggaccatctagggagagacaaaagggagcctggggaaggttgtgcagacaggggtgcagaaaggtgggtgaggcactccgctctccttcccaggcacgacctctgccagcccaggattctcatgaggacgcagaagtcctggcagggccgcatctccatccctctccttcccggcggaagttatggctgctgcgtatcatcttcaca

SEQ ID NO: 63788 - DNA, 30 bp, Homo sapiens; identical to SEQ ID NO: 43323
  misc_feature 1..30: note = chr12:3640833-3640863
  misc_feature 1..30: note = hypo
  source 1..30: mol_type = genomic DNA

SEQ ID NO: 63789 - DNA, 30 bp, Homo sapiens; identical to SEQ ID NO: 43324
  misc_feature 1..30: note = chr12:4019070-4019100
  misc_feature 1..30: note = hypo
  source 1..30: mol_type = genomic DNA

SEQ ID NO: 63790 - DNA, 196 bp, Homo sapiens; identical to SEQ ID NO: 43325
  misc_feature 1..196: note = chr12:4194712-4194908
  misc_feature 1..196: note = hypo
  source 1..196: mol_type = genomic DNA

SEQ ID NO: 63791 - DNA, 30 bp, Homo sapiens; identical to SEQ ID NO: 43326
  misc_feature 1..30: note = chr12:4217500-4217530
  misc_feature 1..30: note = hypo
  source 1..30: mol_type = genomic DNA

SEQ ID NO: 63792 - DNA, 84 bp, Homo sapiens; identical to SEQ ID NO: 43327
  misc_feature 1..84: note = chr12:4268526-4268610
  misc_feature 1..84: note = hypo
  source 1..84: mol_type = genomic DNA

SEQ ID NO: 63793 - DNA, 17 bp, Homo sapiens
  misc_feature 1..17: note = chr12:4272614-4272631
  misc_feature 1..17: note = hypo
  source 1..17: mol_type = genomic DNA
agcgagactctgtctca

SEQ ID NO: 63794 - DNA, 30 bp, Homo sapiens; identical to SEQ ID NO: 43329
  misc_feature 1..30: note = chr12:4280922-4280952
  misc_feature 1..30: note = hypo
  source 1..30: mol_type = genomic DNA

SEQ ID NO: 63795 - DNA, 30 bp, Homo sapiens; identical to SEQ ID NO: 43330
  misc_feature 1..30: note = chr12:4356247-4356277
  misc_feature 1..30: note = hypo
  source 1..30: mol_type = genomic DNA

SEQ ID NO: 63796 - DNA, 75 bp, Homo sapiens; identical to SEQ ID NO: 43331
  misc_feature 1..75: note = chr12:4405652-4405727
  misc_feature 1..75: note = hypo
  source 1..75: mol_type = genomic DNA

SEQ ID NO: 63797 - DNA, 30 bp, Homo sapiens; identical to SEQ ID NO: 43332
  misc_feature 1..30: note = chr12:4411192-4411222
  misc_feature 1..30: note = hypo
  source 1..30: mol_type = genomic DNA

SEQ ID NO: 63798 - DNA, 102 bp, Homo sapiens
  misc_feature 1..102: note = chr12:4554831-4554933
  misc_feature 1..102: note = hypo
  source 1..102: mol_type = genomic DNA
tttggaaggcagatgaaggctgctgacatgaaaccaaagcctccatcgggcactcgggttgagagcagagggacccaggctgagccgcggccggtagagacc

SEQ ID NO: 63799 - DNA, 30 bp, Homo sapiens; identical to SEQ ID NO: 43334
  misc_feature 1..30: note = chr12:4734872-4734902
  misc_feature 1..30: note = hypo
  source 1..30: mol_type = genomic DNA

SEQ ID NO: 63800 - DNA, 146 bp, Homo sapiens; identical to SEQ ID NO: 43335
  misc_feature 1..146: note = chr12:4829055-4829201
  misc_feature 1..146: note = hypo
  source 1..146: mol_type = genomic DNA

SEQ ID NO: 63801 - DNA, 30 bp, Homo sapiens; identical to SEQ ID NO: 43336
  misc_feature 1..30: note = chr12:4959461-4959491
  misc_feature 1..30: note = hypo
  source 1..30: mol_type = genomic DNA

SEQ ID NO: 63802 - DNA, 141 bp, Homo sapiens; identical to SEQ ID NO: 43337
  misc_feature 1..141: note = chr12:5315393-5315534
  misc_feature 1..141: note = hypo
  source 1..141: mol_type = genomic DNA

SEQ ID NO: 63803 - DNA, 106 bp, Homo sapiens; identical to SEQ ID NO: 43338
  misc_feature 1..106: note = chr12:5323880-5323986
  misc_feature 1..106: note = hypo
  source 1..106: mol_type = genomic DNA

SEQ ID NO: 63804 - DNA, 141 bp, Homo sapiens; identical to SEQ ID NO: 43339
  misc_feature 1..141: note = chr12:5335908-5336049
  misc_feature 1..141: note = hypo
  source 1..141: mol_type = genomic DNA

SEQ ID NO: 63805 - DNA, 30 bp, Homo sapiens; identical to SEQ ID NO: 43340
  misc_feature 1..30: note = chr12:5384595-5384625
  misc_feature 1..30: note = hypo
  source 1..30: mol_type = genomic DNA

SEQ ID NO: 63806 - DNA, 20 bp, Homo sapiens
  misc_feature 1..20: note = chr12:5561269-5561289
  misc_feature 1..20: note = hypo
  source 1..20: mol_type = genomic DNA
ttttttttttgttgacggag

SEQ ID NO: 63807 - DNA, 54 bp, Homo sapiens; identical to SEQ ID NO: 43342
  misc_feature 1..54: note = chr12:5713384-5713438
  misc_feature 1..54: note = hypo
  source 1..54: mol_type = genomic DNA

SEQ ID NO: 63808 - DNA, 21 bp, Homo sapiens
  misc_feature 1..21: note = chr12:5720406-5720427
  misc_feature 1..21: note = hypo
  source 1..21: mol_type = genomic DNA
ttacagcggtgagccaccaca

SEQ ID NO: 63809 - DNA, 30 bp, Homo sapiens; identical to SEQ ID NO: 43344
  misc_feature 1..30: note = chr12:6180349-6180379
  misc_feature 1..30: note = hypo
  source 1..30: mol_type = genomic DNA

SEQ ID NO: 63810 - DNA, 30 bp, Homo sapiens; identical to SEQ ID NO: 43345
  misc_feature 1..30: note = chr12:6316943-6316973
  misc_feature 1..30: note = hypo
  source 1..30: mol_type = genomic DNA

SEQ ID NO: 63811 - DNA, 47 bp, Homo sapiens; identical to SEQ ID NO: 24904
  misc_feature 1..47: note = chr12:6483568-6483615
  misc_feature 1..47: note = hypo
  source 1..47: mol_type = genomic DNA

SEQ ID NO: 63812 - DNA, 30 bp, Homo sapiens
  misc_feature 1..30: note = chr12:6483756-6483786
  misc_feature 1..30: note = hypo
  source 1..30: mol_type = genomic DNA
tgttgcagaagaactcgaagagctctcggt

SEQ ID NO: 63813 - DNA, 30 bp, Homo sapiens; identical to SEQ ID NO: 43347
  misc_feature 1..30: note = chr12:6484000-6484030
  misc_feature 1..30: note = hypo
  source 1..30: mol_type = genomic DNA

SEQ ID NO: 63814 - DNA, 30 bp, Homo sapiens; identical to SEQ ID NO: 43348
  misc_feature 1..30: note = chr12:6495108-6495138
  misc_feature 1..30: note = hypo
  source 1..30: mol_type = genomic DNA

SEQ ID NO: 63815 - DNA, 69 bp, Homo sapiens; identical to SEQ ID NO: 43349
  misc_feature 1..69: note = chr12:6623485-6623554
  misc_feature 1..69: note = hypo
  source 1..69: mol_type = genomic DNA

SEQ ID NO: 63816 - DNA, 30 bp, Homo sapiens; identical to SEQ ID NO: 43350
  misc_feature 1..30: note = chr12:6804680-6804710
  misc_feature 1..30: note = hypo
  source 1..30: mol_type = genomic DNA

SEQ ID NO: 63817 - DNA, 16 bp, Homo sapiens
  misc_feature 1..16: note = chr12:7462672-7462688
  misc_feature 1..16: note = hypo
  source 1..16: mol_type = genomic DNA
gcgcctggcaggagac

SEQ ID NO: 63818 - DNA, 81 bp, Homo sapiens; identical to SEQ ID NO: 43352
  misc_feature 1..81: note = chr12:7767211-7767292
  misc_feature 1..81: note = hypo
  source 1..81: mol_type = genomic DNA

SEQ ID NO: 63819 - DNA, 33 bp, Homo sapiens; identical to SEQ ID NO: 43353
  misc_feature 1..33: note = chr12:7864862-7864895
  misc_feature 1..33: note = hypo
  source 1..33: mol_type = genomic DNA

SEQ ID NO: 63820 - DNA, 84 bp, Homo sapiens; identical to SEQ ID NO: 43354
  misc_feature 1..84: note = chr12:7921500-7921584
  misc_feature 1..84: note = hypo
  source 1..84: mol_type = genomic DNA

SEQ ID NO: 63821 - DNA, 43 bp, Homo sapiens; identical to SEQ ID NO: 43355
  misc_feature 1..43: note = chr12:7960433-7960476
  misc_feature 1..43: note = hypo
  source 1..43: mol_type = genomic DNA

SEQ ID NO: 63822 - DNA, 41 bp, Homo sapiens; identical to SEQ ID NO: 43356
  misc_feature 1..41: note = chr12:7963835-7963876
  misc_feature 1..41: note = hypo
  source 1..41: mol_type = genomic DNA

SEQ ID NO: 63823 - DNA, 18 bp, Homo sapiens
  misc_feature 1..18: note = chr12:7973388-7973406
  misc_feature 1..18: note = hypo
  source 1..18: mol_type = genomic DNA
aattaaacaacagtccgg

SEQ ID NO: 63824 - DNA, 30 bp, Homo sapiens; identical to SEQ ID NO: 43358
  misc_feature 1..30: note = chr12:7980007-7980037
  misc_feature 1..30: note = hypo
  source 1..30: mol_type = genomic DNA

SEQ ID NO: 63825 - DNA, 30 bp, Homo sapiens; identical to SEQ ID NO: 43359
  misc_feature 1..30: note = chr12:7986413-7986443
  misc_feature 1..30: note = hypo
  source 1..30: mol_type = genomic DNA

SEQ ID NO: 63826 - DNA, 30 bp, Homo sapiens; identical to SEQ ID NO: 43360
  misc_feature 1..30: note = chr12:8023514-8023544
  misc_feature 1..30: note = hypo
  source 1..30: mol_type = genomic DNA

SEQ ID NO: 63827 - DNA, 96 bp, Homo sapiens; identical to SEQ ID NO: 43361
  misc_feature 1..96: note = chr12:8117682-8117778
  misc_feature 1..96: note = hypo
  source 1..96: mol_type = genomic DNA

SEQ ID NO: 63828 - DNA, 18 bp, Homo sapiens
  misc_feature 1..18: note = chr12:8122686-8122704
  misc_feature 1..18: note = hypo
  source 1..18: mol_type = genomic DNA
gcccgaactacaattctt

SEQ ID NO: 63829 - DNA, 38 bp, Homo sapiens; identical to SEQ ID NO: 43364
  misc_feature 1..38: note = chr12:8168255-8168293
  misc_feature 1..38: note = hypo
  source 1..38: mol_type = genomic DNA

SEQ ID NO: 63830 - DNA, 32 bp, Homo sapiens; identical to SEQ ID NO: 43365
  misc_feature 1..32: note = chr12:8170444-8170476
  misc_feature 1..32: note = hypo
  source 1..32: mol_type = genomic DNA

SEQ ID NO: 63831 - DNA, 89 bp, Homo sapiens; identical to SEQ ID NO: 43366
  misc_feature 1..89: note = chr12:8322396-8322485
  misc_feature 1..89: note = hypo
  source 1..89: mol_type = genomic DNA

SEQ ID NO: 63832 - DNA, 21 bp, Homo sapiens
  misc_feature 1..21: note = chr12:8748055-8748076
  misc_feature 1..21: note = hypo
  source 1..21: mol_type = genomic DNA
ccaaagcgctgggattacagg

SEQ ID NO: 63833 - DNA, 30 bp, Homo sapiens; identical to SEQ ID NO: 43368
  misc_feature 1..30: note = chr12:8748716-8748746
  misc_feature 1..30: note = hypo
  source 1..30: mol_type = genomic DNA

SEQ ID NO: 63834 - DNA, 28 bp, Homo sapiens
  misc_feature 1..28: note = chr12:8751148-8751176
  misc_feature 1..28: note = hypo
  source 1..28: mol_type = genomic DNA
aggtttacttgacttcgaagtcatactg

SEQ ID NO: 63835 - DNA, 198 bp, Homo sapiens; identical to SEQ ID NO: 43370
  misc_feature 1..198: note = chr12:8790007-8790205
  misc_feature 1..198: note = hypo
  source 1..198: mol_type = genomic DNA

SEQ ID NO: 63836 - DNA, 61 bp, Homo sapiens; identical to SEQ ID NO: 43371
  misc_feature 1..61: note = chr12:8799944-8800005
  misc_feature 1..61: note = hypo
  source 1..61: mol_type = genomic DNA

SEQ ID NO: 63837 - DNA, 40 bp, Homo sapiens; identical to SEQ ID NO: 24909
  misc_feature 1..40: note = chr12:8808559-8808599
  misc_feature 1..40: note = hypo
  source 1..40: mol_type = genomic DNA

SEQ ID NO: 63838 - DNA, 25 bp, Homo sapiens
  misc_feature 1..25: note = chr12:8869424-8869449
  misc_feature 1..25: note = hypo
  source 1..25: mol_type = genomic DNA
caggctcaagcgatcttcccacctc

SEQ ID NO: 63839 - DNA, 80 bp, Homo sapiens; identical to SEQ ID NO: 43374
  misc_feature 1..80: note = chr12:8908240-8908320
  misc_feature 1..80: note = hypo
  source 1..80: mol_type = genomic DNA

SEQ ID NO: 63840 - DNA, 147 bp, Homo sapiens; identical to SEQ ID NO: 43376
  misc_feature 1..147: note = chr12:8982341-8982488
  misc_feature 1..147: note = hypo
  source 1..147: mol_type = genomic DNA

SEQ ID NO: 63841 - DNA, 103 bp, Homo sapiens; identical to SEQ ID NO: 43377
  misc_feature 1..103: note = chr12:8983831-8983934
  misc_feature 1..103: note = hypo
  source 1..103: mol_type = genomic DNA

SEQ ID NO: 63842 - DNA, 30 bp, Homo sapiens; identical to SEQ ID NO: 43378
  misc_feature 1..30: note = chr12:9006991-9007021
  misc_feature 1..30: note = hypo
  source 1..30: mol_type = genomic DNA

SEQ ID NO: 63843 - DNA, 135 bp, Homo sapiens; identical to SEQ ID NO: 43379
  misc_feature 1..135: note = chr12:9016413-9016548
  misc_feature 1..135: note = hypo
  source 1..135: mol_type = genomic DNA

SEQ ID NO: 63844 - DNA, 21 bp, Homo sapiens
  misc_feature 1..21: note = chr12:9018124-9018145
  misc_feature 1..21: note = hypo
  source 1..21: mol_type = genomic DNA
aaactccgtctcaacaacaac

SEQ ID NO: 63845 - DNA, 30 bp, Homo sapiens; identical to SEQ ID NO: 43381
  misc_feature 1..30: note = chr12:9026553-9026583
  misc_feature 1..30: note = hypo
  source 1..30: mol_type = genomic DNA

SEQ ID NO: 63846 - DNA, 105 bp, Homo sapiens; identical to SEQ ID NO: 43382
  misc_feature 1..105: note = chr12:9203172-9203277
  misc_feature 1..105: note = hypo
  source 1..105: mol_type = genomic DNA

SEQ ID NO: 63847 - DNA, 28 bp, Homo sapiens
  misc_feature 1..28: note = chr12:10086245-10086273
  misc_feature 1..28: note = hypo
  source 1..28: mol_type = genomic DNA
gcttttggtgcttcggtgcagagacaga

SEQ ID NO: 63848 - DNA, 30 bp, Homo sapiens; identical to SEQ ID NO: 43386
  misc_feature 1..30: note = chr12:10364485-10364515
  misc_feature 1..30: note = hypo
  source 1..30: mol_type = genomic DNA

SEQ ID NO: 63849 - DNA, 32 bp, Homo sapiens; identical to SEQ ID NO: 43387
  misc_feature 1..32: note = chr12:10823904-10823936
  misc_feature 1..32: note = hypo
  source 1..32: mol_type = genomic DNA

SEQ ID NO: 63850 - DNA, 93 bp, Homo sapiens; identical to SEQ ID NO: 43389
  misc_feature 1..93: note = chr12:13025675-13025768
  misc_feature 1..93: note = hypo
  source 1..93: mol_type = genomic DNA

SEQ ID NO: 63851 - DNA, 187 bp, Homo sapiens; identical to SEQ ID NO: 43390
  misc_feature 1..187: note = chr12:13030748-13030935
  misc_feature 1..187: note = hypo
  source 1..187: mol_type = genomic DNA

SEQ ID NO: 63852 - DNA, 16 bp, Homo sapiens
  misc_feature 1..16: note = chr12:13035999-13036015
  misc_feature 1..16: note = hypo
  source 1..16: mol_type = genomic DNA
gtgtttaaggccgggc

SEQ ID NO: 63853 - DNA, 385 bp, Homo sapiens; identical to SEQ ID NO: 43392
  misc_feature 1..385: note = chr12:13079626-13080011
  misc_feature 1..385: note = hypo
  source 1..385: mol_type = genomic DNA

SEQ ID NO: 63854 - DNA, 94 bp, Homo sapiens; identical to SEQ ID NO: 15639
  misc_feature 1..94: note = chr12:13215216-13215310
  misc_feature 1..94: note = hypo
  source 1..94: mol_type = genomic DNA

SEQ ID NO: 63855 - DNA, 30 bp, Homo sapiens; identical to SEQ ID NO: 43394
  misc_feature 1..30: note = chr12:13229039-13229069
  misc_feature 1..30: note = hypo
  source 1..30: mol_type = genomic DNA

SEQ ID NO: 63856 - DNA, 30 bp, Homo sapiens; identical to SEQ ID NO: 43395
  misc_feature 1..30: note = chr12:13716358-13716388
  misc_feature 1..30: note = hypo
  source 1..30: mol_type = genomic DNA

SEQ ID NO: 63857 - DNA, 36 bp, Homo sapiens; identical to SEQ ID NO: 43396
  misc_feature 1..36: note = chr12:14817857-14817893
  misc_feature 1..36: note = hypo
  source 1..36: mol_type = genomic DNA

SEQ ID NO: 63858 - DNA, 18 bp, Homo sapiens
  misc_feature 1..18: note = chr12:14905519-14905537
  misc_feature 1..18: note = hypo
  source 1..18: mol_type = genomic DNA
aaaaaaaaagctggccgg

SEQ ID NO: 63859 - DNA, 30 bp, Homo sapiens; identical to SEQ ID NO: 43398
  misc_feature 1..30: note = chr12:14926203-14926233
  misc_feature 1..30: note = hypo
  source 1..30: mol_type = genomic DNA

SEQ ID NO: 63860 - DNA, 52 bp, Homo sapiens; identical to SEQ ID NO: 43399
  misc_feature 1..52: note = chr12:14929885-14929937
  misc_feature 1..52: note = hypo
  source 1..52: mol_type = genomic DNA

SEQ ID NO: 63861 - DNA, 82 bp, Homo sapiens; identical to SEQ ID NO: 43400
  misc_feature 1..82: note = chr12:17629461-17629543
  misc_feature 1..82: note = hypo
  source 1..82: mol_type = genomic DNA

SEQ ID NO: 63862 - DNA, 35 bp, Homo sapiens; identical to SEQ ID NO: 43401
  misc_feature 1..35: note = chr12:19636251-19636286
  misc_feature 1..35: note = hypo
  source 1..35: mol_type = genomic DNA

SEQ ID NO: 63863 - DNA, 81 bp, Homo sapiens; identical to SEQ ID NO: 43403
  misc_feature 1..81: note = chr12:22698115-22698196
  misc_feature 1..81: note = hypo
  source 1..81: mol_type = genomic DNA

SEQ ID NO: 63864 - DNA, 187 bp, Homo sapiens; identical to SEQ ID NO: 43404
  misc_feature 1..187: note = chr12:25059405-25059592
  misc_feature 1..187: note = hypo
  source 1..187: mol_type = genomic DNA

SEQ ID NO: 63865 - DNA, 77 bp, Homo sapiens; identical to SEQ ID NO: 15643
  misc_feature 1..77: note = chr12:25081492-25081569
  misc_feature 1..77: note = hypo
  source 1..77: mol_type = genomic DNA

SEQ ID NO: 63866 - DNA, 25 bp, Homo sapiens
  misc_feature 1..25: note = chr12:25191255-25191280
  misc_feature 1..25: note = hypo
  source 1..25: mol_type = genomic DNA
caaaattgcaaatgacgaactataa

SEQ ID NO: 63867 - DNA, 30 bp, Homo sapiens; identical to SEQ ID NO: 43407
  misc_feature 1..30: note = chr12:25195744-25195774
  misc_feature 1..30: note = hypo
  source 1..30: mol_type = genomic DNA

SEQ ID NO: 63868 - DNA, 30 bp, Homo sapiens; identical to SEQ ID NO: 43408
  misc_feature 1..30: note = chr12:25262919-25262949
  misc_feature 1..30: note = hypo
  source 1..30: mol_type = genomic DNA

SEQ ID NO: 63869 - DNA, 30 bp, Homo sapiens; identical to SEQ ID NO: 43409
  misc_feature 1..30: note = chr12:25537400-25537430
  misc_feature 1..30: note = hypo
  source 1..30: mol_type = genomic DNA

SEQ ID NO: 63870 - DNA, 30 bp, Homo sapiens; identical to SEQ ID NO: 43410
  misc_feature 1..30: note = chr12:26555243-26555273
  misc_feature 1..30: note = hypo
  source 1..30: mol_type = genomic DNA

SEQ ID NO: 63871 - DNA, 37 bp, Homo sapiens; identical to SEQ ID NO: 43411
  misc_feature 1..37: note = chr12:26555819-26555856
  misc_feature 1..37: note = hypo
  source 1..37: mol_type = genomic DNA

SEQ ID NO: 63872 - DNA, 153 bp, Homo sapiens; identical to SEQ ID NO: 43412
  misc_feature 1..153: note = chr12:27489449-27489602
  misc_feature 1..153: note = hypo
  source 1..153: mol_type = genomic DNA

SEQ ID NO: 63873 - DNA, 30 bp, Homo sapiens; identical to SEQ ID NO: 43413
  misc_feature 1..30: note = chr12:29374034-29374064
  misc_feature 1..30: note = hypo
  source 1..30: mol_type = genomic DNA

SEQ ID NO: 63874 - DNA, 20 bp, Homo sapiens
  misc_feature 1..20: note = chr12:30859424-30859444
  misc_feature 1..20: note = hypo
  source 1..20: mol_type = genomic DNA
acaagcgtaagccactgtac

SEQ ID NO: 63875 - DNA, 41 bp, Homo sapiens; identical to SEQ ID NO: 43415
  misc_feature 1..41: note = chr12:30947564-30947605
  misc_feature 1..41: note = hypo
  source 1..41: mol_type = genomic DNA

SEQ ID NO: 63876 - DNA, 30 bp, Homo sapiens; identical to SEQ ID NO: 43416
  misc_feature 1..30: note = chr12:31255181-31255211
  misc_feature 1..30: note = hypo
  source 1..30: mol_type = genomic DNA

SEQ ID NO: 63877 - DNA, 16 bp, Homo sapiens
  misc_feature 1..16: note = chr12:32087179-32087195
  misc_feature 1..16: note = hypo
  source 1..16: mol_type = genomic DNA
gtgccacagctactcc

SEQ ID NO: 63878 - DNA, 151 bp, Homo sapiens; identical to SEQ ID NO: 15647
  misc_feature 1..151: note = chr12:32597645-32597796
  misc_feature 1..151: note = hypo
  source 1..151: mol_type = genomic DNA

SEQ ID NO: 63879 - DNA, 40 bp, Homo sapiens; identical to SEQ ID NO: 43420
  misc_feature 1..40: note = chr12:32831140-32831180
  misc_feature 1..40: note = hypo
  source 1..40: mol_type = genomic DNA

SEQ ID NO: 63880 - DNA, 240 bp, Homo sapiens; identical to SEQ ID NO: 43421
  misc_feature 1..240: note = chr12:32831300-32831540
  misc_feature 1..240: note = hypo
  source 1..240: mol_type = genomic DNA

SEQ ID NO: 63881 - DNA, 157 bp, Homo sapiens; identical to SEQ ID NO: 43422
  misc_feature 1..157: note = chr12:33205564-33205721
  misc_feature 1..157: note = hypo
  source 1..157: mol_type = genomic DNA

SEQ ID NO: 63882 - DNA, 43 bp, Homo sapiens; identical to SEQ ID NO: 43423
  misc_feature 1..43: note = chr12:34362659-34362702
  misc_feature 1..43: note = hypo
  source 1..43: mol_type = genomic DNA

SEQ ID NO: 63883 - DNA, 30 bp, Homo sapiens; identical to SEQ ID NO: 43424
  misc_feature 1..30: note = chr12:34364426-34364456
  misc_feature 1..30: note = hypo
  source 1..30: mol_type = genomic DNA

SEQ ID NO: 63884 - DNA, 25 bp, Homo sapiens
  misc_feature 1..25: note = chr12:34463931-34463956
  misc_feature 1..25: note = hypo
  source 1..25: mol_type = genomic DNA
tgcgtgtcgtgctcacggggacacc

SEQ ID NO: 63885 - DNA, 85 bp, Homo sapiens; identical to SEQ ID NO: 43426
  misc_feature 1..85: note = chr12:34464016-34464101
  misc_feature 1..85: note = hypo
  source 1..85: mol_type = genomic DNA

SEQ ID NO: 63886 - DNA, 51 bp, Homo sapiens
  misc_feature 1..51: note = chr12:34494918-34494969
  misc_feature 1..51: note = hypo
  source 1..51: mol_type = genomic DNA
gtcccgggtttgcactccccgagcggctggacactgcggggggctgcccaa

SEQ ID NO: 63887 - DNA, 114 bp, Homo sapiens
  misc_feature 1..114: note = chr12:34502619-34502733
  misc_feature 1..114: note = hypo
  source 1..114: mol_type = genomic DNA
atttggcctaacccacgcggggtccagcctctccgggggtgtgaaccccggacctcagggtcctcaggacccagtgcatgcgcagcaggtgggacttggggttggccgggggcc

SEQ ID NO: 63888 - DNA, 84 bp, Homo sapiens
  misc_feature 1..84: note = chr12:34502803-34502887
  misc_feature 1..84: note = hypo
  source 1..84: mol_type = genomic DNA
gcggctgtgggcggctaccccaggggaccagctgctccgagggcgcgagcctaggaccctgcttatgcacggcaggggtggtgt

SEQ ID NO: 63889 - DNA, 93 bp, Homo sapiens; identical to SEQ ID NO: 43429
  misc_feature 1..93: note = chr12:34519278-34519371
  misc_feature 1..93: note = hypo
  source 1..93: mol_type = genomic DNA

SEQ ID NO: 63890 - DNA, 113 bp, Homo sapiens; identical to SEQ ID NO: 43430
  misc_feature 1..113: note = chr12:34520137-34520250
  misc_feature 1..113: note = hypo
  source 1..113: mol_type = genomic DNA

SEQ ID NO: 63891 - DNA, 30 bp, Homo sapiens; identical to SEQ ID NO: 43431
  misc_feature 1..30: note = chr12:34522309-34522339
  misc_feature 1..30: note = hypo
  source 1..30: mol_type = genomic DNA

SEQ ID NO: 63892 - DNA, 30 bp, Homo sapiens; identical to SEQ ID NO: 43432
  misc_feature 1..30: note = chr12:38543382-38543412
  misc_feature 1..30: note = hypo
  source 1..30: mol_type = genomic DNA

SEQ ID NO: 63893 - DNA, 30 bp, Homo sapiens; identical to SEQ ID NO: 43433
  misc_feature 1..30: note = chr12:38549417-38549447
  misc_feature 1..30: note = hypo
  source 1..30: mol_type = genomic DNA

SEQ ID NO: 63894 - DNA, 177 bp, Homo sapiens; identical to SEQ ID NO: 43434
  misc_feature 1..177: note = chr12:38550692-38550869
  misc_feature 1..177: note = hypo
  source 1..177: mol_type = genomic DNA

SEQ ID NO: 63895 - DNA, 207 bp, Homo sapiens; identical to SEQ ID NO: 43435
  misc_feature 1..207: note = chr12:38551229-38551436
  misc_feature 1..207: note = hypo
  source 1..207: mol_type = genomic DNA

SEQ ID NO: 63896 - DNA, 43 bp, Homo sapiens; identical to SEQ ID NO: 43436
  misc_feature 1..43: note = chr12:38551858-38551901
  misc_feature 1..43: note = hypo
  source 1..43: mol_type = genomic DNA

SEQ ID NO: 63897 - DNA, 36 bp, Homo sapiens; identical to SEQ ID NO: 43437
  misc_feature 1..36: note = chr12:38553830-38553866
  misc_feature 1..36: note = hypo
  source 1..36: mol_type = genomic DNA

SEQ ID NO: 63898 - DNA, 96 bp, Homo sapiens; identical to SEQ ID NO: 43438
  misc_feature 1..96: note = chr12:38595440-38595536
  misc_feature 1..96: note = hypo
  source 1..96: mol_type = genomic DNA

SEQ ID NO: 63899 - DNA, 30 bp, Homo sapiens; identical to SEQ ID NO: 43439
  misc_feature 1..30: note = chr12:40501737-40501767
  misc_feature 1..30: note = hypo
  source 1..30: mol_type = genomic DNA

SEQ ID NO: 63900 - DNA, 30 bp, Homo sapiens; identical to SEQ ID NO: 43440
  misc_feature 1..30: note = chr12:41925162-41925192
  misc_feature 1..30: note = hypo
  source 1..30: mol_type = genomic DNA

SEQ ID NO: 63901 - DNA, 24 bp, Homo sapiens
  misc_feature 1..24: note = chr12:42654216-42654240
  misc_feature 1..24: note = hypo
  source 1..24: mol_type = genomic DNA
gataatagtacttgccgggaggcg

SEQ ID NO: 63902 - DNA, 83 bp, Homo sapiens; identical to SEQ ID NO: 43442
  misc_feature 1..83: note = chr12:42654300-42654383
  misc_feature 1..83: note = hypo
  source 1..83: mol_type = genomic DNA

SEQ ID NO: 63903 - DNA, 21 bp, Homo sapiens
  misc_feature 1..21: note = chr12:43957389-43957410
  misc_feature 1..21: note = hypo
  source 1..21: mol_type = genomic DNA
ccaccgcgcccggccctcaga

SEQ ID NO: 63904 - DNA, 86 bp, Homo sapiens; identical to SEQ ID NO: 43444
  misc_feature 1..86: note = chr12:47628723-47628809
  misc_feature 1..86: note = hypo
  source 1..86: mol_type = genomic DNA

SEQ ID NO: 63905 - DNA, 140 bp, Homo sapiens; identical to SEQ ID NO: 43445
  misc_feature 1..140: note = chr12:47629068-47629208
  misc_feature 1..140: note = hypo
  source 1..140: mol_type = genomic DNA

SEQ ID NO: 63906 - DNA, 30 bp, Homo sapiens; identical to SEQ ID NO: 43446
  misc_feature 1..30: note = chr12:48590883-48590913
  misc_feature 1..30: note = hypo
  source 1..30: mol_type = genomic DNA

SEQ ID NO: 63907 - DNA, 18 bp, Homo sapiens
  misc_feature 1..18: note = chr12:49108598-49108616
  misc_feature 1..18: note = hypo
  source 1..18: mol_type = genomic DNA
tataaggcggccaggcgc

SEQ ID NO: 63908 - DNA, 25 bp, Homo sapiens
  misc_feature 1..25: note = chr12:49174695-49174720
  misc_feature 1..25: note = hypo
  source 1..25: mol_type = genomic DNA
cattctggccaggtgcggtggctca

SEQ ID NO: 63909 - DNA, 17 bp, Homo sapiens
  misc_feature 1..17: note = chr12:49455664-49455681
  misc_feature 1..17: note = hypo
  source 1..17: mol_type = genomic DNA
agagtctcgcactgtcg

SEQ ID NO: 63910 - DNA, 35 bp, Homo sapiens; identical to SEQ ID NO: 43450
  misc_feature 1..35: note = chr12:49596187-49596222
  misc_feature 1..35: note = hypo
  source 1..35: mol_type = genomic DNA

SEQ ID NO: 63911 - DNA, 98 bp, Homo sapiens; identical to SEQ ID NO: 24924
  misc_feature 1..98: note = chr12:49657607-49657705
  misc_feature 1..98: note = hypo
  source 1..98: mol_type = genomic DNA

SEQ ID NO: 63912 - DNA, 30 bp, Homo sapiens; identical to SEQ ID NO: 43452
  misc_feature 1..30: note = chr12:50790622-50790652
  misc_feature 1..30: note = hypo
  source 1..30: mol_type = genomic DNA

SEQ ID NO: 63913 - DNA, 21 bp, Homo sapiens
  misc_feature 1..21: note = chr12:50897742-50897763
  misc_feature 1..21: note = hypo
  source 1..21: mol_type = genomic DNA
tttcttttctttagacggagt

SEQ ID NO: 63914 - DNA, 285 bp, Homo sapiens
  misc_feature 1..285: note = chr12:51421271-51421556
  misc_feature 1..285: note = hypo
  source 1..285: mol_type = genomic DNA
cccaagcctccgtagtgaattgttttcctcctcgcccagctgactcgattctccccagacttcatcctacctacccaaaagcaatcccactctatcgccagtttcagcctcacaccgtatcttttgctctgaagatgagactgccaaactggtgaagagggaataaatggcctaacaaattaccgtaattttctgcaatgtcgtttacagccaccaaaaacattagatcctcccgccaccctcactccccgacccctcgcactgcttacagcattaaaggtaatt

SEQ ID NO: 63915 - DNA, 148 bp, Homo sapiens; identical to SEQ ID NO: 43457
  misc_feature 1..148: note = chr12:52387912-52388060
  misc_feature 1..148: note = hypo
  source 1..148: mol_type = genomic DNA

SEQ ID NO: 63916 - DNA, 94 bp, Homo sapiens; identical to SEQ ID NO: 43458
  misc_feature 1..94: note = chr12:52388344-52388438
  misc_feature 1..94: note = hypo
  source 1..94: mol_type = genomic DNA

SEQ ID NO: 63917 - DNA, 30 bp, Homo sapiens; identical to SEQ ID NO: 43459
  misc_feature 1..30: note = chr12:52467638-52467668
  misc_feature 1..30: note = hypo
  source 1..30: mol_type = genomic DNA

SEQ ID NO: 63918 - DNA, 30 bp, Homo sapiens; identical to SEQ ID NO: 43460
  misc_feature 1..30: note = chr12:52913808-52913838
  misc_feature 1..30: note = hypo
  source 1..30: mol_type = genomic DNA

SEQ ID NO: 63919 - DNA, 30 bp, Homo sapiens; identical to SEQ ID NO: 43461
  misc_feature 1..30: note = chr12:52914057-52914087
  misc_feature 1..30: note = hypo
  source 1..30: mol_type = genomic DNA

SEQ ID NO: 63920 - DNA, 102 bp, Homo sapiens; identical to SEQ ID NO: 43462
  misc_feature 1..102: note = chr12:53069161-53069263
  misc_feature 1..102: note = hypo
  source 1..102: mol_type = genomic DNA

SEQ ID NO: 63921 - DNA, 210 bp, Homo sapiens; identical to SEQ ID NO: 43463
  misc_feature 1..210: note = chr12:53189513-53189723
  misc_feature 1..210: note = hypo
  source 1..210: mol_type = genomic DNA

SEQ ID NO: 63922 - DNA, 30 bp, Homo sapiens; identical to SEQ ID NO: 43464
  misc_feature 1..30: note = chr12:53455806-53455836
  misc_feature 1..30: note = hypo
  source 1..30: mol_type = genomic DNA

SEQ ID NO: 63923 - DNA, 30 bp, Homo sapiens; identical to SEQ ID NO: 43465
  misc_feature 1..30: note = chr12:53456042-53456072
  misc_feature 1..30: note = hypo
  source 1..30: mol_type = genomic DNA

SEQ ID NO: 63924 - DNA, 240 bp, Homo sapiens; identical to SEQ ID NO: 43466
  misc_feature 1..240: note = chr12:53662984-53663224
  misc_feature 1..240: note = hypo
  source 1..240: mol_type = genomic DNA

SEQ ID NO: 63925 - DNA, 30 bp, Homo sapiens; identical to SEQ ID NO: 43467
  misc_feature 1..30: note = chr12:53813830-53813860
  misc_feature 1..30: note = hypo
  source 1..30: mol_type = genomic DNA

SEQ ID NO: 63926 - DNA, 71 bp, Homo sapiens; identical to SEQ ID NO: 24928
  misc_feature 1..71: note = chr12:54720232-54720303
  misc_feature 1..71: note = hypo
  source 1..71: mol_type = genomic DNA

SEQ ID NO: 63927 - DNA, 111 bp, Homo sapiens; identical to SEQ ID NO: 43470
  misc_feature 1..111: note = chr12:55356770-55356881
  misc_feature 1..111: note = hypo
  source 1..111: mol_type = genomic DNA

SEQ ID NO: 63928 - DNA, 30 bp, Homo sapiens; identical to SEQ ID NO: 43471
  misc_feature 1..30: note = chr12:55786344-55786374
  misc_feature 1..30: note = hypo
  source 1..30: mol_type = genomic DNA

SEQ ID NO: 63929 - DNA, 30 bp, Homo sapiens; identical to SEQ ID NO: 43472
  misc_feature 1..30: note = chr12:56094359-56094389
  misc_feature 1..30: note = hypo
  source 1..30: mol_type = genomic DNA

SEQ ID NO: 63930 - DNA, 43 bp, Homo sapiens; identical to SEQ ID NO: 15661
  misc_feature 1..43: note = chr12:56441277-56441320
  misc_feature 1..43: note = hypo
  source 1..43: mol_type = genomic DNA

SEQ ID NO: 63931 - DNA, 30 bp, Homo sapiens; identical to SEQ ID NO: 43474
  misc_feature 1..30: note = chr12:57493886-57493916
  misc_feature 1..30: note = hypo
  source 1..30: mol_type = genomic DNA

SEQ ID NO: 63932 - DNA, 56 bp, Homo sapiens; identical to SEQ ID NO: 43475
  misc_feature 1..56: note = chr12:57559766-57559822
  misc_feature 1..56: note = hypo
  source 1..56: mol_type = genomic DNA

SEQ ID NO: 63933 - DNA, 15 bp, Homo sapiens
  misc_feature 1..15: note = chr12:57881112-57881127
  misc_feature 1..15: note = hypo
  source 1..15: mol_type = genomic DNA
ctttgtcactaattc

SEQ ID NO: 63934 - DNA, 90 bp, Homo sapiens; identical to SEQ ID NO: 43477
  misc_feature 1..90: note = chr12:58241509-58241599
  misc_feature 1..90: note = hypo
  source 1..90: mol_type = genomic DNA

SEQ ID NO: 63935 - DNA, 39 bp, Homo sapiens; identical to SEQ ID NO: 43478
  misc_feature 1..39: note = chr12:62429791-62429830
  misc_feature 1..39: note = hypo
  source 1..39: mol_type = genomic DNA

SEQ ID NO: 63936 - DNA, 31 bp, Homo sapiens; identical to SEQ ID NO: 43479
  misc_feature 1..31: note = chr12:62539074-62539105
  misc_feature 1..31: note = hypo
  source 1..31: mol_type = genomic DNA

SEQ ID NO: 63937 - DNA, 31 bp, Homo sapiens; identical to SEQ ID NO: 43480
  misc_feature 1..31: note = chr12:62539225-62539256
  misc_feature 1..31: note = hypo
  source 1..31: mol_type = genomic DNA

SEQ ID NO: 63938 - DNA, 42 bp, Homo sapiens; identical to SEQ ID NO: 43481
  misc_feature 1..42: note = chr12:62563338-62563380
  misc_feature 1..42: note = hypo
  source 1..42: mol_type = genomic DNA

SEQ ID NO: 63939 - DNA, 168 bp, Homo sapiens; identical to SEQ ID NO: 43482
  misc_feature 1..168: note = chr12:62580835-62581003
  misc_feature 1..168: note = hypo
  source 1..168: mol_type = genomic DNA

SEQ ID NO: 63940 - DNA, 22 bp, Homo sapiens
  misc_feature 1..22: note = chr12:62603703-62603725
  misc_feature 1..22: note = hypo
  source 1..22: mol_type = genomic DNA
aggcgcaggggctcacgcctgt

SEQ ID NO: 63941 - DNA, 40 bp, Homo sapiens; identical to SEQ ID NO: 43484
  misc_feature 1..40: note = chr12:62630994-62631034
  misc_feature 1..40: note = hypo
  source 1..40: mol_type = genomic DNA

SEQ ID NO: 63942 - DNA, 30 bp, Homo sapiens; identical to SEQ ID NO: 43485
  misc_feature 1..30: note = chr12:63788043-63788073
  misc_feature 1..30: note = hypo
  source 1..30: mol_type = genomic DNA

SEQ ID NO: 63943 - DNA, 40 bp, Homo sapiens
  misc_feature 1..40: note = chr12:64783308-64783348
  misc_feature 1..40: note = hypo
  source 1..40: mol_type = genomic DNA
tctgtagctcaggctggagtgcaggtggggcgatctcggc

SEQ ID NO: 63944 - DNA, 42 bp, Homo sapiens; identical to SEQ ID NO: 43487
  misc_feature 1..42: note = chr12:64797450-64797492
  misc_feature 1..42: note = hypo
  source 1..42: mol_type = genomic DNA

SEQ ID NO: 63945 - DNA, 20 bp, Homo sapiens
  misc_feature 1..20: note = chr12:64799707-64799727
  misc_feature 1..20: note = hypo
  source 1..20: mol_type = genomic DNA
ttgatcgtccaaatgccttc

SEQ ID NO: 63946 - DNA, 75 bp, Homo sapiens; identical to SEQ ID NO: 24937
  misc_feature 1..75: note = chr12:65516455-65516530
  misc_feature 1..75: note = hypo
  source 1..75: mol_type = genomic DNA

SEQ ID NO: 63947 - DNA, 29 bp, Homo sapiens
  misc_feature 1..29: note = chr12:65530856-65530885
  misc_feature 1..29: note = hypo
  source 1..29: mol_type = genomic DNA
ctagaaaaggccaggcgtggtggcctttt

SEQ ID NO: 63948 - DNA, 30 bp, Homo sapiens; identical to SEQ ID NO: 43493
  misc_feature 1..30: note = chr12:65787081-65787111
  misc_feature 1..30: note = hypo
  source 1..30: mol_type = genomic DNA

SEQ ID NO: 63949 - DNA, 44 bp, Homo sapiens; identical to SEQ ID NO: 43494
  misc_feature 1..44: note = chr12:66208320-66208364
  misc_feature 1..44: note = hypo
  source 1..44: mol_type = genomic DNA

SEQ ID NO: 63950 - DNA, 30 bp, Homo sapiens; identical to SEQ ID NO: 43495
  misc_feature 1..30: note = chr12:66211140-66211170
  misc_feature 1..30: note = hypo
  source 1..30: mol_type = genomic DNA

SEQ ID NO: 63951 - DNA, 22 bp, Homo sapiens
  misc_feature 1..22: note = chr12:66242342-66242364
  misc_feature 1..22: note = hypo
  source 1..22: mol_type = genomic DNA
ttaaaagtttaaggccgggtgc

SEQ ID NO: 63952 - DNA, 81 bp, Homo sapiens; identical to SEQ ID NO: 43497
  misc_feature 1..81: note = chr12:68978219-68978300
  misc_feature 1..81: note = hypo
  source 1..81: mol_type = genomic DNA

SEQ ID NO: 63953 - DNA, 21 bp, Homo sapiens
  misc_feature 1..21: note = chr12:68978600-68978621
  misc_feature 1..21: note = hypo
  source 1..21: mol_type = genomic DNA
tttttccgttttcactagaaa

SEQ ID NO: 63954 - DNA, 19 bp, Homo sapiens
  misc_feature 1..19: note = chr12:69751028-69751047
  misc_feature 1..19: note = hypo
  source 1..19: mol_type = genomic DNA
tttttgtttttgagacgga

SEQ ID NO: 63955 - DNA, 16 bp, Homo sapiens
  misc_feature 1..16: note = chr12:69754426-69754442
  misc_feature 1..16: note = hypo
  source 1..16: mol_type = genomic DNA
acacagcccctggcac

SEQ ID NO: 63956 - DNA, 26 bp, Homo sapiens
  misc_feature 1..26: note = chr12:69964264-69964290
  misc_feature 1..26: note = hypo
  source 1..26: mol_type = genomic DNA
ttgaaagtggtcgaaggtgtcaaact

SEQ ID NO: 63957 - DNA, 23 bp, Homo sapiens
  misc_feature 1..23: note = chr12:69999350-69999373
  misc_feature 1..23: note = hypo
  source 1..23: mol_type = genomic DNA
atcacaattactggccgggcgcg

SEQ ID NO: 63958 - DNA, 30 bp, Homo sapiens; identical to SEQ ID NO: 43504
  misc_feature 1..30: note = chr12:70024017-70024047
  misc_feature 1..30: note = hypo
  source 1..30: mol_type = genomic DNA

SEQ ID NO: 63959 - DNA, 179 bp, Homo sapiens
  misc_feature 1..179: note = chr12:70087568-70087747
  misc_feature 1..179: note = hypo
  source 1..179: mol_type = genomic DNA
gcgcccgtgctcgtcgcttccgtgaacactgctagagatgaggaacattagcctgtctggccagggcaaattcacaaactggttccaccatcggttcactaccagagtaacataaaaccctgtagaataacaggaaattataaagcagtttcttacagcagacacgttggtgacactga

SEQ ID NO: 63960 - DNA, 30 bp, Homo sapiens; identical to SEQ ID NO: 43506
  misc_feature 1..30: note = chr12:70173245-70173275
  misc_feature 1..30: note = hypo
  source 1..30: mol_type = genomic DNA

SEQ ID NO: 63961 - DNA, 137 bp, Homo sapiens; identical to SEQ ID NO: 43507
  misc_feature 1..137: note = chr12:71626492-71626629
  misc_feature 1..137: note = hypo
  source 1..137: mol_type = genomic DNA

SEQ ID NO: 63962 - DNA, 37 bp, Homo sapiens; identical to SEQ ID NO: 43508
  misc_feature 1..37: note = chr12:72054795-72054832
  misc_feature 1..37: note = hypo
  source 1..37: mol_type = genomic DNA

SEQ ID NO: 63963 - DNA, 30 bp, Homo sapiens; identical to SEQ ID NO: 43509
  misc_feature 1..30: note = chr12:72077720-72077750
  misc_feature 1..30: note = hypo
  source 1..30: mol_type = genomic DNA

SEQ ID NO: 63964 - DNA, 16 bp, Homo sapiens
  misc_feature 1..16: note = chr12:72634641-72634657
  misc_feature 1..16: note = hypo
  source 1..16: mol_type = genomic DNA
gcgcctggcctctcca

SEQ ID NO: 63965 - DNA, 20 bp, Homo sapiens
  misc_feature 1..20: note = chr12:73732468-73732488
  misc_feature 1..20: note = hypo
  source 1..20: mol_type = genomic DNA
gcgcccggccatttactggt

SEQ ID NO: 63966 - DNA, 30 bp, Homo sapiens; identical to SEQ ID NO: 43512
  misc_feature 1..30: note = chr12:74092079-74092109
  misc_feature 1..30: note = hypo
  source 1..30: mol_type = genomic DNA

SEQ ID NO: 63967 - DNA, 25 bp, Homo sapiens
  misc_feature 1..25: note = chr12:74930406-74930431
  misc_feature 1..25: note = hypo
  source 1..25: mol_type = genomic DNA
catgtaaggcactgtcgcaagattt

SEQ ID NO: 63968 - DNA, 43 bp, Homo sapiens; identical to SEQ ID NO: 43514
  misc_feature 1..43: note = chr12:77085862-77085905
  misc_feature 1..43: note = hypo
  source 1..43: mol_type = genomic DNA

SEQ ID NO: 63969 - DNA, 30 bp, Homo sapiens; identical to SEQ ID NO: 15677
  misc_feature 1..30: note = chr12:77150018-77150048
  misc_feature 1..30: note = hypo
  source 1..30: mol_type = genomic DNA

SEQ ID NO: 63970 - DNA, 30 bp, Homo sapiens; identical to SEQ ID NO: 43516
  misc_feature 1..30: note = chr12:79842607-79842637
  misc_feature 1..30: note = hypo
  source 1..30: mol_type = genomic DNA

SEQ ID NO: 63971 - DNA, 96 bp, Homo sapiens; identical to SEQ ID NO: 43517
  misc_feature 1..96: note = chr12:80488160-80488256
  misc_feature 1..96: note = hypo
  source 1..96: mol_type = genomic DNA

SEQ ID NO: 63972 - DNA, 30 bp, Homo sapiens; identical to SEQ ID NO: 43518
  misc_feature 1..30: note = chr12:89794228-89794258
  misc_feature 1..30: note = hypo
  source 1..30: mol_type = genomic DNA

SEQ ID NO: 63973 - DNA, 156 bp, Homo sapiens; identical to SEQ ID NO: 43519
  misc_feature 1..156: note = chr12:90313545-90313701
  misc_feature 1..156: note = hypo
  source 1..156: mol_type = genomic DNA

SEQ ID NO: 63974 - DNA, 33 bp, Homo sapiens; identical to SEQ ID NO: 43520
  misc_feature 1..33: note = chr12:93711081-93711114
  misc_feature 1..33: note = hypo
  source 1..33: mol_type = genomic DNA

SEQ ID NO: 63975 - DNA, 30 bp, Homo sapiens; identical to SEQ ID NO: 43521
  misc_feature 1..30: note = chr12:93797551-93797581
  misc_feature 1..30: note = hypo
  source 1..30: mol_type = genomic DNA

SEQ ID NO: 63976 - DNA, 30 bp, Homo sapiens; identical to SEQ ID NO: 15678
  misc_feature 1..30: note = chr12:94641622-94641652
  misc_feature 1..30: note = hypo
  source 1..30: mol_type = genomic DNA

SEQ ID NO: 63977 - DNA, 81 bp, Homo sapiens; identical to SEQ ID NO: 15679
  misc_feature 1..81: note = chr12:95465839-95465920
  misc_feature 1..81: note = hypo
  source 1..81: mol_type = genomic DNA

SEQ ID NO: 63978 - skipped

SEQ ID NO: 63979 - DNA, 30 bp, Homo sapiens; identical to SEQ ID NO: 43525
  misc_feature 1..30: note = chr12:97073402-97073432
  misc_feature 1..30: note = hypo
  source 1..30: mol_type = genomic DNA

SEQ ID NO: 63980 - DNA, 133 bp, Homo sapiens; identical to SEQ ID NO: 43526
  misc_feature 1..133: note = chr12:98763899-98764032
  misc_feature 1..133: note = hypo
  source 1..133: mol_type = genomic DNA

SEQ ID NO: 63981 - DNA, 38 bp, Homo sapiens; identical to SEQ ID NO: 43527
  misc_feature 1..38: note = chr12:98947863-98947901
  misc_feature 1..38: note = hypo
  source 1..38: mol_type = genomic DNA

SEQ ID NO: 63982 - DNA, 42 bp, Homo sapiens; identical to SEQ ID NO: 15681
  misc_feature 1..42: note = chr12:98948376-98948418
  misc_feature 1..42: note = hypo
  source 1..42: mol_type = genomic DNA

SEQ ID NO: 63983 - DNA, 24 bp, Homo sapiens
  misc_feature 1..24: note = chr12:98986204-98986228
  misc_feature 1..24: note = hypo
  source 1..24: mol_type = genomic DNA
ttaagaatttcaagccgggcatgg

SEQ ID NO: 63984 - DNA, 35 bp, Homo sapiens; identical to SEQ ID NO: 43530
  misc_feature 1..35: note = chr12:100595448-100595483
  misc_feature 1..35: note = hypo
  source 1..35: mol_type = genomic DNA

SEQ ID NO: 63985 - DNA, 30 bp, Homo sapiens; identical to SEQ ID NO: 43531
  misc_feature 1..30: note = chr12:101025517-101025547
  misc_feature 1..30: note = hypo
  source 1..30: mol_type = genomic DNA

SEQ ID NO: 63986 - DNA, 30 bp, Homo sapiens; identical to SEQ ID NO: 43532
  misc_feature 1..30: note = chr12:102158693-102158723
  misc_feature 1..30: note = hypo
  source 1..30: mol_type = genomic DNA

SEQ ID NO: 63987 - DNA, 30 bp, Homo sapiens; identical to SEQ ID NO: 15682
  misc_feature 1..30: note = chr12:104690709-104690739
  misc_feature 1..30: note = hypo
  source 1..30: mol_type = genomic DNA

SEQ ID NO: 63988 - DNA, 85 bp, Homo sapiens; identical to SEQ ID NO: 43534
  misc_feature 1..85: note = chr12:104695389-104695474
  misc_feature 1..85: note = hypo
  source 1..85: mol_type = genomic DNA

SEQ ID NO: 63989 - DNA, 102 bp, Homo sapiens; identical to SEQ ID NO: 43535
  misc_feature 1..102: note = chr12:104696536-104696638
  misc_feature 1..102: note = hypo
  source 1..102: mol_type = genomic DNA

SEQ ID NO: 63990 - DNA, 30 bp, Homo sapiens; identical to SEQ ID NO: 43536
  misc_feature 1..30: note = chr12:104698273-104698303
  misc_feature 1..30: note = hypo
  source 1..30: mol_type = genomic DNA

SEQ ID NO: 63991 - DNA, 30 bp, Homo sapiens; identical to SEQ ID NO: 43537
  misc_feature 1..30: note = chr12:104975785-104975815
  misc_feature 1..30: note = hypo
  source 1..30: mol_type = genomic DNA

SEQ ID NO: 63992 - DNA, 78 bp, Homo sapiens; identical to SEQ ID NO: 43538
  misc_feature 1..78: note = chr12:105018625-105018703
  misc_feature 1..78: note = hypo
  source 1..78: mol_type = genomic DNA

SEQ ID NO: 63993 - DNA, 30 bp, Homo sapiens; identical to SEQ ID NO: 43539
  misc_feature 1..30: note = chr12:105056939-105056969
  misc_feature 1..30: note = hypo
  source 1..30: mol_type = genomic DNA

SEQ ID NO: 63994 - DNA, 141 bp, Homo sapiens; identical to SEQ ID NO: 43540
  misc_feature 1..141: note = chr12:105069324-105069465
  misc_feature 1..141: note = hypo
  source 1..141: mol_type = genomic DNA

SEQ ID NO: 63995 - DNA, 30 bp, Homo sapiens; identical to SEQ ID NO: 43541
  misc_feature 1..30: note = chr12:105104162-105104192
  misc_feature 1..30: note = hypo
  source 1..30: mol_type = genomic DNA

SEQ ID NO: 63996 - DNA, 200 bp, Homo sapiens; identical to SEQ ID NO: 43542
  misc_feature 1..200: note = chr12:107138858-107139058
  misc_feature 1..200: note = hypo
  source 1..200: mol_type = genomic DNA

SEQ ID NO: 63997 - DNA, 158 bp, Homo sapiens; identical to SEQ ID NO: 43543
  misc_feature 1..158: note = chr12:108898965-108899123
  misc_feature 1..158: note = hypo
  source 1..158: mol_type = genomic DNA

SEQ ID NO: 63998 - DNA, 58 bp, Homo sapiens; identical to SEQ ID NO: 43544
  misc_feature 1..58: note = chr12:109208616-109208674
  misc_feature 1..58: note = hypo
  source 1..58: mol_type = genomic DNA

SEQ ID NO: 63999 - DNA, 30 bp, Homo sapiens; identical to SEQ ID NO: 43545
  misc_feature 1..30: note = chr12:109343659-109343689
  misc_feature 1..30: note = hypo
  source 1..30: mol_type = genomic DNA

SEQ ID NO: 64000 - DNA, 30 bp, Homo sapiens; identical to SEQ ID NO: 43546
  misc_feature 1..30: note = chr12:109719635-109719665
  misc_feature 1..30: note = hypo
  source 1..30: mol_type = genomic DNA

SEQ ID NO: 64001 - DNA, 37 bp, Homo sapiens; identical to SEQ ID NO: 43547
  misc_feature 1..37: note = chr12:110506967-110507004
  misc_feature 1..37: note = hypo
  source 1..37: mol_type = genomic DNA

SEQ ID NO: 64002 - DNA, 38 bp, Homo sapiens; identical to SEQ ID NO: 43548
  misc_feature 1..38: note = chr12:110563206-110563244
  misc_feature 1..38: note = hypo
  source 1..38: mol_type = genomic DNA

SEQ ID NO: 64003 - DNA, 89 bp, Homo sapiens
  misc_feature 1..89: note = chr12:110717710-110717799
  misc_feature 1..89: note = hypo
  source 1..89: mol_type = genomic DNA
taattttttgtttgtttgtttcgtgtagggttttgttggttcttttccaagtatcaatcaaaactacatgccaacgtccactccttgga

SEQ ID NO: 64004 - DNA, 30 bp, Homo sapiens; identical to SEQ ID NO: 15684
  misc_feature 1..30: note = chr12:110782730-110782760
  misc_feature 1..30: note = hypo
  source 1..30: mol_type = genomic DNA

SEQ ID NO: 64005 - DNA, 23 bp, Homo sapiens
  misc_feature 1..23: note = chr12:110840421-110840444
  misc_feature 1..23: note = hypo
  source 1..23: mol_type = genomic DNA
agccactacgcccggccaataaa

SEQ ID NO: 64006 - DNA, 39 bp, Homo sapiens; identical to SEQ ID NO: 43552
  misc_feature 1..39: note = chr12:110908132-110908171
  misc_feature 1..39: note = hypo
  source 1..39: mol_type = genomic DNA

SEQ ID NO: 64007 - DNA, 35 bp, Homo sapiens; identical to SEQ ID NO: 43553
  misc_feature 1..35: note = chr12:110915431-110915466
  misc_feature 1..35: note = hypo
  source 1..35: mol_type = genomic DNA

SEQ ID NO: 64008 - DNA, 30 bp, Homo sapiens; identical to SEQ ID NO: 15686
  misc_feature 1..30: note = chr12:111296630-111296660
  misc_feature 1..30: note = hypo
  source 1..30: mol_type = genomic DNA

SEQ ID NO: 64009 - DNA, 30 bp, Homo sapiens; identical to SEQ ID NO: 43555
  misc_feature 1..30: note = chr12:111355976-111356006
  misc_feature 1..30: note = hypo
  source 1..30: mol_type = genomic DNA

SEQ ID NO: 64010 - DNA, 224 bp, Homo sapiens; identical to SEQ ID NO: 43556
  misc_feature 1..224: note = chr12:111369069-111369293
  misc_feature 1..224: note = hypo
  source 1..224: mol_type = genomic DNA

SEQ ID NO: 64011 - DNA, 30 bp, Homo sapiens; identical to SEQ ID NO: 43557
  misc_feature 1..30: note = chr12:111535459-111535489
  misc_feature 1..30: note = hypo
  source 1..30: mol_type = genomic DNA

SEQ ID NO: 64012 - DNA, 23 bp, Homo sapiens
  misc_feature 1..23: note = chr12:112281623-112281646
  misc_feature 1..23: note = hypo
  source 1..23: mol_type = genomic DNA
tgtttgtttttgagacggagtct

SEQ ID NO: 64013 - DNA, 68 bp, Homo sapiens; identical to SEQ ID NO: 43560
  misc_feature 1..68: note = chr12:112605535-112605603
  misc_feature 1..68: note = hypo
  source 1..68: mol_type = genomic DNA

SEQ ID NO: 64014 - DNA, 91 bp, Homo sapiens; identical to SEQ ID NO: 43561
  misc_feature 1..91: note = chr12:112610355-112610446
  misc_feature 1..91: note = hypo
  source 1..91: mol_type = genomic DNA

SEQ ID NO: 64015 - DNA, 30 bp, Homo sapiens; identical to SEQ ID NO: 15688
  misc_feature 1..30: note = chr12:112628549-112628579
  misc_feature 1..30: note = hypo
  source 1..30: mol_type = genomic DNA

SEQ ID NO: 64016 - DNA, 30 bp, Homo sapiens; identical to SEQ ID NO: 43563
  misc_feature 1..30: note = chr12:112630855-112630885
  misc_feature 1..30: note = hypo
  source 1..30: mol_type = genomic DNA

SEQ ID NO: 64017 - DNA, 30 bp, Homo sapiens; identical to SEQ ID NO: 43564
  misc_feature 1..30: note = chr12:112820695-112820725
  misc_feature 1..30: note = hypo
  source 1..30: mol_type = genomic DNA

SEQ ID NO: 64018 - DNA, 152 bp, Homo sapiens; identical to SEQ ID NO: 43565
  misc_feature 1..152: note = chr12:112825982-112826134
  misc_feature 1..152: note = hypo
  source 1..152: mol_type = genomic DNA

SEQ ID NO: 64019 - DNA, 30 bp, Homo sapiens; identical to SEQ ID NO: 15690
  misc_feature 1..30: note = chr12:112919571-112919601
  misc_feature 1..30: note = hypo
  source 1..30: mol_type = genomic DNA

SEQ ID NO: 64020 - DNA, 36 bp, Homo sapiens; identical to SEQ ID NO: 43567
  misc_feature 1..36: note = chr12:113677751-113677787
  misc_feature 1..36: note = hypo
  source 1..36: mol_type = genomic DNA

SEQ ID NO: 64021 - DNA, 98 bp, Homo sapiens; identical to SEQ ID NO: 43568
  misc_feature 1..98: note = chr12:113725864-113725962
  misc_feature 1..98: note = hypo
  source 1..98: mol_type = genomic DNA

SEQ ID NO: 64022 - DNA, 36 bp, Homo sapiens; identical to SEQ ID NO: 43569
  misc_feature 1..36: note = chr12:113795723-113795759
  misc_feature 1..36: note = hypo
  source 1..36: mol_type = genomic DNA

SEQ ID NO: 64023 - DNA, 143 bp, Homo sapiens; identical to SEQ ID NO: 43570
  misc_feature 1..143: note = chr12:114130077-114130220
  misc_feature 1..143: note = hypo
  source 1..143: mol_type = genomic DNA

SEQ ID NO: 64024 - DNA, 49 bp, Homo sapiens; identical to SEQ ID NO: 43571
  misc_feature 1..49: note = chr12:114236483-114236532
  misc_feature 1..49: note = hypo
  source 1..49: mol_type = genomic DNA

SEQ ID NO: 64025 - DNA, 180 bp, Homo sapiens; identical to SEQ ID NO: 43572
  misc_feature 1..180: note = chr12:114240258-114240438
  misc_feature 1..180: note = hypo
  source 1..180: mol_type = genomic DNA

SEQ ID NO: 64026 - DNA, 30 bp, Homo sapiens; identical to SEQ ID NO: 43573
  misc_feature 1..30: note = chr12:114295503-114295533
  misc_feature 1..30: note = hypo
  source 1..30: mol_type = genomic DNA

SEQ ID NO: 64027 - DNA, 152 bp, Homo sapiens; identical to SEQ ID NO: 43574
  misc_feature 1..152: note = chr12:114329563-114329715
  misc_feature 1..152: note = hypo
  source 1..152: mol_type = genomic DNA

SEQ ID NO: 64028 - DNA, 49 bp, Homo sapiens; identical to SEQ ID NO: 43575
  misc_feature 1..49: note = chr12:114337939-114337988
  misc_feature 1..49: note = hypo
  source 1..49: mol_type = genomic DNA

SEQ ID NO: 64029 - DNA, 74 bp, Homo sapiens; identical to SEQ ID NO: 43576
  misc_feature 1..74: note = chr12:116756120-116756194
  misc_feature 1..74: note = hypo
  source 1..74: mol_type = genomic DNA

SEQ ID NO: 64030 - DNA, 59 bp, Homo sapiens; identical to SEQ ID NO: 43577
  misc_feature 1..59: note = chr12:116842266-116842325
  misc_feature 1..59: note = hypo
  source 1..59: mol_type = genomic DNA

SEQ ID NO: 64031 - DNA, 172 bp, Homo sapiens; identical to SEQ ID NO: 43578
  misc_feature 1..172: note = chr12:116941191-116941363
  misc_feature 1..172: note = hypo
  source 1..172: mol_type = genomic DNA

SEQ ID NO: 64032 - DNA, 30 bp, Homo sapiens; identical to SEQ ID NO: 43579
  misc_feature 1..30: note = chr12:117472788-117472818
  misc_feature 1..30: note = hypo
  source 1..30: mol_type = genomic DNA

SEQ ID NO: 64033 - DNA, 30 bp, Homo sapiens; identical to SEQ ID NO: 43580
  misc_feature 1..30: note = chr12:117473067-117473097
  misc_feature 1..30: note = hypo
  source 1..30: mol_type = genomic DNA

SEQ ID NO: 64034 - DNA, 78 bp, Homo sapiens
  misc_feature 1..78: note = chr12:117473987-117474065
  misc_feature 1..78: note = hypo
  source 1..78: mol_type = genomic DNA
gcctggggtggcacacgctgctgtctggtgtctactaggctctgccaggtgcttacaatgacaatgacagcacagagt

SEQ ID NO: 64035 - DNA, 198 bp, Homo sapiens; identical to SEQ ID NO: 43582
  misc_feature 1..198: note = chr12:117474577-117474775
  misc_feature 1..198: note = hypo
  source 1..198: mol_type = genomic DNA

SEQ ID NO: 64036 - DNA, 30 bp, Homo sapiens; identical to SEQ ID NO: 43583
  misc_feature 1..30: note = chr12:117484341-117484371
  misc_feature 1..30: note = hypo
  source 1..30: mol_type = genomic DNA

SEQ ID NO: 64037 - DNA, 347 bp, Homo sapiens; identical to SEQ ID NO: 43584
  misc_feature 1..347: note = chr12:117529912-117530259
  misc_feature 1..347: note = hypo
  source 1..347: mol_type = genomic DNA

SEQ ID NO: 64038 - DNA, 87 bp, Homo sapiens; identical to SEQ ID NO: 43585
  misc_feature 1..87: note = chr12:117530986-117531073
  misc_feature 1..87: note = hypo
  source 1..87: mol_type = genomic DNA

SEQ ID NO: 64039 - DNA, 151 bp, Homo sapiens; identical to SEQ ID NO: 43586
  misc_feature 1..151: note = chr12:117532401-117532552
  misc_feature 1..151: note = hypo
  source 1..151: mol_type = genomic DNA

SEQ ID NO: 64040 - DNA, 20 bp, Homo sapiens
  misc_feature 1..20: note = chr12:117533167-117533187
  misc_feature 1..20: note = hypo
  source 1..20: mol_type = genomic DNA
acgcccggcctagaccttac

SEQ ID NO: 64041 - DNA, 67 bp, Homo sapiens; identical to SEQ ID NO: 43588
  misc_feature 1..67: note = chr12:117544227-117544294
  misc_feature 1..67: note = hypo
  source 1..67: mol_type = genomic DNA

SEQ ID NO: 64042 - DNA, 60 bp, Homo sapiens; identical to SEQ ID NO: 43589
  misc_feature 1..60: note = chr12:117563240-117563300
  misc_feature 1..60: note = hypo
  source 1..60: mol_type = genomic DNA

SEQ ID NO: 64043 - DNA, 38 bp, Homo sapiens; identical to SEQ ID NO: 43590
  misc_feature 1..38: note = chr12:118177130-118177168
  misc_feature 1..38: note = hypo
  source 1..38: mol_type = genomic DNA

SEQ ID NO: 64044 - DNA, 37 bp, Homo sapiens; identical to SEQ ID NO: 43591
  misc_feature 1..37: note = chr12:118198752-118198789
  misc_feature 1..37: note = hypo
  source 1..37: mol_type = genomic DNA

SEQ ID NO: 64045 - DNA, 87 bp, Homo sapiens; identical to SEQ ID NO: 43593
  misc_feature 1..87: note = chr12:120148309-120148396
  misc_feature 1..87: note = hypo
  source 1..87: mol_type = genomic DNA

SEQ ID NO: 64046 - DNA, 30 bp, Homo sapiens; identical to SEQ ID NO: 43594
  misc_feature 1..30: note = chr12:120152067-120152097
  misc_feature 1..30: note = hypo
  source 1..30: mol_type = genomic DNA

SEQ ID NO: 64047 - DNA, 30 bp, Homo sapiens; identical to SEQ ID NO: 15699
  misc_feature 1..30: note = chr12:120574326-120574356
  misc_feature 1..30: note = hypo
  source 1..30: mol_type = genomic DNA

SEQ ID NO: 64048 - DNA, 63 bp, Homo sapiens; identical to SEQ ID NO: 43596
  misc_feature 1..63: note = chr12:120580446-120580509
  misc_feature 1..63: note = hypo
  source 1..63: mol_type = genomic DNA

SEQ ID NO: 64049 - DNA, 30 bp, Homo sapiens; identical to SEQ ID NO: 43597
  misc_feature 1..30: note = chr12:120740933-120740963
  misc_feature 1..30: note = hypo
  source 1..30: mol_type = genomic DNA

SEQ ID NO: 64050 - DNA, 42 bp, Homo sapiens; identical to SEQ ID NO: 43598
  misc_feature 1..42: note = chr12:120932999-120933041
  misc_feature 1..42: note = hypo
  source 1..42: mol_type = genomic DNA

SEQ ID NO: 64051 - DNA, 155 bp, Homo sapiens; identical to SEQ ID NO: 43599
  misc_feature 1..155: note = chr12:121366974-121367129
  misc_feature 1..155: note = hypo
  source 1..155: mol_type = genomic DNA

SEQ ID NO: 64052 - DNA, 30 bp, Homo sapiens; identical to SEQ ID NO: 43600
  misc_feature 1..30: note = chr12:121641645-121641675
  misc_feature 1..30: note = hypo
  source 1..30: mol_type = genomic DNA

SEQ ID NO: 64053 - DNA, 30 bp, Homo sapiens; identical to SEQ ID NO: 43601
  misc_feature 1..30: note = chr12:121688301-121688331
  misc_feature 1..30: note = hypo
  source 1..30: mol_type = genomic DNA

SEQ ID NO: 64054 - DNA, 82 bp, Homo sapiens; identical to SEQ ID NO: 43602
  misc_feature 1..82: note = chr12:122107201-122107283
  misc_feature 1..82: note = hypo
  source 1..82: mol_type = genomic DNA

SEQ ID NO: 64055 - DNA, 46 bp, Homo sapiens; identical to SEQ ID NO: 15700
  misc_feature 1..46: note = chr12:122141060-122141106
  misc_feature 1..46: note = hypo
  source 1..46: mol_type = genomic DNA

SEQ ID NO: 64056 - DNA, 104 bp, Homo sapiens; identical to SEQ ID NO: 43604
  misc_feature 1..104: note = chr12:122204974-122205078
  misc_feature 1..104: note = hypo
  source 1..104: mol_type = genomic DNA

SEQ ID NO: 64057 - DNA, 85 bp, Homo sapiens; identical to SEQ ID NO: 43605
  misc_feature 1..85: note = chr12:122213608-122213693
  misc_feature 1..85: note = hypo
  source 1..85: mol_type = genomic DNA

SEQ ID NO: 64058 - DNA, 166 bp, Homo sapiens; identical to SEQ ID NO: 43606
  misc_feature 1..166: note = chr12:122281163-122281329
  misc_feature 1..166: note = hypo
  source 1..166: mol_type = genomic DNA

SEQ ID NO: 64059 - DNA, 40 bp, Homo sapiens; identical to SEQ ID NO: 24966
  misc_feature 1..40: note = chr12:122285027-122285067
  misc_feature 1..40: note = hypo
  source 1..40: mol_type = genomic DNA

SEQ ID NO: 64060 - DNA, 30 bp, Homo sapiens; identical to SEQ ID NO: 15703
  misc_feature 1..30: note = chr12:122292767-122292797
  misc_feature 1..30: note = hypo
  source 1..30: mol_type = genomic DNA

SEQ ID NO: 64061 - DNA, 112 bp, Homo sapiens; identical to SEQ ID NO: 43609
  misc_feature 1..112: note = chr12:122439399-122439511
  misc_feature 1..112: note = hypo
  source 1..112: mol_type = genomic DNA

SEQ ID NO: 64062 - DNA, 53 bp, Homo sapiens; identical to SEQ ID NO: 43610
  misc_feature 1..53: note = chr12:122458643-122458696
  misc_feature 1..53: note = hypo
  source 1..53: mol_type = genomic DNA

SEQ ID NO: 64063 - DNA, 30 bp, Homo sapiens; identical to SEQ ID NO: 43611
  misc_feature 1..30: note = chr12:122591572-122591602
  misc_feature 1..30: note = hypo
  source 1..30: mol_type = genomic DNA

SEQ ID NO: 64064 - DNA, 50 bp, Homo sapiens; identical to SEQ ID NO: 43612
  misc_feature 1..50: note = chr12:122602863-122602913
  misc_feature 1..50: note = hypo
  source 1..50: mol_type = genomic DNA

SEQ ID NO: 64065 - DNA, 30 bp, Homo sapiens; identical to SEQ ID NO: 15707
  misc_feature 1..30: note = chr12:122622042-122622072
  misc_feature 1..30: note = hypo
  source 1..30: mol_type = genomic DNA

SEQ ID NO: 64066 - DNA, 41 bp, Homo sapiens; identical to SEQ ID NO: 43614
  misc_feature 1..41: note = chr12:122622344-122622385
  misc_feature 1..41: note = hypo
  source 1..41: mol_type = genomic DNA

SEQ ID NO: 64067 - DNA, 89 bp, Homo sapiens; identical to SEQ ID NO: 43615
  misc_feature 1..89: note = chr12:122623990-122624079
  misc_feature 1..89: note = hypo
  source 1..89: mol_type = genomic DNA

SEQ ID NO: 64068 - DNA, 30 bp, Homo sapiens; identical to SEQ ID NO: 43616
  misc_feature 1..30: note = chr12:122691182-122691212
  misc_feature 1..30: note = hypo
  source 1..30: mol_type = genomic DNA

SEQ ID NO: 64069 - DNA, 201 bp, Homo sapiens
  misc_feature 1..201: note = chr12:123128928-123129129
  misc_feature 1..201: note = hypo
  source 1..201: mol_type = genomic DNA
ggagccagaaaggagatggttttcttcgggagtcgggcggcttcttcgcagcccgggctctcctccgactgcccaggccaaactccgcctcattcccccagtcaatggcctgatggcctgtaggcatgccagtgtctgactatgtgctcttccgccagcgtgctaccctcgatgtcctctcgatgtccagccacctgtgtc

SEQ ID NO: 64070 - DNA, 41 bp, Homo sapiens; identical to SEQ ID NO: 43618
  misc_feature 1..41: note = chr12:123333308-123333349
  misc_feature 1..41: note = hypo
  source 1..41: mol_type = genomic DNA

SEQ ID NO: 64071 - DNA, 38 bp, Homo sapiens; identical to SEQ ID NO: 43619
  misc_feature 1..38: note = chr12:123881693-123881731
  misc_feature 1..38: note = hypo
  source 1..38: mol_type = genomic DNA

SEQ ID NO: 64072 - DNA, 30 bp, Homo sapiens; identical to SEQ ID NO: 43621
  misc_feature 1..30: note = chr12:124284067-124284097
  misc_feature 1..30: note = hypo
  source 1..30: mol_type = genomic DNA

SEQ ID NO: 64073 - DNA, 92 bp, Homo sapiens; identical to SEQ ID NO: 43624
  misc_feature 1..92: note = chr12:124404180-124404272
  misc_feature 1..92: note = hypo
  source 1..92: mol_type = genomic DNA

SEQ ID NO: 64074 - DNA, 47 bp, Homo sapiens; identical to SEQ ID NO: 43625
  misc_feature 1..47: note = chr12:124651773-124651820
  misc_feature 1..47: note = hypo
  source 1..47: mol_type = genomic DNA

SEQ ID NO: 64075 - DNA, 207 bp, Homo sapiens; identical to SEQ ID NO: 43626
  misc_feature 1..207: note = chr12:124716795-124717002
  misc_feature 1..207: note = hypo
  source 1..207: mol_type = genomic DNA

SEQ ID NO: 64076 - DNA, 173 bp, Homo sapiens; identical to SEQ ID NO: 15711
  misc_feature 1..173: note = chr12:124778198-124778371
  misc_feature 1..173: note = hypo
  source 1..173: mol_type = genomic DNA

SEQ ID NO: 64077 - DNA, 30 bp, Homo sapiens; identical to SEQ ID NO: 43628
  misc_feature 1..30: note = chr12:124782655-124782685
  misc_feature 1..30: note = hypo
  source 1..30: mol_type = genomic DNA

SEQ ID NO: 64078 - DNA, 223 bp, Homo sapiens; identical to SEQ ID NO: 43629
  misc_feature 1..223: note = chr12:124788775-124788998
  misc_feature 1..223: note = hypo
  source 1..223: mol_type = genomic DNA

SEQ ID NO: 64079 - DNA, 33 bp, Homo sapiens; identical to SEQ ID NO: 43630
  misc_feature 1..33: note = chr12:124843830-124843863
  misc_feature 1..33: note = hypo
  source 1..33: mol_type = genomic DNA

SEQ ID NO: 64080 - DNA, 129 bp, Homo sapiens; identical to SEQ ID NO: 43631
  misc_feature 1..129: note = chr12:124869876-124870005
  misc_feature 1..129: note = hypo
  source 1..129: mol_type = genomic DNA

SEQ ID NO: 64081 - DNA, 60 bp, Homo sapiens; identical to SEQ ID NO: 43632
  misc_feature 1..60: note = chr12:124893479-124893539
  misc_feature 1..60: note = hypo
  source 1..60: mol_type = genomic DNA

SEQ ID NO: 64082 - DNA, 45 bp, Homo sapiens; identical to SEQ ID NO: 43633
  misc_feature 1..45: note = chr12:124989304-124989349
  misc_feature 1..45: note = hypo
  source 1..45: mol_type = genomic DNA

SEQ ID NO: 64083 - DNA, 54 bp, Homo sapiens; identical to SEQ ID NO: 15714
  misc_feature 1..54: note = chr12:125009346-125009400
  misc_feature 1..54: note = hypo
  source 1..54: mol_type = genomic DNA

SEQ ID NO: 64084 - DNA, 70 bp, Homo sapiens; identical to SEQ ID NO: 43635
  misc_feature 1..70: note = chr12:125092426-125092496
  misc_feature 1..70: note = hypo
  source 1..70: mol_type = genomic DNA

SEQ ID NO: 64085 - DNA, 33 bp, Homo sapiens; identical to SEQ ID NO: 15716
  misc_feature 1..33: note = chr12:125102143-125102176
  misc_feature 1..33: note = hypo
  source 1..33: mol_type = genomic DNA

SEQ ID NO: 64086 - DNA, 40 bp, Homo sapiens; identical to SEQ ID NO: 43637
  misc_feature 1..40: note = chr12:125102525-125102565
  misc_feature 1..40: note = hypo
  source 1..40: mol_type = genomic DNA

SEQ ID NO: 64087 - DNA, 65 bp, Homo sapiens; identical to SEQ ID NO: 43638
  misc_feature 1..65: note = chr12:125102819-125102884
  misc_feature 1..65: note = hypo
  source 1..65: mol_type = genomic DNA

SEQ ID NO: 64088 - DNA, 58 bp, Homo sapiens; identical to SEQ ID NO: 43639
  misc_feature 1..58: note = chr12:125119323-125119381
  misc_feature 1..58: note = hypo
  source 1..58: mol_type = genomic DNA

SEQ ID NO: 64089 - DNA, 146 bp, Homo sapiens; identical to SEQ ID NO: 43640
  misc_feature 1..146: note = chr12:125152108-125152254
  misc_feature 1..146: note = hypo
  source 1..146: mol_type = genomic DNA

SEQ ID NO: 64090 - DNA, 30 bp, Homo sapiens; identical to SEQ ID NO: 15719
  misc_feature 1..30: note = chr12:125167715-125167745
  misc_feature 1..30: note = hypo
  source 1..30: mol_type = genomic DNA

SEQ ID NO: 64091 - DNA, 30 bp, Homo sapiens; identical to SEQ ID NO: 43642
  misc_feature 1..30: note = chr12:125200849-125200879
  misc_feature 1..30: note = hypo
  source 1..30: mol_type = genomic DNA

SEQ ID NO: 64092 - DNA, 188 bp, Homo sapiens; identical to SEQ ID NO: 43643
  misc_feature 1..188: note = chr12:125565948-125566136
  misc_feature 1..188: note = hypo
  source 1..188: mol_type = genomic DNA

SEQ ID NO: 64093 - DNA, 30 bp, Homo sapiens; identical to SEQ ID NO: 43644
  misc_feature 1..30: note = chr12:125578422-125578452
  misc_feature 1..30: note = hypo
  source 1..30: mol_type = genomic DNA

SEQ ID NO: 64094 - DNA, 186 bp, Homo sapiens; identical to SEQ ID NO: 43645
  misc_feature 1..186: note = chr12:125813536-125813722
  misc_feature 1..186: note = hypo
  source 1..186: mol_type = genomic DNA

SEQ ID NO: 64095 - DNA, 34 bp, Homo sapiens; identical to SEQ ID NO: 43646
  misc_feature 1..34: note = chr12:125977301-125977335
  misc_feature 1..34: note = hypo
  source 1..34: mol_type = genomic DNA

SEQ ID NO: 64096 - DNA, 29 bp, Homo sapiens
  misc_feature 1..29: note = chr12:126243099-126243128
  misc_feature 1..29: note = hypo
  source 1..29: mol_type = genomic DNA
tgagccaccgcgcccggctgatgattgtg

SEQ ID NO: 64097 - DNA, 43 bp, Homo sapiens; identical to SEQ ID NO: 43648
  misc_feature 1..43: note = chr12:127051899-127051942
  misc_feature 1..43: note = hypo
  source 1..43: mol_type = genomic DNA

SEQ ID NO: 64098 - DNA, 40 bp, Homo sapiens; identical to SEQ ID NO: 43649
  misc_feature 1..40: note = chr12:128310415-128310455
  misc_feature 1..40: note = hypo
  source 1..40: mol_type = genomic DNA

SEQ ID NO: 64099 - DNA, 35 bp, Homo sapiens; identical to SEQ ID NO: 15721
  misc_feature 1..35: note = chr12:128311016-128311051
  misc_feature 1..35: note = hypo
  source 1..35: mol_type = genomic DNA

SEQ ID NO: 64100 - DNA, 166 bp, Homo sapiens; identical to SEQ ID NO: 43651
  misc_feature 1..166: note = chr12:128899701-128899867
  misc_feature 1..166: note = hypo
  source 1..166: mol_type = genomic DNA

SEQ ID NO: 64101 - DNA, 193 bp, Homo sapiens; identical to SEQ ID NO: 43652
  misc_feature 1..193: note = chr12:128964823-128965016
  misc_feature 1..193: note = hypo
  source 1..193: mol_type = genomic DNA

SEQ ID NO: 64102 - DNA, 30 bp, Homo sapiens; identical to SEQ ID NO: 43653
  misc_feature 1..30: note = chr12:129028675-129028705
  misc_feature 1..30: note = hypo
  source 1..30: mol_type = genomic DNA

SEQ ID NO: 64103 - DNA, 30 bp, Homo sapiens; identical to SEQ ID NO: 43654
  misc_feature 1..30: note = chr12:129441934-129441964
  misc_feature 1..30: note = hypo
  source 1..30: mol_type = genomic DNA

SEQ ID NO: 64104 - DNA, 120 bp, Homo sapiens; identical to SEQ ID NO: 43655
  misc_feature 1..120: note = chr12:129520220-129520340
  misc_feature 1..120: note = hypo
  source 1..120: mol_type = genomic DNA

SEQ ID NO: 64105 - DNA, 48 bp, Homo sapiens
  misc_feature 1..48: note = chr12:130037778-130037826
  misc_feature 1..48: note = hypo
  source 1..48: mol_type = genomic DNA
cactctgccacagtggcccgtggtccctggctgcgtgagtccatcctg

SEQ ID NO: 64106 - DNA, 30 bp, Homo sapiens; identical to SEQ ID NO: 43657
  misc_feature 1..30: note = chr12:130216152-130216182
  misc_feature 1..30: note = hypo
  source 1..30: mol_type = genomic DNA

SEQ ID NO: 64107 - DNA, 30 bp, Homo sapiens; identical to SEQ ID NO: 43658
  misc_feature 1..30: note = chr12:130308451-130308481
  misc_feature 1..30: note = hypo
  source 1..30: mol_type = genomic DNA

SEQ ID NO: 64108 - DNA, 65 bp, Homo sapiens; identical to SEQ ID NO: 43659
  misc_feature 1..65: note = chr12:130325114-130325179
  misc_feature 1..65: note = hypo
  source 1..65: mol_type = genomic DNA

SEQ ID NO: 64109 - DNA, 51 bp, Homo sapiens; identical to SEQ ID NO: 24986
  misc_feature 1..51: note = chr12:130821621-130821672
  misc_feature 1..51: note = hypo
  source 1..51: mol_type = genomic DNA

SEQ ID NO: 64110 - DNA, 106 bp, Homo sapiens; identical to SEQ ID NO: 43661
  misc_feature 1..106: note = chr12:130918507-130918613
  misc_feature 1..106: note = hypo
  source 1..106: mol_type = genomic DNA

SEQ ID NO: 64111 - DNA, 86 bp, Homo sapiens; identical to SEQ ID NO: 43662
  misc_feature 1..86: note = chr12:130920592-130920678
  misc_feature 1..86: note = hypo
  source 1..86: mol_type = genomic DNA

SEQ ID NO: 64112 - DNA, 30 bp, Homo sapiens; identical to SEQ ID NO: 43663
  misc_feature 1..30: note = chr12:130947254-130947284
  misc_feature 1..30: note = hypo
  source 1..30: mol_type = genomic DNA

SEQ ID NO: 64113 - DNA, 39 bp, Homo sapiens; identical to SEQ ID NO: 43664
  misc_feature 1..39: note = chr12:131077323-131077362
  misc_feature 1..39: note = hypo
  source 1..39: mol_type = genomic DNA

SEQ ID NO: 64114 - DNA, 30 bp, Homo sapiens; identical to SEQ ID NO: 43665
  misc_feature 1..30: note = chr12:131159790-131159820
  misc_feature 1..30: note = hypo
  source 1..30: mol_type = genomic DNA

SEQ ID NO: 64115 - DNA, 30 bp, Homo sapiens; identical to SEQ ID NO: 43666
  misc_feature 1..30: note = chr12:131229952-131229982
  misc_feature 1..30: note = hypo
  source 1..30: mol_type = genomic DNA

SEQ ID NO: 64116 - DNA, 123 bp, Homo sapiens; identical to SEQ ID NO: 43667
  misc_feature 1..123: note = chr12:131268359-131268482
  misc_feature 1..123: note = hypo
  source 1..123: mol_type = genomic DNA

SEQ ID NO: 64117 - DNA, 56 bp, Homo sapiens; identical to SEQ ID NO: 43668
  misc_feature 1..56: note = chr12:131271976-131272032
  misc_feature 1..56: note = hypo
  source 1..56: mol_type = genomic DNA

SEQ ID NO: 64118 - DNA, 30 bp, Homo sapiens; identical to SEQ ID NO: 43669
  misc_feature 1..30: note = chr12:131335293-131335323
  misc_feature 1..30: note = hypo
  source 1..30: mol_type = genomic DNA

SEQ ID NO: 64119 - DNA, 166 bp, Homo sapiens; identical to SEQ ID NO: 43670
  misc_feature 1..166: note = chr12:131383570-131383736
  misc_feature 1..166: note = hypo
  source 1..166: mol_type = genomic DNA

SEQ ID NO: 64120 - DNA, 30 bp, Homo sapiens; identical to SEQ ID NO: 43671
  misc_feature 1..30: note = chr12:131387248-131387278
  misc_feature 1..30: note = hypo
  source 1..30: mol_type = genomic DNA

SEQ ID NO: 64121 - DNA, 34 bp, Homo sapiens; identical to SEQ ID NO: 43672
  misc_feature 1..34: note = chr12:131389290-131389324
  misc_feature 1..34: note = hypo
  source 1..34: mol_type = genomic DNA

SEQ ID NO: 64122 - DNA, 30 bp, Homo sapiens; identical to SEQ ID NO: 43673
  misc_feature 1..30: note = chr12:131402594-131402624
  misc_feature 1..30: note = hypo
  source 1..30: mol_type = genomic DNA

SEQ ID NO: 64123 - DNA, 263 bp, Homo sapiens; identical to SEQ ID NO: 43674
  misc_feature 1..263: note = chr12:131433182-131433445
  misc_feature 1..263: note = hypo
  source 1..263: mol_type = genomic DNA

SEQ ID NO: 64124 - DNA, 53 bp, Homo sapiens; identical to SEQ ID NO: 43675
  misc_feature 1..53: note = chr12:131500873-131500926
  misc_feature 1..53: note = hypo
  source 1..53: mol_type = genomic DNA

SEQ ID NO: 64125 - DNA, 30 bp, Homo sapiens; identical to SEQ ID NO: 43676
  misc_feature 1..30: note = chr12:131513475-131513505
  misc_feature 1..30: note = hypo
  source 1..30: mol_type = genomic DNA

SEQ ID NO: 64126 - DNA, 53 bp, Homo sapiens; identical to SEQ ID NO: 43677
  misc_feature 1..53: note = chr12:131535504-131535557
  misc_feature 1..53: note = hypo
  source 1..53: mol_type = genomic DNA

SEQ ID NO: 64127 - DNA, 27 bp, Homo sapiens
  misc_feature 1..27: note = chr12:131547329-131547356
  misc_feature 1..27: note = hypo
  source 1..27: mol_type = genomic DNA
atacaagggtcacgtggtaaatatatt

SEQ ID NO: 64128 - DNA, 30 bp, Homo sapiens; identical to SEQ ID NO: 43679
  misc_feature 1..30: note = chr12:131569185-131569215
  misc_feature 1..30: note = hypo
  source 1..30: mol_type = genomic DNA

SEQ ID NO: 64129 - DNA, 75 bp, Homo sapiens; identical to SEQ ID NO: 43680
  misc_feature 1..75: note = chr12:131615224-131615299
  misc_feature 1..75: note = hypo
  source 1..75: mol_type = genomic DNA

SEQ ID NO: 64130 - DNA, 190 bp, Homo sapiens; identical to SEQ ID NO: 43681
  misc_feature 1..190: note = chr12:131619032-131619222
  misc_feature 1..190: note = hypo
  source 1..190: mol_type = genomic DNA

SEQ ID NO: 64131 - DNA, 61 bp, Homo sapiens; identical to SEQ ID NO: 43682
  misc_feature 1..61: note = chr12:131623336-131623397
  misc_feature 1..61: note = hypo
  source 1..61: mol_type = genomic DNA

SEQ ID NO: 64132 - DNA, 30 bp, Homo sapiens; identical to SEQ ID NO: 43683
  misc_feature 1..30: note = chr12:131624881-131624911
  misc_feature 1..30: note = hypo
  source 1..30: mol_type = genomic DNA

SEQ ID NO: 64133 - DNA, 42 bp, Homo sapiens; identical to SEQ ID NO: 43684
  misc_feature 1..42: note = chr12:131687270-131687312
  misc_feature 1..42: note = hypo
  source 1..42: mol_type = genomic DNA

SEQ ID NO: 64134 - DNA, 87 bp, Homo sapiens; identical to SEQ ID NO: 43685
  misc_feature 1..87: note = chr12:131725445-131725532
  misc_feature 1..87: note = hypo
  source 1..87: mol_type = genomic DNA

SEQ ID NO: 64135 - DNA, 33 bp, Homo sapiens; identical to SEQ ID NO: 43686
  misc_feature 1..33: note = chr12:131767017-131767050
  misc_feature 1..33: note = hypo
  source 1..33: mol_type = genomic DNA

SEQ ID NO: 64136 - DNA, 39 bp, Homo sapiens; identical to SEQ ID NO: 43687
  misc_feature 1..39: note = chr12:131768368-131768407
  misc_feature 1..39: note = hypo
  source 1..39: mol_type = genomic DNA

SEQ ID NO: 64137 - DNA, 30 bp, Homo sapiens; identical to SEQ ID NO: 43688
  misc_feature 1..30: note = chr12:131769387-131769417
  misc_feature 1..30: note = hypo
  source 1..30: mol_type = genomic DNA

SEQ ID NO: 64138 - DNA, 37 bp, Homo sapiens; identical to SEQ ID NO: 43689
  misc_feature 1..37: note = chr12:131772177-131772214
  misc_feature 1..37: note = hypo
  source 1..37: mol_type = genomic DNA

SEQ ID NO: 64139 - DNA, 30 bp, Homo sapiens; identical to SEQ ID NO: 43690
  misc_feature 1..30: note = chr12:131834216-131834246
  misc_feature 1..30: note = hypo
  source 1..30: mol_type = genomic DNA

SEQ ID NO: 64140 - DNA, 30 bp, Homo sapiens; identical to SEQ ID NO: 43691
  misc_feature 1..30: note = chr12:131850690-131850720
  misc_feature 1..30: note = hypo
  source 1..30: mol_type = genomic DNA

SEQ ID NO: 64141 - DNA, 30 bp, Homo sapiens; identical to SEQ ID NO: 43692
  misc_feature 1..30: note = chr12:131852434-131852464
  misc_feature 1..30: note = hypo
  source 1..30: mol_type = genomic DNA

SEQ ID NO: 64142 - DNA, 62 bp, Homo sapiens; identical to SEQ ID NO: 43693
  misc_feature 1..62: note = chr12:131928846-131928908
  misc_feature 1..62: note = hypo
  source 1..62: mol_type = genomic DNA

SEQ ID NO: 64143 - DNA, 122 bp, Homo sapiens; identical to SEQ ID NO: 43694
  misc_feature 1..122: note = chr12:131979037-131979159
  misc_feature 1..122: note = hypo
  source 1..122: mol_type = genomic DNA

SEQ ID NO: 64144 - DNA, 197 bp, Homo sapiens; identical to SEQ ID NO: 43695
  misc_feature 1..197: note = chr12:132044061-132044258
  misc_feature 1..197: note = hypo
  source 1..197: mol_type = genomic DNA

SEQ ID NO: 64145 - DNA, 30 bp, Homo sapiens; identical to SEQ ID NO: 43696
  misc_feature 1..30: note = chr12:132068982-132069012
  misc_feature 1..30: note = hypo
  source 1..30: mol_type = genomic DNA

SEQ ID NO: 64146 - DNA, 300 bp, Homo sapiens; identical to SEQ ID NO: 43697
  misc_feature 1..300: note = chr12:132076528-132076828
  misc_feature 1..300: note = hypo
  source 1..300: mol_type = genomic DNA

SEQ ID NO: 64147 - DNA, 157 bp, Homo sapiens; identical to SEQ ID NO: 43698
  misc_feature 1..157: note = chr12:132106066-132106223
  misc_feature 1..157: note = hypo
  source 1..157: mol_type = genomic DNA

SEQ ID NO: 64148 - DNA, 80 bp, Homo sapiens; identical to SEQ ID NO: 43699
  misc_feature 1..80: note = chr12:132168266-132168346
  misc_feature 1..80: note = hypo
  source 1..80: mol_type = genomic DNA

SEQ ID NO: 64149 - DNA, 34 bp, Homo sapiens; identical to SEQ ID NO: 43700
  misc_feature 1..34: note = chr12:132171651-132171685
  misc_feature 1..34: note = hypo
  source 1..34: mol_type = genomic DNA

SEQ ID NO: 64150 - DNA, 87 bp, Homo sapiens; identical to SEQ ID NO: 24993
  misc_feature 1..87: note = chr12:132221602-132221689
  misc_feature 1..87: note = hypo
  source 1..87: mol_type = genomic DNA

SEQ ID NO: 64151 - DNA, 48 bp, Homo sapiens; identical to SEQ ID NO: 24994
  misc_feature 1..48: note = chr12:132222076-132222124
  misc_feature 1..48: note = hypo
  source 1..48: mol_type = genomic DNA

SEQ ID NO: 64152 - DNA, 62 bp, Homo sapiens; identical to SEQ ID NO: 43702
  misc_feature 1..62: note = chr12:132240207-132240269
  misc_feature 1..62: note = hypo
  source 1..62: mol_type = genomic DNA

SEQ ID NO: 64153 - DNA, 21 bp, Homo sapiens
  misc_feature 1..21: note = chr12:132244054-132244075
  misc_feature 1..21: note = hypo
  source 1..21: mol_type = genomic DNA
aaatagtaggccgggcgcggt

SEQ ID NO: 64154 - DNA, 30 bp, Homo sapiens; identical to SEQ ID NO: 43704
  misc_feature 1..30: note = chr12:132279981-132280011
  misc_feature 1..30: note = hypo
  source 1..30: mol_type = genomic DNA

SEQ ID NO: 64155 - DNA, 133 bp, Homo sapiens; identical to SEQ ID NO: 15732
  misc_feature 1..133: note = chr12:132280877-132281010
  misc_feature 1..133: note = hypo
  source 1..133: mol_type = genomic DNA

SEQ ID NO: 64156 - DNA, 82 bp, Homo sapiens; identical to SEQ ID NO: 43706
  misc_feature 1..82: note = chr12:132284411-132284493
  misc_feature 1..82: note = hypo
  source 1..82: mol_type = genomic DNA

SEQ ID NO: 64157 - DNA, 104 bp, Homo sapiens; identical to SEQ ID NO: 43707
  misc_feature 1..104: note = chr12:132325069-132325173
  misc_feature 1..104: note = hypo
  source 1..104: mol_type = genomic DNA

SEQ ID NO: 64158 - DNA, 84 bp, Homo sapiens; identical to SEQ ID NO: 43708
  misc_feature 1..84: note = chr12:132329560-132329644
  misc_feature 1..84: note = hypo
  source 1..84: mol_type = genomic DNA

SEQ ID NO: 64159 - DNA, 166 bp, Homo sapiens; identical to SEQ ID NO: 43709
  misc_feature 1..166: note = chr12:132329877-132330043
  misc_feature 1..166: note = hypo
  source 1..166: mol_type = genomic DNA

SEQ ID NO: 64160 - DNA, 36 bp, Homo sapiens
  misc_feature 1..36: note = chr12:132333398-132333434
  misc_feature 1..36: note = hypo
  source 1..36: mol_type = genomic DNA
ggacgctgctatgagcgtgagtgtgcaaacgtctct

SEQ ID NO: 64161 - DNA, 70 bp, Homo sapiens
  misc_feature 1..70: note = chr12:132333597-132333667
  misc_feature 1..70: note = hypo
  source 1..70: mol_type = genomic DNA
catatcctcccgacacaggtgactttccacgttcttgacagtgggggcgagggggcgtctcattgtggtt

SEQ ID NO: 64162 - DNA, 80 bp, Homo sapiens; identical to SEQ ID NO: 43712
  misc_feature 1..80: note = chr12:132335471-132335551
  misc_feature 1..80: note = hypo
  source 1..80: mol_type = genomic DNA

SEQ ID NO: 64163 - DNA, 62 bp, Homo sapiens
  misc_feature 1..62: note = chr12:132348589-132348651
  misc_feature 1..62: note = hypo
  source 1..62: mol_type = genomic DNA
accctggctgtctgtcgggcagccccggcgaggagttgagtccccttaccgctgcgaatgag

SEQ ID NO: 64164 - DNA, 42 bp, Homo sapiens; identical to SEQ ID NO: 43714
  misc_feature 1..42: note = chr12:132349937-132349979
  misc_feature 1..42: note = hypo
  source 1..42: mol_type = genomic DNA

SEQ ID NO: 64165 - DNA, 109 bp, Homo sapiens; identical to SEQ ID NO: 43715
  misc_feature 1..109: note = chr12:132377954-132378063
  misc_feature 1..109: note = hypo
  source 1..109: mol_type = genomic DNA

SEQ ID NO: 64166 - DNA, 37 bp, Homo sapiens; identical to SEQ ID NO: 43716
  misc_feature 1..37: note = chr12:132415173-132415210
  misc_feature 1..37: note = hypo
  source 1..37: mol_type = genomic DNA

SEQ ID NO: 64167 - DNA, 37 bp, Homo sapiens; identical to SEQ ID NO: 43717
  misc_feature 1..37: note = chr12:132415270-132415307
  misc_feature 1..37: note = hypo
  source 1..37: mol_type = genomic DNA

SEQ ID NO: 64168 - DNA, 238 bp, Homo sapiens; identical to SEQ ID NO: 43719
  misc_feature 1..238: note = chr12:132617211-132617449
  misc_feature 1..238: note = hypo
  source 1..238: mol_type = genomic DNA

SEQ ID NO: 64169 - DNA, 30 bp, Homo sapiens; identical to SEQ ID NO: 43720
  misc_feature 1..30: note = chr12:132617675-132617705
  misc_feature 1..30: note = hypo
  source 1..30: mol_type = genomic DNA

SEQ ID NO: 64170 - DNA, 134 bp, Homo sapiens; identical to SEQ ID NO: 43721
  misc_feature 1..134: note = chr12:132643874-132644008
  misc_feature 1..134: note = hypo
  source 1..134: mol_type = genomic DNA

SEQ ID NO: 64171 - DNA, 30 bp, Homo sapiens; identical to SEQ ID NO: 43722
  misc_feature 1..30: note = chr12:132648490-132648520
  misc_feature 1..30: note = hypo
  source 1..30: mol_type = genomic DNA

SEQ ID NO: 64172 - DNA, 161 bp, Homo sapiens; identical to SEQ ID NO: 43723
  misc_feature 1..161: note = chr12:132653008-132653169
  misc_feature 1..161: note = hypo
  source 1..161: mol_type = genomic DNA

SEQ ID NO: 64173 - DNA, 44 bp, Homo sapiens; identical to SEQ ID NO: 43724
  misc_feature 1..44: note = chr12:132666377-132666421
  misc_feature 1..44: note = hypo
  source 1..44: mol_type = genomic DNA

SEQ ID NO: 64174 - DNA, 84 bp, Homo sapiens; identical to SEQ ID NO: 43725
  misc_feature 1..84: note = chr12:132682582-132682666
  misc_feature 1..84: note = hypo
  source 1..84: mol_type = genomic DNA

SEQ ID NO: 64175 - DNA, 288 bp, Homo sapiens; identical to SEQ ID NO: 43726
  misc_feature 1..288: note = chr12:132687989-132688277
  misc_feature 1..288: note = hypo
  source 1..288: mol_type = genomic DNA

SEQ ID NO: 64176 - DNA, 23 bp, Homo sapiens
  misc_feature 1..23: note = chr12:132691177-132691200
  misc_feature 1..23: note = hypo
  source 1..23: mol_type = genomic DNA
cgagactccgtctcaaaaaaaaa

SEQ ID NO: 64177 - DNA, 41 bp, Homo sapiens; identical to SEQ ID NO: 43728
  misc_feature 1..41: note = chr12:132694981-132695022
  misc_feature 1..41: note = hypo
  source 1..41: mol_type = genomic DNA

SEQ ID NO: 64178 - DNA, 115 bp, Homo sapiens; identical to SEQ ID NO: 43729
  misc_feature 1..115: note = chr12:132983629-132983744
  misc_feature 1..115: note = hypo
  source 1..115: mol_type = genomic DNA

SEQ ID NO: 64179 - DNA, 48 bp, Homo sapiens; identical to SEQ ID NO: 43730
  misc_feature 1..48: note = chr12:132985665-132985713
  misc_feature 1..48: note = hypo
  source 1..48: mol_type = genomic DNA

SEQ ID NO: 64180 - DNA, 44 bp, Homo sapiens
  misc_feature 1..44: note = chr12:132986451-132986495
  misc_feature 1..44: note = hypo
  source 1..44: mol_type = genomic DNA
acccagagctgccaccgtcctgtgggtgacggcagaacatctgg

SEQ ID NO: 64181 - DNA, 75 bp, Homo sapiens
  misc_feature 1..75: note = chr12:132986581-132986656
  misc_feature 1..75: note = hypo
  source 1..75: mol_type = genomic DNA
agggagcggagccgggaaggccacggacatctgtgtggtgtcacgaacaaggtccggccacgtgtgtgggagacg

SEQ ID NO: 64182 - DNA, 45 bp, Homo sapiens; identical to SEQ ID NO: 43732
  misc_feature 1..45: note = chr12:132987467-132987512
  misc_feature 1..45: note = hypo
  source 1..45: mol_type = genomic DNA

SEQ ID NO: 64183 - DNA, 60 bp, Homo sapiens; identical to SEQ ID NO: 43734
  misc_feature 1..60: note = chr12:133003308-133003368
  misc_feature 1..60: note = hypo
  source 1..60: mol_type = genomic DNA

SEQ ID NO: 64184 - DNA, 17 bp, Homo sapiens
  misc_feature 1..17: note = chr12:133019687-133019704
  misc_feature 1..17: note = hypo
  source 1..17: mol_type = genomic DNA
cccgaaaaaaaaaaaac

SEQ ID NO: 64185 - DNA, 190 bp, Homo sapiens; identical to SEQ ID NO: 43736
  misc_feature 1..190: note = chr12:133035657-133035847
  misc_feature 1..190: note = hypo
  source 1..190: mol_type = genomic DNA

SEQ ID NO: 64186 - DNA, 58 bp, Homo sapiens; identical to SEQ ID NO: 43737
  misc_feature 1..58: note = chr12:133060930-133060988
  misc_feature 1..58: note = hypo
  source 1..58: mol_type = genomic DNA

SEQ ID NO: 64187 - DNA, 46 bp, Homo sapiens; identical to SEQ ID NO: 43738
  misc_feature 1..46: note = chr12:133100409-133100455
  misc_feature 1..46: note = hypo
  source 1..46: mol_type = genomic DNA

SEQ ID NO: 64188 - DNA, 30 bp, Homo sapiens; identical to SEQ ID NO: 15744
  misc_feature 1..30: note = chr12:133100990-133101020
  misc_feature 1..30: note = hypo
  source 1..30: mol_type = genomic DNA

SEQ ID NO: 64189 - DNA, 30 bp, Homo sapiens; identical to SEQ ID NO: 15745
  misc_feature 1..30: note = chr12:133122176-133122206
  misc_feature 1..30: note = hypo
  source 1..30: mol_type = genomic DNA

SEQ ID NO: 64190 - DNA, 30 bp, Homo sapiens; identical to SEQ ID NO: 43741
  misc_feature 1..30: note = chr12:133167902-133167932
  misc_feature 1..30: note = hypo
  source 1..30: mol_type = genomic DNA

SEQ ID NO: 64191 - DNA, 256 bp, Homo sapiens; identical to SEQ ID NO: 43742
  misc_feature 1..256: note = chr12:133169847-133170103
  misc_feature 1..256: note = hypo
  source 1..256: mol_type = genomic DNA

SEQ ID NO: 64192 - DNA, 102 bp, Homo sapiens; identical to SEQ ID NO: 15747
  misc_feature 1..102: note = chr12:133188357-133188459
  misc_feature 1..102: note = hypo
  source 1..102: mol_type = genomic DNA

SEQ ID NO: 64193 - DNA, 30 bp, Homo sapiens; identical to SEQ ID NO: 43744
  misc_feature 1..30: note = chr12:133199671-133199701
  misc_feature 1..30: note = hypo
  source 1..30: mol_type = genomic DNA

SEQ ID NO: 64194 - DNA, 43 bp, Homo sapiens; identical to SEQ ID NO: 43745
  misc_feature 1..43: note = chr12:133200007-133200050
  misc_feature 1..43: note = hypo
  source 1..43: mol_type = genomic DNA

SEQ ID NO: 64195 - DNA, 79 bp, Homo sapiens; identical to SEQ ID NO: 43747
  misc_feature 1..79: note = chr12:133705743-133705822
  misc_feature 1..79: note = hypo
  source 1..79: mol_type = genomic DNA

SEQ ID NO: 64196 - DNA, 162 bp, Homo sapiens; identical to SEQ ID NO: 43748
  misc_feature 1..162: note = chr13:19517741-19517903
  misc_feature 1..162: note = hypo
  source 1..162: mol_type = genomic DNA

SEQ ID NO: 64197 - DNA, 101 bp, Homo sapiens; identical to SEQ ID NO: 43749
  misc_feature 1..101: note = chr13:20078200-20078301
  misc_feature 1..101: note = hypo
  source 1..101: mol_type = genomic DNA

SEQ ID NO: 64198 - DNA, 87 bp, Homo sapiens; identical to SEQ ID NO: 43750
  misc_feature 1..87: note = chr13:20392358-20392445
  misc_feature 1..87: note = hypo
  source 1..87: mol_type = genomic DNA

SEQ ID NO: 64199 - DNA, 27 bp, Homo sapiens
  misc_feature 1..27: note = chr13:20692250-20692277
  misc_feature 1..27: note = hypo
  source 1..27: mol_type = genomic DNA
cgtgagccactgcgcctggccacattt

SEQ ID NO: 64200 - DNA, 165 bp, Homo sapiens; identical to SEQ ID NO: 43752
  misc_feature 1..165: note = chr13:21057336-21057501
  misc_feature 1..165: note = hypo
  source 1..165: mol_type = genomic DNA

SEQ ID NO: 64201 - DNA, 30 bp, Homo sapiens; identical to SEQ ID NO: 43753
  misc_feature 1..30: note = chr13:21711382-21711412
  misc_feature 1..30: note = hypo
  source 1..30: mol_type = genomic DNA

SEQ ID NO: 64202 - DNA, 23 bp, Homo sapiens
  misc_feature 1..23: note = chr13:22049000-22049023
  misc_feature 1..23: note = hypo
  source 1..23: mol_type = genomic DNA
tttttttttttgagacggagtct

SEQ ID NO: 64203 - DNA, 30 bp, Homo sapiens; identical to SEQ ID NO: 43755
  misc_feature 1..30: note = chr13:22336937-22336967
  misc_feature 1..30: note = hypo
  source 1..30: mol_type = genomic DNA

SEQ ID NO: 64204 - DNA, 30 bp, Homo sapiens; identical to SEQ ID NO: 43756
  misc_feature 1..30: note = chr13:22391874-22391904
  misc_feature 1..30: note = hypo
  source 1..30: mol_type = genomic DNA

SEQ ID NO: 64205 - DNA, 30 bp, Homo sapiens; identical to SEQ ID NO: 43757
  misc_feature 1..30: note = chr13:23717527-23717557
  misc_feature 1..30: note = hypo
  source 1..30: mol_type = genomic DNA

SEQ ID NO: 64206 - DNA, 92 bp, Homo sapiens; identical to SEQ ID NO: 43758
  misc_feature 1..92: note = chr13:23896875-23896967
  misc_feature 1..92: note = hypo
  source 1..92: mol_type = genomic DNA

SEQ ID NO: 64207 - DNA, 62 bp, Homo sapiens; identical to SEQ ID NO: 43759
  misc_feature 1..62: note = chr13:24289608-24289670
  misc_feature 1..62: note = hypo
  source 1..62: mol_type = genomic DNA

SEQ ID NO: 64208 - DNA, 30 bp, Homo sapiens; identical to SEQ ID NO: 43760
  misc_feature 1..30: note = chr13:25561078-25561108
  misc_feature 1..30: note = hypo
  source 1..30: mol_type = genomic DNA

SEQ ID NO: 64209 - DNA, 27 bp, Homo sapiens
  misc_feature 1..27: note = chr13:25668696-25668723
  misc_feature 1..27: note = hypo
  source 1..27: mol_type = genomic DNA
ctactctaggctaggcgcggcggctca

SEQ ID NO: 64210 - DNA, 71 bp, Homo sapiens; identical to SEQ ID NO: 15753
  misc_feature 1..71: note = chr13:25670585-25670656
  misc_feature 1..71: note = hypo
  source 1..71: mol_type = genomic DNA

SEQ ID NO: 64211 - DNA, 30 bp, Homo sapiens; identical to SEQ ID NO: 43763
  misc_feature 1..30: note = chr13:27278150-27278180
  misc_feature 1..30: note = hypo
  source 1..30: mol_type = genomic DNA

SEQ ID NO: 64212 - DNA, 84 bp, Homo sapiens; identical to SEQ ID NO: 43765
  misc_feature 1..84: note = chr13:29914132-29914216
  misc_feature 1..84: note = hypo
  source 1..84: mol_type = genomic DNA

SEQ ID NO: 64213 - DNA, 30 bp, Homo sapiens; identical to SEQ ID NO: 43766
  misc_feature 1..30: note = chr13:29933609-29933639
  misc_feature 1..30: note = hypo
  source 1..30: mol_type = genomic DNA

SEQ ID NO: 64214 - DNA, 19 bp, Homo sapiens
  misc_feature 1..19: note = chr13:30031261-30031280
  misc_feature 1..19: note = hypo
  source 1..19: mol_type = genomic DNA
acagcgagactccattcaa

SEQ ID NO: 64215 - DNA, 57 bp, Homo sapiens; identical to SEQ ID NO: 43768
  misc_feature 1..57: note = chr13:30107065-30107122
  misc_feature 1..57: note = hypo
  source 1..57: mol_type = genomic DNA

SEQ ID NO: 64216 - DNA, 41 bp, Homo sapiens; identical to SEQ ID NO: 43769
  misc_feature 1..41: note = chr13:30123237-30123278
  misc_feature 1..41: note = hypo
  source 1..41: mol_type = genomic DNA

SEQ ID NO: 64217 - DNA, 36 bp, Homo sapiens; identical to SEQ ID NO: 43770
  misc_feature 1..36: note = chr13:30149052-30149088
  misc_feature 1..36: note = hypo
  source 1..36: mol_type = genomic DNA

SEQ ID NO: 64218 - DNA, 64 bp, Homo sapiens; identical to SEQ ID NO: 43771
  misc_feature 1..64: note = chr13:30574503-30574567
  misc_feature 1..64: note = hypo
  source 1..64: mol_type = genomic DNA

SEQ ID NO: 64219 - DNA, 26 bp, Homo sapiens
  misc_feature 1..26: note = chr13:30707178-30707204
  misc_feature 1..26: note = hypo
  source 1..26: mol_type = genomic DNA
aggtccaggccatagcgacggggacc

SEQ ID NO: 64220 - DNA, 117 bp, Homo sapiens; identical to SEQ ID NO: 43773
  misc_feature 1..117: note = chr13:30707244-30707361
  misc_feature 1..117: note = hypo
  source 1..117: mol_type = genomic DNA

SEQ ID NO: 64221 - DNA, 186 bp, Homo sapiens; identical to SEQ ID NO: 43775
  misc_feature 1..186: note = chr13:30761001-30761187
  misc_feature 1..186: note = hypo
  source 1..186: mol_type = genomic DNA

SEQ ID NO: 64222 - DNA, 36 bp, Homo sapiens
  misc_feature 1..36: note = chr13:31742917-31742953
  misc_feature 1..36: note = hypo
  source 1..36: mol_type = genomic DNA
cccaggcagataacccgccggctggtgcctcccaac

SEQ ID NO: 64223 - DNA, 89 bp, Homo sapiens; identical to SEQ ID NO: 43777
  misc_feature 1..89: note = chr13:31821217-31821306
  misc_feature 1..89: note = hypo
  source 1..89: mol_type = genomic DNA

SEQ ID NO: 64224 - DNA, 21 bp, Homo sapiens
  misc_feature 1..21: note = chr13:32244681-32244702
  misc_feature 1..21: note = hypo
  source 1..21: mol_type = genomic DNA
acaggctaggctgggcgcggt

SEQ ID NO: 64225 - DNA, 30 bp, Homo sapiens; identical to SEQ ID NO: 43779
  misc_feature 1..30: note = chr13:32670558-32670588
  misc_feature 1..30: note = hypo
  source 1..30: mol_type = genomic DNA

SEQ ID NO: 64226 - DNA, 30 bp, Homo sapiens; identical to SEQ ID NO: 43780
  misc_feature 1..30: note = chr13:33113918-33113948
  misc_feature 1..30: note = hypo
  source 1..30: mol_type = genomic DNA

SEQ ID NO: 64227 - DNA, 29 bp, Homo sapiens
  misc_feature 1..29: note = chr13:36883103-36883132
  misc_feature 1..29: note = hypo
  source 1..29: mol_type = genomic DNA
aggtgtggtggctcacgcctgtaatccca

SEQ ID NO: 64228 - DNA, 270 bp, Homo sapiens
  misc_feature 1..270: note = chr13:37643672-37643942
  misc_feature 1..270: note = hypo
  source 1..270: mol_type = genomic DNA
gtcccctgtgccccacgtcccggaagcaacctcctgtgctgcccccaaactcatgcagccaggtgggacccgaccctaggcccggagctttcatcactcgggactctggccccacactgctgctctcacccacgcactgctgctgtggggagggcgtggggaggaggcggagctgggcccggggctgtgccacgcttcacgcttcacggaaccagcgggagccaaggacaagcaggagccgccccgcagccccttgggggccgccgctat

SEQ ID NO: 64229 - DNA, 30 bp, Homo sapiens; identical to SEQ ID NO: 43783
  misc_feature 1..30: note = chr13:40020880-40020910
  misc_feature 1..30: note = hypo
  source 1..30: mol_type = genomic DNA

SEQ ID NO: 64230 - DNA, 32 bp, Homo sapiens; identical to SEQ ID NO: 43784
  misc_feature 1..32: note = chr13:41103319-41103351
  misc_feature 1..32: note = hypo
  source 1..32: mol_type = genomic DNA

SEQ ID NO: 64231 - DNA, 53 bp, Homo sapiens; identical to SEQ ID NO: 15760
  misc_feature 1..53: note = chr13:41681520-41681573
  misc_feature 1..53: note = hypo
  source 1..53: mol_type = genomic DNA

SEQ ID NO: 64232 - DNA, 30 bp, Homo sapiens; identical to SEQ ID NO: 43786
  misc_feature 1..30: note = chr13:41705935-41705965
  misc_feature 1..30: note = hypo
  source 1..30: mol_type = genomic DNA

SEQ ID NO: 64233 - DNA, 181 bp, Homo sapiens; identical to SEQ ID NO: 43787
  misc_feature 1..181: note = chr13:42540722-42540903
  misc_feature 1..181: note = hypo
  source 1..181: mol_type = genomic DNA

SEQ ID NO: 64234 - DNA, 30 bp, Homo sapiens; identical to SEQ ID NO: 43788
  misc_feature 1..30: note = chr13:43543197-43543227
  misc_feature 1..30: note = hypo
  source 1..30: mol_type = genomic DNA

SEQ ID NO: 64235 - DNA, 108 bp, Homo sapiens; identical to SEQ ID NO: 43789
  misc_feature 1..108: note = chr13:43986042-43986150
  misc_feature 1..108: note = hypo
  source 1..108: mol_type = genomic DNA

SEQ ID NO: 64236 - DNA, 30 bp, Homo sapiens; identical to SEQ ID NO: 43790
  misc_feature 1..30: note = chr13:45165574-45165604
  misc_feature 1..30: note = hypo
  source 1..30: mol_type = genomic DNA

SEQ ID NO: 64237 - DNA, 17 bp, Homo sapiens
  misc_feature 1..17: note = chr13:45562261-45562278
  misc_feature 1..17: note = hypo
  source 1..17: mol_type = genomic DNA
ctgcactacctggcccg

SEQ ID NO: 64238 - DNA, 229 bp, Homo sapiens; identical to SEQ ID NO: 43792
  misc_feature 1..229: note = chr13:45564574-45564803
  misc_feature 1..229: note = hypo
  source 1..229: mol_type = genomic DNA

SEQ ID NO: 64239 - DNA, 30 bp, Homo sapiens; identical to SEQ ID NO: 43794
  misc_feature 1..30: note = chr13:45939250-45939280
  misc_feature 1..30: note = hypo
  source 1..30: mol_type = genomic DNA

SEQ ID NO: 64240 - DNA, 34 bp, Homo sapiens; identical to SEQ ID NO: 43795
  misc_feature 1..34: note = chr13:45950905-45950939
  misc_feature 1..34: note = hypo
  source 1..34: mol_type = genomic DNA

SEQ ID NO: 64241 - DNA, 85 bp, Homo sapiens; identical to SEQ ID NO: 43796
  misc_feature 1..85: note = chr13:46659255-46659340
  misc_feature 1..85: note = hypo
  source 1..85: mol_type = genomic DNA

SEQ ID NO: 64242 - DNA, 120 bp, Homo sapiens; identical to SEQ ID NO: 43797
  misc_feature 1..120: note = chr13:46660682-46660802
  misc_feature 1..120: note = hypo
  source 1..120: mol_type = genomic DNA

SEQ ID NO: 64243 - DNA, 75 bp, Homo sapiens; identical to SEQ ID NO: 43798
  misc_feature 1..75: note = chr13:46661292-46661367
  misc_feature 1..75: note = hypo
  source 1..75: mol_type = genomic DNA

SEQ ID NO: 64244 - DNA, 172 bp, Homo sapiens; identical to SEQ ID NO: 15765
  misc_feature 1..172: note = chr13:46920144-46920316
  misc_feature 1..172: note = hypo
  source 1..172: mol_type = genomic DNA

SEQ ID NO: 64245 - DNA, 142 bp, Homo sapiens; identical to SEQ ID NO: 43800
  misc_feature 1..142: note = chr13:47528522-47528664
  misc_feature 1..142: note = hypo
  source 1..142: mol_type = genomic DNA

SEQ ID NO: 64246 - DNA, 63 bp, Homo sapiens; identical to SEQ ID NO: 43802
  misc_feature 1..63: note = chr13:49922188-49922251
  misc_feature 1..63: note = hypo
  source 1..63: mol_type = genomic DNA

SEQ ID NO: 64247 - DNA, 49 bp, Homo sapiens; identical to SEQ ID NO: 43803
  misc_feature 1..49: note = chr13:49923030-49923079
  misc_feature 1..49: note = hypo
  source 1..49: mol_type = genomic DNA

SEQ ID NO: 64248 - DNA, 19 bp, Homo sapiens
  misc_feature 1..19: note = chr13:50367846-50367865
  misc_feature 1..19: note = hypo
  source 1..19: mol_type = genomic DNA
agagctgctttcggccggg

SEQ ID NO: 64249 - DNA, 75 bp, Homo sapiens; identical to SEQ ID NO: 43805
  misc_feature 1..75: note = chr13:52532595-52532670
  misc_feature 1..75: note = hypo
  source 1..75: mol_type = genomic DNA

SEQ ID NO: 64250 - DNA, 36 bp, Homo sapiens; identical to SEQ ID NO: 43806
  misc_feature 1..36: note = chr13:53025686-53025722
  misc_feature 1..36: note = hypo
  source 1..36: mol_type = genomic DNA

SEQ ID NO: 64251 - DNA, 17 bp, Homo sapiens
  misc_feature 1..17: note = chr13:53580919-53580936
  misc_feature 1..17: note = hypo
  source 1..17: mol_type = genomic DNA
ggcgtgagccaccgcgc

SEQ ID NO: 64252 - DNA, 30 bp, Homo sapiens; identical to SEQ ID NO: 43808
  misc_feature 1..30: note = chr13:56180149-56180179
  misc_feature 1..30: note = hypo
  source 1..30: mol_type = genomic DNA

SEQ ID NO: 64253 - DNA, 30 bp, Homo sapiens; identical to SEQ ID NO: 43809
  misc_feature 1..30: note = chr13:60614880-60614910
  misc_feature 1..30: note = hypo
  source 1..30: mol_type = genomic DNA

SEQ ID NO: 64254 - DNA, 31 bp, Homo sapiens; identical to SEQ ID NO: 43810
  misc_feature 1..31: note = chr13:64311606-64311637
  misc_feature 1..31: note = hypo
  source 1..31: mol_type = genomic DNA

SEQ ID NO: 64255 - DNA, 30 bp, Homo sapiens; identical to SEQ ID NO: 43811
  misc_feature 1..30: note = chr13:65904937-65904967
  misc_feature 1..30: note = hypo
  source 1..30: mol_type = genomic DNA

SEQ ID NO: 64256 - DNA, 51 bp, Homo sapiens; identical to SEQ ID NO: 43812
  misc_feature 1..51: note = chr13:68343951-68344002
  misc_feature 1..51: note = hypo
  source 1..51: mol_type = genomic DNA

SEQ ID NO: 64257 - DNA, 30 bp, Homo sapiens; identical to SEQ ID NO: 43813
  misc_feature 1..30: note = chr13:74987640-74987670
  misc_feature 1..30: note = hypo
  source 1..30: mol_type = genomic DNA

SEQ ID NO: 64258 - DNA, 28 bp, Homo sapiens
  misc_feature 1..28: note = chr13:77553713-77553741
  misc_feature 1..28: note = hypo
  source 1..28: mol_type = genomic DNA
gggcgcggtgactcacgactgtaagtcg

SEQ ID NO: 64259 - DNA, 44 bp, Homo sapiens; identical to SEQ ID NO: 43815
  misc_feature 1..44: note = chr13:78081890-78081934
  misc_feature 1..44: note = hypo
  source 1..44: mol_type = genomic DNA

SEQ ID NO: 64260 - DNA, 16 bp, Homo sapiens
  misc_feature 1..16: note = chr13:78567988-78568004
  misc_feature 1..16: note = hypo
  source 1..16: mol_type = genomic DNA
gcgcctggcatgtagt

SEQ ID NO: 64261 - DNA, 30 bp, Homo sapiens; identical to SEQ ID NO: 43818
  misc_feature 1..30: note = chr13:95711256-95711286
  misc_feature 1..30: note = hypo
  source 1..30: mol_type = genomic DNA

SEQ ID NO: 64262 - DNA, 50 bp, Homo sapiens; identical to SEQ ID NO: 43819
  misc_feature 1..50: note = chr13:95718425-95718475
  misc_feature 1..50: note = hypo
  source 1..50: mol_type = genomic DNA

SEQ ID NO: 64263 - DNA, 37 bp, Homo sapiens; identical to SEQ ID NO: 43820
  misc_feature 1..37: note = chr13:95858839-95858876
  misc_feature 1..37: note = hypo
  source 1..37: mol_type = genomic DNA

SEQ ID NO: 64264 - DNA, 30 bp, Homo sapiens; identical to SEQ ID NO: 43821
  misc_feature 1..30: note = chr13:95888816-95888846
  misc_feature 1..30: note = hypo
  source 1..30: mol_type = genomic DNA

SEQ ID NO: 64265 - DNA, 66 bp, Homo sapiens; identical to SEQ ID NO: 43823
  misc_feature 1..66: note = chr13:96409578-96409644
  misc_feature 1..66: note = hypo
  source 1..66: mol_type = genomic DNA

SEQ ID NO: 64266 - DNA, 18 bp, Homo sapiens
  misc_feature 1..18: note = chr13:97599727-97599745
  misc_feature 1..18: note = hypo
  source 1..18: mol_type = genomic DNA
tctcgcctcactgcaacc

SEQ ID NO: 64267 - DNA, 16 bp, Homo sapiens
  misc_feature 1..16: note = chr13:98426774-98426790
  misc_feature 1..16: note = hypo
  source 1..16: mol_type = genomic DNA
tgcctgatctcagctc

SEQ ID NO: 64268 - DNA, 30 bp, Homo sapiens; identical to SEQ ID NO: 43826
  misc_feature 1..30: note = chr13:98866341-98866371
  misc_feature 1..30: note = hypo
  source 1..30: mol_type = genomic DNA

SEQ ID NO: 64269 - DNA, 30 bp, Homo sapiens; identical to SEQ ID NO: 43827
  misc_feature 1..30: note = chr13:99083172-99083202
  misc_feature 1..30: note = hypo
  source 1..30: mol_type = genomic DNA

SEQ ID NO: 64270 - DNA, 42 bp, Homo sapiens; identical to SEQ ID NO: 43828
  misc_feature 1..42: note = chr13:99083425-99083467
  misc_feature 1..42: note = hypo
  source 1..42: mol_type = genomic DNA

SEQ ID NO: 64271 - DNA, 30 bp, Homo sapiens; identical to SEQ ID NO: 43829
  misc_feature 1..30: note = chr13:99189615-99189645
  misc_feature 1..30: note = hypo
  source 1..30: mol_type = genomic DNA

SEQ ID NO: 64272 - DNA, 30 bp, Homo sapiens; identical to SEQ ID NO: 43830
  misc_feature 1..30: note = chr13:99428706-99428736
  misc_feature 1..30: note = hypo
  source 1..30: mol_type = genomic DNA

SEQ ID NO: 64273 - DNA, 30 bp, Homo sapiens; identical to SEQ ID NO: 43831
  misc_feature 1..30: note = chr13:100095884-100095914
  misc_feature 1..30: note = hypo
  source 1..30: mol_type = genomic DNA

SEQ ID NO: 64274 - DNA, 37 bp, Homo sapiens; identical to SEQ ID NO: 43832
  misc_feature 1..37: note = chr13:100146505-100146542
  misc_feature 1..37: note = hypo
  source 1..37: mol_type = genomic DNA

SEQ ID NO: 64275 - DNA, 81 bp, Homo sapiens; identical to SEQ ID NO: 15770
  misc_feature 1..81: note = chr13:100356871-100356952
  misc_feature 1..81: note = hypo
  source 1..81: mol_type = genomic DNA

SEQ ID NO: 64276 - DNA, 276 bp, Homo sapiens; identical to SEQ ID NO: 43834
  misc_feature 1..276: note = chr13:100575337-100575613
  misc_feature 1..276: note = hypo
  source 1..276: mol_type = genomic DNA

SEQ ID NO: 64277 - DNA, 30 bp, Homo sapiens; identical to SEQ ID NO: 43835
  misc_feature 1..30: note = chr13:100583792-100583822
  misc_feature 1..30: note = hypo
  source 1..30: mol_type = genomic DNA

SEQ ID NO: 64278 - DNA, 30 bp, Homo sapiens; identical to SEQ ID NO: 43836
  misc_feature 1..30: note = chr13:102206088-102206118
  misc_feature 1..30: note = hypo
  source 1..30: mol_type = genomic DNA

SEQ ID NO: 64279 - DNA, 30 bp, Homo sapiens; identical to SEQ ID NO: 43837
  misc_feature 1..30: note = chr13:102385630-102385660
  misc_feature 1..30: note = hypo
  source 1..30: mol_type = genomic DNA

SEQ ID NO: 64280 - DNA, 27 bp, Homo sapiens
  misc_feature 1..27: note = chr13:103569166-103569193
  misc_feature 1..27: note = hypo
  source 1..27: mol_type = genomic DNA
ccggccgtcccccgttaatcttactcc

SEQ ID NO: 64281 - DNA, 143 bp, Homo sapiens; identical to SEQ ID NO: 43839
  misc_feature 1..143: note = chr13:108218849-108218992
  misc_feature 1..143: note = hypo
  source 1..143: mol_type = genomic DNA

SEQ ID NO: 64282 - DNA, 24 bp, Homo sapiens
  misc_feature 1..24: note = chr13:110053866-110053890
  misc_feature 1..24: note = hypo
  source 1..24: mol_type = genomic DNA
tacctgagattcaatcgctgaggc

SEQ ID NO: 64283 - DNA, 72 bp, Homo sapiens
  misc_feature 1..72: note = chr13:110434379-110434451
  misc_feature 1..72: note = hypo
  source 1..72: mol_type = genomic DNA
cctcctcacctttcacgatggtggcctccttcaagtggtgggacaagaagtcaatgctggcgtaggtgttgg

SEQ ID NO: 64284 - DNA, 1851 bp, Homo sapiens
  misc_feature 1..1851: note = chr13:110434593-110436444
  misc_feature 1..1851: note = hypo
  source 1..1851: mol_type = genomic DNA
ctgcggctggggtggcagcccgggctcctccctcacgtcgatggcgatgtagttgagaccattctggaagccggcagaggtctctctgcgcatgggcgatccaccgctcccaggacaaccgaccaagcccccgggctgacccggggtccacggccggccctgcggtgccaaagggggcgccggctgcaactgtcgtggggaggtgggcggctcgtcgccccctccagggccgacacccacgccgccctcgctgcttttcctgagagagacattttccacggaggccgagttgtggcgcttggggttgtgggcgaaggacggggacacgggggtgaccgtcgtggtggaggagaaggtctcggaactgtggcggcggcggcccccctgcgggtctgcgcggatgaccttggcgccgcggtgggggtccgggggctggctggcctgcaggaaggcctcgactcccgacacctgctccatgaggctcagcctcttcacgcccgacgtcgggctggccacgcgggcagcttctggcttcgggggggccgcgataggttgcggcggggtggcggccacaccaaaagccatctcggtgtagtcaccattgtccccggtgtccgaggacaacgatgaggcggcgcccgggccctgggcggtggcaacggccgaggcggggggcaggcggtacagctcccccggggccggcggcggtggcggcggctgcagagacgacgacggggacgcggacggacgcgggggcaacggcggatacggggaggaggcctcgggggacaggaggccgtccaaggagcccacggggtggccgctcggggcgcccggcttaggagacttgggggagctgaagtcgaggttcatgtagtcggagagcggagaccgctgccggctgtcgctgctggtgcccggggtgcctgagcccagcgacgaggccgggctgctggcggacaagagcgaggaggacgaggccgccgacgccagcaggggaggcgcgggcggcgacaggcgggccccgggctcgccaaagtcgatgttgatgtactcgccggggctcttgggctccggtggcagtgggtactcgtgcatgctgggcaggctgggcagcccctccagggacaggcgcgtgggcctcaccgcccggccgcgctggcccaagaagccctccgggcggccgccgctaggccgcacgggcgaaggcactacagggtgagggggctgcgtggggccggccccgaaggcgctggccgcctggctgggccctggcgtggcctgaggctccagacgctcctcctccaggatgcgccccacgggggagctcatgagcacgtactggtcgctgtccccgccacaggtgtagggggccttgtaggagcggggcaaggagctgtagcagcagccgggaacgcccctgagcggctccccgccggggtgcagggctgcggagaagaagtcgggcggggtgcccgtggtgaccgcgtcgctgggggacacgttgaggtagtccccgttgggcagcagcttgccatctgcatgctccatggacagcttggaaccgcaccacatgcgcatgtacccactgtcctcgggggagctctcggcgggcgagctggccttgtagccgcccccgctcgccgggaatgtcctgcccgccgcagaggtgggtgctggccccgcaggccccgcagaaggcacggcggcggcggcggcggcggcggccctgggctgcaagatctgcttgggggcggacacgctggcggggctcatgggcatgtagtcgtcgctcctgcagctgccgctcccactgcccgcgagggccgcgccgggcgtcatgggcatgta

SEQ ID NO: 64285 - DNA, 30 bp, Homo sapiens; identical to SEQ ID NO: 43842
  misc_feature 1..30: note = chr13:110659714-110659744
  misc_feature 1..30: note = hypo
  source 1..30: mol_type = genomic DNA

SEQ ID NO: 64286 - DNA, 77 bp, Homo sapiens; identical to SEQ ID NO: 43843
  misc_feature 1..77: note = chr13:110998830-110998907
  misc_feature 1..77: note = hypo
  source 1..77: mol_type = genomic DNA

SEQ ID NO: 64287 - DNA, 149 bp, Homo sapiens; identical to SEQ ID NO: 43844
  misc_feature 1..149: note = chr13:111144888-111145037
  misc_feature 1..149: note = hypo
  source 1..149: mol_type = genomic DNA

SEQ ID NO: 64288 - DNA, 496 bp, Homo sapiens; identical to SEQ ID NO: 43845
  misc_feature 1..496: note = chr13:111277129-111277625
  misc_feature 1..496: note = hypo
  source 1..496: mol_type = genomic DNA

SEQ ID NO: 64289 - DNA, 56 bp, Homo sapiens; identical to SEQ ID NO: 15777
  misc_feature 1..56: note = chr13:111289222-111289278
  misc_feature 1..56: note = hypo
  source 1..56: mol_type = genomic DNA

SEQ ID NO: 64290 - DNA, 31 bp, Homo sapiens; identical to SEQ ID NO: 43849
  misc_feature 1..31: note = chr13:111704359-111704390
  misc_feature 1..31: note = hypo
  source 1..31: mol_type = genomic DNA

SEQ ID NO: 64291 - DNA, 30 bp, Homo sapiens; identical to SEQ ID NO: 43850
  misc_feature 1..30: note = chr13:111764740-111764770
  misc_feature 1..30: note = hypo
  source 1..30: mol_type = genomic DNA

SEQ ID NO: 64292 - DNA, 234 bp, Homo sapiens; identical to SEQ ID NO: 43851
  misc_feature 1..234: note = chr13:111978711-111978945
  misc_feature 1..234: note = hypo
  source 1..234: mol_type = genomic DNA

SEQ ID NO: 64293 - DNA, 30 bp, Homo sapiens; identical to SEQ ID NO: 43852
  misc_feature 1..30: note = chr13:112062748-112062778
  misc_feature 1..30: note = hypo
  source 1..30: mol_type = genomic DNA

SEQ ID NO: 64294 - DNA, 56 bp, Homo sapiens; identical to SEQ ID NO: 43853
  misc_feature 1..56: note = chr13:112078451-112078507
  misc_feature 1..56: note = hypo
  source 1..56: mol_type = genomic DNA

SEQ ID NO: 64295 - DNA, 30 bp, Homo sapiens; identical to SEQ ID NO: 43854
  misc_feature 1..30: note = chr13:112090544-112090574
  misc_feature 1..30: note = hypo
  source 1..30: mol_type = genomic DNA

SEQ ID NO: 64296 - DNA, 30 bp, Homo sapiens; identical to SEQ ID NO: 43855
  misc_feature 1..30: note = chr13:112243149-112243179
  misc_feature 1..30: note = hypo
  source 1..30: mol_type = genomic DNA

SEQ ID NO: 64297 - DNA, 68 bp, Homo sapiens; identical to SEQ ID NO: 43857
  misc_feature 1..68: note = chr13:112274715-112274783
  misc_feature 1..68: note = hypo
  source 1..68: mol_type = genomic DNA

SEQ ID NO: 64298 - DNA, 30 bp, Homo sapiens; identical to SEQ ID NO: 43858
  misc_feature 1..30: note = chr13:112320732-112320762
  misc_feature 1..30: note = hypo
  source 1..30: mol_type = genomic DNA

SEQ ID NO: 64299 - DNA, 41 bp, Homo sapiens; identical to SEQ ID NO: 43859
  misc_feature 1..41: note = chr13:112559680-112559721
  misc_feature 1..41: note = hypo
  source 1..41: mol_type = genomic DNA

SEQ ID NO: 64300 - DNA, 30 bp, Homo sapiens; identical to SEQ ID NO: 43860
  misc_feature 1..30: note = chr13:112573448-112573478
  misc_feature 1..30: note = hypo
  source 1..30: mol_type = genomic DNA

SEQ ID NO: 64301 - DNA, 35 bp, Homo sapiens; identical to SEQ ID NO: 43861
  misc_feature 1..35: note = chr13:112573696-112573731
  misc_feature 1..35: note = hypo
  source 1..35: mol_type = genomic DNA

SEQ ID NO: 64302 - DNA, 30 bp, Homo sapiens; identical to SEQ ID NO: 43862
  misc_feature 1..30: note = chr13:112618950-112618980
  misc_feature 1..30: note = hypo
  source 1..30: mol_type = genomic DNA

SEQ ID NO: 64303 - DNA, 38 bp, Homo sapiens; identical to SEQ ID NO: 43863
  misc_feature 1..38: note = chr13:112682862-112682900
  misc_feature 1..38: note = hypo
  source 1..38: mol_type = genomic DNA

SEQ ID NO: 64304 - DNA, 50 bp, Homo sapiens; identical to SEQ ID NO: 43864
  misc_feature 1..50: note = chr13:112690800-112690850
  misc_feature 1..50: note = hypo
  source 1..50: mol_type = genomic DNA

SEQ ID NO: 64305 - DNA, 30 bp, Homo sapiens; identical to SEQ ID NO: 43865
  misc_feature 1..30: note = chr13:112800543-112800573
  misc_feature 1..30: note = hypo
  source 1..30: mol_type = genomic DNA

SEQ ID NO: 64306 - DNA, 41 bp, Homo sapiens; identical to SEQ ID NO: 43866
  misc_feature 1..41: note = chr13:112830483-112830524
  misc_feature 1..41: note = hypo
  source 1..41: mol_type = genomic DNA

SEQ ID NO: 64307 - DNA, 32 bp, Homo sapiens; identical to SEQ ID NO: 43867
  misc_feature 1..32: note = chr13:112882268-112882300
  misc_feature 1..32: note = hypo
  source 1..32: mol_type = genomic DNA

SEQ ID NO: 64308 - DNA, 32 bp, Homo sapiens; identical to SEQ ID NO: 43868
  misc_feature 1..32: note = chr13:112882360-112882392
  misc_feature 1..32: note = hypo
  source 1..32: mol_type = genomic DNA

SEQ ID NO: 64309 - DNA, 42 bp, Homo sapiens; identical to SEQ ID NO: 43869
  misc_feature 1..42: note = chr13:113099281-113099323
  misc_feature 1..42: note = hypo
  source 1..42: mol_type = genomic DNA

SEQ ID NO: 64310 - DNA, 73 bp, Homo sapiens; identical to SEQ ID NO: 43870
  misc_feature 1..73: note = chr13:113107030-113107103
  misc_feature 1..73: note = hypo
  source 1..73: mol_type = genomic DNA

SEQ ID NO: 64311 - DNA, 30 bp, Homo sapiens; identical to SEQ ID NO: 43871
  misc_feature 1..30: note = chr13:113319347-113319377
  misc_feature 1..30: note = hypo
  source 1..30: mol_type = genomic DNA

SEQ ID NO: 64312 - DNA, 210 bp, Homo sapiens; identical to SEQ ID NO: 43872
  misc_feature 1..210: note = chr13:113400400-113400610
  misc_feature 1..210: note = hypo
  source 1..210: mol_type = genomic DNA

SEQ ID NO: 64313 - DNA, 39 bp, Homo sapiens; identical to SEQ ID NO: 43873
  misc_feature 1..39: note = chr13:113401430-113401469
  misc_feature 1..39: note = hypo
  source 1..39: mol_type = genomic DNA

SEQ ID NO: 64314 - DNA, 30 bp, Homo sapiens; identical to SEQ ID NO: 43874
  misc_feature 1..30: note = chr13:113424905-113424935
  misc_feature 1..30: note = hypo
  source 1..30: mol_type = genomic DNA

SEQ ID NO: 64315 - DNA, 55 bp, Homo sapiens; identical to SEQ ID NO: 25040
  misc_feature 1..55: note = chr13:113598563-113598618
  misc_feature 1..55: note = hypo
  source 1..55: mol_type = genomic DNA

SEQ ID NO: 64316 - DNA, 30 bp, Homo sapiens; identical to SEQ ID NO: 43876
  misc_feature 1..30: note = chr13:113608292-113608322
  misc_feature 1..30: note = hypo
  source 1..30: mol_type = genomic DNA

SEQ ID NO: 64317 - DNA, 79 bp, Homo sapiens; identical to SEQ ID NO: 43877
  misc_feature 1..79: note = chr13:113648553-113648632
  misc_feature 1..79: note = hypo
  source 1..79: mol_type = genomic DNA

SEQ ID NO: 64318 - DNA, 44 bp, Homo sapiens; identical to SEQ ID NO: 43878
  misc_feature 1..44: note = chr13:113763552-113763596
  misc_feature 1..44: note = hypo
  source 1..44: mol_type = genomic DNA

SEQ ID NO: 64319 - DNA, 42 bp, Homo sapiens; identical to SEQ ID NO: 43879
  misc_feature 1..42: note = chr13:113776004-113776046
  misc_feature 1..42: note = hypo
  source 1..42: mol_type = genomic DNA

SEQ ID NO: 64320 - DNA, 25 bp, Homo sapiens
  misc_feature 1..25: note = chr13:114055958-114055983
  misc_feature 1..25: note = hypo
  source 1..25: mol_type = genomic DNA
gggagctgtggggaccggcccccca

SEQ ID NO: 64321 - skipped

SEQ ID NO: 64322 - DNA, 30 bp, Homo sapiens; identical to SEQ ID NO: 43882
  misc_feature 1..30: note = chr13:114059583-114059613
  misc_feature 1..30: note = hypo
  source 1..30: mol_type = genomic DNA

SEQ ID NO: 64323 - DNA, 78 bp, Homo sapiens
  misc_feature 1..78: note = chr13:114059986-114060064
  misc_feature 1..78: note = hypo
  source 1..78: mol_type = genomic DNA
cctctgggtgctggacgagggccacgcctctcaggaggctcctccctgctgctccactcttgggctccaaggatcccc

SEQ ID NO: 64324 - DNA, 132 bp, Homo sapiens
  misc_feature 1..132: note = chr13:114060333-114060465
  misc_feature 1..132: note = hypo
  source 1..132: mol_type = genomic DNA
gtgatttcctcggcagccttcaggggctgagaagactctattagcagcggccttctgcattcctccagcgcaccgggcactgtcatgcccatcggggtgacaccctcaggccccgtacgccccttggatgat

SEQ ID NO: 64325 - DNA, 106 bp, Homo sapiens; identical to SEQ ID NO: 43884
  misc_feature 1..106: note = chr13:114060775-114060881
  misc_feature 1..106: note = hypo
  source 1..106: mol_type = genomic DNA

SEQ ID NO: 64326 - DNA, 33 bp, Homo sapiens; identical to SEQ ID NO: 43885
  misc_feature 1..33: note = chr13:114064741-114064774
  misc_feature 1..33: note = hypo
  source 1..33: mol_type = genomic DNA

SEQ ID NO: 64327 - DNA, 194 bp, Homo sapiens; identical to SEQ ID NO: 25043
  misc_feature 1..194: note = chr13:114074574-114074768
  misc_feature 1..194: note = hypo
  source 1..194: mol_type = genomic DNA

SEQ ID NO: 64328 - DNA, 436 bp, Homo sapiens
  misc_feature 1..436: note = chr13:114074853-114075289
  misc_feature 1..436: note = hypo
  source 1..436: mol_type = genomic DNA
gggtttcttttcctgaaaggtaattctcagttaatttccccacacccacgggtgctgggaccacactccatggacgtgtgtgacgtgaggcccttcgcccccgtgtgcctgtctctctggttcttctgacttaaagcaccagtagcagcacagttagtccagttattcggaagctcagcacggagccacattgctgcagcatagaaggccacggattcctccatcagcatggactacacttcccacaaaacgaacggggcatctctatggaaaaagcaaagcgtgtccctatccctgggacacctctacccctgggacacacctagccccaggacccgcccacccccgggacccgctcaccccgggacaccactacccctgggacatgcccacccctgggacaaccctaccccccccgacacgccctgggacacgc

SEQ ID NO: 64329 - DNA, 30 bp, Homo sapiens; identical to SEQ ID NO: 43887
  misc_feature 1..30: note = chr13:114108109-114108139
  misc_feature 1..30: note = hypo
  source 1..30: mol_type = genomic DNA

SEQ ID NO: 64330 - DNA, 43 bp, Homo sapiens; identical to SEQ ID NO: 15787
  misc_feature 1..43: note = chr13:114122929-114122972
  misc_feature 1..43: note = hypo
  source 1..43: mol_type = genomic DNA

SEQ ID NO: 64331 - DNA, 86 bp, Homo sapiens; identical to SEQ ID NO: 15788
  misc_feature 1..86: note = chr13:114188403-114188489
  misc_feature 1..86: note = hypo
  source 1..86: mol_type = genomic DNA

SEQ ID NO: 64332 - DNA, 30 bp, Homo sapiens; identical to SEQ ID NO: 43890
  misc_feature 1..30: note = chr13:114189602-114189632
  misc_feature 1..30: note = hypo
  source 1..30: mol_type = genomic DNA

SEQ ID NO: 64333 - DNA, 57 bp, Homo sapiens; identical to SEQ ID NO: 43891
  misc_feature 1..57: note = chr13:114220577-114220634
  misc_feature 1..57: note = hypo
  source 1..57: mol_type = genomic DNA

SEQ ID NO: 64334 - DNA, 12 bp, Homo sapiens
  misc_feature 1..12: note = chr13:114221652-114221664
  misc_feature 1..12: note = hypo
  source 1..12: mol_type = genomic DNA
aacatgttctct

SEQ ID NO: 64335 - DNA, 62 bp, Homo sapiens; identical to SEQ ID NO: 43893
  misc_feature 1..62: note = chr13:114271940-114272002
  misc_feature 1..62: note = hypo
  source 1..62: mol_type = genomic DNA

SEQ ID NO: 64336 - DNA, 30 bp, Homo sapiens; identical to SEQ ID NO: 43894
  misc_feature 1..30: note = chr13:114285192-114285222
  misc_feature 1..30: note = hypo
  source 1..30: mol_type = genomic DNA

SEQ ID NO: 64337 - DNA, 30 bp, Homo sapiens; identical to SEQ ID NO: 43895
  misc_feature 1..30: note = chr13:114285597-114285627
  misc_feature 1..30: note = hypo
  source 1..30: mol_type = genomic DNA

SEQ ID NO: 64338 - DNA, 53 bp, Homo sapiens; identical to SEQ ID NO: 43897
  misc_feature 1..53: note = chr13:114312349-114312402
  misc_feature 1..53: note = hypo
  source 1..53: mol_type = genomic DNA

SEQ ID NO: 64339 - DNA, 30 bp, Homo sapiens; identical to SEQ ID NO: 43898
  misc_feature 1..30: note = chr13:114318203-114318233
  misc_feature 1..30: note = hypo
  source 1..30: mol_type = genomic DNA

SEQ ID NO: 64340 - DNA, 30 bp, Homo sapiens; identical to SEQ ID NO: 43899
  misc_feature 1..30: note = chr13:114426896-114426926
  misc_feature 1..30: note = hypo
  source 1..30: mol_type = genomic DNA

SEQ ID NO: 64341 - DNA, 46 bp, Homo sapiens; identical to SEQ ID NO: 43900
  misc_feature 1..46: note = chr13:114450608-114450654
  misc_feature 1..46: note = hypo
  source 1..46: mol_type = genomic DNA

SEQ ID NO: 64342 - DNA, 22 bp, Homo sapiens
  misc_feature 1..22: note = chr13:114454880-114454902
  misc_feature 1..22: note = hypo
  source 1..22: mol_type = genomic DNA
cagttgtgccagctccgtggct

SEQ ID NO: 64343 - DNA, 21 bp, Homo sapiens
  misc_feature 1..21: note = chr13:114479383-114479404
  misc_feature 1..21: note = hypo
  source 1..21: mol_type = genomic DNA
cgcacctctcttctgcgggcg

SEQ ID NO: 64344 - skipped

SEQ ID NO: 64345 - DNA, 30 bp, Homo sapiens; identical to SEQ ID NO: 43903
  misc_feature 1..30: note = chr13:114497409-114497439
  misc_feature 1..30: note = hypo
  source 1..30: mol_type = genomic DNA

SEQ ID NO: 64346 - DNA, 173 bp, Homo sapiens
  misc_feature 1..173: note = chr13:114497844-114498017
  misc_feature 1..173: note = hypo
  source 1..173: mol_type = genomic DNA
gttgcttctcagaggcgcgtgccgagggcccggggatggcaacgcccttccgtgcagaaggcgcctgggtgggtcttgcggaatagacgcgtgaggacgacccgcagggtggagtccggcctggccagggctggaagtcataggacgaaaggtagaggtgagaagaggcagtt

SEQ ID NO: 64347 - DNA, 18 bp, Homo sapiens
  misc_feature 1..18: note = chr13:114498260-114498278
  misc_feature 1..18: note = hypo
  source 1..18: mol_type = genomic DNA
cgacgtgaaaaaagtaca

SEQ ID NO: 64348 - DNA, 175 bp, Homo sapiens; identical to SEQ ID NO: 43905
  misc_feature 1..175: note = chr13:114502787-114502962
  misc_feature 1..175: note = hypo
  source 1..175: mol_type = genomic DNA

SEQ ID NO: 64349 - DNA, 45 bp, Homo sapiens; identical to SEQ ID NO: 43906
  misc_feature 1..45: note = chr13:114506372-114506417
  misc_feature 1..45: note = hypo
  source 1..45: mol_type = genomic DNA

SEQ ID NO: 64350 - DNA, 123 bp, Homo sapiens; identical to SEQ ID NO: 43907
  misc_feature 1..123: note = chr13:114526487-114526610
  misc_feature 1..123: note = hypo
  source 1..123: mol_type = genomic DNA

SEQ ID NO: 64351 - DNA, 154 bp, Homo sapiens; identical to SEQ ID NO: 43908
  misc_feature 1..154: note = chr13:114742788-114742942
  misc_feature 1..154: note = hypo
  source 1..154: mol_type = genomic DNA

SEQ ID NO: 64352 - DNA, 77 bp, Homo sapiens; identical to SEQ ID NO: 43909
  misc_feature 1..77: note = chr13:114746775-114746852
  misc_feature 1..77: note = hypo
  source 1..77: mol_type = genomic DNA

SEQ ID NO: 64353 - DNA, 498 bp, Homo sapiens
  misc_feature 1..498: note = chr13:114748638-114749136
  misc_feature 1..498: note = hypo
  source 1..498: mol_type = genomic DNA
ggccgggacggcgtgcatctcactttgccggctctgcgctcttccttctcttctccctcccaaaggctgcggctttgcatgggcagcttgctggcgccactgggcgcgtcccgcagactttaaatggaatgagtggaggtctcggactgctgccggatgtagttctggaagctcttgtctccgatggggtgctccctgaaaagggggatgggagagggaatgaggcacagaccccgttgcctggtgctcacccgtggctgcgggagcttttcctgttcctaaatgtgacacactcacactgcaatccacacaaaaaatagaggagccaaaggaaccacagtgcccccggaagcacccacggtgactctgatgtgtgtgcacaggtgggtcaggcgtgcaagtacatgtgcacgtgtgctctccctgtggcacgtgtgtagcgcatatacatgtgcagatgtggaatatgtagagtgtatggcacgtgtgcagaatgtg

SEQ ID NO: 64354 - DNA, 32 bp, Homo sapiens; identical to SEQ ID NO: 43911
  misc_feature 1..32: note = chr13:114749950-114749982
  misc_feature 1..32: note = hypo
  source 1..32: mol_type = genomic DNA

SEQ ID NO: 64355 - DNA, 30 bp, Homo sapiens; identical to SEQ ID NO: 43912
  misc_feature 1..30: note = chr13:114751360-114751390
  misc_feature 1..30: note = hypo
  source 1..30: mol_type = genomic DNA

SEQ ID NO: 64356 - DNA, 64 bp, Homo sapiens; identical to SEQ ID NO: 43913
  misc_feature 1..64: note = chr13:114760951-114761015
  misc_feature 1..64: note = hypo
  source 1..64: mol_type = genomic DNA

SEQ ID NO: 64357 - DNA, 56 bp, Homo sapiens; identical to SEQ ID NO: 43914
  misc_feature 1..56: note = chr13:114765157-114765213
  misc_feature 1..56: note = hypo
  source 1..56: mol_type = genomic DNA

SEQ ID NO: 64358 - DNA, 137 bp, Homo sapiens; identical to SEQ ID NO: 43915
  misc_feature 1..137: note = chr13:114767508-114767645
  misc_feature 1..137: note = hypo
  source 1..137: mol_type = genomic DNA

SEQ ID NO: 64359 - DNA, 81 bp, Homo sapiens; identical to SEQ ID NO: 43916
  misc_feature 1..81: note = chr13:114767926-114768007
  misc_feature 1..81: note = hypo
  source 1..81: mol_type = genomic DNA

SEQ ID NO: 64360 - DNA, 206 bp, Homo sapiens; identical to SEQ ID NO: 43917
  misc_feature 1..206: note = chr13:114769986-114770192
  misc_feature 1..206: note = hypo
  source 1..206: mol_type = genomic DNA

SEQ ID NO: 64361 - DNA, 124 bp, Homo sapiens; identical to SEQ ID NO: 43918
  misc_feature 1..124: note = chr13:114770941-114771065
  misc_feature 1..124: note = hypo
  source 1..124: mol_type = genomic DNA

SEQ ID NO: 64362 - DNA, 179 bp, Homo sapiens; identical to SEQ ID NO: 43919
  misc_feature 1..179: note = chr13:114774968-114775147
  misc_feature 1..179: note = hypo
  source 1..179: mol_type = genomic DNA

SEQ ID NO: 64363 - DNA, 64 bp, Homo sapiens; identical to SEQ ID NO: 43920
  misc_feature 1..64: note = chr13:114776318-114776382
  misc_feature 1..64: note = hypo
  source 1..64: mol_type = genomic DNA

SEQ ID NO: 64364 - DNA, 40 bp, Homo sapiens; identical to SEQ ID NO: 43921
  misc_feature 1..40: note = chr13:114777010-114777050
  misc_feature 1..40: note = hypo
  source 1..40: mol_type = genomic DNA

SEQ ID NO: 64365 - DNA, 34 bp, Homo sapiens; identical to SEQ ID NO: 43922
  misc_feature 1..34: note = chr13:114778697-114778731
  misc_feature 1..34: note = hypo
  source 1..34: mol_type = genomic DNA

SEQ ID NO: 64366 - DNA, 78 bp, Homo sapiens; identical to SEQ ID NO: 43923
  misc_feature 1..78: note = chr13:114779945-114780023
  misc_feature 1..78: note = hypo
  source 1..78: mol_type = genomic DNA

SEQ ID NO: 64367 - skipped

SEQ ID NO: 64368 - DNA, 22 bp, Homo sapiens
  misc_feature 1..22: note = chr13:114781061-114781083
  misc_feature 1..22: note = hypo
  source 1..22: mol_type = genomic DNA
gaatggacgttcactagaatgt

SEQ ID NO: 64369 - DNA, 30 bp, Homo sapiens; identical to SEQ ID NO: 43925
  misc_feature 1..30: note = chr13:114784556-114784586
  misc_feature 1..30: note = hypo
  source 1..30: mol_type = genomic DNA

SEQ ID NO: 64370 - DNA, 66 bp, Homo sapiens; identical to SEQ ID NO: 43926
  misc_feature 1..66: note = chr13:114785766-114785832
  misc_feature 1..66: note = hypo
  source 1..66: mol_type = genomic DNA

SEQ ID NO: 64371 - DNA, 35 bp, Homo sapiens; identical to SEQ ID NO: 43927
  misc_feature 1..35: note = chr13:114786866-114786901
  misc_feature 1..35: note = hypo
  source 1..35: mol_type = genomic DNA

SEQ ID NO: 64372 - DNA, 30 bp, Homo sapiens; identical to SEQ ID NO: 43928
  misc_feature 1..30: note = chr13:114789401-114789431
  misc_feature 1..30: note = hypo
  source 1..30: mol_type = genomic DNA

SEQ ID NO: 64373 - DNA, 36 bp, Homo sapiens; identical to SEQ ID NO: 43929
  misc_feature 1..36: note = chr13:114802282-114802318
  misc_feature 1..36: note = hypo
  source 1..36: mol_type = genomic DNA

SEQ ID NO: 64374 - DNA, 30 bp, Homo sapiens; identical to SEQ ID NO: 43930
  misc_feature 1..30: note = chr13:114802665-114802695
  misc_feature 1..30: note = hypo
  source 1..30: mol_type = genomic DNA

SEQ ID NO: 64375 - DNA, 32 bp, Homo sapiens; identical to SEQ ID NO: 25060
  misc_feature 1..32: note = chr13:114807815-114807847
  misc_feature 1..32: note = hypo
  source 1..32: mol_type = genomic DNA

SEQ ID NO: 64376 - DNA, 18 bp, Homo sapiens
  misc_feature 1..18: note = chr13:114812180-114812198
  misc_feature 1..18: note = hypo
  source 1..18: mol_type = genomic DNA
gtccgagccctgccttca

SEQ ID NO: 64377 - DNA, 53 bp, Homo sapiens; identical to SEQ ID NO: 43933
  misc_feature 1..53: note = chr13:114843043-114843096
  misc_feature 1..53: note = hypo
  source 1..53: mol_type = genomic DNA

SEQ ID NO: 64378 - DNA, 161 bp, Homo sapiens
  misc_feature 1..161: note = chr13:114855474-114855635
  misc_feature 1..161: note = hypo
  source 1..161: mol_type = genomic DNA
tgatatttcatgtcacggatggaacgcattctgtgtatttgttaatcactgatggatgtttgggctgttcccagctttcagttgttgtgaatggtgccgctgtgaagtgtgcacaagttcccatgtgaacacggacagctttgggattctcttgattattt

SEQ ID NO: 64379 - DNA, 38 bp, Homo sapiens; identical to SEQ ID NO: 43935
  misc_feature 1..38: note = chr13:114917035-114917073
  misc_feature 1..38: note = hypo
  source 1..38: mol_type = genomic DNA

SEQ ID NO: 64380 - DNA, 79 bp, Homo sapiens
  misc_feature 1..79: note = chr13:114961744-114961823
  misc_feature 1..79: note = hypo
  source 1..79: mol_type = genomic DNA
ttcagaacttcaggccgtgtgctgacatggaatccctggtgccacgaaagaccccagagcagcacaatctgagctcact

SEQ ID NO: 64381 - DNA, 50 bp, Homo sapiens; identical to SEQ ID NO: 43937
  misc_feature 1..50: note = chr13:114989948-114989998
  misc_feature 1..50: note = hypo
  source 1..50: mol_type = genomic DNA

SEQ ID NO: 64382 - DNA, 30 bp, Homo sapiens; identical to SEQ ID NO: 43938
  misc_feature 1..30: note = chr14:19828313-19828343
  misc_feature 1..30: note = hypo
  source 1..30: mol_type = genomic DNA

SEQ ID NO: 64383 - DNA, 30 bp, Homo sapiens; identical to SEQ ID NO: 43939
  misc_feature 1..30: note = chr14:20928272-20928302
  misc_feature 1..30: note = hypo
  source 1..30: mol_type = genomic DNA

SEQ ID NO: 64384 - DNA, 107 bp, Homo sapiens; identical to SEQ ID NO: 43940
  misc_feature 1..107: note = chr14:21190405-21190512
  misc_feature 1..107: note = hypo
  source 1..107: mol_type = genomic DNA

SEQ ID NO: 64385 - DNA, 24 bp, Homo sapiens
  misc_feature 1..24: note = chr14:21265229-21265253
  misc_feature 1..24: note = hypo
  source 1..24: mol_type = genomic DNA
gcacctggccgtagcttctaattc

SEQ ID NO: 64386 - DNA, 23 bp, Homo sapiens
  misc_feature 1..23: note = chr14:21282035-21282058
  misc_feature 1..23: note = hypo
  source 1..23: mol_type = genomic DNA
atgtttctggctgggcgcagtgg

SEQ ID NO: 64387 - DNA, 32 bp, Homo sapiens; identical to SEQ ID NO: 43943
  misc_feature 1..32: note = chr14:21657875-21657907
  misc_feature 1..32: note = hypo
  source 1..32: mol_type = genomic DNA

SEQ ID NO: 64388 - DNA, 30 bp, Homo sapiens; identical to SEQ ID NO: 43944
  misc_feature 1..30: note = chr14:21721854-21721884
  misc_feature 1..30: note = hypo
  source 1..30: mol_type = genomic DNA

SEQ ID NO: 64389 - DNA, 42 bp, Homo sapiens; identical to SEQ ID NO: 43945
  misc_feature 1..42: note = chr14:21980230-21980272
  misc_feature 1..42: note = hypo
  source 1..42: mol_type = genomic DNA

SEQ ID NO: 64390 - DNA, 38 bp, Homo sapiens; identical to SEQ ID NO: 43946
  misc_feature 1..38: note = chr14:22551269-22551307
  misc_feature 1..38: note = hypo
  source 1..38: mol_type = genomic DNA

SEQ ID NO: 64391 - DNA, 30 bp, Homo sapiens; identical to SEQ ID NO: 43947
  misc_feature 1..30: note = chr14:23183874-23183904
  misc_feature 1..30: note = hypo
  source 1..30: mol_type = genomic DNA

SEQ ID NO: 64392 - DNA, 46 bp, Homo sapiens; identical to SEQ ID NO: 43948
  misc_feature 1..46: note = chr14:23355390-23355436
  misc_feature 1..46: note = hypo
  source 1..46: mol_type = genomic DNA

SEQ ID NO: 64393 - DNA, 41 bp, Homo sapiens; identical to SEQ ID NO: 43949
  misc_feature 1..41: note = chr14:23426904-23426945
  misc_feature 1..41: note = hypo
  source 1..41: mol_type = genomic DNA

SEQ ID NO: 64394 - DNA, 141 bp, Homo sapiens; identical to SEQ ID NO: 43951
  misc_feature 1..141: note = chr14:23707497-23707638
  misc_feature 1..141: note = hypo
  source 1..141: mol_type = genomic DNA

SEQ ID NO: 64395 - DNA, 285 bp, Homo sapiens; identical to SEQ ID NO: 43952
  misc_feature 1..285: note = chr14:23776954-23777239
  misc_feature 1..285: note = hypo
  source 1..285: mol_type = genomic DNA

SEQ ID NO: 64396 - DNA, 94 bp, Homo sapiens; identical to SEQ ID NO: 43953
  misc_feature 1..94: note = chr14:23884288-23884382
  misc_feature 1..94: note = hypo
  source 1..94: mol_type = genomic DNA

SEQ ID NO: 64397 - DNA, 93 bp, Homo sapiens; identical to SEQ ID NO: 43954
  misc_feature 1..93: note = chr14:24021398-24021491
  misc_feature 1..93: note = hypo
  source 1..93: mol_type = genomic DNA

SEQ ID NO: 64398 - DNA, 153 bp, Homo sapiens; identical to SEQ ID NO: 15809
  misc_feature 1..153: note = chr14:24862082-24862235
  misc_feature 1..153: note = hypo
  source 1..153: mol_type = genomic DNA

SEQ ID NO: 64399 - DNA, 30 bp, Homo sapiens; identical to SEQ ID NO: 43956
  misc_feature 1..30: note = chr14:24901976-24902006
  misc_feature 1..30: note = hypo
  source 1..30: mol_type = genomic DNA

SEQ ID NO: 64400 - DNA, 100 bp, Homo sapiens; identical to SEQ ID NO: 43957
  misc_feature 1..100: note = chr14:31027393-31027493
  misc_feature 1..100: note = hypo
  source 1..100: mol_type = genomic DNA

SEQ ID NO: 64401 - DNA, 119 bp, Homo sapiens; identical to SEQ ID NO: 43958
  misc_feature 1..119: note = chr14:31534496-31534615
  misc_feature 1..119: note = hypo
  source 1..119: mol_type = genomic DNA

SEQ ID NO: 64402 - DNA, 97 bp, Homo sapiens; identical to SEQ ID NO: 43960
  misc_feature 1..97: note = chr14:32597741-32597838
  misc_feature 1..97: note = hypo
  source 1..97: mol_type = genomic DNA

SEQ ID NO: 64403 - DNA, 23 bp, Homo sapiens
  misc_feature 1..23: note = chr14:34920639-34920662
  misc_feature 1..23: note = hypo
  source 1..23: mol_type = genomic DNA
caattctaggctgggcgcggtag

SEQ ID NO: 64404 - DNA, 16 bp, Homo sapiens
  misc_feature 1..16: note = chr14:34921211-34921227
  misc_feature 1..16: note = hypo
  source 1..16: mol_type = genomic DNA
tagcgtggtggctcac

SEQ ID NO: 64405 - DNA, 30 bp, Homo sapiens; identical to SEQ ID NO: 43963
  misc_feature 1..30: note = chr14:35017114-35017144
  misc_feature 1..30: note = hypo
  source 1..30: mol_type = genomic DNA

SEQ ID NO: 64406 - DNA, 289 bp, Homo sapiens
  misc_feature 1..289: note = chr14:35023322-35023611
  misc_feature 1..289: note = hypo
  source 1..289: mol_type = genomic DNA
cgggggtgggagagagaaaatctacaccgggctgcataggtaaattcgtaggttaggtgctaagtgctttgaaaaagcaaacaaacacagggaaagtgagataaggagttgcggcaaggggcaggtggctgtgttaaatcgagtggttggaagaagctgctatgagaaggtaccgtatgagcaaaggacttgaagcaggtgaagggagttggtcacggggcatccccagcacaaacatcagctacagcaaaggcccaggtaggactgggtttggcgaacagcaaggagg

SEQ ID NO: 64407 - DNA, 17 bp, Homo sapiens
  misc_feature 1..17: note = chr14:35507705-35507722
  misc_feature 1..17: note = hypo
  source 1..17: mol_type = genomic DNA
ttacgaatagagcgccg

SEQ ID NO: 64408 - DNA, 30 bp, Homo sapiens; identical to SEQ ID NO: 15815
  misc_feature 1..30: note = chr14:35866882-35866912
  misc_feature 1..30: note = hypo
  source 1..30: mol_type = genomic DNA

SEQ ID NO: 64409 - DNA, 30 bp, Homo sapiens; identical to SEQ ID NO: 43968
  misc_feature 1..30: note = chr14:36458365-36458395
  misc_feature 1..30: note = hypo
  source 1..30: mol_type = genomic DNA

SEQ ID NO: 64410 - DNA, 20 bp, Homo sapiens
  misc_feature 1..20: note = chr14:40125126-40125146
  misc_feature 1..20: note = hypo
  source 1..20: mol_type = genomic DNA
tcccagtatgagcaacgcag

SEQ ID NO: 64411 - DNA, 23 bp, Homo sapiens
  misc_feature 1..23: note = chr14:40221669-40221692
  misc_feature 1..23: note = hypo
  source 1..23: mol_type = genomic DNA
cgagagtccgtctcaaaaaaaaa

SEQ ID NO: 64412 - DNA, 25 bp, Homo sapiens
  misc_feature 1..25: note = chr14:45382862-45382887
  misc_feature 1..25: note = hypo
  source 1..25: mol_type = genomic DNA
ggtctcgaaacgctagcctccagtt

SEQ ID NO: 64413 - DNA, 27 bp, Homo sapiens
  misc_feature 1..27: note = chr14:48095553-48095580
  misc_feature 1..27: note = hypo
  source 1..27: mol_type = genomic DNA
attcttcttcctgtccgctacactgtg

SEQ ID NO: 64414 - DNA, 30 bp, Homo sapiens; identical to SEQ ID NO: 43973
  misc_feature 1..30: note = chr14:48135049-48135079
  misc_feature 1..30: note = hypo
  source 1..30: mol_type = genomic DNA

SEQ ID NO: 64415 - DNA, 40 bp, Homo sapiens; identical to SEQ ID NO: 43974
  misc_feature 1..40: note = chr14:50098049-50098089
  misc_feature 1..40: note = hypo
  source 1..40: mol_type = genomic DNA

SEQ ID NO: 64416 - DNA, 180 bp, Homo sapiens; identical to SEQ ID NO: 43975
  misc_feature 1..180: note = chr14:50233117-50233297
  misc_feature 1..180: note = hypo
  source 1..180: mol_type = genomic DNA

SEQ ID NO: 64417 - DNA, 144 bp, Homo sapiens; identical to SEQ ID NO: 43976
  misc_feature 1..144: note = chr14:50233597-50233741
  misc_feature 1..144: note = hypo
  source 1..144: mol_type = genomic DNA

SEQ ID NO: 64418 - DNA, 30 bp, Homo sapiens; identical to SEQ ID NO: 43977
  misc_feature 1..30: note = chr14:50287126-50287156
  misc_feature 1..30: note = hypo
  source 1..30: mol_type = genomic DNA

SEQ ID NO: 64419 - DNA, 89 bp, Homo sapiens
  misc_feature 1..89: note = chr14:50333994-50334083
  misc_feature 1..89: note = hypo
  source 1..89: mol_type = genomic DNA
ttgcttttttaacagtgcaaaaaacaaggccgtgtctggctatatggggctttgcttgttcaaaatgtaacctctatacggccgcgcgc

SEQ ID NO: 64420 - DNA, 29 bp, Homo sapiens
  misc_feature 1..29: note = chr14:50434015-50434044
  misc_feature 1..29: note = hypo
  source 1..29: mol_type = genomic DNA
catttatgcataaacgatcacatgacatg

SEQ ID NO: 64421 - DNA, 54 bp, Homo sapiens; identical to SEQ ID NO: 43981
  misc_feature 1..54: note = chr14:50777944-50777998
  misc_feature 1..54: note = hypo
  source 1..54: mol_type = genomic DNA

SEQ ID NO: 64422 - DNA, 43 bp, Homo sapiens; identical to SEQ ID NO: 43982
  misc_feature 1..43: note = chr14:52226966-52227009
  misc_feature 1..43: note = hypo
  source 1..43: mol_type = genomic DNA

SEQ ID NO: 64423 - DNA, 30 bp, Homo sapiens; identical to SEQ ID NO: 43983
  misc_feature 1..30: note = chr14:52321518-52321548
  misc_feature 1..30: note = hypo
  source 1..30: mol_type = genomic DNA

SEQ ID NO: 64424 - DNA, 15 bp, Homo sapiens
  misc_feature 1..15: note = chr14:54956536-54956551
  misc_feature 1..15: note = hypo
  source 1..15: mol_type = genomic DNA
cgctgggatcacagg

SEQ ID NO: 64425 - DNA, 39 bp, Homo sapiens; identical to SEQ ID NO: 43985
  misc_feature 1..39: note = chr14:55517158-55517197
  misc_feature 1..39: note = hypo
  source 1..39: mol_type = genomic DNA

SEQ ID NO: 64426 - DNA, 30 bp, Homo sapiens; identical to SEQ ID NO: 15822
  misc_feature 1..30: note = chr14:55664068-55664098
  misc_feature 1..30: note = hypo
  source 1..30: mol_type = genomic DNA

SEQ ID NO: 64427 - DNA, 30 bp, Homo sapiens; identical to SEQ ID NO: 43988
  misc_feature 1..30: note = chr14:56077686-56077716
  misc_feature 1..30: note = hypo
  source 1..30: mol_type = genomic DNA

SEQ ID NO: 64428 - DNA, 48 bp, Homo sapiens
  misc_feature 1..48: note = chr14:57045739-57045787
  misc_feature 1..48: note = hypo
  source 1..48: mol_type = genomic DNA
gtccttattaacggctccgattctttttttttgcgttacagctcattg

SEQ ID NO: 64429 - DNA, 30 bp, Homo sapiens; identical to SEQ ID NO: 43990
  misc_feature 1..30: note = chr14:58410326-58410356
  misc_feature 1..30: note = hypo
  source 1..30: mol_type = genomic DNA

SEQ ID NO: 64430 - DNA, 23 bp, Homo sapiens
  misc_feature 1..23: note = chr14:58599589-58599612
  misc_feature 1..23: note = hypo
  source 1..23: mol_type = genomic DNA
actgcgcccggccaacccttgtc

SEQ ID NO: 64431 - DNA, 40 bp, Homo sapiens; identical to SEQ ID NO: 43992
  misc_feature 1..40: note = chr14:58893188-58893228
  misc_feature 1..40: note = hypo
  source 1..40: mol_type = genomic DNA

SEQ ID NO: 64432 - DNA, 88 bp, Homo sapiens; identical to SEQ ID NO: 43993
  misc_feature 1..88: note = chr14:64022981-64023069
  misc_feature 1..88: note = hypo
  source 1..88: mol_type = genomic DNA

SEQ ID NO: 64433 - DNA, 30 bp, Homo sapiens; identical to SEQ ID NO: 43994
  misc_feature 1..30: note = chr14:65086478-65086508
  misc_feature 1..30: note = hypo
  source 1..30: mol_type = genomic DNA

SEQ ID NO: 64434 - DNA, 21 bp, Homo sapiens
  misc_feature 1..21: note = chr14:65233318-65233339
  misc_feature 1..21: note = hypo
  source 1..21: mol_type = genomic DNA
ggggaggatggagggcggggc

SEQ ID NO: 64435 - DNA, 15 bp, Homo sapiens
  misc_feature 1..15: note = chr14:65233464-65233479
  misc_feature 1..15: note = hypo
  source 1..15: mol_type = genomic DNA
cgcatggtgggaaac

SEQ ID NO: 64436 - DNA, 399 bp, Homo sapiens; identical to SEQ ID NO: 43996
  misc_feature 1..399: note = chr14:65239395-65239794
  misc_feature 1..399: note = hypo
  source 1..399: mol_type = genomic DNA

SEQ ID NO: 64437 - DNA, 63 bp, Homo sapiens; identical to SEQ ID NO: 43997
  misc_feature 1..63: note = chr14:65273132-65273195
  misc_feature 1..63: note = hypo
  source 1..63: mol_type = genomic DNA

SEQ ID NO: 64438 - DNA, 107 bp, Homo sapiens; identical to SEQ ID NO: 43998
  misc_feature 1..107: note = chr14:65406280-65406387
  misc_feature 1..107: note = hypo
  source 1..107: mol_type = genomic DNA

SEQ ID NO: 64439 - DNA, 17 bp, Homo sapiens
  misc_feature 1..17: note = chr14:66499286-66499303
  misc_feature 1..17: note = hypo
  source 1..17: mol_type = genomic DNA
accggagctgttcctgt

SEQ ID NO: 64440 - DNA, 41 bp, Homo sapiens; identical to SEQ ID NO: 44000
  misc_feature 1..41: note = chr14:66560653-66560694
  misc_feature 1..41: note = hypo
  source 1..41: mol_type = genomic DNA

SEQ ID NO: 64441 - DNA, 189 bp, Homo sapiens; identical to SEQ ID NO: 44001
  misc_feature 1..189: note = chr14:66792112-66792301
  misc_feature 1..189: note = hypo
  source 1..189: mol_type = genomic DNA

SEQ ID NO: 64442 - DNA, 181 bp, Homo sapiens; identical to SEQ ID NO: 44002
  misc_feature 1..181: note = chr14:67688245-67688426
  misc_feature 1..181: note = hypo
  source 1..181: mol_type = genomic DNA

SEQ ID NO: 64443 - DNA, 30 bp, Homo sapiens; identical to SEQ ID NO: 44003
  misc_feature 1..30: note = chr14:67879219-67879249
  misc_feature 1..30: note = hypo
  source 1..30: mol_type = genomic DNA

SEQ ID NO: 64444 - DNA, 39 bp, Homo sapiens; identical to SEQ ID NO: 25084
  misc_feature 1..39: note = chr14:67886606-67886645
  misc_feature 1..39: note = hypo
  source 1..39: mol_type = genomic DNA

SEQ ID NO: 64445 - DNA, 139 bp, Homo sapiens; identical to SEQ ID NO: 44005
  misc_feature 1..139: note = chr14:68067690-68067829
  misc_feature 1..139: note = hypo
  source 1..139: mol_type = genomic DNA

SEQ ID NO: 64446 - DNA, 30 bp, Homo sapiens; identical to SEQ ID NO: 44006
  misc_feature 1..30: note = chr14:68231335-68231365
  misc_feature 1..30: note = hypo
  source 1..30: mol_type = genomic DNA

SEQ ID NO: 64447 - DNA, 36 bp, Homo sapiens; identical to SEQ ID NO: 44007
  misc_feature 1..36: note = chr14:68284131-68284167
  misc_feature 1..36: note = hypo
  source 1..36: mol_type = genomic DNA

SEQ ID NO: 64448 - DNA, 30 bp, Homo sapiens; identical to SEQ ID NO: 44009
  misc_feature 1..30: note = chr14:69245934-69245964
  misc_feature 1..30: note = hypo
  source 1..30: mol_type = genomic DNA

SEQ ID NO: 64449 - DNA, 132 bp, Homo sapiens; identical to SEQ ID NO: 44011
  misc_feature 1..132: note = chr14:70701228-70701360
  misc_feature 1..132: note = hypo
  source 1..132: mol_type = genomic DNA

SEQ ID NO: 64450 - DNA, 30 bp, Homo sapiens; identical to SEQ ID NO: 15833
  misc_feature 1..30: note = chr14:72892242-72892272
  misc_feature 1..30: note = hypo
  source 1..30: mol_type = genomic DNA

SEQ ID NO: 64451 - DNA, 30 bp, Homo sapiens; identical to SEQ ID NO: 44013
  misc_feature 1..30: note = chr14:72976891-72976921
  misc_feature 1..30: note = hypo
  source 1..30: mol_type = genomic DNA

SEQ ID NO: 64452 - DNA, 73 bp, Homo sapiens; identical to SEQ ID NO: 44014
  misc_feature 1..73: note = chr14:73029715-73029788
  misc_feature 1..73: note = hypo
  source 1..73: mol_type = genomic DNA

SEQ ID NO: 64453 - DNA, 250 bp, Homo sapiens; identical to SEQ ID NO: 44015
  misc_feature 1..250: note = chr14:73140612-73140862
  misc_feature 1..250: note = hypo
  source 1..250: mol_type = genomic DNA

SEQ ID NO: 64454 - DNA, 30 bp, Homo sapiens; identical to SEQ ID NO: 44016
  misc_feature 1..30: note = chr14:73146807-73146837
  misc_feature 1..30: note = hypo
  source 1..30: mol_type = genomic DNA

SEQ ID NO: 64455 - DNA, 221 bp, Homo sapiens; identical to SEQ ID NO: 44017
  misc_feature 1..221: note = chr14:73147279-73147500
  misc_feature 1..221: note = hypo
  source 1..221: mol_type = genomic DNA

SEQ ID NO: 64456 - DNA, 30 bp, Homo sapiens; identical to SEQ ID NO: 44018
  misc_feature 1..30: note = chr14:73150302-73150332
  misc_feature 1..30: note = hypo
  source 1..30: mol_type = genomic DNA

SEQ ID NO: 64457 - DNA, 37 bp, Homo sapiens; identical to SEQ ID NO: 44019
  misc_feature 1..37: note = chr14:73157349-73157386
  misc_feature 1..37: note = hypo
  source 1..37: mol_type = genomic DNA

SEQ ID NO: 64458 - DNA, 151 bp, Homo sapiens; identical to SEQ ID NO: 44021
  misc_feature 1..151: note = chr14:73172944-73173095
  misc_feature 1..151: note = hypo
  source 1..151: mol_type = genomic DNA

SEQ ID NO: 64459 - DNA, 62 bp, Homo sapiens
  misc_feature 1..62: note = chr14:73175148-73175210
  misc_feature 1..62: note = hypo
  source 1..62: mol_type = genomic DNA
ccaaggacctgcaagacaactgagtgatgagcccagcttcccttccgcgacaaaggcagtga

SEQ ID NO: 64460 - DNA, 30 bp, Homo sapiens; identical to SEQ ID NO: 44023
  misc_feature 1..30: note = chr14:73176464-73176494
  misc_feature 1..30: note = hypo
  source 1..30: mol_type = genomic DNA

SEQ ID NO: 64461 - DNA, 30 bp, Homo sapiens; identical to SEQ ID NO: 44024
  misc_feature 1..30: note = chr14:73178102-73178132
  misc_feature 1..30: note = hypo
  source 1..30: mol_type = genomic DNA

SEQ ID NO: 64462 - DNA, 87 bp, Homo sapiens
  misc_feature 1..87: note = chr14:73178865-73178952
  misc_feature 1..87: note = hypo
  source 1..87: mol_type = genomic DNA
aaagcctgccgtcaggcctcccaggcactacagggcacacagaaggtgggagagagcctgcggggagggcatcgagagaagcaaacg

SEQ ID NO: 64463 - DNA, 95 bp, Homo sapiens
  misc_feature 1..95: note = chr14:73180113-73180208
  misc_feature 1..95: note = hypo
  source 1..95: mol_type = genomic DNA
gccccacccctaccccgccttgccagctctctccctgccttcagggagactgcagaccctggcgagatgggtgggacacccagagggagacccgt

SEQ ID NO: 64464 - DNA, 37 bp, Homo sapiens; identical to SEQ ID NO: 44027
  misc_feature 1..37: note = chr14:73185482-73185519
  misc_feature 1..37: note = hypo
  source 1..37: mol_type = genomic DNA

SEQ ID NO: 64465 - DNA, 146 bp, Homo sapiens; identical to SEQ ID NO: 44028
  misc_feature 1..146: note = chr14:73194579-73194725
  misc_feature 1..146: note = hypo
  source 1..146: mol_type = genomic DNA

SEQ ID NO: 64466 - DNA, 166 bp, Homo sapiens; identical to SEQ ID NO: 15840
  misc_feature 1..166: note = chr14:73195193-73195359
  misc_feature 1..166: note = hypo
  source 1..166: mol_type = genomic DNA

SEQ ID NO: 64467 - DNA, 79 bp, Homo sapiens; identical to SEQ ID NO: 44030
  misc_feature 1..79: note = chr14:73195581-73195660
  misc_feature 1..79: note = hypo
  source 1..79: mol_type = genomic DNA

SEQ ID NO: 64468 - DNA, 30 bp, Homo sapiens; identical to SEQ ID NO: 44031
  misc_feature 1..30: note = chr14:73196936-73196966
  misc_feature 1..30: note = hypo
  source 1..30: mol_type = genomic DNA

SEQ ID NO: 64469 - DNA, 30 bp, Homo sapiens; identical to SEQ ID NO: 44032
  misc_feature 1..30: note = chr14:73197190-73197220
  misc_feature 1..30: note = hypo
  source 1..30: mol_type = genomic DNA

SEQ ID NO: 64470 - DNA, 35 bp, Homo sapiens; identical to SEQ ID NO: 44033
  misc_feature 1..35: note = chr14:73198555-73198590
  misc_feature 1..35: note = hypo
  source 1..35: mol_type = genomic DNA

SEQ ID NO: 64471 - DNA, 152 bp, Homo sapiens; identical to SEQ ID NO: 44034
  misc_feature 1..152: note = chr14:73202868-73203020
  misc_feature 1..152: note = hypo
  source 1..152: mol_type = genomic DNA

SEQ ID NO: 64472 - DNA, 445 bp, Homo sapiens; identical to SEQ ID NO: 44035
  misc_feature 1..445: note = chr14:73209603-73210048
  misc_feature 1..445: note = hypo
  source 1..445: mol_type = genomic DNA

SEQ ID NO: 64473 - DNA, 96 bp, Homo sapiens; identical to SEQ ID NO: 44036
  misc_feature 1..96: note = chr14:73226814-73226910
  misc_feature 1..96: note = hypo
  source 1..96: mol_type = genomic DNA

SEQ ID NO: 64474 - DNA, 114 bp, Homo sapiens; identical to SEQ ID NO: 44037
  misc_feature 1..114: note = chr14:73273305-73273419
  misc_feature 1..114: note = hypo
  source 1..114: mol_type = genomic DNA

SEQ ID NO: 64475 - DNA, 30 bp, Homo sapiens; identical to SEQ ID NO: 15844
  misc_feature 1..30: note = chr14:73275087-73275117
  misc_feature 1..30: note = hypo
  source 1..30: mol_type = genomic DNA

SEQ ID NO: 64476 - DNA, 30 bp, Homo sapiens; identical to SEQ ID NO: 44039
  misc_feature 1..30: note = chr14:73300028-73300058
  misc_feature 1..30: note = hypo
  source 1..30: mol_type = genomic DNA

SEQ ID NO: 64477 - DNA, 32 bp, Homo sapiens; identical to SEQ ID NO: 15845
  misc_feature 1..32: note = chr14:73313912-73313944
  misc_feature 1..32: note = hypo
  source 1..32: mol_type = genomic DNA

SEQ ID NO: 64478 - DNA, 86 bp, Homo sapiens
  misc_feature 1..86: note = chr14:73318385-73318471
  misc_feature 1..86: note = hypo
  source 1..86: mol_type = genomic DNA
cacaaactaacttcccgagggatgagtattttgatgcagatacttcttcaagtgaaaaatgtacaatgtacaaaatgtccactcga

SEQ ID NO: 64479 - DNA, 30 bp, Homo sapiens; identical to SEQ ID NO: 44042
  misc_feature 1..30: note = chr14:73318945-73318975
  misc_feature 1..30: note = hypo
  source 1..30: mol_type = genomic DNA

SEQ ID NO: 64480 - DNA, 30 bp, Homo sapiens; identical to SEQ ID NO: 44043
  misc_feature 1..30: note = chr14:73331141-73331171
  misc_feature 1..30: note = hypo
  source 1..30: mol_type = genomic DNA

SEQ ID NO: 64481 - DNA, 93 bp, Homo sapiens
  misc_feature 1..93: note = chr14:73333156-73333249
  misc_feature 1..93: note = hypo
  source 1..93: mol_type = genomic DNA
gaacccaagcttattcgaatgcacaggctcaggtacccgcctctgctccatcgataccagccatggagtcttgggcaaatcttgggcaactcc

SEQ ID NO: 64482 - DNA, 77 bp, Homo sapiens
  misc_feature 1..77: note = chr14:73602389-73602466
  misc_feature 1..77: note = hypo
  source 1..77: mol_type = genomic DNA
ttttaaagaaactttagaagaatgtaacttgcccagataccatgtaccgttaatttcattttcggttttttgaatac

SEQ ID NO: 64483 - DNA, 30 bp, Homo sapiens; identical to SEQ ID NO: 44046
  misc_feature 1..30: note = chr14:73691528-73691558
  misc_feature 1..30: note = hypo
  source 1..30: mol_type = genomic DNA

SEQ ID NO: 64484 - DNA, 30 bp, Homo sapiens; identical to SEQ ID NO: 15848
  misc_feature 1..30: note = chr14:73958845-73958875
  misc_feature 1..30: note = hypo
  source 1..30: mol_type = genomic DNA

SEQ ID NO: 64485 - DNA, 109 bp, Homo sapiens; identical to SEQ ID NO: 44048
  misc_feature 1..109: note = chr14:73959120-73959229
  misc_feature 1..109: note = hypo
  source 1..109: mol_type = genomic DNA

SEQ ID NO: 64486 - DNA, 60 bp, Homo sapiens; identical to SEQ ID NO: 44049
  misc_feature 1..60: note = chr14:74717689-74717749
  misc_feature 1..60: note = hypo
  source 1..60: mol_type = genomic DNA

SEQ ID NO: 64487 - DNA, 38 bp, Homo sapiens; identical to SEQ ID NO: 44050
  misc_feature 1..38: note = chr14:75389373-75389411
  misc_feature 1..38: note = hypo
  source 1..38: mol_type = genomic DNA

SEQ ID NO: 64488 - DNA, 18 bp, Homo sapiens
  misc_feature 1..18: note = chr14:75390699-75390717
  misc_feature 1..18: note = hypo
  source 1..18: mol_type = genomic DNA
gatcgtgtcactgcactc

SEQ ID NO: 64489 - DNA, 30 bp, Homo sapiens; identical to SEQ ID NO: 44052
  misc_feature 1..30: note = chr14:75446328-75446358
  misc_feature 1..30: note = hypo
  source 1..30: mol_type = genomic DNA

SEQ ID NO: 64490 - DNA, 18 bp, Homo sapiens
  misc_feature 1..18: note = chr14:75517394-75517412
  misc_feature 1..18: note = hypo
  source 1..18: mol_type = genomic DNA
gcccggccagaaggtcat

SEQ ID NO: 64491 - DNA, 153 bp, Homo sapiens; identical to SEQ ID NO: 44054
  misc_feature 1..153: note = chr14:75760140-75760293
  misc_feature 1..153: note = hypo
  source 1..153: mol_type = genomic DNA

SEQ ID NO: 64492 - DNA, 30 bp, Homo sapiens; identical to SEQ ID NO: 44055
  misc_feature 1..30: note = chr14:76101271-76101301
  misc_feature 1..30: note = hypo
  source 1..30: mol_type = genomic DNA

SEQ ID NO: 64493 - DNA, 172 bp, Homo sapiens; identical to SEQ ID NO: 44056
  misc_feature 1..172: note = chr14:76998049-76998221
  misc_feature 1..172: note = hypo
  source 1..172: mol_type = genomic DNA

SEQ ID NO: 64494 - DNA, 30 bp, Homo sapiens; identical to SEQ ID NO: 44057
  misc_feature 1..30: note = chr14:77242483-77242513
  misc_feature 1..30: note = hypo
  source 1..30: mol_type = genomic DNA

SEQ ID NO: 64495 - DNA, 30 bp, Homo sapiens; identical to SEQ ID NO: 44058
  misc_feature 1..30: note = chr14:78141401-78141431
  misc_feature 1..30: note = hypo
  source 1..30: mol_type = genomic DNA

SEQ ID NO: 64496 - DNA, 34 bp, Homo sapiens; identical to SEQ ID NO: 44059
  misc_feature 1..34: note = chr14:78247790-78247824
  misc_feature 1..34: note = hypo
  source 1..34: mol_type = genomic DNA

SEQ ID NO: 64497 - DNA, 30 bp, Homo sapiens; identical to SEQ ID NO: 44060
  misc_feature 1..30: note = chr14:79111630-79111660
  misc_feature 1..30: note = hypo
  source 1..30: mol_type = genomic DNA

SEQ ID NO: 64498 - DNA, 30 bp, Homo sapiens; identical to SEQ ID NO: 44061
  misc_feature 1..30: note = chr14:81489175-81489205
  misc_feature 1..30: note = hypo
  source 1..30: mol_type = genomic DNA

SEQ ID NO: 64499 - DNA, 30 bp, Homo sapiens; identical to SEQ ID NO: 44062
  misc_feature 1..30: note = chr14:88673478-88673508
  misc_feature 1..30: note = hypo
  source 1..30: mol_type = genomic DNA

SEQ ID NO: 64500 - DNA, 33 bp, Homo sapiens; identical to SEQ ID NO: 44063
  misc_feature 1..33: note = chr14:89606032-89606065
  misc_feature 1..33: note = hypo
  source 1..33: mol_type = genomic DNA

SEQ ID NO: 64501 - DNA, 98 bp, Homo sapiens; identical to SEQ ID NO: 44064
  misc_feature 1..98: note = chr14:89657653-89657751
  misc_feature 1..98: note = hypo
  source 1..98: mol_type = genomic DNA

SEQ ID NO: 64502 - DNA, 30 bp, Homo sapiens; identical to SEQ ID NO: 44065
  misc_feature 1..30: note = chr14:89895234-89895264
  misc_feature 1..30: note = hypo
  source 1..30: mol_type = genomic DNA

SEQ ID NO: 64503 - DNA, 30 bp, Homo sapiens; identical to SEQ ID NO: 44066
  misc_feature 1..30: note = chr14:89918720-89918750
  misc_feature 1..30: note = hypo
  source 1..30: mol_type = genomic DNA

SEQ ID NO: 64504 - DNA, 20 bp, Homo sapiens
  misc_feature 1..20: note = chr14:89962546-89962566
  misc_feature 1..20: note = hypo
  source 1..20: mol_type = genomic DNA
aactccgtctcaaaaaaaga

SEQ ID NO: 64505 - DNA, 30 bp, Homo sapiens; identical to SEQ ID NO: 44068
  misc_feature 1..30: note = chr14:90043896-90043926
  misc_feature 1..30: note = hypo
  source 1..30: mol_type = genomic DNA

SEQ ID NO: 64506 - DNA, 30 bp, Homo sapiens; identical to SEQ ID NO: 44069
  misc_feature 1..30: note = chr14:90650692-90650722
  misc_feature 1..30: note = hypo
  source 1..30: mol_type = genomic DNA

SEQ ID NO: 64507 - DNA, 32 bp, Homo sapiens; identical to SEQ ID NO: 44070
  misc_feature 1..32: note = chr14:90724207-90724239
  misc_feature 1..32: note = hypo
  source 1..32: mol_type = genomic DNA

SEQ ID NO: 64508 - DNA, 30 bp, Homo sapiens; identical to SEQ ID NO: 15852
  misc_feature 1..30: note = chr14:90983280-90983310
  misc_feature 1..30: note = hypo
  source 1..30: mol_type = genomic DNA

SEQ ID NO: 64509 - DNA, 30 bp, Homo sapiens; identical to SEQ ID NO: 44072
  misc_feature 1..30: note = chr14:91059804-91059834
  misc_feature 1..30: note = hypo
  source 1..30: mol_type = genomic DNA

SEQ ID NO: 64510 - DNA, 114 bp, Homo sapiens; identical to SEQ ID NO: 44074
  misc_feature 1..114: note = chr14:91747935-91748049
  misc_feature 1..114: note = hypo
  source 1..114: mol_type = genomic DNA

SEQ ID NO: 64511 - DNA, 30 bp, Homo sapiens; identical to SEQ ID NO: 44075
  misc_feature 1..30: note = chr14:91754764-91754794
  misc_feature 1..30: note = hypo
  source 1..30: mol_type = genomic DNA

SEQ ID NO: 64512 - DNA, 66 bp, Homo sapiens
  misc_feature 1..66: note = chr14:91766450-91766516
  misc_feature 1..66: note = hypo
  source 1..66: mol_type = genomic DNA
ggccttcttttccgacaggtaactcacatcccagaggatctgcgtgcctcccgtgagaaaatggga

SEQ ID NO: 64513 - DNA, 90 bp, Homo sapiens; identical to SEQ ID NO: 44077
  misc_feature 1..90: note = chr14:91849645-91849735
  misc_feature 1..90: note = hypo
  source 1..90: mol_type = genomic DNA

SEQ ID NO: 64514 - DNA, 30 bp, Homo sapiens; identical to SEQ ID NO: 44078
  misc_feature 1..30: note = chr14:91850063-91850093
  misc_feature 1..30: note = hypo
  source 1..30: mol_type = genomic DNA

SEQ ID NO: 64515 - DNA, 30 bp, Homo sapiens; identical to SEQ ID NO: 44079
  misc_feature 1..30: note = chr14:92801258-92801288
  misc_feature 1..30: note = hypo
  source 1..30: mol_type = genomic DNA

SEQ ID NO: 64516 - DNA, 191 bp, Homo sapiens; identical to SEQ ID NO: 44080
  misc_feature 1..191: note = chr14:92829024-92829215
  misc_feature 1..191: note = hypo
  source 1..191: mol_type = genomic DNA

SEQ ID NO: 64517 - DNA, 30 bp, Homo sapiens; identical to SEQ ID NO: 44081
  misc_feature 1..30: note = chr14:93065511-93065541
  misc_feature 1..30: note = hypo
  source 1..30: mol_type = genomic DNA

SEQ ID NO: 64518 - DNA, 79 bp, Homo sapiens; identical to SEQ ID NO: 44082
  misc_feature 1..79: note = chr14:93151456-93151535
  misc_feature 1..79: note = hypo
  source 1..79: mol_type = genomic DNA

SEQ ID NO: 64519 - DNA, 124 bp, Homo sapiens; identical to SEQ ID NO: 25105
  misc_feature 1..124: note = chr14:93154937-93155061
  misc_feature 1..124: note = hypo
  source 1..124: mol_type = genomic DNA

SEQ ID NO: 64520 - DNA, 30 bp, Homo sapiens; identical to SEQ ID NO: 44084
  misc_feature 1..30: note = chr14:93454054-93454084
  misc_feature 1..30: note = hypo
  source 1..30: mol_type = genomic DNA

SEQ ID NO: 64521 - DNA, 37 bp, Homo sapiens; identical to SEQ ID NO: 15855
  misc_feature 1..37: note = chr14:93697020-93697057
  misc_feature 1..37: note = hypo
  source 1..37: mol_type = genomic DNA

SEQ ID NO: 64522 - DNA, 30 bp, Homo sapiens; identical to SEQ ID NO: 44086
  misc_feature 1..30: note = chr14:93706848-93706878
  misc_feature 1..30: note = hypo
  source 1..30: mol_type = genomic DNA

SEQ ID NO: 64523 - DNA, 30 bp, Homo sapiens; identical to SEQ ID NO: 44087
  misc_feature 1..30: note = chr14:95200361-95200391
  misc_feature 1..30: note = hypo
  source 1..30: mol_type = genomic DNA

SEQ ID NO: 64524 - DNA, 55 bp, Homo sapiens; identical to SEQ ID NO: 44088
  misc_feature 1..55: note = chr14:95522889-95522944
  misc_feature 1..55: note = hypo
  source 1..55: mol_type = genomic DNA

SEQ ID NO: 64525 - DNA, 30 bp, Homo sapiens; identical to SEQ ID NO: 44089
  misc_feature 1..30: note = chr14:95906326-95906356
  misc_feature 1..30: note = hypo
  source 1..30: mol_type = genomic DNA

SEQ ID NO: 64526 - DNA, 130 bp, Homo sapiens; identical to SEQ ID NO: 44090
  misc_feature 1..130: note = chr14:95927934-95928064
  misc_feature 1..130: note = hypo
  source 1..130: mol_type = genomic DNA

SEQ ID NO: 64527 - DNA, 39 bp, Homo sapiens; identical to SEQ ID NO: 44091
  misc_feature 1..39: note = chr14:96967321-96967360
  misc_feature 1..39: note = hypo
  source 1..39: mol_type = genomic DNA

SEQ ID NO: 64528 - DNA, 109 bp, Homo sapiens; identical to SEQ ID NO: 44093
  misc_feature 1..109: note = chr14:97188235-97188344
  misc_feature 1..109: note = hypo
  source 1..109: mol_type = genomic DNA

SEQ ID NO: 64529 - DNA, 205 bp, Homo sapiens; identical to SEQ ID NO: 44094
  misc_feature 1..205: note = chr14:97262648-97262853
  misc_feature 1..205: note = hypo
  source 1..205: mol_type = genomic DNA

SEQ ID NO: 64530 - DNA, 32 bp, Homo sapiens; identical to SEQ ID NO: 44095
  misc_feature 1..32: note = chr14:99532995-99533027
  misc_feature 1..32: note = hypo
  source 1..32: mol_type = genomic DNA

SEQ ID NO: 64531 - DNA, 30 bp, Homo sapiens; identical to SEQ ID NO: 44096
  misc_feature 1..30: note = chr14:99615561-99615591
  misc_feature 1..30: note = hypo
  source 1..30: mol_type = genomic DNA

SEQ ID NO: 64532 - DNA, 30 bp, Homo sapiens; identical to SEQ ID NO: 44097
  misc_feature 1..30: note = chr14:99626459-99626489
  misc_feature 1..30: note = hypo
  source 1..30: mol_type = genomic DNA

SEQ ID NO: 64533 - DNA, 30 bp, Homo sapiens; identical to SEQ ID NO: 44098
  misc_feature 1..30: note = chr14:99804005-99804035
  misc_feature 1..30: note = hypo
  source 1..30: mol_type = genomic DNA

SEQ ID NO: 64534 - DNA, 30 bp, Homo sapiens; identical to SEQ ID NO: 44099
  misc_feature 1..30: note = chr14:99848008-99848038
  misc_feature 1..30: note = hypo
  source 1..30: mol_type = genomic DNA

SEQ ID NO: 64535 - DNA, 154 bp, Homo sapiens; identical to SEQ ID NO: 44100
  misc_feature 1..154: note = chr14:99849909-99850063
  misc_feature 1..154: note = hypo
  source 1..154: mol_type = genomic DNA

SEQ ID NO: 64536 - DNA, 36 bp, Homo sapiens; identical to SEQ ID NO: 44101
  misc_feature 1..36: note = chr14:100209839-100209875
  misc_feature 1..36: note = hypo
  source 1..36: mol_type = genomic DNA

SEQ ID NO: 64537 - DNA, 38 bp, Homo sapiens; identical to SEQ ID NO: 44102
  misc_feature 1..38: note = chr14:100591043-100591081
  misc_feature 1..38: note = hypo
  source 1..38: mol_type = genomic DNA

SEQ ID NO: 64538 - DNA, 30 bp, Homo sapiens; identical to SEQ ID NO: 15860
  misc_feature 1..30: note = chr14:100611919-100611949
  misc_feature 1..30: note = hypo
  source 1..30: mol_type = genomic DNA

SEQ ID NO: 64539 - DNA, 82 bp, Homo sapiens; identical to SEQ ID NO: 44104
  misc_feature 1..82: note = chr14:100637036-100637118
  misc_feature 1..82: note = hypo
  source 1..82: mol_type = genomic DNA

SEQ ID NO: 64540 - DNA, 65 bp, Homo sapiens
  misc_feature 1..65: note = chr14:100643285-100643350
  misc_feature 1..65: note = hypo
  source 1..65: mol_type = genomic DNA
ggcaccgagtccctacggtgggaccatgcccgcagcggcagtgtggaagatgggacagacacagc

SEQ ID NO: 64541 - DNA, 79 bp, Homo sapiens; identical to SEQ ID NO: 15862
  misc_feature 1..79: note = chr14:100644399-100644478
  misc_feature 1..79: note = hypo
  source 1..79: mol_type = genomic DNA

SEQ ID NO: 64542 - DNA, 27 bp, Homo sapiens
  misc_feature 1..27: note = chr14:100747273-100747300
  misc_feature 1..27: note = hypo
  source 1..27: mol_type = genomic DNA
gaagcctgataatttcgggaggctgag

SEQ ID NO: 64543 - DNA, 35 bp, Homo sapiens; identical to SEQ ID NO: 44108
  misc_feature 1..35: note = chr14:100780162-100780197
  misc_feature 1..35: note = hypo
  source 1..35: mol_type = genomic DNA

SEQ ID NO: 64544 - DNA, 19 bp, Homo sapiens
  misc_feature 1..19: note = chr14:100843965-100843984
  misc_feature 1..19: note = hypo
  source 1..19: mol_type = genomic DNA
tttgcgtgtggaagttgtt

SEQ ID NO: 64545 - DNA, 32 bp, Homo sapiens; identical to SEQ ID NO: 44110
  misc_feature 1..32: note = chr14:101198835-101198867
  misc_feature 1..32: note = hypo
  source 1..32: mol_type = genomic DNA

SEQ ID NO: 64546 - DNA, 116 bp, Homo sapiens; identical to SEQ ID NO: 44111
  misc_feature 1..116: note = chr14:101200602-101200718
  misc_feature 1..116: note = hypo
  source 1..116: mol_type = genomic DNA

SEQ ID NO: 64547 - DNA, 44 bp, Homo sapiens; identical to SEQ ID NO: 44112
  misc_feature 1..44: note = chr14:101201633-101201677
  misc_feature 1..44: note = hypo
  source 1..44: mol_type = genomic DNA

SEQ ID NO: 64548 - DNA, 27 bp, Homo sapiens
  misc_feature 1..27: note = chr14:101250082-101250109
  misc_feature 1..27: note = hypo
  source 1..27: mol_type = genomic DNA
ggggagctggggtggcgacccatgaat

SEQ ID NO: 64549 - DNA, 22 bp, Homo sapiens
  misc_feature 1..22: note = chr14:101250272-101250294
  misc_feature 1..22: note = hypo
  source 1..22: mol_type = genomic DNA
ggtgcaccggggctttgttcag

SEQ ID NO: 64550 - DNA, 30 bp, Homo sapiens; identical to SEQ ID NO: 44114
  misc_feature 1..30: note = chr14:101532280-101532310
  misc_feature 1..30: note = hypo
  source 1..30: mol_type = genomic DNA

SEQ ID NO: 64551 - DNA, 30 bp, Homo sapiens; identical to SEQ ID NO: 44115
  misc_feature 1..30: note = chr14:101532816-101532846
  misc_feature 1..30: note = hypo
  source 1..30: mol_type = genomic DNA

SEQ ID NO: 64552 - DNA, 30 bp, Homo sapiens; identical to SEQ ID NO: 44116
  misc_feature 1..30: note = chr14:101591942-101591972
  misc_feature 1..30: note = hypo
  source 1..30: mol_type = genomic DNA

SEQ ID NO: 64553 - DNA, 30 bp, Homo sapiens; identical to SEQ ID NO: 44117
  misc_feature 1..30: note = chr14:101694589-101694619
  misc_feature 1..30: note = hypo
  source 1..30: mol_type = genomic DNA

SEQ ID NO: 64554 - DNA, 152 bp, Homo sapiens; identical to SEQ ID NO: 44118
  misc_feature 1..152: note = chr14:101713576-101713728
  misc_feature 1..152: note = hypo
  source 1..152: mol_type = genomic DNA

SEQ ID NO: 64555 - DNA, 32 bp, Homo sapiens; identical to SEQ ID NO: 44119
  misc_feature 1..32: note = chr14:102094096-102094128
  misc_feature 1..32: note = hypo
  source 1..32: mol_type = genomic DNA

SEQ ID NO: 64556 - DNA, 30 bp, Homo sapiens; identical to SEQ ID NO: 44120
  misc_feature 1..30: note = chr14:102325042-102325072
  misc_feature 1..30: note = hypo
  source 1..30: mol_type = genomic DNA

SEQ ID NO: 64557 - DNA, 51 bp, Homo sapiens; identical to SEQ ID NO: 15865
  misc_feature 1..51: note = chr14:102335848-102335899
  misc_feature 1..51: note = hypo
  source 1..51: mol_type = genomic DNA

SEQ ID NO: 64558 - DNA, 81 bp, Homo sapiens
  misc_feature 1..81: note = chr14:102418526-102418607
  misc_feature 1..81: note = hypo
  source 1..81: mol_type = genomic DNA
ggcccaggagttgctcgcatgagccaccacgcccagtgtattcagattttcttcgtgtttcttttctcttccgggatccca

SEQ ID NO: 64559 - DNA, 30 bp, Homo sapiens; identical to SEQ ID NO: 44123
  misc_feature 1..30: note = chr14:102474565-102474595
  misc_feature 1..30: note = hypo
  source 1..30: mol_type = genomic DNA

SEQ ID NO: 64560 - DNA, 38 bp, Homo sapiens; identical to SEQ ID NO: 44124
  misc_feature 1..38: note = chr14:102493613-102493651
  misc_feature 1..38: note = hypo
  source 1..38: mol_type = genomic DNA

SEQ ID NO: 64561 - DNA, 28 bp, Homo sapiens
  misc_feature 1..28: note = chr14:102529474-102529502
  misc_feature 1..28: note = hypo
  source 1..28: mol_type = genomic DNA
aatagaatggaaacgttagggagtagca

SEQ ID NO: 64562 - DNA, 21 bp, Homo sapiens
  misc_feature 1..21: note = chr14:102530479-102530500
  misc_feature 1..21: note = hypo
  source 1..21: mol_type = genomic DNA
gctccttctccccagcgtggt

SEQ ID NO: 64563 - DNA, 61 bp, Homo sapiens; identical to SEQ ID NO: 44129
  misc_feature 1..61: note = chr14:102673269-102673330
  misc_feature 1..61: note = hypo
  source 1..61: mol_type = genomic DNA

SEQ ID NO: 64564 - DNA, 96 bp, Homo sapiens
  misc_feature 1..96: note = chr14:102682149-102682245
  misc_feature 1..96: note = hypo
  source 1..96: mol_type = genomic DNA
gagaagaactcatgatttacattgtcttactatgaaataccatccctcactcttgacagacgacgtagctgatctgagcagcgccctggcacccgc

SEQ ID NO: 64565 - DNA, 30 bp, Homo sapiens; identical to SEQ ID NO: 44131
  misc_feature 1..30: note = chr14:102909162-102909192
  misc_feature 1..30: note = hypo
  source 1..30: mol_type = genomic DNA

SEQ ID NO: 64566 - DNA, 152 bp, Homo sapiens; identical to SEQ ID NO: 44132
  misc_feature 1..152: note = chr14:103007088-103007240
  misc_feature 1..152: note = hypo
  source 1..152: mol_type = genomic DNA

SEQ ID NO: 64567 - DNA, 37 bp, Homo sapiens; identical to SEQ ID NO: 44133
  misc_feature 1..37: note = chr14:103018826-103018863
  misc_feature 1..37: note = hypo
  source 1..37: mol_type = genomic DNA

SEQ ID NO: 64568 - DNA, 30 bp, Homo sapiens; identical to SEQ ID NO: 44134
  misc_feature 1..30: note = chr14:103144541-103144571
  misc_feature 1..30: note = hypo
  source 1..30: mol_type = genomic DNA

SEQ ID NO: 64569 - DNA, 66 bp, Homo sapiens; identical to SEQ ID NO: 44135
  misc_feature 1..66: note = chr14:103216392-103216458
  misc_feature 1..66: note = hypo
  source 1..66: mol_type = genomic DNA

SEQ ID NO: 64570 - DNA, 177 bp, Homo sapiens; identical to SEQ ID NO: 44136
  misc_feature 1..177: note = chr14:103277520-103277697
  misc_feature 1..177: note = hypo
  source 1..177: mol_type = genomic DNA

SEQ ID NO: 64571 - DNA, 30 bp, Homo sapiens; identical to SEQ ID NO: 44137
  misc_feature 1..30: note = chr14:103456678-103456708
  misc_feature 1..30: note = hypo
  source 1..30: mol_type = genomic DNA

SEQ ID NO: 64572 - DNA, 17 bp, Homo sapiens
  misc_feature 1..17: note = chr14:103477626-103477643
  misc_feature 1..17: note = hypo
  source 1..17: mol_type = genomic DNA
ctaggcaaagccaaccg

SEQ ID NO: 64573 - DNA, 44 bp, Homo sapiens; identical to SEQ ID NO: 44139
  misc_feature 1..44: note = chr14:103699549-103699593
  misc_feature 1..44: note = hypo
  source 1..44: mol_type = genomic DNA

SEQ ID NO: 64574 - DNA, 89 bp, Homo sapiens; identical to SEQ ID NO: 15869
  misc_feature 1..89: note = chr14:103820833-103820922
  misc_feature 1..89: note = hypo
  source 1..89: mol_type = genomic DNA

SEQ ID NO: 64575 - DNA, 30 bp, Homo sapiens; identical to SEQ ID NO: 15870
  misc_feature 1..30: note = chr14:103996414-103996444
  misc_feature 1..30: note = hypo
  source 1..30: mol_type = genomic DNA

SEQ ID NO: 64576 - DNA, 49 bp, Homo sapiens; identical to SEQ ID NO: 44142
  misc_feature 1..49: note = chr14:104048933-104048982
  misc_feature 1..49: note = hypo
  source 1..49: mol_type = genomic DNA

SEQ ID NO: 64577 - DNA, 30 bp, Homo sapiens; identical to SEQ ID NO: 15871
  misc_feature 1..30: note = chr14:104061854-104061884
  misc_feature 1..30: note = hypo
  source 1..30: mol_type = genomic DNA

SEQ ID NO: 64578 - DNA, 30 bp, Homo sapiens; identical to SEQ ID NO: 44144
  misc_feature 1..30: note = chr14:104121128-104121158
  misc_feature 1..30: note = hypo
  source 1..30: mol_type = genomic DNA

SEQ ID NO: 64579 - DNA, 55 bp, Homo sapiens; identical to SEQ ID NO: 44145
  misc_feature 1..55: note = chr14:104194695-104194750
  misc_feature 1..55: note = hypo
  source 1..55: mol_type = genomic DNA

SEQ ID NO: 64580 - DNA, 30 bp, Homo sapiens; identical to SEQ ID NO: 44146
  misc_feature 1..30: note = chr14:104195285-104195315
  misc_feature 1..30: note = hypo
  source 1..30: mol_type = genomic DNA

SEQ ID NO: 64581 - DNA, 82 bp, Homo sapiens
  misc_feature 1..82: note = chr14:104202759-104202841
  misc_feature 1..82: note = hypo
  source 1..82: mol_type = genomic DNA
cctgcaggacagacaggacaaacgagctcctgagccccagggcaagagtgtgctgttcttaaggtgacgcttagcaatcaca

SEQ ID NO: 64582 - DNA, 40 bp, Homo sapiens; identical to SEQ ID NO: 44148
  misc_feature 1..40: note = chr14:104355130-104355170
  misc_feature 1..40: note = hypo
  source 1..40: mol_type = genomic DNA

SEQ ID NO: 64583 - DNA, 35 bp, Homo sapiens; identical to SEQ ID NO: 44149
  misc_feature 1..35: note = chr14:104387085-104387120
  misc_feature 1..35: note = hypo
  source 1..35: mol_type = genomic DNA

SEQ ID NO: 64584 - DNA, 30 bp, Homo sapiens; identical to SEQ ID NO: 44151
  misc_feature 1..30: note = chr14:104600477-104600507
  misc_feature 1..30: note = hypo
  source 1..30: mol_type = genomic DNA

SEQ ID NO: 64585 - DNA, 30 bp, Homo sapiens; identical to SEQ ID NO: 44152
  misc_feature 1..30: note = chr14:104609469-104609499
  misc_feature 1..30: note = hypo
  source 1..30: mol_type = genomic DNA

SEQ ID NO: 64586 - DNA, 611 bp, Homo sapiens; identical to SEQ ID NO: 44153
  misc_feature 1..611: note = chr14:104617674-104618285
  misc_feature 1..611: note = hypo
  source 1..611: mol_type = genomic DNA

SEQ ID NO: 64587 - DNA, 139 bp, Homo sapiens; identical to SEQ ID NO: 44154
  misc_feature 1..139: note = chr14:104618691-104618830
  misc_feature 1..139: note = hypo
  source 1..139: mol_type = genomic DNA

SEQ ID NO: 64588 - DNA, 242 bp, Homo sapiens; identical to SEQ ID NO: 44155
  misc_feature 1..242: note = chr14:104619085-104619327
  misc_feature 1..242: note = hypo
  source 1..242: mol_type = genomic DNA

SEQ ID NO: 64589 - DNA, 50 bp, Homo sapiens
  misc_feature 1..50: note = chr14:104620554-104620604
  misc_feature 1..50: note = hypo
  source 1..50: mol_type = genomic DNA
caaggcaaacactgatctggggccagcgggtgggacgggggtgctgcagc

SEQ ID NO: 64590 - DNA, 314 bp, Homo sapiens; identical to SEQ ID NO: 44157
  misc_feature 1..314: note = chr14:104622939-104623253
  misc_feature 1..314: note = hypo
  source 1..314: mol_type = genomic DNA

SEQ ID NO: 64591 - DNA, 264 bp, Homo sapiens; identical to SEQ ID NO: 44158
  misc_feature 1..264: note = chr14:104623478-104623742
  misc_feature 1..264: note = hypo
  source 1..264: mol_type = genomic DNA

SEQ ID NO: 64592 - DNA, 216 bp, Homo sapiens; identical to SEQ ID NO: 44159
  misc_feature 1..216: note = chr14:104626773-104626989
  misc_feature 1..216: note = hypo
  source 1..216: mol_type = genomic DNA

SEQ ID NO: 64593 - DNA, 76 bp, Homo sapiens
  misc_feature 1..76: note = chr14:104627759-104627835
  misc_feature 1..76: note = hypo
  source 1..76: mol_type = genomic DNA
ggtaattaagggcctcaccatcaaggccaactgcctgtgaaattaccctcttgtttggaagcggtgatttttctct

SEQ ID NO: 64594 - DNA, 78 bp, Homo sapiens; identical to SEQ ID NO: 44161
  misc_feature 1..78: note = chr14:104628609-104628687
  misc_feature 1..78: note = hypo
  source 1..78: mol_type = genomic DNA

SEQ ID NO: 64595 - DNA, 140 bp, Homo sapiens; identical to SEQ ID NO: 44162
  misc_feature 1..140: note = chr14:104630035-104630175
  misc_feature 1..140: note = hypo
  source 1..140: mol_type = genomic DNA

SEQ ID NO: 64596 - DNA, 45 bp, Homo sapiens; identical to SEQ ID NO: 44163
  misc_feature 1..45: note = chr14:104630962-104631007
  misc_feature 1..45: note = hypo
  source 1..45: mol_type = genomic DNA

SEQ ID NO: 64597 - DNA, 49 bp, Homo sapiens; identical to SEQ ID NO: 44164
  misc_feature 1..49: note = chr14:104637029-104637078
  misc_feature 1..49: note = hypo
  source 1..49: mol_type = genomic DNA

SEQ ID NO: 64598 - DNA, 33 bp, Homo sapiens; identical to SEQ ID NO: 44165
  misc_feature 1..33: note = chr14:104638185-104638218
  misc_feature 1..33: note = hypo
  source 1..33: mol_type = genomic DNA

SEQ ID NO: 64599 - DNA, 752 bp, Homo sapiens; identical to SEQ ID NO: 44166
  misc_feature 1..752: note = chr14:104639103-104639855
  misc_feature 1..752: note = hypo
  source 1..752: mol_type = genomic DNA

SEQ ID NO: 64600 - DNA, 30 bp, Homo sapiens; identical to SEQ ID NO: 44167
  misc_feature 1..30: note = chr14:104640459-104640489
  misc_feature 1..30: note = hypo
  source 1..30: mol_type = genomic DNA

SEQ ID NO: 64601 - DNA, 427 bp, Homo sapiens; identical to SEQ ID NO: 44168
  misc_feature 1..427: note = chr14:104641348-104641775
  misc_feature 1..427: note = hypo
  source 1..427: mol_type = genomic DNA

SEQ ID NO: 64602 - DNA, 30 bp, Homo sapiens; identical to SEQ ID NO: 44169
  misc_feature 1..30: note = chr14:104642691-104642721
  misc_feature 1..30: note = hypo
  source 1..30: mol_type = genomic DNA

SEQ ID NO: 64603 - DNA, 390 bp, Homo sapiens; identical to SEQ ID NO: 44170
  misc_feature 1..390: note = chr14:104643013-104643403
  misc_feature 1..390: note = hypo
  source 1..390: mol_type = genomic DNA

SEQ ID NO: 64604 - DNA, 489 bp, Homo sapiens; identical to SEQ ID NO: 44171
  misc_feature 1..489: note = chr14:104643693-104644182
  misc_feature 1..489: note = hypo
  source 1..489: mol_type = genomic DNA

SEQ ID NO: 64605 - DNA, 320 bp, Homo sapiens
  misc_feature 1..320: note = chr14:104645188-104645508
  misc_feature 1..320: note = hypo
  source 1..320: mol_type = genomic DNA
ggtgtggctgggcagcccctgacctcactttctgtccacgttcctcccaggacgcaaaggtaggagcggccctgcccagcccaagcctgttgcagctccgacactccccttgggcagtgggtgggtggctggggggtcctgaggccactgctgctgtccgctggaattctcccctgtcgtggggagggtggtcctagagccgagccaggacccagacgggcatgggtgggctgccccaggtccgccccctgcccgcccttggagccccactgtgtgcctgccaaggcctggcaggtgaagggaggcgggggccacatcag

SEQ ID NO: 64606 - DNA, 400 bp, Homo sapiens; identical to SEQ ID NO: 44173
  misc_feature 1..400: note = chr14:104645716-104646116
  misc_feature 1..400: note = hypo
  source 1..400: mol_type = genomic DNA

SEQ ID NO: 64607 - DNA, 195 bp, Homo sapiens
  misc_feature 1..195: note = chr14:104646491-104646686
  misc_feature 1..195: note = hypo
  source 1..195: mol_type = genomic DNA
ccaccttgccttctttgcagccaagcagtttttgtggagtggagtgggacttacctgcacgccccaggggtctttcaggattcaggatgacttttcttttacaatggtttcctctcggcagagcccgggttgtgggggatctgtgtggggttctcaacgcagatccatcctggggtctcccgggcagggatggct

SEQ ID NO: 64608 - DNA, 49 bp, Homo sapiens; identical to SEQ ID NO: 15884
  misc_feature 1..49: note = chr14:104647208-104647257
  misc_feature 1..49: note = hypo
  source 1..49: mol_type = genomic DNA

SEQ ID NO: 64609 - DNA, 128 bp, Homo sapiens
  misc_feature 1..128: note = chr14:104647287-104647415
  misc_feature 1..128: note = hypo
  source 1..128: mol_type = genomic DNA
ccctctgagggtccctggggtgacgggcagtaagcgtgggaaggacacatccacggggacccagggcttcgggtgctgtgccagggcctgccttgcagcccctgtggggcccacggtgccatgagggc

SEQ ID NO: 64610 - DNA, 30 bp, Homo sapiens; identical to SEQ ID NO: 44176
  misc_feature 1..30: note = chr14:104647924-104647954
  misc_feature 1..30: note = hypo
  source 1..30: mol_type = genomic DNA

SEQ ID NO: 64611 - DNA, 54 bp, Homo sapiens; identical to SEQ ID NO: 44177
  misc_feature 1..54: note = chr14:104648777-104648831
  misc_feature 1..54: note = hypo
  source 1..54: mol_type = genomic DNA

SEQ ID NO: 64612 - DNA, 160 bp, Homo sapiens; identical to SEQ ID NO: 44179
  misc_feature 1..160: note = chr14:104705230-104705390
  misc_feature 1..160: note = hypo
  source 1..160: mol_type = genomic DNA

SEQ ID NO: 64613 - DNA, 30 bp, Homo sapiens; identical to SEQ ID NO: 44180
  misc_feature 1..30: note = chr14:104768222-104768252
  misc_feature 1..30: note = hypo
  source 1..30: mol_type = genomic DNA

SEQ ID NO: 64614 - DNA, 30 bp, Homo sapiens; identical to SEQ ID NO: 44181
  misc_feature 1..30: note = chr14:104798505-104798535
  misc_feature 1..30: note = hypo
  source 1..30: mol_type = genomic DNA

SEQ ID NO: 64615 - DNA, 38 bp, Homo sapiens; identical to SEQ ID NO: 44182
  misc_feature 1..38: note = chr14:104800605-104800643
  misc_feature 1..38: note = hypo
  source 1..38: mol_type = genomic DNA

SEQ ID NO: 64616 - DNA, 37 bp, Homo sapiens; identical to SEQ ID NO: 44183
  misc_feature 1..37: note = chr14:104801369-104801406
  misc_feature 1..37: note = hypo
  source 1..37: mol_type = genomic DNA

SEQ ID NO: 64617 - DNA, 30 bp, Homo sapiens; identical to SEQ ID NO: 44184
  misc_feature 1..30: note = chr14:104820337-104820367
  misc_feature 1..30: note = hypo
  source 1..30: mol_type = genomic DNA

SEQ ID NO: 64618 - DNA, 174 bp, Homo sapiens; identical to SEQ ID NO: 44185
  misc_feature 1..174: note = chr14:104842214-104842388
  misc_feature 1..174: note = hypo
  source 1..174: mol_type = genomic DNA

SEQ ID NO: 64619 - DNA, 103 bp, Homo sapiens; identical to SEQ ID NO: 44186
  misc_feature 1..103: note = chr14:104897622-104897725
  misc_feature 1..103: note = hypo
  source 1..103: mol_type = genomic DNA

SEQ ID NO: 64620 - DNA, 54 bp, Homo sapiens; identical to SEQ ID NO: 44187
  misc_feature 1..54: note = chr14:104899461-104899515
  misc_feature 1..54: note = hypo
  source 1..54: mol_type = genomic DNA

SEQ ID NO: 64621 - DNA, 38 bp, Homo sapiens; identical to SEQ ID NO: 44188
  misc_feature 1..38: note = chr14:105026775-105026813
  misc_feature 1..38: note = hypo
  source 1..38: mol_type = genomic DNA

SEQ ID NO: 64622 - DNA, 119 bp, Homo sapiens; identical to SEQ ID NO: 44189
  misc_feature 1..119: note = chr14:105174275-105174394
  misc_feature 1..119: note = hypo
  source 1..119: mol_type = genomic DNA

SEQ ID NO: 64623 - DNA, 30 bp, Homo sapiens; identical to SEQ ID NO: 44190
  misc_feature 1..30: note = chr14:105194964-105194994
  misc_feature 1..30: note = hypo
  source 1..30: mol_type = genomic DNA

SEQ ID NO: 64624 - DNA, 18 bp, Homo sapiens
  misc_feature 1..18: note = chr14:105195822-105195840
  misc_feature 1..18: note = hypo
  source 1..18: mol_type = genomic DNA
ggagggaggaggtagcgt

SEQ ID NO: 64625 - DNA, 196 bp, Homo sapiens; identical to SEQ ID NO: 44192
  misc_feature 1..196: note = chr14:105196366-105196562
  misc_feature 1..196: note = hypo
  source 1..196: mol_type = genomic DNA

SEQ ID NO: 64626 - DNA, 92 bp, Homo sapiens; identical to SEQ ID NO: 44193
  misc_feature 1..92: note = chr14:105241003-105241095
  misc_feature 1..92: note = hypo
  source 1..92: mol_type = genomic DNA

SEQ ID NO: 64627 - DNA, 30 bp, Homo sapiens; identical to SEQ ID NO: 44194
  misc_feature 1..30: note = chr14:105254641-105254671
  misc_feature 1..30: note = hypo
  source 1..30: mol_type = genomic DNA

SEQ ID NO: 64628 - DNA, 35 bp, Homo sapiens; identical to SEQ ID NO: 44195
  misc_feature 1..35: note = chr14:105268737-105268772
  misc_feature 1..35: note = hypo
  source 1..35: mol_type = genomic DNA

SEQ ID NO: 64629 - DNA, 30 bp, Homo sapiens; identical to SEQ ID NO: 44196
  misc_feature 1..30: note = chr14:105538919-105538949
  misc_feature 1..30: note = hypo
  source 1..30: mol_type = genomic DNA

SEQ ID NO: 64630 - DNA, 30 bp, Homo sapiens; identical to SEQ ID NO: 44197
  misc_feature 1..30: note = chr14:105590655-105590685
  misc_feature 1..30: note = hypo
  source 1..30: mol_type = genomic DNA

SEQ ID NO: 64631 - DNA, 26 bp, Homo sapiens
  misc_feature 1..26: note = chr14:105714232-105714258
  misc_feature 1..26: note = hypo
  source 1..26: mol_type = genomic DNA
ggattagccccaggccgggaggctag

SEQ ID NO: 64632 - DNA, 81 bp, Homo sapiens; identical to SEQ ID NO: 56211
  misc_feature 1..81: note = chr14:105714334-105714415
  misc_feature 1..81: note = hypo
  source 1..81: mol_type = genomic DNA

SEQ ID NO: 64633 - DNA, 30 bp, Homo sapiens; identical to SEQ ID NO: 44200
  misc_feature 1..30: note = chr14:105739229-105739259
  misc_feature 1..30: note = hypo
  source 1..30: mol_type = genomic DNA

SEQ ID NO: 64634 - DNA, 30 bp, Homo sapiens; identical to SEQ ID NO: 44201
  misc_feature 1..30: note = chr14:105739632-105739662
  misc_feature 1..30: note = hypo
  source 1..30: mol_type = genomic DNA

SEQ ID NO: 64635 - DNA, 30 bp, Homo sapiens; identical to SEQ ID NO: 44202
  misc_feature 1..30: note = chr14:106334145-106334175
  misc_feature 1..30: note = hypo
  source 1..30: mol_type = genomic DNA

SEQ ID NO: 64636 - DNA, 29 bp, Homo sapiens
  misc_feature 1..29: note = chr15:20499470-20499499
  misc_feature 1..29: note = hypo
  source 1..29: mol_type = genomic DNA
ttaggagaaacaggccgagcgcgctgact

SEQ ID NO: 64637 - DNA, 35 bp, Homo sapiens; identical to SEQ ID NO: 44204
  misc_feature 1..35: note = chr15:22515501-22515536
  misc_feature 1..35: note = hypo
  source 1..35: mol_type = genomic DNA

SEQ ID NO: 64638 - DNA, 30 bp, Homo sapiens; identical to SEQ ID NO: 44205
  misc_feature 1..30: note = chr15:22876959-22876989
  misc_feature 1..30: note = hypo
  source 1..30: mol_type = genomic DNA

SEQ ID NO: 64639 - DNA, 128 bp, Homo sapiens; identical to SEQ ID NO: 44206
  misc_feature 1..128: note = chr15:22977063-22977191
  misc_feature 1..128: note = hypo
  source 1..128: mol_type = genomic DNA

SEQ ID NO: 64640 - DNA, 19 bp, Homo sapiens
  misc_feature 1..19: note = chr15:23087577-23087596
  misc_feature 1..19: note = hypo
  source 1..19: mol_type = genomic DNA
tttgagacagagtctcgct

SEQ ID NO: 64641 - DNA, 30 bp, Homo sapiens; identical to SEQ ID NO: 44208
  misc_feature 1..30: note = chr15:23182596-23182626
  misc_feature 1..30: note = hypo
  source 1..30: mol_type = genomic DNA

SEQ ID NO: 64642 - DNA, 107 bp, Homo sapiens; identical to SEQ ID NO: 44209
  misc_feature 1..107: note = chr15:23662038-23662145
  misc_feature 1..107: note = hypo
  source 1..107: mol_type = genomic DNA

SEQ ID NO: 64643 - DNA, 30 bp, Homo sapiens; identical to SEQ ID NO: 44210
  misc_feature 1..30: note = chr15:25449793-25449823
  misc_feature 1..30: note = hypo
  source 1..30: mol_type = genomic DNA

SEQ ID NO: 64644 - DNA, 30 bp, Homo sapiens; identical to SEQ ID NO: 44211
  misc_feature 1..30: note = chr15:26869355-26869385
  misc_feature 1..30: note = hypo
  source 1..30: mol_type = genomic DNA

SEQ ID NO: 64645 - DNA, 66 bp, Homo sapiens; identical to SEQ ID NO: 44212
  misc_feature 1..66: note = chr15:28389827-28389893
  misc_feature 1..66: note = hypo
  source 1..66: mol_type = genomic DNA

SEQ ID NO: 64646 - DNA, 122 bp, Homo sapiens; identical to SEQ ID NO: 44213
  misc_feature 1..122: note = chr15:28517076-28517198
  misc_feature 1..122: note = hypo
  source 1..122: mol_type = genomic DNA

SEQ ID NO: 64647 - DNA, 30 bp, Homo sapiens; identical to SEQ ID NO: 44214
  misc_feature 1..30: note = chr15:29087614-29087644
  misc_feature 1..30: note = hypo
  source 1..30: mol_type = genomic DNA

SEQ ID NO: 64648 - DNA, 48 bp, Homo sapiens; identical to SEQ ID NO: 44215
  misc_feature 1..48: note = chr15:29112193-29112241
  misc_feature 1..48: note = hypo
  source 1..48: mol_type = genomic DNA

SEQ ID NO: 64649 - DNA, 297 bp, Homo sapiens; identical to SEQ ID NO: 44216
  misc_feature 1..297: note = chr15:29133536-29133833
  misc_feature 1..297: note = hypo
  source 1..297: mol_type = genomic DNA

SEQ ID NO: 64650 - DNA, 158 bp, Homo sapiens; identical to SEQ ID NO: 44217
  misc_feature 1..158: note = chr15:29145324-29145482
  misc_feature 1..158: note = hypo
  source 1..158: mol_type = genomic DNA

SEQ ID NO: 64651 - DNA, 30 bp, Homo sapiens; identical to SEQ ID NO: 44218
  misc_feature 1..30: note = chr15:29221674-29221704
  misc_feature 1..30: note = hypo
  source 1..30: mol_type = genomic DNA

SEQ ID NO: 64652 - DNA, 30 bp, Homo sapiens; identical to SEQ ID NO: 44219
  misc_feature 1..30: note = chr15:29397531-29397561
  misc_feature 1..30: note = hypo
  source 1..30: mol_type = genomic DNA

SEQ ID NO: 64653 - DNA, 34 bp, Homo sapiens; identical to SEQ ID NO: 44220
  misc_feature 1..34: note = chr15:29409363-29409397
  misc_feature 1..34: note = hypo
  source 1..34: mol_type = genomic DNA

SEQ ID NO: 64654 - DNA, 30 bp, Homo sapiens; identical to SEQ ID NO: 15892
  misc_feature 1..30: note = chr15:29449033-29449063
  misc_feature 1..30: note = hypo
  source 1..30: mol_type = genomic DNA

SEQ ID NO: 64655 - DNA, 153 bp, Homo sapiens; identical to SEQ ID NO: 44222
  misc_feature 1..153: note = chr15:29721877-29722030
  misc_feature 1..153: note = hypo
  source 1..153: mol_type = genomic DNA

SEQ ID NO: 64656 - DNA, 30 bp, Homo sapiens; identical to SEQ ID NO: 44223
  misc_feature 1..30: note = chr15:31083776-31083806
  misc_feature 1..30: note = hypo
  source 1..30: mol_type = genomic DNA

SEQ ID NO: 64657 - DNA, 30 bp, Homo sapiens; identical to SEQ ID NO: 44224
  misc_feature 1..30: note = chr15:31121996-31122026
  misc_feature 1..30: note = hypo
  source 1..30: mol_type = genomic DNA

SEQ ID NO: 64658 - DNA, 30 bp, Homo sapiens; identical to SEQ ID NO: 44225
  misc_feature 1..30: note = chr15:31221190-31221220
  misc_feature 1..30: note = hypo
  source 1..30: mol_type = genomic DNA

SEQ ID NO: 64659 - DNA, 167 bp, Homo sapiens; identical to SEQ ID NO: 44226
  misc_feature 1..167: note = chr15:31377678-31377845
  misc_feature 1..167: note = hypo
  source 1..167: mol_type = genomic DNA

SEQ ID NO: 64660 - DNA, 30 bp, Homo sapiens; identical to SEQ ID NO: 44227
  misc_feature 1..30: note = chr15:31509535-31509565
  misc_feature 1..30: note = hypo
  source 1..30: mol_type = genomic DNA

SEQ ID NO: 64661 - DNA, 30 bp, Homo sapiens; identical to SEQ ID NO: 44228
  misc_feature 1..30: note = chr15:31539632-31539662
  misc_feature 1..30: note = hypo
  source 1..30: mol_type = genomic DNA

SEQ ID NO: 64662 - DNA, 56 bp, Homo sapiens; identical to SEQ ID NO: 44229
  misc_feature 1..56: note = chr15:31603992-31604048
  misc_feature 1..56: note = hypo
  source 1..56: mol_type = genomic DNA

SEQ ID NO: 64663 - DNA, 30 bp, Homo sapiens; identical to SEQ ID NO: 44230
  misc_feature 1..30: note = chr15:31813319-31813349
  misc_feature 1..30: note = hypo
  source 1..30: mol_type = genomic DNA

SEQ ID NO: 64664 - DNA, 30 bp, Homo sapiens; identical to SEQ ID NO: 44231
  misc_feature 1..30: note = chr15:33438087-33438117
  misc_feature 1..30: note = hypo
  source 1..30: mol_type = genomic DNA

SEQ ID NO: 64665 - DNA, 27 bp, Homo sapiens
  misc_feature 1..27: note = chr15:33541634-33541661
  misc_feature 1..27: note = hypo
  source 1..27: mol_type = genomic DNA
gcctcagcctcccgtaaaggtttttaa

SEQ ID NO: 64666 - DNA, 43 bp, Homo sapiens; identical to SEQ ID NO: 15893
  misc_feature 1..43: note = chr15:33632093-33632136
  misc_feature 1..43: note = hypo
  source 1..43: mol_type = genomic DNA

SEQ ID NO: 64667 - DNA, 17 bp, Homo sapiens
  misc_feature 1..17: note = chr15:33633532-33633549
  misc_feature 1..17: note = hypo
  source 1..17: mol_type = genomic DNA
cccggtctgattcagtg

SEQ ID NO: 64668 - DNA, 30 bp, Homo sapiens; identical to SEQ ID NO: 44235
  misc_feature 1..30: note = chr15:33727786-33727816
  misc_feature 1..30: note = hypo
  source 1..30: mol_type = genomic DNA

SEQ ID NO: 64669 - DNA, 30 bp, Homo sapiens; identical to SEQ ID NO: 44236
  misc_feature 1..30: note = chr15:33746640-33746670
  misc_feature 1..30: note = hypo
  source 1..30: mol_type = genomic DNA

SEQ ID NO: 64670 - DNA, 155 bp, Homo sapiens; identical to SEQ ID NO: 44237
  misc_feature 1..155: note = chr15:33954397-33954552
  misc_feature 1..155: note = hypo
  source 1..155: mol_type = genomic DNA

SEQ ID NO: 64671 - DNA, 36 bp, Homo sapiens; identical to SEQ ID NO: 44238
  misc_feature 1..36: note = chr15:34879893-34879929
  misc_feature 1..36: note = hypo
  source 1..36: mol_type = genomic DNA

SEQ ID NO: 64672 - DNA, 163 bp, Homo sapiens; identical to SEQ ID NO: 44239
  misc_feature 1..163: note = chr15:38218484-38218647
  misc_feature 1..163: note = hypo
  source 1..163: mol_type = genomic DNA

SEQ ID NO: 64673 - DNA, 30 bp, Homo sapiens; identical to SEQ ID NO: 15894
  misc_feature 1..30: note = chr15:40228636-40228666
  misc_feature 1..30: note = hypo
  source 1..30: mol_type = genomic DNA

SEQ ID NO: 64674 - DNA, 39 bp, Homo sapiens; identical to SEQ ID NO: 44241
  misc_feature 1..39: note = chr15:40368182-40368221
  misc_feature 1..39: note = hypo
  source 1..39: mol_type = genomic DNA

SEQ ID NO: 64675 - DNA, 92 bp, Homo sapiens; identical to SEQ ID NO: 44242
  misc_feature 1..92: note = chr15:40423336-40423428
  misc_feature 1..92: note = hypo
  source 1..92: mol_type = genomic DNA

SEQ ID NO: 64676 - DNA, 75 bp, Homo sapiens; identical to SEQ ID NO: 44243
  misc_feature 1..75: note = chr15:40532146-40532221
  misc_feature 1..75: note = hypo
  source 1..75: mol_type = genomic DNA

SEQ ID NO: 64677 - DNA, 30 bp, Homo sapiens; identical to SEQ ID NO: 44244
  misc_feature 1..30: note = chr15:40532791-40532821
  misc_feature 1..30: note = hypo
  source 1..30: mol_type = genomic DNA

SEQ ID NO: 64678 - DNA, 56 bp, Homo sapiens; identical to SEQ ID NO: 44245
  misc_feature 1..56: note = chr15:40545776-40545832
  misc_feature 1..56: note = hypo
  source 1..56: mol_type = genomic DNA

SEQ ID NO: 64679 - DNA, 30 bp, Homo sapiens; identical to SEQ ID NO: 44246
  misc_feature 1..30: note = chr15:40546043-40546073
  misc_feature 1..30: note = hypo
  source 1..30: mol_type = genomic DNA

SEQ ID NO: 64680 - DNA, 30 bp, Homo sapiens; identical to SEQ ID NO: 44248
  misc_feature 1..30: note = chr15:41291830-41291860
  misc_feature 1..30: note = hypo
  source 1..30: mol_type = genomic DNA

SEQ ID NO: 64681 - DNA, 99 bp, Homo sapiens
  misc_feature 1..99: note = chr15:41835720-41835819
  misc_feature 1..99: note = hypo
  source 1..99: mol_type = genomic DNA
cttaagtcccatttccacaactgtaaaatgtgagtaacaggtcctatataataggaaatgtgtgaggatttaaatgactatacacgcaaaacgcctagc

SEQ ID NO: 64682 - DNA, 30 bp, Homo sapiens; identical to SEQ ID NO: 44250
  misc_feature 1..30: note = chr15:41878349-41878379
  misc_feature 1..30: note = hypo
  source 1..30: mol_type = genomic DNA

SEQ ID NO: 64683 - DNA, 30 bp, Homo sapiens; identical to SEQ ID NO: 44251
  misc_feature 1..30: note = chr15:42448030-42448060
  misc_feature 1..30: note = hypo
  source 1..30: mol_type = genomic DNA

SEQ ID NO: 64684 - DNA, 104 bp, Homo sapiens; identical to SEQ ID NO: 44252
  misc_feature 1..104: note = chr15:42562548-42562652
  misc_feature 1..104: note = hypo
  source 1..104: mol_type = genomic DNA

SEQ ID NO: 64685 - DNA, 248 bp, Homo sapiens; identical to SEQ ID NO: 44253
  misc_feature 1..248: note = chr15:42684673-42684921
  misc_feature 1..248: note = hypo
  source 1..248: mol_type = genomic DNA

SEQ ID NO: 64686 - DNA, 40 bp, Homo sapiens; identical to SEQ ID NO: 44254
  misc_feature 1..40: note = chr15:42784374-42784414
  misc_feature 1..40: note = hypo
  source 1..40: mol_type = genomic DNA

SEQ ID NO: 64687 - DNA, 141 bp, Homo sapiens; identical to SEQ ID NO: 44255
  misc_feature 1..141: note = chr15:43020219-43020360
  misc_feature 1..141: note = hypo
  source 1..141: mol_type = genomic DNA

SEQ ID NO: 64688 - DNA, 20 bp, Homo sapiens
  misc_feature 1..20: note = chr15:43511855-43511875
  misc_feature 1..20: note = hypo
  source 1..20: mol_type = genomic DNA
aacgatttggccaggcgcag

SEQ ID NO: 64689 - DNA, 51 bp, Homo sapiens; identical to SEQ ID NO: 44257
  misc_feature 1..51: note = chr15:43661941-43661992
  misc_feature 1..51: note = hypo
  source 1..51: mol_type = genomic DNA

SEQ ID NO: 64690 - DNA, 94 bp, Homo sapiens
  misc_feature 1..94: note = chr15:44037474-44037568
  misc_feature 1..94: note = hypo
  source 1..94: mol_type = genomic DNA
atgtacccacatctacgaactaggagcagttgggcagaacaaacattctactaagactcagggttttttgaaacaaaaggggctaagagtggta

SEQ ID NO: 64691 - DNA, 221 bp, Homo sapiens; identical to SEQ ID NO: 44259
  misc_feature 1..221: note = chr15:44092138-44092359
  misc_feature 1..221: note = hypo
  source 1..221: mol_type = genomic DNA

SEQ ID NO: 64692 - DNA, 17 bp, Homo sapiens
  misc_feature 1..17: note = chr15:44116023-44116040
  misc_feature 1..17: note = hypo
  source 1..17: mol_type = genomic DNA
tgttgagactagatacg

SEQ ID NO: 64693 - DNA, 30 bp, Homo sapiens; identical to SEQ ID NO: 44261
  misc_feature 1..30: note = chr15:45471850-45471880
  misc_feature 1..30: note = hypo
  source 1..30: mol_type = genomic DNA

SEQ ID NO: 64694 - DNA, 23 bp, Homo sapiens
  misc_feature 1..23: note = chr15:45544201-45544224
  misc_feature 1..23: note = hypo
  source 1..23: mol_type = genomic DNA
cggcctcccgaagtgctgggatt

SEQ ID NO: 64695 - DNA, 20 bp, Homo sapiens
  misc_feature 1..20: note = chr15:48906097-48906117
  misc_feature 1..20: note = hypo
  source 1..20: mol_type = genomic DNA
ctgggcgacagagtgagact

SEQ ID NO: 64696 - DNA, 204 bp, Homo sapiens; identical to SEQ ID NO: 44264
  misc_feature 1..204: note = chr15:49182759-49182963
  misc_feature 1..204: note = hypo
  source 1..204: mol_type = genomic DNA

SEQ ID NO: 64697 - DNA, 22 bp, Homo sapiens
  misc_feature 1..22: note = chr15:51202484-51202506
  misc_feature 1..22: note = hypo
  source 1..22: mol_type = genomic DNA
aggcgctcgatggttgcacgga

SEQ ID NO: 64698 - DNA, 29 bp, Homo sapiens
  misc_feature 1..29: note = chr15:52967811-52967840
  misc_feature 1..29: note = hypo
  source 1..29: mol_type = genomic DNA
aacttagtgttaggccgggcgcggtggct

SEQ ID NO: 64699 - DNA, 145 bp, Homo sapiens; identical to SEQ ID NO: 15900
  misc_feature 1..145: note = chr15:53976280-53976425
  misc_feature 1..145: note = hypo
  source 1..145: mol_type = genomic DNA

SEQ ID NO: 64700 - DNA, 43 bp, Homo sapiens; identical to SEQ ID NO: 44269
  misc_feature 1..43: note = chr15:55689108-55689151
  misc_feature 1..43: note = hypo
  source 1..43: mol_type = genomic DNA

SEQ ID NO: 64701 - skipped

SEQ ID NO: 64702 - DNA, 92 bp, Homo sapiens; identical to SEQ ID NO: 44271
  misc_feature 1..92: note = chr15:55806620-55806712
  misc_feature 1..92: note = hypo
  source 1..92: mol_type = genomic DNA

SEQ ID NO: 64703 - DNA, 28 bp, Homo sapiens
  misc_feature 1..28: note = chr15:59158460-59158488
  misc_feature 1..28: note = hypo
  source 1..28: mol_type = genomic DNA
gcccggccccaggtttggattctttcac

SEQ ID NO: 64704 - DNA, 30 bp, Homo sapiens; identical to SEQ ID NO: 44273
  misc_feature 1..30: note = chr15:59243729-59243759
  misc_feature 1..30: note = hypo
  source 1..30: mol_type = genomic DNA

SEQ ID NO: 64705 - DNA, 30 bp, Homo sapiens; identical to SEQ ID NO: 44274
  misc_feature 1..30: note = chr15:59453484-59453514
  misc_feature 1..30: note = hypo
  source 1..30: mol_type = genomic DNA

SEQ ID NO: 64706 - DNA, 30 bp, Homo sapiens; identical to SEQ ID NO: 44275
  misc_feature 1..30: note = chr15:60915264-60915294
  misc_feature 1..30: note = hypo
  source 1..30: mol_type = genomic DNA

SEQ ID NO: 64707 - DNA, 30 bp, Homo sapiens; identical to SEQ ID NO: 44276
  misc_feature 1..30: note = chr15:61305596-61305626
  misc_feature 1..30: note = hypo
  source 1..30: mol_type = genomic DNA

SEQ ID NO: 64708 - DNA, 30 bp, Homo sapiens; identical to SEQ ID NO: 44277
  misc_feature 1..30: note = chr15:62361320-62361350
  misc_feature 1..30: note = hypo
  source 1..30: mol_type = genomic DNA

SEQ ID NO: 64709 - DNA, 44 bp, Homo sapiens; identical to SEQ ID NO: 44278
  misc_feature 1..44: note = chr15:62367703-62367747
  misc_feature 1..44: note = hypo
  source 1..44: mol_type = genomic DNA

SEQ ID NO: 64710 - DNA, 223 bp, Homo sapiens; identical to SEQ ID NO: 44279
  misc_feature 1..223: note = chr15:63753342-63753565
  misc_feature 1..223: note = hypo
  source 1..223: mol_type = genomic DNA

SEQ ID NO: 64711 - DNA, 30 bp, Homo sapiens; identical to SEQ ID NO: 44280
  misc_feature 1..30: note = chr15:64440388-64440418
  misc_feature 1..30: note = hypo
  source 1..30: mol_type = genomic DNA

SEQ ID NO: 64712 - DNA, 30 bp, Homo sapiens; identical to SEQ ID NO: 44281
  misc_feature 1..30: note = chr15:64443222-64443252
  misc_feature 1..30: note = hypo
  source 1..30: mol_type = genomic DNA

SEQ ID NO: 64713 - DNA, 152 bp, Homo sapiens; identical to SEQ ID NO: 44282
  misc_feature 1..152: note = chr15:65043526-65043678
  misc_feature 1..152: note = hypo
  source 1..152: mol_type = genomic DNA

SEQ ID NO: 64714 - DNA, 45 bp, Homo sapiens; identical to SEQ ID NO: 44283
  misc_feature 1..45: note = chr15:65127716-65127761
  misc_feature 1..45: note = hypo
  source 1..45: mol_type = genomic DNA

SEQ ID NO: 64715 - DNA, 44 bp, Homo sapiens; identical to SEQ ID NO: 44284
  misc_feature 1..44: note = chr15:65622974-65623018
  misc_feature 1..44: note = hypo
  source 1..44: mol_type = genomic DNA

SEQ ID NO: 64716 - DNA, 73 bp, Homo sapiens
  misc_feature 1..73: note = chr15:65862121-65862194
  misc_feature 1..73: note = hypo
  source 1..73: mol_type = genomic DNA
atttcttaacttgggttatataaactcaaatgtttatttggcagtattctttagactgcgtttgaacatgtgt

SEQ ID NO: 64717 - DNA, 33 bp, Homo sapiens; identical to SEQ ID NO: 44286
  misc_feature 1..33: note = chr15:66147762-66147795
  misc_feature 1..33: note = hypo
  source 1..33: mol_type = genomic DNA

SEQ ID NO: 64718 - DNA, 192 bp, Homo sapiens; identical to SEQ ID NO: 44287
  misc_feature 1..192: note = chr15:66598802-66598994
  misc_feature 1..192: note = hypo
  source 1..192: mol_type = genomic DNA

SEQ ID NO: 64719 - DNA, 30 bp, Homo sapiens; identical to SEQ ID NO: 44288
  misc_feature 1..30: note = chr15:66788210-66788240
  misc_feature 1..30: note = hypo
  source 1..30: mol_type = genomic DNA

SEQ ID NO: 64720 - DNA, 34 bp, Homo sapiens; identical to SEQ ID NO: 44289
  misc_feature 1..34: note = chr15:66789324-66789358
  misc_feature 1..34: note = hypo
  source 1..34: mol_type = genomic DNA

SEQ ID NO: 64721 - DNA, 131 bp, Homo sapiens; identical to SEQ ID NO: 44290
  misc_feature 1..131: note = chr15:66963229-66963360
  misc_feature 1..131: note = hypo
  source 1..131: mol_type = genomic DNA

SEQ ID NO: 64722 - DNA, 35 bp, Homo sapiens; identical to SEQ ID NO: 44291
  misc_feature 1..35: note = chr15:66963682-66963717
  misc_feature 1..35: note = hypo
  source 1..35: mol_type = genomic DNA

SEQ ID NO: 64723 - DNA, 72 bp, Homo sapiens; identical to SEQ ID NO: 44292
  misc_feature 1..72: note = chr15:66964011-66964083
  misc_feature 1..72: note = hypo
  source 1..72: mol_type = genomic DNA

SEQ ID NO: 64724 - DNA, 39 bp, Homo sapiens; identical to SEQ ID NO: 44293
  misc_feature 1..39: note = chr15:67457364-67457403
  misc_feature 1..39: note = hypo
  source 1..39: mol_type = genomic DNA

SEQ ID NO: 64725 - DNA, 81 bp, Homo sapiens; identical to SEQ ID NO: 15907
  misc_feature 1..81: note = chr15:67545405-67545486
  misc_feature 1..81: note = hypo
  source 1..81: mol_type = genomic DNA

SEQ ID NO: 64726 - DNA, 23 bp, Homo sapiens
  misc_feature 1..23: note = chr15:69324757-69324780
  misc_feature 1..23: note = hypo
  source 1..23: mol_type = genomic DNA
tttttttttctgagacggagtct

SEQ ID NO: 64727 - DNA, 30 bp, Homo sapiens; identical to SEQ ID NO: 44296
  misc_feature 1..30: note = chr15:69754387-69754417
  misc_feature 1..30: note = hypo
  source 1..30: mol_type = genomic DNA

SEQ ID NO: 64728 - DNA, 30 bp, Homo sapiens; identical to SEQ ID NO: 15908
  misc_feature 1..30: note = chr15:70075720-70075750
  misc_feature 1..30: note = hypo
  source 1..30: mol_type = genomic DNA

SEQ ID NO: 64729 - DNA, 18 bp, Homo sapiens
  misc_feature 1..18: note = chr15:71117912-71117930
  misc_feature 1..18: note = hypo
  source 1..18: mol_type = genomic DNA
tttttttttttgagacgg

SEQ ID NO: 64730 - DNA, 176 bp, Homo sapiens; identical to SEQ ID NO: 15909
  misc_feature 1..176: note = chr15:72102772-72102948
  misc_feature 1..176: note = hypo
  source 1..176: mol_type = genomic DNA

SEQ ID NO: 64731 - DNA, 17 bp, Homo sapiens
  misc_feature 1..17: note = chr15:72411795-72411812
  misc_feature 1..17: note = hypo
  source 1..17: mol_type = genomic DNA
tggaggtcatttagccg

SEQ ID NO: 64732 - DNA, 133 bp, Homo sapiens; identical to SEQ ID NO: 25159
  misc_feature 1..133: note = chr15:72412176-72412309
  misc_feature 1..133: note = hypo
  source 1..133: mol_type = genomic DNA

SEQ ID NO: 64733 - DNA, 30 bp, Homo sapiens; identical to SEQ ID NO: 44302
  misc_feature 1..30: note = chr15:72462639-72462669
  misc_feature 1..30: note = hypo
  source 1..30: mol_type = genomic DNA

SEQ ID NO: 64734 - DNA, 319 bp, Homo sapiens; identical to SEQ ID NO: 44303
  misc_feature 1..319: note = chr15:72581481-72581800
  misc_feature 1..319: note = hypo
  source 1..319: mol_type = genomic DNA

SEQ ID NO: 64735 - DNA, 30 bp, Homo sapiens; identical to SEQ ID NO: 44304
  misc_feature 1..30: note = chr15:72743660-72743690
  misc_feature 1..30: note = hypo
  source 1..30: mol_type = genomic DNA

SEQ ID NO: 64736 - DNA, 36 bp, Homo sapiens; identical to SEQ ID NO: 44305
  misc_feature 1..36: note = chr15:72768976-72769012
  misc_feature 1..36: note = hypo
  source 1..36: mol_type = genomic DNA

SEQ ID NO: 64737 - DNA, 30 bp, Homo sapiens; identical to SEQ ID NO: 44306
  misc_feature 1..30: note = chr15:73919229-73919259
  misc_feature 1..30: note = hypo
  source 1..30: mol_type = genomic DNA

SEQ ID NO: 64738 - DNA, 96 bp, Homo sapiens; identical to SEQ ID NO: 44307
  misc_feature 1..96: note = chr15:74790274-74790370
  misc_feature 1..96: note = hypo
  source 1..96: mol_type = genomic DNA

SEQ ID NO: 64739 - DNA, 30 bp, Homo sapiens; identical to SEQ ID NO: 44310
  misc_feature 1..30: note = chr15:74911603-74911633
  misc_feature 1..30: note = hypo
  source 1..30: mol_type = genomic DNA

SEQ ID NO: 64740 - DNA, 101 bp, Homo sapiens; identical to SEQ ID NO: 44311
  misc_feature 1..101: note = chr15:75143124-75143225
  misc_feature 1..101: note = hypo
  source 1..101: mol_type = genomic DNA

SEQ ID NO: 64741 - DNA, 76 bp, Homo sapiens; identical to SEQ ID NO: 44313
  misc_feature 1..76: note = chr15:76197445-76197521
  misc_feature 1..76: note = hypo
  source 1..76: mol_type = genomic DNA

SEQ ID NO: 64742 - DNA, 30 bp, Homo sapiens; identical to SEQ ID NO: 15913
  misc_feature 1..30: note = chr15:76510088-76510118
  misc_feature 1..30: note = hypo
  source 1..30: mol_type = genomic DNA

SEQ ID NO: 64743 - DNA, 81 bp, Homo sapiens; identical to SEQ ID NO: 44315
  misc_feature 1..81: note = chr15:77852830-77852911
  misc_feature 1..81: note = hypo
  source 1..81: mol_type = genomic DNA

SEQ ID NO: 64744 - DNA, 51 bp, Homo sapiens; identical to SEQ ID NO: 44316
  misc_feature 1..51: note = chr15:77906947-77906998
  misc_feature 1..51: note = hypo
  source 1..51: mol_type = genomic DNA

SEQ ID NO: 64745 - DNA, 30 bp, Homo sapiens; identical to SEQ ID NO: 44317
  misc_feature 1..30: note = chr15:78252931-78252961
  misc_feature 1..30: note = hypo
  source 1..30: mol_type = genomic DNA

SEQ ID NO: 64746 - DNA, 30 bp, Homo sapiens; identical to SEQ ID NO: 44318
  misc_feature 1..30: note = chr15:78277490-78277520
  misc_feature 1..30: note = hypo
  source 1..30: mol_type = genomic DNA

SEQ ID NO: 64747 - DNA, 15 bp, Homo sapiens
  misc_feature 1..15: note = chr15:78501791-78501806
  misc_feature 1..15: note = hypo
  source 1..15: mol_type = genomic DNA
cgtgtgcttccgggg

SEQ ID NO: 64748 - DNA, 30 bp, Homo sapiens; identical to SEQ ID NO: 44320
  misc_feature 1..30: note = chr15:78503615-78503645
  misc_feature 1..30: note = hypo
  source 1..30: mol_type = genomic DNA

SEQ ID NO: 64749 - DNA, 139 bp, Homo sapiens; identical to SEQ ID NO: 15917
  misc_feature 1..139: note = chr15:78609750-78609889
  misc_feature 1..139: note = hypo
  source 1..139: mol_type = genomic DNA

SEQ ID NO: 64750 - DNA, 68 bp, Homo sapiens; identical to SEQ ID NO: 44323
  misc_feature 1..68: note = chr15:79055979-79056047
  misc_feature 1..68: note = hypo
  source 1..68: mol_type = genomic DNA

SEQ ID NO: 64751 - DNA, 30 bp, Homo sapiens; identical to SEQ ID NO: 44324
  misc_feature 1..30: note = chr15:79057117-79057147
  misc_feature 1..30: note = hypo
  source 1..30: mol_type = genomic DNA

SEQ ID NO: 64752 - DNA, 66 bp, Homo sapiens; identical to SEQ ID NO: 44325
  misc_feature 1..66: note = chr15:80624497-80624563
  misc_feature 1..66: note = hypo
  source 1..66: mol_type = genomic DNA

SEQ ID NO: 64753 - DNA, 48 bp, Homo sapiens; identical to SEQ ID NO: 44326
  misc_feature 1..48: note = chr15:82042541-82042589
  misc_feature 1..48: note = hypo
  source 1..48: mol_type = genomic DNA

SEQ ID NO: 64754 - DNA, 162 bp, Homo sapiens; identical to SEQ ID NO: 44327
  misc_feature 1..162: note = chr15:82205642-82205804
  misc_feature 1..162: note = hypo
  source 1..162: mol_type = genomic DNA

SEQ ID NO: 64755 - DNA, 21 bp, Homo sapiens
  misc_feature 1..21: note = chr15:83572455-83572476
  misc_feature 1..21: note = hypo
  source 1..21: mol_type = genomic DNA
ctgaacaagactgggcgcagt

SEQ ID NO: 64756 - DNA, 95 bp, Homo sapiens; identical to SEQ ID NO: 15918
  misc_feature 1..95: note = chr15:83655934-83656029
  misc_feature 1..95: note = hypo
  source 1..95: mol_type = genomic DNA

SEQ ID NO: 64757 - DNA, 29 bp, Homo sapiens
  misc_feature 1..29: note = chr15:83665114-83665143
  misc_feature 1..29: note = hypo
  source 1..29: mol_type = genomic DNA
tggcgcggtggctcacgcctgtaatccca

SEQ ID NO: 64758 - DNA, 37 bp, Homo sapiens; identical to SEQ ID NO: 44331
  misc_feature 1..37: note = chr15:84582058-84582095
  misc_feature 1..37: note = hypo
  source 1..37: mol_type = genomic DNA

SEQ ID NO: 64759 - DNA, 30 bp, Homo sapiens; identical to SEQ ID NO: 44332
  misc_feature 1..30: note = chr15:84950141-84950171
  misc_feature 1..30: note = hypo
  source 1..30: mol_type = genomic DNA

SEQ ID NO: 64760 - DNA, 159 bp, Homo sapiens; identical to SEQ ID NO: 44333
  misc_feature 1..159: note = chr15:85143074-85143233
  misc_feature 1..159: note = hypo
  source 1..159: mol_type = genomic DNA

SEQ ID NO: 64761 - DNA, 47 bp, Homo sapiens; identical to SEQ ID NO: 44334
  misc_feature 1..47: note = chr15:85728800-85728847
  misc_feature 1..47: note = hypo
  source 1..47: mol_type = genomic DNA

SEQ ID NO: 64762 - DNA, 27 bp, Homo sapiens
  misc_feature 1..27: note = chr15:85886665-85886692
  misc_feature 1..27: note = hypo
  source 1..27: mol_type = genomic DNA
gattttaacttgcgttagtgaactaat

SEQ ID NO: 64763 - DNA, 38 bp, Homo sapiens; identical to SEQ ID NO: 44336
  misc_feature 1..38: note = chr15:89142361-89142399
  misc_feature 1..38: note = hypo
  source 1..38: mol_type = genomic DNA

SEQ ID NO: 64764 - DNA, 30 bp, Homo sapiens; identical to SEQ ID NO: 44337
  misc_feature 1..30: note = chr15:89145873-89145903
  misc_feature 1..30: note = hypo
  source 1..30: mol_type = genomic DNA

SEQ ID NO: 64765 - DNA, 20 bp, Homo sapiens
  misc_feature 1..20: note = chr15:89448511-89448531
  misc_feature 1..20: note = hypo
  source 1..20: mol_type = genomic DNA
taataaatcattcatcgggg

SEQ ID NO: 64766 - DNA, 214 bp, Homo sapiens; identical to SEQ ID NO: 44339
  misc_feature 1..214: note = chr15:89876593-89876807
  misc_feature 1..214: note = hypo
  source 1..214: mol_type = genomic DNA

SEQ ID NO: 64767 - DNA, 214 bp, Homo sapiens; identical to SEQ ID NO: 44340
  misc_feature 1..214: note = chr15:89876867-89877081
  misc_feature 1..214: note = hypo
  source 1..214: mol_type = genomic DNA

SEQ ID NO: 64768 - DNA, 199 bp, Homo sapiens; identical to SEQ ID NO: 44341
  misc_feature 1..199: note = chr15:90109400-90109599
  misc_feature 1..199: note = hypo
  source 1..199: mol_type = genomic DNA

SEQ ID NO: 64769 - DNA, 30 bp, Homo sapiens; identical to SEQ ID NO: 44342
  misc_feature 1..30: note = chr15:90501049-90501079
  misc_feature 1..30: note = hypo
  source 1..30: mol_type = genomic DNA

SEQ ID NO: 64770 - DNA, 30 bp, Homo sapiens; identical to SEQ ID NO: 44343
  misc_feature 1..30: note = chr15:90501399-90501429
  misc_feature 1..30: note = hypo
  source 1..30: mol_type = genomic DNA

SEQ ID NO: 64771 - DNA, 30 bp, Homo sapiens; identical to SEQ ID NO: 15919
  misc_feature 1..30: note = chr15:90630578-90630608
  misc_feature 1..30: note = hypo
  source 1..30: mol_type = genomic DNA

SEQ ID NO: 64772 - DNA, 39 bp, Homo sapiens
  misc_feature 1..39: note = chr15:90667422-90667461
  misc_feature 1..39: note = hypo
  source 1..39: mol_type = genomic DNA
cctttttttttgagacggagtttcactcttgttgcccag

SEQ ID NO: 64773 - DNA, 20 bp, Homo sapiens
  misc_feature 1..20: note = chr15:90703242-90703262
  misc_feature 1..20: note = hypo
  source 1..20: mol_type = genomic DNA
ttgtttgtttttttgcgggg

SEQ ID NO: 64774 - DNA, 20 bp, Homo sapiens
  misc_feature 1..20: note = chr15:90741434-90741454
  misc_feature 1..20: note = hypo
  source 1..20: mol_type = genomic DNA
caccgcgcctggctggtaaa

SEQ ID NO: 64775 - DNA, 30 bp, Homo sapiens; identical to SEQ ID NO: 44348
  misc_feature 1..30: note = chr15:90755834-90755864
  misc_feature 1..30: note = hypo
  source 1..30: mol_type = genomic DNA

SEQ ID NO: 64776 - DNA, 55 bp, Homo sapiens; identical to SEQ ID NO: 44349
  misc_feature 1..55: note = chr15:90866273-90866328
  misc_feature 1..55: note = hypo
  source 1..55: mol_type = genomic DNA

SEQ ID NO: 64777 - DNA, 35 bp, Homo sapiens; identical to SEQ ID NO: 44350
  misc_feature 1..35: note = chr15:90896205-90896240
  misc_feature 1..35: note = hypo
  source 1..35: mol_type = genomic DNA

SEQ ID NO: 64778 - DNA, 116 bp, Homo sapiens; identical to SEQ ID NO: 15922
  misc_feature 1..116: note = chr15:91189343-91189459
  misc_feature 1..116: note = hypo
  source 1..116: mol_type = genomic DNA

SEQ ID NO: 64779 - DNA, 22 bp, Homo sapiens
  misc_feature 1..22: note = chr15:91313693-91313715
  misc_feature 1..22: note = hypo
  source 1..22: mol_type = genomic DNA
ccgtgcccggccaatccccaca

SEQ ID NO: 64780 - DNA, 30 bp, Homo sapiens; identical to SEQ ID NO: 15924
  misc_feature 1..30: note = chr15:91409404-91409434
  misc_feature 1..30: note = hypo
  source 1..30: mol_type = genomic DNA

SEQ ID NO: 64781 - DNA, 30 bp, Homo sapiens; identical to SEQ ID NO: 44354
  misc_feature 1..30: note = chr15:91500770-91500800
  misc_feature 1..30: note = hypo
  source 1..30: mol_type = genomic DNA

SEQ ID NO: 64782 - DNA, 46 bp, Homo sapiens; identical to SEQ ID NO: 44355
  misc_feature 1..46: note = chr15:92459343-92459389
  misc_feature 1..46: note = hypo
  source 1..46: mol_type = genomic DNA

SEQ ID NO: 64783 - DNA, 98 bp, Homo sapiens; identical to SEQ ID NO: 44356
  misc_feature 1..98: note = chr15:92459593-92459691
  misc_feature 1..98: note = hypo
  source 1..98: mol_type = genomic DNA

SEQ ID NO: 64784 - DNA, 30 bp, Homo sapiens; identical to SEQ ID NO: 44357
  misc_feature 1..30: note = chr15:92701704-92701734
  misc_feature 1..30: note = hypo
  source 1..30: mol_type = genomic DNA

SEQ ID NO: 64785 - DNA, 18 bp, Homo sapiens
  misc_feature 1..18: note = chr15:93364650-93364668
  misc_feature 1..18: note = hypo
  source 1..18: mol_type = genomic DNA
tctcgggggaaaaaaaaa

SEQ ID NO: 64786 - DNA, 121 bp, Homo sapiens; identical to SEQ ID NO: 44359
  misc_feature 1..121: note = chr15:93594841-93594962
  misc_feature 1..121: note = hypo
  source 1..121: mol_type = genomic DNA

SEQ ID NO: 64787 - DNA, 45 bp, Homo sapiens; identical to SEQ ID NO: 44360
  misc_feature 1..45: note = chr15:93609520-93609565
  misc_feature 1..45: note = hypo
  source 1..45: mol_type = genomic DNA

SEQ ID NO: 64788 - DNA, 63 bp, Homo sapiens; identical to SEQ ID NO: 44361
  misc_feature 1..63: note = chr15:93609815-93609878
  misc_feature 1..63: note = hypo
  source 1..63: mol_type = genomic DNA

SEQ ID NO: 64789 - DNA, 33 bp, Homo sapiens; identical to SEQ ID NO: 44362
  misc_feature 1..33: note = chr15:93902389-93902422
  misc_feature 1..33: note = hypo
  source 1..33: mol_type = genomic DNA

SEQ ID NO: 64790 - DNA, 40 bp, Homo sapiens; identical to SEQ ID NO: 44364
  misc_feature 1..40: note = chr15:94478454-94478494
  misc_feature 1..40: note = hypo
  source 1..40: mol_type = genomic DNA

SEQ ID NO: 64791 - DNA, 30 bp, Homo sapiens; identical to SEQ ID NO: 44365
  misc_feature 1..30: note = chr15:94925846-94925876
  misc_feature 1..30: note = hypo
  source 1..30: mol_type = genomic DNA

SEQ ID NO: 64792 - DNA, 19 bp, Homo sapiens
  misc_feature 1..19: note = chr15:97006353-97006372
  misc_feature 1..19: note = hypo
  source 1..19: mol_type = genomic DNA
catgtctgtgacatccgtg

SEQ ID NO: 64793 - DNA, 30 bp, Homo sapiens; identical to SEQ ID NO: 44367
  misc_feature 1..30: note = chr15:98417575-98417605
  misc_feature 1..30: note = hypo
  source 1..30: mol_type = genomic DNA

SEQ ID NO: 64794 - DNA, 31 bp, Homo sapiens; identical to SEQ ID NO: 15930
  misc_feature 1..31: note = chr15:98454964-98454995
  misc_feature 1..31: note = hypo
  source 1..31: mol_type = genomic DNA

SEQ ID NO: 64795 - DNA, 38 bp, Homo sapiens; identical to SEQ ID NO: 44369
  misc_feature 1..38: note = chr15:98776801-98776839
  misc_feature 1..38: note = hypo
  source 1..38: mol_type = genomic DNA

SEQ ID NO: 64796 - DNA, 26 bp, Homo sapiens
  misc_feature 1..26: note = chr15:99168900-99168926
  misc_feature 1..26: note = hypo
  source 1..26: mol_type = genomic DNA
acctcagagtcctcacgtataaaatg

SEQ ID NO: 64797 - DNA, 90 bp, Homo sapiens; identical to SEQ ID NO: 44371
  misc_feature 1..90: note = chr15:99183400-99183490
  misc_feature 1..90: note = hypo
  source 1..90: mol_type = genomic DNA

SEQ ID NO: 64798 - DNA, 42 bp, Homo sapiens; identical to SEQ ID NO: 44372
  misc_feature 1..42: note = chr15:99254581-99254623
  misc_feature 1..42: note = hypo
  source 1..42: mol_type = genomic DNA

SEQ ID NO: 64799 - DNA, 41 bp, Homo sapiens; identical to SEQ ID NO: 44373
  misc_feature 1..41: note = chr15:99295597-99295638
  misc_feature 1..41: note = hypo
  source 1..41: mol_type = genomic DNA

SEQ ID NO: 64800 - DNA, 30 bp, Homo sapiens; identical to SEQ ID NO: 44374
  misc_feature 1..30: note = chr15:99454637-99454667
  misc_feature 1..30: note = hypo
  source 1..30: mol_type = genomic DNA

SEQ ID NO: 64801 - DNA, 33 bp, Homo sapiens; identical to SEQ ID NO: 44375
  misc_feature 1..33: note = chr15:99456398-99456431
  misc_feature 1..33: note = hypo
  source 1..33: mol_type = genomic DNA

SEQ ID NO: 64802 - DNA, 48 bp, Homo sapiens; identical to SEQ ID NO: 44376
  misc_feature 1..48: note = chr15:99460220-99460268
  misc_feature 1..48: note = hypo
  source 1..48: mol_type = genomic DNA

SEQ ID NO: 64803 - DNA, 38 bp, Homo sapiens; identical to SEQ ID NO: 44377
  misc_feature 1..38: note = chr15:99484067-99484105
  misc_feature 1..38: note = hypo
  source 1..38: mol_type = genomic DNA

SEQ ID NO: 64804 - DNA, 132 bp, Homo sapiens; identical to SEQ ID NO: 15933
  misc_feature 1..132: note = chr15:99484456-99484588
  misc_feature 1..132: note = hypo
  source 1..132: mol_type = genomic DNA

SEQ ID NO: 64805 - DNA, 30 bp, Homo sapiens; identical to SEQ ID NO: 44379
  misc_feature 1..30: note = chr15:99506147-99506177
  misc_feature 1..30: note = hypo
  source 1..30: mol_type = genomic DNA

SEQ ID NO: 64806 - DNA, 30 bp, Homo sapiens; identical to SEQ ID NO: 44380
  misc_feature 1..30: note = chr15:99974913-99974943
  misc_feature 1..30: note = hypo
  source 1..30: mol_type = genomic DNA

SEQ ID NO: 64807 - DNA, 30 bp, Homo sapiens; identical to SEQ ID NO: 44381
  misc_feature 1..30: note = chr15:99981097-99981127
  misc_feature 1..30: note = hypo
  source 1..30: mol_type = genomic DNA

SEQ ID NO: 64808 - DNA, 30 bp, Homo sapiens; identical to SEQ ID NO: 44382
  misc_feature 1..30: note = chr15:100378951-100378981
  misc_feature 1..30: note = hypo
  source 1..30: mol_type = genomic DNA

SEQ ID NO: 64809 - DNA, 30 bp, Homo sapiens; identical to SEQ ID NO: 44383
  misc_feature 1..30: note = chr15:100888957-100888987
  misc_feature 1..30: note = hypo
  source 1..30: mol_type = genomic DNA

SEQ ID NO: 64810 - DNA, 326 bp, Homo sapiens; identical to SEQ ID NO: 44384
  misc_feature 1..326: note = chr15:102043003-102043329
  misc_feature 1..326: note = hypo
  source 1..326: mol_type = genomic DNA

SEQ ID NO: 64811 - DNA, 22 bp, Homo sapiens
  misc_feature 1..22: note = chr15:102193729-102193751
  misc_feature 1..22: note = hypo
  source 1..22: mol_type = genomic DNA
gagactccgtctcaaaaaataa

SEQ ID NO: 64812 - DNA, 30 bp, Homo sapiens; identical to SEQ ID NO: 44386
  misc_feature 1..30: note = chr15:102276370-102276400
  misc_feature 1..30: note = hypo
  source 1..30: mol_type = genomic DNA

SEQ ID NO: 64813 - DNA, 23 bp, Homo sapiens
  misc_feature 1..23: note = chr16:142626-142649
  misc_feature 1..23: note = hypo
  source 1..23: mol_type = genomic DNA
ttctgacaaggagaccggcaagg

SEQ ID NO: 64814 - DNA, 120 bp, Homo sapiens; identical to SEQ ID NO: 44388
  misc_feature 1..120: note = chr16:189557-189677
  misc_feature 1..120: note = hypo
  source 1..120: mol_type = genomic DNA

SEQ ID NO: 64815 - DNA, 23 bp, Homo sapiens
  misc_feature 1..23: note = chr16:208745-208768
  misc_feature 1..23: note = hypo
  source 1..23: mol_type = genomic DNA
ttttcttttttgagacggaatct

SEQ ID NO: 64816 - DNA, 30 bp, Homo sapiens; identical to SEQ ID NO: 44390
  misc_feature 1..30: note = chr16:318060-318090
  misc_feature 1..30: note = hypo
  source 1..30: mol_type = genomic DNA

SEQ ID NO: 64817 - DNA, 38 bp, Homo sapiens; identical to SEQ ID NO: 44391
  misc_feature 1..38: note = chr16:319924-319962
  misc_feature 1..38: note = hypo
  source 1..38: mol_type = genomic DNA

SEQ ID NO: 64818 - DNA, 158 bp, Homo sapiens; identical to SEQ ID NO: 44392
  misc_feature 1..158: note = chr16:323428-323586
  misc_feature 1..158: note = hypo
  source 1..158: mol_type = genomic DNA

SEQ ID NO: 64819 - DNA, 92 bp, Homo sapiens; identical to SEQ ID NO: 44393
  misc_feature 1..92: note = chr16:332635-332727
  misc_feature 1..92: note = hypo
  source 1..92: mol_type = genomic DNA

SEQ ID NO: 64820 - DNA, 39 bp, Homo sapiens
  misc_feature 1..39: note = chr16:337560-337599
  misc_feature 1..39: note = hypo
  source 1..39: mol_type = genomic DNA
atgtacatatttacacgggccctcagaaaggaggaccca

SEQ ID NO: 64821 - DNA, 119 bp, Homo sapiens
  misc_feature 1..119: note = chr16:337659-337778
  misc_feature 1..119: note = hypo
  source 1..119: mol_type = genomic DNA
caggcaagagacaagctgtgttgaaggcactcggtggcgcgtacaattgacagaggccctgcaggcctctgcatccgggcctgggccccacccagacctgggtacgtgggcaaatccca

SEQ ID NO: 64822 - DNA, 119 bp, Homo sapiens; identical to SEQ ID NO: 25185
  misc_feature 1..119: note = chr16:410258-410377
  misc_feature 1..119: note = hypo
  source 1..119: mol_type = genomic DNA

SEQ ID NO: 64823 - DNA, 307 bp, Homo sapiens
  misc_feature 1..307: note = chr16:410407-410714
  misc_feature 1..307: note = hypo
  source 1..307: mol_type = genomic DNA
ctaataacctaacaatcgtgtcaacgggagctttgaacccccagggcgcgcctgccaggccaactgagagctcaaggcctctgtgggcagcaggacgtggtcggggggaggagacgcagccacggctgtcctcacacccagctcggcccctgcgggctcctctgggcagaacctggggaaggcacggcctctagcaggaggtggaggcctttgaaagggtgcaggtgttgggaccaggtacccggcccaggcccccagccgcgtccacacacgtcgcacacggcagcaaggacgcaagcagtgtgga

SEQ ID NO: 64824 - DNA, 461 bp, Homo sapiens; identical to SEQ ID NO: 44396
  misc_feature 1..461: note = chr16:411043-411504
  misc_feature 1..461: note = hypo
  source 1..461: mol_type = genomic DNA

SEQ ID NO: 64825 - DNA, 309 bp, Homo sapiens; identical to SEQ ID NO: 44397
  misc_feature 1..309: note = chr16:412764-413073
  misc_feature 1..309: note = hypo
  source 1..309: mol_type = genomic DNA

SEQ ID NO: 64826 - DNA, 30 bp, Homo sapiens; identical to SEQ ID NO: 44398
  misc_feature 1..30: note = chr16:501353-501383
  misc_feature 1..30: note = hypo
  source 1..30: mol_type = genomic DNA

SEQ ID NO: 64827 - DNA, 19 bp, Homo sapiens
  misc_feature 1..19: note = chr16:611950-611969
  misc_feature 1..19: note = hypo
  source 1..19: mol_type = genomic DNA
gtgcagccagggccccgca

SEQ ID NO: 64828 - DNA, 60 bp, Homo sapiens
  misc_feature 1..60: note = chr16:612260-612320
  misc_feature 1..60: note = hypo
  source 1..60: mol_type = genomic DNA
ggagctgggctgagcaggtggctgagccgtggggccatgctgggacgtccactccccaca

SEQ ID NO: 64829 - DNA, 72 bp, Homo sapiens; identical to SEQ ID NO: 44402
  misc_feature 1..72: note = chr16:613552-613624
  misc_feature 1..72: note = hypo
  source 1..72: mol_type = genomic DNA

SEQ ID NO: 64830 - DNA, 134 bp, Homo sapiens; identical to SEQ ID NO: 44403
  misc_feature 1..134: note = chr16:613908-614042
  misc_feature 1..134: note = hypo
  source 1..134: mol_type = genomic DNA

SEQ ID NO: 64831 - DNA, 30 bp, Homo sapiens; identical to SEQ ID NO: 44404
  misc_feature 1..30: note = chr16:614353-614383
  misc_feature 1..30: note = hypo
  source 1..30: mol_type = genomic DNA

SEQ ID NO: 64832 - DNA, 480 bp, Homo sapiens; identical to SEQ ID NO: 44405
  misc_feature 1..480: note = chr16:614777-615257
  misc_feature 1..480: note = hypo
  source 1..480: mol_type = genomic DNA

SEQ ID NO: 64833 - DNA, 30 bp, Homo sapiens; identical to SEQ ID NO: 44406
  misc_feature 1..30: note = chr16:623234-623264
  misc_feature 1..30: note = hypo
  source 1..30: mol_type = genomic DNA

SEQ ID NO: 64834 - DNA, 84 bp, Homo sapiens; identical to SEQ ID NO: 44407
  misc_feature 1..84: note = chr16:643882-643966
  misc_feature 1..84: note = hypo
  source 1..84: mol_type = genomic DNA

SEQ ID NO: 64835 - DNA, 117 bp, Homo sapiens; identical to SEQ ID NO: 44408
  misc_feature 1..117: note = chr16:666790-666907
  misc_feature 1..117: note = hypo
  source 1..117: mol_type = genomic DNA

SEQ ID NO: 64836 - DNA, 63 bp, Homo sapiens; identical to SEQ ID NO: 25191
  misc_feature 1..63: note = chr16:667484-667547
  misc_feature 1..63: note = hypo
  source 1..63: mol_type = genomic DNA

SEQ ID NO: 64837 - DNA, 61 bp, Homo sapiens; identical to SEQ ID NO: 44410
  misc_feature 1..61: note = chr16:677848-677909
  misc_feature 1..61: note = hypo
  source 1..61: mol_type = genomic DNA

SEQ ID NO: 64838 - DNA, 175 bp, Homo sapiens
  misc_feature 1..175: note = chr16:700124-700299
  misc_feature 1..175: note = hypo
  source 1..175: mol_type = genomic DNA
gcccagcaagcacttcgtcatccacctcgatgtgtcctccaaggtacggagcccgcggctgggggctgcgtgggagccccggcacccctgcggcccctgtctcctcacggccctgctccgtccccacaggacaaccaagtcatccgtgtgtctttctccaacctcttcaaggagt

SEQ ID NO: 64839 - DNA, 64 bp, Homo sapiens; identical to SEQ ID NO: 44412
  misc_feature 1..64: note = chr16:700572-700636
  misc_feature 1..64: note = hypo
  source 1..64: mol_type = genomic DNA

SEQ ID NO: 64840 - DNA, 30 bp, Homo sapiens; identical to SEQ ID NO: 44413
  misc_feature 1..30: note = chr16:721696-721726
  misc_feature 1..30: note = hypo
  source 1..30: mol_type = genomic DNA

SEQ ID NO: 64841 - DNA, 57 bp, Homo sapiens
  misc_feature 1..57: note = chr16:726990-727047
  misc_feature 1..57: note = hypo
  source 1..57: mol_type = genomic DNA
cggggcccgcctcaacaagtgggtgctgcagacctaccaccccgagtacatgaagag

SEQ ID NO: 64842 - DNA, 135 bp, Homo sapiens
  misc_feature 1..135: note = chr16:731353-731488
  misc_feature 1..135: note = hypo
  source 1..135: mol_type = genomic DNA
ggctgacaagctgcccggttgtggggcctctggggccaggcgggtggactggccagagagtgacgtgaagcccccgttccccagcttacagcctggccaaggagcagcggctgaacttcggggacgacatcccca

SEQ ID NO: 64843 - DNA, 464 bp, Homo sapiens
  misc_feature 1..464: note = chr16:734741-735205
  misc_feature 1..464: note = hypo
  source 1..464: mol_type = genomic DNA
actcgcagaggtggccgcagcctgcgggacagtgggagctgccttccagccacttcatgatgtgctgcaggtggccgccgtggctgcagccctggcaccacacgaagagacccttgactacgtggtggcagacggcacacatgctggcgcagcggtggcacctgggggcgggcgggagggagggtgcctcagcgggggctgctgcgctgcctgcaggcccctgccccacctcccgaccccactgccccacctgtcgcagacccagccccggctgctcatgggccgcttgcagtggctgcagttgacgtgcagggtggtggaggcctggttgaggcagctgacggcgcggctggtgctcagcttgaccacctcgttggacacgttccagaggcggaagcgctgcagcaggtcgatgtaggaagtgtaccagtgctcctgggggagggagcgcccggcagtcagga

SEQ ID NO: 64844 - DNA, 357 bp, Homo sapiens
  misc_feature 1..357: note = chr16:735594-735951
  misc_feature 1..357: note = hypo
  source 1..357: mol_type = genomic DNA
cggctggaaggcagggaccagcggaggctctgagtctgtcctccatccgcctctgaaccccaccctgcccggacccccactcacggtgcgcgtgttccggatccagcaggtacagctcgtcctcctcaccttccacgtcacccagcaggtagtcggcaggtacgtcgctgccctcggtttcctcgttatctgcccgacaatggggcgggcattcagggtcgtctgggacacccccacccctctcccatcagcacccctacccaccccagcctaccctcattggtgatgagtgtggccgaggagtcgagcagaactgtgtcgctccgtgcatctcctttgctgcggtccagccgcgtc

SEQ ID NO: 64845 - DNA, 30 bp, Homo sapiens; identical to SEQ ID NO: 44418
  misc_feature 1..30: note = chr16:760916-760946
  misc_feature 1..30: note = hypo
  source 1..30: mol_type = genomic DNA

SEQ ID NO: 64846 - DNA, 244 bp, Homo sapiens; identical to SEQ ID NO: 44419
  misc_feature 1..244: note = chr16:775524-775768
  misc_feature 1..244: note = hypo
  source 1..244: mol_type = genomic DNA

SEQ ID NO: 64847 - DNA, 126 bp, Homo sapiens; identical to SEQ ID NO: 44420
  misc_feature 1..126: note = chr16:798233-798359
  misc_feature 1..126: note = hypo
  source 1..126: mol_type = genomic DNA

SEQ ID NO: 64848 - DNA, 30 bp, Homo sapiens; identical to SEQ ID NO: 15953
  misc_feature 1..30: note = chr16:809500-809530
  misc_feature 1..30: note = hypo
  source 1..30: mol_type = genomic DNA

SEQ ID NO: 64849 - DNA, 267 bp, Homo sapiens; identical to SEQ ID NO: 44422
  misc_feature 1..267: note = chr16:809787-810054
  misc_feature 1..267: note = hypo
  source 1..267: mol_type = genomic DNA

SEQ ID NO: 64850 - DNA, 193 bp, Homo sapiens; identical to SEQ ID NO: 44423
  misc_feature 1..193: note = chr16:816004-816197
  misc_feature 1..193: note = hypo
  source 1..193: mol_type = genomic DNA

SEQ ID NO: 64851 - DNA, 19 bp, Homo sapiens
  misc_feature 1..19: note = chr16:822477-822496
  misc_feature 1..19: note = hypo
  source 1..19: mol_type = genomic DNA
actccgtctcaaaaaatga

SEQ ID NO: 64852 - DNA, 30 bp, Homo sapiens; identical to SEQ ID NO: 44425
  misc_feature 1..30: note = chr16:822951-822981
  misc_feature 1..30: note = hypo
  source 1..30: mol_type = genomic DNA

SEQ ID NO: 64853 - DNA, 289 bp, Homo sapiens; identical to SEQ ID NO: 44426
  misc_feature 1..289: note = chr16:824923-825212
  misc_feature 1..289: note = hypo
  source 1..289: mol_type = genomic DNA

SEQ ID NO: 64854 - DNA, 53 bp, Homo sapiens; identical to SEQ ID NO: 25202
  misc_feature 1..53: note = chr16:837308-837361
  misc_feature 1..53: note = hypo
  source 1..53: mol_type = genomic DNA

SEQ ID NO: 64855 - DNA, 98 bp, Homo sapiens
  misc_feature 1..98: note = chr16:837460-837558
  misc_feature 1..98: note = hypo
  source 1..98: mol_type = genomic DNA
ccagctggtggcagaacctggagtgggacagagtccagagtctgagccactttcctccacagacgccaccgtggggctccggccgccccccctacctg

SEQ ID NO: 64856 - DNA, 507 bp, Homo sapiens
  misc_feature 1..507: note = chr16:845985-846492
  misc_feature 1..507: note = hypo
  source 1..507: mol_type = genomic DNA
ctggccagcctggtgggcacgatgctcgcttacagcctgacctaccgccaggagcgcacgcccgatggccagtacatctacaggctggagccgtgagtcccccagtgcctggggtgtgctccagggtcatgctccccggctgtgctccatgttcagggcccgcatggggccaggagtctgaaagcacggtcatggcgtctgggggtggcgggccccagcttatcttttgctcagatgtaaccgtgaaggggggtcacttccagctacttgagattggctctgggacctgagttttgctgcagagctgctcccagccttagcacccccacatggaactggagccgggggccccgagagtgactgcactttccaacactccgtttcccgctgtgggatggccatgggggtggtgggggtgaggcatggggcagtggccccggggtcctgctgccccagcgacggcaccaacttgcaggacgctgagtcactctccgtggcagccatcgg

SEQ ID NO: 64857 - DNA, 66 bp, Homo sapiens; identical to SEQ ID NO: 44429
  misc_feature 1..66: note = chr16:847020-847086
  misc_feature 1..66: note = hypo
  source 1..66: mol_type = genomic DNA

SEQ ID NO: 64858 - DNA, 53 bp, Homo sapiens; identical to SEQ ID NO: 15959
  misc_feature 1..53: note = chr16:858748-858801
  misc_feature 1..53: note = hypo
  source 1..53: mol_type = genomic DNA

SEQ ID NO: 64859 - DNA, 185 bp, Homo sapiens; identical to SEQ ID NO: 44431
  misc_feature 1..185: note = chr16:870944-871129
  misc_feature 1..185: note = hypo
  source 1..185: mol_type = genomic DNA

SEQ ID NO: 64860 - DNA, 79 bp, Homo sapiens; identical to SEQ ID NO: 44432
  misc_feature 1..79: note = chr16:882403-882482
  misc_feature 1..79: note = hypo
  source 1..79: mol_type = genomic DNA

SEQ ID NO: 64861 - DNA, 93 bp, Homo sapiens
  misc_feature 1..93: note = chr16:882588-882681
  misc_feature 1..93: note = hypo
  source 1..93: mol_type = genomic DNA
ttagctgtgggatgtttgggctttgaaaggagctgatctgacggagccaggagggctggctgcaggacagagacaggacggctgtcacagcag

SEQ ID NO: 64862 - DNA, 30 bp, Homo sapiens; identical to SEQ ID NO: 44434
  misc_feature 1..30: note = chr16:883678-883708
  misc_feature 1..30: note = hypo
  source 1..30: mol_type = genomic DNA

SEQ ID NO: 64863 - DNA, 131 bp, Homo sapiens; identical to SEQ ID NO: 44435
  misc_feature 1..131: note = chr16:888838-888969
  misc_feature 1..131: note = hypo
  source 1..131: mol_type = genomic DNA

SEQ ID NO: 64864 - DNA, 30 bp, Homo sapiens; identical to SEQ ID NO: 44436
  misc_feature 1..30: note = chr16:891770-891800
  misc_feature 1..30: note = hypo
  source 1..30: mol_type = genomic DNA

SEQ ID NO: 64865 - DNA, 203 bp, Homo sapiens
  misc_feature 1..203: note = chr16:894890-895093
  misc_feature 1..203: note = hypo
  source 1..203: mol_type = genomic DNA
cagagcctgcctctccgggactgggcttcggccgagcagacaccgcctagctgctctttgaccagcgttctctgctctgcgtctggctggcatcggcggcttgctgagtccagcctggcatctcgctggcatcggcggctcgctgggtccagcctggcgctgacacgtttctgtgctcatttcattttacaaatcaactcccc

SEQ ID NO: 64866 - DNA, 285 bp, Homo sapiens; identical to SEQ ID NO: 44438
  misc_feature 1..285: note = chr16:924548-924833
  misc_feature 1..285: note = hypo
  source 1..285: mol_type = genomic DNA

SEQ ID NO: 64867 - DNA, 22 bp, Homo sapiens
  misc_feature 1..22: note = chr16:943459-943481
  misc_feature 1..22: note = hypo
  source 1..22: mol_type = genomic DNA
ggatgagcccaaagtcggaggg

SEQ ID NO: 64868 - DNA, 60 bp, Homo sapiens
  misc_feature 1..60: note = chr16:943553-943613
  misc_feature 1..60: note = hypo
  source 1..60: mol_type = genomic DNA
tctcccacacactgcagctcgcctgctgtgaggactcctggggcacgggacaggcttcca

SEQ ID NO: 64869 - DNA, 132 bp, Homo sapiens; identical to SEQ ID NO: 44440
  misc_feature 1..132: note = chr16:963266-963398
  misc_feature 1..132: note = hypo
  source 1..132: mol_type = genomic DNA

SEQ ID NO: 64870 - DNA, 76 bp, Homo sapiens; identical to SEQ ID NO: 44441
  misc_feature 1..76: note = chr16:965804-965880
  misc_feature 1..76: note = hypo
  source 1..76: mol_type = genomic DNA

SEQ ID NO: 64871 - DNA, 30 bp, Homo sapiens; identical to SEQ ID NO: 44442
  misc_feature 1..30: note = chr16:968262-968292
  misc_feature 1..30: note = hypo
  source 1..30: mol_type = genomic DNA

SEQ ID NO: 64872 - DNA, 45 bp, Homo sapiens; identical to SEQ ID NO: 44443
  misc_feature 1..45: note = chr16:968601-968646
  misc_feature 1..45: note = hypo
  source 1..45: mol_type = genomic DNA

SEQ ID NO: 64873 - DNA, 77 bp, Homo sapiens; identical to SEQ ID NO: 44444
  misc_feature 1..77: note = chr16:981729-981806
  misc_feature 1..77: note = hypo
  source 1..77: mol_type = genomic DNA

SEQ ID NO: 64874 - DNA, 30 bp, Homo sapiens; identical to SEQ ID NO: 44445
  misc_feature 1..30: note = chr16:1022784-1022814
  misc_feature 1..30: note = hypo
  source 1..30: mol_type = genomic DNA

SEQ ID NO: 64875 - DNA, 131 bp, Homo sapiens; identical to SEQ ID NO: 44446
  misc_feature 1..131: note = chr16:1040337-1040468
  misc_feature 1..131: note = hypo
  source 1..131: mol_type = genomic DNA

SEQ ID NO: 64876 - DNA, 115 bp, Homo sapiens
  misc_feature 1..115: note = chr16:1052472-1052587
  misc_feature 1..115: note = hypo
  source 1..115: mol_type = genomic DNA
cacatgtgcacctgccgcagccccgatgtccctccccgggtgaaggaacccacggacgtggctcatccataccgcggaacgtgagccatgaaaaggggcagcctcggctcagcca

SEQ ID NO: 64877 - DNA, 30 bp, Homo sapiens; identical to SEQ ID NO: 44448
  misc_feature 1..30: note = chr16:1061426-1061456
  misc_feature 1..30: note = hypo
  source 1..30: mol_type = genomic DNA

SEQ ID NO: 64878 - DNA, 32 bp, Homo sapiens; identical to SEQ ID NO: 44449
  misc_feature 1..32: note = chr16:1062412-1062444
  misc_feature 1..32: note = hypo
  source 1..32: mol_type = genomic DNA

SEQ ID NO: 64879 - DNA, 30 bp, Homo sapiens; identical to SEQ ID NO: 44450
  misc_feature 1..30: note = chr16:1072992-1073022
  misc_feature 1..30: note = hypo
  source 1..30: mol_type = genomic DNA

SEQ ID NO: 64880 - DNA, 42 bp, Homo sapiens; identical to SEQ ID NO: 44451
  misc_feature 1..42: note = chr16:1073516-1073558
  misc_feature 1..42: note = hypo
  source 1..42: mol_type = genomic DNA

SEQ ID NO: 64881 - DNA, 51 bp, Homo sapiens; identical to SEQ ID NO: 44452
  misc_feature 1..51: note = chr16:1076434-1076485
  misc_feature 1..51: note = hypo
  source 1..51: mol_type = genomic DNA

SEQ ID NO: 64882 - DNA, 78 bp, Homo sapiens; identical to SEQ ID NO: 44453
  misc_feature 1..78: note = chr16:1077581-1077659
  misc_feature 1..78: note = hypo
  source 1..78: mol_type = genomic DNA

SEQ ID NO: 64883 - DNA, 217 bp, Homo sapiens; identical to SEQ ID NO: 15968
  misc_feature 1..217: note = chr16:1081773-1081990
  misc_feature 1..217: note = hypo
  source 1..217: mol_type = genomic DNA

SEQ ID NO: 64884 - DNA, 30 bp, Homo sapiens; identical to SEQ ID NO: 44455
  misc_feature 1..30: note = chr16:1089739-1089769
  misc_feature 1..30: note = hypo
  source 1..30: mol_type = genomic DNA

SEQ ID NO: 64885 - DNA, 30 bp, Homo sapiens; identical to SEQ ID NO: 44456
  misc_feature 1..30: note = chr16:1092742-1092772
  misc_feature 1..30: note = hypo
  source 1..30: mol_type = genomic DNA

SEQ ID NO: 64886 - DNA, 69 bp, Homo sapiens; identical to SEQ ID NO: 44457
  misc_feature 1..69: note = chr16:1101038-1101107
  misc_feature 1..69: note = hypo
  source 1..69: mol_type = genomic DNA

SEQ ID NO: 64887 - DNA, 30 bp, Homo sapiens; identical to SEQ ID NO: 44458
  misc_feature 1..30: note = chr16:1103161-1103191
  misc_feature 1..30: note = hypo
  source 1..30: mol_type = genomic DNA

SEQ ID NO: 64888 - DNA, 44 bp, Homo sapiens
  misc_feature 1..44: note = chr16:1128967-1129011
  misc_feature 1..44: note = hypo
  source 1..44: mol_type = genomic DNA
ccctcggcaggggcccgggcggtgctggtgcccgtgctgtacct

SEQ ID NO: 64889 - DNA, 51 bp, Homo sapiens
  misc_feature 1..51: note = chr16:1155111-1155162
  misc_feature 1..51: note = hypo
  source 1..51: mol_type = genomic DNA
ggggccagcagcaggcgggtctcagcggcggtgctaccacctcccactcag

SEQ ID NO: 64890 - DNA, 206 bp, Homo sapiens; identical to SEQ ID NO: 44461
  misc_feature 1..206: note = chr16:1166561-1166767
  misc_feature 1..206: note = hypo
  source 1..206: mol_type = genomic DNA

SEQ ID NO: 64891 - DNA, 67 bp, Homo sapiens; identical to SEQ ID NO: 44462
  misc_feature 1..67: note = chr16:1171222-1171289
  misc_feature 1..67: note = hypo
  source 1..67: mol_type = genomic DNA

SEQ ID NO: 64892 - DNA, 143 bp, Homo sapiens; identical to SEQ ID NO: 44463
  misc_feature 1..143: note = chr16:1173250-1173393
  misc_feature 1..143: note = hypo
  source 1..143: mol_type = genomic DNA

SEQ ID NO: 64893 - DNA, 33 bp, Homo sapiens; identical to SEQ ID NO: 44464
  misc_feature 1..33: note = chr16:1188925-1188958
  misc_feature 1..33: note = hypo
  source 1..33: mol_type = genomic DNA

SEQ ID NO: 64894 - DNA, 152 bp, Homo sapiens; identical to SEQ ID NO: 44465
  misc_feature 1..152: note = chr16:1195670-1195822
  misc_feature 1..152: note = hypo
  source 1..152: mol_type = genomic DNA

SEQ ID NO: 64895 - DNA, 112 bp, Homo sapiens
  misc_feature 1..112: note = chr16:1217195-1217307
  misc_feature 1..112: note = hypo
  source 1..112: mol_type = genomic DNA
cccgtggggatgaaacgggctctttgcggggggcctgtggggtatgggcctcctgtcagcagcccgtcccggtgggtggggcttgccggccgcccgcgaatgtcaggaacct

SEQ ID NO: 64896 - DNA, 126 bp, Homo sapiens
  misc_feature 1..126: note = chr16:1217908-1218034
  misc_feature 1..126: note = hypo
  source 1..126: mol_type = genomic DNA
ccagtgcgtggagcacgtggggcctcaggagccaggcctgttccccggggctgcctggaggcggccgcttgtccccaaggcctggtgaccgcacctctgtctgccctaggccttcgagttggggga

SEQ ID NO: 64897 - DNA, 30 bp, Homo sapiens; identical to SEQ ID NO: 44468
  misc_feature 1..30: note = chr16:1220508-1220538
  misc_feature 1..30: note = hypo
  source 1..30: mol_type = genomic DNA

SEQ ID NO: 64898 - DNA, 30 bp, Homo sapiens; identical to SEQ ID NO: 44469
  misc_feature 1..30: note = chr16:1222610-1222640
  misc_feature 1..30: note = hypo
  source 1..30: mol_type = genomic DNA

SEQ ID NO: 64899 - DNA, 24 bp, Homo sapiens
  misc_feature 1..24: note = chr16:1228780-1228804
  misc_feature 1..24: note = hypo
  source 1..24: mol_type = genomic DNA
ccaagctccagaagtcggggttgg

SEQ ID NO: 64900 - DNA, 15 bp, Homo sapiens
  misc_feature 1..15: note = chr16:1228916-1228931
  misc_feature 1..15: note = hypo
  source 1..15: mol_type = genomic DNA
cggaggaccagatgg

SEQ ID NO: 64901 - DNA, 154 bp, Homo sapiens
  misc_feature 1..154: note = chr16:1230142-1230296
  misc_feature 1..154: note = hypo
  source 1..154: mol_type = genomic DNA
gtgccctggctgggtccctgtccctgcacaccgggtcagccggctcctgggtgcacaggcaggtggtgtgcgtccgcattgcagaacacggggcgttgcaggccggagctgggttttcacacagattgagaccaggcgtcgcccacagagcata

SEQ ID NO: 64902 - DNA, 205 bp, Homo sapiens; identical to SEQ ID NO: 44472
  misc_feature 1..205: note = chr16:1236691-1236896
  misc_feature 1..205: note = hypo
  source 1..205: mol_type = genomic DNA

SEQ ID NO: 64903 - DNA, 30 bp, Homo sapiens; identical to SEQ ID NO: 44473
  misc_feature 1..30: note = chr16:1245806-1245836
  misc_feature 1..30: note = hypo
  source 1..30: mol_type = genomic DNA

SEQ ID NO: 64904 - DNA, 138 bp, Homo sapiens
  misc_feature 1..138: note = chr16:1248466-1248604
  misc_feature 1..138: note = hypo
  source 1..138: mol_type = genomic DNA
caccagggggtggcccgagtcagtgtgcagtgggcgtggacacccactgtgaacagtggacggggctcgggggtcccgggaggggctgcagccccgaggacactcctgcagggcttagcagtgccaatcctggccctg

SEQ ID NO: 64905 - DNA, 215 bp, Homo sapiens
  misc_feature 1..215: note = chr16:1248675-1248890
  misc_feature 1..215: note = hypo
  source 1..215: mol_type = genomic DNA
gctgtgcttcttcgtcttcttcattttcggcatcgttggcgtccagctctgggctggcctcctgcggaaccgctgcttcctggacagtgcctttgtcaggtgcccaggccccacccccgtgaggcccctgcccagatggccctgcccaccatgcagataacgcaccatgtggctccaccgccccacgtggctctgcccaccgtgcagtcacccgc

SEQ ID NO: 64906 - DNA, 79 bp, Homo sapiens; identical to SEQ ID NO: 44475
  misc_feature 1..79: note = chr16:1250278-1250357
  misc_feature 1..79: note = hypo
  source 1..79: mol_type = genomic DNA

SEQ ID NO: 64907 - DNA, 100 bp, Homo sapiens; identical to SEQ ID NO: 44476
  misc_feature 1..100: note = chr16:1251693-1251793
  misc_feature 1..100: note = hypo
  source 1..100: mol_type = genomic DNA

SEQ ID NO: 64908 - DNA, 51 bp, Homo sapiens; identical to SEQ ID NO: 44477
  misc_feature 1..51: note = chr16:1253065-1253116
  misc_feature 1..51: note = hypo
  source 1..51: mol_type = genomic DNA

SEQ ID NO: 64909 - DNA, 32 bp, Homo sapiens; identical to SEQ ID NO: 44478
  misc_feature 1..32: note = chr16:1259204-1259236
  misc_feature 1..32: note = hypo
  source 1..32: mol_type = genomic DNA

SEQ ID NO: 64910 - DNA, 38 bp, Homo sapiens; identical to SEQ ID NO: 44479
  misc_feature 1..38: note = chr16:1261601-1261639
  misc_feature 1..38: note = hypo
  source 1..38: mol_type = genomic DNA

SEQ ID NO: 64911 - DNA, 133 bp, Homo sapiens; identical to SEQ ID NO: 44480
  misc_feature 1..133: note = chr16:1262013-1262146
  misc_feature 1..133: note = hypo
  source 1..133: mol_type = genomic DNA

SEQ ID NO: 64912 - DNA, 47 bp, Homo sapiens; identical to SEQ ID NO: 44481
  misc_feature 1..47: note = chr16:1262447-1262494
  misc_feature 1..47: note = hypo
  source 1..47: mol_type = genomic DNA

SEQ ID NO: 64913 - DNA, 52 bp, Homo sapiens; identical to SEQ ID NO: 44482
  misc_feature 1..52: note = chr16:1265614-1265666
  misc_feature 1..52: note = hypo
  source 1..52: mol_type = genomic DNA

SEQ ID NO: 64914 - DNA, 30 bp, Homo sapiens; identical to SEQ ID NO: 44483
  misc_feature 1..30: note = chr16:1267184-1267214
  misc_feature 1..30: note = hypo
  source 1..30: mol_type = genomic DNA

SEQ ID NO: 64915 - DNA, 418 bp, Homo sapiens
  misc_feature 1..418: note = chr16:1268120-1268538
  misc_feature 1..418: note = hypo
  source 1..418: mol_type = genomic DNA
cttgcagggcagggggaaggggacggcactgccagggtggcacccgcgggtgggtgtggaccccggcccacagctgtcccccaccgcaggacacgctgcgcgagtgctcccgtgaggacaagcactgcctgagctacctgccggccctgtcgcccgtctacttcgtgaccttcgtgctggtggcccagttcgtgctggtgaacgtggtggtggccgtgctcatgaagcacctggaggagagcaacaaggaggcacgggaggatgcggagctggacgccgagatcgagctggagatggcgcagggccccgggagtgcacgccgggtggacgcggacaggcctcccttgccccaggagagtccgggcgccagggacgccccaaacctggttgcacgcaaggtgtccgtgtccaggatgct

SEQ ID NO: 64916 - DNA, 150 bp, Homo sapiens; identical to SEQ ID NO: 44485
  misc_feature 1..150: note = chr16:1270207-1270357
  misc_feature 1..150: note = hypo
  source 1..150: mol_type = genomic DNA

SEQ ID NO: 64917 - DNA, 30 bp, Homo sapiens; identical to SEQ ID NO: 44486
  misc_feature 1..30: note = chr16:1271505-1271535
  misc_feature 1..30: note = hypo
  source 1..30: mol_type = genomic DNA

SEQ ID NO: 64918 - DNA, 38 bp, Homo sapiens; identical to SEQ ID NO: 44487
  misc_feature 1..38: note = chr16:1272194-1272232
  misc_feature 1..38: note = hypo
  source 1..38: mol_type = genomic DNA

SEQ ID NO: 64919 - DNA, 30 bp, Homo sapiens; identical to SEQ ID NO: 44488
  misc_feature 1..30: note = chr16:1288468-1288498
  misc_feature 1..30: note = hypo
  source 1..30: mol_type = genomic DNA

SEQ ID NO: 64920 - DNA, 39 bp, Homo sapiens; identical to SEQ ID NO: 44489
  misc_feature 1..39: note = chr16:1307000-1307039
  misc_feature 1..39: note = hypo
  source 1..39: mol_type = genomic DNA

SEQ ID NO: 64921 - DNA, 83 bp, Homo sapiens
  misc_feature 1..83: note = chr16:1312443-1312526
  misc_feature 1..83: note = hypo
  source 1..83: mol_type = genomic DNA
cccgaacatcctgatcgctccccagccagtcacccagcactggtccttcggggtgagctccagcgagaccggggagagcttga

SEQ ID NO: 64922 - DNA, 99 bp, Homo sapiens
  misc_feature 1..99: note = chr16:1312611-1312710
  misc_feature 1..99: note = hypo
  source 1..99: mol_type = genomic DNA
ggggtggacgatgatccggctgacgttcagcagcccccggcccccgtagagatacacgtccccagcgtggatccggtagatggacgggtcggtgtcctt

SEQ ID NO: 64923 - DNA, 133 bp, Homo sapiens; identical to SEQ ID NO: 44491
  misc_feature 1..133: note = chr16:1315371-1315504
  misc_feature 1..133: note = hypo
  source 1..133: mol_type = genomic DNA

SEQ ID NO: 64924 - DNA, 44 bp, Homo sapiens; identical to SEQ ID NO: 44492
  misc_feature 1..44: note = chr16:1323678-1323722
  misc_feature 1..44: note = hypo
  source 1..44: mol_type = genomic DNA

SEQ ID NO: 64925 - DNA, 42 bp, Homo sapiens
  misc_feature 1..42: note = chr16:1324061-1324103
  misc_feature 1..42: note = hypo
  source 1..42: mol_type = genomic DNA
cggcagcatatctgcagagacaagccacgggtggcgggagca

SEQ ID NO: 64926 - DNA, 30 bp, Homo sapiens; identical to SEQ ID NO: 44494
  misc_feature 1..30: note = chr16:1329677-1329707
  misc_feature 1..30: note = hypo
  source 1..30: mol_type = genomic DNA

SEQ ID NO: 64927 - DNA, 191 bp, Homo sapiens; identical to SEQ ID NO: 44495
  misc_feature 1..191: note = chr16:1391751-1391942
  misc_feature 1..191: note = hypo
  source 1..191: mol_type = genomic DNA

SEQ ID NO: 64928 - DNA, 30 bp, Homo sapiens; identical to SEQ ID NO: 44496
  misc_feature 1..30: note = chr16:1397121-1397151
  misc_feature 1..30: note = hypo
  source 1..30: mol_type = genomic DNA

SEQ ID NO: 64929 - DNA, 311 bp, Homo sapiens; identical to SEQ ID NO: 44497
  misc_feature 1..311: note = chr16:1397548-1397859
  misc_feature 1..311: note = hypo
  source 1..311: mol_type = genomic DNA

SEQ ID NO: 64930 - DNA, 72 bp, Homo sapiens
  misc_feature 1..72: note = chr16:1407846-1407918
  misc_feature 1..72: note = hypo
  source 1..72: mol_type = genomic DNA
gagtttgaaacatcagtctggggcgtcctcctctaaccagtgcacttgctgctgcagcgcaggcccttcagg

SEQ ID NO: 64931 - DNA, 282 bp, Homo sapiens; identical to SEQ ID NO: 44500
  misc_feature 1..282: note = chr16:1417076-1417358
  misc_feature 1..282: note = hypo
  source 1..282: mol_type = genomic DNA

SEQ ID NO: 64932 - DNA, 411 bp, Homo sapiens; identical to SEQ ID NO: 44501
  misc_feature 1..411: note = chr16:1417675-1418086
  misc_feature 1..411: note = hypo
  source 1..411: mol_type = genomic DNA

SEQ ID NO: 64933 - DNA, 200 bp, Homo sapiens; identical to SEQ ID NO: 44502
  misc_feature 1..200: note = chr16:1425484-1425684
  misc_feature 1..200: note = hypo
  source 1..200: mol_type = genomic DNA

SEQ ID NO: 64934 - DNA, 395 bp, Homo sapiens
  misc_feature 1..395: note = chr16:1428113-1428508
  misc_feature 1..395: note = hypo
  source 1..395: mol_type = genomic DNA
ccccagaaagctgctcggcctccaagccctgcatggaatgccccccactacatccttgcaggtgtcagcctgaaccatgtcagggccctggacagactcactgaggacaggcaccgaccccccaacccgcaggcctgcccacagccccctcatgctcccatacgggggcttgatgacgggcagggccaagcggtttgcccatagtcaggtcagccaggctcgggaacctggacctgccctctgcacccaagtcccaggatcaggatatggcagccccttcagagctcaccgcccctcacacctggcagagatccagaaactcctcatgaaaatcaaagacgcaaagaagttgggggacaggaacggaggcgccttttctccccttggagtggggt

SEQ ID NO: 64935 - DNA, 34 bp, Homo sapiens
  misc_feature 1..34: note = chr16:1428873-1428907
  misc_feature 1..34: note = hypo
  source 1..34: mol_type = genomic DNA
cctggcccactttctcacccgcagcttctccccc

SEQ ID NO: 64936 - DNA, 48 bp, Homo sapiens; identical to SEQ ID NO: 44504
  misc_feature 1..48: note = chr16:1430200-1430248
  misc_feature 1..48: note = hypo
  source 1..48: mol_type = genomic DNA

SEQ ID NO: 64937 - DNA, 30 bp, Homo sapiens; identical to SEQ ID NO: 15991
  misc_feature 1..30: note = chr16:1486627-1486657
  misc_feature 1..30: note = hypo
  source 1..30: mol_type = genomic DNA

SEQ ID NO: 64938 - DNA, 30 bp, Homo sapiens; identical to SEQ ID NO: 44506
  misc_feature 1..30: note = chr16:1488680-1488710
  misc_feature 1..30: note = hypo
  source 1..30: mol_type = genomic DNA

SEQ ID NO: 64939 - DNA, 82 bp, Homo sapiens; identical to SEQ ID NO: 44507
  misc_feature 1..82: note = chr16:1491115-1491197
  misc_feature 1..82: note = hypo
  source 1..82: mol_type = genomic DNA

SEQ ID NO: 64940 - DNA, 30 bp, Homo sapiens; identical to SEQ ID NO: 44508
  misc_feature 1..30: note = chr16:1491482-1491512
  misc_feature 1..30: note = hypo
  source 1..30: mol_type = genomic DNA

SEQ ID NO: 64941 - DNA, 101 bp, Homo sapiens; identical to SEQ ID NO: 44509
  misc_feature 1..101: note = chr16:1493574-1493675
  misc_feature 1..101: note = hypo
  source 1..101: mol_type = genomic DNA

SEQ ID NO: 64942 - DNA, 120 bp, Homo sapiens; identical to SEQ ID NO: 44510
  misc_feature 1..120: note = chr16:1729690-1729810
  misc_feature 1..120: note = hypo
  source 1..120: mol_type = genomic DNA

SEQ ID NO: 64943 - DNA, 164 bp, Homo sapiens
  misc_feature 1..164: note = chr16:1730597-1730761
  misc_feature 1..164: note = hypo
  source 1..164: mol_type = genomic DNA
acatttagttttgctgtgaagcgagtcaggtggtggctgtaagattacctagccaggttttcctctcctgagacctcacatctctcctttccttgctgagggattgtcttgtgttaaaggggtttcgtaaaagcgttatgctttagccgcgattaacctgaggt

SEQ ID NO: 64944 - DNA, 30 bp, Homo sapiens; identical to SEQ ID NO: 44512
  misc_feature 1..30: note = chr16:1734955-1734985
  misc_feature 1..30: note = hypo
  source 1..30: mol_type = genomic DNA

SEQ ID NO: 64945 - DNA, 127 bp, Homo sapiens
  misc_feature 1..127: note = chr16:1741726-1741853
  misc_feature 1..127: note = hypo
  source 1..127: mol_type = genomic DNA
ctcagggctggcactcggggttcctatgagaggaggtctccaaagcactgcgggggtggggtggggtggggtccggtggacgtctggttgctcagtgttctgtgatcgtttctgcagggggtaaagg

SEQ ID NO: 64946 - DNA, 262 bp, Homo sapiens; identical to SEQ ID NO: 44514
  misc_feature 1..262: note = chr16:1813482-1813744
  misc_feature 1..262: note = hypo
  source 1..262: mol_type = genomic DNA

SEQ ID NO: 64947 - DNA, 55 bp, Homo sapiens; identical to SEQ ID NO: 44515
  misc_feature 1..55: note = chr16:1813946-1814001
  misc_feature 1..55: note = hypo
  source 1..55: mol_type = genomic DNA

SEQ ID NO: 64948 - DNA, 48 bp, Homo sapiens; identical to SEQ ID NO: 44516
  misc_feature 1..48: note = chr16:1814297-1814345
  misc_feature 1..48: note = hypo
  source 1..48: mol_type = genomic DNA

SEQ ID NO: 64949 - DNA, 30 bp, Homo sapiens; identical to SEQ ID NO: 44517
  misc_feature 1..30: note = chr16:1831357-1831387
  misc_feature 1..30: note = hypo
  source 1..30: mol_type = genomic DNA

SEQ ID NO: 64950 - DNA, 39 bp, Homo sapiens; identical to SEQ ID NO: 44518
  misc_feature 1..39: note = chr16:1833960-1833999
  misc_feature 1..39: note = hypo
  source 1..39: mol_type = genomic DNA

SEQ ID NO: 64951 - DNA, 30 bp, Homo sapiens; identical to SEQ ID NO: 44519
  misc_feature 1..30: note = chr16:1946973-1947003
  misc_feature 1..30: note = hypo
  source 1..30: mol_type = genomic DNA

SEQ ID NO: 64952 - DNA, 30 bp, Homo sapiens; identical to SEQ ID NO: 44520
  misc_feature 1..30: note = chr16:1962525-1962555
  misc_feature 1..30: note = hypo
  source 1..30: mol_type = genomic DNA

SEQ ID NO: 64953 - DNA, 96 bp, Homo sapiens; identical to SEQ ID NO: 44521
  misc_feature 1..96: note = chr16:2028658-2028754
  misc_feature 1..96: note = hypo
  source 1..96: mol_type = genomic DNA

SEQ ID NO: 64954 - DNA, 100 bp, Homo sapiens
  misc_feature 1..100: note = chr16:2028972-2029072
  misc_feature 1..100: note = hypo
  source 1..100: mol_type = genomic DNA
ctggccagggagatccgccctccccgctcctccccagccctgggatggcgcggtccatcccctcatcgggatcctcgcgctcactgctccgtcgtggggt

SEQ ID NO: 64955 - DNA, 60 bp, Homo sapiens
  misc_feature 1..60: note = chr16:2029137-2029197
  misc_feature 1..60: note = hypo
  source 1..60: mol_type = genomic DNA
cgtgtgacggtgcagcagcggctctggatggcgcccggcgaaggtcgggtgggcacggtg

SEQ ID NO: 64956 - DNA, 200 bp, Homo sapiens; identical to SEQ ID NO: 44523
  misc_feature 1..200: note = chr16:2105061-2105261
  misc_feature 1..200: note = hypo
  source 1..200: mol_type = genomic DNA

SEQ ID NO: 64957 - DNA, 102 bp, Homo sapiens; identical to SEQ ID NO: 44525
  misc_feature 1..102: note = chr16:2145625-2145727
  misc_feature 1..102: note = hypo
  source 1..102: mol_type = genomic DNA

SEQ ID NO: 64958 - DNA, 30 bp, Homo sapiens; identical to SEQ ID NO: 44526
  misc_feature 1..30: note = chr16:2146363-2146393
  misc_feature 1..30: note = hypo
  source 1..30: mol_type = genomic DNA

SEQ ID NO: 64959 - DNA, 23 bp, Homo sapiens
  misc_feature 1..23: note = chr16:2151275-2151298
  misc_feature 1..23: note = hypo
  source 1..23: mol_type = genomic DNA
cgcccggccgacagtttttaaaa

SEQ ID NO: 64960 - DNA, 112 bp, Homo sapiens; identical to SEQ ID NO: 44528
  misc_feature 1..112: note = chr16:2193270-2193382
  misc_feature 1..112: note = hypo
  source 1..112: mol_type = genomic DNA

SEQ ID NO: 64961 - DNA, 142 bp, Homo sapiens; identical to SEQ ID NO: 44529
  misc_feature 1..142: note = chr16:2212716-2212858
  misc_feature 1..142: note = hypo
  source 1..142: mol_type = genomic DNA

SEQ ID NO: 64962 - DNA, 52 bp, Homo sapiens; identical to SEQ ID NO: 44530
  misc_feature 1..52: note = chr16:2213671-2213723
  misc_feature 1..52: note = hypo
  source 1..52: mol_type = genomic DNA

SEQ ID NO: 64963 - DNA, 30 bp, Homo sapiens; identical to SEQ ID NO: 44531
  misc_feature 1..30: note = chr16:2229690-2229720
  misc_feature 1..30: note = hypo
  source 1..30: mol_type = genomic DNA

SEQ ID NO: 64964 - DNA, 231 bp, Homo sapiens; identical to SEQ ID NO: 44532
  misc_feature 1..231: note = chr16:2229967-2230198
  misc_feature 1..231: note = hypo
  source 1..231: mol_type = genomic DNA

SEQ ID NO: 64965 - DNA, 605 bp, Homo sapiens; identical to SEQ ID NO: 44533
  misc_feature 1..605: note = chr16:2230512-2231117
  misc_feature 1..605: note = hypo
  source 1..605: mol_type = genomic DNA

SEQ ID NO: 64966 - DNA, 141 bp, Homo sapiens; identical to SEQ ID NO: 44535
  misc_feature 1..141: note = chr16:2233066-2233207
  misc_feature 1..141: note = hypo
  source 1..141: mol_type = genomic DNA

SEQ ID NO: 64967 - DNA, 412 bp, Homo sapiens
  misc_feature 1..412: note = chr16:2234314-2234726
  misc_feature 1..412: note = hypo
  source 1..412: mol_type = genomic DNA
ggcctcgggctggaccggaaggtgggctctgtgcccacaggcaggggcaccttgcctcctccaccgtgcaggactcagccagcagcttacagctctccggcacacgagtgcactcacacaccatacgccgtgcccatgcacacgctgcaccatctcatacccatccccttccacctgtacacagacacgcgtgcccagctcgcagtcccaccatcacacacacacacgcacacacagaggcacaggttggcccacacgcacagcctgcacaatgacgacacccgtacacacaggcagacacacacacaacacacagactgacagacagaggagagggtctggcctggcaatgcccccgaccccgccgctgccaggccaggcaggccgtgtaagcacccatcagcccatcggc

SEQ ID NO: 64968 - DNA, 19 bp, Homo sapiens
  misc_feature 1..19: note = chr16:2235020-2235039
  misc_feature 1..19: note = hypo
  source 1..19: mol_type = genomic DNA
gcaccgttgccaggagctg

SEQ ID NO: 64969 - DNA, 51 bp, Homo sapiens; identical to SEQ ID NO: 44537
  misc_feature 1..51: note = chr16:2237472-2237523
  misc_feature 1..51: note = hypo
  source 1..51: mol_type = genomic DNA

SEQ ID NO: 64970 - DNA, 387 bp, Homo sapiens; identical to SEQ ID NO: 44538
  misc_feature 1..387: note = chr16:2278383-2278770
  misc_feature 1..387: note = hypo
  source 1..387: mol_type = genomic DNA

SEQ ID NO: 64971 - DNA, 33 bp, Homo sapiens; identical to SEQ ID NO: 44540
  misc_feature 1..33: note = chr16:2294623-2294656
  misc_feature 1..33: note = hypo
  source 1..33: mol_type = genomic DNA

SEQ ID NO: 64972 - DNA, 30 bp, Homo sapiens; identical to SEQ ID NO: 44541
  misc_feature 1..30: note = chr16:2324195-2324225
  misc_feature 1..30: note = hypo
  source 1..30: mol_type = genomic DNA

SEQ ID NO: 64973 - DNA, 30 bp, Homo sapiens; identical to SEQ ID NO: 44542
  misc_feature 1..30: note = chr16:2436229-2436259
  misc_feature 1..30: note = hypo
  source 1..30: mol_type = genomic DNA

SEQ ID NO: 64974 - DNA, 34 bp, Homo sapiens; identical to SEQ ID NO: 16004
  misc_feature 1..34: note = chr16:2466336-2466370
  misc_feature 1..34: note = hypo
  source 1..34: mol_type = genomic DNA

SEQ ID NO: 64975 - DNA, 56 bp, Homo sapiens; identical to SEQ ID NO: 44544
  misc_feature 1..56: note = chr16:2474253-2474309
  misc_feature 1..56: note = hypo
  source 1..56: mol_type = genomic DNA

SEQ ID NO: 64976 - DNA, 174 bp, Homo sapiens; identical to SEQ ID NO: 44545
  misc_feature 1..174: note = chr16:2497879-2498053
  misc_feature 1..174: note = hypo
  source 1..174: mol_type = genomic DNA

SEQ ID NO: 64977 - DNA, 16 bp, Homo sapiens
  misc_feature 1..16: note = chr16:2508540-2508556
  misc_feature 1..16: note = hypo
  source 1..16: mol_type = genomic DNA
gcgcctggcccccaaa

SEQ ID NO: 64978 - DNA, 59 bp, Homo sapiens; identical to SEQ ID NO: 44547
  misc_feature 1..59: note = chr16:2531804-2531863
  misc_feature 1..59: note = hypo
  source 1..59: mol_type = genomic DNA

SEQ ID NO: 64979 - DNA, 37 bp, Homo sapiens; identical to SEQ ID NO: 16006
  misc_feature 1..37: note = chr16:2540828-2540865
  misc_feature 1..37: note = hypo
  source 1..37: mol_type = genomic DNA

SEQ ID NO: 64980 - DNA, 48 bp, Homo sapiens; identical to SEQ ID NO: 44549
  misc_feature 1..48: note = chr16:2546458-2546506
  misc_feature 1..48: note = hypo
  source 1..48: mol_type = genomic DNA

SEQ ID NO: 64981 - DNA, 76 bp, Homo sapiens; identical to SEQ ID NO: 44550
  misc_feature 1..76: note = chr16:2589044-2589120
  misc_feature 1..76: note = hypo
  source 1..76: mol_type = genomic DNA

SEQ ID NO: 64982 - DNA, 120 bp, Homo sapiens; identical to SEQ ID NO: 44551
  misc_feature 1..120: note = chr16:2731629-2731749
  misc_feature 1..120: note = hypo
  source 1..120: mol_type = genomic DNA

SEQ ID NO: 64983 - DNA, 82 bp, Homo sapiens; identical to SEQ ID NO: 44552
  misc_feature 1..82: note = chr16:2762758-2762840
  misc_feature 1..82: note = hypo
  source 1..82: mol_type = genomic DNA

SEQ ID NO: 64984 - DNA, 266 bp, Homo sapiens
  misc_feature 1..266: note = chr16:2764111-2764377
  misc_feature 1..266: note = hypo
  source 1..266: mol_type = genomic DNA
cgtctcaaagatcaccgaggggtcaggcaggcacacggggaggatgtaattggtgaagggcactggtgcctccagctccaccagggccacgtcagcgctggaggccgtgccctggtacagggggttgctctccacctgcctcacccgggcatacatagcgtgtggtcccggctgcactagctgccttgcccccagcaggacctggtacagggacgtctcagaggtgctggcgggagaaacagagaggcggcgtgaggcggcccctc

SEQ ID NO: 64985 - DNA, 239 bp, Homo sapiens
  misc_feature 1..239: note = chr16:2764470-2764709
  misc_feature 1..239: note = hypo
  source 1..239: mol_type = genomic DNA
ggacagccaggtgcagcggtgatgcgtgttgacattgaagccagaccgcccgactcagatttccacctccacccctggccgctgtgtggccttgggcaagtcacttaacaagttctctgtgatgcagctttctcacctgtgctgtggggacagtcacagtgcctacctgaaaggctggctcggagagaaccaccctccaggtgcagcagggccagccccacctgcgggcctctggcagg

SEQ ID NO: 64986 - DNA, 133 bp, Homo sapiens; identical to SEQ ID NO: 44555
  misc_feature 1..133: note = chr16:2806261-2806394
  misc_feature 1..133: note = hypo
  source 1..133: mol_type = genomic DNA

SEQ ID NO: 64987 - DNA, 30 bp, Homo sapiens; identical to SEQ ID NO: 44556
  misc_feature 1..30: note = chr16:2849391-2849421
  misc_feature 1..30: note = hypo
  source 1..30: mol_type = genomic DNA

SEQ ID NO: 64988 - DNA, 30 bp, Homo sapiens; identical to SEQ ID NO: 16011
  misc_feature 1..30: note = chr16:2877506-2877536
  misc_feature 1..30: note = hypo
  source 1..30: mol_type = genomic DNA

SEQ ID NO: 64989 - DNA, 138 bp, Homo sapiens; identical to SEQ ID NO: 44558
  misc_feature 1..138: note = chr16:2975835-2975973
  misc_feature 1..138: note = hypo
  source 1..138: mol_type = genomic DNA

SEQ ID NO: 64990 - DNA, 34 bp, Homo sapiens; identical to SEQ ID NO: 44559
  misc_feature 1..34: note = chr16:3021547-3021581
  misc_feature 1..34: note = hypo
  source 1..34: mol_type = genomic DNA

SEQ ID NO: 64991 - DNA, 30 bp, Homo sapiens; identical to SEQ ID NO: 44560
  misc_feature 1..30: note = chr16:3139240-3139270
  misc_feature 1..30: note = hypo
  source 1..30: mol_type = genomic DNA

SEQ ID NO: 64992 - DNA, 30 bp, Homo sapiens; identical to SEQ ID NO: 44561
  misc_feature 1..30: note = chr16:3142599-3142629
  misc_feature 1..30: note = hypo
  source 1..30: mol_type = genomic DNA

SEQ ID NO: 64993 - DNA, 30 bp, Homo sapiens; identical to SEQ ID NO: 44562
  misc_feature 1..30: note = chr16:3151067-3151097
  misc_feature 1..30: note = hypo
  source 1..30: mol_type = genomic DNA

SEQ ID NO: 64994 - DNA, 35 bp, Homo sapiens
  misc_feature 1..35: note = chr16:3211673-3211708
  misc_feature 1..35: note = hypo
  source 1..35: mol_type = genomic DNA
acctccctcagctcccgtggtgcgcccgggggaaa

SEQ ID NO: 64995 - DNA, 30 bp, Homo sapiens; identical to SEQ ID NO: 44565
  misc_feature 1..30: note = chr16:3286293-3286323
  misc_feature 1..30: note = hypo
  source 1..30: mol_type = genomic DNA

SEQ ID NO: 64996 - DNA, 80 bp, Homo sapiens
  misc_feature 1..80: note = chr16:3492675-3492755
  misc_feature 1..80: note = hypo
  source 1..80: mol_type = genomic DNA
aaaaaaaaaaaaaaagaacttttaaaagtagccagacactgtggtatgcgcgcctctcagatactcgagaggctgaggcg

SEQ ID NO: 64997 - DNA, 78 bp, Homo sapiens
  misc_feature 1..78: note = chr16:3696724-3696802
  misc_feature 1..78: note = hypo
  source 1..78: mol_type = genomic DNA
gctgtggggacggctgggacatgtacctggaagcagggcagccaaagggagaggcagtgatgacgggtggtatggagg

SEQ ID NO: 64998 - DNA, 30 bp, Homo sapiens; identical to SEQ ID NO: 44569
  misc_feature 1..30: note = chr16:3925449-3925479
  misc_feature 1..30: note = hypo
  source 1..30: mol_type = genomic DNA

SEQ ID NO: 64999 - DNA, 37 bp, Homo sapiens; identical to SEQ ID NO: 16016
  misc_feature 1..37: note = chr16:3957870-3957907
  misc_feature 1..37: note = hypo
  source 1..37: mol_type = genomic DNA

SEQ ID NO: 65000 - DNA, 76 bp, Homo sapiens; identical to SEQ ID NO: 44571
  misc_feature 1..76: note = chr16:4203919-4203995
  misc_feature 1..76: note = hypo
  source 1..76: mol_type = genomic DNA

SEQ ID NO: 65001 - DNA, 30 bp, Homo sapiens; identical to SEQ ID NO: 44573
  misc_feature 1..30: note = chr16:4308074-4308104
  misc_feature 1..30: note = hypo
  source 1..30: mol_type = genomic DNA

SEQ ID NO: 65002 - DNA, 34 bp, Homo sapiens; identical to SEQ ID NO: 44574
  misc_feature 1..34: note = chr16:4385394-4385428
  misc_feature 1..34: note = hypo
  source 1..34: mol_type = genomic DNA

SEQ ID NO: 65003 - DNA, 66 bp, Homo sapiens; identical to SEQ ID NO: 44575
  misc_feature 1..66: note = chr16:4410920-4410986
  misc_feature 1..66: note = hypo
  source 1..66: mol_type = genomic DNA

SEQ ID NO: 65004 - DNA, 30 bp, Homo sapiens; identical to SEQ ID NO: 44576
  misc_feature 1..30: note = chr16:4474675-4474705
  misc_feature 1..30: note = hypo
  source 1..30: mol_type = genomic DNA

SEQ ID NO: 65005 - DNA, 30 bp, Homo sapiens; identical to SEQ ID NO: 44577
  misc_feature 1..30: note = chr16:4655417-4655447
  misc_feature 1..30: note = hypo
  source 1..30: mol_type = genomic DNA

SEQ ID NO: 65006 - DNA, 30 bp, Homo sapiens; identical to SEQ ID NO: 16018
  misc_feature 1..30: note = chr16:4840446-4840476
  misc_feature 1..30: note = hypo
  source 1..30: mol_type = genomic DNA

SEQ ID NO: 65007 - DNA, 84 bp, Homo sapiens; identical to SEQ ID NO: 44579
  misc_feature 1..84: note = chr16:4841600-4841684
  misc_feature 1..84: note = hypo
  source 1..84: mol_type = genomic DNA

SEQ ID NO: 65008 - DNA, 44 bp, Homo sapiens; identical to SEQ ID NO: 44581
  misc_feature 1..44: note = chr16:4846780-4846824
  misc_feature 1..44: note = hypo
  source 1..44: mol_type = genomic DNA

SEQ ID NO: 65009 - DNA, 30 bp, Homo sapiens; identical to SEQ ID NO: 44582
  misc_feature 1..30: note = chr16:5090604-5090634
  misc_feature 1..30: note = hypo
  source 1..30: mol_type = genomic DNA

SEQ ID NO: 65010 - DNA, 30 bp, Homo sapiens; identical to SEQ ID NO: 44583
  misc_feature 1..30: note = chr16:5115567-5115597
  misc_feature 1..30: note = hypo
  source 1..30: mol_type = genomic DNA

SEQ ID NO: 65011 - DNA, 30 bp, Homo sapiens; identical to SEQ ID NO: 44584
  misc_feature 1..30: note = chr16:5130557-5130587
  misc_feature 1..30: note = hypo
  source 1..30: mol_type = genomic DNA

SEQ ID NO: 65012 - DNA, 41 bp, Homo sapiens; identical to SEQ ID NO: 44585
  misc_feature 1..41: note = chr16:5412627-5412668
  misc_feature 1..41: note = hypo
  source 1..41: mol_type = genomic DNA

SEQ ID NO: 65013 - DNA, 30 bp, Homo sapiens; identical to SEQ ID NO: 16020
  misc_feature 1..30: note = chr16:5439313-5439343
  misc_feature 1..30: note = hypo
  source 1..30: mol_type = genomic DNA

SEQ ID NO: 65014 - DNA, 141 bp, Homo sapiens; identical to SEQ ID NO: 44587
  misc_feature 1..141: note = chr16:5541176-5541317
  misc_feature 1..141: note = hypo
  source 1..141: mol_type = genomic DNA

SEQ ID NO: 65015 - DNA, 152 bp, Homo sapiens; identical to SEQ ID NO: 44588
  misc_feature 1..152: note = chr16:5559744-5559896
  misc_feature 1..152: note = hypo
  source 1..152: mol_type = genomic DNA

SEQ ID NO: 65016 - DNA, 30 bp, Homo sapiens; identical to SEQ ID NO: 44589
  misc_feature 1..30: note = chr16:6186354-6186384
  misc_feature 1..30: note = hypo
  source 1..30: mol_type = genomic DNA

SEQ ID NO: 65017 - DNA, 30 bp, Homo sapiens; identical to SEQ ID NO: 44590
  misc_feature 1..30: note = chr16:6314961-6314991
  misc_feature 1..30: note = hypo
  source 1..30: mol_type = genomic DNA

SEQ ID NO: 65018 - DNA, 161 bp, Homo sapiens; identical to SEQ ID NO: 44591
  misc_feature 1..161: note = chr16:7489023-7489184
  misc_feature 1..161: note = hypo
  source 1..161: mol_type = genomic DNA

SEQ ID NO: 65019 - DNA, 34 bp, Homo sapiens; identical to SEQ ID NO: 44592
  misc_feature 1..34: note = chr16:8222706-8222740
  misc_feature 1..34: note = hypo
  source 1..34: mol_type = genomic DNA

SEQ ID NO: 65020 - DNA, 28 bp, Homo sapiens
  misc_feature 1..28: note = chr16:8781004-8781032
  misc_feature 1..28: note = hypo
  source 1..28: mol_type = genomic DNA
ggacgcacatctggacggaaagtgtttg

SEQ ID NO: 65021 - DNA, 29 bp, Homo sapiens
  misc_feature 1..29: note = chr16:8963909-8963938
  misc_feature 1..29: note = hypo
  source 1..29: mol_type = genomic DNA
gggtgcggtggctcacgcctgtaattcca

SEQ ID NO: 65022 - DNA, 76 bp, Homo sapiens; identical to SEQ ID NO: 16023
  misc_feature 1..76: note = chr16:9005728-9005804
  misc_feature 1..76: note = hypo
  source 1..76: mol_type = genomic DNA

SEQ ID NO: 65023 - DNA, 30 bp, Homo sapiens; identical to SEQ ID NO: 16024
  misc_feature 1..30: note = chr16:9010029-9010059
  misc_feature 1..30: note = hypo
  source 1..30: mol_type = genomic DNA

SEQ ID NO: 65024 - DNA, 208 bp, Homo sapiens; identical to SEQ ID NO: 44598
  misc_feature 1..208: note = chr16:9888740-9888948
  misc_feature 1..208: note = hypo
  source 1..208: mol_type = genomic DNA

SEQ ID NO: 65025 - DNA, 47 bp, Homo sapiens; identical to SEQ ID NO: 44599
  misc_feature 1..47: note = chr16:10721519-10721566
  misc_feature 1..47: note = hypo
  source 1..47: mol_type = genomic DNA

SEQ ID NO: 65026 - DNA, 30 bp, Homo sapiens; identical to SEQ ID NO: 16025
  misc_feature 1..30: note = chr16:10804588-10804618
  misc_feature 1..30: note = hypo
  source 1..30: mol_type = genomic DNA

SEQ ID NO: 65027 - DNA, 30 bp, Homo sapiens; identical to SEQ ID NO: 44601
  misc_feature 1..30: note = chr16:11712101-11712131
  misc_feature 1..30: note = hypo
  source 1..30: mol_type = genomic DNA

SEQ ID NO: 65028 - DNA, 20 bp, Homo sapiens
  misc_feature 1..20: note = chr16:11808484-11808504
  misc_feature 1..20: note = hypo
  source 1..20: mol_type = genomic DNA
gactccgtctcaaaaaaaaa

SEQ ID NO: 65029 - DNA, 42 bp, Homo sapiens; identical to SEQ ID NO: 44603
  misc_feature 1..42: note = chr16:11853669-11853711
  misc_feature 1..42: note = hypo
  source 1..42: mol_type = genomic DNA

SEQ ID NO: 65030 - DNA, 33 bp, Homo sapiens; identical to SEQ ID NO: 44604
  misc_feature 1..33: note = chr16:12012098-12012131
  misc_feature 1..33: note = hypo
  source 1..33: mol_type = genomic DNA

SEQ ID NO: 65031 - DNA, 27 bp, Homo sapiens
  misc_feature 1..27: note = chr16:13064659-13064686
  misc_feature 1..27: note = hypo
  source 1..27: mol_type = genomic DNA
tgtgagccaccgcgcctggccggggca

SEQ ID NO: 65032 - DNA, 147 bp, Homo sapiens; identical to SEQ ID NO: 44606
  misc_feature 1..147: note = chr16:13676585-13676732
  misc_feature 1..147: note = hypo
  source 1..147: mol_type = genomic DNA

SEQ ID NO: 65033 - DNA, 32 bp, Homo sapiens; identical to SEQ ID NO: 44607
  misc_feature 1..32: note = chr16:14464204-14464236
  misc_feature 1..32: note = hypo
  source 1..32: mol_type = genomic DNA

SEQ ID NO: 65034 - DNA, 21 bp, Homo sapiens
  misc_feature 1..21: note = chr16:14724506-14724527
  misc_feature 1..21: note = hypo
  source 1..21: mol_type = genomic DNA
aatgggatccgggtgcggtgg

SEQ ID NO: 65035 - DNA, 71 bp, Homo sapiens; identical to SEQ ID NO: 25266
  misc_feature 1..71: note = chr16:14725771-14725842
  misc_feature 1..71: note = hypo
  source 1..71: mol_type = genomic DNA

SEQ ID NO: 65036 - DNA, 30 bp, Homo sapiens; identical to SEQ ID NO: 44610
  misc_feature 1..30: note = chr16:14728494-14728524
  misc_feature 1..30: note = hypo
  source 1..30: mol_type = genomic DNA

SEQ ID NO: 65037 - DNA, 48 bp, Homo sapiens; identical to SEQ ID NO: 44611
  misc_feature 1..48: note = chr16:14761842-14761890
  misc_feature 1..48: note = hypo
  source 1..48: mol_type = genomic DNA

SEQ ID NO: 65038 - DNA, 30 bp, Homo sapiens; identical to SEQ ID NO: 44612
  misc_feature 1..30: note = chr16:15052961-15052991
  misc_feature 1..30: note = hypo
  source 1..30: mol_type = genomic DNA

SEQ ID NO: 65039 - DNA, 106 bp, Homo sapiens; identical to SEQ ID NO: 44613
  misc_feature 1..106: note = chr16:15241283-15241389
  misc_feature 1..106: note = hypo
  source 1..106: mol_type = genomic DNA

SEQ ID NO: 65040 - DNA, 30 bp, Homo sapiens; identical to SEQ ID NO: 44614
  misc_feature 1..30: note = chr16:15555102-15555132
  misc_feature 1..30: note = hypo
  source 1..30: mol_type = genomic DNA

SEQ ID NO: 65041 - DNA, 80 bp, Homo sapiens; identical to SEQ ID NO: 44615
  misc_feature 1..80: note = chr16:15595921-15596001
  misc_feature 1..80: note = hypo
  source 1..80: mol_type = genomic DNA

SEQ ID NO: 65042 - DNA, 42 bp, Homo sapiens; identical to SEQ ID NO: 44616
  misc_feature 1..42: note = chr16:15604294-15604336
  misc_feature 1..42: note = hypo
  source 1..42: mol_type = genomic DNA

SEQ ID NO: 65043 - DNA, 47 bp, Homo sapiens; identical to SEQ ID NO: 44617
  misc_feature 1..47: note = chr16:15692124-15692171
  misc_feature 1..47: note = hypo
  source 1..47: mol_type = genomic DNA

SEQ ID NO: 65044 - DNA, 22 bp, Homo sapiens
  misc_feature 1..22: note = chr16:15708051-15708073
  misc_feature 1..22: note = hypo
  source 1..22: mol_type = genomic DNA
agtttcggccaggtgcggtggc

SEQ ID NO: 65045 - DNA, 42 bp, Homo sapiens; identical to SEQ ID NO: 44619
  misc_feature 1..42: note = chr16:15762689-15762731
  misc_feature 1..42: note = hypo
  source 1..42: mol_type = genomic DNA

SEQ ID NO: 65046 - DNA, 52 bp, Homo sapiens
  misc_feature 1..52: note = chr16:15820865-15820917
  misc_feature 1..52: note = hypo
  source 1..52: mol_type = genomic DNA
tctctttctccagcgtctgcttattcttgtctaggttcgccttggcctggcg

SEQ ID NO: 65047 - DNA, 16 bp, Homo sapiens
  misc_feature 1..16: note = chr16:17049595-17049611
  misc_feature 1..16: note = hypo
  source 1..16: mol_type = genomic DNA
ccggccacaacagatt

SEQ ID NO: 65048 - DNA, 30 bp, Homo sapiens; identical to SEQ ID NO: 44622
  misc_feature 1..30: note = chr16:17341523-17341553
  misc_feature 1..30: note = hypo
  source 1..30: mol_type = genomic DNA

SEQ ID NO: 65049 - DNA, 100 bp, Homo sapiens; identical to SEQ ID NO: 44623
  misc_feature 1..100: note = chr16:17866410-17866510
  misc_feature 1..100: note = hypo
  source 1..100: mol_type = genomic DNA

SEQ ID NO: 65050 - DNA, 37 bp, Homo sapiens; identical to SEQ ID NO: 44625
  misc_feature 1..37: note = chr16:18804505-18804542
  misc_feature 1..37: note = hypo
  source 1..37: mol_type = genomic DNA

SEQ ID NO: 65051 - DNA, 30 bp, Homo sapiens; identical to SEQ ID NO: 44626
  misc_feature 1..30: note = chr16:18950653-18950683
  misc_feature 1..30: note = hypo
  source 1..30: mol_type = genomic DNA

SEQ ID NO: 65052 - DNA, 31 bp, Homo sapiens; identical to SEQ ID NO: 44628
  misc_feature 1..31: note = chr16:19534839-19534870
  misc_feature 1..31: note = hypo
  source 1..31: mol_type = genomic DNA

SEQ ID NO: 65053 - DNA, 30 bp, Homo sapiens; identical to SEQ ID NO: 44629
  misc_feature 1..30: note = chr16:19708504-19708534
  misc_feature 1..30: note = hypo
  source 1..30: mol_type = genomic DNA

SEQ ID NO: 65054 - DNA, 30 bp, Homo sapiens; identical to SEQ ID NO: 44630
  misc_feature 1..30: note = chr16:19929817-19929847
  misc_feature 1..30: note = hypo
  source 1..30: mol_type = genomic DNA

SEQ ID NO: 65055 - DNA, 194 bp, Homo sapiens; identical to SEQ ID NO: 44631
  misc_feature 1..194: note = chr16:20327311-20327505
  misc_feature 1..194: note = hypo
  source 1..194: mol_type = genomic DNA

SEQ ID NO: 65056 - DNA, 35 bp, Homo sapiens; identical to SEQ ID NO: 44632
  misc_feature 1..35: note = chr16:21539162-21539197
  misc_feature 1..35: note = hypo
  source 1..35: mol_type = genomic DNA

SEQ ID NO: 65057 - DNA, 18 bp, Homo sapiens
  misc_feature 1..18: note = chr16:21541457-21541475
  misc_feature 1..18: note = hypo
  source 1..18: mol_type = genomic DNA
agcttgatccagacccga

SEQ ID NO: 65058 - DNA, 38 bp, Homo sapiens; identical to SEQ ID NO: 44634
  misc_feature 1..38: note = chr16:21566671-21566709
  misc_feature 1..38: note = hypo
  source 1..38: mol_type = genomic DNA

SEQ ID NO: 65059 - DNA, 33 bp, Homo sapiens; identical to SEQ ID NO: 44635
  misc_feature 1..33: note = chr16:21719131-21719164
  misc_feature 1..33: note = hypo
  source 1..33: mol_type = genomic DNA

SEQ ID NO: 65060 - DNA, 30 bp, Homo sapiens; identical to SEQ ID NO: 44636
  misc_feature 1..30: note = chr16:23093885-23093915
  misc_feature 1..30: note = hypo
  source 1..30: mol_type = genomic DNA

SEQ ID NO: 65061 - DNA, 30 bp, Homo sapiens; identical to SEQ ID NO: 16032
  misc_feature 1..30: note = chr16:23303315-23303345
  misc_feature 1..30: note = hypo
  source 1..30: mol_type = genomic DNA

SEQ ID NO: 65062 - DNA, 30 bp, Homo sapiens; identical to SEQ ID NO: 44638
  misc_feature 1..30: note = chr16:23444796-23444826
  misc_feature 1..30: note = hypo
  source 1..30: mol_type = genomic DNA

SEQ ID NO: 65063 - DNA, 29 bp, Homo sapiens
  misc_feature 1..29: note = chr16:23606614-23606643
  misc_feature 1..29: note = hypo
  source 1..29: mol_type = genomic DNA
tcactgcctcccggcgtttcagcctcacg

SEQ ID NO: 65064 - DNA, 91 bp, Homo sapiens; identical to SEQ ID NO: 44640
  misc_feature 1..91: note = chr16:23716327-23716418
  misc_feature 1..91: note = hypo
  source 1..91: mol_type = genomic DNA

SEQ ID NO: 65065 - DNA, 151 bp, Homo sapiens; identical to SEQ ID NO: 44641
  misc_feature 1..151: note = chr16:23990960-23991111
  misc_feature 1..151: note = hypo
  source 1..151: mol_type = genomic DNA

SEQ ID NO: 65066 - DNA, 33 bp, Homo sapiens; identical to SEQ ID NO: 44642
  misc_feature 1..33: note = chr16:24013932-24013965
  misc_feature 1..33: note = hypo
  source 1..33: mol_type = genomic DNA

SEQ ID NO: 65067 - DNA, 30 bp, Homo sapiens; identical to SEQ ID NO: 44643
  misc_feature 1..30: note = chr16:25077168-25077198
  misc_feature 1..30: note = hypo
  source 1..30: mol_type = genomic DNA

SEQ ID NO: 65068 - DNA, 28 bp, Homo sapiens
  misc_feature 1..28: note = chr16:25692519-25692547
  misc_feature 1..28: note = hypo
  source 1..28: mol_type = genomic DNA
ttaagatatgtaggccgggtgcggtggc

SEQ ID NO: 65069 - DNA, 16 bp, Homo sapiens
  misc_feature 1..16: note = chr16:26388437-26388453
  misc_feature 1..16: note = hypo
  source 1..16: mol_type = genomic DNA
ccgtctcaaaaaaaaa

SEQ ID NO: 65070 - skipped

SEQ ID NO: 65071 - DNA, 30 bp, Homo sapiens; identical to SEQ ID NO: 44647
  misc_feature 1..30: note = chr16:26732577-26732607
  misc_feature 1..30: note = hypo
  source 1..30: mol_type = genomic DNA

SEQ ID NO: 65072 - DNA, 32 bp, Homo sapiens; identical to SEQ ID NO: 44648
  misc_feature 1..32: note = chr16:27038943-27038975
  misc_feature 1..32: note = hypo
  source 1..32: mol_type = genomic DNA

SEQ ID NO: 65073 - DNA, 36 bp, Homo sapiens; identical to SEQ ID NO: 44649
  misc_feature 1..36: note = chr16:27279055-27279091
  misc_feature 1..36: note = hypo
  source 1..36: mol_type = genomic DNA

SEQ ID NO: 65074 - DNA, 40 bp, Homo sapiens; identical to SEQ ID NO: 44650
  misc_feature 1..40: note = chr16:27853439-27853479
  misc_feature 1..40: note = hypo
  source 1..40: mol_type = genomic DNA

SEQ ID NO: 65075 - DNA, 103 bp, Homo sapiens; identical to SEQ ID NO: 44651
  misc_feature 1..103: note = chr16:28560175-28560278
  misc_feature 1..103: note = hypo
  source 1..103: mol_type = genomic DNA

SEQ ID NO: 65076 - DNA, 78 bp, Homo sapiens; identical to SEQ ID NO: 16035
  misc_feature 1..78: note = chr16:28878714-28878792
  misc_feature 1..78: note = hypo
  source 1..78: mol_type = genomic DNA

SEQ ID NO: 65077 - DNA, 26 bp, Homo sapiens
  misc_feature 1..26: note = chr16:28947344-28947370
  misc_feature 1..26: note = hypo
  source 1..26: mol_type = genomic DNA
cccgtccgcctcgcaatttgaactcc

SEQ ID NO: 65078 - DNA, 91 bp, Homo sapiens; identical to SEQ ID NO: 44654
  misc_feature 1..91: note = chr16:29009366-29009457
  misc_feature 1..91: note = hypo
  source 1..91: mol_type = genomic DNA

SEQ ID NO: 65079 - DNA, 34 bp, Homo sapiens; identical to SEQ ID NO: 16036
  misc_feature 1..34: note = chr16:29139111-29139145
  misc_feature 1..34: note = hypo
  source 1..34: mol_type = genomic DNA

SEQ ID NO: 65080 - DNA, 81 bp, Homo sapiens
  misc_feature 1..81: note = chr16:29153203-29153284
  misc_feature 1..81: note = hypo
  source 1..81: mol_type = genomic DNA
catggcacaagggagcggtggaataatcctctgtggcacgcgggggggggtgtggaataatcctccgtggcacgagggggt

SEQ ID NO: 65081 - DNA, 162 bp, Homo sapiens; identical to SEQ ID NO: 44657
  misc_feature 1..162: note = chr16:29153365-29153527
  misc_feature 1..162: note = hypo
  source 1..162: mol_type = genomic DNA

SEQ ID NO: 65082 - DNA, 96 bp, Homo sapiens; identical to SEQ ID NO: 44658
  misc_feature 1..96: note = chr16:29244717-29244813
  misc_feature 1..96: note = hypo
  source 1..96: mol_type = genomic DNA

SEQ ID NO: 65083 - DNA, 30 bp, Homo sapiens; identical to SEQ ID NO: 44659
  misc_feature 1..30: note = chr16:29262965-29262995
  misc_feature 1..30: note = hypo
  source 1..30: mol_type = genomic DNA

SEQ ID NO: 65084 - DNA, 30 bp, Homo sapiens; identical to SEQ ID NO: 44660
  misc_feature 1..30: note = chr16:29266418-29266448
  misc_feature 1..30: note = hypo
  source 1..30: mol_type = genomic DNA

SEQ ID NO: 65085 - DNA, 34 bp, Homo sapiens; identical to SEQ ID NO: 44661
  misc_feature 1..34: note = chr16:29324812-29324846
  misc_feature 1..34: note = hypo
  source 1..34: mol_type = genomic DNA

SEQ ID NO: 65086 - DNA, 73 bp, Homo sapiens; identical to SEQ ID NO: 44662
  misc_feature 1..73: note = chr16:29691644-29691717
  misc_feature 1..73: note = hypo
  source 1..73: mol_type = genomic DNA

SEQ ID NO: 65087 - DNA, 45 bp, Homo sapiens; identical to SEQ ID NO: 25275
  misc_feature 1..45: note = chr16:29831078-29831123
  misc_feature 1..45: note = hypo
  source 1..45: mol_type = genomic DNA

SEQ ID NO: 65088 - DNA, 102 bp, Homo sapiens
  misc_feature 1..102: note = chr16:30017228-30017330
  misc_feature 1..102: note = hypo
  source 1..102: mol_type = genomic DNA
gcgggggcctggggccgggctctgagcactgcccgggtgtgcagatgatggggggtttgcatatttgcagggactagcgagtcaggcaggaggtttgcatat

SEQ ID NO: 65089 - DNA, 214 bp, Homo sapiens
  misc_feature 1..214: note = chr16:30017447-30017661
  misc_feature 1..214: note = hypo
  source 1..214: mol_type = genomic DNA
tgcgaaggttgggtactggacccggctcgatgggcctgtgccgggacactgctgtccactcaggctgaggacagagccccggccgcagggggcagctcactggtcagggtgtgccagcgctccagggctgcgtccggctgctgcaggcagtcactccagtgcttccgagcctcgcctcgggcacctggccccagggacacgccacctggggagc

SEQ ID NO: 65090 - DNA, 37 bp, Homo sapiens
  misc_feature 1..37: note = chr16:30116248-30116285
  misc_feature 1..37: note = hypo
  source 1..37: mol_type = genomic DNA
gataatccgttatgacgccagtggctcccacgctgaa

SEQ ID NO: 65091 - DNA, 176 bp, Homo sapiens
  misc_feature 1..176: note = chr16:30124515-30124691
  misc_feature 1..176: note = hypo
  source 1..176: mol_type = genomic DNA
cagcatcttcttcctcgtccacaccctgccctgccacttcgctctccttctctcttggtccctgccccgtttctagcatgcccccttggacctacccctctgtgctgtccactttggcacctgttctcacccctacccggctcacctcctcggtgggcccccaggcggatgcggaa

SEQ ID NO: 65092 - DNA, 30 bp, Homo sapiens; identical to SEQ ID NO: 44667
  misc_feature 1..30: note = chr16:30354712-30354742
  misc_feature 1..30: note = hypo
  source 1..30: mol_type = genomic DNA

SEQ ID NO: 65093 - DNA, 30 bp, Homo sapiens; identical to SEQ ID NO: 44668
  misc_feature 1..30: note = chr16:30430132-30430162
  misc_feature 1..30: note = hypo
  source 1..30: mol_type = genomic DNA

SEQ ID NO: 65094 - DNA, 32 bp, Homo sapiens; identical to SEQ ID NO: 44669
  misc_feature 1..32: note = chr16:30567477-30567509
  misc_feature 1..32: note = hypo
  source 1..32: mol_type = genomic DNA

SEQ ID NO: 65095 - DNA, 30 bp, Homo sapiens; identical to SEQ ID NO: 44670
  misc_feature 1..30: note = chr16:30803924-30803954
  misc_feature 1..30: note = hypo
  source 1..30: mol_type = genomic DNA

SEQ ID NO: 65096 - DNA, 24 bp, Homo sapiens
  misc_feature 1..24: note = chr16:30906986-30907010
  misc_feature 1..24: note = hypo
  source 1..24: mol_type = genomic DNA
tccagcaattgctcacggcaatac

SEQ ID NO: 65097 - DNA, 170 bp, Homo sapiens
  misc_feature 1..170: note = chr16:30907148-30907318
  misc_feature 1..170: note = hypo
  source 1..170: mol_type = genomic DNA
acgcagacacacgcaagcgcacacacacacgggcctcctcgtcttcattcacaaaccccattagcttctgttgtctatgggcttcctcgacagaccgcgagcccctcgcgggggccagaaaccaagtatggatcatccctatgtgccttcctttccgtctacaccaggtt

SEQ ID NO: 65098 - DNA, 30 bp, Homo sapiens; identical to SEQ ID NO: 44674
  misc_feature 1..30: note = chr16:31018076-31018106
  misc_feature 1..30: note = hypo
  source 1..30: mol_type = genomic DNA

SEQ ID NO: 65099 - DNA, 120 bp, Homo sapiens; identical to SEQ ID NO: 16045
  misc_feature 1..120: note = chr16:31138607-31138727
  misc_feature 1..120: note = hypo
  source 1..120: mol_type = genomic DNA

SEQ ID NO: 65100 - DNA, 39 bp, Homo sapiens; identical to SEQ ID NO: 44676
  misc_feature 1..39: note = chr16:31149942-31149981
  misc_feature 1..39: note = hypo
  source 1..39: mol_type = genomic DNA

SEQ ID NO: 65101 - DNA, 144 bp, Homo sapiens; identical to SEQ ID NO: 44677
  misc_feature 1..144: note = chr16:31373926-31374070
  misc_feature 1..144: note = hypo
  source 1..144: mol_type = genomic DNA

SEQ ID NO: 65102 - DNA, 30 bp, Homo sapiens; identical to SEQ ID NO: 44678
  misc_feature 1..30: note = chr16:31384803-31384833
  misc_feature 1..30: note = hypo
  source 1..30: mol_type = genomic DNA

SEQ ID NO: 65103 - DNA, 129 bp, Homo sapiens
  misc_feature 1..129: note = chr16:31447096-31447225
  misc_feature 1..129: note = hypo
  source 1..129: mol_type = genomic DNA
cacccagggctgcagcacgctggttcttcagtgtcgggccaggttggacctccggctggaggccttccacaccggaaacactggtagggctcctctccagtgtgggttcgagggcggtggaggagctcg

SEQ ID NO: 65104 - DNA, 33 bp, Homo sapiens; identical to SEQ ID NO: 44681
  misc_feature 1..33: note = chr16:31526376-31526409
  misc_feature 1..33: note = hypo
  source 1..33: mol_type = genomic DNA

SEQ ID NO: 65105 - DNA, 16 bp, Homo sapiens
  misc_feature 1..16: note = chr16:31658246-31658262
  misc_feature 1..16: note = hypo
  source 1..16: mol_type = genomic DNA
aatggaaggactgggc

SEQ ID NO: 65106 - DNA, 30 bp, Homo sapiens; identical to SEQ ID NO: 44683
  misc_feature 1..30: note = chr16:32485550-32485580
  misc_feature 1..30: note = hypo
  source 1..30: mol_type = genomic DNA

SEQ ID NO: 65107 - DNA, 18 bp, Homo sapiens
  misc_feature 1..18: note = chr16:33396766-33396784
  misc_feature 1..18: note = hypo
  source 1..18: mol_type = genomic DNA
tatgagatggattttcgc

SEQ ID NO: 65108 - DNA, 120 bp, Homo sapiens; identical to SEQ ID NO: 44685
  misc_feature 1..120: note = chr16:33893446-33893566
  misc_feature 1..120: note = hypo
  source 1..120: mol_type = genomic DNA

SEQ ID NO: 65109 - DNA, 92 bp, Homo sapiens; identical to SEQ ID NO: 44686
  misc_feature 1..92: note = chr16:33897833-33897925
  misc_feature 1..92: note = hypo
  source 1..92: mol_type = genomic DNA

SEQ ID NO: 65110 - DNA, 30 bp, Homo sapiens; identical to SEQ ID NO: 44687
  misc_feature 1..30: note = chr16:34983961-34983991
  misc_feature 1..30: note = hypo
  source 1..30: mol_type = genomic DNA

SEQ ID NO: 65111 - DNA, 19 bp, Homo sapiens
  misc_feature 1..19: note = chr16:46721707-46721726
  misc_feature 1..19: note = hypo
  source 1..19: mol_type = genomic DNA
taagcgagctgcctaaatt

SEQ ID NO: 65112 - DNA, 37 bp, Homo sapiens; identical to SEQ ID NO: 44689
  misc_feature 1..37: note = chr16:46803066-46803103
  misc_feature 1..37: note = hypo
  source 1..37: mol_type = genomic DNA

SEQ ID NO: 65113 - DNA, 120 bp, Homo sapiens; identical to SEQ ID NO: 44690
  misc_feature 1..120: note = chr16:48642029-48642149
  misc_feature 1..120: note = hypo
  source 1..120: mol_type = genomic DNA

SEQ ID NO: 65114 - DNA, 30 bp, Homo sapiens; identical to SEQ ID NO: 44691
  misc_feature 1..30: note = chr16:49500178-49500208
  misc_feature 1..30: note = hypo
  source 1..30: mol_type = genomic DNA

SEQ ID NO: 65115 - DNA, 30 bp, Homo sapiens; identical to SEQ ID NO: 44692
  misc_feature 1..30: note = chr16:49533007-49533037
  misc_feature 1..30: note = hypo
  source 1..30: mol_type = genomic DNA

SEQ ID NO: 65116 - DNA, 161 bp, Homo sapiens; identical to SEQ ID NO: 44693
  misc_feature 1..161: note = chr16:49545215-49545376
  misc_feature 1..161: note = hypo
  source 1..161: mol_type = genomic DNA

SEQ ID NO: 65117 - DNA, 90 bp, Homo sapiens; identical to SEQ ID NO: 44694
  misc_feature 1..90: note = chr16:49623675-49623765
  misc_feature 1..90: note = hypo
  source 1..90: mol_type = genomic DNA

SEQ ID NO: 65118 - DNA, 30 bp, Homo sapiens; identical to SEQ ID NO: 44695
  misc_feature 1..30: note = chr16:49634741-49634771
  misc_feature 1..30: note = hypo
  source 1..30: mol_type = genomic DNA

SEQ ID NO: 65119 - DNA, 19 bp, Homo sapiens
  misc_feature 1..19: note = chr16:50070334-50070353
  misc_feature 1..19: note = hypo
  source 1..19: mol_type = genomic DNA
ccaccgtgcctggcctctt

SEQ ID NO: 65120 - DNA, 80 bp, Homo sapiens; identical to SEQ ID NO: 44698
  misc_feature 1..80: note = chr16:50218595-50218675
  misc_feature 1..80: note = hypo
  source 1..80: mol_type = genomic DNA

SEQ ID NO: 65121 - DNA, 30 bp, Homo sapiens; identical to SEQ ID NO: 44700
  misc_feature 1..30: note = chr16:50336356-50336386
  misc_feature 1..30: note = hypo
  source 1..30: mol_type = genomic DNA

SEQ ID NO: 65122 - DNA, 152 bp, Homo sapiens; identical to SEQ ID NO: 44701
  misc_feature 1..152: note = chr16:50336625-50336777
  misc_feature 1..152: note = hypo
  source 1..152: mol_type = genomic DNA

SEQ ID NO: 65123 - DNA, 30 bp, Homo sapiens; identical to SEQ ID NO: 44702
  misc_feature 1..30: note = chr16:50958718-50958748
  misc_feature 1..30: note = hypo
  source 1..30: mol_type = genomic DNA

SEQ ID NO: 65124 - DNA, 34 bp, Homo sapiens; identical to SEQ ID NO: 16051
  misc_feature 1..34: note = chr16:53448517-53448551
  misc_feature 1..34: note = hypo
  source 1..34: mol_type = genomic DNA

SEQ ID NO: 65125 - DNA, 168 bp, Homo sapiens
  misc_feature 1..168: note = chr16:53563454-53563622
  misc_feature 1..168: note = hypo
  source 1..168: mol_type = genomic DNA
ccttcatatagcaatcggctcctcttatcccccaggcaactggctgcctttcacctccgcggcacagcaattatgtggtgtaatggaggcagcgcaaataagcagaaagattttattaaaccaaatgagcaaatcatctgcgtattattgcgatttgattgacactga

SEQ ID NO: 65126 - DNA, 221 bp, Homo sapiens; identical to SEQ ID NO: 44705
  misc_feature 1..221: note = chr16:55203739-55203960
  misc_feature 1..221: note = hypo
  source 1..221: mol_type = genomic DNA

SEQ ID NO: 65127 - DNA, 30 bp, Homo sapiens; identical to SEQ ID NO: 44706
  misc_feature 1..30: note = chr16:56460223-56460253
  misc_feature 1..30: note = hypo
  source 1..30: mol_type = genomic DNA

SEQ ID NO: 65128 - DNA, 27 bp, Homo sapiens
  misc_feature 1..27: note = chr16:56774935-56774962
  misc_feature 1..27: note = hypo
  source 1..27: mol_type = genomic DNA
ggagagggagagcgctaaatttctttt

SEQ ID NO: 65129 - DNA, 63 bp, Homo sapiens; identical to SEQ ID NO: 44708
  misc_feature 1..63: note = chr16:57222193-57222256
  misc_feature 1..63: note = hypo
  source 1..63: mol_type = genomic DNA

SEQ ID NO: 65130 - DNA, 12 bp, Homo sapiens
  misc_feature 1..12: note = chr16:57222709-57222721
  misc_feature 1..12: note = hypo
  source 1..12: mol_type = genomic DNA
gagccactgtgt

SEQ ID NO: 65131 - DNA, 30 bp, Homo sapiens; identical to SEQ ID NO: 44710
  misc_feature 1..30: note = chr16:57321322-57321352
  misc_feature 1..30: note = hypo
  source 1..30: mol_type = genomic DNA

SEQ ID NO: 65132 - DNA, 30 bp, Homo sapiens; identical to SEQ ID NO: 16055
  misc_feature 1..30: note = chr16:57759922-57759952
  misc_feature 1..30: note = hypo
  source 1..30: mol_type = genomic DNA

SEQ ID NO: 65133 - DNA, 122 bp, Homo sapiens; identical to SEQ ID NO: 44712
  misc_feature 1..122: note = chr16:58120963-58121085
  misc_feature 1..122: note = hypo
  source 1..122: mol_type = genomic DNA

SEQ ID NO: 65134 - DNA, 21 bp, Homo sapiens
  misc_feature 1..21: note = chr16:58462002-58462023
  misc_feature 1..21: note = hypo
  source 1..21: mol_type = genomic DNA
atacatcgtggacatccttcc

SEQ ID NO: 65135 - DNA, 39 bp, Homo sapiens; identical to SEQ ID NO: 44714
  misc_feature 1..39: note = chr16:58548346-58548385
  misc_feature 1..39: note = hypo
  source 1..39: mol_type = genomic DNA

SEQ ID NO: 65136 - DNA, 30 bp, Homo sapiens; identical to SEQ ID NO: 44715
  misc_feature 1..30: note = chr16:58886327-58886357
  misc_feature 1..30: note = hypo
  source 1..30: mol_type = genomic DNA

SEQ ID NO: 65137 - DNA, 33 bp, Homo sapiens; identical to SEQ ID NO: 44716
  misc_feature 1..33: note = chr16:58932088-58932121
  misc_feature 1..33: note = hypo
  source 1..33: mol_type = genomic DNA

SEQ ID NO: 65138 - DNA, 30 bp, Homo sapiens; identical to SEQ ID NO: 44718
  misc_feature 1..30: note = chr16:59046529-59046559
  misc_feature 1..30: note = hypo
  source 1..30: mol_type = genomic DNA

SEQ ID NO: 65139 - DNA, 174 bp, Homo sapiens; identical to SEQ ID NO: 44719
  misc_feature 1..174: note = chr16:67241603-67241777
  misc_feature 1..174: note = hypo
  source 1..174: mol_type = genomic DNA

SEQ ID NO: 65140 - DNA, 63 bp, Homo sapiens; identical to SEQ ID NO: 25289
  misc_feature 1..63: note = chr16:67313895-67313958
  misc_feature 1..63: note = hypo
  source 1..63: mol_type = genomic DNA

SEQ ID NO: 65141 - DNA, 48 bp, Homo sapiens; identical to SEQ ID NO: 44721
  misc_feature 1..48: note = chr16:67578633-67578681
  misc_feature 1..48: note = hypo
  source 1..48: mol_type = genomic DNA

SEQ ID NO: 65142 - DNA, 27 bp, Homo sapiens
  misc_feature 1..27: note = chr16:68770701-68770728
  misc_feature 1..27: note = hypo
  source 1..27: mol_type = genomic DNA
aaaaaattagcctggcgtggtggtgtg

SEQ ID NO: 65143 - DNA, 45 bp, Homo sapiens; identical to SEQ ID NO: 44724
  misc_feature 1..45: note = chr16:68787504-68787549
  misc_feature 1..45: note = hypo
  source 1..45: mol_type = genomic DNA

SEQ ID NO: 65144 - DNA, 30 bp, Homo sapiens; identical to SEQ ID NO: 44726
  misc_feature 1..30: note = chr16:69133585-69133615
  misc_feature 1..30: note = hypo
  source 1..30: mol_type = genomic DNA

SEQ ID NO: 65145 - DNA, 30 bp, Homo sapiens; identical to SEQ ID NO: 44727
  misc_feature 1..30: note = chr16:69352566-69352596
  misc_feature 1..30: note = hypo
  source 1..30: mol_type = genomic DNA

SEQ ID NO: 65146 - DNA, 121 bp, Homo sapiens; identical to SEQ ID NO: 44728
  misc_feature 1..121: note = chr16:70380004-70380125
  misc_feature 1..121: note = hypo
  source 1..121: mol_type = genomic DNA

SEQ ID NO: 65147 - DNA, 137 bp, Homo sapiens; identical to SEQ ID NO: 44729
  misc_feature 1..137: note = chr16:70416085-70416222
  misc_feature 1..137: note = hypo
  source 1..137: mol_type = genomic DNA

SEQ ID NO: 65148 - DNA, 126 bp, Homo sapiens; identical to SEQ ID NO: 44730
  misc_feature 1..126: note = chr16:70427606-70427732
  misc_feature 1..126: note = hypo
  source 1..126: mol_type = genomic DNA

SEQ ID NO: 65149 - DNA, 50 bp, Homo sapiens; identical to SEQ ID NO: 44732
  misc_feature 1..50: note = chr16:70680482-70680532
  misc_feature 1..50: note = hypo
  source 1..50: mol_type = genomic DNA

SEQ ID NO: 65150 - DNA, 30 bp, Homo sapiens; identical to SEQ ID NO: 44733
  misc_feature 1..30: note = chr16:70795276-70795306
  misc_feature 1..30: note = hypo
  source 1..30: mol_type = genomic DNA

SEQ ID NO: 65151 - DNA, 23 bp, Homo sapiens
  misc_feature 1..23: note = chr16:71266650-71266673
  misc_feature 1..23: note = hypo
  source 1..23: mol_type = genomic DNA
gggtgcagtggctcacgcctgta

SEQ ID NO: 65152 - DNA, 29 bp, Homo sapiens
  misc_feature 1..29: note = chr16:71841040-71841069
  misc_feature 1..29: note = hypo
  source 1..29: mol_type = genomic DNA
actttttgccaggcacggtggctcacgcc

SEQ ID NO: 65153 - DNA, 36 bp, Homo sapiens; identical to SEQ ID NO: 44736
  misc_feature 1..36: note = chr16:71919045-71919081
  misc_feature 1..36: note = hypo
  source 1..36: mol_type = genomic DNA

SEQ ID NO: 65154 - DNA, 84 bp, Homo sapiens; identical to SEQ ID NO: 16064
  misc_feature 1..84: note = chr16:72461607-72461691
  misc_feature 1..84: note = hypo
  source 1..84: mol_type = genomic DNA

SEQ ID NO: 65155 - DNA, 19 bp, Homo sapiens
  misc_feature 1..19: note = chr16:72957744-72957763
  misc_feature 1..19: note = hypo
  source 1..19: mol_type = genomic DNA
tactttgaattgcctcgtc

SEQ ID NO: 65156 - DNA, 30 bp, Homo sapiens; identical to SEQ ID NO: 44739
  misc_feature 1..30: note = chr16:73033457-73033487
  misc_feature 1..30: note = hypo
  source 1..30: mol_type = genomic DNA

SEQ ID NO: 65157 - DNA, 30 bp, Homo sapiens; identical to SEQ ID NO: 44740
  misc_feature 1..30: note = chr16:73062471-73062501
  misc_feature 1..30: note = hypo
  source 1..30: mol_type = genomic DNA

SEQ ID NO: 65158 - DNA, 30 bp, Homo sapiens; identical to SEQ ID NO: 44741
  misc_feature 1..30: note = chr16:73397239-73397269
  misc_feature 1..30: note = hypo
  source 1..30: mol_type = genomic DNA

SEQ ID NO: 65159 - DNA, 30 bp, Homo sapiens; identical to SEQ ID NO: 44742
  misc_feature 1..30: note = chr16:74331835-74331865
  misc_feature 1..30: note = hypo
  source 1..30: mol_type = genomic DNA

SEQ ID NO: 65160 - DNA, 18 bp, Homo sapiens
  misc_feature 1..18: note = chr16:74901527-74901545
  misc_feature 1..18: note = hypo
  source 1..18: mol_type = genomic DNA
ctggtccaccctatccgt

SEQ ID NO: 65161 - DNA, 72 bp, Homo sapiens; identical to SEQ ID NO: 44744
  misc_feature 1..72: note = chr16:75019649-75019721
  misc_feature 1..72: note = hypo
  source 1..72: mol_type = genomic DNA

SEQ ID NO: 65162 - DNA, 308 bp, Homo sapiens; identical to SEQ ID NO: 44745
  misc_feature 1..308: note = chr16:75148816-75149124
  misc_feature 1..308: note = hypo
  source 1..308: mol_type = genomic DNA

SEQ ID NO: 65163 - DNA, 37 bp, Homo sapiens; identical to SEQ ID NO: 44746
  misc_feature 1..37: note = chr16:75171636-75171673
  misc_feature 1..37: note = hypo
  source 1..37: mol_type = genomic DNA

SEQ ID NO: 65164 - DNA, 120 bp, Homo sapiens; identical to SEQ ID NO: 44747
  misc_feature 1..120: note = chr16:75183598-75183718
  misc_feature 1..120: note = hypo
  source 1..120: mol_type = genomic DNA

SEQ ID NO: 65165 - DNA, 29 bp, Homo sapiens
  misc_feature 1..29: note = chr16:75469090-75469119
  misc_feature 1..29: note = hypo
  source 1..29: mol_type = genomic DNA
gtgagccaccgcgccgggcaccttcaagg

SEQ ID NO: 65166 - DNA, 38 bp, Homo sapiens; identical to SEQ ID NO: 44749
  misc_feature 1..38: note = chr16:75658302-75658340
  misc_feature 1..38: note = hypo
  source 1..38: mol_type = genomic DNA

SEQ ID NO: 65167 - DNA, 30 bp, Homo sapiens; identical to SEQ ID NO: 44750
  misc_feature 1..30: note = chr16:75733411-75733441
  misc_feature 1..30: note = hypo
  source 1..30: mol_type = genomic DNA

SEQ ID NO: 65168 - DNA, 58 bp, Homo sapiens
  misc_feature 1..58: note = chr16:77247382-77247440
  misc_feature 1..58: note = hypo
  source 1..58: mol_type = genomic DNA
tctgttaaatgtgtccgccactctggaggccggcatttgggacccaaatccaaaggca

SEQ ID NO: 65169 - DNA, 30 bp, Homo sapiens; identical to SEQ ID NO: 44752
  misc_feature 1..30: note = chr16:77754041-77754071
  misc_feature 1..30: note = hypo
  source 1..30: mol_type = genomic DNA

SEQ ID NO: 65170 - DNA, 95 bp, Homo sapiens; identical to SEQ ID NO: 44753
  misc_feature 1..95: note = chr16:80644760-80644855
  misc_feature 1..95: note = hypo
  source 1..95: mol_type = genomic DNA

SEQ ID NO: 65171 - DNA, 59 bp, Homo sapiens; identical to SEQ ID NO: 44754
  misc_feature 1..59: note = chr16:80654771-80654830
  misc_feature 1..59: note = hypo
  source 1..59: mol_type = genomic DNA

SEQ ID NO: 65172 - DNA, 132 bp, Homo sapiens; identical to SEQ ID NO: 44755
  misc_feature 1..132: note = chr16:80704564-80704696
  misc_feature 1..132: note = hypo
  source 1..132: mol_type = genomic DNA

SEQ ID NO: 65173 - DNA, 30 bp, Homo sapiens; identical to SEQ ID NO: 44756
  misc_feature 1..30: note = chr16:80718633-80718663
  misc_feature 1..30: note = hypo
  source 1..30: mol_type = genomic DNA

SEQ ID NO: 65174 - DNA, 19 bp, Homo sapiens
  misc_feature 1..19: note = chr16:81042228-81042247
  misc_feature 1..19: note = hypo
  source 1..19: mol_type = genomic DNA
ggcgcgctcccggcccctc

SEQ ID NO: 65175 - DNA, 30 bp, Homo sapiens; identical to SEQ ID NO: 16070
  misc_feature 1..30: note = chr16:81533258-81533288
  misc_feature 1..30: note = hypo
  source 1..30: mol_type = genomic DNA

SEQ ID NO: 65176 - DNA, 151 bp, Homo sapiens; identical to SEQ ID NO: 44759
  misc_feature 1..151: note = chr16:81569552-81569703
  misc_feature 1..151: note = hypo
  source 1..151: mol_type = genomic DNA

SEQ ID NO: 65177 - DNA, 30 bp, Homo sapiens; identical to SEQ ID NO: 44760
  misc_feature 1..30: note = chr16:81627246-81627276
  misc_feature 1..30: note = hypo
  source 1..30: mol_type = genomic DNA

SEQ ID NO: 65178 - DNA, 180 bp, Homo sapiens; identical to SEQ ID NO: 16071
  misc_feature 1..180: note = chr16:81632932-81633112
  misc_feature 1..180: note = hypo
  source 1..180: mol_type = genomic DNA

SEQ ID NO: 65179 - DNA, 68 bp, Homo sapiens; identical to SEQ ID NO: 44762
  misc_feature 1..68: note = chr16:83968763-83968831
  misc_feature 1..68: note = hypo
  source 1..68: mol_type = genomic DNA

SEQ ID NO: 65180 - DNA, 41 bp, Homo sapiens; identical to SEQ ID NO: 16073
  misc_feature 1..41: note = chr16:84075186-84075227
  misc_feature 1..41: note = hypo
  source 1..41: mol_type = genomic DNA

SEQ ID NO: 65181 - DNA, 30 bp, Homo sapiens; identical to SEQ ID NO: 44764
  misc_feature 1..30: note = chr16:84129364-84129394
  misc_feature 1..30: note = hypo
  source 1..30: mol_type = genomic DNA

SEQ ID NO: 65182 - DNA, 30 bp, Homo sapiens; identical to SEQ ID NO: 44765
  misc_feature 1..30: note = chr16:84152910-84152940
  misc_feature 1..30: note = hypo
  source 1..30: mol_type = genomic DNA

SEQ ID NO: 65183 - DNA, 30 bp, Homo sapiens; identical to SEQ ID NO: 44767
  misc_feature 1..30: note = chr16:84593218-84593248
  misc_feature 1..30: note = hypo
  source 1..30: mol_type = genomic DNA

SEQ ID NO: 65184 - DNA, 30 bp, Homo sapiens; identical to SEQ ID NO: 44768
  misc_feature 1..30: note = chr16:85001619-85001649
  misc_feature 1..30: note = hypo
  source 1..30: mol_type = genomic DNA

SEQ ID NO: 65185 - DNA, 58 bp, Homo sapiens; identical to SEQ ID NO: 16075
  misc_feature 1..58: note = chr16:85007798-85007856
  misc_feature 1..58: note = hypo
  source 1..58: mol_type = genomic DNA

SEQ ID NO: 65186 - DNA, 30 bp, Homo sapiens; identical to SEQ ID NO: 44770
  misc_feature 1..30: note = chr16:85010139-85010169
  misc_feature 1..30: note = hypo
  source 1..30: mol_type = genomic DNA

SEQ ID NO: 65187 - DNA, 173 bp, Homo sapiens; identical to SEQ ID NO: 16076
  misc_feature 1..173: note = chr16:85028164-85028337
  misc_feature 1..173: note = hypo
  source 1..173: mol_type = genomic DNA

SEQ ID NO: 65188 - DNA, 30 bp, Homo sapiens; identical to SEQ ID NO: 44772
  misc_feature 1..30: note = chr16:85028787-85028817
  misc_feature 1..30: note = hypo
  source 1..30: mol_type = genomic DNA

SEQ ID NO: 65189 - DNA, 55 bp, Homo sapiens; identical to SEQ ID NO: 16077
  misc_feature 1..55: note = chr16:85033827-85033882
  misc_feature 1..55: note = hypo
  source 1..55: mol_type = genomic DNA

SEQ ID NO: 65190 - DNA, 16 bp, Homo sapiens
  misc_feature 1..16: note = chr16:85043890-85043906
  misc_feature 1..16: note = hypo
  source 1..16: mol_type = genomic DNA
gcgctgggattacagg

SEQ ID NO: 65191 - DNA, 17 bp, Homo sapiens
  misc_feature 1..17: note = chr16:85075553-85075570
  misc_feature 1..17: note = hypo
  source 1..17: mol_type = genomic DNA
tgcgcactcctgtccct

SEQ ID NO: 65192 - DNA, 214 bp, Homo sapiens; identical to SEQ ID NO: 44776
  misc_feature 1..214: note = chr16:85083548-85083762
  misc_feature 1..214: note = hypo
  source 1..214: mol_type = genomic DNA

SEQ ID NO: 65193 - DNA, 30 bp, Homo sapiens; identical to SEQ ID NO: 44777
  misc_feature 1..30: note = chr16:85318173-85318203
  misc_feature 1..30: note = hypo
  source 1..30: mol_type = genomic DNA

SEQ ID NO: 65194 - DNA, 30 bp, Homo sapiens; identical to SEQ ID NO: 44778
  misc_feature 1..30: note = chr16:85328964-85328994
  misc_feature 1..30: note = hypo
  source 1..30: mol_type = genomic DNA

SEQ ID NO: 65195 - DNA, 239 bp, Homo sapiens; identical to SEQ ID NO: 44779
  misc_feature 1..239: note = chr16:85336342-85336581
  misc_feature 1..239: note = hypo
  source 1..239: mol_type = genomic DNA

SEQ ID NO: 65196 - DNA, 68 bp, Homo sapiens; identical to SEQ ID NO: 16082
  misc_feature 1..68: note = chr16:85455150-85455218
  misc_feature 1..68: note = hypo
  source 1..68: mol_type = genomic DNA

SEQ ID NO: 65197 - DNA, 30 bp, Homo sapiens; identical to SEQ ID NO: 44781
  misc_feature 1..30: note = chr16:85464272-85464302
  misc_feature 1..30: note = hypo
  source 1..30: mol_type = genomic DNA

SEQ ID NO: 65198 - DNA, 45 bp, Homo sapiens; identical to SEQ ID NO: 44783
  misc_feature 1..45: note = chr16:85516822-85516867
  misc_feature 1..45: note = hypo
  source 1..45: mol_type = genomic DNA

SEQ ID NO: 65199 - DNA, 127 bp, Homo sapiens
  misc_feature 1..127: note = chr16:85517218-85517345
  misc_feature 1..127: note = hypo
  source 1..127: mol_type = genomic DNA
gggatcaagtgtctccgaggcggcgggctgagacggatgggcctcctggccgcacacctgagaacatgctggcaaaagcgtttgcttaattaattgactttgagcgagggagcccgtccccgtgtaa

SEQ ID NO: 65200 - DNA, 30 bp, Homo sapiens; identical to SEQ ID NO: 44785
  misc_feature 1..30: note = chr16:85517571-85517601
  misc_feature 1..30: note = hypo
  source 1..30: mol_type = genomic DNA

SEQ ID NO: 65201 - DNA, 70 bp, Homo sapiens; identical to SEQ ID NO: 44786
  misc_feature 1..70: note = chr16:85617748-85617818
  misc_feature 1..70: note = hypo
  source 1..70: mol_type = genomic DNA

SEQ ID NO: 65202 - DNA, 47 bp, Homo sapiens; identical to SEQ ID NO: 44787
  misc_feature 1..47: note = chr16:85668941-85668988
  misc_feature 1..47: note = hypo
  source 1..47: mol_type = genomic DNA

SEQ ID NO: 65203 - DNA, 32 bp, Homo sapiens; identical to SEQ ID NO: 16084
  misc_feature 1..32: note = chr16:85671134-85671166
  misc_feature 1..32: note = hypo
  source 1..32: mol_type = genomic DNA

SEQ ID NO: 65204 - DNA, 55 bp, Homo sapiens; identical to SEQ ID NO: 44789
  misc_feature 1..55: note = chr16:85673184-85673239
  misc_feature 1..55: note = hypo
  source 1..55: mol_type = genomic DNA

SEQ ID NO: 65205 - DNA, 48 bp, Homo sapiens; identical to SEQ ID NO: 44790
  misc_feature 1..48: note = chr16:85673838-85673886
  misc_feature 1..48: note = hypo
  source 1..48: mol_type = genomic DNA

SEQ ID NO: 65206 - DNA, 144 bp, Homo sapiens; identical to SEQ ID NO: 44791
  misc_feature 1..144: note = chr16:85674157-85674301
  misc_feature 1..144: note = hypo
  source 1..144: mol_type = genomic DNA

SEQ ID NO: 65207 - DNA, 423 bp, Homo sapiens
  misc_feature 1..423: note = chr16:85678216-85678639
  misc_feature 1..423: note = hypo
  source 1..423: mol_type = genomic DNA
gcccttctttagagacggagagccaatgcgtgcggggcctggggagacgggagtggttgctcatgggtagggggttccttttggggtgacggaaatgctctgaaatggattgtggtgatggtcgcacaactctggacgtgctagaaccgtggggccgcgcgctgggtgggtgaattacgcgggatggaatcatagctcggtgaagctataacaactgaaacccaagagccatggaggttccatggaatttttttttttaaacaacgatcctttccctagtttttattttttttccccaaaaacttaaagtgaactttttctcaaaatctaaatacatacagaaaagcgcctagactgccagtgtccagaacgaacccacagatcaggagggctgaggcctgttctcctgtccccaccctctgc

SEQ ID NO: 65208 - DNA, 245 bp, Homo sapiens
  misc_feature 1..245: note = chr16:85684063-85684308
  misc_feature 1..245: note = hypo
  source 1..245: mol_type = genomic DNA
ccactgccttgaccccgaccagagctcctggcctagacccaggacgcctcgaggggattccagcgccttttccggcgactcctccgctctgagctggtccctcctcggagggtccttaccgcctcgggaacattgagctaccccagagcagagcaggggcgcgacaggcccgccccagcagtgtaccaccgcggcgcttaatggaacacggtgccgccagggaaggcgcggggccggcagctgga

SEQ ID NO: 65209 - DNA, 137 bp, Homo sapiens
  misc_feature 1..137: note = chr16:85684457-85684594
  misc_feature 1..137: note = hypo
  source 1..137: mol_type = genomic DNA
gttgccgggccggaggcttctcggccccttctcggggtcacccctctctcccaggtgtagtgggagctgcgagaggagaaatgagatgaaaaagcctgttttaaagctaacagggcatgtcccgcctgtctgactat

SEQ ID NO: 65210 - DNA, 40 bp, Homo sapiens; identical to SEQ ID NO: 44795
  misc_feature 1..40: note = chr16:85721581-85721621
  misc_feature 1..40: note = hypo
  source 1..40: mol_type = genomic DNA

SEQ ID NO: 65211 - DNA, 163 bp, Homo sapiens; identical to SEQ ID NO: 44796
  misc_feature 1..163: note = chr16:85731450-85731613
  misc_feature 1..163: note = hypo
  source 1..163: mol_type = genomic DNA

SEQ ID NO: 65212 - DNA, 30 bp, Homo sapiens; identical to SEQ ID NO: 44797
  misc_feature 1..30: note = chr16:85741538-85741568
  misc_feature 1..30: note = hypo
  source 1..30: mol_type = genomic DNA

SEQ ID NO: 65213 - DNA, 30 bp, Homo sapiens; identical to SEQ ID NO: 44798
  misc_feature 1..30: note = chr16:85752258-85752288
  misc_feature 1..30: note = hypo
  source 1..30: mol_type = genomic DNA

SEQ ID NO: 65214 - DNA, 30 bp, Homo sapiens; identical to SEQ ID NO: 44799
  misc_feature 1..30: note = chr16:85758266-85758296
  misc_feature 1..30: note = hypo
  source 1..30: mol_type = genomic DNA

SEQ ID NO: 65215 - DNA, 55 bp, Homo sapiens; identical to SEQ ID NO: 44800
  misc_feature 1..55: note = chr16:86119064-86119119
  misc_feature 1..55: note = hypo
  source 1..55: mol_type = genomic DNA

SEQ ID NO: 65216 - DNA, 62 bp, Homo sapiens; identical to SEQ ID NO: 44801
  misc_feature 1..62: note = chr16:86215345-86215407
  misc_feature 1..62: note = hypo
  source 1..62: mol_type = genomic DNA

SEQ ID NO: 65217 - DNA, 45 bp, Homo sapiens; identical to SEQ ID NO: 44802
  misc_feature 1..45: note = chr16:86878195-86878240
  misc_feature 1..45: note = hypo
  source 1..45: mol_type = genomic DNA

SEQ ID NO: 65218 - DNA, 38 bp, Homo sapiens; identical to SEQ ID NO: 44803
  misc_feature 1..38: note = chr16:86903475-86903513
  misc_feature 1..38: note = hypo
  source 1..38: mol_type = genomic DNA

SEQ ID NO: 65219 - DNA, 30 bp, Homo sapiens; identical to SEQ ID NO: 44804
  misc_feature 1..30: note = chr16:87022637-87022667
  misc_feature 1..30: note = hypo
  source 1..30: mol_type = genomic DNA

SEQ ID NO: 65220 - DNA, 63 bp, Homo sapiens
  misc_feature 1..63: note = chr16:87092376-87092439
  misc_feature 1..63: note = hypo
  source 1..63: mol_type = genomic DNA
tgacaaatatgctctcggatagaacagcccagaaagggcaagagggagagttggaacactcag

SEQ ID NO: 65221 - DNA, 30 bp, Homo sapiens; identical to SEQ ID NO: 44806
  misc_feature 1..30: note = chr16:87188016-87188046
  misc_feature 1..30: note = hypo
  source 1..30: mol_type = genomic DNA

SEQ ID NO: 65222 - DNA, 147 bp, Homo sapiens; identical to SEQ ID NO: 16090
  misc_feature 1..147: note = chr16:87296936-87297083
  misc_feature 1..147: note = hypo
  source 1..147: mol_type = genomic DNA

SEQ ID NO: 65223 - DNA, 135 bp, Homo sapiens; identical to SEQ ID NO: 44808
  misc_feature 1..135: note = chr16:87354991-87355126
  misc_feature 1..135: note = hypo
  source 1..135: mol_type = genomic DNA

SEQ ID NO: 65224 - DNA, 46 bp, Homo sapiens; identical to SEQ ID NO: 44809
  misc_feature 1..46: note = chr16:87356783-87356829
  misc_feature 1..46: note = hypo
  source 1..46: mol_type = genomic DNA

SEQ ID NO: 65225 - DNA, 85 bp, Homo sapiens; identical to SEQ ID NO: 44810
  misc_feature 1..85: note = chr16:87421370-87421455
  misc_feature 1..85: note = hypo
  source 1..85: mol_type = genomic DNA

SEQ ID NO: 65226 - DNA, 130 bp, Homo sapiens; identical to SEQ ID NO: 44811
  misc_feature 1..130: note = chr16:87594957-87595087
  misc_feature 1..130: note = hypo
  source 1..130: mol_type = genomic DNA

SEQ ID NO: 65227 - DNA, 93 bp, Homo sapiens; identical to SEQ ID NO: 44812
  misc_feature 1..93: note = chr16:87648265-87648358
  misc_feature 1..93: note = hypo
  source 1..93: mol_type = genomic DNA

SEQ ID NO: 65228 - DNA, 112 bp, Homo sapiens; identical to SEQ ID NO: 44813
  misc_feature 1..112: note = chr16:87688591-87688703
  misc_feature 1..112: note = hypo
  source 1..112: mol_type = genomic DNA

SEQ ID NO: 65229 - DNA, 30 bp, Homo sapiens; identical to SEQ ID NO: 44814
  misc_feature 1..30: note = chr16:87701846-87701876
  misc_feature 1..30: note = hypo
  source 1..30: mol_type = genomic DNA

SEQ ID NO: 65230 - DNA, 171 bp, Homo sapiens; identical to SEQ ID NO: 44815
  misc_feature 1..171: note = chr16:87723156-87723327
  misc_feature 1..171: note = hypo
  source 1..171: mol_type = genomic DNA

SEQ ID NO: 65231 - DNA, 129 bp, Homo sapiens
  misc_feature 1..129: note = chr16:87723606-87723735
  misc_feature 1..129: note = hypo
  source 1..129: mol_type = genomic DNA
gcgcggcggcctgctcgtggatgacttccgcacccgaggttcgggccgcaagcagcccgggaaccccaagccgcgggagcggcggacggagtcaccccccgtgttcacgtggacttcccaccaccgggc

SEQ ID NO: 65232 - DNA, 15 bp, Homo sapiens
  misc_feature 1..15: note = chr16:87724098-87724113
  misc_feature 1..15: note = hypo
  source 1..15: mol_type = genomic DNA
cgaggagaatgggga

SEQ ID NO: 65233 - DNA, 48 bp, Homo sapiens; identical to SEQ ID NO: 44817
  misc_feature 1..48: note = chr16:88101496-88101544
  misc_feature 1..48: note = hypo
  source 1..48: mol_type = genomic DNA

SEQ ID NO: 65234 - DNA, 86 bp, Homo sapiens; identical to SEQ ID NO: 44818
  misc_feature 1..86: note = chr16:88164472-88164558
  misc_feature 1..86: note = hypo
  source 1..86: mol_type = genomic DNA

SEQ ID NO: 65235 - DNA, 191 bp, Homo sapiens; identical to SEQ ID NO: 44819
  misc_feature 1..191: note = chr16:88165560-88165751
  misc_feature 1..191: note = hypo
  source 1..191: mol_type = genomic DNA

SEQ ID NO: 65236 - DNA, 85 bp, Homo sapiens; identical to SEQ ID NO: 44820
  misc_feature 1..85: note = chr16:88375259-88375344
  misc_feature 1..85: note = hypo
  source 1..85: mol_type = genomic DNA

SEQ ID NO: 65237 - DNA, 159 bp, Homo sapiens; identical to SEQ ID NO: 44821
  misc_feature 1..159: note = chr16:88476104-88476263
  misc_feature 1..159: note = hypo
  source 1..159: mol_type = genomic DNA

SEQ ID NO: 65238 - DNA, 170 bp, Homo sapiens; identical to SEQ ID NO: 44822
  misc_feature 1..170: note = chr16:88495551-88495721
  misc_feature 1..170: note = hypo
  source 1..170: mol_type = genomic DNA

SEQ ID NO: 65239 - DNA, 36 bp, Homo sapiens; identical to SEQ ID NO: 44823
  misc_feature 1..36: note = chr16:88498199-88498235
  misc_feature 1..36: note = hypo
  source 1..36: mol_type = genomic DNA

SEQ ID NO: 65240 - DNA, 57 bp, Homo sapiens
  misc_feature 1..57: note = chr16:88498760-88498817
  misc_feature 1..57: note = hypo
  source 1..57: mol_type = genomic DNA
cgcgcgttggagaatccactgcacatcgggagggtgcggaatcggctgtggccaccg

SEQ ID NO: 65241 - DNA, 30 bp, Homo sapiens; identical to SEQ ID NO: 44825
  misc_feature 1..30: note = chr16:88502327-88502357
  misc_feature 1..30: note = hypo
  source 1..30: mol_type = genomic DNA

SEQ ID NO: 65242 - DNA, 30 bp, Homo sapiens; identical to SEQ ID NO: 44826
  misc_feature 1..30: note = chr16:88502901-88502931
  misc_feature 1..30: note = hypo
  source 1..30: mol_type = genomic DNA

SEQ ID NO: 65243 - DNA, 30 bp, Homo sapiens; identical to SEQ ID NO: 16096
  misc_feature 1..30: note = chr16:88503235-88503265
  misc_feature 1..30: note = hypo
  source 1..30: mol_type = genomic DNA

SEQ ID NO: 65244 - DNA, 161 bp, Homo sapiens; identical to SEQ ID NO: 44828
  misc_feature 1..161: note = chr16:88503557-88503718
  misc_feature 1..161: note = hypo
  source 1..161: mol_type = genomic DNA

SEQ ID NO: 65245 - DNA, 41 bp, Homo sapiens; identical to SEQ ID NO: 25325
  misc_feature 1..41: note = chr16:88504017-88504058
  misc_feature 1..41: note = hypo
  source 1..41: mol_type = genomic DNA

SEQ ID NO: 65246 - DNA, 38 bp, Homo sapiens
  misc_feature 1..38: note = chr16:88504315-88504353
  misc_feature 1..38: note = hypo
  source 1..38: mol_type = genomic DNA
cccggcagtgcccctgggcccggcgaggacaggcctcc

SEQ ID NO: 65247 - DNA, 30 bp, Homo sapiens; identical to SEQ ID NO: 44830
  misc_feature 1..30: note = chr16:88504602-88504632
  misc_feature 1..30: note = hypo
  source 1..30: mol_type = genomic DNA

SEQ ID NO: 65248 - DNA, 15 bp, Homo sapiens
  misc_feature 1..15: note = chr16:88506526-88506541
  misc_feature 1..15: note = hypo
  source 1..15: mol_type = genomic DNA
cgcctatttgcaatg

SEQ ID NO: 65249 - DNA, 250 bp, Homo sapiens; identical to SEQ ID NO: 44832
  misc_feature 1..250: note = chr16:88507040-88507290
  misc_feature 1..250: note = hypo
  source 1..250: mol_type = genomic DNA

SEQ ID NO: 65250 - DNA, 90 bp, Homo sapiens; identical to SEQ ID NO: 44833
  misc_feature 1..90: note = chr16:88507982-88508072
  misc_feature 1..90: note = hypo
  source 1..90: mol_type = genomic DNA

SEQ ID NO: 65251 - DNA, 21 bp, Homo sapiens
  misc_feature 1..21: note = chr16:88512529-88512550
  misc_feature 1..21: note = hypo
  source 1..21: mol_type = genomic DNA
gtgcgtcggggtgcagggcac

SEQ ID NO: 65252 - DNA, 124 bp, Homo sapiens; identical to SEQ ID NO: 44835
  misc_feature 1..124: note = chr16:88551425-88551549
  misc_feature 1..124: note = hypo
  source 1..124: mol_type = genomic DNA

SEQ ID NO: 65253 - DNA, 30 bp, Homo sapiens; identical to SEQ ID NO: 44836
  misc_feature 1..30: note = chr16:88601644-88601674
  misc_feature 1..30: note = hypo
  source 1..30: mol_type = genomic DNA

SEQ ID NO: 65254 - DNA, 51 bp, Homo sapiens; identical to SEQ ID NO: 44837
  misc_feature 1..51: note = chr16:88602946-88602997
  misc_feature 1..51: note = hypo
  source 1..51: mol_type = genomic DNA

SEQ ID NO: 65255 - DNA, 16 bp, Homo sapiens
  misc_feature 1..16: note = chr16:88603760-88603776
  misc_feature 1..16: note = hypo
  source 1..16: mol_type = genomic DNA
tcgaagcttagggcag

SEQ ID NO: 65256 - DNA, 61 bp, Homo sapiens; identical to SEQ ID NO: 44840
  misc_feature 1..61: note = chr16:88624831-88624892
  misc_feature 1..61: note = hypo
  source 1..61: mol_type = genomic DNA

SEQ ID NO: 65257 - DNA, 83 bp, Homo sapiens; identical to SEQ ID NO: 44841
  misc_feature 1..83: note = chr16:88683834-88683917
  misc_feature 1..83: note = hypo
  source 1..83: mol_type = genomic DNA

SEQ ID NO: 65258 - DNA, 96 bp, Homo sapiens; identical to SEQ ID NO: 44842
  misc_feature 1..96: note = chr16:88722642-88722738
  misc_feature 1..96: note = hypo
  source 1..96: mol_type = genomic DNA

SEQ ID NO: 65259 - DNA, 107 bp, Homo sapiens; identical to SEQ ID NO: 44843
  misc_feature 1..107: note = chr16:88757527-88757634
  misc_feature 1..107: note = hypo
  source 1..107: mol_type = genomic DNA

SEQ ID NO: 65260 - DNA, 120 bp, Homo sapiens; identical to SEQ ID NO: 44844
  misc_feature 1..120: note = chr16:88791699-88791819
  misc_feature 1..120: note = hypo
  source 1..120: mol_type = genomic DNA

SEQ ID NO: 65261 - DNA, 42 bp, Homo sapiens; identical to SEQ ID NO: 44845
  misc_feature 1..42: note = chr16:88793407-88793449
  misc_feature 1..42: note = hypo
  source 1..42: mol_type = genomic DNA

SEQ ID NO: 65262 - DNA, 157 bp, Homo sapiens; identical to SEQ ID NO: 44846
  misc_feature 1..157: note = chr16:88794604-88794761
  misc_feature 1..157: note = hypo
  source 1..157: mol_type = genomic DNA

SEQ ID NO: 65263 - DNA, 30 bp, Homo sapiens; identical to SEQ ID NO: 44847
  misc_feature 1..30: note = chr16:88798777-88798807
  misc_feature 1..30: note = hypo
  source 1..30: mol_type = genomic DNA

SEQ ID NO: 65264 - DNA, 30 bp, Homo sapiens; identical to SEQ ID NO: 44848
  misc_feature 1..30: note = chr16:88803397-88803427
  misc_feature 1..30: note = hypo
  source 1..30: mol_type = genomic DNA

SEQ ID NO: 65265 - DNA, 54 bp, Homo sapiens; identical to SEQ ID NO: 44849
  misc_feature 1..54: note = chr16:88805867-88805921
  misc_feature 1..54: note = hypo
  source 1..54: mol_type = genomic DNA

SEQ ID NO: 65266 - DNA, 30 bp, Homo sapiens; identical to SEQ ID NO: 44850
  misc_feature 1..30: note = chr16:88827321-88827351
  misc_feature 1..30: note = hypo
  source 1..30: mol_type = genomic DNA

SEQ ID NO: 65267 - DNA, 36 bp, Homo sapiens; identical to SEQ ID NO: 44851
  misc_feature 1..36: note = chr16:88831239-88831275
  misc_feature 1..36: note = hypo
  source 1..36: mol_type = genomic DNA

SEQ ID NO: 65268 - DNA, 143 bp, Homo sapiens; identical to SEQ ID NO: 44852
  misc_feature 1..143: note = chr16:88832684-88832827
  misc_feature 1..143: note = hypo
  source 1..143: mol_type = genomic DNA

SEQ ID NO: 65269 - DNA, 21 bp, Homo sapiens
  misc_feature 1..21: note = chr16:88881425-88881446
  misc_feature 1..21: note = hypo
  source 1..21: mol_type = genomic DNA
ccaccgcgcttggcctcgagc

SEQ ID NO: 65270 - DNA, 397 bp, Homo sapiens
  misc_feature 1..397: note = chr16:88882841-88883238
  misc_feature 1..397: note = hypo
  source 1..397: mol_type = genomic DNA
gtccagaggcggggacgccagctgcccaggtccctttgaaggaagggccctgaatatcttcctatgaaacttgccaggcacccccgccccccgccccccaactaacggaggtggccctgccctgcccagtcctaaataaccctgcagggtggactgtccctgggcagggacaaggccatctgccctccatggtcctcactgctggtaggtgctcccgatggccggtgctctcctgttacatccgccggcccacgctgtggctccctggctgttcagagccaccaccttccttcccacggcacggcgggcacccagcggctcccacgctgcagccgggtctggccctggaaagaggcttcagctgggccttttcgcccgcacagcaggagcccaggct

SEQ ID NO: 65271 - DNA, 97 bp, Homo sapiens
  misc_feature 1..97: note = chr16:88883377-88883474
  misc_feature 1..97: note = hypo
  source 1..97: mol_type = genomic DNA
tgctcggtgggctctgggcacccaggagcgacaccgcagacctgtgtgtggctcgtttttgccgactagagcgagggccgcacgtgtcccatctgaa

SEQ ID NO: 65272 - DNA, 72 bp, Homo sapiens; identical to SEQ ID NO: 44856
  misc_feature 1..72: note = chr16:88884207-88884279
  misc_feature 1..72: note = hypo
  source 1..72: mol_type = genomic DNA

SEQ ID NO: 65273 - DNA, 91 bp, Homo sapiens; identical to SEQ ID NO: 44857
  misc_feature 1..91: note = chr16:88931237-88931328
  misc_feature 1..91: note = hypo
  source 1..91: mol_type = genomic DNA

SEQ ID NO: 65274 - DNA, 30 bp, Homo sapiens; identical to SEQ ID NO: 44858
  misc_feature 1..30: note = chr16:88933367-88933397
  misc_feature 1..30: note = hypo
  source 1..30: mol_type = genomic DNA

SEQ ID NO: 65275 - DNA, 30 bp, Homo sapiens; identical to SEQ ID NO: 44859
  misc_feature 1..30: note = chr16:88941444-88941474
  misc_feature 1..30: note = hypo
  source 1..30: mol_type = genomic DNA

SEQ ID NO: 65276 - DNA, 134 bp, Homo sapiens
  misc_feature 1..134: note = chr16:88941985-88942119
  misc_feature 1..134: note = hypo
  source 1..134: mol_type = genomic DNA
aggttggagttggggcgatggggctgagagaggtcggagctggggtgagggggccgagagaggtcggagggcgcggagaggagagaggtagaggaggacgggctggccgagaagcagtgtttcagggaggcctg

SEQ ID NO: 65277 - DNA, 78 bp, Homo sapiens; identical to SEQ ID NO: 44861
  misc_feature 1..78: note = chr16:88943090-88943168
  misc_feature 1..78: note = hypo
  source 1..78: mol_type = genomic DNA

SEQ ID NO: 65278 - DNA, 117 bp, Homo sapiens
  misc_feature 1..117: note = chr16:88943442-88943559
  misc_feature 1..117: note = hypo
  source 1..117: mol_type = genomic DNA
ccgcagagccggcttcgctggggctggcagcacccacaggcagggaggggcccaggctgtgggcggcttcgggcggtccaggcaccgggtcggccaccacggctgtggggccctgca

SEQ ID NO: 65279 - DNA, 63 bp, Homo sapiens; identical to SEQ ID NO: 44863
  misc_feature 1..63: note = chr16:88944955-88945018
  misc_feature 1..63: note = hypo
  source 1..63: mol_type = genomic DNA

SEQ ID NO: 65280 - DNA, 213 bp, Homo sapiens; identical to SEQ ID NO: 25337
  misc_feature 1..213: note = chr16:88945602-88945815
  misc_feature 1..213: note = hypo
  source 1..213: mol_type = genomic DNA

SEQ ID NO: 65281 - DNA, 84 bp, Homo sapiens; identical to SEQ ID NO: 25338
  misc_feature 1..84: note = chr16:88945995-88946079
  misc_feature 1..84: note = hypo
  source 1..84: mol_type = genomic DNA

SEQ ID NO: 65282 - DNA, 440 bp, Homo sapiens; identical to SEQ ID NO: 44865
  misc_feature 1..440: note = chr16:88948329-88948769
  misc_feature 1..440: note = hypo
  source 1..440: mol_type = genomic DNA

SEQ ID NO: 65283 - DNA, 579 bp, Homo sapiens; identical to SEQ ID NO: 44866
  misc_feature 1..579: note = chr16:88952219-88952798
  misc_feature 1..579: note = hypo
  source 1..579: mol_type = genomic DNA

SEQ ID NO: 65284 - DNA, 60 bp, Homo sapiens
  misc_feature 1..60: note = chr16:88955189-88955249
  misc_feature 1..60: note = hypo
  source 1..60: mol_type = genomic DNA
atgtcccactggccccgggccccgggtgggggcacgaggtgggctggccctgagctccag

SEQ ID NO: 65285 - DNA, 89 bp, Homo sapiens
  misc_feature 1..89: note = chr16:88956141-88956230
  misc_feature 1..89: note = hypo
  source 1..89: mol_type = genomic DNA
cttcaaatccctggacgacgccccgcgattcctcctcctccagggacgacgccacgcgattcctcctcctccagggacacttcaaatcc

SEQ ID NO: 65286 - DNA, 118 bp, Homo sapiens; identical to SEQ ID NO: 44869
  misc_feature 1..118: note = chr16:88956594-88956712
  misc_feature 1..118: note = hypo
  source 1..118: mol_type = genomic DNA

SEQ ID NO: 65287 - DNA, 138 bp, Homo sapiens
  misc_feature 1..138: note = chr16:88957857-88957995
  misc_feature 1..138: note = hypo
  source 1..138: mol_type = genomic DNA
gggtgctggctccaggagggacctgctgcatgtcctgggccctatccccgagccttgcccccacactggcacgtcgtcagtgctcaaaaatcacccgtggagtgagcgagcacattcggccaacggcaaccagaggcg

SEQ ID NO: 65288 - DNA, 52 bp, Homo sapiens
  misc_feature 1..52: note = chr16:88958345-88958397
  misc_feature 1..52: note = hypo
  source 1..52: mol_type = genomic DNA
tggaatgaaactcctcgatcgtcaatgtcgagttctgcaggggagaaaaccc

SEQ ID NO: 65289 - DNA, 18 bp, Homo sapiens
  misc_feature 1..18: note = chr16:88958431-88958449
  misc_feature 1..18: note = hypo
  source 1..18: mol_type = genomic DNA
cgccgacccacccatgcc

SEQ ID NO: 65290 - DNA, 99 bp, Homo sapiens; identical to SEQ ID NO: 44872
  misc_feature 1..99: note = chr16:88962807-88962906
  misc_feature 1..99: note = hypo
  source 1..99: mol_type = genomic DNA

SEQ ID NO: 65291 - DNA, 63 bp, Homo sapiens; identical to SEQ ID NO: 25346
  misc_feature 1..63: note = chr16:88963214-88963277
  misc_feature 1..63: note = hypo
  source 1..63: mol_type = genomic DNA

SEQ ID NO: 65292 - DNA, 30 bp, Homo sapiens; identical to SEQ ID NO: 44874
  misc_feature 1..30: note = chr16:88965028-88965058
  misc_feature 1..30: note = hypo
  source 1..30: mol_type = genomic DNA

SEQ ID NO: 65293 - DNA, 242 bp, Homo sapiens
  misc_feature 1..242: note = chr16:88966588-88966830
  misc_feature 1..242: note = hypo
  source 1..242: mol_type = genomic DNA
gccgttaggctgtttggctcctactgagtgccgggcacatttccagctgtacctgcctctgggcggcacacctgggggcaccccattgctgggccaccccattccccaaccaagtcgggaggctgactcggagccaacatcctacaaacagggccgcaaatctgctgcctgaccgcacagccagtgctctctccagatggaggggagatgatggccaaagccctcggcggagcaggccccca

SEQ ID NO: 65294 - DNA, 224 bp, Homo sapiens; identical to SEQ ID NO: 44876
  misc_feature 1..224: note = chr16:88967701-88967925
  misc_feature 1..224: note = hypo
  source 1..224: mol_type = genomic DNA

SEQ ID NO: 65295 - DNA, 417 bp, Homo sapiens
  misc_feature 1..417: note = chr16:88968292-88968709
  misc_feature 1..417: note = hypo
  source 1..417: mol_type = genomic DNA
tggagctggggccctcggtgtgtggccgccctgcgagagccgtgccccactccaggcttgaggcttctacagaccagggagtgggcagtgccccgaggcagcggtgccttgctcccacctccatgagcatcccccggggggtgttcagacagacctcagcctcttcccccagtcctgattcagcaggtcaggctgagacccagaatttgcatttccggcatgttcccaggtggcgctgctgctggtctggccctggaagccatggttctaagagtcccttccactttcagatgctagaaggctcccctgggctggggggcgggggacggtgtctgcccagggagaggccggcaggcaggccatttagggcggcaaaacctctattttaaccgtcttctgccccggtgattcacagga

SEQ ID NO: 65296 - DNA, 23 bp, Homo sapiens
  misc_feature 1..23: note = chr16:88968789-88968812
  misc_feature 1..23: note = hypo
  source 1..23: mol_type = genomic DNA
ccaggacacgtgattaatgagaa

SEQ ID NO: 65297 - DNA, 30 bp, Homo sapiens; identical to SEQ ID NO: 44878
  misc_feature 1..30: note = chr16:88970496-88970526
  misc_feature 1..30: note = hypo
  source 1..30: mol_type = genomic DNA

SEQ ID NO: 65298 - DNA, 50 bp, Homo sapiens; identical to SEQ ID NO: 44879
  misc_feature 1..50: note = chr16:88976653-88976703
  misc_feature 1..50: note = hypo
  source 1..50: mol_type = genomic DNA

SEQ ID NO: 65299 - DNA, 74 bp, Homo sapiens
  misc_feature 1..74: note = chr16:88977950-88978024
  misc_feature 1..74: note = hypo
  source 1..74: mol_type = genomic DNA
ctctccctgcaggaacggagttggcttttccgtctcctaatctggcctcagttttctcatctgtaaaatgggaa

SEQ ID NO: 65300 - DNA, 50 bp, Homo sapiens
  misc_feature 1..50: note = chr16:88978072-88978122
  misc_feature 1..50: note = hypo
  source 1..50: mol_type = genomic DNA
cacgaaaagcgtctagaacagagcgcctggccgctcgccctggccaccca

SEQ ID NO: 65301 - DNA, 30 bp, Homo sapiens; identical to SEQ ID NO: 44881
  misc_feature 1..30: note = chr16:88980132-88980162
  misc_feature 1..30: note = hypo
  source 1..30: mol_type = genomic DNA

SEQ ID NO: 65302 - DNA, 272 bp, Homo sapiens; identical to SEQ ID NO: 44883
  misc_feature 1..272: note = chr16:88994398-88994670
  misc_feature 1..272: note = hypo
  source 1..272: mol_type = genomic DNA

SEQ ID NO: 65303 - DNA, 17 bp, Homo sapiens
  misc_feature 1..17: note = chr16:89000151-89000168
  misc_feature 1..17: note = hypo
  source 1..17: mol_type = genomic DNA
tctatacgcctcacacg

SEQ ID NO: 65304 - DNA, 35 bp, Homo sapiens
  misc_feature 1..35: note = chr16:89000204-89000239
  misc_feature 1..35: note = hypo
  source 1..35: mol_type = genomic DNA
agtggccacttcatgccacgcgtatgtgacttggt

SEQ ID NO: 65305 - DNA, 93 bp, Homo sapiens
  misc_feature 1..93: note = chr16:89001001-89001094
  misc_feature 1..93: note = hypo
  source 1..93: mol_type = genomic DNA
ggaggcccagaggagcggagaggagtctggcctcgctgcctgcctattcttgctgttggcagggcctggtaaaggaggcagagatgccacgaa

SEQ ID NO: 65306 - DNA, 38 bp, Homo sapiens
  misc_feature 1..38: note = chr16:89001124-89001162
  misc_feature 1..38: note = hypo
  source 1..38: mol_type = genomic DNA
tccacccccgaagttcagaaggacgcattctttttttc

SEQ ID NO: 65307 - DNA, 38 bp, Homo sapiens; identical to SEQ ID NO: 16126
  misc_feature 1..38: note = chr16:89025782-89025820
  misc_feature 1..38: note = hypo
  source 1..38: mol_type = genomic DNA

SEQ ID NO: 65308 - DNA, 93 bp, Homo sapiens; identical to SEQ ID NO: 44887
  misc_feature 1..93: note = chr16:89026022-89026115
  misc_feature 1..93: note = hypo
  source 1..93: mol_type = genomic DNA

SEQ ID NO: 65309 - DNA, 30 bp, Homo sapiens; identical to SEQ ID NO: 44888
  misc_feature 1..30: note = chr16:89028699-89028729
  misc_feature 1..30: note = hypo
  source 1..30: mol_type = genomic DNA

SEQ ID NO: 65310 - DNA, 30 bp, Homo sapiens; identical to SEQ ID NO: 44889
  misc_feature 1..30: note = chr16:89029708-89029738
  misc_feature 1..30: note = hypo
  source 1..30: mol_type = genomic DNA

SEQ ID NO: 65311 - DNA, 535 bp, Homo sapiens; identical to SEQ ID NO: 44890
  misc_feature 1..535: note = chr16:89055410-89055945
  misc_feature 1..535: note = hypo
  source 1..535: mol_type = genomic DNA

SEQ ID NO: 65312 - DNA, 53 bp, Homo sapiens
  misc_feature 1..53: note = chr16:89072774-89072827
  misc_feature 1..53: note = hypo
  source 1..53: mol_type = genomic DNA
gagacaaggaactgactgcaagtggaccatttgcagggcgaccccaagggcag

SEQ ID NO: 65313 - DNA, 30 bp, Homo sapiens; identical to SEQ ID NO: 44892
  misc_feature 1..30: note = chr16:89103482-89103512
  misc_feature 1..30: note = hypo
  source 1..30: mol_type = genomic DNA

SEQ ID NO: 65314 - DNA, 123 bp, Homo sapiens; identical to SEQ ID NO: 44893
  misc_feature 1..123: note = chr16:89105547-89105670
  misc_feature 1..123: note = hypo
  source 1..123: mol_type = genomic DNA

SEQ ID NO: 65315 - DNA, 28 bp, Homo sapiens
  misc_feature 1..28: note = chr16:89107647-89107675
  misc_feature 1..28: note = hypo
  source 1..28: mol_type = genomic DNA
ggagggcaaccgagtcggcctgggttca

SEQ ID NO: 65316 - DNA, 52 bp, Homo sapiens; identical to SEQ ID NO: 25353
  misc_feature 1..52: note = chr16:89107732-89107784
  misc_feature 1..52: note = hypo
  source 1..52: mol_type = genomic DNA

SEQ ID NO: 65317 - DNA, 177 bp, Homo sapiens; identical to SEQ ID NO: 44895
  misc_feature 1..177: note = chr16:89109482-89109659
  misc_feature 1..177: note = hypo
  source 1..177: mol_type = genomic DNA

SEQ ID NO: 65318 - DNA, 30 bp, Homo sapiens; identical to SEQ ID NO: 44896
  misc_feature 1..30: note = chr16:89110091-89110121
  misc_feature 1..30: note = hypo
  source 1..30: mol_type = genomic DNA

SEQ ID NO: 65319 - DNA, 30 bp, Homo sapiens; identical to SEQ ID NO: 44897
  misc_feature 1..30: note = chr16:89115322-89115352
  misc_feature 1..30: note = hypo
  source 1..30: mol_type = genomic DNA

SEQ ID NO: 65320 - DNA, 87 bp, Homo sapiens
  misc_feature 1..87: note = chr16:89120319-89120406
  misc_feature 1..87: note = hypo
  source 1..87: mol_type = genomic DNA
ggcgggcaggtgctggaggactgagtgaggcccctccaggatggctccctgcccctccatgcgctgggtcctcgggccaggacaggt

SEQ ID NO: 65321 - DNA, 24 bp, Homo sapiens
  misc_feature 1..24: note = chr16:89120684-89120708
  misc_feature 1..24: note = hypo
  source 1..24: mol_type = genomic DNA
tggctggggctcctgcggccaccc

SEQ ID NO: 65322 - DNA, 63 bp, Homo sapiens
  misc_feature 1..63: note = chr16:89138060-89138123
  misc_feature 1..63: note = hypo
  source 1..63: mol_type = genomic DNA
ctcccgaccttctcatttgatcctcctgccctatgcggttggtgccaacgttcatcccatttt

SEQ ID NO: 65323 - DNA, 25 bp, Homo sapiens
  misc_feature 1..25: note = chr16:89139536-89139561
  misc_feature 1..25: note = hypo
  source 1..25: mol_type = genomic DNA
cacttacctggagtgcggtggcccc

SEQ ID NO: 65324 - DNA, 52 bp, Homo sapiens; identical to SEQ ID NO: 44902
  misc_feature 1..52: note = chr16:89140367-89140419
  misc_feature 1..52: note = hypo
  source 1..52: mol_type = genomic DNA

SEQ ID NO: 65325 - DNA, 30 bp, Homo sapiens; identical to SEQ ID NO: 44903
  misc_feature 1..30: note = chr16:89141923-89141953
  misc_feature 1..30: note = hypo
  source 1..30: mol_type = genomic DNA

SEQ ID NO: 65326 - DNA, 402 bp, Homo sapiens; identical to SEQ ID NO: 44904
  misc_feature 1..402: note = chr16:89172134-89172536
  misc_feature 1..402: note = hypo
  source 1..402: mol_type = genomic DNA

SEQ ID NO: 65327 - DNA, 44 bp, Homo sapiens; identical to SEQ ID NO: 44905
  misc_feature 1..44: note = chr16:89189859-89189903
  misc_feature 1..44: note = hypo
  source 1..44: mol_type = genomic DNA

SEQ ID NO: 65328 - DNA, 54 bp, Homo sapiens; identical to SEQ ID NO: 44906
  misc_feature 1..54: note = chr16:89219318-89219372
  misc_feature 1..54: note = hypo
  source 1..54: mol_type = genomic DNA

SEQ ID NO: 65329 - DNA, 257 bp, Homo sapiens
  misc_feature 1..257: note = chr16:89220398-89220655
  misc_feature 1..257: note = hypo
  source 1..257: mol_type = genomic DNA
cagggtcccaggggcacctgtccgtactgctgggcgcctgagttcctcctgctgggcactgtcagggcagtgcgcctcaggctgtgcttgtctctgcagaaatgtcctggccccgtacgcggtgccctcggagctggtgctggtggaggagatcccgcggaaccagatgggcaagattgacaagaaggcgctcatcaggcacttccacccctcatgacccggcagactgggactgcgggtctggtggggagcagcag

SEQ ID NO: 65330 - DNA, 112 bp, Homo sapiens
  misc_feature 1..112: note = chr16:89220922-89221034
  misc_feature 1..112: note = hypo
  source 1..112: mol_type = genomic DNA
tgcagttgccaggctctccagggcaggtcccagaggtttcccacaaaaaacaaagactccactggaggaaacaagcccctgtcccacgccgtctgcacgtgcctgtgcctca

SEQ ID NO: 65331 - DNA, 82 bp, Homo sapiens; identical to SEQ ID NO: 44908
  misc_feature 1..82: note = chr16:89225881-89225963
  misc_feature 1..82: note = hypo
  source 1..82: mol_type = genomic DNA

SEQ ID NO: 65332 - DNA, 390 bp, Homo sapiens; identical to SEQ ID NO: 44909
  misc_feature 1..390: note = chr16:89226330-89226720
  misc_feature 1..390: note = hypo
  source 1..390: mol_type = genomic DNA

SEQ ID NO: 65333 - DNA, 112 bp, Homo sapiens; identical to SEQ ID NO: 44910
  misc_feature 1..112: note = chr16:89242936-89243048
  misc_feature 1..112: note = hypo
  source 1..112: mol_type = genomic DNA

SEQ ID NO: 65334 - DNA, 151 bp, Homo sapiens; identical to SEQ ID NO: 44911
  misc_feature 1..151: note = chr16:89245291-89245442
  misc_feature 1..151: note = hypo
  source 1..151: mol_type = genomic DNA

SEQ ID NO: 65335 - DNA, 102 bp, Homo sapiens; identical to SEQ ID NO: 44912
  misc_feature 1..102: note = chr16:89245643-89245745
  misc_feature 1..102: note = hypo
  source 1..102: mol_type = genomic DNA

SEQ ID NO: 65336 - DNA, 20 bp, Homo sapiens
  misc_feature 1..20: note = chr16:89254633-89254653
  misc_feature 1..20: note = hypo
  source 1..20: mol_type = genomic DNA
gggcagttcaccatccgcac

SEQ ID NO: 65337 - DNA, 30 bp, Homo sapiens; identical to SEQ ID NO: 44914
  misc_feature 1..30: note = chr16:89311109-89311139
  misc_feature 1..30: note = hypo
  source 1..30: mol_type = genomic DNA

SEQ ID NO: 65338 - DNA, 30 bp, Homo sapiens; identical to SEQ ID NO: 44915
  misc_feature 1..30: note = chr16:89531824-89531854
  misc_feature 1..30: note = hypo
  source 1..30: mol_type = genomic DNA

SEQ ID NO: 65339 - DNA, 62 bp, Homo sapiens
  misc_feature 1..62: note = chr16:89558703-89558765
  misc_feature 1..62: note = hypo
  source 1..62: mol_type = genomic DNA
agtgtttccatatttgcctcactggacgaagtatttggtaaaattgacgaaattcagagtcc

SEQ ID NO: 65340 - DNA, 44 bp, Homo sapiens; identical to SEQ ID NO: 44917
  misc_feature 1..44: note = chr16:89575654-89575698
  misc_feature 1..44: note = hypo
  source 1..44: mol_type = genomic DNA

SEQ ID NO: 65341 - DNA, 30 bp, Homo sapiens; identical to SEQ ID NO: 16146
  misc_feature 1..30: note = chr16:89576068-89576098
  misc_feature 1..30: note = hypo
  source 1..30: mol_type = genomic DNA

SEQ ID NO: 65342 - DNA, 26 bp, Homo sapiens
  misc_feature 1..26: note = chr16:89637111-89637137
  misc_feature 1..26: note = hypo
  source 1..26: mol_type = genomic DNA
acaggaggaggtgagcggggattgga

SEQ ID NO: 65343 - DNA, 30 bp, Homo sapiens; identical to SEQ ID NO: 44920
  misc_feature 1..30: note = chr16:89651651-89651681
  misc_feature 1..30: note = hypo
  source 1..30: mol_type = genomic DNA

SEQ ID NO: 65344 - DNA, 79 bp, Homo sapiens; identical to SEQ ID NO: 16147
  misc_feature 1..79: note = chr16:89655054-89655133
  misc_feature 1..79: note = hypo
  source 1..79: mol_type = genomic DNA

SEQ ID NO: 65345 - DNA, 30 bp, Homo sapiens; identical to SEQ ID NO: 44922
  misc_feature 1..30: note = chr16:89667452-89667482
  misc_feature 1..30: note = hypo
  source 1..30: mol_type = genomic DNA

SEQ ID NO: 65346 - DNA, 30 bp, Homo sapiens; identical to SEQ ID NO: 16148
  misc_feature 1..30: note = chr16:89668379-89668409
  misc_feature 1..30: note = hypo
  source 1..30: mol_type = genomic DNA

SEQ ID NO: 65347 - DNA, 79 bp, Homo sapiens; identical to SEQ ID NO: 44924
  misc_feature 1..79: note = chr16:89688162-89688241
  misc_feature 1..79: note = hypo
  source 1..79: mol_type = genomic DNA

SEQ ID NO: 65348 - DNA, 255 bp, Homo sapiens; identical to SEQ ID NO: 44925
  misc_feature 1..255: note = chr16:89702746-89703001
  misc_feature 1..255: note = hypo
  source 1..255: mol_type = genomic DNA

SEQ ID NO: 65349 - DNA, 48 bp, Homo sapiens; identical to SEQ ID NO: 44926
  misc_feature 1..48: note = chr16:89704648-89704696
  misc_feature 1..48: note = hypo
  source 1..48: mol_type = genomic DNA

SEQ ID NO: 65350 - DNA, 30 bp, Homo sapiens; identical to SEQ ID NO: 44927
  misc_feature 1..30: note = chr16:89713595-89713625
  misc_feature 1..30: note = hypo
  source 1..30: mol_type = genomic DNA

SEQ ID NO: 65351 - DNA, 37 bp, Homo sapiens; identical to SEQ ID NO: 44928
  misc_feature 1..37: note = chr16:89763835-89763872
  misc_feature 1..37: note = hypo
  source 1..37: mol_type = genomic DNA

SEQ ID NO: 65352 - DNA, 50 bp, Homo sapiens
  misc_feature 1..50: note = chr16:89883922-89883972
  misc_feature 1..50: note = hypo
  source 1..50: mol_type = genomic DNA
ggcagagcgagactctgtctcaaaacaaaaccaaacataagaattcgtaa

SEQ ID NO: 65353 - DNA, 157 bp, Homo sapiens
  misc_feature 1..157: note = chr16:89884185-89884342
  misc_feature 1..157: note = hypo
  source 1..157: mol_type = genomic DNA
cagagtggggccttggattcatgagatggggatggagcagaaatgagaattcggagtccatgaaacccccacaaagactcctgcacggcccgactcggacactttgcaatctgctggttgagggggatggtgtgaactcagggaacagcctgagatc

SEQ ID NO: 65354 - DNA, 70 bp, Homo sapiens
  misc_feature 1..70: note = chr16:89884896-89884966
  misc_feature 1..70: note = hypo
  source 1..70: mol_type = genomic DNA
aaccatgaagatggccggaggaaaaagatacgttaaatacagtaacaaaggtaagaattccagcctgggc

SEQ ID NO: 65355 - DNA, 30 bp, Homo sapiens; identical to SEQ ID NO: 44932
  misc_feature 1..30: note = chr16:89896219-89896249
  misc_feature 1..30: note = hypo
  source 1..30: mol_type = genomic DNA

SEQ ID NO: 65356 - DNA, 71 bp, Homo sapiens
  misc_feature 1..71: note = chr16:89900384-89900455
  misc_feature 1..71: note = hypo
  source 1..71: mol_type = genomic DNA
tgtagatggcattcccgatatagtctcacctctgagcaagggttacctcacaggaaggcagtcctgcagca

SEQ ID NO: 65357 - DNA, 289 bp, Homo sapiens
  misc_feature 1..289: note = chr16:89900526-89900815
  misc_feature 1..289: note = hypo
  source 1..289: mol_type = genomic DNA
aagcatagcccgtgtgaatctgtgaacctgcctgcgctcgcggttggccgtcgtagaagcctggataagcatagcccgtgtgaatctgtgaacctgcctgtgctcacggttggccgtcgtagaagcatggataagcatagcccgtgtgaatctgtgaacctgcccgcgctcgcggttggccgtcgtagaaggccccataagcatagcccgtgtgaatctgtgaacctgcctgtgctcacggttggccgtcgtagaagcctggataagcatagcccgtgtgaatctgtga

SEQ ID NO: 65358 - DNA, 30 bp, Homo sapiens; identical to SEQ ID NO: 44935
  misc_feature 1..30: note = chr16:89972205-89972235
  misc_feature 1..30: note = hypo
  source 1..30: mol_type = genomic DNA

SEQ ID NO: 65359 - DNA, 40 bp, Homo sapiens; identical to SEQ ID NO: 44936
  misc_feature 1..40: note = chr16:90037700-90037740
  misc_feature 1..40: note = hypo
  source 1..40: mol_type = genomic DNA

SEQ ID NO: 65360 - DNA, 321 bp, Homo sapiens; identical to SEQ ID NO: 44937
  misc_feature 1..321: note = chr16:90066626-90066947
  misc_feature 1..321: note = hypo
  source 1..321: mol_type = genomic DNA

SEQ ID NO: 65361 - DNA, 133 bp, Homo sapiens; identical to SEQ ID NO: 16154
  misc_feature 1..133: note = chr16:90069191-90069324
  misc_feature 1..133: note = hypo
  source 1..133: mol_type = genomic DNA

SEQ ID NO: 65362 - DNA, 12 bp, Homo sapiens
  misc_feature 1..12: note = chr17:616989-617001
  misc_feature 1..12: note = hypo
  source 1..12: mol_type = genomic DNA
gcaggcagggcc

SEQ ID NO: 65363 - DNA, 57 bp, Homo sapiens; identical to SEQ ID NO: 44940
  misc_feature 1..57: note = chr17:706526-706583
  misc_feature 1..57: note = hypo
  source 1..57: mol_type = genomic DNA

SEQ ID NO: 65364 - DNA, 121 bp, Homo sapiens; identical to SEQ ID NO: 44941
  misc_feature 1..121: note = chr17:745667-745788
  misc_feature 1..121: note = hypo
  source 1..121: mol_type = genomic DNA

SEQ ID NO: 65365 - DNA, 30 bp, Homo sapiens; identical to SEQ ID NO: 44942
  misc_feature 1..30: note = chr17:876870-876900
  misc_feature 1..30: note = hypo
  source 1..30: mol_type = genomic DNA

SEQ ID NO: 65366 - DNA, 30 bp, Homo sapiens; identical to SEQ ID NO: 44943
  misc_feature 1..30: note = chr17:896321-896351
  misc_feature 1..30: note = hypo
  source 1..30: mol_type = genomic DNA

SEQ ID NO: 65367 - DNA, 30 bp, Homo sapiens; identical to SEQ ID NO: 44944
  misc_feature 1..30: note = chr17:915987-916017
  misc_feature 1..30: note = hypo
  source 1..30: mol_type = genomic DNA

SEQ ID NO: 65368 - DNA, 34 bp, Homo sapiens; identical to SEQ ID NO: 44945
  misc_feature 1..34: note = chr17:1136687-1136721
  misc_feature 1..34: note = hypo
  source 1..34: mol_type = genomic DNA

SEQ ID NO: 65369 - DNA, 30 bp, Homo sapiens; identical to SEQ ID NO: 44946
  misc_feature 1..30: note = chr17:1193094-1193124
  misc_feature 1..30: note = hypo
  source 1..30: mol_type = genomic DNA

SEQ ID NO: 65370 - DNA, 121 bp, Homo sapiens; identical to SEQ ID NO: 44947
  misc_feature 1..121: note = chr17:1387772-1387893
  misc_feature 1..121: note = hypo
  source 1..121: mol_type = genomic DNA

SEQ ID NO: 65371 - DNA, 51 bp, Homo sapiens; identical to SEQ ID NO: 44948
  misc_feature 1..51: note = chr17:1412412-1412463
  misc_feature 1..51: note = hypo
  source 1..51: mol_type = genomic DNA

SEQ ID NO: 65372 - DNA, 18 bp, Homo sapiens
  misc_feature 1..18: note = chr17:1471448-1471466
  misc_feature 1..18: note = hypo
  source 1..18: mol_type = genomic DNA
acccggccactctttcat

SEQ ID NO: 65373 - DNA, 18 bp, Homo sapiens
  misc_feature 1..18: note = chr17:1520967-1520985
  misc_feature 1..18: note = hypo
  source 1..18: mol_type = genomic DNA
agccgccacacccagccg

SEQ ID NO: 65374 - DNA, 30 bp, Homo sapiens; identical to SEQ ID NO: 44951
  misc_feature 1..30: note = chr17:1536225-1536255
  misc_feature 1..30: note = hypo
  source 1..30: mol_type = genomic DNA

SEQ ID NO: 65375 - DNA, 49 bp, Homo sapiens; identical to SEQ ID NO: 44952
  misc_feature 1..49: note = chr17:1543917-1543966
  misc_feature 1..49: note = hypo
  source 1..49: mol_type = genomic DNA

SEQ ID NO: 65376 - DNA, 30 bp, Homo sapiens; identical to SEQ ID NO: 44953
  misc_feature 1..30: note = chr17:1544312-1544342
  misc_feature 1..30: note = hypo
  source 1..30: mol_type = genomic DNA

SEQ ID NO: 65377 - DNA, 16 bp, Homo sapiens
  misc_feature 1..16: note = chr17:1545305-1545321
  misc_feature 1..16: note = hypo
  source 1..16: mol_type = genomic DNA
gcgcccagccagggat

SEQ ID NO: 65378 - skipped

SEQ ID NO: 65379 - DNA, 30 bp, Homo sapiens; identical to SEQ ID NO: 44957
  misc_feature 1..30: note = chr17:1819565-1819595
  misc_feature 1..30: note = hypo
  source 1..30: mol_type = genomic DNA

SEQ ID NO: 65380 - DNA, 30 bp, Homo sapiens; identical to SEQ ID NO: 44961
  misc_feature 1..30: note = chr17:2264699-2264729
  misc_feature 1..30: note = hypo
  source 1..30: mol_type = genomic DNA

SEQ ID NO: 65381 - DNA, 126 bp, Homo sapiens; identical to SEQ ID NO: 44962
  misc_feature 1..126: note = chr17:2298883-2299009
  misc_feature 1..126: note = hypo
  source 1..126: mol_type = genomic DNA

SEQ ID NO: 65382 - DNA, 33 bp, Homo sapiens; identical to SEQ ID NO: 44963
  misc_feature 1..33: note = chr17:2495626-2495659
  misc_feature 1..33: note = hypo
  source 1..33: mol_type = genomic DNA

SEQ ID NO: 65383 - DNA, 30 bp, Homo sapiens; identical to SEQ ID NO: 44964
  misc_feature 1..30: note = chr17:2634361-2634391
  misc_feature 1..30: note = hypo
  source 1..30: mol_type = genomic DNA

SEQ ID NO: 65384 - DNA, 30 bp, Homo sapiens; identical to SEQ ID NO: 44965
  misc_feature 1..30: note = chr17:2859488-2859518
  misc_feature 1..30: note = hypo
  source 1..30: mol_type = genomic DNA

SEQ ID NO: 65385 - DNA, 30 bp, Homo sapiens; identical to SEQ ID NO: 44966
  misc_feature 1..30: note = chr17:3541079-3541109
  misc_feature 1..30: note = hypo
  source 1..30: mol_type = genomic DNA

SEQ ID NO: 65386 - DNA, 30 bp, Homo sapiens; identical to SEQ ID NO: 44968
  misc_feature 1..30: note = chr17:3686152-3686182
  misc_feature 1..30: note = hypo
  source 1..30: mol_type = genomic DNA

SEQ ID NO: 65387 - DNA, 191 bp, Homo sapiens; identical to SEQ ID NO: 44969
  misc_feature 1..191: note = chr17:3741605-3741796
  misc_feature 1..191: note = hypo
  source 1..191: mol_type = genomic DNA

SEQ ID NO: 65388 - DNA, 30 bp, Homo sapiens; identical to SEQ ID NO: 44970
  misc_feature 1..30: note = chr17:3792191-3792221
  misc_feature 1..30: note = hypo
  source 1..30: mol_type = genomic DNA

SEQ ID NO: 65389 - DNA, 39 bp, Homo sapiens; identical to SEQ ID NO: 16163
  misc_feature 1..39: note = chr17:4236673-4236712
  misc_feature 1..39: note = hypo
  source 1..39: mol_type = genomic DNA

SEQ ID NO: 65390 - DNA, 30 bp, Homo sapiens; identical to SEQ ID NO: 44972
  misc_feature 1..30: note = chr17:4446308-4446338
  misc_feature 1..30: note = hypo
  source 1..30: mol_type = genomic DNA

SEQ ID NO: 65391 - DNA, 21 bp, Homo sapiens
  misc_feature 1..21: note = chr17:4976841-4976862
  misc_feature 1..21: note = hypo
  source 1..21: mol_type = genomic DNA
gtgtaataaagcagacggtgg

SEQ ID NO: 65392 - DNA, 20 bp, Homo sapiens
  misc_feature 1..20: note = chr17:5320631-5320651
  misc_feature 1..20: note = hypo
  source 1..20: mol_type = genomic DNA
aagtaaatagccaggcgtgg

SEQ ID NO: 65393 - DNA, 120 bp, Homo sapiens; identical to SEQ ID NO: 44976
  misc_feature 1..120: note = chr17:5320771-5320891
  misc_feature 1..120: note = hypo
  source 1..120: mol_type = genomic DNA

SEQ ID NO: 65394 - DNA, 98 bp, Homo sapiens; identical to SEQ ID NO: 44977
  misc_feature 1..98: note = chr17:7047830-7047928
  misc_feature 1..98: note = hypo
  source 1..98: mol_type = genomic DNA

SEQ ID NO: 65395 - DNA, 30 bp, Homo sapiens; identical to SEQ ID NO: 44978
  misc_feature 1..30: note = chr17:7107670-7107700
  misc_feature 1..30: note = hypo
  source 1..30: mol_type = genomic DNA

SEQ ID NO: 65396 - DNA, 30 bp, Homo sapiens; identical to SEQ ID NO: 44979
  misc_feature 1..30: note = chr17:7156905-7156935
  misc_feature 1..30: note = hypo
  source 1..30: mol_type = genomic DNA

SEQ ID NO: 65397 - DNA, 153 bp, Homo sapiens; identical to SEQ ID NO: 44981
  misc_feature 1..153: note = chr17:7466711-7466864
  misc_feature 1..153: note = hypo
  source 1..153: mol_type = genomic DNA

SEQ ID NO: 65398 - DNA, 30 bp, Homo sapiens; identical to SEQ ID NO: 44982
  misc_feature 1..30: note = chr17:7727283-7727313
  misc_feature 1..30: note = hypo
  source 1..30: mol_type = genomic DNA

SEQ ID NO: 65399 - DNA, 25 bp, Homo sapiens
  misc_feature 1..25: note = chr17:7856920-7856945
  misc_feature 1..25: note = hypo
  source 1..25: mol_type = genomic DNA
ccgctcacctcgtgctttgcagtcc

SEQ ID NO: 65400 - DNA, 225 bp, Homo sapiens; identical to SEQ ID NO: 44984
  misc_feature 1..225: note = chr17:8104414-8104639
  misc_feature 1..225: note = hypo
  source 1..225: mol_type = genomic DNA

SEQ ID NO: 65401 - DNA, 23 bp, Homo sapiens
  misc_feature 1..23: note = chr17:8104911-8104934
  misc_feature 1..23: note = hypo
  source 1..23: mol_type = genomic DNA
tataggctgaaaggccgggcgcg

SEQ ID NO: 65402 - DNA, 25 bp, Homo sapiens
  misc_feature 1..25: note = chr17:8123524-8123549
  misc_feature 1..25: note = hypo
  source 1..25: mol_type = genomic DNA
cccatcccaccggttttgtttttca

SEQ ID NO: 65403 - DNA, 30 bp, Homo sapiens; identical to SEQ ID NO: 44987
  misc_feature 1..30: note = chr17:8287729-8287759
  misc_feature 1..30: note = hypo
  source 1..30: mol_type = genomic DNA

SEQ ID NO: 65404 - DNA, 149 bp, Homo sapiens; identical to SEQ ID NO: 44988
  misc_feature 1..149: note = chr17:8296142-8296291
  misc_feature 1..149: note = hypo
  source 1..149: mol_type = genomic DNA

SEQ ID NO: 65405 - DNA, 228 bp, Homo sapiens; identical to SEQ ID NO: 44989
  misc_feature 1..228: note = chr17:8384676-8384904
  misc_feature 1..228: note = hypo
  source 1..228: mol_type = genomic DNA

SEQ ID NO: 65406 - DNA, 18 bp, Homo sapiens
  misc_feature 1..18: note = chr17:8464515-8464533
  misc_feature 1..18: note = hypo
  source 1..18: mol_type = genomic DNA
ggggcctctcctctccgg

SEQ ID NO: 65407 - DNA, 30 bp, Homo sapiens; identical to SEQ ID NO: 44991
  misc_feature 1..30: note = chr17:8572387-8572417
  misc_feature 1..30: note = hypo
  source 1..30: mol_type = genomic DNA

SEQ ID NO: 65408 - DNA, 30 bp, Homo sapiens; identical to SEQ ID NO: 44992
  misc_feature 1..30: note = chr17:8732186-8732216
  misc_feature 1..30: note = hypo
  source 1..30: mol_type = genomic DNA

SEQ ID NO: 65409 - DNA, 38 bp, Homo sapiens; identical to SEQ ID NO: 44993
  misc_feature 1..38: note = chr17:8789494-8789532
  misc_feature 1..38: note = hypo
  source 1..38: mol_type = genomic DNA

SEQ ID NO: 65410 - DNA, 30 bp, Homo sapiens; identical to SEQ ID NO: 44994
  misc_feature 1..30: note = chr17:8789780-8789810
  misc_feature 1..30: note = hypo
  source 1..30: mol_type = genomic DNA

SEQ ID NO: 65411 - DNA, 36 bp, Homo sapiens; identical to SEQ ID NO: 44995
  misc_feature 1..36: note = chr17:9808139-9808175
  misc_feature 1..36: note = hypo
  source 1..36: mol_type = genomic DNA

SEQ ID NO: 65412 - DNA, 137 bp, Homo sapiens; identical to SEQ ID NO: 44996
  misc_feature 1..137: note = chr17:9810182-9810319
  misc_feature 1..137: note = hypo
  source 1..137: mol_type = genomic DNA

SEQ ID NO: 65413 - DNA, 194 bp, Homo sapiens; identical to SEQ ID NO: 44997
  misc_feature 1..194: note = chr17:10212814-10213008
  misc_feature 1..194: note = hypo
  source 1..194: mol_type = genomic DNA

SEQ ID NO: 65414 - DNA, 30 bp, Homo sapiens; identical to SEQ ID NO: 16169
  misc_feature 1..30: note = chr17:11572707-11572737
  misc_feature 1..30: note = hypo
  source 1..30: mol_type = genomic DNA

SEQ ID NO: 65415 - DNA, 165 bp, Homo sapiens; identical to SEQ ID NO: 44999
  misc_feature 1..165: note = chr17:11637555-11637720
  misc_feature 1..165: note = hypo
  source 1..165: mol_type = genomic DNA

SEQ ID NO: 65416 - DNA, 144 bp, Homo sapiens; identical to SEQ ID NO: 45000
  misc_feature 1..144: note = chr17:11672360-11672504
  misc_feature 1..144: note = hypo
  source 1..144: mol_type = genomic DNA

SEQ ID NO: 65417 - DNA, 24 bp, Homo sapiens
  misc_feature 1..24: note = chr17:15702893-15702917
  misc_feature 1..24: note = hypo
  source 1..24: mol_type = genomic DNA
gattacaggcgtgagccaccgcgc

SEQ ID NO: 65418 - DNA, 24 bp, Homo sapiens
  misc_feature 1..24: note = chr17:16120077-16120101
  misc_feature 1..24: note = hypo
  source 1..24: mol_type = genomic DNA
cagcctgggcgacagagcctctca

SEQ ID NO: 65419 - DNA, 30 bp, Homo sapiens; identical to SEQ ID NO: 16171
  misc_feature 1..30: note = chr17:16282207-16282237
  misc_feature 1..30: note = hypo
  source 1..30: mol_type = genomic DNA

SEQ ID NO: 65420 - DNA, 85 bp, Homo sapiens; identical to SEQ ID NO: 45004
  misc_feature 1..85: note = chr17:16282438-16282523
  misc_feature 1..85: note = hypo
  source 1..85: mol_type = genomic DNA

SEQ ID NO: 65421 - DNA, 41 bp, Homo sapiens
  misc_feature 1..41: note = chr17:17123922-17123963
  misc_feature 1..41: note = hypo
  source 1..41: mol_type = genomic DNA
tgcccagcacacctgcgtttccagctctcacaaaggcttcg

SEQ ID NO: 65422 - DNA, 30 bp, Homo sapiens; identical to SEQ ID NO: 45006
  misc_feature 1..30: note = chr17:17146203-17146233
  misc_feature 1..30: note = hypo
  source 1..30: mol_type = genomic DNA

SEQ ID NO: 65423 - DNA, 77 bp, Homo sapiens; identical to SEQ ID NO: 45007
  misc_feature 1..77: note = chr17:17395970-17396047
  misc_feature 1..77: note = hypo
  source 1..77: mol_type = genomic DNA

SEQ ID NO: 65424 - DNA, 187 bp, Homo sapiens; identical to SEQ ID NO: 16172
  misc_feature 1..187: note = chr17:17579341-17579528
  misc_feature 1..187: note = hypo
  source 1..187: mol_type = genomic DNA

SEQ ID NO: 65425 - DNA, 39 bp, Homo sapiens; identical to SEQ ID NO: 45009
  misc_feature 1..39: note = chr17:17592178-17592217
  misc_feature 1..39: note = hypo
  source 1..39: mol_type = genomic DNA

SEQ ID NO: 65426 - DNA, 108 bp, Homo sapiens; identical to SEQ ID NO: 45010
  misc_feature 1..108: note = chr17:17891258-17891366
  misc_feature 1..108: note = hypo
  source 1..108: mol_type = genomic DNA

SEQ ID NO: 65427 - DNA, 40 bp, Homo sapiens; identical to SEQ ID NO: 45011
  misc_feature 1..40: note = chr17:17910311-17910351
  misc_feature 1..40: note = hypo
  source 1..40: mol_type = genomic DNA

SEQ ID NO: 65428 - DNA, 38 bp, Homo sapiens; identical to SEQ ID NO: 45012
  misc_feature 1..38: note = chr17:18070928-18070966
  misc_feature 1..38: note = hypo
  source 1..38: mol_type = genomic DNA

SEQ ID NO: 65429 - DNA, 29 bp, Homo sapiens
  misc_feature 1..29: note = chr17:18163325-18163354
  misc_feature 1..29: note = hypo
  source 1..29: mol_type = genomic DNA
tgttcaagggggctcgccctggctgacac

SEQ ID NO: 65430 - DNA, 21 bp, Homo sapiens
  misc_feature 1..21: note = chr17:18272614-18272635
  misc_feature 1..21: note = hypo
  source 1..21: mol_type = genomic DNA
tttttgagaaagtctcgatct

SEQ ID NO: 65431 - DNA, 34 bp, Homo sapiens; identical to SEQ ID NO: 45015
  misc_feature 1..34: note = chr17:19230161-19230195
  misc_feature 1..34: note = hypo
  source 1..34: mol_type = genomic DNA

SEQ ID NO: 65432 - DNA, 179 bp, Homo sapiens; identical to SEQ ID NO: 45016
  misc_feature 1..179: note = chr17:19622428-19622607
  misc_feature 1..179: note = hypo
  source 1..179: mol_type = genomic DNA

SEQ ID NO: 65433 - DNA, 89 bp, Homo sapiens; identical to SEQ ID NO: 45017
  misc_feature 1..89: note = chr17:19769823-19769912
  misc_feature 1..89: note = hypo
  source 1..89: mol_type = genomic DNA

SEQ ID NO: 65434 - DNA, 118 bp, Homo sapiens; identical to SEQ ID NO: 45018
  misc_feature 1..118: note = chr17:19771594-19771712
  misc_feature 1..118: note = hypo
  source 1..118: mol_type = genomic DNA

SEQ ID NO: 65435 - DNA, 30 bp, Homo sapiens; identical to SEQ ID NO: 45019
  misc_feature 1..30: note = chr17:20008410-20008440
  misc_feature 1..30: note = hypo
  source 1..30: mol_type = genomic DNA

SEQ ID NO: 65436 - DNA, 162 bp, Homo sapiens; identical to SEQ ID NO: 45020
  misc_feature 1..162: note = chr17:20771807-20771969
  misc_feature 1..162: note = hypo
  source 1..162: mol_type = genomic DNA

SEQ ID NO: 65437 - DNA, 30 bp, Homo sapiens; identical to SEQ ID NO: 45021
  misc_feature 1..30: note = chr17:20773688-20773718
  misc_feature 1..30: note = hypo
  source 1..30: mol_type = genomic DNA

SEQ ID NO: 65438 - DNA, 102 bp, Homo sapiens; identical to SEQ ID NO: 45022
  misc_feature 1..102: note = chr17:20813557-20813659
  misc_feature 1..102: note = hypo
  source 1..102: mol_type = genomic DNA

SEQ ID NO: 65439 - DNA, 38 bp, Homo sapiens; identical to SEQ ID NO: 45023
  misc_feature 1..38: note = chr17:20817586-20817624
  misc_feature 1..38: note = hypo
  source 1..38: mol_type = genomic DNA

SEQ ID NO: 65440 - DNA, 70 bp, Homo sapiens; identical to SEQ ID NO: 45024
  misc_feature 1..70: note = chr17:21104001-21104071
  misc_feature 1..70: note = hypo
  source 1..70: mol_type = genomic DNA

SEQ ID NO: 65441 - DNA, 53 bp, Homo sapiens; identical to SEQ ID NO: 16179
  misc_feature 1..53: note = chr17:21147486-21147539
  misc_feature 1..53: note = hypo
  source 1..53: mol_type = genomic DNA

SEQ ID NO: 65442 - DNA, 30 bp, Homo sapiens; identical to SEQ ID NO: 45026
  misc_feature 1..30: note = chr17:21150794-21150824
  misc_feature 1..30: note = hypo
  source 1..30: mol_type = genomic DNA

SEQ ID NO: 65443 - DNA, 27 bp, Homo sapiens
  misc_feature 1..27: note = chr17:21168792-21168819
  misc_feature 1..27: note = hypo
  source 1..27: mol_type = genomic DNA
acctgaggctcttaacgattctctgga

SEQ ID NO: 65444 - DNA, 37 bp, Homo sapiens; identical to SEQ ID NO: 45028
  misc_feature 1..37: note = chr17:21860030-21860067
  misc_feature 1..37: note = hypo
  source 1..37: mol_type = genomic DNA

SEQ ID NO: 65445 - DNA, 30 bp, Homo sapiens; identical to SEQ ID NO: 45029
  misc_feature 1..30: note = chr17:25432186-25432216
  misc_feature 1..30: note = hypo
  source 1..30: mol_type = genomic DNA

SEQ ID NO: 65446 - DNA, 78 bp, Homo sapiens
  misc_feature 1..78: note = chr17:25676881-25676959
  misc_feature 1..78: note = hypo
  source 1..78: mol_type = genomic DNA
cccccgcctggtgtgcgcatgctaggggcagtgctgacacgctccactggtttcagatcaactttggagaatttggcg

SEQ ID NO: 65447 - DNA, 75 bp, Homo sapiens
  misc_feature 1..75: note = chr17:25907780-25907855
  misc_feature 1..75: note = hypo
  source 1..75: mol_type = genomic DNA
acaggctgtaaagaaatacctgaaactggattggttatttatttatttatgagacggcctggagtgcagtggcgc

SEQ ID NO: 65448 - DNA, 116 bp, Homo sapiens; identical to SEQ ID NO: 45034
  misc_feature 1..116: note = chr17:25931618-25931734
  misc_feature 1..116: note = hypo
  source 1..116: mol_type = genomic DNA

SEQ ID NO: 65449 - DNA, 30 bp, Homo sapiens; identical to SEQ ID NO: 45035
  misc_feature 1..30: note = chr17:25957285-25957315
  misc_feature 1..30: note = hypo
  source 1..30: mol_type = genomic DNA

SEQ ID NO: 65450 - DNA, 22 bp, Homo sapiens
  misc_feature 1..22: note = chr17:26927142-26927164
  misc_feature 1..22: note = hypo
  source 1..22: mol_type = genomic DNA
actggatttcaaacacgtcgta

SEQ ID NO: 65451 - DNA, 30 bp, Homo sapiens; identical to SEQ ID NO: 45038
  misc_feature 1..30: note = chr17:26961906-26961936
  misc_feature 1..30: note = hypo
  source 1..30: mol_type = genomic DNA

SEQ ID NO: 65452 - DNA, 24 bp, Homo sapiens
  misc_feature 1..24: note = chr17:27056401-27056425
  misc_feature 1..24: note = hypo
  source 1..24: mol_type = genomic DNA
ctccctctgtcaccccggctggag

SEQ ID NO: 65453 - DNA, 12 bp, Homo sapiens
  misc_feature 1..12: note = chr17:27056857-27056869
  misc_feature 1..12: note = hypo
  source 1..12: mol_type = genomic DNA
caggccagaagt

SEQ ID NO: 65454 - DNA, 30 bp, Homo sapiens; identical to SEQ ID NO: 16185
  misc_feature 1..30: note = chr17:27074858-27074888
  misc_feature 1..30: note = hypo
  source 1..30: mol_type = genomic DNA

SEQ ID NO: 65455 - DNA, 22 bp, Homo sapiens
  misc_feature 1..22: note = chr17:27081800-27081822
  misc_feature 1..22: note = hypo
  source 1..22: mol_type = genomic DNA
ttttttttcctgagacgggagt

SEQ ID NO: 65456 - DNA, 30 bp, Homo sapiens; identical to SEQ ID NO: 16187
  misc_feature 1..30: note = chr17:27411663-27411693
  misc_feature 1..30: note = hypo
  source 1..30: mol_type = genomic DNA

SEQ ID NO: 65457 - DNA, 30 bp, Homo sapiens; identical to SEQ ID NO: 45045
  misc_feature 1..30: note = chr17:27419477-27419507
  misc_feature 1..30: note = hypo
  source 1..30: mol_type = genomic DNA

SEQ ID NO: 65458 - DNA, 68 bp, Homo sapiens; identical to SEQ ID NO: 25402
  misc_feature 1..68: note = chr17:27716046-27716114
  misc_feature 1..68: note = hypo
  source 1..68: mol_type = genomic DNA

SEQ ID NO: 65459 - DNA, 102 bp, Homo sapiens
  misc_feature 1..102: note = chr17:27716220-27716322
  misc_feature 1..102: note = hypo
  source 1..102: mol_type = genomic DNA
ttttattcatgaaactcatataacaggtttatttatttcagtcgttttgttggttaaagaaccaagattttttatgactacactttgtgtacacttttaggt

SEQ ID NO: 65460 - DNA, 30 bp, Homo sapiens; identical to SEQ ID NO: 45048
  misc_feature 1..30: note = chr17:28715779-28715809
  misc_feature 1..30: note = hypo
  source 1..30: mol_type = genomic DNA

SEQ ID NO: 65461 - DNA, 17 bp, Homo sapiens
  misc_feature 1..17: note = chr17:28988919-28988936
  misc_feature 1..17: note = hypo
  source 1..17: mol_type = genomic DNA
gggtgcggtggctcacg

SEQ ID NO: 65462 - DNA, 47 bp, Homo sapiens
  misc_feature 1..47: note = chr17:30243907-30243954
  misc_feature 1..47: note = hypo
  source 1..47: mol_type = genomic DNA
ccctgggctgcgcagccccagccagcccgacccgggctcagcgaccc

SEQ ID NO: 65463 - DNA, 30 bp, Homo sapiens; identical to SEQ ID NO: 45052
  misc_feature 1..30: note = chr17:30333112-30333142
  misc_feature 1..30: note = hypo
  source 1..30: mol_type = genomic DNA

SEQ ID NO: 65464 - DNA, 39 bp, Homo sapiens
  misc_feature 1..39: note = chr17:30710888-30710927
  misc_feature 1..39: note = hypo
  source 1..39: mol_type = genomic DNA
cagcctggacaaggagtgggactccgtctcaaaaaacaa

SEQ ID NO: 65465 - DNA, 30 bp, Homo sapiens; identical to SEQ ID NO: 45054
  misc_feature 1..30: note = chr17:30822187-30822217
  misc_feature 1..30: note = hypo
  source 1..30: mol_type = genomic DNA

SEQ ID NO: 65466 - DNA, 50 bp, Homo sapiens; identical to SEQ ID NO: 45055
  misc_feature 1..50: note = chr17:30954269-30954319
  misc_feature 1..50: note = hypo
  source 1..50: mol_type = genomic DNA

SEQ ID NO: 65467 - DNA, 30 bp, Homo sapiens; identical to SEQ ID NO: 45056
  misc_feature 1..30: note = chr17:31162054-31162084
  misc_feature 1..30: note = hypo
  source 1..30: mol_type = genomic DNA

SEQ ID NO: 65468 - DNA, 155 bp, Homo sapiens; identical to SEQ ID NO: 45057
  misc_feature 1..155: note = chr17:31214020-31214175
  misc_feature 1..155: note = hypo
  source 1..155: mol_type = genomic DNA

SEQ ID NO: 65469 - DNA, 184 bp, Homo sapiens; identical to SEQ ID NO: 45058
  misc_feature 1..184: note = chr17:32237066-32237250
  misc_feature 1..184: note = hypo
  source 1..184: mol_type = genomic DNA

SEQ ID NO: 65470 - DNA, 23 bp, Homo sapiens
  misc_feature 1..23: note = chr17:32239704-32239727
  misc_feature 1..23: note = hypo
  source 1..23: mol_type = genomic DNA
attatagactagggccgggtgag

SEQ ID NO: 65471 - DNA, 30 bp, Homo sapiens; identical to SEQ ID NO: 45060
  misc_feature 1..30: note = chr17:32275435-32275465
  misc_feature 1..30: note = hypo
  source 1..30: mol_type = genomic DNA

SEQ ID NO: 65472 - DNA, 189 bp, Homo sapiens; identical to SEQ ID NO: 45063
  misc_feature 1..189: note = chr17:35061647-35061836
  misc_feature 1..189: note = hypo
  source 1..189: mol_type = genomic DNA

SEQ ID NO: 65473 - DNA, 43 bp, Homo sapiens; identical to SEQ ID NO: 45064
  misc_feature 1..43: note = chr17:37011090-37011133
  misc_feature 1..43: note = hypo
  source 1..43: mol_type = genomic DNA

SEQ ID NO: 65474 - DNA, 21 bp, Homo sapiens
  misc_feature 1..21: note = chr17:37369159-37369180
  misc_feature 1..21: note = hypo
  source 1..21: mol_type = genomic DNA
cagagcatttacccccgcacc

SEQ ID NO: 65475 - DNA, 23 bp, Homo sapiens
  misc_feature 1..23: note = chr17:37606489-37606512
  misc_feature 1..23: note = hypo
  source 1..23: mol_type = genomic DNA
actgctcccggcctcacctttcg

SEQ ID NO: 65476 - DNA, 17 bp, Homo sapiens
  misc_feature 1..17: note = chr17:37887620-37887637
  misc_feature 1..17: note = hypo
  source 1..17: mol_type = genomic DNA
cccggtgctgatggcat

SEQ ID NO: 65477 - DNA, 33 bp, Homo sapiens; identical to SEQ ID NO: 45069
  misc_feature 1..33: note = chr17:38179589-38179622
  misc_feature 1..33: note = hypo
  source 1..33: mol_type = genomic DNA

SEQ ID NO: 65478 - DNA, 17 bp, Homo sapiens
  misc_feature 1..17: note = chr17:38445245-38445262
  misc_feature 1..17: note = hypo
  source 1..17: mol_type = genomic DNA
cccggcccatttcaggt

SEQ ID NO: 65479 - DNA, 124 bp, Homo sapiens; identical to SEQ ID NO: 45072
  misc_feature 1..124: note = chr17:39768852-39768976
  misc_feature 1..124: note = hypo
  source 1..124: mol_type = genomic DNA

SEQ ID NO: 65480 - DNA, 36 bp, Homo sapiens; identical to SEQ ID NO: 45073
  misc_feature 1..36: note = chr17:39803800-39803836
  misc_feature 1..36: note = hypo
  source 1..36: mol_type = genomic DNA

SEQ ID NO: 65481 - DNA, 30 bp, Homo sapiens; identical to SEQ ID NO: 45074
  misc_feature 1..30: note = chr17:39855665-39855695
  misc_feature 1..30: note = hypo
  source 1..30: mol_type = genomic DNA

SEQ ID NO: 65482 - DNA, 23 bp, Homo sapiens
  misc_feature 1..23: note = chr17:40477866-40477889
  misc_feature 1..23: note = hypo
  source 1..23: mol_type = genomic DNA
accgcgcccggccaatcaatttc

SEQ ID NO: 65483 - DNA, 30 bp, Homo sapiens; identical to SEQ ID NO: 45076
  misc_feature 1..30: note = chr17:40705998-40706028
  misc_feature 1..30: note = hypo
  source 1..30: mol_type = genomic DNA

SEQ ID NO: 65484 - DNA, 24 bp, Homo sapiens
  misc_feature 1..24: note = chr17:40801969-40801993
  misc_feature 1..24: note = hypo
  source 1..24: mol_type = genomic DNA
ctccctctccgaaaaaaaaaaaac

SEQ ID NO: 65485 - DNA, 30 bp, Homo sapiens; identical to SEQ ID NO: 45079
  misc_feature 1..30: note = chr17:41188525-41188555
  misc_feature 1..30: note = hypo
  source 1..30: mol_type = genomic DNA

SEQ ID NO: 65486 - DNA, 56 bp, Homo sapiens
  misc_feature 1..56: note = chr17:41278565-41278621
  misc_feature 1..56: note = hypo
  source 1..56: mol_type = genomic DNA
ctttttccgtgtctccggacagctaatcgttttagtgacaggatgagagagccctt

SEQ ID NO: 65487 - skipped

SEQ ID NO: 65488 - DNA, 30 bp, Homo sapiens; identical to SEQ ID NO: 45081
  misc_feature 1..30: note = chr17:41416844-41416874
  misc_feature 1..30: note = hypo
  source 1..30: mol_type = genomic DNA

SEQ ID NO: 65489 - DNA, 193 bp, Homo sapiens; identical to SEQ ID NO: 45082
  misc_feature 1..193: note = chr17:41464759-41464952
  misc_feature 1..193: note = hypo
  source 1..193: mol_type = genomic DNA

SEQ ID NO: 65490 - DNA, 34 bp, Homo sapiens; identical to SEQ ID NO: 45083
  misc_feature 1..34: note = chr17:41957252-41957286
  misc_feature 1..34: note = hypo
  source 1..34: mol_type = genomic DNA

SEQ ID NO: 65491 - DNA, 294 bp, Homo sapiens; identical to SEQ ID NO: 45084
  misc_feature 1..294: note = chr17:42330572-42330866
  misc_feature 1..294: note = hypo
  source 1..294: mol_type = genomic DNA

SEQ ID NO: 65492 - DNA, 112 bp, Homo sapiens
  misc_feature 1..112: note = chr17:42331659-42331771
  misc_feature 1..112: note = hypo
  source 1..112: mol_type = genomic DNA
aaaaagagctctccaaattatacaacttctggtcccacaaaacctggaactgcccctggcttttcactattcctgctagtcgggagggccacacacccgcagggactagctt

SEQ ID NO: 65493 - DNA, 30 bp, Homo sapiens; identical to SEQ ID NO: 45086
  misc_feature 1..30: note = chr17:42335482-42335512
  misc_feature 1..30: note = hypo
  source 1..30: mol_type = genomic DNA

SEQ ID NO: 65494 - DNA, 41 bp, Homo sapiens; identical to SEQ ID NO: 16204
  misc_feature 1..41: note = chr17:42395128-42395169
  misc_feature 1..41: note = hypo
  source 1..41: mol_type = genomic DNA

SEQ ID NO: 65495 - DNA, 16 bp, Homo sapiens
  misc_feature 1..16: note = chr17:42401285-42401301
  misc_feature 1..16: note = hypo
  source 1..16: mol_type = genomic DNA
gcgtgagccaccgcac

SEQ ID NO: 65496 - DNA, 82 bp, Homo sapiens; identical to SEQ ID NO: 45090
  misc_feature 1..82: note = chr17:42787212-42787294
  misc_feature 1..82: note = hypo
  source 1..82: mol_type = genomic DNA

SEQ ID NO: 65497 - DNA, 30 bp, Homo sapiens; identical to SEQ ID NO: 45093
  misc_feature 1..30: note = chr17:43318029-43318059
  misc_feature 1..30: note = hypo
  source 1..30: mol_type = genomic DNA

SEQ ID NO: 65498 - DNA, 20 bp, Homo sapiens
  misc_feature 1..20: note = chr17:45268837-45268857
  misc_feature 1..20: note = hypo
  source 1..20: mol_type = genomic DNA
tacattttttttttccgaga

SEQ ID NO: 65499 - DNA, 30 bp, Homo sapiens; identical to SEQ ID NO: 45095
  misc_feature 1..30: note = chr17:45971018-45971048
  misc_feature 1..30: note = hypo
  source 1..30: mol_type = genomic DNA

SEQ ID NO: 65500 - DNA, 39 bp, Homo sapiens; identical to SEQ ID NO: 45096
  misc_feature 1..39: note = chr17:46177212-46177251
  misc_feature 1..39: note = hypo
  source 1..39: mol_type = genomic DNA

SEQ ID NO: 65501 - DNA, 116 bp, Homo sapiens; identical to SEQ ID NO: 45097
  misc_feature 1..116: note = chr17:46946208-46946324
  misc_feature 1..116: note = hypo
  source 1..116: mol_type = genomic DNA

SEQ ID NO: 65502 - DNA, 30 bp, Homo sapiens; identical to SEQ ID NO: 45098
  misc_feature 1..30: note = chr17:47170202-47170232
  misc_feature 1..30: note = hypo
  source 1..30: mol_type = genomic DNA

SEQ ID NO: 65503 - DNA, 95 bp, Homo sapiens; identical to SEQ ID NO: 45099
  misc_feature 1..95: note = chr17:47227368-47227463
  misc_feature 1..95: note = hypo
  source 1..95: mol_type = genomic DNA

SEQ ID NO: 65504 - DNA, 30 bp, Homo sapiens; identical to SEQ ID NO: 45100
  misc_feature 1..30: note = chr17:47330524-47330554
  misc_feature 1..30: note = hypo
  source 1..30: mol_type = genomic DNA

SEQ ID NO: 65505 - DNA, 30 bp, Homo sapiens; identical to SEQ ID NO: 45101
  misc_feature 1..30: note = chr17:47449030-47449060
  misc_feature 1..30: note = hypo
  source 1..30: mol_type = genomic DNA

SEQ ID NO: 65506 - DNA, 36 bp, Homo sapiens
  misc_feature 1..36: note = chr17:47657508-47657544
  misc_feature 1..36: note = hypo
  source 1..36: mol_type = genomic DNA
agaccggggttctcccggatctggatggcgccgccc

SEQ ID NO: 65507 - DNA, 11 bp, Homo sapiens
  misc_feature 1..11: note = chr17:47657583-47657594
  misc_feature 1..11: note = hypo
  source 1..11: mol_type = genomic DNA
gagcatgtgct

SEQ ID NO: 65508 - DNA, 32 bp, Homo sapiens; identical to SEQ ID NO: 16208
  misc_feature 1..32: note = chr17:47851118-47851150
  misc_feature 1..32: note = hypo
  source 1..32: mol_type = genomic DNA

SEQ ID NO: 65509 - DNA, 31 bp, Homo sapiens; identical to SEQ ID NO: 16209
  misc_feature 1..31: note = chr17:47851390-47851421
  misc_feature 1..31: note = hypo
  source 1..31: mol_type = genomic DNA

SEQ ID NO: 65510 - DNA, 30 bp, Homo sapiens; identical to SEQ ID NO: 45105
  misc_feature 1..30: note = chr17:48239531-48239561
  misc_feature 1..30: note = hypo
  source 1..30: mol_type = genomic DNA

SEQ ID NO: 65511 - DNA, 35 bp, Homo sapiens; identical to SEQ ID NO: 45106
  misc_feature 1..35: note = chr17:48611963-48611998
  misc_feature 1..35: note = hypo
  source 1..35: mol_type = genomic DNA

SEQ ID NO: 65512 - DNA, 144 bp, Homo sapiens
  misc_feature 1..144: note = chr17:48652984-48653128
  misc_feature 1..144: note = hypo
  source 1..144: mol_type = genomic DNA
ctgatgcgggagcagcgtgtgcggttcctgtccaacgccagcaccctggctagcttctctgagcccggcagctgctatgaggagctgctcaagtacctggtgtacatccttcgtaaggcagcccgcaggctggctcaggtctct

SEQ ID NO: 65513 - DNA, 266 bp, Homo sapiens
  misc_feature 1..266: note = chr17:48653158-48653424
  misc_feature 1..266: note = hypo
  source 1..266: mol_type = genomic DNA
agcagcccagcacccctcgggggccaggagacccagcccagcagcagctgctctcgctcccaccgccgcctatccgtccaccacctggtgcaccaccaccaccaccatcaccaccactaccacctgggcaatgggacgctcagggccccccgggccagcccggagatccaggacagggatgccaatgggtcccgccggctcatgctgccaccaccctcgacgcctgccctctccggggccccccctggtggcgcagagtctgtgca

SEQ ID NO: 65514 - DNA, 64 bp, Homo sapiens; identical to SEQ ID NO: 45109
  misc_feature 1..64: note = chr17:48687158-48687222
  misc_feature 1..64: note = hypo
  source 1..64: mol_type = genomic DNA

SEQ ID NO: 65515 - skipped

SEQ ID NO: 65516 - DNA, 30 bp, Homo sapiens; identical to SEQ ID NO: 45112
  misc_feature 1..30: note = chr17:51321147-51321177
  misc_feature 1..30: note = hypo
  source 1..30: mol_type = genomic DNA

SEQ ID NO: 65517 - DNA, 39 bp, Homo sapiens; identical to SEQ ID NO: 16215
  misc_feature 1..39: note = chr17:53479136-53479175
  misc_feature 1..39: note = hypo
  source 1..39: mol_type = genomic DNA

SEQ ID NO: 65518 - DNA, 40 bp, Homo sapiens; identical to SEQ ID NO: 45114
  misc_feature 1..40: note = chr17:53916938-53916978
  misc_feature 1..40: note = hypo
  source 1..40: mol_type = genomic DNA

SEQ ID NO: 65519 - DNA, 30 bp, Homo sapiens; identical to SEQ ID NO: 16216
  misc_feature 1..30: note = chr17:54473510-54473540
  misc_feature 1..30: note = hypo
  source 1..30: mol_type = genomic DNA

SEQ ID NO: 65520 - DNA, 34 bp, Homo sapiens; identical to SEQ ID NO: 5202
  misc_feature 1..34: note = chr17:55037248-55037282
  misc_feature 1..34: note = hypo
  source 1..34: mol_type = genomic DNA

SEQ ID NO: 65521 - DNA, 44 bp, Homo sapiens; identical to SEQ ID NO: 16218
  misc_feature 1..44: note = chr17:55184791-55184835
  misc_feature 1..44: note = hypo
  source 1..44: mol_type = genomic DNA

SEQ ID NO: 65522 - DNA, 181 bp, Homo sapiens; identical to SEQ ID NO: 45118
  misc_feature 1..181: note = chr17:55364048-55364229
  misc_feature 1..181: note = hypo
  source 1..181: mol_type = genomic DNA

SEQ ID NO: 65523 - DNA, 70 bp, Homo sapiens; identical to SEQ ID NO: 45119
  misc_feature 1..70: note = chr17:56031530-56031600
  misc_feature 1..70: note = hypo
  source 1..70: mol_type = genomic DNA

SEQ ID NO: 65524 - DNA, 30 bp, Homo sapiens; identical to SEQ ID NO: 45121
  misc_feature 1..30: note = chr17:57881555-57881585
  misc_feature 1..30: note = hypo
  source 1..30: mol_type = genomic DNA

SEQ ID NO: 65525 - DNA, 21 bp, Homo sapiens
  misc_feature 1..21: note = chr17:58471329-58471350
  misc_feature 1..21: note = hypo
  source 1..21: mol_type = genomic DNA
ccaccgcgccccaccaatatt

SEQ ID NO: 65526 - DNA, 110 bp, Homo sapiens; identical to SEQ ID NO: 45123
  misc_feature 1..110: note = chr17:60216644-60216754
  misc_feature 1..110: note = hypo
  source 1..110: mol_type = genomic DNA

SEQ ID NO: 65527 - DNA, 41 bp, Homo sapiens; identical to SEQ ID NO: 45124
  misc_feature 1..41: note = chr17:60221577-60221618
  misc_feature 1..41: note = hypo
  source 1..41: mol_type = genomic DNA

SEQ ID NO: 65528 - DNA, 30 bp, Homo sapiens; identical to SEQ ID NO: 45125
  misc_feature 1..30: note = chr17:60242060-60242090
  misc_feature 1..30: note = hypo
  source 1..30: mol_type = genomic DNA

SEQ ID NO: 65529 - DNA, 35 bp, Homo sapiens; identical to SEQ ID NO: 45126
  misc_feature 1..35: note = chr17:60670444-60670479
  misc_feature 1..35: note = hypo
  source 1..35: mol_type = genomic DNA

SEQ ID NO: 65530 - DNA, 54 bp, Homo sapiens; identical to SEQ ID NO: 45127
  misc_feature 1..54: note = chr17:60744566-60744620
  misc_feature 1..54: note = hypo
  source 1..54: mol_type = genomic DNA

SEQ ID NO: 65531 - DNA, 59 bp, Homo sapiens; identical to SEQ ID NO: 45128
  misc_feature 1..59: note = chr17:60766944-60767003
  misc_feature 1..59: note = hypo
  source 1..59: mol_type = genomic DNA

SEQ ID NO: 65532 - DNA, 234 bp, Homo sapiens; identical to SEQ ID NO: 45129
  misc_feature 1..234: note = chr17:60856637-60856871
  misc_feature 1..234: note = hypo
  source 1..234: mol_type = genomic DNA

SEQ ID NO: 65533 - DNA, 80 bp, Homo sapiens; identical to SEQ ID NO: 45130
  misc_feature 1..80: note = chr17:61580796-61580876
  misc_feature 1..80: note = hypo
  source 1..80: mol_type = genomic DNA

SEQ ID NO: 65534 - DNA, 19 bp, Homo sapiens
  misc_feature 1..19: note = chr17:61580936-61580955
  misc_feature 1..19: note = hypo
  source 1..19: mol_type = genomic DNA
tgcccgatcatatggtaat

SEQ ID NO: 65535 - DNA, 66 bp, Homo sapiens; identical to SEQ ID NO: 45132
  misc_feature 1..66: note = chr17:61607855-61607921
  misc_feature 1..66: note = hypo
  source 1..66: mol_type = genomic DNA

SEQ ID NO: 65536 - DNA, 30 bp, Homo sapiens; identical to SEQ ID NO: 45133
  misc_feature 1..30: note = chr17:61677509-61677539
  misc_feature 1..30: note = hypo
  source 1..30: mol_type = genomic DNA

SEQ ID NO: 65537 - DNA, 62 bp, Homo sapiens
  misc_feature 1..62: note = chr17:61817955-61818017
  misc_feature 1..62: note = hypo
  source 1..62: mol_type = genomic DNA
gctaaatgcttcatgagcagctcacaagtattatcatctctgttttacggatcaggaaattc

SEQ ID NO: 65538 - DNA, 30 bp, Homo sapiens; identical to SEQ ID NO: 45135
  misc_feature 1..30: note = chr17:61847674-61847704
  misc_feature 1..30: note = hypo
  source 1..30: mol_type = genomic DNA

SEQ ID NO: 65539 - DNA, 30 bp, Homo sapiens; identical to SEQ ID NO: 45136
  misc_feature 1..30: note = chr17:62020148-62020178
  misc_feature 1..30: note = hypo
  source 1..30: mol_type = genomic DNA

SEQ ID NO: 65540 - DNA, 16 bp, Homo sapiens
  misc_feature 1..16: note = chr17:62054818-62054834
  misc_feature 1..16: note = hypo
  source 1..16: mol_type = genomic DNA
gcgatagagcaagacc

SEQ ID NO: 65541 - DNA, 35 bp, Homo sapiens
  misc_feature 1..35: note = chr17:64672331-64672366
  misc_feature 1..35: note = hypo
  source 1..35: mol_type = genomic DNA
tcccagtaacgtgaccgggaaaatgtgagccagag

SEQ ID NO: 65542 - DNA, 14 bp, Homo sapiens
  misc_feature 1..14: note = chr17:64672544-64672558
  misc_feature 1..14: note = hypo
  source 1..14: mol_type = genomic DNA
gaggaagcagaggg

SEQ ID NO: 65543 - DNA, 30 bp, Homo sapiens; identical to SEQ ID NO: 45139
  misc_feature 1..30: note = chr17:65298508-65298538
  misc_feature 1..30: note = hypo
  source 1..30: mol_type = genomic DNA

SEQ ID NO: 65544 - DNA, 24 bp, Homo sapiens
  misc_feature 1..24: note = chr17:65789887-65789911
  misc_feature 1..24: note = hypo
  source 1..24: mol_type = genomic DNA
cccagcactttgggacgttgaggc

SEQ ID NO: 65545 - DNA, 39 bp, Homo sapiens; identical to SEQ ID NO: 45141
  misc_feature 1..39: note = chr17:66421027-66421066
  misc_feature 1..39: note = hypo
  source 1..39: mol_type = genomic DNA

SEQ ID NO: 65546 - DNA, 20 bp, Homo sapiens
  misc_feature 1..20: note = chr17:66462836-66462856
  misc_feature 1..20: note = hypo
  source 1..20: mol_type = genomic DNA
gtcaccgtgcccaaccatgt

SEQ ID NO: 65547 - DNA, 30 bp, Homo sapiens; identical to SEQ ID NO: 16224
  misc_feature 1..30: note = chr17:66643303-66643333
  misc_feature 1..30: note = hypo
  source 1..30: mol_type = genomic DNA

SEQ ID NO: 65548 - DNA, 30 bp, Homo sapiens; identical to SEQ ID NO: 45144
  misc_feature 1..30: note = chr17:66872616-66872646
  misc_feature 1..30: note = hypo
  source 1..30: mol_type = genomic DNA

SEQ ID NO: 65549 - DNA, 13 bp, Homo sapiens
  misc_feature 1..13: note = chr17:67410397-67410410
  misc_feature 1..13: note = hypo
  source 1..13: mol_type = genomic DNA
ggaaaaaaacaac

SEQ ID NO: 65550 - DNA, 24 bp, Homo sapiens
  misc_feature 1..24: note = chr17:68268160-68268184
  misc_feature 1..24: note = hypo
  source 1..24: mol_type = genomic DNA
ttaaaaaaatattgtcggccgggc

SEQ ID NO: 65551 - DNA, 38 bp, Homo sapiens; identical to SEQ ID NO: 16227
  misc_feature 1..38: note = chr17:70657503-70657541
  misc_feature 1..38: note = hypo
  source 1..38: mol_type = genomic DNA

SEQ ID NO: 65552 - DNA, 30 bp, Homo sapiens; identical to SEQ ID NO: 16228
  misc_feature 1..30: note = chr17:70712704-70712734
  misc_feature 1..30: note = hypo
  source 1..30: mol_type = genomic DNA

SEQ ID NO: 65553 - DNA, 30 bp, Homo sapiens; identical to SEQ ID NO: 45149
  misc_feature 1..30: note = chr17:71201620-71201650
  misc_feature 1..30: note = hypo
  source 1..30: mol_type = genomic DNA

SEQ ID NO: 65554 - DNA, 30 bp, Homo sapiens; identical to SEQ ID NO: 45150
  misc_feature 1..30: note = chr17:71202377-71202407
  misc_feature 1..30: note = hypo
  source 1..30: mol_type = genomic DNA

SEQ ID NO: 65555 - DNA, 30 bp, Homo sapiens; identical to SEQ ID NO: 45151
  misc_feature 1..30: note = chr17:71375377-71375407
  misc_feature 1..30: note = hypo
  source 1..30: mol_type = genomic DNA

SEQ ID NO: 65556 - DNA, 30 bp, Homo sapiens; identical to SEQ ID NO: 16229
  misc_feature 1..30: note = chr17:71391476-71391506
  misc_feature 1..30: note = hypo
  source 1..30: mol_type = genomic DNA

SEQ ID NO: 65557 - DNA, 30 bp, Homo sapiens; identical to SEQ ID NO: 45153
  misc_feature 1..30: note = chr17:71417363-71417393
  misc_feature 1..30: note = hypo
  source 1..30: mol_type = genomic DNA

SEQ ID NO: 65558 - DNA, 30 bp, Homo sapiens; identical to SEQ ID NO: 45154
  misc_feature 1..30: note = chr17:71427753-71427783
  misc_feature 1..30: note = hypo
  source 1..30: mol_type = genomic DNA

SEQ ID NO: 65559 - DNA, 30 bp, Homo sapiens; identical to SEQ ID NO: 45155
  misc_feature 1..30: note = chr17:71484009-71484039
  misc_feature 1..30: note = hypo
  source 1..30: mol_type = genomic DNA

SEQ ID NO: 65560 - DNA, 21 bp, Homo sapiens
  misc_feature 1..21: note = chr17:71879558-71879579
  misc_feature 1..21: note = hypo
  source 1..21: mol_type = genomic DNA
ctccaaaatccgaaacgctcc

SEQ ID NO: 65561 - DNA, 30 bp, Homo sapiens; identical to SEQ ID NO: 45157
  misc_feature 1..30: note = chr17:72233647-72233677
  misc_feature 1..30: note = hypo
  source 1..30: mol_type = genomic DNA

SEQ ID NO: 65562 - DNA, 119 bp, Homo sapiens; identical to SEQ ID NO: 45158
  misc_feature 1..119: note = chr17:72356210-72356329
  misc_feature 1..119: note = hypo
  source 1..119: mol_type = genomic DNA

SEQ ID NO: 65563 - DNA, 30 bp, Homo sapiens; identical to SEQ ID NO: 16232
  misc_feature 1..30: note = chr17:72370768-72370798
  misc_feature 1..30: note = hypo
  source 1..30: mol_type = genomic DNA

SEQ ID NO: 65564 - DNA, 30 bp, Homo sapiens; identical to SEQ ID NO: 45160
  misc_feature 1..30: note = chr17:72731669-72731699
  misc_feature 1..30: note = hypo
  source 1..30: mol_type = genomic DNA

SEQ ID NO: 65565 - DNA, 30 bp, Homo sapiens; identical to SEQ ID NO: 45161
  misc_feature 1..30: note = chr17:72800435-72800465
  misc_feature 1..30: note = hypo
  source 1..30: mol_type = genomic DNA

SEQ ID NO: 65566 - DNA, 30 bp, Homo sapiens; identical to SEQ ID NO: 45162
  misc_feature 1..30: note = chr17:72969610-72969640
  misc_feature 1..30: note = hypo
  source 1..30: mol_type = genomic DNA

SEQ ID NO: 65567 - DNA, 16 bp, Homo sapiens
  misc_feature 1..16: note = chr17:73031621-73031637
  misc_feature 1..16: note = hypo
  source 1..16: mol_type = genomic DNA
actccagtctctggcc

SEQ ID NO: 65568 - DNA, 26 bp, Homo sapiens
  misc_feature 1..26: note = chr17:73083437-73083463
  misc_feature 1..26: note = hypo
  source 1..26: mol_type = genomic DNA
agcgagactcccggccaactgagtac

SEQ ID NO: 65569 - DNA, 257 bp, Homo sapiens; identical to SEQ ID NO: 45165
  misc_feature 1..257: note = chr17:73089693-73089950
  misc_feature 1..257: note = hypo
  source 1..257: mol_type = genomic DNA

SEQ ID NO: 65570 - DNA, 105 bp, Homo sapiens; identical to SEQ ID NO: 45166
  misc_feature 1..105: note = chr17:73091075-73091180
  misc_feature 1..105: note = hypo
  source 1..105: mol_type = genomic DNA

SEQ ID NO: 65571 - DNA, 30 bp, Homo sapiens; identical to SEQ ID NO: 45167
  misc_feature 1..30: note = chr17:73091437-73091467
  misc_feature 1..30: note = hypo
  source 1..30: mol_type = genomic DNA

SEQ ID NO: 65572 - DNA, 30 bp, Homo sapiens; identical to SEQ ID NO: 45168
  misc_feature 1..30: note = chr17:73124882-73124912
  misc_feature 1..30: note = hypo
  source 1..30: mol_type = genomic DNA

SEQ ID NO: 65573 - DNA, 17 bp, Homo sapiens
  misc_feature 1..17: note = chr17:73135904-73135921
  misc_feature 1..17: note = hypo
  source 1..17: mol_type = genomic DNA
tccgtctcaaaaataaa

SEQ ID NO: 65574 - DNA, 41 bp, Homo sapiens; identical to SEQ ID NO: 45170
  misc_feature 1..41: note = chr17:73179823-73179864
  misc_feature 1..41: note = hypo
  source 1..41: mol_type = genomic DNA

SEQ ID NO: 65575 - DNA, 60 bp, Homo sapiens
  misc_feature 1..60: note = chr17:73585955-73586015
  misc_feature 1..60: note = hypo
  source 1..60: mol_type = genomic DNA
cccgactgcacccgacgggccttccctcgacgagagcggctccagcagtgaggcggagtt

SEQ ID NO: 65576 - DNA, 48 bp, Homo sapiens; identical to SEQ ID NO: 45172
  misc_feature 1..48: note = chr17:73592635-73592683
  misc_feature 1..48: note = hypo
  source 1..48: mol_type = genomic DNA

SEQ ID NO: 65577 - DNA, 52 bp, Homo sapiens; identical to SEQ ID NO: 45173
  misc_feature 1..52: note = chr17:73606380-73606432
  misc_feature 1..52: note = hypo
  source 1..52: mol_type = genomic DNA

SEQ ID NO: 65578 - DNA, 200 bp, Homo sapiens; identical to SEQ ID NO: 45175
  misc_feature 1..200: note = chr17:73615929-73616129
  misc_feature 1..200: note = hypo
  source 1..200: mol_type = genomic DNA

SEQ ID NO: 65579 - DNA, 30 bp, Homo sapiens; identical to SEQ ID NO: 45176
  misc_feature 1..30: note = chr17:73635801-73635831
  misc_feature 1..30: note = hypo
  source 1..30: mol_type = genomic DNA

SEQ ID NO: 65580 - skipped

SEQ ID NO: 65581 - DNA, 54 bp, Homo sapiens
  misc_feature 1..54: note = chr17:73636337-73636391
  misc_feature 1..54: note = hypo
  source 1..54: mol_type = genomic DNA
caagctgcagagactgccccaggctgagcccgtggagatcgtggccttctcagt

SEQ ID NO: 65582 - DNA, 37 bp, Homo sapiens; identical to SEQ ID NO: 16241
  misc_feature 1..37: note = chr17:73638388-73638425
  misc_feature 1..37: note = hypo
  source 1..37: mol_type = genomic DNA

SEQ ID NO: 65583 - DNA, 39 bp, Homo sapiens; identical to SEQ ID NO: 45179
  misc_feature 1..39: note = chr17:73693123-73693162
  misc_feature 1..39: note = hypo
  source 1..39: mol_type = genomic DNA

SEQ ID NO: 65584 - DNA, 30 bp, Homo sapiens; identical to SEQ ID NO: 45180
  misc_feature 1..30: note = chr17:73931814-73931844
  misc_feature 1..30: note = hypo
  source 1..30: mol_type = genomic DNA

SEQ ID NO: 65585 - DNA, 42 bp, Homo sapiens; identical to SEQ ID NO: 45181
  misc_feature 1..42: note = chr17:74005455-74005497
  misc_feature 1..42: note = hypo
  source 1..42: mol_type = genomic DNA

SEQ ID NO: 65586 - DNA, 30 bp, Homo sapiens; identical to SEQ ID NO: 45182
  misc_feature 1..30: note = chr17:74028304-74028334
  misc_feature 1..30: note = hypo
  source 1..30: mol_type = genomic DNA

SEQ ID NO: 65587 - DNA, 30 bp, Homo sapiens; identical to SEQ ID NO: 45183
  misc_feature 1..30: note = chr17:74062044-74062074
  misc_feature 1..30: note = hypo
  source 1..30: mol_type = genomic DNA

SEQ ID NO: 65588 - DNA, 165 bp, Homo sapiens; identical to SEQ ID NO: 16242
  misc_feature 1..165: note = chr17:74128189-74128354
  misc_feature 1..165: note = hypo
  source 1..165: mol_type = genomic DNA

SEQ ID NO: 65589 - DNA, 30 bp, Homo sapiens; identical to SEQ ID NO: 45185
  misc_feature 1..30: note = chr17:74362291-74362321
  misc_feature 1..30: note = hypo
  source 1..30: mol_type = genomic DNA

SEQ ID NO: 65590 - DNA, 30 bp, Homo sapiens; identical to SEQ ID NO: 16243
  misc_feature 1..30: note = chr17:74908784-74908814
  misc_feature 1..30: note = hypo
  source 1..30: mol_type = genomic DNA

SEQ ID NO: 65591 - DNA, 30 bp, Homo sapiens; identical to SEQ ID NO: 45187
  misc_feature 1..30: note = chr17:74920559-74920589
  misc_feature 1..30: note = hypo
  source 1..30: mol_type = genomic DNA

SEQ ID NO: 65592 - DNA, 178 bp, Homo sapiens; identical to SEQ ID NO: 45188
  misc_feature 1..178: note = chr17:75049797-75049975
  misc_feature 1..178: note = hypo
  source 1..178: mol_type = genomic DNA

SEQ ID NO: 65593 - DNA, 62 bp, Homo sapiens
  misc_feature 1..62: note = chr17:75523080-75523142
  misc_feature 1..62: note = hypo
  source 1..62: mol_type = genomic DNA
agtttgagaagatggcggcctgaaccggagtccttcttcccctcctccctctccgctgctgc

SEQ ID NO: 65594 - DNA, 39 bp, Homo sapiens; identical to SEQ ID NO: 45191
  misc_feature 1..39: note = chr17:75544134-75544173
  misc_feature 1..39: note = hypo
  source 1..39: mol_type = genomic DNA

SEQ ID NO: 65595 - DNA, 56 bp, Homo sapiens; identical to SEQ ID NO: 45192
  misc_feature 1..56: note = chr17:75630378-75630434
  misc_feature 1..56: note = hypo
  source 1..56: mol_type = genomic DNA

SEQ ID NO: 65596 - DNA, 11 bp, Homo sapiens
  misc_feature 1..11: note = chr17:75733967-75733978
  misc_feature 1..11: note = hypo
  source 1..11: mol_type = genomic DNA
acagagaataa

SEQ ID NO: 65597 - DNA, 33 bp, Homo sapiens; identical to SEQ ID NO: 45194
  misc_feature 1..33: note = chr17:75770731-75770764
  misc_feature 1..33: note = hypo
  source 1..33: mol_type = genomic DNA

SEQ ID NO: 65598 - DNA, 30 bp, Homo sapiens; identical to SEQ ID NO: 45195
  misc_feature 1..30: note = chr17:75840791-75840821
  misc_feature 1..30: note = hypo
  source 1..30: mol_type = genomic DNA

SEQ ID NO: 65599 - DNA, 43 bp, Homo sapiens; identical to SEQ ID NO: 45196
  misc_feature 1..43: note = chr17:75905178-75905221
  misc_feature 1..43: note = hypo
  source 1..43: mol_type = genomic DNA

SEQ ID NO: 65600 - DNA, 79 bp, Homo sapiens; identical to SEQ ID NO: 45197
  misc_feature 1..79: note = chr17:76021242-76021321
  misc_feature 1..79: note = hypo
  source 1..79: mol_type = genomic DNA

SEQ ID NO: 65601 - DNA, 41 bp, Homo sapiens; identical to SEQ ID NO: 45198
  misc_feature 1..41: note = chr17:76101087-76101128
  misc_feature 1..41: note = hypo
  source 1..41: mol_type = genomic DNA

SEQ ID NO: 65602 - DNA, 92 bp, Homo sapiens; identical to SEQ ID NO: 45199
  misc_feature 1..92: note = chr17:76134317-76134409
  misc_feature 1..92: note = hypo
  source 1..92: mol_type = genomic DNA

SEQ ID NO: 65603 - DNA, 82 bp, Homo sapiens; identical to SEQ ID NO: 45200
  misc_feature 1..82: note = chr17:76136106-76136188
  misc_feature 1..82: note = hypo
  source 1..82: mol_type = genomic DNA

SEQ ID NO: 65604 - DNA, 53 bp, Homo sapiens; identical to SEQ ID NO: 25449
  misc_feature 1..53: note = chr17:76137898-76137951
  misc_feature 1..53: note = hypo
  source 1..53: mol_type = genomic DNA

SEQ ID NO: 65605 - DNA, 38 bp, Homo sapiens; identical to SEQ ID NO: 45202
  misc_feature 1..38: note = chr17:76138696-76138734
  misc_feature 1..38: note = hypo
  source 1..38: mol_type = genomic DNA

SEQ ID NO: 65606 - DNA, 19 bp, Homo sapiens
  misc_feature 1..19: note = chr17:76146895-76146914
  misc_feature 1..19: note = hypo
  source 1..19: mol_type = genomic DNA
agcctacactccaaacggc

SEQ ID NO: 65607 - DNA, 33 bp, Homo sapiens; identical to SEQ ID NO: 45204
  misc_feature 1..33: note = chr17:76211252-76211285
  misc_feature 1..33: note = hypo
  source 1..33: mol_type = genomic DNA

SEQ ID NO: 65608 - DNA, 93 bp, Homo sapiens; identical to SEQ ID NO: 45205
  misc_feature 1..93: note = chr17:76211525-76211618
  misc_feature 1..93: note = hypo
  source 1..93: mol_type = genomic DNA

SEQ ID NO: 65609 - DNA, 18 bp, Homo sapiens
  misc_feature 1..18: note = chr17:76212036-76212054
  misc_feature 1..18: note = hypo
  source 1..18: mol_type = genomic DNA
atccttacagtgggccgg

SEQ ID NO: 65610 - DNA, 30 bp, Homo sapiens; identical to SEQ ID NO: 45207
  misc_feature 1..30: note = chr17:76217104-76217134
  misc_feature 1..30: note = hypo
  source 1..30: mol_type = genomic DNA

SEQ ID NO: 65611 - DNA, 125 bp, Homo sapiens; identical to SEQ ID NO: 45208
  misc_feature 1..125: note = chr17:76395588-76395713
  misc_feature 1..125: note = hypo
  source 1..125: mol_type = genomic DNA

SEQ ID NO: 65612 - DNA, 44 bp, Homo sapiens; identical to SEQ ID NO: 45209
  misc_feature 1..44: note = chr17:76404759-76404803
  misc_feature 1..44: note = hypo
  source 1..44: mol_type = genomic DNA

SEQ ID NO: 65613 - DNA, 30 bp, Homo sapiens; identical to SEQ ID NO: 16251
  misc_feature 1..30: note = chr17:76419409-76419439
  misc_feature 1..30: note = hypo
  source 1..30: mol_type = genomic DNA

SEQ ID NO: 65614 - DNA, 53 bp, Homo sapiens; identical to SEQ ID NO: 45211
  misc_feature 1..53: note = chr17:76498919-76498972
  misc_feature 1..53: note = hypo
  source 1..53: mol_type = genomic DNA

SEQ ID NO: 65615 - DNA, 99 bp, Homo sapiens; identical to SEQ ID NO: 45212
  misc_feature 1..99: note = chr17:76501675-76501774
  misc_feature 1..99: note = hypo
  source 1..99: mol_type = genomic DNA

SEQ ID NO: 65616 - DNA, 30 bp, Homo sapiens; identical to SEQ ID NO: 45213
  misc_feature 1..30: note = chr17:76526202-76526232
  misc_feature 1..30: note = hypo
  source 1..30: mol_type = genomic DNA

SEQ ID NO: 65617 - DNA, 66 bp, Homo sapiens; identical to SEQ ID NO: 45214
  misc_feature 1..66: note = chr17:76557445-76557511
  misc_feature 1..66: note = hypo
  source 1..66: mol_type = genomic DNA

SEQ ID NO: 65618 - DNA, 78 bp, Homo sapiens; identical to SEQ ID NO: 45215
  misc_feature 1..78: note = chr17:76670740-76670818
  misc_feature 1..78: note = hypo
  source 1..78: mol_type = genomic DNA

SEQ ID NO: 65619 - DNA, 112 bp, Homo sapiens; identical to SEQ ID NO: 45216
  misc_feature 1..112: note = chr17:76676225-76676337
  misc_feature 1..112: note = hypo
  source 1..112: mol_type = genomic DNA

SEQ ID NO: 65620 - DNA, 80 bp, Homo sapiens; identical to SEQ ID NO: 45217
  misc_feature 1..80: note = chr17:76897106-76897186
  misc_feature 1..80: note = hypo
  source 1..80: mol_type = genomic DNA

SEQ ID NO: 65621 - DNA, 33 bp, Homo sapiens; identical to SEQ ID NO: 45218
  misc_feature 1..33: note = chr17:76958740-76958773
  misc_feature 1..33: note = hypo
  source 1..33: mol_type = genomic DNA

SEQ ID NO: 65622 - DNA, 183 bp, Homo sapiens
  misc_feature 1..183: note = chr17:76974264-76974447
  misc_feature 1..183: note = hypo
  source 1..183: mol_type = genomic DNA
agggggcctggtggacggctgcaatggcatccccagagcttgtcggaaatgcagtcatggctggccttgccctagcccctctgcatgggagtctgcatgaacaagcgccctgggagctgggtgcactggctggtgagcagctttgctctgggactcgtgctcgctggcactgtgcagccaccc

SEQ ID NO: 65623 - DNA, 49 bp, Homo sapiens; identical to SEQ ID NO: 45220
  misc_feature 1..49: note = chr17:76991604-76991653
  misc_feature 1..49: note = hypo
  source 1..49: mol_type = genomic DNA

SEQ ID NO: 65624 - DNA, 30 bp, Homo sapiens; identical to SEQ ID NO: 45221
  misc_feature 1..30: note = chr17:76997571-76997601
  misc_feature 1..30: note = hypo
  source 1..30: mol_type = genomic DNA

SEQ ID NO: 65625 - DNA, 272 bp, Homo sapiens; identical to SEQ ID NO: 45222
  misc_feature 1..272: note = chr17:77002640-77002912
  misc_feature 1..272: note = hypo
  source 1..272: mol_type = genomic DNA

SEQ ID NO: 65626 - DNA, 32 bp, Homo sapiens; identical to SEQ ID NO: 45223
  misc_feature 1..32: note = chr17:77003134-77003166
  misc_feature 1..32: note = hypo
  source 1..32: mol_type = genomic DNA

SEQ ID NO: 65627 - DNA, 30 bp, Homo sapiens; identical to SEQ ID NO: 45224
  misc_feature 1..30: note = chr17:77104088-77104118
  misc_feature 1..30: note = hypo
  source 1..30: mol_type = genomic DNA

SEQ ID NO: 65628 - DNA, 35 bp, Homo sapiens
  misc_feature 1..35: note = chr17:77105020-77105055
  misc_feature 1..35: note = hypo
  source 1..35: mol_type = genomic DNA
cagctctgtcccctgcgttgaacagcgaggatgca

SEQ ID NO: 65629 - DNA, 30 bp, Homo sapiens; identical to SEQ ID NO: 45226
  misc_feature 1..30: note = chr17:77126850-77126880
  misc_feature 1..30: note = hypo
  source 1..30: mol_type = genomic DNA

SEQ ID NO: 65630 - DNA, 30 bp, Homo sapiens; identical to SEQ ID NO: 16254
  misc_feature 1..30: note = chr17:77127147-77127177
  misc_feature 1..30: note = hypo
  source 1..30: mol_type = genomic DNA

SEQ ID NO: 65631 - DNA, 72 bp, Homo sapiens; identical to SEQ ID NO: 45228
  misc_feature 1..72: note = chr17:77135878-77135950
  misc_feature 1..72: note = hypo
  source 1..72: mol_type = genomic DNA

SEQ ID NO: 65632 - DNA, 206 bp, Homo sapiens; identical to SEQ ID NO: 45229
  misc_feature 1..206: note = chr17:77143891-77144097
  misc_feature 1..206: note = hypo
  source 1..206: mol_type = genomic DNA

SEQ ID NO: 65633 - DNA, 41 bp, Homo sapiens
  misc_feature 1..41: note = chr17:77145242-77145283
  misc_feature 1..41: note = hypo
  source 1..41: mol_type = genomic DNA
aaatgcgacgtctgtgctattattgccggggttacaccagg

SEQ ID NO: 65634 - DNA, 45 bp, Homo sapiens; identical to SEQ ID NO: 45231
  misc_feature 1..45: note = chr17:77147241-77147286
  misc_feature 1..45: note = hypo
  source 1..45: mol_type = genomic DNA

SEQ ID NO: 65635 - DNA, 30 bp, Homo sapiens; identical to SEQ ID NO: 45232
  misc_feature 1..30: note = chr17:77174895-77174925
  misc_feature 1..30: note = hypo
  source 1..30: mol_type = genomic DNA

SEQ ID NO: 65636 - DNA, 30 bp, Homo sapiens; identical to SEQ ID NO: 45233
  misc_feature 1..30: note = chr17:77365458-77365488
  misc_feature 1..30: note = hypo
  source 1..30: mol_type = genomic DNA

SEQ ID NO: 65637 - DNA, 34 bp, Homo sapiens; identical to SEQ ID NO: 45234
  misc_feature 1..34: note = chr17:77390969-77391003
  misc_feature 1..34: note = hypo
  source 1..34: mol_type = genomic DNA

SEQ ID NO: 65638 - DNA, 34 bp, Homo sapiens; identical to SEQ ID NO: 45235
  misc_feature 1..34: note = chr17:77807459-77807493
  misc_feature 1..34: note = hypo
  source 1..34: mol_type = genomic DNA

SEQ ID NO: 65639 - DNA, 244 bp, Homo sapiens; identical to SEQ ID NO: 45236
  misc_feature 1..244: note = chr17:77807717-77807961
  misc_feature 1..244: note = hypo
  source 1..244: mol_type = genomic DNA

SEQ ID NO: 65640 - DNA, 78 bp, Homo sapiens; identical to SEQ ID NO: 45237
  misc_feature 1..78: note = chr17:77808479-77808557
  misc_feature 1..78: note = hypo
  source 1..78: mol_type = genomic DNA

SEQ ID NO: 65641 - DNA, 217 bp, Homo sapiens; identical to SEQ ID NO: 45238
  misc_feature 1..217: note = chr17:77825381-77825598
  misc_feature 1..217: note = hypo
  source 1..217: mol_type = genomic DNA

SEQ ID NO: 65642 - DNA, 78 bp, Homo sapiens; identical to SEQ ID NO: 16257
  misc_feature 1..78: note = chr17:77926480-77926558
  misc_feature 1..78: note = hypo
  source 1..78: mol_type = genomic DNA

SEQ ID NO: 65643 - DNA, 211 bp, Homo sapiens; identical to SEQ ID NO: 45240
  misc_feature 1..211: note = chr17:77948908-77949119
  misc_feature 1..211: note = hypo
  source 1..211: mol_type = genomic DNA

SEQ ID NO: 65644 - DNA, 57 bp, Homo sapiens; identical to SEQ ID NO: 45241
  misc_feature 1..57: note = chr17:78078914-78078971
  misc_feature 1..57: note = hypo
  source 1..57: mol_type = genomic DNA

SEQ ID NO: 65645 - DNA, 40 bp, Homo sapiens; identical to SEQ ID NO: 45242
  misc_feature 1..40: note = chr17:78083747-78083787
  misc_feature 1..40: note = hypo
  source 1..40: mol_type = genomic DNA

SEQ ID NO: 65646 - skipped

SEQ ID NO: 65647 - DNA, 63 bp, Homo sapiens; identical to SEQ ID NO: 25460
  misc_feature 1..63: note = chr17:78122190-78122253
  misc_feature 1..63: note = hypo
  source 1..63: mol_type = genomic DNA

SEQ ID NO: 65648 - DNA, 60 bp, Homo sapiens; identical to SEQ ID NO: 45244
  misc_feature 1..60: note = chr17:78151768-78151828
  misc_feature 1..60: note = hypo
  source 1..60: mol_type = genomic DNA

SEQ ID NO: 65649 - DNA, 30 bp, Homo sapiens; identical to SEQ ID NO: 45245
  misc_feature 1..30: note = chr17:78152480-78152510
  misc_feature 1..30: note = hypo
  source 1..30: mol_type = genomic DNA

SEQ ID NO: 65650 - DNA, 45 bp, Homo sapiens; identical to SEQ ID NO: 45246
  misc_feature 1..45: note = chr17:78447074-78447119
  misc_feature 1..45: note = hypo
  source 1..45: mol_type = genomic DNA

SEQ ID NO: 65651 - DNA, 92 bp, Homo sapiens; identical to SEQ ID NO: 25462
  misc_feature 1..92: note = chr17:78667900-78667992
  misc_feature 1..92: note = hypo
  source 1..92: mol_type = genomic DNA

SEQ ID NO: 65652 - DNA, 30 bp, Homo sapiens; identical to SEQ ID NO: 45249
  misc_feature 1..30: note = chr17:78820077-78820107
  misc_feature 1..30: note = hypo
  source 1..30: mol_type = genomic DNA

SEQ ID NO: 65653 - DNA, 76 bp, Homo sapiens; identical to SEQ ID NO: 45250
  misc_feature 1..76: note = chr17:78872638-78872714
  misc_feature 1..76: note = hypo
  source 1..76: mol_type = genomic DNA

SEQ ID NO: 65654 - DNA, 101 bp, Homo sapiens; identical to SEQ ID NO: 45251
  misc_feature 1..101: note = chr17:78975561-78975662
  misc_feature 1..101: note = hypo
  source 1..101: mol_type = genomic DNA

SEQ ID NO: 65655 - DNA, 30 bp, Homo sapiens; identical to SEQ ID NO: 45252
  misc_feature 1..30: note = chr17:79001034-79001064
  misc_feature 1..30: note = hypo
  source 1..30: mol_type = genomic DNA

SEQ ID NO: 65656 - DNA, 30 bp, Homo sapiens; identical to SEQ ID NO: 45253
  misc_feature 1..30: note = chr17:79066768-79066798
  misc_feature 1..30: note = hypo
  source 1..30: mol_type = genomic DNA

SEQ ID NO: 65657 - DNA, 215 bp, Homo sapiens
  misc_feature 1..215: note = chr17:79093967-79094182
  misc_feature 1..215: note = hypo
  source 1..215: mol_type = genomic DNA
gccccgggcagaccccgggtggcggcggcccacctggtcaaagaggtagacggtgacgtcgtcgaagaaggacacggccttcttcttgcgttccaggtcctcgcagaaggtctcggacagcaggctgggcatcttgagcaggctgcgcaggttgcgcgcgctctggctctcagccaccaccacgggcaccgccggcgcctcctcttcgctgtcct

SEQ ID NO: 65658 - DNA, 236 bp, Homo sapiens
  misc_feature 1..236: note = chr17:79094245-79094481
  misc_feature 1..236: note = hypo
  source 1..236: mol_type = genomic DNA
cctcctcctcctcctccggccggccctccaaggccgcagggaggccgggcagagccaggcggagtggggctctgggggtgcctgggccccccatccgcttttgtggggccggccctgacaacagtcctgggggcccctggaactcagagctgttgccttctgatctcagcggaaccggggtcagcaggaaaaactgggagcagctggggctgggcccaggccgcaccttggctggg

SEQ ID NO: 65659 - DNA, 46 bp, Homo sapiens; identical to SEQ ID NO: 45255
  misc_feature 1..46: note = chr17:79094742-79094788
  misc_feature 1..46: note = hypo
  source 1..46: mol_type = genomic DNA

SEQ ID NO: 65660 - DNA, 35 bp, Homo sapiens; identical to SEQ ID NO: 16262
  misc_feature 1..35: note = chr17:79096981-79097016
  misc_feature 1..35: note = hypo
  source 1..35: mol_type = genomic DNA

SEQ ID NO: 65661 - DNA, 48 bp, Homo sapiens; identical to SEQ ID NO: 45257
  misc_feature 1..48: note = chr17:79098155-79098203
  misc_feature 1..48: note = hypo
  source 1..48: mol_type = genomic DNA

SEQ ID NO: 65662-65663 - skipped (2 entries)

SEQ ID NO: 65664 - DNA, 75 bp, Homo sapiens; identical to SEQ ID NO: 45259
  misc_feature 1..75: note = chr17:79100184-79100259
  misc_feature 1..75: note = hypo
  source 1..75: mol_type = genomic DNA

SEQ ID NO: 65665 - DNA, 120 bp, Homo sapiens; identical to SEQ ID NO: 45260
  misc_feature 1..120: note = chr17:79104885-79105005
  misc_feature 1..120: note = hypo
  source 1..120: mol_type = genomic DNA

SEQ ID NO: 65666 - DNA, 30 bp, Homo sapiens; identical to SEQ ID NO: 16265
  misc_feature 1..30: note = chr17:79107633-79107663
  misc_feature 1..30: note = hypo
  source 1..30: mol_type = genomic DNA

SEQ ID NO: 65667 - DNA, 149 bp, Homo sapiens; identical to SEQ ID NO: 45262
  misc_feature 1..149: note = chr17:79158112-79158261
  misc_feature 1..149: note = hypo
  source 1..149: mol_type = genomic DNA

SEQ ID NO: 65668 - DNA, 125 bp, Homo sapiens; identical to SEQ ID NO: 45263
  misc_feature 1..125: note = chr17:79211706-79211831
  misc_feature 1..125: note = hypo
  source 1..125: mol_type = genomic DNA

SEQ ID NO: 65669 - DNA, 30 bp, Homo sapiens; identical to SEQ ID NO: 45264
  misc_feature 1..30: note = chr17:79226304-79226334
  misc_feature 1..30: note = hypo
  source 1..30: mol_type = genomic DNA

SEQ ID NO: 65670 - DNA, 17 bp, Homo sapiens
  misc_feature 1..17: note = chr17:79292579-79292596
  misc_feature 1..17: note = hypo
  source 1..17: mol_type = genomic DNA
ggccgggcatggtggcg

SEQ ID NO: 65671 - DNA, 30 bp, Homo sapiens; identical to SEQ ID NO: 45266
  misc_feature 1..30: note = chr17:79505417-79505447
  misc_feature 1..30: note = hypo
  source 1..30: mol_type = genomic DNA

SEQ ID NO: 65672 - DNA, 30 bp, Homo sapiens; identical to SEQ ID NO: 45267
  misc_feature 1..30: note = chr17:79544264-79544294
  misc_feature 1..30: note = hypo
  source 1..30: mol_type = genomic DNA

SEQ ID NO: 65673 - DNA, 48 bp, Homo sapiens; identical to SEQ ID NO: 16267
  misc_feature 1..48: note = chr17:79609256-79609304
  misc_feature 1..48: note = hypo
  source 1..48: mol_type = genomic DNA

SEQ ID NO: 65674 - DNA, 161 bp, Homo sapiens; identical to SEQ ID NO: 45269
  misc_feature 1..161: note = chr17:79619136-79619297
  misc_feature 1..161: note = hypo
  source 1..161: mol_type = genomic DNA

SEQ ID NO: 65675 - DNA, 102 bp, Homo sapiens; identical to SEQ ID NO: 45270
  misc_feature 1..102: note = chr17:79626311-79626413
  misc_feature 1..102: note = hypo
  source 1..102: mol_type = genomic DNA

SEQ ID NO: 65676 - DNA, 30 bp, Homo sapiens; identical to SEQ ID NO: 45271
  misc_feature 1..30: note = chr17:79643888-79643918
  misc_feature 1..30: note = hypo
  source 1..30: mol_type = genomic DNA

SEQ ID NO: 65677 - DNA, 145 bp, Homo sapiens; identical to SEQ ID NO: 45272
  misc_feature 1..145: note = chr17:79668589-79668734
  misc_feature 1..145: note = hypo
  source 1..145: mol_type = genomic DNA

SEQ ID NO: 65678 - DNA, 22 bp, Homo sapiens
  misc_feature 1..22: note = chr17:79695451-79695473
  misc_feature 1..22: note = hypo
  source 1..22: mol_type = genomic DNA
gagccaccgcacctggccagct

SEQ ID NO: 65679 - DNA, 69 bp, Homo sapiens
  misc_feature 1..69: note = chr17:79769364-79769433
  misc_feature 1..69: note = hypo
  source 1..69: mol_type = genomic DNA
gggctgctcaggacccgctacagccagaaaattggcgacgacctcagtgtcagcacctggctcagtgat

SEQ ID NO: 65680 - DNA, 30 bp, Homo sapiens; identical to SEQ ID NO: 16269
  misc_feature 1..30: note = chr17:79774960-79774990
  misc_feature 1..30: note = hypo
  source 1..30: mol_type = genomic DNA

SEQ ID NO: 65681 - DNA, 30 bp, Homo sapiens; identical to SEQ ID NO: 16270
  misc_feature 1..30: note = chr17:79847763-79847793
  misc_feature 1..30: note = hypo
  source 1..30: mol_type = genomic DNA

SEQ ID NO: 65682 - DNA, 86 bp, Homo sapiens; identical to SEQ ID NO: 45277
  misc_feature 1..86: note = chr17:79870436-79870522
  misc_feature 1..86: note = hypo
  source 1..86: mol_type = genomic DNA

SEQ ID NO: 65683 - DNA, 173 bp, Homo sapiens; identical to SEQ ID NO: 16272
  misc_feature 1..173: note = chr17:79874854-79875027
  misc_feature 1..173: note = hypo
  source 1..173: mol_type = genomic DNA

SEQ ID NO: 65684 - DNA, 195 bp, Homo sapiens; identical to SEQ ID NO: 45279
  misc_feature 1..195: note = chr17:79887606-79887801
  misc_feature 1..195: note = hypo
  source 1..195: mol_type = genomic DNA

SEQ ID NO: 65685 - DNA, 23 bp, Homo sapiens
  misc_feature 1..23: note = chr17:79913143-79913166
  misc_feature 1..23: note = hypo
  source 1..23: mol_type = genomic DNA
actgcgcccggcctacaagacct

SEQ ID NO: 65686 - DNA, 30 bp, Homo sapiens; identical to SEQ ID NO: 45281
  misc_feature 1..30: note = chr17:80163670-80163700
  misc_feature 1..30: note = hypo
  source 1..30: mol_type = genomic DNA

SEQ ID NO: 65687 - DNA, 30 bp, Homo sapiens; identical to SEQ ID NO: 45282
  misc_feature 1..30: note = chr17:80201941-80201971
  misc_feature 1..30: note = hypo
  source 1..30: mol_type = genomic DNA

SEQ ID NO: 65688 - DNA, 44 bp, Homo sapiens; identical to SEQ ID NO: 45283
  misc_feature 1..44: note = chr17:80229940-80229984
  misc_feature 1..44: note = hypo
  source 1..44: mol_type = genomic DNA

SEQ ID NO: 65689 - DNA, 82 bp, Homo sapiens; identical to SEQ ID NO: 45284
  misc_feature 1..82: note = chr17:80251922-80252004
  misc_feature 1..82: note = hypo
  source 1..82: mol_type = genomic DNA

SEQ ID NO: 65690 - skipped

SEQ ID NO: 65691 - DNA, 40 bp, Homo sapiens
  misc_feature 1..40: note = chr17:80254296-80254336
  misc_feature 1..40: note = hypo
  source 1..40: mol_type = genomic DNA
cgttgacggacacttaggcgagttccgtaccttgattgca

SEQ ID NO: 65692 - DNA, 49 bp, Homo sapiens; identical to SEQ ID NO: 45286
  misc_feature 1..49: note = chr17:80281082-80281131
  misc_feature 1..49: note = hypo
  source 1..49: mol_type = genomic DNA

SEQ ID NO: 65693 - DNA, 111 bp, Homo sapiens
  misc_feature 1..111: note = chr17:80289310-80289421
  misc_feature 1..111: note = hypo
  source 1..111: mol_type = genomic DNA
caggcccctctcaggtcaccaggcacatctggtcacatctgagtctcagataaacaaccaatgatgtcctggtgaaagcttgtcccgtgggacactcgggacacacttata

SEQ ID NO: 65694 - DNA, 28 bp, Homo sapiens
  misc_feature 1..28: note = chr17:80294427-80294455
  misc_feature 1..28: note = hypo
  source 1..28: mol_type = genomic DNA
ctgggattacaggcgtgagccactgtgc

SEQ ID NO: 65695 - DNA, 135 bp, Homo sapiens; identical to SEQ ID NO: 45289
  misc_feature 1..135: note = chr17:80300182-80300317
  misc_feature 1..135: note = hypo
  source 1..135: mol_type = genomic DNA

SEQ ID NO: 65696 - DNA, 151 bp, Homo sapiens; identical to SEQ ID NO: 45290
  misc_feature 1..151: note = chr17:80338743-80338894
  misc_feature 1..151: note = hypo
  source 1..151: mol_type = genomic DNA

SEQ ID NO: 65697 - DNA, 34 bp, Homo sapiens; identical to SEQ ID NO: 45291
  misc_feature 1..34: note = chr17:80448159-80448193
  misc_feature 1..34: note = hypo
  source 1..34: mol_type = genomic DNA

SEQ ID NO: 65698 - DNA, 209 bp, Homo sapiens; identical to SEQ ID NO: 45293
  misc_feature 1..209: note = chr17:80518148-80518357
  misc_feature 1..209: note = hypo
  source 1..209: mol_type = genomic DNA

SEQ ID NO: 65699 - DNA, 130 bp, Homo sapiens
  misc_feature 1..130: note = chr17:80655013-80655143
  misc_feature 1..130: note = hypo
  source 1..130: mol_type = genomic DNA
atctcagctgctcccccaaactctgcccattcctcaccccgtcccctaagctgaggtgtggccgggcacctgagtcccaccccacgctccacagtctcaggccaccccctccagccgtgccacactccct

SEQ ID NO: 65700 - DNA, 16 bp, Homo sapiens
  misc_feature 1..16: note = chr17:80692834-80692850
  misc_feature 1..16: note = hypo
  source 1..16: mol_type = genomic DNA
gcgccactgcactgca

SEQ ID NO: 65701 - DNA, 30 bp, Homo sapiens; identical to SEQ ID NO: 45296
  misc_feature 1..30: note = chr17:80747022-80747052
  misc_feature 1..30: note = hypo
  source 1..30: mol_type = genomic DNA

SEQ ID NO: 65702 - DNA, 40 bp, Homo sapiens; identical to SEQ ID NO: 45297
  misc_feature 1..40: note = chr17:80772901-80772941
  misc_feature 1..40: note = hypo
  source 1..40: mol_type = genomic DNA

SEQ ID NO: 65703 - DNA, 375 bp, Homo sapiens; identical to SEQ ID NO: 25479
  misc_feature 1..375: note = chr17:80798345-80798720
  misc_feature 1..375: note = hypo
  source 1..375: mol_type = genomic DNA

SEQ ID NO: 65704 - DNA, 233 bp, Homo sapiens
  misc_feature 1..233: note = chr17:80832479-80832712
  misc_feature 1..233: note = hypo
  source 1..233: mol_type = genomic DNA
gtcaggcttgtccaacgggttcttagagaacctgggccccatccctccttggcccacgcagactccaggcatccggccgggcgggctgtgagtcaggctgcaccaggtgagcgtgtgggatgctgctggtgcgagcctccctgcccaggagccctgcgcacccgggtatcggttggggtgtgcccttccagatctccctcccttggtttgtcataggtgaccacattttaatt

SEQ ID NO: 65705 - DNA, 30 bp, Homo sapiens; identical to SEQ ID NO: 45300
  misc_feature 1..30: note = chr17:80882906-80882936
  misc_feature 1..30: note = hypo
  source 1..30: mol_type = genomic DNA

SEQ ID NO: 65706 - DNA, 50 bp, Homo sapiens; identical to SEQ ID NO: 45301
  misc_feature 1..50: note = chr17:80972320-80972370
  misc_feature 1..50: note = hypo
  source 1..50: mol_type = genomic DNA

SEQ ID NO: 65707 - DNA, 59 bp, Homo sapiens
  misc_feature 1..59: note = chr17:81008826-81008885
  misc_feature 1..59: note = hypo
  source 1..59: mol_type = genomic DNA
tgggcaagtgtgccgggaatgtgtgacggcagacgtgtggggtgcgaggttgtgtgggg

SEQ ID NO: 65708 - DNA, 166 bp, Homo sapiens; identical to SEQ ID NO: 45303
  misc_feature 1..166: note = chr17:81015300-81015466
  misc_feature 1..166: note = hypo
  source 1..166: mol_type = genomic DNA

SEQ ID NO: 65709 - DNA, 30 bp, Homo sapiens; identical to SEQ ID NO: 45304
  misc_feature 1..30: note = chr17:81015900-81015930
  misc_feature 1..30: note = hypo
  source 1..30: mol_type = genomic DNA

SEQ ID NO: 65710 - DNA, 30 bp, Homo sapiens; identical to SEQ ID NO: 45305
  misc_feature 1..30: note = chr17:81021226-81021256
  misc_feature 1..30: note = hypo
  source 1..30: mol_type = genomic DNA

SEQ ID NO: 65711 - DNA, 30 bp, Homo sapiens; identical to SEQ ID NO: 45306
  misc_feature 1..30: note = chr17:81024242-81024272
  misc_feature 1..30: note = hypo
  source 1..30: mol_type = genomic DNA

SEQ ID NO: 65712 - DNA, 98 bp, Homo sapiens; identical to SEQ ID NO: 45308
  misc_feature 1..98: note = chr17:81043026-81043124
  misc_feature 1..98: note = hypo
  source 1..98: mol_type = genomic DNA

SEQ ID NO: 65713 - DNA, 32 bp, Homo sapiens; identical to SEQ ID NO: 45309
  misc_feature 1..32: note = chr17:81047925-81047957
  misc_feature 1..32: note = hypo
  source 1..32: mol_type = genomic DNA

SEQ ID NO: 65714 - DNA, 58 bp, Homo sapiens; identical to SEQ ID NO: 16285
  misc_feature 1..58: note = chr17:81048783-81048841
  misc_feature 1..58: note = hypo
  source 1..58: mol_type = genomic DNA

SEQ ID NO: 65715 - DNA, 147 bp, Homo sapiens; identical to SEQ ID NO: 45311
  misc_feature 1..147: note = chr17:81050193-81050340
  misc_feature 1..147: note = hypo
  source 1..147: mol_type = genomic DNA

SEQ ID NO: 65716 - DNA, 48 bp, Homo sapiens; identical to SEQ ID NO: 45312
  misc_feature 1..48: note = chr17:81050936-81050984
  misc_feature 1..48: note = hypo
  source 1..48: mol_type = genomic DNA

SEQ ID NO: 65717 - DNA, 69 bp, Homo sapiens; identical to SEQ ID NO: 45313
  misc_feature 1..69: note = chr17:81062099-81062168
  misc_feature 1..69: note = hypo
  source 1..69: mol_type = genomic DNA

SEQ ID NO: 65718 - DNA, 55 bp, Homo sapiens; identical to SEQ ID NO: 45314
  misc_feature 1..55: note = chr17:81065766-81065821
  misc_feature 1..55: note = hypo
  source 1..55: mol_type = genomic DNA

SEQ ID NO: 65719 - DNA, 30 bp, Homo sapiens; identical to SEQ ID NO: 45315
  misc_feature 1..30: note = chr17:81068659-81068689
  misc_feature 1..30: note = hypo
  source 1..30: mol_type = genomic DNA

SEQ ID NO: 65720 - DNA, 82 bp, Homo sapiens; identical to SEQ ID NO: 45316
  misc_feature 1..82: note = chr17:81076347-81076429
  misc_feature 1..82: note = hypo
  source 1..82: mol_type = genomic DNA

SEQ ID NO: 65721 - DNA, 23 bp, Homo sapiens
  misc_feature 1..23: note = chr17:81081890-81081913
  misc_feature 1..23: note = hypo
  source 1..23: mol_type = genomic DNA
gggcgacgctcagggcggccgtg

SEQ ID NO: 65722 - DNA, 38 bp, Homo sapiens; identical to SEQ ID NO: 45318
  misc_feature 1..38: note = chr17:81087525-81087563
  misc_feature 1..38: note = hypo
  source 1..38: mol_type = genomic DNA

SEQ ID NO: 65723 - DNA, 78 bp, Homo sapiens; identical to SEQ ID NO: 45319
  misc_feature 1..78: note = chr18:597381-597459
  misc_feature 1..78: note = hypo
  source 1..78: mol_type = genomic DNA

SEQ ID NO: 65724 - DNA, 19 bp, Homo sapiens
  misc_feature 1..19: note = chr18:1522199-1522218
  misc_feature 1..19: note = hypo
  source 1..19: mol_type = genomic DNA
agaccggagctgttcctat

SEQ ID NO: 65725 - DNA, 122 bp, Homo sapiens; identical to SEQ ID NO: 45322
  misc_feature 1..122: note = chr18:3616285-3616407
  misc_feature 1..122: note = hypo
  source 1..122: mol_type = genomic DNA

SEQ ID NO: 65726 - DNA, 86 bp, Homo sapiens; identical to SEQ ID NO: 45323
  misc_feature 1..86: note = chr18:3930506-3930592
  misc_feature 1..86: note = hypo
  source 1..86: mol_type = genomic DNA

SEQ ID NO: 65727 - DNA, 25 bp, Homo sapiens
  misc_feature 1..25: note = chr18:5133182-5133207
  misc_feature 1..25: note = hypo
  source 1..25: mol_type = genomic DNA
cagctccaccaccaccgaccacgat

SEQ ID NO: 65728 - DNA, 30 bp, Homo sapiens; identical to SEQ ID NO: 45325
  misc_feature 1..30: note = chr18:6929750-6929780
  misc_feature 1..30: note = hypo
  source 1..30: mol_type = genomic DNA

SEQ ID NO: 65729 - DNA, 97 bp, Homo sapiens; identical to SEQ ID NO: 45326
  misc_feature 1..97: note = chr18:8570976-8571073
  misc_feature 1..97: note = hypo
  source 1..97: mol_type = genomic DNA

SEQ ID NO: 65730 - DNA, 40 bp, Homo sapiens; identical to SEQ ID NO: 16294
  misc_feature 1..40: note = chr18:8845133-8845173
  misc_feature 1..40: note = hypo
  source 1..40: mol_type = genomic DNA

SEQ ID NO: 65731 - DNA, 30 bp, Homo sapiens; identical to SEQ ID NO: 45329
  misc_feature 1..30: note = chr18:9333406-9333436
  misc_feature 1..30: note = hypo
  source 1..30: mol_type = genomic DNA

SEQ ID NO: 65732 - DNA, 143 bp, Homo sapiens; identical to SEQ ID NO: 45330
  misc_feature 1..143: note = chr18:9364378-9364521
  misc_feature 1..143: note = hypo
  source 1..143: mol_type = genomic DNA

SEQ ID NO: 65733 - DNA, 30 bp, Homo sapiens; identical to SEQ ID NO: 45331
  misc_feature 1..30: note = chr18:9547786-9547816
  misc_feature 1..30: note = hypo
  source 1..30: mol_type = genomic DNA

SEQ ID NO: 65734 - DNA, 30 bp, Homo sapiens; identical to SEQ ID NO: 45332
  misc_feature 1..30: note = chr18:9737972-9738002
  misc_feature 1..30: note = hypo
  source 1..30: mol_type = genomic DNA

SEQ ID NO: 65735 - DNA, 76 bp, Homo sapiens; identical to SEQ ID NO: 45333
  misc_feature 1..76: note = chr18:9797320-9797396
  misc_feature 1..76: note = hypo
  source 1..76: mol_type = genomic DNA

SEQ ID NO: 65736 - DNA, 50 bp, Homo sapiens
  misc_feature 1..50: note = chr18:10589046-10589096
  misc_feature 1..50: note = hypo
  source 1..50: mol_type = genomic DNA
gtttctcgtgtgctccgggagtgtgagccccagcttctgctttcactgaa

SEQ ID NO: 65737 - DNA, 232 bp, Homo sapiens
  misc_feature 1..232: note = chr18:10589348-10589580
  misc_feature 1..232: note = hypo
  source 1..232: mol_type = genomic DNA
gaaggcaccgccgccgcccgccgcgggaggcttccgcggagactcagggctgcagagccagcggaggctgaaggaagagaaaggtaattttcctactcgcatatattaatttcagtaaacagataaaacaattagtaaatcaaacatataaaacagaatttttaaagaaaataatctcccaaaatatataaaagtagaatagttaaaaaaacagaaccgaatattttaatgt

SEQ ID NO: 65738 - DNA, 30 bp, Homo sapiens; identical to SEQ ID NO: 45335
  misc_feature 1..30: note = chr18:10664802-10664832
  misc_feature 1..30: note = hypo
  source 1..30: mol_type = genomic DNA

SEQ ID NO: 65739 - DNA, 36 bp, Homo sapiens; identical to SEQ ID NO: 45336
  misc_feature 1..36: note = chr18:10696324-10696360
  misc_feature 1..36: note = hypo
  source 1..36: mol_type = genomic DNA

SEQ ID NO: 65740 - DNA, 30 bp, Homo sapiens; identical to SEQ ID NO: 45337
  misc_feature 1..30: note = chr18:10832633-10832663
  misc_feature 1..30: note = hypo
  source 1..30: mol_type = genomic DNA

SEQ ID NO: 65741 - DNA, 25 bp, Homo sapiens
  misc_feature 1..25: note = chr18:10906877-10906902
  misc_feature 1..25: note = hypo
  source 1..25: mol_type = genomic DNA
tgtcttttgtcgccttcctgagccc

SEQ ID NO: 65742 - DNA, 86 bp, Homo sapiens; identical to SEQ ID NO: 45339
  misc_feature 1..86: note = chr18:11009583-11009669
  misc_feature 1..86: note = hypo
  source 1..86: mol_type = genomic DNA

SEQ ID NO: 65743 - DNA, 17 bp, Homo sapiens
  misc_feature 1..17: note = chr18:11014809-11014826
  misc_feature 1..17: note = hypo
  source 1..17: mol_type = genomic DNA
tccggggccccctcatt

SEQ ID NO: 65744 - DNA, 30 bp, Homo sapiens; identical to SEQ ID NO: 45341
  misc_feature 1..30: note = chr18:11533320-11533350
  misc_feature 1..30: note = hypo
  source 1..30: mol_type = genomic DNA

SEQ ID NO: 65745 - DNA, 30 bp, Homo sapiens; identical to SEQ ID NO: 16298
  misc_feature 1..30: note = chr18:11979044-11979074
  misc_feature 1..30: note = hypo
  source 1..30: mol_type = genomic DNA

SEQ ID NO: 65746 - DNA, 15 bp, Homo sapiens
  misc_feature 1..15: note = chr18:11979861-11979876
  misc_feature 1..15: note = hypo
  source 1..15: mol_type = genomic DNA
cggcctctgtcttaa

SEQ ID NO: 65747 - DNA, 30 bp, Homo sapiens; identical to SEQ ID NO: 45344
  misc_feature 1..30: note = chr18:11989410-11989440
  misc_feature 1..30: note = hypo
  source 1..30: mol_type = genomic DNA

SEQ ID NO: 65748 - DNA, 30 bp, Homo sapiens; identical to SEQ ID NO: 45345
  misc_feature 1..30: note = chr18:12076093-12076123
  misc_feature 1..30: note = hypo
  source 1..30: mol_type = genomic DNA

SEQ ID NO: 65749 - DNA, 120 bp, Homo sapiens; identical to SEQ ID NO: 45346
  misc_feature 1..120: note = chr18:12375353-12375473
  misc_feature 1..120: note = hypo
  source 1..120: mol_type = genomic DNA

SEQ ID NO: 65750 - DNA, 32 bp, Homo sapiens
  misc_feature 1..32: note = chr18:12376129-12376161
  misc_feature 1..32: note = hypo
  source 1..32: mol_type = genomic DNA
tccccttacagtgaagacgttgagctgactac

SEQ ID NO: 65751 - DNA, 30 bp, Homo sapiens; identical to SEQ ID NO: 16300
  misc_feature 1..30: note = chr18:12701811-12701841
  misc_feature 1..30: note = hypo
  source 1..30: mol_type = genomic DNA

SEQ ID NO: 65752 - DNA, 26 bp, Homo sapiens
  misc_feature 1..26: note = chr18:12949149-12949175
  misc_feature 1..26: note = hypo
  source 1..26: mol_type = genomic DNA
gccaccgcgcccggcctacaagcaga

SEQ ID NO: 65753 - DNA, 88 bp, Homo sapiens; identical to SEQ ID NO: 45350
  misc_feature 1..88: note = chr18:13231230-13231318
  misc_feature 1..88: note = hypo
  source 1..88: mol_type = genomic DNA

SEQ ID NO: 65754 - DNA, 30 bp, Homo sapiens; identical to SEQ ID NO: 45351
  misc_feature 1..30: note = chr18:13295972-13296002
  misc_feature 1..30: note = hypo
  source 1..30: mol_type = genomic DNA

SEQ ID NO: 65755 - DNA, 61 bp, Homo sapiens; identical to SEQ ID NO: 45352
  misc_feature 1..61: note = chr18:13319261-13319322
  misc_feature 1..61: note = hypo
  source 1..61: mol_type = genomic DNA

SEQ ID NO: 65756 - DNA, 30 bp, Homo sapiens; identical to SEQ ID NO: 45353
  misc_feature 1..30: note = chr18:13430352-13430382
  misc_feature 1..30: note = hypo
  source 1..30: mol_type = genomic DNA

SEQ ID NO: 65757 - DNA, 30 bp, Homo sapiens; identical to SEQ ID NO: 45354
  misc_feature 1..30: note = chr18:13452326-13452356
  misc_feature 1..30: note = hypo
  source 1..30: mol_type = genomic DNA

SEQ ID NO: 65758 - DNA, 111 bp, Homo sapiens; identical to SEQ ID NO: 45355
  misc_feature 1..111: note = chr18:13452723-13452834
  misc_feature 1..111: note = hypo
  source 1..111: mol_type = genomic DNA

SEQ ID NO: 65759 - DNA, 283 bp, Homo sapiens; identical to SEQ ID NO: 45356
  misc_feature 1..283: note = chr18:13461100-13461383
  misc_feature 1..283: note = hypo
  source 1..283: mol_type = genomic DNA

SEQ ID NO: 65760 - DNA, 32 bp, Homo sapiens; identical to SEQ ID NO: 45357
  misc_feature 1..32: note = chr18:13486501-13486533
  misc_feature 1..32: note = hypo
  source 1..32: mol_type = genomic DNA

SEQ ID NO: 65761 - DNA, 30 bp, Homo sapiens; identical to SEQ ID NO: 45358
  misc_feature 1..30: note = chr18:13486818-13486848
  misc_feature 1..30: note = hypo
  source 1..30: mol_type = genomic DNA

SEQ ID NO: 65762 - DNA, 85 bp, Homo sapiens; identical to SEQ ID NO: 45359
  misc_feature 1..85: note = chr18:13583740-13583825
  misc_feature 1..85: note = hypo
  source 1..85: mol_type = genomic DNA

SEQ ID NO: 65763 - DNA, 30 bp, Homo sapiens; identical to SEQ ID NO: 45360
  misc_feature 1..30: note = chr18:13603756-13603786
  misc_feature 1..30: note = hypo
  source 1..30: mol_type = genomic DNA

SEQ ID NO: 65764 - DNA, 67 bp, Homo sapiens; identical to SEQ ID NO: 45361
  misc_feature 1..67: note = chr18:13621659-13621726
  misc_feature 1..67: note = hypo
  source 1..67: mol_type = genomic DNA

SEQ ID NO: 65765 - DNA, 237 bp, Homo sapiens; identical to SEQ ID NO: 45362
  misc_feature 1..237: note = chr18:13621998-13622235
  misc_feature 1..237: note = hypo
  source 1..237: mol_type = genomic DNA

SEQ ID NO: 65766 - DNA, 60 bp, Homo sapiens
  misc_feature 1..60: note = chr18:13826333-13826393
  misc_feature 1..60: note = hypo
  source 1..60: mol_type = genomic DNA
catctccatgttcttcgctatgctgttcctcctggtgtctctgtacatacacatgttcct

SEQ ID NO: 65767 - DNA, 180 bp, Homo sapiens; identical to SEQ ID NO: 45364
  misc_feature 1..180: note = chr18:13836794-13836974
  misc_feature 1..180: note = hypo
  source 1..180: mol_type = genomic DNA

SEQ ID NO: 65768 - DNA, 59 bp, Homo sapiens; identical to SEQ ID NO: 16304
  misc_feature 1..59: note = chr18:13940522-13940581
  misc_feature 1..59: note = hypo
  source 1..59: mol_type = genomic DNA

SEQ ID NO: 65769 - DNA, 30 bp, Homo sapiens; identical to SEQ ID NO: 45366
  misc_feature 1..30: note = chr18:19243727-19243757
  misc_feature 1..30: note = hypo
  source 1..30: mol_type = genomic DNA

SEQ ID NO: 65770 - DNA, 197 bp, Homo sapiens
  misc_feature 1..197: note = chr18:20911344-20911541
  misc_feature 1..197: note = hypo
  source 1..197: mol_type = genomic DNA
gtgaaacctgccccccgccaccacctgtagtacaggagacaccacaaagcaagaggccccagggctctgctcgggaagctgccgggcctgtttttcctcccagtggccaacaaacaggagggcaggttcagcacgttgggctctgctttctgagcgccgcaccattacagcatccacatccgatttttaaaactgaa

SEQ ID NO: 65771 - DNA, 25 bp, Homo sapiens
  misc_feature 1..25: note = chr18:21168944-21168969
  misc_feature 1..25: note = hypo
  source 1..25: mol_type = genomic DNA
gctcccagcccgcttttcttttcgg

SEQ ID NO: 65772 - DNA, 40 bp, Homo sapiens; identical to SEQ ID NO: 45369
  misc_feature 1..40: note = chr18:23841433-23841473
  misc_feature 1..40: note = hypo
  source 1..40: mol_type = genomic DNA

SEQ ID NO: 65773 - DNA, 30 bp, Homo sapiens; identical to SEQ ID NO: 45370
  misc_feature 1..30: note = chr18:24465773-24465803
  misc_feature 1..30: note = hypo
  source 1..30: mol_type = genomic DNA

SEQ ID NO: 65774 - DNA, 36 bp, Homo sapiens; identical to SEQ ID NO: 45371
  misc_feature 1..36: note = chr18:25089977-25090013
  misc_feature 1..36: note = hypo
  source 1..36: mol_type = genomic DNA

SEQ ID NO: 65775 - DNA, 30 bp, Homo sapiens; identical to SEQ ID NO: 45372
  misc_feature 1..30: note = chr18:43254053-43254083
  misc_feature 1..30: note = hypo
  source 1..30: mol_type = genomic DNA

SEQ ID NO: 65776 - DNA, 45 bp, Homo sapiens; identical to SEQ ID NO: 45373
  misc_feature 1..45: note = chr18:44140380-44140425
  misc_feature 1..45: note = hypo
  source 1..45: mol_type = genomic DNA

SEQ ID NO: 65777 - DNA, 81 bp, Homo sapiens; identical to SEQ ID NO: 45374
  misc_feature 1..81: note = chr18:47344091-47344172
  misc_feature 1..81: note = hypo
  source 1..81: mol_type = genomic DNA

SEQ ID NO: 65778 - DNA, 145 bp, Homo sapiens; identical to SEQ ID NO: 45375
  misc_feature 1..145: note = chr18:48493743-48493888
  misc_feature 1..145: note = hypo
  source 1..145: mol_type = genomic DNA

SEQ ID NO: 65779 - DNA, 44 bp, Homo sapiens; identical to SEQ ID NO: 45376
  misc_feature 1..44: note = chr18:52627111-52627155
  misc_feature 1..44: note = hypo
  source 1..44: mol_type = genomic DNA

SEQ ID NO: 65780 - DNA, 103 bp, Homo sapiens; identical to SEQ ID NO: 45377
  misc_feature 1..103: note = chr18:52961793-52961896
  misc_feature 1..103: note = hypo
  source 1..103: mol_type = genomic DNA

SEQ ID NO: 65781 - DNA, 180 bp, Homo sapiens; identical to SEQ ID NO: 45378
  misc_feature 1..180: note = chr18:53074296-53074476
  misc_feature 1..180: note = hypo
  source 1..180: mol_type = genomic DNA

SEQ ID NO: 65782 - DNA, 181 bp, Homo sapiens; identical to SEQ ID NO: 16306
  misc_feature 1..181: note = chr18:53968903-53969084
  misc_feature 1..181: note = hypo
  source 1..181: mol_type = genomic DNA

SEQ ID NO: 65783 - DNA, 47 bp, Homo sapiens; identical to SEQ ID NO: 45380
  misc_feature 1..47: note = chr18:54483265-54483312
  misc_feature 1..47: note = hypo
  source 1..47: mol_type = genomic DNA

SEQ ID NO: 65784 - DNA, 30 bp, Homo sapiens; identical to SEQ ID NO: 45382
  misc_feature 1..30: note = chr18:56483562-56483592
  misc_feature 1..30: note = hypo
  source 1..30: mol_type = genomic DNA

SEQ ID NO: 65785 - DNA, 23 bp, Homo sapiens
  misc_feature 1..23: note = chr18:56816117-56816140
  misc_feature 1..23: note = hypo
  source 1..23: mol_type = genomic DNA
attacaggcgtgagccactgtgc

SEQ ID NO: 65786 - DNA, 170 bp, Homo sapiens; identical to SEQ ID NO: 45385
  misc_feature 1..170: note = chr18:57652629-57652799
  misc_feature 1..170: note = hypo
  source 1..170: mol_type = genomic DNA

SEQ ID NO: 65787 - DNA, 30 bp, Homo sapiens; identical to SEQ ID NO: 45386
  misc_feature 1..30: note = chr18:59137607-59137637
  misc_feature 1..30: note = hypo
  source 1..30: mol_type = genomic DNA

SEQ ID NO: 65788 - DNA, 30 bp, Homo sapiens; identical to SEQ ID NO: 45387
  misc_feature 1..30: note = chr18:60056441-60056471
  misc_feature 1..30: note = hypo
  source 1..30: mol_type = genomic DNA

SEQ ID NO: 65789 - DNA, 30 bp, Homo sapiens; identical to SEQ ID NO: 45388
  misc_feature 1..30: note = chr18:60557827-60557857
  misc_feature 1..30: note = hypo
  source 1..30: mol_type = genomic DNA

SEQ ID NO: 65790 - DNA, 27 bp, Homo sapiens
  misc_feature 1..27: note = chr18:60759984-60760011
  misc_feature 1..27: note = hypo
  source 1..27: mol_type = genomic DNA
acagctgccccccatcgctcacatgac

SEQ ID NO: 65791 - DNA, 31 bp, Homo sapiens; identical to SEQ ID NO: 45390
  misc_feature 1..31: note = chr18:62165289-62165320
  misc_feature 1..31: note = hypo
  source 1..31: mol_type = genomic DNA

SEQ ID NO: 65792 - DNA, 35 bp, Homo sapiens; identical to SEQ ID NO: 45391
  misc_feature 1..35: note = chr18:68051409-68051444
  misc_feature 1..35: note = hypo
  source 1..35: mol_type = genomic DNA

SEQ ID NO: 65793 - DNA, 19 bp, Homo sapiens
  misc_feature 1..19: note = chr18:68699219-68699238
  misc_feature 1..19: note = hypo
  source 1..19: mol_type = genomic DNA
ccaccggccgctcccagtg

SEQ ID NO: 65794 - DNA, 17 bp, Homo sapiens
  misc_feature 1..17: note = chr18:72263664-72263681
  misc_feature 1..17: note = hypo
  source 1..17: mol_type = genomic DNA
atgatttttttgagacg

SEQ ID NO: 65795 - DNA, 17 bp, Homo sapiens
  misc_feature 1..17: note = chr18:72263921-72263938
  misc_feature 1..17: note = hypo
  source 1..17: mol_type = genomic DNA
ggcgtaagccaccccgc

SEQ ID NO: 65796 - DNA, 30 bp, Homo sapiens; identical to SEQ ID NO: 45395
  misc_feature 1..30: note = chr18:72347499-72347529
  misc_feature 1..30: note = hypo
  source 1..30: mol_type = genomic DNA

SEQ ID NO: 65797 - DNA, 45 bp, Homo sapiens; identical to SEQ ID NO: 45396
  misc_feature 1..45: note = chr18:72896219-72896264
  misc_feature 1..45: note = hypo
  source 1..45: mol_type = genomic DNA

SEQ ID NO: 65798 - DNA, 41 bp, Homo sapiens; identical to SEQ ID NO: 45397
  misc_feature 1..41: note = chr18:74062274-74062315
  misc_feature 1..41: note = hypo
  source 1..41: mol_type = genomic DNA

SEQ ID NO: 65799 - DNA, 88 bp, Homo sapiens; identical to SEQ ID NO: 45398
  misc_feature 1..88: note = chr18:74107215-74107303
  misc_feature 1..88: note = hypo
  source 1..88: mol_type = genomic DNA

SEQ ID NO: 65800 - DNA, 38 bp, Homo sapiens; identical to SEQ ID NO: 45399
  misc_feature 1..38: note = chr18:74113912-74113950
  misc_feature 1..38: note = hypo
  source 1..38: mol_type = genomic DNA

SEQ ID NO: 65801 - DNA, 158 bp, Homo sapiens; identical to SEQ ID NO: 45400
  misc_feature 1..158: note = chr18:74114010-74114168
  misc_feature 1..158: note = hypo
  source 1..158: mol_type = genomic DNA

SEQ ID NO: 65802 - DNA, 37 bp, Homo sapiens; identical to SEQ ID NO: 45401
  misc_feature 1..37: note = chr18:74396499-74396536
  misc_feature 1..37: note = hypo
  source 1..37: mol_type = genomic DNA

SEQ ID NO: 65803 - DNA, 30 bp, Homo sapiens; identical to SEQ ID NO: 45402
  misc_feature 1..30: note = chr18:74497491-74497521
  misc_feature 1..30: note = hypo
  source 1..30: mol_type = genomic DNA

SEQ ID NO: 65804 - DNA, 76 bp, Homo sapiens; identical to SEQ ID NO: 45403
  misc_feature 1..76: note = chr18:74501216-74501292
  misc_feature 1..76: note = hypo
  source 1..76: mol_type = genomic DNA

SEQ ID NO: 65805 - DNA, 30 bp, Homo sapiens; identical to SEQ ID NO: 45404
  misc_feature 1..30: note = chr18:74504480-74504510
  misc_feature 1..30: note = hypo
  source 1..30: mol_type = genomic DNA

SEQ ID NO: 65806 - DNA, 30 bp, Homo sapiens; identical to SEQ ID NO: 45405
  misc_feature 1..30: note = chr18:74695927-74695957
  misc_feature 1..30: note = hypo
  source 1..30: mol_type = genomic DNA

SEQ ID NO: 65807 - DNA, 30 bp, Homo sapiens; identical to SEQ ID NO: 45406
  misc_feature 1..30: note = chr18:74755472-74755502
  misc_feature 1..30: note = hypo
  source 1..30: mol_type = genomic DNA

SEQ ID NO: 65808 - DNA, 32 bp, Homo sapiens; identical to SEQ ID NO: 45407
  misc_feature 1..32: note = chr18:74877184-74877216
  misc_feature 1..32: note = hypo
  source 1..32: mol_type = genomic DNA

SEQ ID NO: 65809 - DNA, 143 bp, Homo sapiens; identical to SEQ ID NO: 16311
  misc_feature 1..143: note = chr18:75229713-75229856
  misc_feature 1..143: note = hypo
  source 1..143: mol_type = genomic DNA

SEQ ID NO: 65810 - DNA, 176 bp, Homo sapiens; identical to SEQ ID NO: 45409
  misc_feature 1..176: note = chr18:75230687-75230863
  misc_feature 1..176: note = hypo
  source 1..176: mol_type = genomic DNA

SEQ ID NO: 65811 - DNA, 46 bp, Homo sapiens; identical to SEQ ID NO: 45410
  misc_feature 1..46: note = chr18:75617810-75617856
  misc_feature 1..46: note = hypo
  source 1..46: mol_type = genomic DNA

SEQ ID NO: 65812 - DNA, 30 bp, Homo sapiens; identical to SEQ ID NO: 45411
  misc_feature 1..30: note = chr18:75631688-75631718
  misc_feature 1..30: note = hypo
  source 1..30: mol_type = genomic DNA

SEQ ID NO: 65813 - DNA, 395 bp, Homo sapiens; identical to SEQ ID NO: 45412
  misc_feature 1..395: note = chr18:75998625-75999020
  misc_feature 1..395: note = hypo
  source 1..395: mol_type = genomic DNA

SEQ ID NO: 65814 - DNA, 93 bp, Homo sapiens; identical to SEQ ID NO: 45413
  misc_feature 1..93: note = chr18:76073259-76073352
  misc_feature 1..93: note = hypo
  source 1..93: mol_type = genomic DNA

SEQ ID NO: 65815 - DNA, 174 bp, Homo sapiens; identical to SEQ ID NO: 45414
  misc_feature 1..174: note = chr18:76123720-76123894
  misc_feature 1..174: note = hypo
  source 1..174: mol_type = genomic DNA

SEQ ID NO: 65816 - DNA, 172 bp, Homo sapiens; identical to SEQ ID NO: 45415
  misc_feature 1..172: note = chr18:76161408-76161580
  misc_feature 1..172: note = hypo
  source 1..172: mol_type = genomic DNA

SEQ ID NO: 65817 - DNA, 49 bp, Homo sapiens; identical to SEQ ID NO: 45416
  misc_feature 1..49: note = chr18:76189823-76189872
  misc_feature 1..49: note = hypo
  source 1..49: mol_type = genomic DNA

SEQ ID NO: 65818 - DNA, 66 bp, Homo sapiens
  misc_feature 1..66: note = chr18:76239475-76239541
  misc_feature 1..66: note = hypo
  source 1..66: mol_type = genomic DNA
gggttaaccagagtccggagtcagagaaataatttggtgtttcagggtcgcctgctgcagggcaat

SEQ ID NO: 65819 - DNA, 43 bp, Homo sapiens; identical to SEQ ID NO: 45418
  misc_feature 1..43: note = chr18:76412736-76412779
  misc_feature 1..43: note = hypo
  source 1..43: mol_type = genomic DNA

SEQ ID NO: 65820 - DNA, 94 bp, Homo sapiens; identical to SEQ ID NO: 45419
  misc_feature 1..94: note = chr18:76415372-76415466
  misc_feature 1..94: note = hypo
  source 1..94: mol_type = genomic DNA

SEQ ID NO: 65821 - DNA, 158 bp, Homo sapiens; identical to SEQ ID NO: 45420
  misc_feature 1..158: note = chr18:76477472-76477630
  misc_feature 1..158: note = hypo
  source 1..158: mol_type = genomic DNA

SEQ ID NO: 65822 - DNA, 74 bp, Homo sapiens; identical to SEQ ID NO: 45421
  misc_feature 1..74: note = chr18:76486799-76486873
  misc_feature 1..74: note = hypo
  source 1..74: mol_type = genomic DNA

SEQ ID NO: 65823 - DNA, 20 bp, Homo sapiens
  misc_feature 1..20: note = chr18:76501459-76501479
  misc_feature 1..20: note = hypo
  source 1..20: mol_type = genomic DNA
agagctcaggaagtgcggct

SEQ ID NO: 65824 - DNA, 165 bp, Homo sapiens
  misc_feature 1..165: note = chr18:76501509-76501674
  misc_feature 1..165: note = hypo
  source 1..165: mol_type = genomic DNA
ccgctgttctcaactcaccgaatgacagtaaaatcaaagccttgtatcatattcagaagattcagcgccaagactcagcatgtggcggtgtcttctttaggacgcagcagtgcgatggagaaggtagagggtaactctggcagggtgcatcggtaaccagcaaga

SEQ ID NO: 65825 - DNA, 36 bp, Homo sapiens; identical to SEQ ID NO: 45423
  misc_feature 1..36: note = chr18:76540366-76540402
  misc_feature 1..36: note = hypo
  source 1..36: mol_type = genomic DNA

SEQ ID NO: 65826 - DNA, 36 bp, Homo sapiens; identical to SEQ ID NO: 45424
  misc_feature 1..36: note = chr18:76541554-76541590
  misc_feature 1..36: note = hypo
  source 1..36: mol_type = genomic DNA

SEQ ID NO: 65827 - DNA, 33 bp, Homo sapiens; identical to SEQ ID NO: 45425
  misc_feature 1..33: note = chr18:76564667-76564700
  misc_feature 1..33: note = hypo
  source 1..33: mol_type = genomic DNA

SEQ ID NO: 65828 - DNA, 16 bp, Homo sapiens
  misc_feature 1..16: note = chr18:76571588-76571604
  misc_feature 1..16: note = hypo
  source 1..16: mol_type = genomic DNA
ccgctcatctcctgct

SEQ ID NO: 65829 - DNA, 159 bp, Homo sapiens; identical to SEQ ID NO: 45427
  misc_feature 1..159: note = chr18:76626246-76626405
  misc_feature 1..159: note = hypo
  source 1..159: mol_type = genomic DNA

SEQ ID NO: 65830 - DNA, 30 bp, Homo sapiens; identical to SEQ ID NO: 16321
  misc_feature 1..30: note = chr18:76686197-76686227
  misc_feature 1..30: note = hypo
  source 1..30: mol_type = genomic DNA

SEQ ID NO: 65831 - DNA, 68 bp, Homo sapiens
  misc_feature 1..68: note = chr18:77167756-77167824
  misc_feature 1..68: note = hypo
  source 1..68: mol_type = genomic DNA
tattgacattactgttctctctccggtgcaggagactgcgtggctcccgtcctcttgagggcatttct

SEQ ID NO: 65832 - DNA, 53 bp, Homo sapiens; identical to SEQ ID NO: 45430
  misc_feature 1..53: note = chr18:77176557-77176610
  misc_feature 1..53: note = hypo
  source 1..53: mol_type = genomic DNA

SEQ ID NO: 65833 - DNA, 86 bp, Homo sapiens
  misc_feature 1..86: note = chr18:77181269-77181355
  misc_feature 1..86: note = hypo
  source 1..86: mol_type = genomic DNA
actgttcccagaactcgagggttccctgacaccaagatgacatgtggcacagacctggaatcacgaggaaatgcccgtcctcctcc

SEQ ID NO: 65834 - DNA, 17 bp, Homo sapiens
  misc_feature 1..17: note = chr18:77181409-77181426
  misc_feature 1..17: note = hypo
  source 1..17: mol_type = genomic DNA
agcgcctggatgacgtc

SEQ ID NO: 65835 - DNA, 30 bp, Homo sapiens; identical to SEQ ID NO: 45432
  misc_feature 1..30: note = chr18:77181779-77181809
  misc_feature 1..30: note = hypo
  source 1..30: mol_type = genomic DNA

SEQ ID NO: 65836 - DNA, 290 bp, Homo sapiens; identical to SEQ ID NO: 45434
  misc_feature 1..290: note = chr18:77201979-77202269
  misc_feature 1..290: note = hypo
  source 1..290: mol_type = genomic DNA

SEQ ID NO: 65837 - DNA, 40 bp, Homo sapiens; identical to SEQ ID NO: 45435
  misc_feature 1..40: note = chr18:77203641-77203681
  misc_feature 1..40: note = hypo
  source 1..40: mol_type = genomic DNA

SEQ ID NO: 65838 - DNA, 167 bp, Homo sapiens; identical to SEQ ID NO: 45436
  misc_feature 1..167: note = chr18:77209978-77210145
  misc_feature 1..167: note = hypo
  source 1..167: mol_type = genomic DNA

SEQ ID NO: 65839 - DNA, 63 bp, Homo sapiens; identical to SEQ ID NO: 45437
  misc_feature 1..63: note = chr18:77229435-77229498
  misc_feature 1..63: note = hypo
  source 1..63: mol_type = genomic DNA

SEQ ID NO: 65840 - DNA, 30 bp, Homo sapiens; identical to SEQ ID NO: 45438
  misc_feature 1..30: note = chr18:77230030-77230060
  misc_feature 1..30: note = hypo
  source 1..30: mol_type = genomic DNA

SEQ ID NO: 65841 - DNA, 59 bp, Homo sapiens; identical to SEQ ID NO: 45439
  misc_feature 1..59: note = chr18:77236179-77236238
  misc_feature 1..59: note = hypo
  source 1..59: mol_type = genomic DNA

SEQ ID NO: 65842 - DNA, 135 bp, Homo sapiens; identical to SEQ ID NO: 45440
  misc_feature 1..135: note = chr18:77236516-77236651
  misc_feature 1..135: note = hypo
  source 1..135: mol_type = genomic DNA

SEQ ID NO: 65843 - DNA, 91 bp, Homo sapiens; identical to SEQ ID NO: 45441
  misc_feature 1..91: note = chr18:77246511-77246602
  misc_feature 1..91: note = hypo
  source 1..91: mol_type = genomic DNA

SEQ ID NO: 65844 - DNA, 38 bp, Homo sapiens; identical to SEQ ID NO: 45442
  misc_feature 1..38: note = chr18:77247301-77247339
  misc_feature 1..38: note = hypo
  source 1..38: mol_type = genomic DNA

SEQ ID NO: 65845 - DNA, 38 bp, Homo sapiens; identical to SEQ ID NO: 45443
  misc_feature 1..38: note = chr18:77271051-77271089
  misc_feature 1..38: note = hypo
  source 1..38: mol_type = genomic DNA

SEQ ID NO: 65846 - DNA, 78 bp, Homo sapiens; identical to SEQ ID NO: 45444
  misc_feature 1..78: note = chr18:77272049-77272127
  misc_feature 1..78: note = hypo
  source 1..78: mol_type = genomic DNA

SEQ ID NO: 65847 - DNA, 39 bp, Homo sapiens; identical to SEQ ID NO: 45445
  misc_feature 1..39: note = chr18:77272999-77273038
  misc_feature 1..39: note = hypo
  source 1..39: mol_type = genomic DNA

SEQ ID NO: 65848 - DNA, 27 bp, Homo sapiens
  misc_feature 1..27: note = chr18:77285870-77285897
  misc_feature 1..27: note = hypo
  source 1..27: mol_type = genomic DNA
gcaaggctgaaccagcgcagtgggaaa

SEQ ID NO: 65849 - DNA, 86 bp, Homo sapiens
  misc_feature 1..86: note = chr18:77286028-77286114
  misc_feature 1..86: note = hypo
  source 1..86: mol_type = genomic DNA
agcctagggcatttgggtggggacgtgcgacccccacacagaacagagccgtctttctctctgcgttgtgccgaggccccgcagcg

SEQ ID NO: 65850 - DNA, 55 bp, Homo sapiens; identical to SEQ ID NO: 45447
  misc_feature 1..55: note = chr18:77288237-77288292
  misc_feature 1..55: note = hypo
  source 1..55: mol_type = genomic DNA

SEQ ID NO: 65851 - DNA, 30 bp, Homo sapiens; identical to SEQ ID NO: 45448
  misc_feature 1..30: note = chr18:77290969-77290999
  misc_feature 1..30: note = hypo
  source 1..30: mol_type = genomic DNA

SEQ ID NO: 65852 - DNA, 48 bp, Homo sapiens; identical to SEQ ID NO: 45449
  misc_feature 1..48: note = chr18:77308327-77308375
  misc_feature 1..48: note = hypo
  source 1..48: mol_type = genomic DNA

SEQ ID NO: 65853 - DNA, 84 bp, Homo sapiens; identical to SEQ ID NO: 45450
  misc_feature 1..84: note = chr18:77313917-77314001
  misc_feature 1..84: note = hypo
  source 1..84: mol_type = genomic DNA

SEQ ID NO: 65854 - DNA, 188 bp, Homo sapiens; identical to SEQ ID NO: 45451
  misc_feature 1..188: note = chr18:77320324-77320512
  misc_feature 1..188: note = hypo
  source 1..188: mol_type = genomic DNA

SEQ ID NO: 65855 - DNA, 100 bp, Homo sapiens; identical to SEQ ID NO: 45453
  misc_feature 1..100: note = chr18:77357908-77358008
  misc_feature 1..100: note = hypo
  source 1..100: mol_type = genomic DNA

SEQ ID NO: 65856 - DNA, 261 bp, Homo sapiens; identical to SEQ ID NO: 45454
  misc_feature 1..261: note = chr18:77364366-77364627
  misc_feature 1..261: note = hypo
  source 1..261: mol_type = genomic DNA

SEQ ID NO: 65857 - DNA, 77 bp, Homo sapiens; identical to SEQ ID NO: 45455
  misc_feature 1..77: note = chr18:77365747-77365824
  misc_feature 1..77: note = hypo
  source 1..77: mol_type = genomic DNA

SEQ ID NO: 65858 - DNA, 30 bp, Homo sapiens; identical to SEQ ID NO: 16334
  misc_feature 1..30: note = chr18:77410108-77410138
  misc_feature 1..30: note = hypo
  source 1..30: mol_type = genomic DNA

SEQ ID NO: 65859 - DNA, 80 bp, Homo sapiens; identical to SEQ ID NO: 45457
  misc_feature 1..80: note = chr18:77509599-77509679
  misc_feature 1..80: note = hypo
  source 1..80: mol_type = genomic DNA

SEQ ID NO: 65860 - DNA, 69 bp, Homo sapiens; identical to SEQ ID NO: 45458
  misc_feature 1..69: note = chr18:77533378-77533447
  misc_feature 1..69: note = hypo
  source 1..69: mol_type = genomic DNA

SEQ ID NO: 65861 - DNA, 30 bp, Homo sapiens; identical to SEQ ID NO: 45459
  misc_feature 1..30: note = chr18:77534970-77535000
  misc_feature 1..30: note = hypo
  source 1..30: mol_type = genomic DNA

SEQ ID NO: 65862 - DNA, 46 bp, Homo sapiens; identical to SEQ ID NO: 45460
  misc_feature 1..46: note = chr18:77542905-77542951
  misc_feature 1..46: note = hypo
  source 1..46: mol_type = genomic DNA

SEQ ID NO: 65863 - DNA, 19 bp, Homo sapiens
  misc_feature 1..19: note = chr18:77543230-77543249
  misc_feature 1..19: note = hypo
  source 1..19: mol_type = genomic DNA
catccccgtgagctccgcc

SEQ ID NO: 65864 - DNA, 80 bp, Homo sapiens; identical to SEQ ID NO: 45463
  misc_feature 1..80: note = chr18:77544682-77544762
  misc_feature 1..80: note = hypo
  source 1..80: mol_type = genomic DNA

SEQ ID NO: 65865 - DNA, 110 bp, Homo sapiens
  misc_feature 1..110: note = chr18:77550096-77550206
  misc_feature 1..110: note = hypo
  source 1..110: mol_type = genomic DNA
gttcaccctgggccccggagactagtgatcccgctccccagcagagcaccgccaaaagccccgggtgccggagctgtcctgcaagaatgaacgggcaggagacacaagag

SEQ ID NO: 65866 - DNA, 63 bp, Homo sapiens
  misc_feature 1..63: note = chr18:77550367-77550430
  misc_feature 1..63: note = hypo
  source 1..63: mol_type = genomic DNA
tgtttaaaagatgagcacacaaaggactgtgcacctgccgcggagtggcgtcctctgggagaa

SEQ ID NO: 65867 - DNA, 147 bp, Homo sapiens
  misc_feature 1..147: note = chr18:77577043-77577190
  misc_feature 1..147: note = hypo
  source 1..147: mol_type = genomic DNA
gatgttacacggctgtcatacagctgtcacacggctgccactcacatgcctgtcacgtttgtcacacggctgccacatggctgtcacgcagctgccacatggatgttacacggctgtcatacagctgtcacacggctgccactcaca

SEQ ID NO: 65868 - DNA, 30 bp, Homo sapiens; identical to SEQ ID NO: 45466
  misc_feature 1..30: note = chr18:77609629-77609659
  misc_feature 1..30: note = hypo
  source 1..30: mol_type = genomic DNA

SEQ ID NO: 65869 - DNA, 40 bp, Homo sapiens; identical to SEQ ID NO: 45467
  misc_feature 1..40: note = chr18:77612204-77612244
  misc_feature 1..40: note = hypo
  source 1..40: mol_type = genomic DNA

SEQ ID NO: 65870 - DNA, 30 bp, Homo sapiens; identical to SEQ ID NO: 45468
  misc_feature 1..30: note = chr18:77622551-77622581
  misc_feature 1..30: note = hypo
  source 1..30: mol_type = genomic DNA

SEQ ID NO: 65871 - DNA, 30 bp, Homo sapiens; identical to SEQ ID NO: 45469
  misc_feature 1..30: note = chr18:77627798-77627828
  misc_feature 1..30: note = hypo
  source 1..30: mol_type = genomic DNA

SEQ ID NO: 65872 - DNA, 49 bp, Homo sapiens; identical to SEQ ID NO: 45470
  misc_feature 1..49: note = chr18:77628385-77628434
  misc_feature 1..49: note = hypo
  source 1..49: mol_type = genomic DNA

SEQ ID NO: 65873 - DNA, 30 bp, Homo sapiens; identical to SEQ ID NO: 45471
  misc_feature 1..30: note = chr18:77628965-77628995
  misc_feature 1..30: note = hypo
  source 1..30: mol_type = genomic DNA

SEQ ID NO: 65874 - DNA, 71 bp, Homo sapiens; identical to SEQ ID NO: 45472
  misc_feature 1..71: note = chr18:77631844-77631915
  misc_feature 1..71: note = hypo
  source 1..71: mol_type = genomic DNA

SEQ ID NO: 65875 - DNA, 40 bp, Homo sapiens; identical to SEQ ID NO: 45473
  misc_feature 1..40: note = chr18:77636150-77636190
  misc_feature 1..40: note = hypo
  source 1..40: mol_type = genomic DNA

SEQ ID NO: 65876 - DNA, 178 bp, Homo sapiens
  misc_feature 1..178: note = chr18:77636621-77636799
  misc_feature 1..178: note = hypo
  source 1..178: mol_type = genomic DNA
cctgtgtctgtgacgctggtgccctgagggcagggccagccccctctctcggcacagctgggtgaatcatcaacgacacccttggcaccgtgagcacttgcacctgcagaccgcctggtctcgctcttgggcaccagccgtgccaggcccgggccaccaactccgtgtccttcttgca

SEQ ID NO: 65877 - DNA, 36 bp, Homo sapiens; identical to SEQ ID NO: 45475
  misc_feature 1..36: note = chr18:77644664-77644700
  misc_feature 1..36: note = hypo
  source 1..36: mol_type = genomic DNA

SEQ ID NO: 65878 - DNA, 30 bp, Homo sapiens; identical to SEQ ID NO: 45476
  misc_feature 1..30: note = chr18:77713124-77713154
  misc_feature 1..30: note = hypo
  source 1..30: mol_type = genomic DNA

SEQ ID NO: 65879 - DNA, 115 bp, Homo sapiens; identical to SEQ ID NO: 45477
  misc_feature 1..115: note = chr19:292109-292224
  misc_feature 1..115: note = hypo
  source 1..115: mol_type = genomic DNA

SEQ ID NO: 65880 - DNA, 26 bp, Homo sapiens
  misc_feature 1..26: note = chr19:349162-349188
  misc_feature 1..26: note = hypo
  source 1..26: mol_type = genomic DNA
ataaagcaccacggatgaggtagttt

SEQ ID NO: 65881 - DNA, 118 bp, Homo sapiens; identical to SEQ ID NO: 45479
  misc_feature 1..118: note = chr19:400972-401090
  misc_feature 1..118: note = hypo
  source 1..118: mol_type = genomic DNA

SEQ ID NO: 65882 - DNA, 30 bp, Homo sapiens; identical to SEQ ID NO: 45480
  misc_feature 1..30: note = chr19:401481-401511
  misc_feature 1..30: note = hypo
  source 1..30: mol_type = genomic DNA

SEQ ID NO: 65883 - DNA, 171 bp, Homo sapiens; identical to SEQ ID NO: 25536
  misc_feature 1..171: note = chr19:403367-403538
  misc_feature 1..171: note = hypo
  source 1..171: mol_type = genomic DNA

SEQ ID NO: 65884 - DNA, 65 bp, Homo sapiens
  misc_feature 1..65: note = chr19:407124-407189
  misc_feature 1..65: note = hypo
  source 1..65: mol_type = genomic DNA
gcagctccttctccccgagcagcgtgtcccgcttgaggctgctgcccttgttcaccaccttgatc

SEQ ID NO: 65885 - DNA, 350 bp, Homo sapiens
  misc_feature 1..350: note = chr19:407320-407670
  misc_feature 1..350: note = hypo
  source 1..350: mol_type = genomic DNA
gcccacgcagcagttgatgctgcgggcgtcgcacaggcggtcgtagaggccctcggcggccagcaggtgcacccgcaggcgggcctggccggcctcgtactcggccagcagccgcacgctgccccgagggcccacgtggaccgtgtgctccccacgcgcctggcccgactcggggccaggttccgggggtgcccggcgggtcaggcggcgccggctcccggggctggcgtccggggtgctgtcgtccgcagacagggagccgtggcggcccacggagtgccggagctggctcaccttggcctggctgtcctgggcgaaacctttgagcagagacacggagcgggacagca

SEQ ID NO: 65886 - DNA, 30 bp, Homo sapiens; identical to SEQ ID NO: 45483
  misc_feature 1..30: note = chr19:413211-413241
  misc_feature 1..30: note = hypo
  source 1..30: mol_type = genomic DNA

SEQ ID NO: 65887 - DNA, 119 bp, Homo sapiens; identical to SEQ ID NO: 45484
  misc_feature 1..119: note = chr19:426860-426979
  misc_feature 1..119: note = hypo
  source 1..119: mol_type = genomic DNA

SEQ ID NO: 65888 - DNA, 38 bp, Homo sapiens
  misc_feature 1..38: note = chr19:468719-468757
  misc_feature 1..38: note = hypo
  source 1..38: mol_type = genomic DNA
cacggccccacagaccgtctgtgcacacatgctgtaca

SEQ ID NO: 65889 - DNA, 272 bp, Homo sapiens; identical to SEQ ID NO: 45486
  misc_feature 1..272: note = chr19:470863-471135
  misc_feature 1..272: note = hypo
  source 1..272: mol_type = genomic DNA

SEQ ID NO: 65890 - DNA, 216 bp, Homo sapiens; identical to SEQ ID NO: 45488
  misc_feature 1..216: note = chr19:491311-491527
  misc_feature 1..216: note = hypo
  source 1..216: mol_type = genomic DNA

SEQ ID NO: 65891 - DNA, 30 bp, Homo sapiens; identical to SEQ ID NO: 45489
  misc_feature 1..30: note = chr19:499792-499822
  misc_feature 1..30: note = hypo
  source 1..30: mol_type = genomic DNA

SEQ ID NO: 65892 - DNA, 41 bp, Homo sapiens; identical to SEQ ID NO: 45490
  misc_feature 1..41: note = chr19:508329-508370
  misc_feature 1..41: note = hypo
  source 1..41: mol_type = genomic DNA

SEQ ID NO: 65893 - DNA, 176 bp, Homo sapiens; identical to SEQ ID NO: 45491
  misc_feature 1..176: note = chr19:524057-524233
  misc_feature 1..176: note = hypo
  source 1..176: mol_type = genomic DNA

SEQ ID NO: 65894 - DNA, 224 bp, Homo sapiens; identical to SEQ ID NO: 45492
  misc_feature 1..224: note = chr19:530256-530480
  misc_feature 1..224: note = hypo
  source 1..224: mol_type = genomic DNA

SEQ ID NO: 65895 - DNA, 206 bp, Homo sapiens; identical to SEQ ID NO: 45493
  misc_feature 1..206: note = chr19:548497-548703
  misc_feature 1..206: note = hypo
  source 1..206: mol_type = genomic DNA

SEQ ID NO: 65896 - DNA, 47 bp, Homo sapiens
  misc_feature 1..47: note = chr19:549314-549361
  misc_feature 1..47: note = hypo
  source 1..47: mol_type = genomic DNA
cactggcaggggtcccgtttctcaggtgcagaaactgaggctcagac

SEQ ID NO: 65897 - DNA, 229 bp, Homo sapiens; identical to SEQ ID NO: 25542
  misc_feature 1..229: note = chr19:549451-549680
  misc_feature 1..229: note = hypo
  source 1..229: mol_type = genomic DNA

SEQ ID NO: 65898 - DNA, 111 bp, Homo sapiens; identical to SEQ ID NO: 16352
  misc_feature 1..111: note = chr19:550388-550499
  misc_feature 1..111: note = hypo
  source 1..111: mol_type = genomic DNA

SEQ ID NO: 65899 - DNA, 37 bp, Homo sapiens; identical to SEQ ID NO: 45496
  misc_feature 1..37: note = chr19:557261-557298
  misc_feature 1..37: note = hypo
  source 1..37: mol_type = genomic DNA

SEQ ID NO: 65900 - DNA, 24 bp, Homo sapiens
  misc_feature 1..24: note = chr19:558037-558061
  misc_feature 1..24: note = hypo
  source 1..24: mol_type = genomic DNA
gatgccaaggtcaggcgccgtcgc

SEQ ID NO: 65901 - DNA, 30 bp, Homo sapiens; identical to SEQ ID NO: 45498
  misc_feature 1..30: note = chr19:559762-559792
  misc_feature 1..30: note = hypo
  source 1..30: mol_type = genomic DNA

SEQ ID NO: 65902 - DNA, 140 bp, Homo sapiens; identical to SEQ ID NO: 25544
  misc_feature 1..140: note = chr19:593150-593290
  misc_feature 1..140: note = hypo
  source 1..140: mol_type = genomic DNA

SEQ ID NO: 65903 - DNA, 22 bp, Homo sapiens
  misc_feature 1..22: note = chr19:599192-599214
  misc_feature 1..22: note = hypo
  source 1..22: mol_type = genomic DNA
ctcttccttttggaccgtttcc

SEQ ID NO: 65904 - DNA, 107 bp, Homo sapiens
  misc_feature 1..107: note = chr19:599333-599440
  misc_feature 1..107: note = hypo
  source 1..107: mol_type = genomic DNA
aggtcccggcggccacgccagcgatgagctcccaggtttttctttattggtgttaactttggggagtccctccagtccctcagcatctcctccgaaaggatgtgggg

SEQ ID NO: 65905 - DNA, 46 bp, Homo sapiens; identical to SEQ ID NO: 45501
  misc_feature 1..46: note = chr19:601680-601726
  misc_feature 1..46: note = hypo
  source 1..46: mol_type = genomic DNA

SEQ ID NO: 65906 - DNA, 30 bp, Homo sapiens; identical to SEQ ID NO: 45502
  misc_feature 1..30: note = chr19:602546-602576
  misc_feature 1..30: note = hypo
  source 1..30: mol_type = genomic DNA

SEQ ID NO: 65907 - DNA, 34 bp, Homo sapiens; identical to SEQ ID NO: 45503
  misc_feature 1..34: note = chr19:623991-624025
  misc_feature 1..34: note = hypo
  source 1..34: mol_type = genomic DNA

SEQ ID NO: 65908 - DNA, 84 bp, Homo sapiens; identical to SEQ ID NO: 45504
  misc_feature 1..84: note = chr19:634304-634388
  misc_feature 1..84: note = hypo
  source 1..84: mol_type = genomic DNA

SEQ ID NO: 65909 - DNA, 30 bp, Homo sapiens; identical to SEQ ID NO: 45505
  misc_feature 1..30: note = chr19:638382-638412
  misc_feature 1..30: note = hypo
  source 1..30: mol_type = genomic DNA

SEQ ID NO: 65910 - DNA, 58 bp, Homo sapiens; identical to SEQ ID NO: 45506
  misc_feature 1..58: note = chr19:640949-641007
  misc_feature 1..58: note = hypo
  source 1..58: mol_type = genomic DNA

SEQ ID NO: 65911 - DNA, 50 bp, Homo sapiens
  misc_feature 1..50: note = chr19:690838-690888
  misc_feature 1..50: note = hypo
  source 1..50: mol_type = genomic DNA
tacaccgtccctggcaaggtgacaggccgctgcggctctgcgctggtgtg

SEQ ID NO: 65912 - DNA, 30 bp, Homo sapiens; identical to SEQ ID NO: 45508
  misc_feature 1..30: note = chr19:696867-696897
  misc_feature 1..30: note = hypo
  source 1..30: mol_type = genomic DNA

SEQ ID NO: 65913 - DNA, 33 bp, Homo sapiens; identical to SEQ ID NO: 45509
  misc_feature 1..33: note = chr19:727028-727061
  misc_feature 1..33: note = hypo
  source 1..33: mol_type = genomic DNA

SEQ ID NO: 65914 - DNA, 30 bp, Homo sapiens; identical to SEQ ID NO: 45510
  misc_feature 1..30: note = chr19:748479-748509
  misc_feature 1..30: note = hypo
  source 1..30: mol_type = genomic DNA

SEQ ID NO: 65915 - DNA, 55 bp, Homo sapiens
  misc_feature 1..55: note = chr19:752081-752136
  misc_feature 1..55: note = hypo
  source 1..55: mol_type = genomic DNA
cacttgctctgtcatcgctgtgtgacctcagatgagcaggttctcctctctgggt

SEQ ID NO: 65916 - DNA, 39 bp, Homo sapiens; identical to SEQ ID NO: 45512
  misc_feature 1..39: note = chr19:793780-793819
  misc_feature 1..39: note = hypo
  source 1..39: mol_type = genomic DNA

SEQ ID NO: 65917 - DNA, 87 bp, Homo sapiens; identical to SEQ ID NO: 45513
  misc_feature 1..87: note = chr19:814462-814549
  misc_feature 1..87: note = hypo
  source 1..87: mol_type = genomic DNA

SEQ ID NO: 65918 - DNA, 30 bp, Homo sapiens; identical to SEQ ID NO: 45514
  misc_feature 1..30: note = chr19:850011-850041
  misc_feature 1..30: note = hypo
  source 1..30: mol_type = genomic DNA

SEQ ID NO: 65919 - DNA, 42 bp, Homo sapiens; identical to SEQ ID NO: 25546
  misc_feature 1..42: note = chr19:883582-883624
  misc_feature 1..42: note = hypo
  source 1..42: mol_type = genomic DNA

SEQ ID NO: 65920 - DNA, 227 bp, Homo sapiens; identical to SEQ ID NO: 25547
  misc_feature 1..227: note = chr19:883791-884018
  misc_feature 1..227: note = hypo
  source 1..227: mol_type = genomic DNA

SEQ ID NO: 65921 - DNA, 52 bp, Homo sapiens; identical to SEQ ID NO: 25548
  misc_feature 1..52: note = chr19:884162-884214
  misc_feature 1..52: note = hypo
  source 1..52: mol_type = genomic DNA

SEQ ID NO: 65922 - DNA, 30 bp, Homo sapiens; identical to SEQ ID NO: 45516
  misc_feature 1..30: note = chr19:885082-885112
  misc_feature 1..30: note = hypo
  source 1..30: mol_type = genomic DNA

SEQ ID NO: 65923 - DNA, 41 bp, Homo sapiens; identical to SEQ ID NO: 45518
  misc_feature 1..41: note = chr19:893910-893951
  misc_feature 1..41: note = hypo
  source 1..41: mol_type = genomic DNA

SEQ ID NO: 65924 - DNA, 228 bp, Homo sapiens; identical to SEQ ID NO: 45519
  misc_feature 1..228: note = chr19:900821-901049
  misc_feature 1..228: note = hypo
  source 1..228: mol_type = genomic DNA

SEQ ID NO: 65925 - DNA, 113 bp, Homo sapiens; identical to SEQ ID NO: 45520
  misc_feature 1..113: note = chr19:945999-946112
  misc_feature 1..113: note = hypo
  source 1..113: mol_type = genomic DNA

SEQ ID NO: 65926 - DNA, 38 bp, Homo sapiens; identical to SEQ ID NO: 25550
  misc_feature 1..38: note = chr19:955719-955757
  misc_feature 1..38: note = hypo
  source 1..38: mol_type = genomic DNA

SEQ ID NO: 65927 - DNA, 315 bp, Homo sapiens
  misc_feature 1..315: note = chr19:956237-956552
  misc_feature 1..315: note = hypo
  source 1..315: mol_type = genomic DNA
ctcgtcctgtccccctctccgccctgtccccctctccgccctgcccggctcacttttgcagctgagaaaatcaaggttcaagtaacgagcatttattaggcaactgctgtgtgctcggctgattccagactctgggaacaaaacagactaaaccccagatacactcctagatccgtgactcggtgatggacggggtctcggaggaagaacgtggaggggagggggcggcagccgggccggggtcagaggacgaggccgggcgtgtggccatgtgtgcgtgcctgtgctcatgggacccaccggcccggccagccg

SEQ ID NO: 65928 - DNA, 230 bp, Homo sapiens; identical to SEQ ID NO: 45522
  misc_feature 1..230: note = chr19:957171-957401
  misc_feature 1..230: note = hypo
  source 1..230: mol_type = genomic DNA

SEQ ID NO: 65929 - DNA, 32 bp, Homo sapiens; identical to SEQ ID NO: 45523
  misc_feature 1..32: note = chr19:959587-959619
  misc_feature 1..32: note = hypo
  source 1..32: mol_type = genomic DNA

SEQ ID NO: 65930 - DNA, 65 bp, Homo sapiens; identical to SEQ ID NO: 45524
  misc_feature 1..65: note = chr19:963980-964045
  misc_feature 1..65: note = hypo
  source 1..65: mol_type = genomic DNA

SEQ ID NO: 65931 - DNA, 128 bp, Homo sapiens
  misc_feature 1..128: note = chr19:1003177-1003305
  misc_feature 1..128: note = hypo
  source 1..128: mol_type = genomic DNA
tggatgtgctggtggcggtgctgcaggcgcacgcctgggaagacgtcggcctggccctgtgccgcactcaggaccccggcggcctggtggccctctggacaagccgggctggccggcccccacagctg

SEQ ID NO: 65932 - DNA, 285 bp, Homo sapiens
  misc_feature 1..285: note = chr19:1003384-1003669
  misc_feature 1..285: note = hypo
  source 1..285: mol_type = genomic DNA
gtgaagcaccggtacccgcggcggtcctcctcggctgtgacatcgcccgtgcccgtcgggtgctggaggccgtacctcccggcccccactggctgttggggacaccactgccgcccaaggccctgcccaccgcggggctgccaccagggctgctggcgctgggcgaggtggcacgacccccgctggaggccgccatccatgacattgtgcaactggtggcccgggcgctgggcagtgcggcccaggtgcagccgaagcgagccctcctccccgccccggtcaact

SEQ ID NO: 65933 - DNA, 68 bp, Homo sapiens
  misc_feature 1..68: note = chr19:1003734-1003802
  misc_feature 1..68: note = hypo
  source 1..68: mol_type = genomic DNA
ctgcttcccttaggagggtgtccaggccactgagtctgcactgctcatggatcacaaaaggcaacgtg

SEQ ID NO: 65934 - DNA, 140 bp, Homo sapiens
  misc_feature 1..140: note = chr19:1004775-1004915
  misc_feature 1..140: note = hypo
  source 1..140: mol_type = genomic DNA
ccatttgtgtttgcccgtgatccagacgaagacgggcagtgcccagcggggcagctgtgcctggaccctggcaccaacgactcggccaccctggacgcactgttcgccgcgctggccaacggctcagcgccccgtgccct

SEQ ID NO: 65935 - DNA, 84 bp, Homo sapiens
  misc_feature 1..84: note = chr19:1030092-1030176
  misc_feature 1..84: note = hypo
  source 1..84: mol_type = genomic DNA
cctcagtgctgtctccgcggtcactagtggctggatagggacactcgaggtccccactggtgcacacccactgcccaggagcac

SEQ ID NO: 65936 - DNA, 56 bp, Homo sapiens; identical to SEQ ID NO: 45528
  misc_feature 1..56: note = chr19:1042258-1042314
  misc_feature 1..56: note = hypo
  source 1..56: mol_type = genomic DNA

SEQ ID NO: 65937 - DNA, 178 bp, Homo sapiens; identical to SEQ ID NO: 45530
  misc_feature 1..178: note = chr19:1051366-1051544
  misc_feature 1..178: note = hypo
  source 1..178: mol_type = genomic DNA

SEQ ID NO: 65938 - DNA, 32 bp, Homo sapiens; identical to SEQ ID NO: 45531
  misc_feature 1..32: note = chr19:1083719-1083751
  misc_feature 1..32: note = hypo
  source 1..32: mol_type = genomic DNA

SEQ ID NO: 65939 - DNA, 118 bp, Homo sapiens; identical to SEQ ID NO: 45532
  misc_feature 1..118: note = chr19:1085976-1086094
  misc_feature 1..118: note = hypo
  source 1..118: mol_type = genomic DNA

SEQ ID NO: 65940 - DNA, 186 bp, Homo sapiens; identical to SEQ ID NO: 45533
  misc_feature 1..186: note = chr19:1105541-1105727
  misc_feature 1..186: note = hypo
  source 1..186: mol_type = genomic DNA

SEQ ID NO: 65941 - DNA, 158 bp, Homo sapiens; identical to SEQ ID NO: 45534
  misc_feature 1..158: note = chr19:1112603-1112761
  misc_feature 1..158: note = hypo
  source 1..158: mol_type = genomic DNA

SEQ ID NO: 65942 - DNA, 25 bp, Homo sapiens
  misc_feature 1..25: note = chr19:1128398-1128423
  misc_feature 1..25: note = hypo
  source 1..25: mol_type = genomic DNA
tttttttttttgagacggattctta

SEQ ID NO: 65943 - DNA, 56 bp, Homo sapiens; identical to SEQ ID NO: 45536
  misc_feature 1..56: note = chr19:1156227-1156283
  misc_feature 1..56: note = hypo
  source 1..56: mol_type = genomic DNA

SEQ ID NO: 65944 - DNA, 60 bp, Homo sapiens; identical to SEQ ID NO: 45537
  misc_feature 1..60: note = chr19:1156568-1156628
  misc_feature 1..60: note = hypo
  source 1..60: mol_type = genomic DNA

SEQ ID NO: 65945 - DNA, 30 bp, Homo sapiens; identical to SEQ ID NO: 45538
  misc_feature 1..30: note = chr19:1167293-1167323
  misc_feature 1..30: note = hypo
  source 1..30: mol_type = genomic DNA

SEQ ID NO: 65946 - DNA, 31 bp, Homo sapiens
  misc_feature 1..31: note = chr19:1171068-1171099
  misc_feature 1..31: note = hypo
  source 1..31: mol_type = genomic DNA
cacacaacacaaacacgggtgcacaggcaca

SEQ ID NO: 65947 - DNA, 98 bp, Homo sapiens
  misc_feature 1..98: note = chr19:1171324-1171422
  misc_feature 1..98: note = hypo
  source 1..98: mol_type = genomic DNA
aagaatacacacatccatacaacacacaggcacacaacacacatgtgcatgcacatggcgcaacatacagatacacaaagacacgtgtacacacacat

SEQ ID NO: 65948 - DNA, 30 bp, Homo sapiens; identical to SEQ ID NO: 45540
  misc_feature 1..30: note = chr19:1208940-1208970
  misc_feature 1..30: note = hypo
  source 1..30: mol_type = genomic DNA

SEQ ID NO: 65949 - DNA, 92 bp, Homo sapiens; identical to SEQ ID NO: 45542
  misc_feature 1..92: note = chr19:1227516-1227608
  misc_feature 1..92: note = hypo
  source 1..92: mol_type = genomic DNA

SEQ ID NO: 65950 - DNA, 30 bp, Homo sapiens; identical to SEQ ID NO: 45543
  misc_feature 1..30: note = chr19:1234905-1234935
  misc_feature 1..30: note = hypo
  source 1..30: mol_type = genomic DNA

SEQ ID NO: 65951 - DNA, 30 bp, Homo sapiens; identical to SEQ ID NO: 16369
  misc_feature 1..30: note = chr19:1236238-1236268
  misc_feature 1..30: note = hypo
  source 1..30: mol_type = genomic DNA

SEQ ID NO: 65952 - DNA, 30 bp, Homo sapiens; identical to SEQ ID NO: 45546
  misc_feature 1..30: note = chr19:1257622-1257652
  misc_feature 1..30: note = hypo
  source 1..30: mol_type = genomic DNA

SEQ ID NO: 65953 - DNA, 30 bp, Homo sapiens; identical to SEQ ID NO: 45547
  misc_feature 1..30: note = chr19:1274097-1274127
  misc_feature 1..30: note = hypo
  source 1..30: mol_type = genomic DNA

SEQ ID NO: 65954 - DNA, 85 bp, Homo sapiens
  misc_feature 1..85: note = chr19:1274693-1274778
  misc_feature 1..85: note = hypo
  source 1..85: mol_type = genomic DNA
ctggagcacgggctgcggtgcgccggcagcttacggggcggccagtccttgcccacaacgatgtggagccctgtgaaagtcggat

SEQ ID NO: 65955 - DNA, 48 bp, Homo sapiens; identical to SEQ ID NO: 45549
  misc_feature 1..48: note = chr19:1289247-1289295
  misc_feature 1..48: note = hypo
  source 1..48: mol_type = genomic DNA

SEQ ID NO: 65956 - DNA, 32 bp, Homo sapiens; identical to SEQ ID NO: 45550
  misc_feature 1..32: note = chr19:1301313-1301345
  misc_feature 1..32: note = hypo
  source 1..32: mol_type = genomic DNA

SEQ ID NO: 65957 - DNA, 168 bp, Homo sapiens; identical to SEQ ID NO: 45551
  misc_feature 1..168: note = chr19:1308177-1308345
  misc_feature 1..168: note = hypo
  source 1..168: mol_type = genomic DNA

SEQ ID NO: 65958 - DNA, 80 bp, Homo sapiens; identical to SEQ ID NO: 45552
  misc_feature 1..80: note = chr19:1311273-1311353
  misc_feature 1..80: note = hypo
  source 1..80: mol_type = genomic DNA

SEQ ID NO: 65959 - DNA, 30 bp, Homo sapiens; identical to SEQ ID NO: 16373
  misc_feature 1..30: note = chr19:1325942-1325972
  misc_feature 1..30: note = hypo
  source 1..30: mol_type = genomic DNA

SEQ ID NO: 65960 - DNA, 35 bp, Homo sapiens; identical to SEQ ID NO: 45554
  misc_feature 1..35: note = chr19:1329520-1329555
  misc_feature 1..35: note = hypo
  source 1..35: mol_type = genomic DNA

SEQ ID NO: 65961 - DNA, 40 bp, Homo sapiens; identical to SEQ ID NO: 45555
  misc_feature 1..40: note = chr19:1409921-1409961
  misc_feature 1..40: note = hypo
  source 1..40: mol_type = genomic DNA

SEQ ID NO: 65962 - DNA, 39 bp, Homo sapiens; identical to SEQ ID NO: 45556
  misc_feature 1..39: note = chr19:1424255-1424294
  misc_feature 1..39: note = hypo
  source 1..39: mol_type = genomic DNA

SEQ ID NO: 65963 - DNA, 30 bp, Homo sapiens; identical to SEQ ID NO: 45557
  misc_feature 1..30: note = chr19:1437261-1437291
  misc_feature 1..30: note = hypo
  source 1..30: mol_type = genomic DNA

SEQ ID NO: 65964 - DNA, 30 bp, Homo sapiens; identical to SEQ ID NO: 45558
  misc_feature 1..30: note = chr19:1440112-1440142
  misc_feature 1..30: note = hypo
  source 1..30: mol_type = genomic DNA

SEQ ID NO: 65965 - DNA, 149 bp, Homo sapiens; identical to SEQ ID NO: 45559
  misc_feature 1..149: note = chr19:1481985-1482134
  misc_feature 1..149: note = hypo
  source 1..149: mol_type = genomic DNA

SEQ ID NO: 65966 - DNA, 198 bp, Homo sapiens; identical to SEQ ID NO: 45560
  misc_feature 1..198: note = chr19:1482359-1482557
  misc_feature 1..198: note = hypo
  source 1..198: mol_type = genomic DNA

SEQ ID NO: 65967 - DNA, 30 bp, Homo sapiens; identical to SEQ ID NO: 45561
  misc_feature 1..30: note = chr19:1495370-1495400
  misc_feature 1..30: note = hypo
  source 1..30: mol_type = genomic DNA

SEQ ID NO: 65968 - DNA, 26 bp, Homo sapiens
  misc_feature 1..26: note = chr19:1496387-1496413
  misc_feature 1..26: note = hypo
  source 1..26: mol_type = genomic DNA
agacagaatcatgaacgacctcagcg

SEQ ID NO: 65969 - DNA, 204 bp, Homo sapiens
  misc_feature 1..204: note = chr19:1496450-1496654
  misc_feature 1..204: note = hypo
  source 1..204: mol_type = genomic DNA
cggtgggtgctcgcaggcgcctggctgcctcaggccatctcccgggtctggacctgtctctctccaccttgcctccctttctgactttggccgccccctctcactgtccgcctctctctctcacgcttccgggaaccagtcttgcaggtcctggcccgtagccgggcaggcatcaccccggtggctgtggccgggccctccact

SEQ ID NO: 65970 - DNA, 21 bp, Homo sapiens
  misc_feature 1..21: note = chr19:1525960-1525981
  misc_feature 1..21: note = hypo
  source 1..21: mol_type = genomic DNA
tgtgaccgcctgggcccatca

SEQ ID NO: 65971 - DNA, 43 bp, Homo sapiens; identical to SEQ ID NO: 45564
  misc_feature 1..43: note = chr19:1526480-1526523
  misc_feature 1..43: note = hypo
  source 1..43: mol_type = genomic DNA

SEQ ID NO: 65972 - DNA, 33 bp, Homo sapiens; identical to SEQ ID NO: 45566
  misc_feature 1..33: note = chr19:1528123-1528156
  misc_feature 1..33: note = hypo
  source 1..33: mol_type = genomic DNA

SEQ ID NO: 65973 - DNA, 30 bp, Homo sapiens; identical to SEQ ID NO: 16379
  misc_feature 1..30: note = chr19:1533726-1533756
  misc_feature 1..30: note = hypo
  source 1..30: mol_type = genomic DNA

SEQ ID NO: 65974 - DNA, 49 bp, Homo sapiens; identical to SEQ ID NO: 45568
  misc_feature 1..49: note = chr19:1654563-1654612
  misc_feature 1..49: note = hypo
  source 1..49: mol_type = genomic DNA

SEQ ID NO: 65975 - DNA, 46 bp, Homo sapiens; identical to SEQ ID NO: 45569
  misc_feature 1..46: note = chr19:1672993-1673039
  misc_feature 1..46: note = hypo
  source 1..46: mol_type = genomic DNA

SEQ ID NO: 65976 - DNA, 46 bp, Homo sapiens; identical to SEQ ID NO: 45570
  misc_feature 1..46: note = chr19:1729230-1729276
  misc_feature 1..46: note = hypo
  source 1..46: mol_type = genomic DNA

SEQ ID NO: 65977 - DNA, 48 bp, Homo sapiens; identical to SEQ ID NO: 16380
  misc_feature 1..48: note = chr19:1799852-1799900
  misc_feature 1..48: note = hypo
  source 1..48: mol_type = genomic DNA

SEQ ID NO: 65978 - DNA, 64 bp, Homo sapiens; identical to SEQ ID NO: 45572
  misc_feature 1..64: note = chr19:1802584-1802648
  misc_feature 1..64: note = hypo
  source 1..64: mol_type = genomic DNA

SEQ ID NO: 65979 - DNA, 30 bp, Homo sapiens; identical to SEQ ID NO: 45573
  misc_feature 1..30: note = chr19:1807179-1807209
  misc_feature 1..30: note = hypo
  source 1..30: mol_type = genomic DNA

SEQ ID NO: 65980 - DNA, 27 bp, Homo sapiens
  misc_feature 1..27: note = chr19:1808413-1808440
  misc_feature 1..27: note = hypo
  source 1..27: mol_type = genomic DNA
ctcacttggcctcgcccagcatcctct

SEQ ID NO: 65981 - DNA, 377 bp, Homo sapiens; identical to SEQ ID NO: 16382
  misc_feature 1..377: note = chr19:1809512-1809889
  misc_feature 1..377: note = hypo
  source 1..377: mol_type = genomic DNA

SEQ ID NO: 65982 - DNA, 141 bp, Homo sapiens; identical to SEQ ID NO: 45576
  misc_feature 1..141: note = chr19:1810575-1810716
  misc_feature 1..141: note = hypo
  source 1..141: mol_type = genomic DNA

SEQ ID NO: 65983 - DNA, 78 bp, Homo sapiens; identical to SEQ ID NO: 45577
  misc_feature 1..78: note = chr19:1896317-1896395
  misc_feature 1..78: note = hypo
  source 1..78: mol_type = genomic DNA

SEQ ID NO: 65984 - DNA, 51 bp, Homo sapiens; identical to SEQ ID NO: 45578
  misc_feature 1..51: note = chr19:1908389-1908440
  misc_feature 1..51: note = hypo
  source 1..51: mol_type = genomic DNA

SEQ ID NO: 65985 - DNA, 37 bp, Homo sapiens; identical to SEQ ID NO: 16383
  misc_feature 1..37: note = chr19:1912092-1912129
  misc_feature 1..37: note = hypo
  source 1..37: mol_type = genomic DNA

SEQ ID NO: 65986 - DNA, 48 bp, Homo sapiens; identical to SEQ ID NO: 45580
  misc_feature 1..48: note = chr19:1912374-1912422
  misc_feature 1..48: note = hypo
  source 1..48: mol_type = genomic DNA

SEQ ID NO: 65987 - DNA, 150 bp, Homo sapiens; identical to SEQ ID NO: 45581
  misc_feature 1..150: note = chr19:1969956-1970106
  misc_feature 1..150: note = hypo
  source 1..150: mol_type = genomic DNA

SEQ ID NO: 65988 - DNA, 99 bp, Homo sapiens; identical to SEQ ID NO: 45582
  misc_feature 1..99: note = chr19:1970425-1970524
  misc_feature 1..99: note = hypo
  source 1..99: mol_type = genomic DNA

SEQ ID NO: 65989 - DNA, 30 bp, Homo sapiens; identical to SEQ ID NO: 45583
  misc_feature 1..30: note = chr19:1970740-1970770
  misc_feature 1..30: note = hypo
  source 1..30: mol_type = genomic DNA

SEQ ID NO: 65990 - DNA, 649 bp, Homo sapiens; identical to SEQ ID NO: 45584
  misc_feature 1..649: note = chr19:1978313-1978962
  misc_feature 1..649: note = hypo
  source 1..649: mol_type = genomic DNA

SEQ ID NO: 65991 - DNA, 385 bp, Homo sapiens; identical to SEQ ID NO: 45585
  misc_feature 1..385: note = chr19:1992849-1993234
  misc_feature 1..385: note = hypo
  source 1..385: mol_type = genomic DNA

SEQ ID NO: 65992 - DNA, 44 bp, Homo sapiens; identical to SEQ ID NO: 45586
  misc_feature 1..44: note = chr19:2191591-2191635
  misc_feature 1..44: note = hypo
  source 1..44: mol_type = genomic DNA

SEQ ID NO: 65993 - DNA, 30 bp, Homo sapiens; identical to SEQ ID NO: 45587
  misc_feature 1..30: note = chr19:2214092-2214122
  misc_feature 1..30: note = hypo
  source 1..30: mol_type = genomic DNA

SEQ ID NO: 65994 - DNA, 56 bp, Homo sapiens; identical to SEQ ID NO: 45588
  misc_feature 1..56: note = chr19:2243515-2243571
  misc_feature 1..56: note = hypo
  source 1..56: mol_type = genomic DNA

SEQ ID NO: 65995 - DNA, 55 bp, Homo sapiens; identical to SEQ ID NO: 16388
  misc_feature 1..55: note = chr19:2274600-2274655
  misc_feature 1..55: note = hypo
  source 1..55: mol_type = genomic DNA

SEQ ID NO: 65996 - DNA, 197 bp, Homo sapiens; identical to SEQ ID NO: 45590
  misc_feature 1..197: note = chr19:2275743-2275940
  misc_feature 1..197: note = hypo
  source 1..197: mol_type = genomic DNA

SEQ ID NO: 65997 - DNA, 140 bp, Homo sapiens
  misc_feature 1..140: note = chr19:2331273-2331413
  misc_feature 1..140: note = hypo
  source 1..140: mol_type = genomic DNA
acagtcacttggaagcggggtttctaagcctagtagtttctgaacctgtgtgcggttgcaaagcgtttgtgctgcaattgtgaaggatttggaggtcgaggcttgggctttgagcctgtccttgtagcctgagctttttc

SEQ ID NO: 65998 - DNA, 125 bp, Homo sapiens; identical to SEQ ID NO: 45592
  misc_feature 1..125: note = chr19:2331903-2332028
  misc_feature 1..125: note = hypo
  source 1..125: mol_type = genomic DNA

SEQ ID NO: 65999 - DNA, 204 bp, Homo sapiens; identical to SEQ ID NO: 45593
  misc_feature 1..204: note = chr19:2358959-2359163
  misc_feature 1..204: note = hypo
  source 1..204: mol_type = genomic DNA

SEQ ID NO: 66000 - DNA, 99 bp, Homo sapiens; identical to SEQ ID NO: 45594
  misc_feature 1..99: note = chr19:2360711-2360810
  misc_feature 1..99: note = hypo
  source 1..99: mol_type = genomic DNA

SEQ ID NO: 66001 - DNA, 127 bp, Homo sapiens; identical to SEQ ID NO: 45595
  misc_feature 1..127: note = chr19:2363057-2363184
  misc_feature 1..127: note = hypo
  source 1..127: mol_type = genomic DNA

SEQ ID NO: 66002 - DNA, 42 bp, Homo sapiens; identical to SEQ ID NO: 45596
  misc_feature 1..42: note = chr19:2471261-2471303
  misc_feature 1..42: note = hypo
  source 1..42: mol_type = genomic DNA

SEQ ID NO: 66003 - DNA, 29 bp, Homo sapiens
  misc_feature 1..29: note = chr19:2471700-2471729
  misc_feature 1..29: note = hypo
  source 1..29: mol_type = genomic DNA
aaatacggtgactcacgcctgtaattcca

SEQ ID NO: 66004 - DNA, 50 bp, Homo sapiens
  misc_feature 1..50: note = chr19:2513200-2513250
  misc_feature 1..50: note = hypo
  source 1..50: mol_type = genomic DNA
ccaagcagggatccccgcctcacgggcctgcacggaggacctgggcggcc

SEQ ID NO: 66005 - DNA, 209 bp, Homo sapiens
  misc_feature 1..209: note = chr19:2513285-2513494
  misc_feature 1..209: note = hypo
  source 1..209: mol_type = genomic DNA
ctgtctccactggggccggagggacaggactaggctagttttattctactacttgcttctaggccagccccgtggagggggtcggggcggccaggcctcctgcgatcagggctgcgtggggtccatctcaggtgtggccgcaggtgatgccggcaggccctggaagatgtggctgcacctgctcccgtccgtgccgcagaggaggacgc

SEQ ID NO: 66006 - DNA, 60 bp, Homo sapiens; identical to SEQ ID NO: 45599
  misc_feature 1..60: note = chr19:2518493-2518553
  misc_feature 1..60: note = hypo
  source 1..60: mol_type = genomic DNA

SEQ ID NO: 66007 - DNA, 124 bp, Homo sapiens; identical to SEQ ID NO: 45600
  misc_feature 1..124: note = chr19:2524811-2524935
  misc_feature 1..124: note = hypo
  source 1..124: mol_type = genomic DNA

SEQ ID NO: 66008 - DNA, 20 bp, Homo sapiens
  misc_feature 1..20: note = chr19:2683891-2683911
  misc_feature 1..20: note = hypo
  source 1..20: mol_type = genomic DNA
gctggtggacagcatcggcc

SEQ ID NO: 66009 - DNA, 30 bp, Homo sapiens; identical to SEQ ID NO: 45602
  misc_feature 1..30: note = chr19:2895788-2895818
  misc_feature 1..30: note = hypo
  source 1..30: mol_type = genomic DNA

SEQ ID NO: 66010 - DNA, 22 bp, Homo sapiens
  misc_feature 1..22: note = chr19:2899962-2899984
  misc_feature 1..22: note = hypo
  source 1..22: mol_type = genomic DNA
caggaggctgggaaacgtttgg

SEQ ID NO: 66011 - DNA, 22 bp, Homo sapiens
  misc_feature 1..22: note = chr19:3050735-3050757
  misc_feature 1..22: note = hypo
  source 1..22: mol_type = genomic DNA
gggcgcggtggctcacgcctgt

SEQ ID NO: 66012 - skipped

SEQ ID NO: 66013 - DNA, 89 bp, Homo sapiens
  misc_feature 1..89: note = chr19:3219565-3219654
  misc_feature 1..89: note = hypo
  source 1..89: mol_type = genomic DNA
gtaacatccatggcacgggcatcctgcagtgaccgatgcccaccagactgcatccgctaacaagacagggagaccggcctgtggtaccc

SEQ ID NO: 66014 - DNA, 15 bp, Homo sapiens
  misc_feature 1..15: note = chr19:3296598-3296613
  misc_feature 1..15: note = hypo
  source 1..15: mol_type = genomic DNA
catgccaatctgcct

SEQ ID NO: 66015 - DNA, 25 bp, Homo sapiens
  misc_feature 1..25: note = chr19:3296670-3296695
  misc_feature 1..25: note = hypo
  source 1..25: mol_type = genomic DNA
gagtgtgtgccggtgtgcagttgta

SEQ ID NO: 66016 - DNA, 30 bp, Homo sapiens; identical to SEQ ID NO: 45607
  misc_feature 1..30: note = chr19:3308117-3308147
  misc_feature 1..30: note = hypo
  source 1..30: mol_type = genomic DNA

SEQ ID NO: 66017 - DNA, 122 bp, Homo sapiens; identical to SEQ ID NO: 45608
  misc_feature 1..122: note = chr19:3344938-3345060
  misc_feature 1..122: note = hypo
  source 1..122: mol_type = genomic DNA

SEQ ID NO: 66018 - DNA, 32 bp, Homo sapiens; identical to SEQ ID NO: 45609
  misc_feature 1..32: note = chr19:3456167-3456199
  misc_feature 1..32: note = hypo
  source 1..32: mol_type = genomic DNA

SEQ ID NO: 66019 - DNA, 32 bp, Homo sapiens; identical to SEQ ID NO: 45611
  misc_feature 1..32: note = chr19:3570187-3570219
  misc_feature 1..32: note = hypo
  source 1..32: mol_type = genomic DNA

SEQ ID NO: 66020 - DNA, 88 bp, Homo sapiens; identical to SEQ ID NO: 45612
  misc_feature 1..88: note = chr19:3571371-3571459
  misc_feature 1..88: note = hypo
  source 1..88: mol_type = genomic DNA

SEQ ID NO: 66021 - DNA, 30 bp, Homo sapiens; identical to SEQ ID NO: 45614
  misc_feature 1..30: note = chr19:3747990-3748020
  misc_feature 1..30: note = hypo
  source 1..30: mol_type = genomic DNA

SEQ ID NO: 66022 - DNA, 40 bp, Homo sapiens; identical to SEQ ID NO: 45615
  misc_feature 1..40: note = chr19:3760214-3760254
  misc_feature 1..40: note = hypo
  source 1..40: mol_type = genomic DNA

SEQ ID NO: 66023 - DNA, 23 bp, Homo sapiens
  misc_feature 1..23: note = chr19:3778394-3778417
  misc_feature 1..23: note = hypo
  source 1..23: mol_type = genomic DNA
acggcctccgacacctctttcag

SEQ ID NO: 66024 - DNA, 268 bp, Homo sapiens
  misc_feature 1..268: note = chr19:3779009-3779277
  misc_feature 1..268: note = hypo
  source 1..268: mol_type = genomic DNA
gcgccgtccacttgacgggcagccggcttgagtctagccccttccgctcggctttggccaggccaaagtcgctgaccttggccaccaggtcctctgagaccaggatgttgcgggcggccaggtcgcggtgcacaagcttcttgctctccaggtactccatgccctcggccacgtgcctgggggtagtagggggcagtgggggctcaggtgccaggatgcccacattcagggctcagaaagctcggggtgcctggggccacaagctcac

SEQ ID NO: 66025 - skipped

SEQ ID NO: 66026 - DNA, 33 bp, Homo sapiens
  misc_feature 1..33: note = chr19:3821011-3821044
  misc_feature 1..33: note = hypo
  source 1..33: mol_type = genomic DNA
agggacaccgggggtcgggggacacaggtcaca

SEQ ID NO: 66027 - DNA, 37 bp, Homo sapiens
  misc_feature 1..37: note = chr19:3821217-3821254
  misc_feature 1..37: note = hypo
  source 1..37: mol_type = genomic DNA
ccccactgctcgagagctcacacggaggagctccgta

SEQ ID NO: 66028 - DNA, 58 bp, Homo sapiens
  misc_feature 1..58: note = chr19:3855595-3855653
  misc_feature 1..58: note = hypo
  source 1..58: mol_type = genomic DNA
aattcaacgcgatctgatggttctcatgccgccgggaaggacgcggcaagggggtgtg

SEQ ID NO: 66029 - DNA, 120 bp, Homo sapiens; identical to SEQ ID NO: 45620
  misc_feature 1..120: note = chr19:3907807-3907927
  misc_feature 1..120: note = hypo
  source 1..120: mol_type = genomic DNA

SEQ ID NO: 66030 - DNA, 105 bp, Homo sapiens; identical to SEQ ID NO: 45621
  misc_feature 1..105: note = chr19:3982749-3982854
  misc_feature 1..105: note = hypo
  source 1..105: mol_type = genomic DNA

SEQ ID NO: 66031 - DNA, 34 bp, Homo sapiens; identical to SEQ ID NO: 45622
  misc_feature 1..34: note = chr19:4043284-4043318
  misc_feature 1..34: note = hypo
  source 1..34: mol_type = genomic DNA

SEQ ID NO: 66032 - DNA, 206 bp, Homo sapiens; identical to SEQ ID NO: 45623
  misc_feature 1..206: note = chr19:4053834-4054040
  misc_feature 1..206: note = hypo
  source 1..206: mol_type = genomic DNA

SEQ ID NO: 66033 - DNA, 34 bp, Homo sapiens; identical to SEQ ID NO: 45624
  misc_feature 1..34: note = chr19:4054641-4054675
  misc_feature 1..34: note = hypo
  source 1..34: mol_type = genomic DNA

SEQ ID NO: 66034 - DNA, 41 bp, Homo sapiens; identical to SEQ ID NO: 45625
  misc_feature 1..41: note = chr19:4096416-4096457
  misc_feature 1..41: note = hypo
  source 1..41: mol_type = genomic DNA

SEQ ID NO: 66035 - DNA, 37 bp, Homo sapiens; identical to SEQ ID NO: 45626
  misc_feature 1..37: note = chr19:4131483-4131520
  misc_feature 1..37: note = hypo
  source 1..37: mol_type = genomic DNA

SEQ ID NO: 66036 - DNA, 188 bp, Homo sapiens; identical to SEQ ID NO: 45627
  misc_feature 1..188: note = chr19:4212361-4212549
  misc_feature 1..188: note = hypo
  source 1..188: mol_type = genomic DNA

SEQ ID NO: 66037 - DNA, 30 bp, Homo sapiens; identical to SEQ ID NO: 45628
  misc_feature 1..30: note = chr19:4290546-4290576
  misc_feature 1..30: note = hypo
  source 1..30: mol_type = genomic DNA

SEQ ID NO: 66038 - DNA, 30 bp, Homo sapiens; identical to SEQ ID NO: 45629
  misc_feature 1..30: note = chr19:4305764-4305794
  misc_feature 1..30: note = hypo
  source 1..30: mol_type = genomic DNA

SEQ ID NO: 66039 - DNA, 131 bp, Homo sapiens; identical to SEQ ID NO: 45630
  misc_feature 1..131: note = chr19:4361539-4361670
  misc_feature 1..131: note = hypo
  source 1..131: mol_type = genomic DNA

SEQ ID NO: 66040 - DNA, 30 bp, Homo sapiens; identical to SEQ ID NO: 45631
  misc_feature 1..30: note = chr19:4363376-4363406
  misc_feature 1..30: note = hypo
  source 1..30: mol_type = genomic DNA

SEQ ID NO: 66041 - DNA, 48 bp, Homo sapiens; identical to SEQ ID NO: 45632
  misc_feature 1..48: note = chr19:4512122-4512170
  misc_feature 1..48: note = hypo
  source 1..48: mol_type = genomic DNA

SEQ ID NO: 66042 - DNA, 136 bp, Homo sapiens
  misc_feature 1..136: note = chr19:4547998-4548134
  misc_feature 1..136: note = hypo
  source 1..136: mol_type = genomic DNA
cttgcttcccgcccacggctggcctggggtggacactcacttcatacaccccgagtactgctggcagcgagccacaggcactcggaccacgcagcgggggaaggcagccagcaggccccccgaagctgcgtccagc

SEQ ID NO: 66043 - DNA, 26 bp, Homo sapiens
  misc_feature 1..26: note = chr19:4548364-4548390
  misc_feature 1..26: note = hypo
  source 1..26: mol_type = genomic DNA
aggaccgtccccgcctcagaacccag

SEQ ID NO: 66044 - DNA, 114 bp, Homo sapiens; identical to SEQ ID NO: 45634
  misc_feature 1..114: note = chr19:4550904-4551018
  misc_feature 1..114: note = hypo
  source 1..114: mol_type = genomic DNA

SEQ ID NO: 66045 - DNA, 166 bp, Homo sapiens; identical to SEQ ID NO: 45635
  misc_feature 1..166: note = chr19:4554076-4554242
  misc_feature 1..166: note = hypo
  source 1..166: mol_type = genomic DNA

SEQ ID NO: 66046 - DNA, 62 bp, Homo sapiens; identical to SEQ ID NO: 45636
  misc_feature 1..62: note = chr19:4554999-4555061
  misc_feature 1..62: note = hypo
  source 1..62: mol_type = genomic DNA

SEQ ID NO: 66047 - DNA, 44 bp, Homo sapiens
  misc_feature 1..44: note = chr19:4556112-4556156
  misc_feature 1..44: note = hypo
  source 1..44: mol_type = genomic DNA
acaggaggaagcggggagcgcgatgtgggcgtggtcatggtgat

SEQ ID NO: 66048 - DNA, 170 bp, Homo sapiens
  misc_feature 1..170: note = chr19:4556928-4557098
  misc_feature 1..170: note = hypo
  source 1..170: mol_type = genomic DNA
cgcaggggccgggaccgagccagggccaactcacctcctgtttgcccttcatccgacacacgtttatgtcgctggggttagatctccaggtcagcttctgcagacagagagagctggtgagggggtaacgggtcccagcagccctgagtgaccccgccgtgctgggccga

SEQ ID NO: 66049 - DNA, 101 bp, Homo sapiens
  misc_feature 1..101: note = chr19:4557235-4557336
  misc_feature 1..101: note = hypo
  source 1..101: mol_type = genomic DNA
ctgggggaggggcatagttagtgagaactgggggctccgccaccctctcccgttccatccttcccactgccaatgtggtgtgcacacgggggcatgcaggg

SEQ ID NO: 66050 - DNA, 42 bp, Homo sapiens; identical to SEQ ID NO: 45639
  misc_feature 1..42: note = chr19:4572555-4572597
  misc_feature 1..42: note = hypo
  source 1..42: mol_type = genomic DNA

SEQ ID NO: 66051 - DNA, 40 bp, Homo sapiens
  misc_feature 1..40: note = chr19:4670725-4670765
  misc_feature 1..40: note = hypo
  source 1..40: mol_type = genomic DNA
aaggtcaccattaggcgaacttctcataatcgttgcagcc

SEQ ID NO: 66052 - DNA, 50 bp, Homo sapiens; identical to SEQ ID NO: 45641
  misc_feature 1..50: note = chr19:4672854-4672904
  misc_feature 1..50: note = hypo
  source 1..50: mol_type = genomic DNA

SEQ ID NO: 66053 - DNA, 40 bp, Homo sapiens; identical to SEQ ID NO: 45642
  misc_feature 1..40: note = chr19:4725551-4725591
  misc_feature 1..40: note = hypo
  source 1..40: mol_type = genomic DNA

SEQ ID NO: 66054 - DNA, 78 bp, Homo sapiens; identical to SEQ ID NO: 45643
  misc_feature 1..78: note = chr19:4789954-4790032
  misc_feature 1..78: note = hypo
  source 1..78: mol_type = genomic DNA

SEQ ID NO: 66055 - DNA, 194 bp, Homo sapiens; identical to SEQ ID NO: 45644
  misc_feature 1..194: note = chr19:4792866-4793060
  misc_feature 1..194: note = hypo
  source 1..194: mol_type = genomic DNA

SEQ ID NO: 66056 - DNA, 30 bp, Homo sapiens; identical to SEQ ID NO: 45645
  misc_feature 1..30: note = chr19:4794081-4794111
  misc_feature 1..30: note = hypo
  source 1..30: mol_type = genomic DNA

SEQ ID NO: 66057 - DNA, 30 bp, Homo sapiens; identical to SEQ ID NO: 45646
  misc_feature 1..30: note = chr19:4795123-4795153
  misc_feature 1..30: note = hypo
  source 1..30: mol_type = genomic DNA

SEQ ID NO: 66058 - DNA, 35 bp, Homo sapiens; identical to SEQ ID NO: 45647
  misc_feature 1..35: note = chr19:4798716-4798751
  misc_feature 1..35: note = hypo
  source 1..35: mol_type = genomic DNA

SEQ ID NO: 66059 - DNA, 30 bp, Homo sapiens; identical to SEQ ID NO: 16414
  misc_feature 1..30: note = chr19:4800545-4800575
  misc_feature 1..30: note = hypo
  source 1..30: mol_type = genomic DNA

SEQ ID NO: 66060 - DNA, 30 bp, Homo sapiens; identical to SEQ ID NO: 45649
  misc_feature 1..30: note = chr19:4835700-4835730
  misc_feature 1..30: note = hypo
  source 1..30: mol_type = genomic DNA

SEQ ID NO: 66061 - DNA, 30 bp, Homo sapiens; identical to SEQ ID NO: 45650
  misc_feature 1..30: note = chr19:5041081-5041111
  misc_feature 1..30: note = hypo
  source 1..30: mol_type = genomic DNA

SEQ ID NO: 66062 - DNA, 200 bp, Homo sapiens; identical to SEQ ID NO: 45651
  misc_feature 1..200: note = chr19:5046161-5046361
  misc_feature 1..200: note = hypo
  source 1..200: mol_type = genomic DNA

SEQ ID NO: 66063 - DNA, 236 bp, Homo sapiens; identical to SEQ ID NO: 45652
  misc_feature 1..236: note = chr19:5155177-5155413
  misc_feature 1..236: note = hypo
  source 1..236: mol_type = genomic DNA

SEQ ID NO: 66064 - DNA, 229 bp, Homo sapiens; identical to SEQ ID NO: 45653
  misc_feature 1..229: note = chr19:5587354-5587583
  misc_feature 1..229: note = hypo
  source 1..229: mol_type = genomic DNA

SEQ ID NO: 66065 - DNA, 362 bp, Homo sapiens; identical to SEQ ID NO: 45654
  misc_feature 1..362: note = chr19:5587840-5588202
  misc_feature 1..362: note = hypo
  source 1..362: mol_type = genomic DNA

SEQ ID NO: 66066 - DNA, 103 bp, Homo sapiens; identical to SEQ ID NO: 45655
  misc_feature 1..103: note = chr19:5676808-5676911
  misc_feature 1..103: note = hypo
  source 1..103: mol_type = genomic DNA

SEQ ID NO: 66067 - DNA, 30 bp, Homo sapiens; identical to SEQ ID NO: 45656
  misc_feature 1..30: note = chr19:5688079-5688109
  misc_feature 1..30: note = hypo
  source 1..30: mol_type = genomic DNA

SEQ ID NO: 66068 - DNA, 16 bp, Homo sapiens
  misc_feature 1..16: note = chr19:5759774-5759790
  misc_feature 1..16: note = hypo
  source 1..16: mol_type = genomic DNA
gactcagacttaagaa

SEQ ID NO: 66069 - DNA, 30 bp, Homo sapiens; identical to SEQ ID NO: 16417
  misc_feature 1..30: note = chr19:5789897-5789927
  misc_feature 1..30: note = hypo
  source 1..30: mol_type = genomic DNA

SEQ ID NO: 66070 - DNA, 37 bp, Homo sapiens; identical to SEQ ID NO: 16418
  misc_feature 1..37: note = chr19:5790176-5790213
  misc_feature 1..37: note = hypo
  source 1..37: mol_type = genomic DNA

SEQ ID NO: 66071 - DNA, 34 bp, Homo sapiens; identical to SEQ ID NO: 45660
  misc_feature 1..34: note = chr19:5825328-5825362
  misc_feature 1..34: note = hypo
  source 1..34: mol_type = genomic DNA

SEQ ID NO: 66072 - DNA, 17 bp, Homo sapiens
  misc_feature 1..17: note = chr19:5857648-5857665
  misc_feature 1..17: note = hypo
  source 1..17: mol_type = genomic DNA
accgacgtgcgtgacac

SEQ ID NO: 66073 - DNA, 36 bp, Homo sapiens; identical to SEQ ID NO: 45662
  misc_feature 1..36: note = chr19:5897722-5897758
  misc_feature 1..36: note = hypo
  source 1..36: mol_type = genomic DNA

SEQ ID NO: 66074 - DNA, 33 bp, Homo sapiens; identical to SEQ ID NO: 45663
  misc_feature 1..33: note = chr19:5905436-5905469
  misc_feature 1..33: note = hypo
  source 1..33: mol_type = genomic DNA

SEQ ID NO: 66075 - DNA, 39 bp, Homo sapiens
  misc_feature 1..39: note = chr19:5914953-5914992
  misc_feature 1..39: note = hypo
  source 1..39: mol_type = genomic DNA
cccatgtcccaggcccgggaggctgtcatcgcagctgca

SEQ ID NO: 66076 - DNA, 57 bp, Homo sapiens
  misc_feature 1..57: note = chr19:5915060-5915117
  misc_feature 1..57: note = hypo
  source 1..57: mol_type = genomic DNA
ccgtgcccaccccaaggtgcgcagtggggagtggaccgaggacgaggtgctgcgccg

SEQ ID NO: 66077 - DNA, 87 bp, Homo sapiens; identical to SEQ ID NO: 45666
  misc_feature 1..87: note = chr19:5915421-5915508
  misc_feature 1..87: note = hypo
  source 1..87: mol_type = genomic DNA

SEQ ID NO: 66078 - DNA, 30 bp, Homo sapiens; identical to SEQ ID NO: 16422
  misc_feature 1..30: note = chr19:5915925-5915955
  misc_feature 1..30: note = hypo
  source 1..30: mol_type = genomic DNA

SEQ ID NO: 66079 - DNA, 30 bp, Homo sapiens; identical to SEQ ID NO: 45668
  misc_feature 1..30: note = chr19:6333625-6333655
  misc_feature 1..30: note = hypo
  source 1..30: mol_type = genomic DNA

SEQ ID NO: 66080 - DNA, 45 bp, Homo sapiens; identical to SEQ ID NO: 45669
  misc_feature 1..45: note = chr19:6351083-6351128
  misc_feature 1..45: note = hypo
  source 1..45: mol_type = genomic DNA

SEQ ID NO: 66081 - DNA, 215 bp, Homo sapiens; identical to SEQ ID NO: 45670
  misc_feature 1..215: note = chr19:6358251-6358466
  misc_feature 1..215: note = hypo
  source 1..215: mol_type = genomic DNA

SEQ ID NO: 66082 - DNA, 21 bp, Homo sapiens
  misc_feature 1..21: note = chr19:6623980-6624001
  misc_feature 1..21: note = hypo
  source 1..21: mol_type = genomic DNA
accctaagggccaggcgtggt

SEQ ID NO: 66083 - DNA, 32 bp, Homo sapiens; identical to SEQ ID NO: 45672
  misc_feature 1..32: note = chr19:6779828-6779860
  misc_feature 1..32: note = hypo
  source 1..32: mol_type = genomic DNA

SEQ ID NO: 66084 - DNA, 38 bp, Homo sapiens; identical to SEQ ID NO: 45673
  misc_feature 1..38: note = chr19:7168432-7168470
  misc_feature 1..38: note = hypo
  source 1..38: mol_type = genomic DNA

SEQ ID NO: 66085 - DNA, 38 bp, Homo sapiens; identical to SEQ ID NO: 45674
  misc_feature 1..38: note = chr19:7184325-7184363
  misc_feature 1..38: note = hypo
  source 1..38: mol_type = genomic DNA

SEQ ID NO: 66086 - DNA, 104 bp, Homo sapiens; identical to SEQ ID NO: 45675
  misc_feature 1..104: note = chr19:7542252-7542356
  misc_feature 1..104: note = hypo
  source 1..104: mol_type = genomic DNA

SEQ ID NO: 66087 - DNA, 30 bp, Homo sapiens; identical to SEQ ID NO: 45676
  misc_feature 1..30: note = chr19:7543713-7543743
  misc_feature 1..30: note = hypo
  source 1..30: mol_type = genomic DNA

SEQ ID NO: 66088 - DNA, 99 bp, Homo sapiens; identical to SEQ ID NO: 45677
  misc_feature 1..99: note = chr19:7627750-7627849
  misc_feature 1..99: note = hypo
  source 1..99: mol_type = genomic DNA

SEQ ID NO: 66089 - DNA, 43 bp, Homo sapiens; identical to SEQ ID NO: 45678
  misc_feature 1..43: note = chr19:7706504-7706547
  misc_feature 1..43: note = hypo
  source 1..43: mol_type = genomic DNA

SEQ ID NO: 66090 - DNA, 127 bp, Homo sapiens; identical to SEQ ID NO: 45679
  misc_feature 1..127: note = chr19:7727784-7727911
  misc_feature 1..127: note = hypo
  source 1..127: mol_type = genomic DNA

SEQ ID NO: 66091 - DNA, 38 bp, Homo sapiens; identical to SEQ ID NO: 45680
  misc_feature 1..38: note = chr19:7752437-7752475
  misc_feature 1..38: note = hypo
  source 1..38: mol_type = genomic DNA

SEQ ID NO: 66092 - DNA, 84 bp, Homo sapiens; identical to SEQ ID NO: 45681
  misc_feature 1..84: note = chr19:7914950-7915034
  misc_feature 1..84: note = hypo
  source 1..84: mol_type = genomic DNA

SEQ ID NO: 66093 - DNA, 48 bp, Homo sapiens; identical to SEQ ID NO: 45682
  misc_feature 1..48: note = chr19:7970450-7970498
  misc_feature 1..48: note = hypo
  source 1..48: mol_type = genomic DNA

SEQ ID NO: 66094 - DNA, 56 bp, Homo sapiens; identical to SEQ ID NO: 45683
  misc_feature 1..56: note = chr19:8009581-8009637
  misc_feature 1..56: note = hypo
  source 1..56: mol_type = genomic DNA

SEQ ID NO: 66095 - DNA, 30 bp, Homo sapiens; identical to SEQ ID NO: 45684
  misc_feature 1..30: note = chr19:8091663-8091693
  misc_feature 1..30: note = hypo
  source 1..30: mol_type = genomic DNA

SEQ ID NO: 66096 - DNA, 30 bp, Homo sapiens; identical to SEQ ID NO: 45685
  misc_feature 1..30: note = chr19:8124555-8124585
  misc_feature 1..30: note = hypo
  source 1..30: mol_type = genomic DNA

SEQ ID NO: 66097 - DNA, 34 bp, Homo sapiens; identical to SEQ ID NO: 45686
  misc_feature 1..34: note = chr19:8194085-8194119
  misc_feature 1..34: note = hypo
  source 1..34: mol_type = genomic DNA

SEQ ID NO: 66098 - DNA, 16 bp, Homo sapiens
  misc_feature 1..16: note = chr19:8253828-8253844
  misc_feature 1..16: note = hypo
  source 1..16: mol_type = genomic DNA
tggcaacgggctggac

SEQ ID NO: 66099 - DNA, 100 bp, Homo sapiens; identical to SEQ ID NO: 45688
  misc_feature 1..100: note = chr19:8475425-8475525
  misc_feature 1..100: note = hypo
  source 1..100: mol_type = genomic DNA

SEQ ID NO: 66100 - DNA, 11 bp, Homo sapiens
  misc_feature 1..11: note = chr19:8576903-8576914
  misc_feature 1..11: note = hypo
  source 1..11: mol_type = genomic DNA
ctgtgcaatgc

SEQ ID NO: 66101 - DNA, 88 bp, Homo sapiens; identical to SEQ ID NO: 45690
  misc_feature 1..88: note = chr19:9129141-9129229
  misc_feature 1..88: note = hypo
  source 1..88: mol_type = genomic DNA

SEQ ID NO: 66102 - DNA, 30 bp, Homo sapiens; identical to SEQ ID NO: 45691
  misc_feature 1..30: note = chr19:9261611-9261641
  misc_feature 1..30: note = hypo
  source 1..30: mol_type = genomic DNA

SEQ ID NO: 66103 - DNA, 125 bp, Homo sapiens
  misc_feature 1..125: note = chr19:9937386-9937511
  misc_feature 1..125: note = hypo
  source 1..125: mol_type = genomic DNA
ggaccaaaccagtaaggagcagctctttaggcataagcacgcgcattaaagacaaaaagtatccttaacatgataaggataaccagctcattagcgctcatgcatatggacggcatatcatgaat

SEQ ID NO: 66104 - DNA, 30 bp, Homo sapiens; identical to SEQ ID NO: 16430
  misc_feature 1..30: note = chr19:10231504-10231534
  misc_feature 1..30: note = hypo
  source 1..30: mol_type = genomic DNA

SEQ ID NO: 66105 - DNA, 232 bp, Homo sapiens; identical to SEQ ID NO: 45696
  misc_feature 1..232: note = chr19:10370332-10370564
  misc_feature 1..232: note = hypo
  source 1..232: mol_type = genomic DNA

SEQ ID NO: 66106 - DNA, 30 bp, Homo sapiens; identical to SEQ ID NO: 45697
  misc_feature 1..30: note = chr19:10394324-10394354
  misc_feature 1..30: note = hypo
  source 1..30: mol_type = genomic DNA

SEQ ID NO: 66107 - DNA, 185 bp, Homo sapiens; identical to SEQ ID NO: 45698
  misc_feature 1..185: note = chr19:10562119-10562304
  misc_feature 1..185: note = hypo
  source 1..185: mol_type = genomic DNA

SEQ ID NO: 66108 - DNA, 30 bp, Homo sapiens; identical to SEQ ID NO: 16433
  misc_feature 1..30: note = chr19:10570365-10570395
  misc_feature 1..30: note = hypo
  source 1..30: mol_type = genomic DNA

SEQ ID NO: 66109 - DNA, 139 bp, Homo sapiens; identical to SEQ ID NO: 45700
  misc_feature 1..139: note = chr19:10711944-10712083
  misc_feature 1..139: note = hypo
  source 1..139: mol_type = genomic DNA

SEQ ID NO: 66110 - DNA, 30 bp, Homo sapiens; identical to SEQ ID NO: 45701
  misc_feature 1..30: note = chr19:10762205-10762235
  misc_feature 1..30: note = hypo
  source 1..30: mol_type = genomic DNA

SEQ ID NO: 66111 - DNA, 75 bp, Homo sapiens; identical to SEQ ID NO: 45702
  misc_feature 1..75: note = chr19:10872535-10872610
  misc_feature 1..75: note = hypo
  source 1..75: mol_type = genomic DNA

SEQ ID NO: 66112 - DNA, 202 bp, Homo sapiens; identical to SEQ ID NO: 45703
  misc_feature 1..202: note = chr19:10875905-10876107
  misc_feature 1..202: note = hypo
  source 1..202: mol_type = genomic DNA

SEQ ID NO: 66113 - DNA, 30 bp, Homo sapiens; identical to SEQ ID NO: 16436
  misc_feature 1..30: note = chr19:10954418-10954448
  misc_feature 1..30: note = hypo
  source 1..30: mol_type = genomic DNA

SEQ ID NO: 66114 - DNA, 30 bp, Homo sapiens; identical to SEQ ID NO: 45705
  misc_feature 1..30: note = chr19:11002349-11002379
  misc_feature 1..30: note = hypo
  source 1..30: mol_type = genomic DNA

SEQ ID NO: 66115 - DNA, 95 bp, Homo sapiens; identical to SEQ ID NO: 45706
  misc_feature 1..95: note = chr19:11002992-11003087
  misc_feature 1..95: note = hypo
  source 1..95: mol_type = genomic DNA

SEQ ID NO: 66116 - DNA, 30 bp, Homo sapiens; identical to SEQ ID NO: 16438
  misc_feature 1..30: note = chr19:11005335-11005365
  misc_feature 1..30: note = hypo
  source 1..30: mol_type = genomic DNA

SEQ ID NO: 66117 - DNA, 25 bp, Homo sapiens
  misc_feature 1..25: note = chr19:11008369-11008394
  misc_feature 1..25: note = hypo
  source 1..25: mol_type = genomic DNA
atgctagctctgggccgggcacggt

SEQ ID NO: 66118 - DNA, 55 bp, Homo sapiens; identical to SEQ ID NO: 45709
  misc_feature 1..55: note = chr19:11030140-11030195
  misc_feature 1..55: note = hypo
  source 1..55: mol_type = genomic DNA

SEQ ID NO: 66119 - DNA, 90 bp, Homo sapiens; identical to SEQ ID NO: 45710
  misc_feature 1..90: note = chr19:11052037-11052127
  misc_feature 1..90: note = hypo
  source 1..90: mol_type = genomic DNA

SEQ ID NO: 66120 - DNA, 36 bp, Homo sapiens; identical to SEQ ID NO: 45711
  misc_feature 1..36: note = chr19:11053260-11053296
  misc_feature 1..36: note = hypo
  source 1..36: mol_type = genomic DNA

SEQ ID NO: 66121 - DNA, 42 bp, Homo sapiens; identical to SEQ ID NO: 45712
  misc_feature 1..42: note = chr19:11129719-11129761
  misc_feature 1..42: note = hypo
  source 1..42: mol_type = genomic DNA

SEQ ID NO: 66122 - DNA, 30 bp, Homo sapiens; identical to SEQ ID NO: 16440
  misc_feature 1..30: note = chr19:11252737-11252767
  misc_feature 1..30: note = hypo
  source 1..30: mol_type = genomic DNA

SEQ ID NO: 66123 - DNA, 30 bp, Homo sapiens; identical to SEQ ID NO: 45714
  misc_feature 1..30: note = chr19:11406534-11406564
  misc_feature 1..30: note = hypo
  source 1..30: mol_type = genomic DNA

SEQ ID NO: 66124 - DNA, 104 bp, Homo sapiens; identical to SEQ ID NO: 45715
  misc_feature 1..104: note = chr19:11658653-11658757
  misc_feature 1..104: note = hypo
  source 1..104: mol_type = genomic DNA

SEQ ID NO: 66125 - DNA, 101 bp, Homo sapiens; identical to SEQ ID NO: 45716
  misc_feature 1..101: note = chr19:12220383-12220484
  misc_feature 1..101: note = hypo
  source 1..101: mol_type = genomic DNA

SEQ ID NO: 66126 - DNA, 132 bp, Homo sapiens; identical to SEQ ID NO: 45717
  misc_feature 1..132: note = chr19:12222626-12222758
  misc_feature 1..132: note = hypo
  source 1..132: mol_type = genomic DNA

SEQ ID NO: 66127 - DNA, 40 bp, Homo sapiens; identical to SEQ ID NO: 45718
  misc_feature 1..40: note = chr19:12675871-12675911
  misc_feature 1..40: note = hypo
  source 1..40: mol_type = genomic DNA

SEQ ID NO: 66128 - DNA, 23 bp, Homo sapiens
  misc_feature 1..23: note = chr19:12846825-12846848
  misc_feature 1..23: note = hypo
  source 1..23: mol_type = genomic DNA
tggagctgaagtccccgtctgag

SEQ ID NO: 66129 - DNA, 84 bp, Homo sapiens
  misc_feature 1..84: note = chr19:12863520-12863604
  misc_feature 1..84: note = hypo
  source 1..84: mol_type = genomic DNA
ttccttgggttctacatggcgctgagtgctgcctaccggtgaggctgccctgaggtgctcatgttctagcggagggggggcagc

SEQ ID NO: 66130 - DNA, 45 bp, Homo sapiens; identical to SEQ ID NO: 45721
  misc_feature 1..45: note = chr19:12977473-12977518
  misc_feature 1..45: note = hypo
  source 1..45: mol_type = genomic DNA

SEQ ID NO: 66131 - DNA, 30 bp, Homo sapiens; identical to SEQ ID NO: 16444
  misc_feature 1..30: note = chr19:13335742-13335772
  misc_feature 1..30: note = hypo
  source 1..30: mol_type = genomic DNA

SEQ ID NO: 66132 - DNA, 163 bp, Homo sapiens; identical to SEQ ID NO: 45723
  misc_feature 1..163: note = chr19:13781908-13782071
  misc_feature 1..163: note = hypo
  source 1..163: mol_type = genomic DNA

SEQ ID NO: 66133 - DNA, 39 bp, Homo sapiens; identical to SEQ ID NO: 45724
  misc_feature 1..39: note = chr19:13943608-13943647
  misc_feature 1..39: note = hypo
  source 1..39: mol_type = genomic DNA

SEQ ID NO: 66134 - DNA, 465 bp, Homo sapiens; identical to SEQ ID NO: 45725
  misc_feature 1..465: note = chr19:13988295-13988760
  misc_feature 1..465: note = hypo
  source 1..465: mol_type = genomic DNA

SEQ ID NO: 66135 - DNA, 40 bp, Homo sapiens; identical to SEQ ID NO: 45726
  misc_feature 1..40: note = chr19:14042824-14042864
  misc_feature 1..40: note = hypo
  source 1..40: mol_type = genomic DNA

SEQ ID NO: 66136 - DNA, 79 bp, Homo sapiens; identical to SEQ ID NO: 45728
  misc_feature 1..79: note = chr19:14209036-14209115
  misc_feature 1..79: note = hypo
  source 1..79: mol_type = genomic DNA

SEQ ID NO: 66137 - DNA, 85 bp, Homo sapiens; identical to SEQ ID NO: 45729
  misc_feature 1..85: note = chr19:14244905-14244990
  misc_feature 1..85: note = hypo
  source 1..85: mol_type = genomic DNA

SEQ ID NO: 66138 - DNA, 30 bp, Homo sapiens; identical to SEQ ID NO: 45730
  misc_feature 1..30: note = chr19:14616913-14616943
  misc_feature 1..30: note = hypo
  source 1..30: mol_type = genomic DNA

SEQ ID NO: 66139 - DNA, 36 bp, Homo sapiens; identical to SEQ ID NO: 16449
  misc_feature 1..36: note = chr19:14630627-14630663
  misc_feature 1..36: note = hypo
  source 1..36: mol_type = genomic DNA

SEQ ID NO: 66140 - DNA, 44 bp, Homo sapiens; identical to SEQ ID NO: 45732
  misc_feature 1..44: note = chr19:14675028-14675072
  misc_feature 1..44: note = hypo
  source 1..44: mol_type = genomic DNA

SEQ ID NO: 66141 - DNA, 40 bp, Homo sapiens; identical to SEQ ID NO: 45733
  misc_feature 1..40: note = chr19:14797872-14797912
  misc_feature 1..40: note = hypo
  source 1..40: mol_type = genomic DNA

SEQ ID NO: 66142 - DNA, 80 bp, Homo sapiens; identical to SEQ ID NO: 45734
  misc_feature 1..80: note = chr19:14877987-14878067
  misc_feature 1..80: note = hypo
  source 1..80: mol_type = genomic DNA

SEQ ID NO: 66143 - DNA, 47 bp, Homo sapiens; identical to SEQ ID NO: 45735
  misc_feature 1..47: note = chr19:15220624-15220671
  misc_feature 1..47: note = hypo
  source 1..47: mol_type = genomic DNA

SEQ ID NO: 66144 - DNA, 123 bp, Homo sapiens; identical to SEQ ID NO: 45736
  misc_feature 1..123: note = chr19:15272392-15272515
  misc_feature 1..123: note = hypo
  source 1..123: mol_type = genomic DNA

SEQ ID NO: 66145 - DNA, 95 bp, Homo sapiens
  misc_feature 1..95: note = chr19:15292289-15292384
  misc_feature 1..95: note = hypo
  source 1..95: mol_type = genomic DNA
aggactcccccaagtcgttgctgtccccacttcgtcccaggtcccaggccccatcccaagccagagtccctgctctccaagcagaggccccgccc

SEQ ID NO: 66146 - DNA, 46 bp, Homo sapiens
  misc_feature 1..46: note = chr19:15292499-15292545
  misc_feature 1..46: note = hypo
  source 1..46: mol_type = genomic DNA
gctcaggcactcatccacatcgcgggcgcatcgtgggccggcgaaa

SEQ ID NO: 66147 - DNA, 38 bp, Homo sapiens; identical to SEQ ID NO: 45738
  misc_feature 1..38: note = chr19:15488546-15488584
  misc_feature 1..38: note = hypo
  source 1..38: mol_type = genomic DNA

SEQ ID NO: 66148 - DNA, 30 bp, Homo sapiens; identical to SEQ ID NO: 45739
  misc_feature 1..30: note = chr19:15547714-15547744
  misc_feature 1..30: note = hypo
  source 1..30: mol_type = genomic DNA

SEQ ID NO: 66149 - DNA, 174 bp, Homo sapiens; identical to SEQ ID NO: 45740
  misc_feature 1..174: note = chr19:15558347-15558521
  misc_feature 1..174: note = hypo
  source 1..174: mol_type = genomic DNA

SEQ ID NO: 66150 - DNA, 30 bp, Homo sapiens; identical to SEQ ID NO: 45741
  misc_feature 1..30: note = chr19:16232444-16232474
  misc_feature 1..30: note = hypo
  source 1..30: mol_type = genomic DNA

SEQ ID NO: 66151 - DNA, 136 bp, Homo sapiens; identical to SEQ ID NO: 16452
  misc_feature 1..136: note = chr19:16275694-16275830
  misc_feature 1..136: note = hypo
  source 1..136: mol_type = genomic DNA

SEQ ID NO: 66152 - DNA, 30 bp, Homo sapiens; identical to SEQ ID NO: 16453
  misc_feature 1..30: note = chr19:16638285-16638315
  misc_feature 1..30: note = hypo
  source 1..30: mol_type = genomic DNA

SEQ ID NO: 66153 - DNA, 68 bp, Homo sapiens; identical to SEQ ID NO: 45744
  misc_feature 1..68: note = chr19:16638668-16638736
  misc_feature 1..68: note = hypo
  source 1..68: mol_type = genomic DNA

SEQ ID NO: 66154 - DNA, 191 bp, Homo sapiens; identical to SEQ ID NO: 45745
  misc_feature 1..191: note = chr19:16939668-16939859
  misc_feature 1..191: note = hypo
  source 1..191: mol_type = genomic DNA

SEQ ID NO: 66155 - DNA, 44 bp, Homo sapiens; identical to SEQ ID NO: 45746
  misc_feature 1..44: note = chr19:17049224-17049268
  misc_feature 1..44: note = hypo
  source 1..44: mol_type = genomic DNA

SEQ ID NO: 66156 - DNA, 42 bp, Homo sapiens; identical to SEQ ID NO: 45747
  misc_feature 1..42: note = chr19:17265055-17265097
  misc_feature 1..42: note = hypo
  source 1..42: mol_type = genomic DNA

SEQ ID NO: 66157 - DNA, 62 bp, Homo sapiens; identical to SEQ ID NO: 45748
  misc_feature 1..62: note = chr19:17365683-17365745
  misc_feature 1..62: note = hypo
  source 1..62: mol_type = genomic DNA

SEQ ID NO: 66158 - DNA, 23 bp, Homo sapiens
  misc_feature 1..23: note = chr19:17379245-17379268
  misc_feature 1..23: note = hypo
  source 1..23: mol_type = genomic DNA
tttttttttttgagacggagttt

SEQ ID NO: 66159 - DNA, 798 bp, Homo sapiens; identical to SEQ ID NO: 45750
  misc_feature 1..798: note = chr19:17404613-17405411
  misc_feature 1..798: note = hypo
  source 1..798: mol_type = genomic DNA

SEQ ID NO: 66160 - DNA, 438 bp, Homo sapiens; identical to SEQ ID NO: 45751
  misc_feature 1..438: note = chr19:17438085-17438523
  misc_feature 1..438: note = hypo
  source 1..438: mol_type = genomic DNA

SEQ ID NO: 66161 - DNA, 30 bp, Homo sapiens; identical to SEQ ID NO: 45752
  misc_feature 1..30: note = chr19:17644708-17644738
  misc_feature 1..30: note = hypo
  source 1..30: mol_type = genomic DNA

SEQ ID NO: 66162 - DNA, 66 bp, Homo sapiens; identical to SEQ ID NO: 45753
  misc_feature 1..66: note = chr19:17687961-17688027
  misc_feature 1..66: note = hypo
  source 1..66: mol_type = genomic DNA

SEQ ID NO: 66163 - DNA, 79 bp, Homo sapiens; identical to SEQ ID NO: 45755
  misc_feature 1..79: note = chr19:17759753-17759832
  misc_feature 1..79: note = hypo
  source 1..79: mol_type = genomic DNA

SEQ ID NO: 66164 - DNA, 30 bp, Homo sapiens; identical to SEQ ID NO: 45756
  misc_feature 1..30: note = chr19:17767185-17767215
  misc_feature 1..30: note = hypo
  source 1..30: mol_type = genomic DNA

SEQ ID NO: 66165 - DNA, 46 bp, Homo sapiens; identical to SEQ ID NO: 45757
  misc_feature 1..46: note = chr19:17836551-17836597
  misc_feature 1..46: note = hypo
  source 1..46: mol_type = genomic DNA

SEQ ID NO: 66166 - DNA, 39 bp, Homo sapiens; identical to SEQ ID NO: 25638
  misc_feature 1..39: note = chr19:18041203-18041242
  misc_feature 1..39: note = hypo
  source 1..39: mol_type = genomic DNA

SEQ ID NO: 66167 - DNA, 181 bp, Homo sapiens; identical to SEQ ID NO: 45759
  misc_feature 1..181: note = chr19:18054301-18054482
  misc_feature 1..181: note = hypo
  source 1..181: mol_type = genomic DNA

SEQ ID NO: 66168 - DNA, 82 bp, Homo sapiens; identical to SEQ ID NO: 45760
  misc_feature 1..82: note = chr19:18054758-18054840
  misc_feature 1..82: note = hypo
  source 1..82: mol_type = genomic DNA

SEQ ID NO: 66169 - DNA, 51 bp, Homo sapiens; identical to SEQ ID NO: 45761
  misc_feature 1..51: note = chr19:18084967-18085018
  misc_feature 1..51: note = hypo
  source 1..51: mol_type = genomic DNA

SEQ ID NO: 66170 - DNA, 310 bp, Homo sapiens; identical to SEQ ID NO: 45762
  misc_feature 1..310: note = chr19:18092490-18092800
  misc_feature 1..310: note = hypo
  source 1..310: mol_type = genomic DNA

SEQ ID NO: 66171 - DNA, 11 bp, Homo sapiens
  misc_feature 1..11: note = chr19:18103700-18103711
  misc_feature 1..11: note = hypo
  source 1..11: mol_type = genomic DNA
acctccccaga

SEQ ID NO: 66172 - DNA, 124 bp, Homo sapiens
  misc_feature 1..124: note = chr19:18103741-18103865
  misc_feature 1..124: note = hypo
  source 1..124: mol_type = genomic DNA
cccgcgcggggccctagggtggcatccccgggaggtgggcagggttgggtacatgccgaacaactgtgctgaggttaaaattgccttgtgatttttctcctgctctgcccggtcctgccagggc

SEQ ID NO: 66173 - DNA, 42 bp, Homo sapiens; identical to SEQ ID NO: 25643
  misc_feature 1..42: note = chr19:18104430-18104472
  misc_feature 1..42: note = hypo
  source 1..42: mol_type = genomic DNA

SEQ ID NO: 66174 - DNA, 76 bp, Homo sapiens; identical to SEQ ID NO: 45765
  misc_feature 1..76: note = chr19:18207919-18207995
  misc_feature 1..76: note = hypo
  source 1..76: mol_type = genomic DNA

SEQ ID NO: 66175 - DNA, 18 bp, Homo sapiens
  misc_feature 1..18: note = chr19:18227706-18227724
  misc_feature 1..18: note = hypo
  source 1..18: mol_type = genomic DNA
gagcgaaactctgtctca

SEQ ID NO: 66176 - DNA, 105 bp, Homo sapiens; identical to SEQ ID NO: 45767
  misc_feature 1..105: note = chr19:18272708-18272813
  misc_feature 1..105: note = hypo
  source 1..105: mol_type = genomic DNA

SEQ ID NO: 66177 - DNA, 18 bp, Homo sapiens
  misc_feature 1..18: note = chr19:18298268-18298286
  misc_feature 1..18: note = hypo
  source 1..18: mol_type = genomic DNA
acaggcataagccaccga

SEQ ID NO: 66178 - DNA, 40 bp, Homo sapiens; identical to SEQ ID NO: 25646
  misc_feature 1..40: note = chr19:18330991-18331031
  misc_feature 1..40: note = hypo
  source 1..40: mol_type = genomic DNA

SEQ ID NO: 66179 - DNA, 73 bp, Homo sapiens
  misc_feature 1..73: note = chr19:18331136-18331209
  misc_feature 1..73: note = hypo
  source 1..73: mol_type = genomic DNA
ggagagaaggtgaagaccgtgatgatggggcaccgtgggccgaggcaggtgagctcagcgatctgccccacct

SEQ ID NO: 66180 - DNA, 30 bp, Homo sapiens; identical to SEQ ID NO: 45771
  misc_feature 1..30: note = chr19:18600783-18600813
  misc_feature 1..30: note = hypo
  source 1..30: mol_type = genomic DNA

SEQ ID NO: 66181 - DNA, 30 bp, Homo sapiens; identical to SEQ ID NO: 45773
  misc_feature 1..30: note = chr19:18707421-18707451
  misc_feature 1..30: note = hypo
  source 1..30: mol_type = genomic DNA

SEQ ID NO: 66182 - DNA, 42 bp, Homo sapiens; identical to SEQ ID NO: 16472
  misc_feature 1..42: note = chr19:18788397-18788439
  misc_feature 1..42: note = hypo
  source 1..42: mol_type = genomic DNA

SEQ ID NO: 66183 - DNA, 30 bp, Homo sapiens; identical to SEQ ID NO: 45775
  misc_feature 1..30: note = chr19:18878375-18878405
  misc_feature 1..30: note = hypo
  source 1..30: mol_type = genomic DNA

SEQ ID NO: 66184 - DNA, 101 bp, Homo sapiens; identical to SEQ ID NO: 45776
  misc_feature 1..101: note = chr19:18880013-18880114
  misc_feature 1..101: note = hypo
  source 1..101: mol_type = genomic DNA

SEQ ID NO: 66185 - DNA, 30 bp, Homo sapiens; identical to SEQ ID NO: 16473
  misc_feature 1..30: note = chr19:18883509-18883539
  misc_feature 1..30: note = hypo
  source 1..30: mol_type = genomic DNA

SEQ ID NO: 66186 - DNA, 111 bp, Homo sapiens; identical to SEQ ID NO: 45778
  misc_feature 1..111: note = chr19:18883973-18884084
  misc_feature 1..111: note = hypo
  source 1..111: mol_type = genomic DNA

SEQ ID NO: 66187 - DNA, 30 bp, Homo sapiens; identical to SEQ ID NO: 45779
  misc_feature 1..30: note = chr19:18895773-18895803
  misc_feature 1..30: note = hypo
  source 1..30: mol_type = genomic DNA

SEQ ID NO: 66188 - DNA, 30 bp, Homo sapiens; identical to SEQ ID NO: 45780
  misc_feature 1..30: note = chr19:18975090-18975120
  misc_feature 1..30: note = hypo
  source 1..30: mol_type = genomic DNA

SEQ ID NO: 66189 - DNA, 83 bp, Homo sapiens; identical to SEQ ID NO: 16475
  misc_feature 1..83: note = chr19:18988902-18988985
  misc_feature 1..83: note = hypo
  source 1..83: mol_type = genomic DNA

SEQ ID NO: 66190 - DNA, 126 bp, Homo sapiens
  misc_feature 1..126: note = chr19:18989695-18989821
  misc_feature 1..126: note = hypo
  source 1..126: mol_type = genomic DNA
cactaaaggagggaacgcggggtgcgggcccctccacactcactcggctttgctgggcttcaggctctgggcctcggctgtgtcatactcccgcaggtccttcagctcgtgcacctggcctgtcaa

SEQ ID NO: 66191 - DNA, 207 bp, Homo sapiens
  misc_feature 1..207: note = chr19:18994680-18994887
  misc_feature 1..207: note = hypo
  source 1..207: mol_type = genomic DNA
tccctcaggaatctccgggcccacatcccctcctcagccttcctgcctctggtctgtcccctcgtcggacccctgagcactctgaccttggaaccctgagcactccgacctgatgtgatcccctccacggcctcctctgtgccccgccgcaacatcagcctccgcactctgtgtgggctgtgcctcggccccctgccacccgatcct

SEQ ID NO: 66192 - DNA, 41 bp, Homo sapiens
  misc_feature 1..41: note = chr19:18995206-18995247
  misc_feature 1..41: note = hypo
  source 1..41: mol_type = genomic DNA
gctttccattcccaattctatttttttttttttttctttga

SEQ ID NO: 66193 - DNA, 57 bp, Homo sapiens; identical to SEQ ID NO: 45784
  misc_feature 1..57: note = chr19:19042770-19042827
  misc_feature 1..57: note = hypo
  source 1..57: mol_type = genomic DNA

SEQ ID NO: 66194 - DNA, 30 bp, Homo sapiens; identical to SEQ ID NO: 45785
  misc_feature 1..30: note = chr19:19214217-19214247
  misc_feature 1..30: note = hypo
  source 1..30: mol_type = genomic DNA

SEQ ID NO: 66195 - DNA, 200 bp, Homo sapiens; identical to SEQ ID NO: 45786
  misc_feature 1..200: note = chr19:19218598-19218798
  misc_feature 1..200: note = hypo
  source 1..200: mol_type = genomic DNA

SEQ ID NO: 66196 - DNA, 30 bp, Homo sapiens
  misc_feature 1..30: note = chr19:19334915-19334945
  misc_feature 1..30: note = hypo
  source 1..30: mol_type = genomic DNA
atcattgcagcccctcggcatctacaggct

SEQ ID NO: 66197 - DNA, 50 bp, Homo sapiens; identical to SEQ ID NO: 45788
  misc_feature 1..50: note = chr19:19335175-19335225
  misc_feature 1..50: note = hypo
  source 1..50: mol_type = genomic DNA

SEQ ID NO: 66198 - DNA, 183 bp, Homo sapiens; identical to SEQ ID NO: 45789
  misc_feature 1..183: note = chr19:19391386-19391569
  misc_feature 1..183: note = hypo
  source 1..183: mol_type = genomic DNA

SEQ ID NO: 66199 - DNA, 39 bp, Homo sapiens; identical to SEQ ID NO: 45790
  misc_feature 1..39: note = chr19:19391907-19391946
  misc_feature 1..39: note = hypo
  source 1..39: mol_type = genomic DNA

SEQ ID NO: 66200 - DNA, 30 bp, Homo sapiens; identical to SEQ ID NO: 45791
  misc_feature 1..30: note = chr19:19737618-19737648
  misc_feature 1..30: note = hypo
  source 1..30: mol_type = genomic DNA

SEQ ID NO: 66201 - DNA, 22 bp, Homo sapiens
  misc_feature 1..22: note = chr19:21265857-21265879
  misc_feature 1..22: note = hypo
  source 1..22: mol_type = genomic DNA
tttaagatggagtttcgctctt

SEQ ID NO: 66202 - DNA, 30 bp, Homo sapiens; identical to SEQ ID NO: 45793
  misc_feature 1..30: note = chr19:21727297-21727327
  misc_feature 1..30: note = hypo
  source 1..30: mol_type = genomic DNA

SEQ ID NO: 66203 - DNA, 42 bp, Homo sapiens; identical to SEQ ID NO: 45794
  misc_feature 1..42: note = chr19:22017749-22017791
  misc_feature 1..42: note = hypo
  source 1..42: mol_type = genomic DNA

SEQ ID NO: 66204 - DNA, 120 bp, Homo sapiens; identical to SEQ ID NO: 45795
  misc_feature 1..120: note = chr19:22606112-22606232
  misc_feature 1..120: note = hypo
  source 1..120: mol_type = genomic DNA

SEQ ID NO: 66205 - DNA, 171 bp, Homo sapiens; identical to SEQ ID NO: 45796
  misc_feature 1..171: note = chr19:28402178-28402349
  misc_feature 1..171: note = hypo
  source 1..171: mol_type = genomic DNA

SEQ ID NO: 66206 - DNA, 54 bp, Homo sapiens; identical to SEQ ID NO: 45797
  misc_feature 1..54: note = chr19:29145984-29146038
  misc_feature 1..54: note = hypo
  source 1..54: mol_type = genomic DNA

SEQ ID NO: 66207 - DNA, 85 bp, Homo sapiens; identical to SEQ ID NO: 45798
  misc_feature 1..85: note = chr19:29425113-29425198
  misc_feature 1..85: note = hypo
  source 1..85: mol_type = genomic DNA

SEQ ID NO: 66208 - DNA, 103 bp, Homo sapiens; identical to SEQ ID NO: 45799
  misc_feature 1..103: note = chr19:29716608-29716711
  misc_feature 1..103: note = hypo
  source 1..103: mol_type = genomic DNA

SEQ ID NO: 66209 - DNA, 30 bp, Homo sapiens; identical to SEQ ID NO: 45800
  misc_feature 1..30: note = chr19:29920756-29920786
  misc_feature 1..30: note = hypo
  source 1..30: mol_type = genomic DNA

SEQ ID NO: 66210 - DNA, 49 bp, Homo sapiens; identical to SEQ ID NO: 45801
  misc_feature 1..49: note = chr19:29930941-29930990
  misc_feature 1..49: note = hypo
  source 1..49: mol_type = genomic DNA

SEQ ID NO: 66211 - DNA, 45 bp, Homo sapiens; identical to SEQ ID NO: 45802
  misc_feature 1..45: note = chr19:30056272-30056317
  misc_feature 1..45: note = hypo
  source 1..45: mol_type = genomic DNA

SEQ ID NO: 66212 - DNA, 30 bp, Homo sapiens; identical to SEQ ID NO: 45803
  misc_feature 1..30: note = chr19:30244714-30244744
  misc_feature 1..30: note = hypo
  source 1..30: mol_type = genomic DNA

SEQ ID NO: 66213 - DNA, 341 bp, Homo sapiens
  misc_feature 1..341: note = chr19:30555376-30555717
  misc_feature 1..341: note = hypo
  source 1..341: mol_type = genomic DNA
gcggcccactgtgctcccggcagccctcctgacgtcaacggcagccgcggggacgctgcctcctctgccacacgttgctcacaaagtgtaggcaaaaggcaggcgtccaattgctgcggatgaggaagagaaataatttcgtttctaaatcaggactcagtaccggtggccaggccccggaaggggcatctgtcggctgcacggcagccactcctgcaatggaggagatggtccagttctccatggggacttggggggctccccagctctggccctgggtgccgaaagccctgagaacaagccatctgaaaattaggattctgcgtcgcctgtcaatcccc

SEQ ID NO: 66214 - DNA, 30 bp, Homo sapiens; identical to SEQ ID NO: 45805
  misc_feature 1..30: note = chr19:30562726-30562756
  misc_feature 1..30: note = hypo
  source 1..30: mol_type = genomic DNA

SEQ ID NO: 66215 - DNA, 184 bp, Homo sapiens; identical to SEQ ID NO: 45806
  misc_feature 1..184: note = chr19:30579049-30579233
  misc_feature 1..184: note = hypo
  source 1..184: mol_type = genomic DNA

SEQ ID NO: 66216 - DNA, 33 bp, Homo sapiens; identical to SEQ ID NO: 45807
  misc_feature 1..33: note = chr19:30636005-30636038
  misc_feature 1..33: note = hypo
  source 1..33: mol_type = genomic DNA

SEQ ID NO: 66217 - DNA, 39 bp, Homo sapiens
  misc_feature 1..39: note = chr19:30637531-30637570
  misc_feature 1..39: note = hypo
  source 1..39: mol_type = genomic DNA
gcaagcacgtgacatccagtactacgtgaggtgctgaca

SEQ ID NO: 66218 - DNA, 45 bp, Homo sapiens; identical to SEQ ID NO: 45809
  misc_feature 1..45: note = chr19:31017337-31017382
  misc_feature 1..45: note = hypo
  source 1..45: mol_type = genomic DNA

SEQ ID NO: 66219 - DNA, 205 bp, Homo sapiens; identical to SEQ ID NO: 45810
  misc_feature 1..205: note = chr19:31587355-31587560
  misc_feature 1..205: note = hypo
  source 1..205: mol_type = genomic DNA

SEQ ID NO: 66220 - DNA, 138 bp, Homo sapiens; identical to SEQ ID NO: 45811
  misc_feature 1..138: note = chr19:31780548-31780686
  misc_feature 1..138: note = hypo
  source 1..138: mol_type = genomic DNA

SEQ ID NO: 66221 - DNA, 30 bp, Homo sapiens; identical to SEQ ID NO: 45812
  misc_feature 1..30: note = chr19:32026024-32026054
  misc_feature 1..30: note = hypo
  source 1..30: mol_type = genomic DNA

SEQ ID NO: 66222 - DNA, 59 bp, Homo sapiens; identical to SEQ ID NO: 45813
  misc_feature 1..59: note = chr19:32083683-32083742
  misc_feature 1..59: note = hypo
  source 1..59: mol_type = genomic DNA

SEQ ID NO: 66223 - DNA, 32 bp, Homo sapiens; identical to SEQ ID NO: 45814
  misc_feature 1..32: note = chr19:32232273-32232305
  misc_feature 1..32: note = hypo
  source 1..32: mol_type = genomic DNA

SEQ ID NO: 66224 - DNA, 143 bp, Homo sapiens
  misc_feature 1..143: note = chr19:32364403-32364546
  misc_feature 1..143: note = hypo
  source 1..143: mol_type = genomic DNA
tacatgaaagccctccttacaagccttccttgtaccctatggctccaggatctggccccttcacctccccagagtcagagttaccacggtgcagtggcgcaccagtgggcctccggcaatgctgctcccgcttcccaccttcc

SEQ ID NO: 66225 - DNA, 48 bp, Homo sapiens
  misc_feature 1..48: note = chr19:32516351-32516399
  misc_feature 1..48: note = hypo
  source 1..48: mol_type = genomic DNA
aactcccctgcggcccgtccctgcctcaccgcatggcccggctttgca

SEQ ID NO: 66226 - DNA, 89 bp, Homo sapiens; identical to SEQ ID NO: 45817
  misc_feature 1..89: note = chr19:32672320-32672409
  misc_feature 1..89: note = hypo
  source 1..89: mol_type = genomic DNA

SEQ ID NO: 66227 - DNA, 81 bp, Homo sapiens; identical to SEQ ID NO: 45818
  misc_feature 1..81: note = chr19:32718922-32719003
  misc_feature 1..81: note = hypo
  source 1..81: mol_type = genomic DNA

SEQ ID NO: 66228 - DNA, 89 bp, Homo sapiens; identical to SEQ ID NO: 45819
  misc_feature 1..89: note = chr19:32835111-32835200
  misc_feature 1..89: note = hypo
  source 1..89: mol_type = genomic DNA

SEQ ID NO: 66229 - DNA, 16 bp, Homo sapiens
  misc_feature 1..16: note = chr19:33143466-33143482
  misc_feature 1..16: note = hypo
  source 1..16: mol_type = genomic DNA
gcgaaactccatcccg

SEQ ID NO: 66230 - DNA, 156 bp, Homo sapiens; identical to SEQ ID NO: 45822
  misc_feature 1..156: note = chr19:33415273-33415429
  misc_feature 1..156: note = hypo
  source 1..156: mol_type = genomic DNA

SEQ ID NO: 66231 - DNA, 13 bp, Homo sapiens
  misc_feature 1..13: note = chr19:33468055-33468068
  misc_feature 1..13: note = hypo
  source 1..13: mol_type = genomic DNA
tctgagttcagct

SEQ ID NO: 66232 - DNA, 75 bp, Homo sapiens; identical to SEQ ID NO: 45824
  misc_feature 1..75: note = chr19:33557281-33557356
  misc_feature 1..75: note = hypo
  source 1..75: mol_type = genomic DNA

SEQ ID NO: 66233 - DNA, 18 bp, Homo sapiens
  misc_feature 1..18: note = chr19:33557746-33557764
  misc_feature 1..18: note = hypo
  source 1..18: mol_type = genomic DNA
aaaaaaaaaaaagtccgg

SEQ ID NO: 66234 - DNA, 30 bp, Homo sapiens; identical to SEQ ID NO: 45826
  misc_feature 1..30: note = chr19:33908049-33908079
  misc_feature 1..30: note = hypo
  source 1..30: mol_type = genomic DNA

SEQ ID NO: 66235 - DNA, 40 bp, Homo sapiens; identical to SEQ ID NO: 45827
  misc_feature 1..40: note = chr19:34263232-34263272
  misc_feature 1..40: note = hypo
  source 1..40: mol_type = genomic DNA

SEQ ID NO: 66236 - DNA, 30 bp, Homo sapiens; identical to SEQ ID NO: 16489
  misc_feature 1..30: note = chr19:34263853-34263883
  misc_feature 1..30: note = hypo
  source 1..30: mol_type = genomic DNA

SEQ ID NO: 66237 - DNA, 34 bp, Homo sapiens; identical to SEQ ID NO: 45829
  misc_feature 1..34: note = chr19:34558340-34558374
  misc_feature 1..34: note = hypo
  source 1..34: mol_type = genomic DNA

SEQ ID NO: 66238 - skipped

SEQ ID NO: 66239 - DNA, 16 bp, Homo sapiens
  misc_feature 1..16: note = chr19:35497210-35497226
  misc_feature 1..16: note = hypo
  source 1..16: mol_type = genomic DNA
gcgactctttgtctcc

SEQ ID NO: 66240 - DNA, 33 bp, Homo sapiens; identical to SEQ ID NO: 45832
  misc_feature 1..33: note = chr19:35524590-35524623
  misc_feature 1..33: note = hypo
  source 1..33: mol_type = genomic DNA

SEQ ID NO: 66241 - DNA, 30 bp, Homo sapiens; identical to SEQ ID NO: 45833
  misc_feature 1..30: note = chr19:35607399-35607429
  misc_feature 1..30: note = hypo
  source 1..30: mol_type = genomic DNA

SEQ ID NO: 66242 - DNA, 30 bp, Homo sapiens; identical to SEQ ID NO: 45834
  misc_feature 1..30: note = chr19:35608942-35608972
  misc_feature 1..30: note = hypo
  source 1..30: mol_type = genomic DNA

SEQ ID NO: 66243 - DNA, 54 bp, Homo sapiens; identical to SEQ ID NO: 45835
  misc_feature 1..54: note = chr19:35615955-35616009
  misc_feature 1..54: note = hypo
  source 1..54: mol_type = genomic DNA

SEQ ID NO: 66244 - DNA, 85 bp, Homo sapiens; identical to SEQ ID NO: 25666
  misc_feature 1..85: note = chr19:35616256-35616341
  misc_feature 1..85: note = hypo
  source 1..85: mol_type = genomic DNA

SEQ ID NO: 66245 - DNA, 80 bp, Homo sapiens
  misc_feature 1..80: note = chr19:35616397-35616477
  misc_feature 1..80: note = hypo
  source 1..80: mol_type = genomic DNA
tcccagcgcatgacctgtgggggtgtggccagtgagggcctggggtcccgggggtctctgggggccgtggaacagcttgg

SEQ ID NO: 66246 - DNA, 151 bp, Homo sapiens
  misc_feature 1..151: note = chr19:35781223-35781374
  misc_feature 1..151: note = hypo
  source 1..151: mol_type = genomic DNA
ccgtgcatggcctcaattccggtttttaagccacccagtttgtgaaactttgttgtaacagccctggaaaactgatacacctgctctctcgtaaaagatcagctgatacggcagcaccggccactggatctgcgggtcagttgtcccctta

SEQ ID NO: 66247 - DNA, 25 bp, Homo sapiens
  misc_feature 1..25: note = chr19:35781459-35781484
  misc_feature 1..25: note = hypo
  source 1..25: mol_type = genomic DNA
cctggagacccgagttgctgatgtc

SEQ ID NO: 66248 - skipped

SEQ ID NO: 66249 - DNA, 156 bp, Homo sapiens; identical to SEQ ID NO: 45839
  misc_feature 1..156: note = chr19:35827208-35827364
  misc_feature 1..156: note = hypo
  source 1..156: mol_type = genomic DNA

SEQ ID NO: 66250 - DNA, 35 bp, Homo sapiens; identical to SEQ ID NO: 45840
  misc_feature 1..35: note = chr19:35842975-35843010
  misc_feature 1..35: note = hypo
  source 1..35: mol_type = genomic DNA

SEQ ID NO: 66251 - DNA, 30 bp, Homo sapiens; identical to SEQ ID NO: 45841
  misc_feature 1..30: note = chr19:35921023-35921053
  misc_feature 1..30: note = hypo
  source 1..30: mol_type = genomic DNA

SEQ ID NO: 66252 - DNA, 195 bp, Homo sapiens; identical to SEQ ID NO: 45842
  misc_feature 1..195: note = chr19:35940942-35941137
  misc_feature 1..195: note = hypo
  source 1..195: mol_type = genomic DNA

SEQ ID NO: 66253 - DNA, 30 bp, Homo sapiens; identical to SEQ ID NO: 45843
  misc_feature 1..30: note = chr19:36199677-36199707
  misc_feature 1..30: note = hypo
  source 1..30: mol_type = genomic DNA

SEQ ID NO: 66254 - DNA, 417 bp, Homo sapiens; identical to SEQ ID NO: 45844
  misc_feature 1..417: note = chr19:36221572-36221989
  misc_feature 1..417: note = hypo
  source 1..417: mol_type = genomic DNA

SEQ ID NO: 66255 - DNA, 57 bp, Homo sapiens
  misc_feature 1..57: note = chr19:36249972-36250029
  misc_feature 1..57: note = hypo
  source 1..57: mol_type = genomic DNA
gtctggaatgggaaccgcgcgcctgtaacgttgaaaagcccctcctagactggatcc

SEQ ID NO: 66256 - DNA, 115 bp, Homo sapiens
  misc_feature 1..115: note = chr19:36250134-36250249
  misc_feature 1..115: note = hypo
  source 1..115: mol_type = genomic DNA
gcaacggtgcttcatggaaatgacagtccgtctcctccaggaatctatgggaattgtctggttctgccctcctctaatgtccccctccccagggctgcggcgaaaccacgtgctg

SEQ ID NO: 66257 - DNA, 339 bp, Homo sapiens; identical to SEQ ID NO: 45847
  misc_feature 1..339: note = chr19:36604439-36604778
  misc_feature 1..339: note = hypo
  source 1..339: mol_type = genomic DNA

SEQ ID NO: 66258 - DNA, 150 bp, Homo sapiens; identical to SEQ ID NO: 45848
  misc_feature 1..150: note = chr19:36640992-36641142
  misc_feature 1..150: note = hypo
  source 1..150: mol_type = genomic DNA

SEQ ID NO: 66259 - DNA, 196 bp, Homo sapiens; identical to SEQ ID NO: 45849
  misc_feature 1..196: note = chr19:36704661-36704857
  misc_feature 1..196: note = hypo
  source 1..196: mol_type = genomic DNA

SEQ ID NO: 66260 - DNA, 101 bp, Homo sapiens; identical to SEQ ID NO: 45850
  misc_feature 1..101: note = chr19:36747803-36747904
  misc_feature 1..101: note = hypo
  source 1..101: mol_type = genomic DNA

SEQ ID NO: 66261 - DNA, 30 bp, Homo sapiens; identical to SEQ ID NO: 45851
  misc_feature 1..30: note = chr19:37110908-37110938
  misc_feature 1..30: note = hypo
  source 1..30: mol_type = genomic DNA

SEQ ID NO: 66262 - DNA, 98 bp, Homo sapiens; identical to SEQ ID NO: 45853
  misc_feature 1..98: note = chr19:38228271-38228369
  misc_feature 1..98: note = hypo
  source 1..98: mol_type = genomic DNA

SEQ ID NO: 66263 - skipped

SEQ ID NO: 66264 - DNA, 24 bp, Homo sapiens
  misc_feature 1..24: note = chr19:38782535-38782559
  misc_feature 1..24: note = hypo
  source 1..24: mol_type = genomic DNA
atggtctacctgatccgggtggca

SEQ ID NO: 66265 - DNA, 214 bp, Homo sapiens; identical to SEQ ID NO: 45856
  misc_feature 1..214: note = chr19:38828121-38828335
  misc_feature 1..214: note = hypo
  source 1..214: mol_type = genomic DNA

SEQ ID NO: 66266 - DNA, 200 bp, Homo sapiens
  misc_feature 1..200: note = chr19:38873965-38874165
  misc_feature 1..200: note = hypo
  source 1..200: mol_type = genomic DNA
ttccctccacagaactggccaaacaggtcatcgagtatgcccggcagctggagatgatcgtctgagccccccgggcactgggtggggcagggcacgagttatttaaaacagttacactgcagggtttcgcccaataaaggtggactgacattccctcttccaggcccttgtctccccagttgggacggcagagagacaag

SEQ ID NO: 66267 - DNA, 30 bp, Homo sapiens
  misc_feature 1..30: note = chr19:38905702-38905732
  misc_feature 1..30: note = hypo
  source 1..30: mol_type = genomic DNA
tgcggcggtagcgggcgtagttgttgtggg

SEQ ID NO: 66268 - DNA, 112 bp, Homo sapiens; identical to SEQ ID NO: 45859
  misc_feature 1..112: note = chr19:38934459-38934571
  misc_feature 1..112: note = hypo
  source 1..112: mol_type = genomic DNA

SEQ ID NO: 66269 - DNA, 87 bp, Homo sapiens; identical to SEQ ID NO: 45860
  misc_feature 1..87: note = chr19:38956890-38956977
  misc_feature 1..87: note = hypo
  source 1..87: mol_type = genomic DNA

SEQ ID NO: 66270 - DNA, 321 bp, Homo sapiens; identical to SEQ ID NO: 45862
  misc_feature 1..321: note = chr19:38976340-38976661
  misc_feature 1..321: note = hypo
  source 1..321: mol_type = genomic DNA

SEQ ID NO: 66271 - DNA, 145 bp, Homo sapiens; identical to SEQ ID NO: 45863
  misc_feature 1..145: note = chr19:38990607-38990752
  misc_feature 1..145: note = hypo
  source 1..145: mol_type = genomic DNA

SEQ ID NO: 66272 - DNA, 53 bp, Homo sapiens; identical to SEQ ID NO: 45864
  misc_feature 1..53: note = chr19:38991499-38991552
  misc_feature 1..53: note = hypo
  source 1..53: mol_type = genomic DNA

SEQ ID NO: 66273 - DNA, 30 bp, Homo sapiens; identical to SEQ ID NO: 45865
  misc_feature 1..30: note = chr19:38996547-38996577
  misc_feature 1..30: note = hypo
  source 1..30: mol_type = genomic DNA

SEQ ID NO: 66274 - DNA, 80 bp, Homo sapiens; identical to SEQ ID NO: 45866
  misc_feature 1..80: note = chr19:38998362-38998442
  misc_feature 1..80: note = hypo
  source 1..80: mol_type = genomic DNA

SEQ ID NO: 66275 - DNA, 41 bp, Homo sapiens; identical to SEQ ID NO: 45867
  misc_feature 1..41: note = chr19:39006715-39006756
  misc_feature 1..41: note = hypo
  source 1..41: mol_type = genomic DNA

SEQ ID NO: 66276 - DNA, 52 bp, Homo sapiens; identical to SEQ ID NO: 45868
  misc_feature 1..52: note = chr19:39071019-39071071
  misc_feature 1..52: note = hypo
  source 1..52: mol_type = genomic DNA

SEQ ID NO: 66277 - DNA, 30 bp, Homo sapiens; identical to SEQ ID NO: 45869
  misc_feature 1..30: note = chr19:39101480-39101510
  misc_feature 1..30: note = hypo
  source 1..30: mol_type = genomic DNA

SEQ ID NO: 66278 - DNA, 30 bp, Homo sapiens; identical to SEQ ID NO: 45871
  misc_feature 1..30: note = chr19:39151783-39151813
  misc_feature 1..30: note = hypo
  source 1..30: mol_type = genomic DNA

SEQ ID NO: 66279 - DNA, 30 bp, Homo sapiens; identical to SEQ ID NO: 45872
  misc_feature 1..30: note = chr19:39191735-39191765
  misc_feature 1..30: note = hypo
  source 1..30: mol_type = genomic DNA

SEQ ID NO: 66280 - DNA, 42 bp, Homo sapiens; identical to SEQ ID NO: 45873
  misc_feature 1..42: note = chr19:39222079-39222121
  misc_feature 1..42: note = hypo
  source 1..42: mol_type = genomic DNA

SEQ ID NO: 66281 - DNA, 30 bp, Homo sapiens; identical to SEQ ID NO: 45874
  misc_feature 1..30: note = chr19:39235148-39235178
  misc_feature 1..30: note = hypo
  source 1..30: mol_type = genomic DNA

SEQ ID NO: 66282 - DNA, 30 bp, Homo sapiens; identical to SEQ ID NO: 45875
  misc_feature 1..30: note = chr19:39266345-39266375
  misc_feature 1..30: note = hypo
  source 1..30: mol_type = genomic DNA

SEQ ID NO: 66283 - DNA, 30 bp, Homo sapiens; identical to SEQ ID NO: 45876
  misc_feature 1..30: note = chr19:39329609-39329639
  misc_feature 1..30: note = hypo
  source 1..30: mol_type = genomic DNA

SEQ ID NO: 66284 - DNA, 30 bp, Homo sapiens; identical to SEQ ID NO: 45877
  misc_feature 1..30: note = chr19:39329947-39329977
  misc_feature 1..30: note = hypo
  source 1..30: mol_type = genomic DNA

SEQ ID NO: 66285 - DNA, 30 bp, Homo sapiens; identical to SEQ ID NO: 16504
  misc_feature 1..30: note = chr19:39330221-39330251
  misc_feature 1..30: note = hypo
  source 1..30: mol_type = genomic DNA

SEQ ID NO: 66286 - DNA, 19 bp, Homo sapiens
  misc_feature 1..19: note = chr19:39393000-39393019
  misc_feature 1..19: note = hypo
  source 1..19: mol_type = genomic DNA
cgcccggcctcattttatt

SEQ ID NO: 66287 - DNA, 30 bp, Homo sapiens; identical to SEQ ID NO: 45880
  misc_feature 1..30: note = chr19:39524876-39524906
  misc_feature 1..30: note = hypo
  source 1..30: mol_type = genomic DNA

SEQ ID NO: 66288 - DNA, 94 bp, Homo sapiens; identical to SEQ ID NO: 45881
  misc_feature 1..94: note = chr19:39646149-39646243
  misc_feature 1..94: note = hypo
  source 1..94: mol_type = genomic DNA

SEQ ID NO: 66289 - DNA, 30 bp, Homo sapiens; identical to SEQ ID NO: 45882
  misc_feature 1..30: note = chr19:39672405-39672435
  misc_feature 1..30: note = hypo
  source 1..30: mol_type = genomic DNA

SEQ ID NO: 66290 - DNA, 30 bp, Homo sapiens; identical to SEQ ID NO: 45883
  misc_feature 1..30: note = chr19:39815860-39815890
  misc_feature 1..30: note = hypo
  source 1..30: mol_type = genomic DNA

SEQ ID NO: 66291 - DNA, 101 bp, Homo sapiens
  misc_feature 1..101: note = chr19:39817085-39817186
  misc_feature 1..101: note = hypo
  source 1..101: mol_type = genomic DNA
actcctcattggatagtgcagtctgttctggcctctctgattggtccttccacaatccctagctgtactccctctgcattggactgcgcctgtgagccacc

SEQ ID NO: 66292 - DNA, 19 bp, Homo sapiens
  misc_feature 1..19: note = chr19:39996557-39996576
  misc_feature 1..19: note = hypo
  source 1..19: mol_type = genomic DNA
agattaaatgcggcccggc

SEQ ID NO: 66293 - DNA, 189 bp, Homo sapiens; identical to SEQ ID NO: 16507
  misc_feature 1..189: note = chr19:40218707-40218896
  misc_feature 1..189: note = hypo
  source 1..189: mol_type = genomic DNA

SEQ ID NO: 66294 - DNA, 114 bp, Homo sapiens; identical to SEQ ID NO: 45888
  misc_feature 1..114: note = chr19:40889727-40889841
  misc_feature 1..114: note = hypo
  source 1..114: mol_type = genomic DNA

SEQ ID NO: 66295 - DNA, 30 bp, Homo sapiens; identical to SEQ ID NO: 45889
  misc_feature 1..30: note = chr19:40901793-40901823
  misc_feature 1..30: note = hypo
  source 1..30: mol_type = genomic DNA

SEQ ID NO: 66296 - DNA, 147 bp, Homo sapiens
  misc_feature 1..147: note = chr19:40902278-40902425
  misc_feature 1..147: note = hypo
  source 1..147: mol_type = genomic DNA
cgggagctgcacttccgggaggtgcacatcgggcacagccatctcgggcaccttcgggagtttcacctcagggagtttcatctcagggagcttcatctctgggacttttggaagctgcacttctgggaggtgcacatcgggcacggc

SEQ ID NO: 66297 - DNA, 16 bp, Homo sapiens
  misc_feature 1..16: note = chr19:40908674-40908690
  misc_feature 1..16: note = hypo
  source 1..16: mol_type = genomic DNA
ccgtctcaaaaaaaaa

SEQ ID NO: 66298 - DNA, 49 bp, Homo sapiens; identical to SEQ ID NO: 16509
  misc_feature 1..49: note = chr19:41062945-41062994
  misc_feature 1..49: note = hypo
  source 1..49: mol_type = genomic DNA

SEQ ID NO: 66299 - DNA, 47 bp, Homo sapiens; identical to SEQ ID NO: 45894
  misc_feature 1..47: note = chr19:41198165-41198212
  misc_feature 1..47: note = hypo
  source 1..47: mol_type = genomic DNA

SEQ ID NO: 66300 - DNA, 30 bp, Homo sapiens; identical to SEQ ID NO: 45895
  misc_feature 1..30: note = chr19:41615907-41615937
  misc_feature 1..30: note = hypo
  source 1..30: mol_type = genomic DNA

SEQ ID NO: 66301 - DNA, 67 bp, Homo sapiens
  misc_feature 1..67: note = chr19:41881467-41881534
  misc_feature 1..67: note = hypo
  source 1..67: mol_type = genomic DNA
ccactgcgcccggcccgtgagcccgtttctttatctgcaaaacagggattaaaaacaagccaacacc

SEQ ID NO: 66302 - DNA, 40 bp, Homo sapiens; identical to SEQ ID NO: 45897
  misc_feature 1..40: note = chr19:41956303-41956343
  misc_feature 1..40: note = hypo
  source 1..40: mol_type = genomic DNA

SEQ ID NO: 66303 - DNA, 31 bp, Homo sapiens; identical to SEQ ID NO: 16511
  misc_feature 1..31: note = chr19:42202366-42202397
  misc_feature 1..31: note = hypo
  source 1..31: mol_type = genomic DNA

SEQ ID NO: 66304 - DNA, 127 bp, Homo sapiens; identical to SEQ ID NO: 16512
  misc_feature 1..127: note = chr19:42349306-42349433
  misc_feature 1..127: note = hypo
  source 1..127: mol_type = genomic DNA

SEQ ID NO: 66305 - DNA, 154 bp, Homo sapiens; identical to SEQ ID NO: 45900
  misc_feature 1..154: note = chr19:42373753-42373907
  misc_feature 1..154: note = hypo
  source 1..154: mol_type = genomic DNA

SEQ ID NO: 66306 - DNA, 97 bp, Homo sapiens
  misc_feature 1..97: note = chr19:42408203-42408300
  misc_feature 1..97: note = hypo
  source 1..97: mol_type = genomic DNA
gaagaaattggtccacgagggcccactgacgtggcgggtgactaaggacaaggcagtgggtgagtgccagagcagctgcctagtgcagggtgttggg

SEQ ID NO: 66307 - DNA, 364 bp, Homo sapiens
  misc_feature 1..364: note = chr19:42408330-42408694
  misc_feature 1..364: note = hypo
  source 1..364: mol_type = genomic DNA
gcgggggcacgccgtgtgagcactgctcgccccgtagaggtgcatgtgctgctgctggacgacctgctgctgctgctccagcgccaggacgagcggctgctgctcaagtcccatagccggacactgacgcccacgcccgatggcaagaccatgctgcggcccgtgctgcggctcacctccgccatgacccgcgaggtggccaccggtgagtgcagccactgcatggcccagggcagagggtgtcttttttgggcagagctgcctgtggagtggggagcagaaccctctagagagccagggagccagcattctagcaaagaggttgagaagtaggtggaggtgggcagggcggggccaggcctag

SEQ ID NO: 66308 - DNA, 30 bp, Homo sapiens; identical to SEQ ID NO: 45902
  misc_feature 1..30: note = chr19:42507833-42507863
  misc_feature 1..30: note = hypo
  source 1..30: mol_type = genomic DNA

SEQ ID NO: 66309 - DNA, 34 bp, Homo sapiens; identical to SEQ ID NO: 45903
  misc_feature 1..34: note = chr19:42579050-42579084
  misc_feature 1..34: note = hypo
  source 1..34: mol_type = genomic DNA

SEQ ID NO: 66310 - DNA, 43 bp, Homo sapiens; identical to SEQ ID NO: 45904
  misc_feature 1..43: note = chr19:42697082-42697125
  misc_feature 1..43: note = hypo
  source 1..43: mol_type = genomic DNA

SEQ ID NO: 66311 - DNA, 71 bp, Homo sapiens; identical to SEQ ID NO: 45905
  misc_feature 1..71: note = chr19:42722668-42722739
  misc_feature 1..71: note = hypo
  source 1..71: mol_type = genomic DNA

SEQ ID NO: 66312 - DNA, 41 bp, Homo sapiens; identical to SEQ ID NO: 45906
  misc_feature 1..41: note = chr19:42907251-42907292
  misc_feature 1..41: note = hypo
  source 1..41: mol_type = genomic DNA

SEQ ID NO: 66313 - DNA, 30 bp, Homo sapiens; identical to SEQ ID NO: 45909
  misc_feature 1..30: note = chr19:45279887-45279917
  misc_feature 1..30: note = hypo
  source 1..30: mol_type = genomic DNA

SEQ ID NO: 66314 - DNA, 33 bp, Homo sapiens; identical to SEQ ID NO: 16517
  misc_feature 1..33: note = chr19:45381918-45381951
  misc_feature 1..33: note = hypo
  source 1..33: mol_type = genomic DNA

SEQ ID NO: 66315 - DNA, 15 bp, Homo sapiens
  misc_feature 1..15: note = chr19:45570386-45570401
  misc_feature 1..15: note = hypo
  source 1..15: mol_type = genomic DNA
tgagtgtatctagag

SEQ ID NO: 66316 - DNA, 43 bp, Homo sapiens
  misc_feature 1..43: note = chr19:45570450-45570493
  misc_feature 1..43: note = hypo
  source 1..43: mol_type = genomic DNA
tggagggagagtagcaggagaggagagtcgagcctgtcaccct

SEQ ID NO: 66317 - DNA, 205 bp, Homo sapiens
  misc_feature 1..205: note = chr19:45574495-45574700
  misc_feature 1..205: note = hypo
  source 1..205: mol_type = genomic DNA
cacatgggcccctttgcccagggcctctggcgacaggtccgggcctctccccgccctcgcctcagcccctgccctggcctcgcccgcactaggaactgggagcgcagctttctgtgccagtcctgctgcgccccaggcactgggggctggccgttccctcaccccctcactccaaaccggtctgtccagccgtccaccccacgga

SEQ ID NO: 66318 - DNA, 38 bp, Homo sapiens; identical to SEQ ID NO: 45913
  misc_feature 1..38: note = chr19:45575118-45575156
  misc_feature 1..38: note = hypo
  source 1..38: mol_type = genomic DNA

SEQ ID NO: 66319 - DNA, 30 bp, Homo sapiens; identical to SEQ ID NO: 45914
  misc_feature 1..30: note = chr19:45601584-45601614
  misc_feature 1..30: note = hypo
  source 1..30: mol_type = genomic DNA

SEQ ID NO: 66320 - DNA, 30 bp, Homo sapiens; identical to SEQ ID NO: 45915
  misc_feature 1..30: note = chr19:45616778-45616808
  misc_feature 1..30: note = hypo
  source 1..30: mol_type = genomic DNA

SEQ ID NO: 66321 - DNA, 30 bp, Homo sapiens; identical to SEQ ID NO: 16518
  misc_feature 1..30: note = chr19:45626698-45626728
  misc_feature 1..30: note = hypo
  source 1..30: mol_type = genomic DNA

SEQ ID NO: 66322 - DNA, 30 bp, Homo sapiens; identical to SEQ ID NO: 45917
  misc_feature 1..30: note = chr19:45627017-45627047
  misc_feature 1..30: note = hypo
  source 1..30: mol_type = genomic DNA

SEQ ID NO: 66323 - DNA, 30 bp, Homo sapiens; identical to SEQ ID NO: 16519
  misc_feature 1..30: note = chr19:45709152-45709182
  misc_feature 1..30: note = hypo
  source 1..30: mol_type = genomic DNA

SEQ ID NO: 66324 - DNA, 30 bp, Homo sapiens; identical to SEQ ID NO: 45919
  misc_feature 1..30: note = chr19:45751388-45751418
  misc_feature 1..30: note = hypo
  source 1..30: mol_type = genomic DNA

SEQ ID NO: 66325 - DNA, 99 bp, Homo sapiens
  misc_feature 1..99: note = chr19:45810003-45810102
  misc_feature 1..99: note = hypo
  source 1..99: mol_type = genomic DNA
gcgcctacttctgggcggggatcatgtcgtcaatggactggcctttctccaacttcttctccatttccaccatgagcttcacaccatccaccaccagct

SEQ ID NO: 66326 - DNA, 92 bp, Homo sapiens; identical to SEQ ID NO: 45921
  misc_feature 1..92: note = chr19:45810770-45810862
  misc_feature 1..92: note = hypo
  source 1..92: mol_type = genomic DNA

SEQ ID NO: 66327 - DNA, 201 bp, Homo sapiens; identical to SEQ ID NO: 45923
  misc_feature 1..201: note = chr19:45851193-45851394
  misc_feature 1..201: note = hypo
  source 1..201: mol_type = genomic DNA

SEQ ID NO: 66328 - DNA, 112 bp, Homo sapiens
  misc_feature 1..112: note = chr19:45997416-45997528
  misc_feature 1..112: note = hypo
  source 1..112: mol_type = genomic DNA
tgcttacctagaaggcgtggctccaccgtgaattctaattggtccgtgctatcgaggcactgtccccttactggctctcgctccagtggcccccactgcttttcttcctctt

SEQ ID NO: 66329 - DNA, 67 bp, Homo sapiens
  misc_feature 1..67: note = chr19:45997584-45997651
  misc_feature 1..67: note = hypo
  source 1..67: mol_type = genomic DNA
gtaccggcctggggtgtcccagagcccggactgagctggggagtcaagacctcgggcgatgagggct

SEQ ID NO: 66330 - DNA, 17 bp, Homo sapiens
  misc_feature 1..17: note = chr19:46144063-46144080
  misc_feature 1..17: note = hypo
  source 1..17: mol_type = genomic DNA
tccgcctcccaaactgc

SEQ ID NO: 66331 - DNA, 112 bp, Homo sapiens
  misc_feature 1..112: note = chr19:46234887-46234999
  misc_feature 1..112: note = hypo
  source 1..112: mol_type = genomic DNA
tacctcctgatttacaaatgagaaaattaagccttaggaggaaggaaagtcccatacattaggagttagtccacatcatagaatagcagctccacatcgctcgagcccagga

SEQ ID NO: 66332 - DNA, 30 bp, Homo sapiens; identical to SEQ ID NO: 45927
  misc_feature 1..30: note = chr19:46269160-46269190
  misc_feature 1..30: note = hypo
  source 1..30: mol_type = genomic DNA

SEQ ID NO: 66333 - DNA, 64 bp, Homo sapiens; identical to SEQ ID NO: 45928
  misc_feature 1..64: note = chr19:46321335-46321399
  misc_feature 1..64: note = hypo
  source 1..64: mol_type = genomic DNA

SEQ ID NO: 66334 - DNA, 121 bp, Homo sapiens; identical to SEQ ID NO: 45929
  misc_feature 1..121: note = chr19:46327091-46327212
  misc_feature 1..121: note = hypo
  source 1..121: mol_type = genomic DNA

SEQ ID NO: 66335 - DNA, 30 bp, Homo sapiens; identical to SEQ ID NO: 45930
  misc_feature 1..30: note = chr19:46346873-46346903
  misc_feature 1..30: note = hypo
  source 1..30: mol_type = genomic DNA

SEQ ID NO: 66336 - DNA, 95 bp, Homo sapiens; identical to SEQ ID NO: 45931
  misc_feature 1..95: note = chr19:46356540-46356635
  misc_feature 1..95: note = hypo
  source 1..95: mol_type = genomic DNA

SEQ ID NO: 66337 - DNA, 46 bp, Homo sapiens
  misc_feature 1..46: note = chr19:46404601-46404647
  misc_feature 1..46: note = hypo
  source 1..46: mol_type = genomic DNA
gctgtgaagagggggccgcagggggctcctccgccccagcacctgc

SEQ ID NO: 66338 - DNA, 39 bp, Homo sapiens; identical to SEQ ID NO: 45933
  misc_feature 1..39: note = chr19:46811882-46811921
  misc_feature 1..39: note = hypo
  source 1..39: mol_type = genomic DNA

SEQ ID NO: 66339 - DNA, 30 bp, Homo sapiens; identical to SEQ ID NO: 45934
  misc_feature 1..30: note = chr19:47116936-47116966
  misc_feature 1..30: note = hypo
  source 1..30: mol_type = genomic DNA

SEQ ID NO: 66340 - DNA, 29 bp, Homo sapiens
  misc_feature 1..29: note = chr19:47200536-47200565
  misc_feature 1..29: note = hypo
  source 1..29: mol_type = genomic DNA
cccagtccctatcccgtggagctgcttgg

SEQ ID NO: 66341 - DNA, 37 bp, Homo sapiens; identical to SEQ ID NO: 45936
  misc_feature 1..37: note = chr19:47284561-47284598
  misc_feature 1..37: note = hypo
  source 1..37: mol_type = genomic DNA

SEQ ID NO: 66342 - DNA, 44 bp, Homo sapiens; identical to SEQ ID NO: 16528
  misc_feature 1..44: note = chr19:47429440-47429484
  misc_feature 1..44: note = hypo
  source 1..44: mol_type = genomic DNA

SEQ ID NO: 66343 - DNA, 30 bp, Homo sapiens; identical to SEQ ID NO: 45938
  misc_feature 1..30: note = chr19:47593170-47593200
  misc_feature 1..30: note = hypo
  source 1..30: mol_type = genomic DNA

SEQ ID NO: 66344 - DNA, 30 bp, Homo sapiens; identical to SEQ ID NO: 45939
  misc_feature 1..30: note = chr19:47633375-47633405
  misc_feature 1..30: note = hypo
  source 1..30: mol_type = genomic DNA

SEQ ID NO: 66345 - DNA, 30 bp, Homo sapiens; identical to SEQ ID NO: 45940
  misc_feature 1..30: note = chr19:47783598-47783628
  misc_feature 1..30: note = hypo
  source 1..30: mol_type = genomic DNA

SEQ ID NO: 66346 - DNA, 30 bp, Homo sapiens; identical to SEQ ID NO: 45941
  misc_feature 1..30: note = chr19:47847634-47847664
  misc_feature 1..30: note = hypo
  source 1..30: mol_type = genomic DNA

SEQ ID NO: 66347 - DNA, 23 bp, Homo sapiens
  misc_feature 1..23: note = chr19:47864411-47864434
  misc_feature 1..23: note = hypo
  source 1..23: mol_type = genomic DNA
atgacaatggcaggccgtcccgg

SEQ ID NO: 66348 - DNA, 47 bp, Homo sapiens; identical to SEQ ID NO: 45943
  misc_feature 1..47: note = chr19:47986518-47986565
  misc_feature 1..47: note = hypo
  source 1..47: mol_type = genomic DNA

SEQ ID NO: 66349 - DNA, 42 bp, Homo sapiens; identical to SEQ ID NO: 16529
  misc_feature 1..42: note = chr19:48003498-48003540
  misc_feature 1..42: note = hypo
  source 1..42: mol_type = genomic DNA

SEQ ID NO: 66350 - DNA, 32 bp, Homo sapiens; identical to SEQ ID NO: 45945
  misc_feature 1..32: note = chr19:48003977-48004009
  misc_feature 1..32: note = hypo
  source 1..32: mol_type = genomic DNA

SEQ ID NO: 66351 - DNA, 41 bp, Homo sapiens; identical to SEQ ID NO: 45946
  misc_feature 1..41: note = chr19:48106984-48107025
  misc_feature 1..41: note = hypo
  source 1..41: mol_type = genomic DNA

SEQ ID NO: 66352 - DNA, 30 bp, Homo sapiens; identical to SEQ ID NO: 45947
  misc_feature 1..30: note = chr19:48137321-48137351
  misc_feature 1..30: note = hypo
  source 1..30: mol_type = genomic DNA

SEQ ID NO: 66353 - DNA, 74 bp, Homo sapiens
  misc_feature 1..74: note = chr19:48151337-48151411
  misc_feature 1..74: note = hypo
  source 1..74: mol_type = genomic DNA
cgtctccctgttttcctgttaccgtctccccgtccctctctctgtctctctgaactgctcgttccctccttgcc

SEQ ID NO: 66354 - DNA, 34 bp, Homo sapiens; identical to SEQ ID NO: 45949
  misc_feature 1..34: note = chr19:48237374-48237408
  misc_feature 1..34: note = hypo
  source 1..34: mol_type = genomic DNA

SEQ ID NO: 66355 - DNA, 25 bp, Homo sapiens
  misc_feature 1..25: note = chr19:48293267-48293292
  misc_feature 1..25: note = hypo
  source 1..25: mol_type = genomic DNA
tcactgtgcccggccacacaggcgt

SEQ ID NO: 66356 - DNA, 30 bp, Homo sapiens; identical to SEQ ID NO: 45951
  misc_feature 1..30: note = chr19:48586347-48586377
  misc_feature 1..30: note = hypo
  source 1..30: mol_type = genomic DNA

SEQ ID NO: 66357 - DNA, 13 bp, Homo sapiens
  misc_feature 1..13: note = chr19:48614830-48614843
  misc_feature 1..13: note = hypo
  source 1..13: mol_type = genomic DNA
aagcccagcacta

SEQ ID NO: 66358 - DNA, 54 bp, Homo sapiens; identical to SEQ ID NO: 45953
  misc_feature 1..54: note = chr19:48775999-48776053
  misc_feature 1..54: note = hypo
  source 1..54: mol_type = genomic DNA

SEQ ID NO: 66359 - DNA, 74 bp, Homo sapiens
  misc_feature 1..74: note = chr19:48800769-48800843
  misc_feature 1..74: note = hypo
  source 1..74: mol_type = genomic DNA
ctccacctgcagggaaggtgaactgggccccgacacacactgaggcctggccccacccccgcaggccccactct

SEQ ID NO: 66360 - DNA, 39 bp, Homo sapiens; identical to SEQ ID NO: 45955
  misc_feature 1..39: note = chr19:48806604-48806643
  misc_feature 1..39: note = hypo
  source 1..39: mol_type = genomic DNA

SEQ ID NO: 66361 - DNA, 16 bp, Homo sapiens
  misc_feature 1..16: note = chr19:48834248-48834264
  misc_feature 1..16: note = hypo
  source 1..16: mol_type = genomic DNA
tggagtgcagtggtac

SEQ ID NO: 66362 - DNA, 30 bp, Homo sapiens; identical to SEQ ID NO: 45957
  misc_feature 1..30: note = chr19:48844484-48844514
  misc_feature 1..30: note = hypo
  source 1..30: mol_type = genomic DNA

SEQ ID NO: 66363 - DNA, 40 bp, Homo sapiens; identical to SEQ ID NO: 45958
  misc_feature 1..40: note = chr19:48902532-48902572
  misc_feature 1..40: note = hypo
  source 1..40: mol_type = genomic DNA

SEQ ID NO: 66364 - DNA, 202 bp, Homo sapiens
  misc_feature 1..202: note = chr19:49119027-49119229
  misc_feature 1..202: note = hypo
  source 1..202: mol_type = genomic DNA
tggggctggctggtacgagggataggagaagcagcccaagtgtggccaggcctggccctgcaggctgagtctggggagagggcagggctgggggcctgatactcacttggtgtggctgtgcggggttcctggggccttgccgaaatgccggtacacctctcggcccttgcgaggacctagggaaggggaaggagaaccgggt

SEQ ID NO: 66365 - DNA, 142 bp, Homo sapiens
  misc_feature 1..142: note = chr19:49119259-49119401
  misc_feature 1..142: note = hypo
  source 1..142: mol_type = genomic DNA
ctcccagatccaggagggtgaaggctgccagtagccacacagctcagtccaaacccgtcgaccacgtatcactcaccggagagcaggacagtgccacagcccttaggggagtccagggccagctggtcgaaagtgaggatct

SEQ ID NO: 66366 - DNA, 23 bp, Homo sapiens
  misc_feature 1..23: note = chr19:49266813-49266836
  misc_feature 1..23: note = hypo
  source 1..23: mol_type = genomic DNA
cgagactccgtctatttaaaaaa

SEQ ID NO: 66367 - DNA, 76 bp, Homo sapiens; identical to SEQ ID NO: 45962
  misc_feature 1..76: note = chr19:49328490-49328566
  misc_feature 1..76: note = hypo
  source 1..76: mol_type = genomic DNA

SEQ ID NO: 66368 - DNA, 44 bp, Homo sapiens; identical to SEQ ID NO: 45963
  misc_feature 1..44: note = chr19:49402394-49402438
  misc_feature 1..44: note = hypo
  source 1..44: mol_type = genomic DNA

SEQ ID NO: 66369 - DNA, 38 bp, Homo sapiens; identical to SEQ ID NO: 45964
  misc_feature 1..38: note = chr19:49463885-49463923
  misc_feature 1..38: note = hypo
  source 1..38: mol_type = genomic DNA

SEQ ID NO: 66370 - DNA, 30 bp, Homo sapiens; identical to SEQ ID NO: 45965
  misc_feature 1..30: note = chr19:49482126-49482156
  misc_feature 1..30: note = hypo
  source 1..30: mol_type = genomic DNA

SEQ ID NO: 66371 - DNA, 45 bp, Homo sapiens; identical to SEQ ID NO: 45966
  misc_feature 1..45: note = chr19:49541866-49541911
  misc_feature 1..45: note = hypo
  source 1..45: mol_type = genomic DNA

SEQ ID NO: 66372 - DNA, 30 bp, Homo sapiens; identical to SEQ ID NO: 45967
  misc_feature 1..30: note = chr19:49553727-49553757
  misc_feature 1..30: note = hypo
  source 1..30: mol_type = genomic DNA

SEQ ID NO: 66373 - DNA, 30 bp, Homo sapiens; identical to SEQ ID NO: 45968
  misc_feature 1..30: note = chr19:49703569-49703599
  misc_feature 1..30: note = hypo
  source 1..30: mol_type = genomic DNA

SEQ ID NO: 66374 - DNA, 41 bp, Homo sapiens; identical to SEQ ID NO: 45970
  misc_feature 1..41: note = chr19:49971866-49971907
  misc_feature 1..41: note = hypo
  source 1..41: mol_type = genomic DNA

SEQ ID NO: 66375 - DNA, 18 bp, Homo sapiens
  misc_feature 1..18: note = chr19:49997380-49997398
  misc_feature 1..18: note = hypo
  source 1..18: mol_type = genomic DNA
gcccggccaatttttttt

SEQ ID NO: 66376 - DNA, 21 bp, Homo sapiens
  misc_feature 1..21: note = chr19:50050812-50050833
  misc_feature 1..21: note = hypo
  source 1..21: mol_type = genomic DNA
tttttttttggaagacgaatc

SEQ ID NO: 66377 - DNA, 20 bp, Homo sapiens
  misc_feature 1..20: note = chr19:50053089-50053109
  misc_feature 1..20: note = hypo
  source 1..20: mol_type = genomic DNA
atccacactgtagcccgtgt

SEQ ID NO: 66378 - DNA, 205 bp, Homo sapiens; identical to SEQ ID NO: 45975
  misc_feature 1..205: note = chr19:50166617-50166822
  misc_feature 1..205: note = hypo
  source 1..205: mol_type = genomic DNA

SEQ ID NO: 66379 - DNA, 130 bp, Homo sapiens; identical to SEQ ID NO: 45976
  misc_feature 1..130: note = chr19:50216075-50216205
  misc_feature 1..130: note = hypo
  source 1..130: mol_type = genomic DNA

SEQ ID NO: 66380 - DNA, 174 bp, Homo sapiens; identical to SEQ ID NO: 45977
  misc_feature 1..174: note = chr19:50216693-50216867
  misc_feature 1..174: note = hypo
  source 1..174: mol_type = genomic DNA

SEQ ID NO: 66381 - DNA, 30 bp, Homo sapiens; identical to SEQ ID NO: 45978
  misc_feature 1..30: note = chr19:50292243-50292273
  misc_feature 1..30: note = hypo
  source 1..30: mol_type = genomic DNA

SEQ ID NO: 66382 - DNA, 30 bp, Homo sapiens; identical to SEQ ID NO: 45979
  misc_feature 1..30: note = chr19:50306672-50306702
  misc_feature 1..30: note = hypo
  source 1..30: mol_type = genomic DNA

SEQ ID NO: 66383 - DNA, 120 bp, Homo sapiens; identical to SEQ ID NO: 45980
  misc_feature 1..120: note = chr19:50319641-50319761
  misc_feature 1..120: note = hypo
  source 1..120: mol_type = genomic DNA

SEQ ID NO: 66384 - DNA, 45 bp, Homo sapiens; identical to SEQ ID NO: 45981
  misc_feature 1..45: note = chr19:50331949-50331994
  misc_feature 1..45: note = hypo
  source 1..45: mol_type = genomic DNA

SEQ ID NO: 66385 - DNA, 242 bp, Homo sapiens
  misc_feature 1..242: note = chr19:50353152-50353394
  misc_feature 1..242: note = hypo
  source 1..242: mol_type = genomic DNA
aacactgatgactcccgaatttctctctccaggctatgacatcaatatctatctacattgtttagtcaacatccgaaacagaagtagggactccgtctctaacctcctacagctgtgtctatttctcctctctaccttcactcgactccgcccacactggctcccttttattccttctactttcaggatttgtctttgctgttctgtcctctttgcacacttttccagccatctggaatggc

SEQ ID NO: 66386 - skipped

SEQ ID NO: 66387 - DNA, 30 bp, Homo sapiens; identical to SEQ ID NO: 45983
  misc_feature 1..30: note = chr19:50362485-50362515
  misc_feature 1..30: note = hypo
  source 1..30: mol_type = genomic DNA

SEQ ID NO: 66388 - DNA, 254 bp, Homo sapiens; identical to SEQ ID NO: 45984
  misc_feature 1..254: note = chr19:50364908-50365162
  misc_feature 1..254: note = hypo
  source 1..254: mol_type = genomic DNA

SEQ ID NO: 66389 - DNA, 45 bp, Homo sapiens; identical to SEQ ID NO: 45985
  misc_feature 1..45: note = chr19:50395086-50395131
  misc_feature 1..45: note = hypo
  source 1..45: mol_type = genomic DNA

SEQ ID NO: 66390 - DNA, 51 bp, Homo sapiens; identical to SEQ ID NO: 45986
  misc_feature 1..51: note = chr19:50481531-50481582
  misc_feature 1..51: note = hypo
  source 1..51: mol_type = genomic DNA

SEQ ID NO: 66391 - DNA, 212 bp, Homo sapiens; identical to SEQ ID NO: 45987
  misc_feature 1..212: note = chr19:50919863-50920075
  misc_feature 1..212: note = hypo
  source 1..212: mol_type = genomic DNA

SEQ ID NO: 66392 - DNA, 95 bp, Homo sapiens; identical to SEQ ID NO: 45988
  misc_feature 1..95: note = chr19:50926491-50926586
  misc_feature 1..95: note = hypo
  source 1..95: mol_type = genomic DNA

SEQ ID NO: 66393 - DNA, 21 bp, Homo sapiens
  misc_feature 1..21: note = chr19:50938691-50938712
  misc_feature 1..21: note = hypo
  source 1..21: mol_type = genomic DNA
gcccctcggctggcatcggct

SEQ ID NO: 66394 - DNA, 44 bp, Homo sapiens; identical to SEQ ID NO: 45990
  misc_feature 1..44: note = chr19:50947800-50947844
  misc_feature 1..44: note = hypo
  source 1..44: mol_type = genomic DNA

SEQ ID NO: 66395 - DNA, 74 bp, Homo sapiens; identical to SEQ ID NO: 45991
  misc_feature 1..74: note = chr19:50967770-50967844
  misc_feature 1..74: note = hypo
  source 1..74: mol_type = genomic DNA

SEQ ID NO: 66396 - DNA, 35 bp, Homo sapiens; identical to SEQ ID NO: 45992
  misc_feature 1..35: note = chr19:51022774-51022809
  misc_feature 1..35: note = hypo
  source 1..35: mol_type = genomic DNA

SEQ ID NO: 66397 - DNA, 58 bp, Homo sapiens; identical to SEQ ID NO: 45993
  misc_feature 1..58: note = chr19:51046474-51046532
  misc_feature 1..58: note = hypo
  source 1..58: mol_type = genomic DNA

SEQ ID NO: 66398 - DNA, 33 bp, Homo sapiens; identical to SEQ ID NO: 45994
  misc_feature 1..33: note = chr19:51128766-51128799
  misc_feature 1..33: note = hypo
  source 1..33: mol_type = genomic DNA

SEQ ID NO: 66399 - DNA, 82 bp, Homo sapiens; identical to SEQ ID NO: 45995
  misc_feature 1..82: note = chr19:51203231-51203313
  misc_feature 1..82: note = hypo
  source 1..82: mol_type = genomic DNA

SEQ ID NO: 66400 - DNA, 48 bp, Homo sapiens; identical to SEQ ID NO: 45997
  misc_feature 1..48: note = chr19:51340799-51340847
  misc_feature 1..48: note = hypo
  source 1..48: mol_type = genomic DNA

SEQ ID NO: 66401 - DNA, 30 bp, Homo sapiens; identical to SEQ ID NO: 45998
  misc_feature 1..30: note = chr19:51684708-51684738
  misc_feature 1..30: note = hypo
  source 1..30: mol_type = genomic DNA

SEQ ID NO: 66402 - DNA, 30 bp, Homo sapiens; identical to SEQ ID NO: 45999
  misc_feature 1..30: note = chr19:51715131-51715161
  misc_feature 1..30: note = hypo
  source 1..30: mol_type = genomic DNA

SEQ ID NO: 66403 - DNA, 40 bp, Homo sapiens; identical to SEQ ID NO: 46000
  misc_feature 1..40: note = chr19:51754542-51754582
  misc_feature 1..40: note = hypo
  source 1..40: mol_type = genomic DNA

SEQ ID NO: 66404 - DNA, 41 bp, Homo sapiens; identical to SEQ ID NO: 46001
  misc_feature 1..41: note = chr19:52086376-52086417
  misc_feature 1..41: note = hypo
  source 1..41: mol_type = genomic DNA

SEQ ID NO: 66405 - DNA, 30 bp, Homo sapiens; identical to SEQ ID NO: 46002
  misc_feature 1..30: note = chr19:52091303-52091333
  misc_feature 1..30: note = hypo
  source 1..30: mol_type = genomic DNA

SEQ ID NO: 66406 - DNA, 82 bp, Homo sapiens; identical to SEQ ID NO: 46003
  misc_feature 1..82: note = chr19:52248361-52248443
  misc_feature 1..82: note = hypo
  source 1..82: mol_type = genomic DNA

SEQ ID NO: 66407 - DNA, 23 bp, Homo sapiens
  misc_feature 1..23: note = chr19:52512149-52512172
  misc_feature 1..23: note = hypo
  source 1..23: mol_type = genomic DNA
ggttgggaaagaggccgggcgcg

SEQ ID NO: 66408 - DNA, 137 bp, Homo sapiens; identical to SEQ ID NO: 46005
  misc_feature 1..137: note = chr19:52780320-52780457
  misc_feature 1..137: note = hypo
  source 1..137: mol_type = genomic DNA

SEQ ID NO: 66409 - DNA, 149 bp, Homo sapiens; identical to SEQ ID NO: 46006
  misc_feature 1..149: note = chr19:52893581-52893730
  misc_feature 1..149: note = hypo
  source 1..149: mol_type = genomic DNA

SEQ ID NO: 66410 - DNA, 25 bp, Homo sapiens
  misc_feature 1..25: note = chr19:52983447-52983472
  misc_feature 1..25: note = hypo
  source 1..25: mol_type = genomic DNA
cgtgcccagtcgattatgaatctta

SEQ ID NO: 66411 - DNA, 39 bp, Homo sapiens; identical to SEQ ID NO: 46009
  misc_feature 1..39: note = chr19:53105829-53105868
  misc_feature 1..39: note = hypo
  source 1..39: mol_type = genomic DNA

SEQ ID NO: 66412 - DNA, 76 bp, Homo sapiens; identical to SEQ ID NO: 46010
  misc_feature 1..76: note = chr19:53148247-53148323
  misc_feature 1..76: note = hypo
  source 1..76: mol_type = genomic DNA

SEQ ID NO: 66413 - DNA, 30 bp, Homo sapiens; identical to SEQ ID NO: 46011
  misc_feature 1..30: note = chr19:53225425-53225455
  misc_feature 1..30: note = hypo
  source 1..30: mol_type = genomic DNA

SEQ ID NO: 66414 - DNA, 30 bp, Homo sapiens; identical to SEQ ID NO: 46012
  misc_feature 1..30: note = chr19:53299504-53299534
  misc_feature 1..30: note = hypo
  source 1..30: mol_type = genomic DNA

SEQ ID NO: 66415 - DNA, 30 bp, Homo sapiens; identical to SEQ ID NO: 46013
  misc_feature 1..30: note = chr19:53387507-53387537
  misc_feature 1..30: note = hypo
  source 1..30: mol_type = genomic DNA

SEQ ID NO: 66416 - DNA, 30 bp, Homo sapiens; identical to SEQ ID NO: 46014
  misc_feature 1..30: note = chr19:53412458-53412488
  misc_feature 1..30: note = hypo
  source 1..30: mol_type = genomic DNA

SEQ ID NO: 66417 - DNA, 24 bp, Homo sapiens
  misc_feature 1..24: note = chr19:53429320-53429344
  misc_feature 1..24: note = hypo
  source 1..24: mol_type = genomic DNA
ataagaagggacaatcggccaggt

SEQ ID NO: 66418 - DNA, 41 bp, Homo sapiens; identical to SEQ ID NO: 46016
  misc_feature 1..41: note = chr19:53702028-53702069
  misc_feature 1..41: note = hypo
  source 1..41: mol_type = genomic DNA

SEQ ID NO: 66419 - DNA, 23 bp, Homo sapiens
  misc_feature 1..23: note = chr19:53728478-53728501
  misc_feature 1..23: note = hypo
  source 1..23: mol_type = genomic DNA
ttacccatgtggggccgggtgcg

SEQ ID NO: 66420 - DNA, 38 bp, Homo sapiens; identical to SEQ ID NO: 46018
  misc_feature 1..38: note = chr19:53965321-53965359
  misc_feature 1..38: note = hypo
  source 1..38: mol_type = genomic DNA

SEQ ID NO: 66421 - DNA, 114 bp, Homo sapiens; identical to SEQ ID NO: 46019
  misc_feature 1..114: note = chr19:54033275-54033389
  misc_feature 1..114: note = hypo
  source 1..114: mol_type = genomic DNA

SEQ ID NO: 66422 - DNA, 21 bp, Homo sapiens
  misc_feature 1..21: note = chr19:54039855-54039876
  misc_feature 1..21: note = hypo
  source 1..21: mol_type = genomic DNA
tttaaaaattattctcgactg

SEQ ID NO: 66423 - DNA, 30 bp, Homo sapiens; identical to SEQ ID NO: 46021
  misc_feature 1..30: note = chr19:54046025-54046055
  misc_feature 1..30: note = hypo
  source 1..30: mol_type = genomic DNA

SEQ ID NO: 66424 - DNA, 39 bp, Homo sapiens; identical to SEQ ID NO: 46022
  misc_feature 1..39: note = chr19:54314338-54314377
  misc_feature 1..39: note = hypo
  source 1..39: mol_type = genomic DNA

SEQ ID NO: 66425 - DNA, 126 bp, Homo sapiens; identical to SEQ ID NO: 46023
  misc_feature 1..126: note = chr19:54403466-54403592
  misc_feature 1..126: note = hypo
  source 1..126: mol_type = genomic DNA

SEQ ID NO: 66426 - DNA, 44 bp, Homo sapiens; identical to SEQ ID NO: 46024
  misc_feature 1..44: note = chr19:55645710-55645754
  misc_feature 1..44: note = hypo
  source 1..44: mol_type = genomic DNA

SEQ ID NO: 66427 - DNA, 16 bp, Homo sapiens
  misc_feature 1..16: note = chr19:55727832-55727848
  misc_feature 1..16: note = hypo
  source 1..16: mol_type = genomic DNA
gcgattagatcattga

SEQ ID NO: 66428 - DNA, 30 bp, Homo sapiens; identical to SEQ ID NO: 46026
  misc_feature 1..30: note = chr19:55798634-55798664
  misc_feature 1..30: note = hypo
  source 1..30: mol_type = genomic DNA

SEQ ID NO: 66429 - DNA, 58 bp, Homo sapiens; identical to SEQ ID NO: 46027
  misc_feature 1..58: note = chr19:55853009-55853067
  misc_feature 1..58: note = hypo
  source 1..58: mol_type = genomic DNA

SEQ ID NO: 66430 - DNA, 30 bp, Homo sapiens; identical to SEQ ID NO: 46028
  misc_feature 1..30: note = chr19:55912333-55912363
  misc_feature 1..30: note = hypo
  source 1..30: mol_type = genomic DNA

SEQ ID NO: 66431 - DNA, 30 bp, Homo sapiens; identical to SEQ ID NO: 46029
  misc_feature 1..30: note = chr19:55927698-55927728
  misc_feature 1..30: note = hypo
  source 1..30: mol_type = genomic DNA

SEQ ID NO: 66432 - DNA, 54 bp, Homo sapiens; identical to SEQ ID NO: 46030
  misc_feature 1..54: note = chr19:55976843-55976897
  misc_feature 1..54: note = hypo
  source 1..54: mol_type = genomic DNA

SEQ ID NO: 66433 - DNA, 30 bp, Homo sapiens; identical to SEQ ID NO: 46031
  misc_feature 1..30: note = chr19:55982821-55982851
  misc_feature 1..30: note = hypo
  source 1..30: mol_type = genomic DNA

SEQ ID NO: 66434 - DNA, 39 bp, Homo sapiens; identical to SEQ ID NO: 46032
  misc_feature 1..39: note = chr19:56179648-56179687
  misc_feature 1..39: note = hypo
  source 1..39: mol_type = genomic DNA

SEQ ID NO: 66435 - DNA, 79 bp, Homo sapiens; identical to SEQ ID NO: 46033
  misc_feature 1..79: note = chr19:56181818-56181897
  misc_feature 1..79: note = hypo
  source 1..79: mol_type = genomic DNA

SEQ ID NO: 66436 - DNA, 100 bp, Homo sapiens; identical to SEQ ID NO: 46034
  misc_feature 1..100: note = chr19:56200496-56200596
  misc_feature 1..100: note = hypo
  source 1..100: mol_type = genomic DNA

SEQ ID NO: 66437 - DNA, 51 bp, Homo sapiens; identical to SEQ ID NO: 46035
  misc_feature 1..51: note = chr19:56205745-56205796
  misc_feature 1..51: note = hypo
  source 1..51: mol_type = genomic DNA

SEQ ID NO: 66438 - DNA, 34 bp, Homo sapiens; identical to SEQ ID NO: 46036
  misc_feature 1..34: note = chr19:56354394-56354428
  misc_feature 1..34: note = hypo
  source 1..34: mol_type = genomic DNA

SEQ ID NO: 66439 - DNA, 84 bp, Homo sapiens; identical to SEQ ID NO: 46037
  misc_feature 1..84: note = chr19:56539038-56539122
  misc_feature 1..84: note = hypo
  source 1..84: mol_type = genomic DNA

SEQ ID NO: 66440 - DNA, 30 bp, Homo sapiens; identical to SEQ ID NO: 46038
  misc_feature 1..30: note = chr19:56543855-56543885
  misc_feature 1..30: note = hypo
  source 1..30: mol_type = genomic DNA

SEQ ID NO: 66441 - DNA, 30 bp, Homo sapiens; identical to SEQ ID NO: 46039
  misc_feature 1..30: note = chr19:56603841-56603871
  misc_feature 1..30: note = hypo
  source 1..30: mol_type = genomic DNA

SEQ ID NO: 66442 - DNA, 52 bp, Homo sapiens; identical to SEQ ID NO: 46040
  misc_feature 1..52: note = chr19:56617216-56617268
  misc_feature 1..52: note = hypo
  source 1..52: mol_type = genomic DNA

SEQ ID NO: 66443 - DNA, 40 bp, Homo sapiens; identical to SEQ ID NO: 46041
  misc_feature 1..40: note = chr19:56686390-56686430
  misc_feature 1..40: note = hypo
  source 1..40: mol_type = genomic DNA

SEQ ID NO: 66444 - DNA, 35 bp, Homo sapiens; identical to SEQ ID NO: 46042
  misc_feature 1..35: note = chr19:56688387-56688422
  misc_feature 1..35: note = hypo
  source 1..35: mol_type = genomic DNA

SEQ ID NO: 66445 - DNA, 30 bp, Homo sapiens; identical to SEQ ID NO: 46043
  misc_feature 1..30: note = chr19:56727704-56727734
  misc_feature 1..30: note = hypo
  source 1..30: mol_type = genomic DNA

SEQ ID NO: 66446 - DNA, 35 bp, Homo sapiens; identical to SEQ ID NO: 46044
  misc_feature 1..35: note = chr19:56987547-56987582
  misc_feature 1..35: note = hypo
  source 1..35: mol_type = genomic DNA

SEQ ID NO: 66447 - DNA, 30 bp, Homo sapiens; identical to SEQ ID NO: 46045
  misc_feature 1..30: note = chr19:57334846-57334876
  misc_feature 1..30: note = hypo
  source 1..30: mol_type = genomic DNA

SEQ ID NO: 66448 - DNA, 30 bp, Homo sapiens; identical to SEQ ID NO: 46046
  misc_feature 1..30: note = chr19:57399477-57399507
  misc_feature 1..30: note = hypo
  source 1..30: mol_type = genomic DNA

SEQ ID NO: 66449 - DNA, 30 bp, Homo sapiens; identical to SEQ ID NO: 46047
  misc_feature 1..30: note = chr19:57477131-57477161
  misc_feature 1..30: note = hypo
  source 1..30: mol_type = genomic DNA

SEQ ID NO: 66450 - DNA, 49 bp, Homo sapiens; identical to SEQ ID NO: 46048
  misc_feature 1..49: note = chr19:57491242-57491291
  misc_feature 1..49: note = hypo
  source 1..49: mol_type = genomic DNA

SEQ ID NO: 66451 - DNA, 18 bp, Homo sapiens
  misc_feature 1..18: note = chr19:58032743-58032761
  misc_feature 1..18: note = hypo
  source 1..18: mol_type = genomic DNA
ctccgtctcaaaaaaaaa

SEQ ID NO: 66452 - DNA, 130 bp, Homo sapiens; identical to SEQ ID NO: 46050
  misc_feature 1..130: note = chr19:58046095-58046225
  misc_feature 1..130: note = hypo
  source 1..130: mol_type = genomic DNA

SEQ ID NO: 66453 - DNA, 179 bp, Homo sapiens; identical to SEQ ID NO: 46051
  misc_feature 1..179: note = chr19:58101908-58102087
  misc_feature 1..179: note = hypo
  source 1..179: mol_type = genomic DNA

SEQ ID NO: 66454 - DNA, 30 bp, Homo sapiens; identical to SEQ ID NO: 46052
  misc_feature 1..30: note = chr19:58233563-58233593
  misc_feature 1..30: note = hypo
  source 1..30: mol_type = genomic DNA

SEQ ID NO: 66455 - DNA, 30 bp, Homo sapiens; identical to SEQ ID NO: 46053
  misc_feature 1..30: note = chr19:58438364-58438394
  misc_feature 1..30: note = hypo
  source 1..30: mol_type = genomic DNA

SEQ ID NO: 66456 - DNA, 30 bp, Homo sapiens; identical to SEQ ID NO: 46054
  misc_feature 1..30: note = chr19:58447467-58447497
  misc_feature 1..30: note = hypo
  source 1..30: mol_type = genomic DNA

SEQ ID NO: 66457 - DNA, 30 bp, Homo sapiens; identical to SEQ ID NO: 46055
  misc_feature 1..30: note = chr19:58448066-58448096
  misc_feature 1..30: note = hypo
  source 1..30: mol_type = genomic DNA

SEQ ID NO: 66458 - DNA, 190 bp, Homo sapiens; identical to SEQ ID NO: 46056
  misc_feature 1..190: note = chr19:58457382-58457572
  misc_feature 1..190: note = hypo
  source 1..190: mol_type = genomic DNA

SEQ ID NO: 66459 - DNA, 30 bp, Homo sapiens; identical to SEQ ID NO: 46057
  misc_feature 1..30: note = chr19:58512170-58512200
  misc_feature 1..30: note = hypo
  source 1..30: mol_type = genomic DNA

SEQ ID NO: 66460 - DNA, 75 bp, Homo sapiens; identical to SEQ ID NO: 46058
  misc_feature 1..75: note = chr19:58517427-58517502
  misc_feature 1..75: note = hypo
  source 1..75: mol_type = genomic DNA

SEQ ID NO: 66461 - DNA, 41 bp, Homo sapiens; identical to SEQ ID NO: 46059
  misc_feature 1..41: note = chr19:58536175-58536216
  misc_feature 1..41: note = hypo
  source 1..41: mol_type = genomic DNA

SEQ ID NO: 66462 - DNA, 157 bp, Homo sapiens; identical to SEQ ID NO: 46060
  misc_feature 1..157: note = chr19:58836900-58837057
  misc_feature 1..157: note = hypo
  source 1..157: mol_type = genomic DNA

SEQ ID NO: 66463 - DNA, 75 bp, Homo sapiens; identical to SEQ ID NO: 46062
  misc_feature 1..75: note = chr19:58891154-58891229
  misc_feature 1..75: note = hypo
  source 1..75: mol_type = genomic DNA

SEQ ID NO: 66464 - skipped

SEQ ID NO: 66465 - DNA, 20 bp, Homo sapiens
  misc_feature 1..20: note = chr20:277026-277046
  misc_feature 1..20: note = hypo
  source 1..20: mol_type = genomic DNA
gctaccggccgggcgcggtg

SEQ ID NO: 66466 - DNA, 68 bp, Homo sapiens
  misc_feature 1..68: note = chr20:399939-400007
  misc_feature 1..68: note = hypo
  source 1..68: mol_type = genomic DNA
gtggaccaagtgggccgcgtggaaccaccaccctttaaccctcctccacagatctgggcttcaaggac

SEQ ID NO: 66467 - DNA, 38 bp, Homo sapiens
  misc_feature 1..38: note = chr20:400087-400125
  misc_feature 1..38: note = hypo
  source 1..38: mol_type = genomic DNA
agatgcagtgcctgagcccccaccggtaagctgtcctt

SEQ ID NO: 66468 - DNA, 104 bp, Homo sapiens
  misc_feature 1..104: note = chr20:401049-401153
  misc_feature 1..104: note = hypo
  source 1..104: mol_type = genomic DNA
ccccactcctgttcccgtctcagctcctcggcttcgtcacttccccacccctgacgttgagtggctccaccagccctggcccgggccctgccctgctacctgac

SEQ ID NO: 66469 - DNA, 408 bp, Homo sapiens
  misc_feature 1..408: note = chr20:401183-401591
  misc_feature 1..408: note = hypo
  source 1..408: mol_type = genomic DNA
ccttgctgccattgctgtctcacctggcgccttccgtggctacctggccggcctcccctcccttggcttccccacctccacctggcctcactcccagccccgcccctcccaacctgcctgctcctgcccatcccccaccccccaccccccatcccccagccccacccccatcccccacccccgtcccccatcccccatccctactggctcccagctttgcctgtggctggtctgacccagccctgaccacgccccctggcccttcccccttcggggtctgacccgcccccgaggccctgacccgccccgtggccccgccccgtgtgcccagcggaagcagcagcagcaggaggggaactacctgcagcacgtccagctggaccagaggagcctggtgctgaacacgga

SEQ ID NO: 66470 - DNA, 415 bp, Homo sapiens
  misc_feature 1..415: note = chr20:401756-402171
  misc_feature 1..415: note = hypo
  source 1..415: mol_type = genomic DNA
gtgctctgatacctcattggacgcccgcgaaaacctacgaggtaggctccgtctccccatgttgcggacgaggaacctgagggaaagagaggcccagcgccttaccccaggcccacggctcatgagagaagcagcctagacgtgagcgcaggcgtggggggagactcccttcccctctacctttcgccgcccgggctcctgcagccacgctgctctcagcctcgctgtgggcatctgccagtttctgagtctcctgtcatggcccccccacccctgaatgtggggaacacagacccgctcaccacagcggacccttgtggagccgcccctgggtgacaggctccgtgcctgcctcctgcagcttacattccagcagagaggctgatgagaatcggataatcgctggttgatgtct

SEQ ID NO: 66471 - DNA, 143 bp, Homo sapiens; identical to SEQ ID NO: 46067
  misc_feature 1..143: note = chr20:741900-742043
  misc_feature 1..143: note = hypo
  source 1..143: mol_type = genomic DNA

SEQ ID NO: 66472 - DNA, 27 bp, Homo sapiens
  misc_feature 1..27: note = chr20:799706-799733
  misc_feature 1..27: note = hypo
  source 1..27: mol_type = genomic DNA
gagccaccgcgccgggcccagcttctg

SEQ ID NO: 66473 - DNA, 41 bp, Homo sapiens; identical to SEQ ID NO: 16556
  misc_feature 1..41: note = chr20:1323452-1323493
  misc_feature 1..41: note = hypo
  source 1..41: mol_type = genomic DNA

SEQ ID NO: 66474 - DNA, 30 bp, Homo sapiens; identical to SEQ ID NO: 16557
  misc_feature 1..30: note = chr20:1692274-1692304
  misc_feature 1..30: note = hypo
  source 1..30: mol_type = genomic DNA

SEQ ID NO: 66475 - DNA, 30 bp, Homo sapiens; identical to SEQ ID NO: 46072
  misc_feature 1..30: note = chr20:2058766-2058796
  misc_feature 1..30: note = hypo
  source 1..30: mol_type = genomic DNA

SEQ ID NO: 66476 - DNA, 147 bp, Homo sapiens; identical to SEQ ID NO: 5237
  misc_feature 1..147: note = chr20:2113428-2113575
  misc_feature 1..147: note = hypo
  source 1..147: mol_type = genomic DNA

SEQ ID NO: 66477 - DNA, 41 bp, Homo sapiens; identical to SEQ ID NO: 46074
  misc_feature 1..41: note = chr20:2444391-2444432
  misc_feature 1..41: note = hypo
  source 1..41: mol_type = genomic DNA

SEQ ID NO: 66478 - DNA, 32 bp, Homo sapiens; identical to SEQ ID NO: 16560
  misc_feature 1..32: note = chr20:2645508-2645540
  misc_feature 1..32: note = hypo
  source 1..32: mol_type = genomic DNA

SEQ ID NO: 66479 - DNA, 30 bp, Homo sapiens; identical to SEQ ID NO: 46076
  misc_feature 1..30: note = chr20:3001373-3001403
  misc_feature 1..30: note = hypo
  source 1..30: mol_type = genomic DNA

SEQ ID NO: 66480 - DNA, 30 bp, Homo sapiens; identical to SEQ ID NO: 46078
  misc_feature 1..30: note = chr20:3202086-3202116
  misc_feature 1..30: note = hypo
  source 1..30: mol_type = genomic DNA

SEQ ID NO: 66481 - DNA, 91 bp, Homo sapiens; identical to SEQ ID NO: 16562
  misc_feature 1..91: note = chr20:3202418-3202509
  misc_feature 1..91: note = hypo
  source 1..91: mol_type = genomic DNA

SEQ ID NO: 66482 - DNA, 23 bp, Homo sapiens
  misc_feature 1..23: note = chr20:3204952-3204975
  misc_feature 1..23: note = hypo
  source 1..23: mol_type = genomic DNA
atgccacacgcccttactctgtg

SEQ ID NO: 66483 - DNA, 30 bp, Homo sapiens; identical to SEQ ID NO: 46081
  misc_feature 1..30: note = chr20:3729991-3730021
  misc_feature 1..30: note = hypo
  source 1..30: mol_type = genomic DNA

SEQ ID NO: 66484 - DNA, 30 bp, Homo sapiens; identical to SEQ ID NO: 16564
  misc_feature 1..30: note = chr20:3763473-3763503
  misc_feature 1..30: note = hypo
  source 1..30: mol_type = genomic DNA

SEQ ID NO: 66485 - DNA, 34 bp, Homo sapiens; identical to SEQ ID NO: 46083
  misc_feature 1..34: note = chr20:3764967-3765001
  misc_feature 1..34: note = hypo
  source 1..34: mol_type = genomic DNA

SEQ ID NO: 66486 - DNA, 105 bp, Homo sapiens; identical to SEQ ID NO: 16565
  misc_feature 1..105: note = chr20:3820924-3821029
  misc_feature 1..105: note = hypo
  source 1..105: mol_type = genomic DNA

SEQ ID NO: 66487 - DNA, 17 bp, Homo sapiens
  misc_feature 1..17: note = chr20:4657798-4657815
  misc_feature 1..17: note = hypo
  source 1..17: mol_type = genomic DNA
tccgtctaaaaaaaaaa

SEQ ID NO: 66488 - DNA, 30 bp, Homo sapiens; identical to SEQ ID NO: 46086
  misc_feature 1..30: note = chr20:4677123-4677153
  misc_feature 1..30: note = hypo
  source 1..30: mol_type = genomic DNA

SEQ ID NO: 66489 - DNA, 76 bp, Homo sapiens; identical to SEQ ID NO: 46087
  misc_feature 1..76: note = chr20:4690696-4690772
  misc_feature 1..76: note = hypo
  source 1..76: mol_type = genomic DNA

SEQ ID NO: 66490 - DNA, 30 bp, Homo sapiens; identical to SEQ ID NO: 46088
  misc_feature 1..30: note = chr20:4749380-4749410
  misc_feature 1..30: note = hypo
  source 1..30: mol_type = genomic DNA

SEQ ID NO: 66491 - DNA, 48 bp, Homo sapiens; identical to SEQ ID NO: 46089
  misc_feature 1..48: note = chr20:5762556-5762604
  misc_feature 1..48: note = hypo
  source 1..48: mol_type = genomic DNA

SEQ ID NO: 66492 - DNA, 30 bp, Homo sapiens; identical to SEQ ID NO: 46090
  misc_feature 1..30: note = chr20:10641102-10641132
  misc_feature 1..30: note = hypo
  source 1..30: mol_type = genomic DNA

SEQ ID NO: 66493 - DNA, 207 bp, Homo sapiens; identical to SEQ ID NO: 46091
  misc_feature 1..207: note = chr20:13243380-13243587
  misc_feature 1..207: note = hypo
  source 1..207: mol_type = genomic DNA

SEQ ID NO: 66494 - DNA, 142 bp, Homo sapiens; identical to SEQ ID NO: 46092
  misc_feature 1..142: note = chr20:16554594-16554736
  misc_feature 1..142: note = hypo
  source 1..142: mol_type = genomic DNA

SEQ ID NO: 66495 - DNA, 142 bp, Homo sapiens; identical to SEQ ID NO: 46093
  misc_feature 1..142: note = chr20:16555036-16555178
  misc_feature 1..142: note = hypo
  source 1..142: mol_type = genomic DNA

SEQ ID NO: 66496 - DNA, 179 bp, Homo sapiens; identical to SEQ ID NO: 46094
  misc_feature 1..179: note = chr20:17482564-17482743
  misc_feature 1..179: note = hypo
  source 1..179: mol_type = genomic DNA

SEQ ID NO: 66497 - DNA, 30 bp, Homo sapiens; identical to SEQ ID NO: 46095
  misc_feature 1..30: note = chr20:17702368-17702398
  misc_feature 1..30: note = hypo
  source 1..30: mol_type = genomic DNA

SEQ ID NO: 66498 - DNA, 154 bp, Homo sapiens; identical to SEQ ID NO: 46096
  misc_feature 1..154: note = chr20:18233341-18233495
  misc_feature 1..154: note = hypo
  source 1..154: mol_type = genomic DNA

SEQ ID NO: 66499 - DNA, 196 bp, Homo sapiens
  misc_feature 1..196: note = chr20:18489658-18489854
  misc_feature 1..196: note = hypo
  source 1..196: mol_type = genomic DNA
ccggccgccagtgccttttaataaagaacgttttgagagagagacggttatttaatgaaatctgctgacatacttgctgagagttgtgatagaacttgctttcattccgactttagttatccctttgcttcccatgaagctccagagtgcttcctgtgcacacagtgcttcaggttcttgccgttgccagaaataa

SEQ ID NO: 66500 - DNA, 197 bp, Homo sapiens; identical to SEQ ID NO: 46098
  misc_feature 1..197: note = chr20:19080645-19080842
  misc_feature 1..197: note = hypo
  source 1..197: mol_type = genomic DNA

SEQ ID NO: 66501 - DNA, 40 bp, Homo sapiens; identical to SEQ ID NO: 46099
  misc_feature 1..40: note = chr20:19674013-19674053
  misc_feature 1..40: note = hypo
  source 1..40: mol_type = genomic DNA

SEQ ID NO: 66502 - DNA, 30 bp, Homo sapiens; identical to SEQ ID NO: 46101
  misc_feature 1..30: note = chr20:19961658-19961688
  misc_feature 1..30: note = hypo
  source 1..30: mol_type = genomic DNA

SEQ ID NO: 66503 - DNA, 30 bp, Homo sapiens; identical to SEQ ID NO: 46102
  misc_feature 1..30: note = chr20:20376922-20376952
  misc_feature 1..30: note = hypo
  source 1..30: mol_type = genomic DNA

SEQ ID NO: 66504 - DNA, 30 bp, Homo sapiens; identical to SEQ ID NO: 46103
  misc_feature 1..30: note = chr20:20377191-20377221
  misc_feature 1..30: note = hypo
  source 1..30: mol_type = genomic DNA

SEQ ID NO: 66505 - DNA, 30 bp, Homo sapiens; identical to SEQ ID NO: 46104
  misc_feature 1..30: note = chr20:20421168-20421198
  misc_feature 1..30: note = hypo
  source 1..30: mol_type = genomic DNA

SEQ ID NO: 66506 - DNA, 32 bp, Homo sapiens; identical to SEQ ID NO: 46105
  misc_feature 1..32: note = chr20:20914015-20914047
  misc_feature 1..32: note = hypo
  source 1..32: mol_type = genomic DNA

SEQ ID NO: 66507 - DNA, 30 bp, Homo sapiens; identical to SEQ ID NO: 46106
  misc_feature 1..30: note = chr20:23117794-23117824
  misc_feature 1..30: note = hypo
  source 1..30: mol_type = genomic DNA

SEQ ID NO: 66508 - DNA, 37 bp, Homo sapiens; identical to SEQ ID NO: 46107
  misc_feature 1..37: note = chr20:23138450-23138487
  misc_feature 1..37: note = hypo
  source 1..37: mol_type = genomic DNA

SEQ ID NO: 66509 - DNA, 94 bp, Homo sapiens; identical to SEQ ID NO: 46108
  misc_feature 1..94: note = chr20:24467593-24467687
  misc_feature 1..94: note = hypo
  source 1..94: mol_type = genomic DNA

SEQ ID NO: 66510 - DNA, 174 bp, Homo sapiens; identical to SEQ ID NO: 46109
  misc_feature 1..174: note = chr20:24523871-24524045
  misc_feature 1..174: note = hypo
  source 1..174: mol_type = genomic DNA

SEQ ID NO: 66511 - DNA, 134 bp, Homo sapiens; identical to SEQ ID NO: 46110
  misc_feature 1..134: note = chr20:24571035-24571169
  misc_feature 1..134: note = hypo
  source 1..134: mol_type = genomic DNA

SEQ ID NO: 66512 - DNA, 77 bp, Homo sapiens; identical to SEQ ID NO: 46111
  misc_feature 1..77: note = chr20:24571472-24571549
  misc_feature 1..77: note = hypo
  source 1..77: mol_type = genomic DNA

SEQ ID NO: 66513 - DNA, 46 bp, Homo sapiens; identical to SEQ ID NO: 46112
  misc_feature 1..46: note = chr20:24872951-24872997
  misc_feature 1..46: note = hypo
  source 1..46: mol_type = genomic DNA

SEQ ID NO: 66514 - DNA, 246 bp, Homo sapiens; identical to SEQ ID NO: 46113
  misc_feature 1..246: note = chr20:25028280-25028526
  misc_feature 1..246: note = hypo
  source 1..246: mol_type = genomic DNA

SEQ ID NO: 66515 - DNA, 152 bp, Homo sapiens; identical to SEQ ID NO: 46114
  misc_feature 1..152: note = chr20:25230352-25230504
  misc_feature 1..152: note = hypo
  source 1..152: mol_type = genomic DNA

SEQ ID NO: 66516 - DNA, 156 bp, Homo sapiens
  misc_feature 1..156: note = chr20:25230799-25230955
  misc_feature 1..156: note = hypo
  source 1..156: mol_type = genomic DNA
attgtctaagtggcggatggcaaggacatagctctgccttcacattcaagggcatttccttggagctggaccaggactcagctctacaccttagggtgcccattggagtatttatgtataatcacatcctggagaggccagcgatgggctcaggga

SEQ ID NO: 66517 - DNA, 97 bp, Homo sapiens; identical to SEQ ID NO: 46116
  misc_feature 1..97: note = chr20:25251463-25251560
  misc_feature 1..97: note = hypo
  source 1..97: mol_type = genomic DNA

SEQ ID NO: 66518 - DNA, 30 bp, Homo sapiens; identical to SEQ ID NO: 46117
  misc_feature 1..30: note = chr20:25603036-25603066
  misc_feature 1..30: note = hypo
  source 1..30: mol_type = genomic DNA

SEQ ID NO: 66519 - DNA, 30 bp, Homo sapiens; identical to SEQ ID NO: 46118
  misc_feature 1..30: note = chr20:30022593-30022623
  misc_feature 1..30: note = hypo
  source 1..30: mol_type = genomic DNA

SEQ ID NO: 66520 - DNA, 28 bp, Homo sapiens
  misc_feature 1..28: note = chr20:30134312-30134340
  misc_feature 1..28: note = hypo
  source 1..28: mol_type = genomic DNA
ggaggctgaggcaggcggatgacttgag

SEQ ID NO: 66521 - DNA, 47 bp, Homo sapiens; identical to SEQ ID NO: 46121
  misc_feature 1..47: note = chr20:30153940-30153987
  misc_feature 1..47: note = hypo
  source 1..47: mol_type = genomic DNA

SEQ ID NO: 66522 - DNA, 20 bp, Homo sapiens
  misc_feature 1..20: note = chr20:30181151-30181171
  misc_feature 1..20: note = hypo
  source 1..20: mol_type = genomic DNA
cacatcgttgcttttgcatc

SEQ ID NO: 66523 - DNA, 30 bp, Homo sapiens; identical to SEQ ID NO: 46123
  misc_feature 1..30: note = chr20:30464460-30464490
  misc_feature 1..30: note = hypo
  source 1..30: mol_type = genomic DNA

SEQ ID NO: 66524 - DNA, 33 bp, Homo sapiens; identical to SEQ ID NO: 46124
  misc_feature 1..33: note = chr20:30468280-30468313
  misc_feature 1..33: note = hypo
  source 1..33: mol_type = genomic DNA

SEQ ID NO: 66525 - DNA, 51 bp, Homo sapiens; identical to SEQ ID NO: 46125
  misc_feature 1..51: note = chr20:30585053-30585104
  misc_feature 1..51: note = hypo
  source 1..51: mol_type = genomic DNA

SEQ ID NO: 66526 - DNA, 30 bp, Homo sapiens; identical to SEQ ID NO: 46126
  misc_feature 1..30: note = chr20:30671697-30671727
  misc_feature 1..30: note = hypo
  source 1..30: mol_type = genomic DNA

SEQ ID NO: 66527 - DNA, 30 bp, Homo sapiens; identical to SEQ ID NO: 46127
  misc_feature 1..30: note = chr20:30770464-30770494
  misc_feature 1..30: note = hypo
  source 1..30: mol_type = genomic DNA

SEQ ID NO: 66528 - DNA, 153 bp, Homo sapiens; identical to SEQ ID NO: 5243
  misc_feature 1..153: note = chr20:30864866-30865019
  misc_feature 1..153: note = hypo
  source 1..153: mol_type = genomic DNA

SEQ ID NO: 66529 - DNA, 48 bp, Homo sapiens; identical to SEQ ID NO: 46129
  misc_feature 1..48: note = chr20:31108565-31108613
  misc_feature 1..48: note = hypo
  source 1..48: mol_type = genomic DNA

SEQ ID NO: 66530 - DNA, 66 bp, Homo sapiens
  misc_feature 1..66: note = chr20:31115617-31115683
  misc_feature 1..66: note = hypo
  source 1..66: mol_type = genomic DNA
gctctccacatgcatcgagtagatgatgtcaaagaaatcttccaccacagcgacccgcttcagaga

SEQ ID NO: 66531 - DNA, 31 bp, Homo sapiens
  misc_feature 1..31: note = chr20:31115799-31115830
  misc_feature 1..31: note = hypo
  source 1..31: mol_type = genomic DNA
ggacgggcaatgcctccgacagtgggtcttg

SEQ ID NO: 66532 - DNA, 30 bp, Homo sapiens; identical to SEQ ID NO: 46131
  misc_feature 1..30: note = chr20:31147343-31147373
  misc_feature 1..30: note = hypo
  source 1..30: mol_type = genomic DNA

SEQ ID NO: 66533 - DNA, 30 bp, Homo sapiens; identical to SEQ ID NO: 46132
  misc_feature 1..30: note = chr20:31151622-31151652
  misc_feature 1..30: note = hypo
  source 1..30: mol_type = genomic DNA

SEQ ID NO: 66534 - DNA, 159 bp, Homo sapiens; identical to SEQ ID NO: 46133
  misc_feature 1..159: note = chr20:31226664-31226823
  misc_feature 1..159: note = hypo
  source 1..159: mol_type = genomic DNA

SEQ ID NO: 66535 - DNA, 30 bp, Homo sapiens; identical to SEQ ID NO: 46134
  misc_feature 1..30: note = chr20:31553994-31554024
  misc_feature 1..30: note = hypo
  source 1..30: mol_type = genomic DNA

SEQ ID NO: 66536 - DNA, 30 bp, Homo sapiens; identical to SEQ ID NO: 46135
  misc_feature 1..30: note = chr20:31940171-31940201
  misc_feature 1..30: note = hypo
  source 1..30: mol_type = genomic DNA

SEQ ID NO: 66537 - DNA, 223 bp, Homo sapiens; identical to SEQ ID NO: 46136
  misc_feature 1..223: note = chr20:32242529-32242752
  misc_feature 1..223: note = hypo
  source 1..223: mol_type = genomic DNA

SEQ ID NO: 66538 - DNA, 30 bp, Homo sapiens; identical to SEQ ID NO: 46138
  misc_feature 1..30: note = chr20:32414088-32414118
  misc_feature 1..30: note = hypo
  source 1..30: mol_type = genomic DNA

SEQ ID NO: 66539 - DNA, 116 bp, Homo sapiens
  misc_feature 1..116: note = chr20:32450427-32450543
  misc_feature 1..116: note = hypo
  source 1..116: mol_type = genomic DNA
gacttcaggggcaaatgtacattgggaatctccaagggacatctcccaaactacctgaccagggtgtgggttccgccgaatatcttttgggaaacgctgtgcgggggtccctagag

SEQ ID NO: 66540 - DNA, 38 bp, Homo sapiens; identical to SEQ ID NO: 46140
  misc_feature 1..38: note = chr20:32459722-32459760
  misc_feature 1..38: note = hypo
  source 1..38: mol_type = genomic DNA

SEQ ID NO: 66541 - DNA, 30 bp, Homo sapiens; identical to SEQ ID NO: 16581
  misc_feature 1..30: note = chr20:32524318-32524348
  misc_feature 1..30: note = hypo
  source 1..30: mol_type = genomic DNA

SEQ ID NO: 66542 - DNA, 30 bp, Homo sapiens; identical to SEQ ID NO: 46142
  misc_feature 1..30: note = chr20:32950057-32950087
  misc_feature 1..30: note = hypo
  source 1..30: mol_type = genomic DNA

SEQ ID NO: 66543 - DNA, 123 bp, Homo sapiens; identical to SEQ ID NO: 46143
  misc_feature 1..123: note = chr20:33134858-33134981
  misc_feature 1..123: note = hypo
  source 1..123: mol_type = genomic DNA

SEQ ID NO: 66544 - DNA, 30 bp, Homo sapiens; identical to SEQ ID NO: 46144
  misc_feature 1..30: note = chr20:33137930-33137960
  misc_feature 1..30: note = hypo
  source 1..30: mol_type = genomic DNA

SEQ ID NO: 66545 - DNA, 29 bp, Homo sapiens
  misc_feature 1..29: note = chr20:33290324-33290353
  misc_feature 1..29: note = hypo
  source 1..29: mol_type = genomic DNA
ttatcactagagtgccgggcacggtggct

SEQ ID NO: 66546 - DNA, 30 bp, Homo sapiens; identical to SEQ ID NO: 16583
  misc_feature 1..30: note = chr20:33547626-33547656
  misc_feature 1..30: note = hypo
  source 1..30: mol_type = genomic DNA

SEQ ID NO: 66547 - DNA, 30 bp, Homo sapiens; identical to SEQ ID NO: 46147
  misc_feature 1..30: note = chr20:33574865-33574895
  misc_feature 1..30: note = hypo
  source 1..30: mol_type = genomic DNA

SEQ ID NO: 66548 - DNA, 45 bp, Homo sapiens; identical to SEQ ID NO: 46148
  misc_feature 1..45: note = chr20:33834734-33834779
  misc_feature 1..45: note = hypo
  source 1..45: mol_type = genomic DNA

SEQ ID NO: 66549 - DNA, 41 bp, Homo sapiens; identical to SEQ ID NO: 46149
  misc_feature 1..41: note = chr20:33855099-33855140
  misc_feature 1..41: note = hypo
  source 1..41: mol_type = genomic DNA

SEQ ID NO: 66550 - DNA, 30 bp, Homo sapiens; identical to SEQ ID NO: 16584
  misc_feature 1..30: note = chr20:33866905-33866935
  misc_feature 1..30: note = hypo
  source 1..30: mol_type = genomic DNA

SEQ ID NO: 66551 - DNA, 244 bp, Homo sapiens; identical to SEQ ID NO: 46151
  misc_feature 1..244: note = chr20:33879984-33880228
  misc_feature 1..244: note = hypo
  source 1..244: mol_type = genomic DNA

SEQ ID NO: 66552 - DNA, 30 bp, Homo sapiens; identical to SEQ ID NO: 46153
  misc_feature 1..30: note = chr20:34147200-34147230
  misc_feature 1..30: note = hypo
  source 1..30: mol_type = genomic DNA

SEQ ID NO: 66553 - DNA, 42 bp, Homo sapiens
  misc_feature 1..42: note = chr20:34147978-34148020
  misc_feature 1..42: note = hypo
  source 1..42: mol_type = genomic DNA
aagggtccagacctgcgccagacgctcacctcccgctccgtg

SEQ ID NO: 66554 - DNA, 63 bp, Homo sapiens; identical to SEQ ID NO: 46155
  misc_feature 1..63: note = chr20:34710619-34710682
  misc_feature 1..63: note = hypo
  source 1..63: mol_type = genomic DNA

SEQ ID NO: 66555 - DNA, 131 bp, Homo sapiens; identical to SEQ ID NO: 46156
  misc_feature 1..131: note = chr20:35089026-35089157
  misc_feature 1..131: note = hypo
  source 1..131: mol_type = genomic DNA

SEQ ID NO: 66556 - DNA, 256 bp, Homo sapiens; identical to SEQ ID NO: 46157
  misc_feature 1..256: note = chr20:35924156-35924412
  misc_feature 1..256: note = hypo
  source 1..256: mol_type = genomic DNA

SEQ ID NO: 66557 - DNA, 33 bp, Homo sapiens; identical to SEQ ID NO: 46158
  misc_feature 1..33: note = chr20:36049828-36049861
  misc_feature 1..33: note = hypo
  source 1..33: mol_type = genomic DNA

SEQ ID NO: 66558 - DNA, 39 bp, Homo sapiens; identical to SEQ ID NO: 16588
  misc_feature 1..39: note = chr20:36151122-36151161
  misc_feature 1..39: note = hypo
  source 1..39: mol_type = genomic DNA

SEQ ID NO: 66559 - DNA, 35 bp, Homo sapiens; identical to SEQ ID NO: 46160
  misc_feature 1..35: note = chr20:36526859-36526894
  misc_feature 1..35: note = hypo
  source 1..35: mol_type = genomic DNA

SEQ ID NO: 66560 - DNA, 96 bp, Homo sapiens; identical to SEQ ID NO: 46161
  misc_feature 1..96: note = chr20:36571234-36571330
  misc_feature 1..96: note = hypo
  source 1..96: mol_type = genomic DNA

SEQ ID NO: 66561 - DNA, 30 bp, Homo sapiens; identical to SEQ ID NO: 46162
  misc_feature 1..30: note = chr20:36767887-36767917
  misc_feature 1..30: note = hypo
  source 1..30: mol_type = genomic DNA

SEQ ID NO: 66562 - DNA, 63 bp, Homo sapiens; identical to SEQ ID NO: 46163
  misc_feature 1..63: note = chr20:36775268-36775331
  misc_feature 1..63: note = hypo
  source 1..63: mol_type = genomic DNA

SEQ ID NO: 66563 - DNA, 40 bp, Homo sapiens; identical to SEQ ID NO: 46164
  misc_feature 1..40: note = chr20:39687444-39687484
  misc_feature 1..40: note = hypo
  source 1..40: mol_type = genomic DNA

SEQ ID NO: 66564 - DNA, 30 bp, Homo sapiens; identical to SEQ ID NO: 46165
  misc_feature 1..30: note = chr20:40715181-40715211
  misc_feature 1..30: note = hypo
  source 1..30: mol_type = genomic DNA

SEQ ID NO: 66565 - DNA, 107 bp, Homo sapiens; identical to SEQ ID NO: 46166
  misc_feature 1..107: note = chr20:42088631-42088738
  misc_feature 1..107: note = hypo
  source 1..107: mol_type = genomic DNA

SEQ ID NO: 66566 - DNA, 143 bp, Homo sapiens; identical to SEQ ID NO: 46167
  misc_feature 1..143: note = chr20:42199155-42199298
  misc_feature 1..143: note = hypo
  source 1..143: mol_type = genomic DNA

SEQ ID NO: 66567 - DNA, 30 bp, Homo sapiens; identical to SEQ ID NO: 25751
  misc_feature 1..30: note = chr20:42218664-42218694
  misc_feature 1..30: note = hypo
  source 1..30: mol_type = genomic DNA

SEQ ID NO: 66568 - DNA, 30 bp, Homo sapiens; identical to SEQ ID NO: 46169
  misc_feature 1..30: note = chr20:42853157-42853187
  misc_feature 1..30: note = hypo
  source 1..30: mol_type = genomic DNA

SEQ ID NO: 66569 - DNA, 128 bp, Homo sapiens; identical to SEQ ID NO: 16591
  misc_feature 1..128: note = chr20:43065628-43065756
  misc_feature 1..128: note = hypo
  source 1..128: mol_type = genomic DNA

SEQ ID NO: 66570 - DNA, 113 bp, Homo sapiens; identical to SEQ ID NO: 46171
  misc_feature 1..113: note = chr20:43276908-43277021
  misc_feature 1..113: note = hypo
  source 1..113: mol_type = genomic DNA

SEQ ID NO: 66571 - DNA, 37 bp, Homo sapiens; identical to SEQ ID NO: 46172
  misc_feature 1..37: note = chr20:43385586-43385623
  misc_feature 1..37: note = hypo
  source 1..37: mol_type = genomic DNA

SEQ ID NO: 66572 - DNA, 31 bp, Homo sapiens; identical to SEQ ID NO: 46173
  misc_feature 1..31: note = chr20:43952328-43952359
  misc_feature 1..31: note = hypo
  source 1..31: mol_type = genomic DNA

SEQ ID NO: 66573 - DNA, 40 bp, Homo sapiens; identical to SEQ ID NO: 46174
  misc_feature 1..40: note = chr20:44477901-44477941
  misc_feature 1..40: note = hypo
  source 1..40: mol_type = genomic DNA

SEQ ID NO: 66574 - DNA, 30 bp, Homo sapiens; identical to SEQ ID NO: 46175
  misc_feature 1..30: note = chr20:44562147-44562177
  misc_feature 1..30: note = hypo
  source 1..30: mol_type = genomic DNA

SEQ ID NO: 66575 - DNA, 40 bp, Homo sapiens; identical to SEQ ID NO: 46176
  misc_feature 1..40: note = chr20:44601506-44601546
  misc_feature 1..40: note = hypo
  source 1..40: mol_type = genomic DNA

SEQ ID NO: 66576 - DNA, 288 bp, Homo sapiens
  misc_feature 1..288: note = chr20:44601786-44602074
  misc_feature 1..288: note = hypo
  source 1..288: mol_type = genomic DNA
gcgacagagcgagaccctctttcaaaaaataaataaatacaagtcaactacctatcctttaaaagtggagaaagaaaaaaaattttaattaaaagtcagctgcccttaaggtatgtccttcctccggaaatgtcaccttctgttttaagacttttagcagtttgcagtggaagagcacaagagggagtaaggcgctctggtttttgtccctaagtctctgtagttccataggctattttccttaattgaaagatacaaattttgggggaaaaaaatctcaaaaaaact

SEQ ID NO: 66577 - DNA, 82 bp, Homo sapiens
  misc_feature 1..82: note = chr20:44602364-44602446
  misc_feature 1..82: note = hypo
  source 1..82: mol_type = genomic DNA
caaacaaacaaacaaaaagtcctaaggagaagacctattaataaggagaaaaggtccgggctcggtgggtcacacctgtaat

SEQ ID NO: 66578 - DNA, 47 bp, Homo sapiens; identical to SEQ ID NO: 46179
  misc_feature 1..47: note = chr20:44756555-44756602
  misc_feature 1..47: note = hypo
  source 1..47: mol_type = genomic DNA

SEQ ID NO: 66579 - DNA, 30 bp, Homo sapiens; identical to SEQ ID NO: 46180
  misc_feature 1..30: note = chr20:44845534-44845564
  misc_feature 1..30: note = hypo
  source 1..30: mol_type = genomic DNA

SEQ ID NO: 66580 - DNA, 199 bp, Homo sapiens
  misc_feature 1..199: note = chr20:45337605-45337804
  misc_feature 1..199: note = hypo
  source 1..199: mol_type = genomic DNA
tgcctaacccaccaccgtagtttaactttctgcctagtctttatcactagctgatatttctcaggatcctttagttacttctttttcgtcttcccctcctagaatgtaaactcttcccctcctagaaggtaaacaaaagacctgttctgttttgttcttcggcccatcccaagcctagcgtagtgcctggtatgtggtg

SEQ ID NO: 66581 - DNA, 76 bp, Homo sapiens; identical to SEQ ID NO: 25758
  misc_feature 1..76: note = chr20:45337945-45338021
  misc_feature 1..76: note = hypo
  source 1..76: mol_type = genomic DNA

SEQ ID NO: 66582 - DNA, 30 bp, Homo sapiens; identical to SEQ ID NO: 46182
  misc_feature 1..30: note = chr20:45834171-45834201
  misc_feature 1..30: note = hypo
  source 1..30: mol_type = genomic DNA

SEQ ID NO: 66583 - DNA, 32 bp, Homo sapiens; identical to SEQ ID NO: 46183
  misc_feature 1..32: note = chr20:45949151-45949183
  misc_feature 1..32: note = hypo
  source 1..32: mol_type = genomic DNA

SEQ ID NO: 66584 - DNA, 30 bp, Homo sapiens; identical to SEQ ID NO: 46184
  misc_feature 1..30: note = chr20:45951653-45951683
  misc_feature 1..30: note = hypo
  source 1..30: mol_type = genomic DNA

SEQ ID NO: 66585 - DNA, 146 bp, Homo sapiens; identical to SEQ ID NO: 46185
  misc_feature 1..146: note = chr20:46013515-46013661
  misc_feature 1..146: note = hypo
  source 1..146: mol_type = genomic DNA

SEQ ID NO: 66586 - DNA, 30 bp, Homo sapiens; identical to SEQ ID NO: 46186
  misc_feature 1..30: note = chr20:46175625-46175655
  misc_feature 1..30: note = hypo
  source 1..30: mol_type = genomic DNA

SEQ ID NO: 66587 - DNA, 30 bp, Homo sapiens; identical to SEQ ID NO: 46187
  misc_feature 1..30: note = chr20:46315525-46315555
  misc_feature 1..30: note = hypo
  source 1..30: mol_type = genomic DNA

SEQ ID NO: 66588 - DNA, 36 bp, Homo sapiens; identical to SEQ ID NO: 46188
  misc_feature 1..36: note = chr20:46365599-46365635
  misc_feature 1..36: note = hypo
  source 1..36: mol_type = genomic DNA

SEQ ID NO: 66589 - DNA, 30 bp, Homo sapiens; identical to SEQ ID NO: 46189
  misc_feature 1..30: note = chr20:46582135-46582165
  misc_feature 1..30: note = hypo
  source 1..30: mol_type = genomic DNA

SEQ ID NO: 66590 - DNA, 30 bp, Homo sapiens; identical to SEQ ID NO: 46190
  misc_feature 1..30: note = chr20:46823521-46823551
  misc_feature 1..30: note = hypo
  source 1..30: mol_type = genomic DNA

SEQ ID NO: 66591 - DNA, 30 bp, Homo sapiens; identical to SEQ ID NO: 46191
  misc_feature 1..30: note = chr20:47128746-47128776
  misc_feature 1..30: note = hypo
  source 1..30: mol_type = genomic DNA

SEQ ID NO: 66592 - DNA, 38 bp, Homo sapiens; identical to SEQ ID NO: 25760
  misc_feature 1..38: note = chr20:47247201-47247239
  misc_feature 1..38: note = hypo
  source 1..38: mol_type = genomic DNA

SEQ ID NO: 66593 - DNA, 36 bp, Homo sapiens; identical to SEQ ID NO: 46193
  misc_feature 1..36: note = chr20:47252955-47252991
  misc_feature 1..36: note = hypo
  source 1..36: mol_type = genomic DNA

SEQ ID NO: 66594 - DNA, 36 bp, Homo sapiens; identical to SEQ ID NO: 46194
  misc_feature 1..36: note = chr20:47260725-47260761
  misc_feature 1..36: note = hypo
  source 1..36: mol_type = genomic DNA

SEQ ID NO: 66595 - DNA, 182 bp, Homo sapiens; identical to SEQ ID NO: 46195
  misc_feature 1..182: note = chr20:47274120-47274302
  misc_feature 1..182: note = hypo
  source 1..182: mol_type = genomic DNA

SEQ ID NO: 66596 - DNA, 30 bp, Homo sapiens; identical to SEQ ID NO: 46196
  misc_feature 1..30: note = chr20:47274646-47274676
  misc_feature 1..30: note = hypo
  source 1..30: mol_type = genomic DNA

SEQ ID NO: 66597 - DNA, 133 bp, Homo sapiens
  misc_feature 1..133: note = chr20:47296231-47296364
  misc_feature 1..133: note = hypo
  source 1..133: mol_type = genomic DNA
ccatcgtcgtagcggaagcgatacatcacctgctcattcttgaactggtgcttgtcggaaactggagagacaggaggacctgtgacgctgggcacgccccctcagcccctcccagccacgccccccagcattg

SEQ ID NO: 66598 - DNA, 184 bp, Homo sapiens; identical to SEQ ID NO: 16602
  misc_feature 1..184: note = chr20:47428537-47428721
  misc_feature 1..184: note = hypo
  source 1..184: mol_type = genomic DNA

SEQ ID NO: 66599 - DNA, 118 bp, Homo sapiens; identical to SEQ ID NO: 46199
  misc_feature 1..118: note = chr20:47837088-47837206
  misc_feature 1..118: note = hypo
  source 1..118: mol_type = genomic DNA

SEQ ID NO: 66600 - DNA, 76 bp, Homo sapiens
  misc_feature 1..76: note = chr20:47905350-47905426
  misc_feature 1..76: note = hypo
  source 1..76: mol_type = genomic DNA
taaacattttgccaacgcaggtacaatatgggattcaataaaagtacagaattaaagttgtcttattagagattgg

SEQ ID NO: 66601 - DNA, 33 bp, Homo sapiens; identical to SEQ ID NO: 46201
  misc_feature 1..33: note = chr20:48252895-48252928
  misc_feature 1..33: note = hypo
  source 1..33: mol_type = genomic DNA

SEQ ID NO: 66602 - DNA, 30 bp, Homo sapiens; identical to SEQ ID NO: 16604
  misc_feature 1..30: note = chr20:48477511-48477541
  misc_feature 1..30: note = hypo
  source 1..30: mol_type = genomic DNA

SEQ ID NO: 66603 - DNA, 88 bp, Homo sapiens; identical to SEQ ID NO: 46203
  misc_feature 1..88: note = chr20:48673896-48673984
  misc_feature 1..88: note = hypo
  source 1..88: mol_type = genomic DNA

SEQ ID NO: 66604 - DNA, 21 bp, Homo sapiens
  misc_feature 1..21: note = chr20:48720805-48720826
  misc_feature 1..21: note = hypo
  source 1..21: mol_type = genomic DNA
agactccgtctcaaaaaaaaa

SEQ ID NO: 66605 - DNA, 154 bp, Homo sapiens; identical to SEQ ID NO: 46205
  misc_feature 1..154: note = chr20:48767027-48767181
  misc_feature 1..154: note = hypo
  source 1..154: mol_type = genomic DNA

SEQ ID NO: 66606 - DNA, 25 bp, Homo sapiens
  misc_feature 1..25: note = chr20:48771341-48771366
  misc_feature 1..25: note = hypo
  source 1..25: mol_type = genomic DNA
ttccatacaggcagccgggcgcggt

SEQ ID NO: 66607 - DNA, 180 bp, Homo sapiens; identical to SEQ ID NO: 46207
  misc_feature 1..180: note = chr20:48863456-48863636
  misc_feature 1..180: note = hypo
  source 1..180: mol_type = genomic DNA

SEQ ID NO: 66608 - DNA, 142 bp, Homo sapiens; identical to SEQ ID NO: 46208
  misc_feature 1..142: note = chr20:49047022-49047164
  misc_feature 1..142: note = hypo
  source 1..142: mol_type = genomic DNA

SEQ ID NO: 66609 - DNA, 30 bp, Homo sapiens; identical to SEQ ID NO: 46209
  misc_feature 1..30: note = chr20:49194287-49194317
  misc_feature 1..30: note = hypo
  source 1..30: mol_type = genomic DNA

SEQ ID NO: 66610 - DNA, 111 bp, Homo sapiens; identical to SEQ ID NO: 46210
  misc_feature 1..111: note = chr20:49200439-49200550
  misc_feature 1..111: note = hypo
  source 1..111: mol_type = genomic DNA

SEQ ID NO: 66611 - DNA, 99 bp, Homo sapiens; identical to SEQ ID NO: 46212
  misc_feature 1..99: note = chr20:49218709-49218808
  misc_feature 1..99: note = hypo
  source 1..99: mol_type = genomic DNA

SEQ ID NO: 66612 - DNA, 26 bp, Homo sapiens
  misc_feature 1..26: note = chr20:49250786-49250812
  misc_feature 1..26: note = hypo
  source 1..26: mol_type = genomic DNA
aggattatagccgtgagccaccgcgc

SEQ ID NO: 66613 - DNA, 79 bp, Homo sapiens; identical to SEQ ID NO: 46214
  misc_feature 1..79: note = chr20:49252062-49252141
  misc_feature 1..79: note = hypo
  source 1..79: mol_type = genomic DNA

SEQ ID NO: 66614 - DNA, 42 bp, Homo sapiens; identical to SEQ ID NO: 25770
  misc_feature 1..42: note = chr20:49261761-49261803
  misc_feature 1..42: note = hypo
  source 1..42: mol_type = genomic DNA

SEQ ID NO: 66615 - DNA, 44 bp, Homo sapiens
  misc_feature 1..44: note = chr20:49262104-49262148
  misc_feature 1..44: note = hypo
  source 1..44: mol_type = genomic DNA
ctaagggcactgggaaccctgtgggcatgcgcagttcaagccca

SEQ ID NO: 66616 - DNA, 114 bp, Homo sapiens; identical to SEQ ID NO: 46216
  misc_feature 1..114: note = chr20:49286780-49286894
  misc_feature 1..114: note = hypo
  source 1..114: mol_type = genomic DNA

SEQ ID NO: 66617 - DNA, 56 bp, Homo sapiens; identical to SEQ ID NO: 46218
  misc_feature 1..56: note = chr20:49345671-49345727
  misc_feature 1..56: note = hypo
  source 1..56: mol_type = genomic DNA

SEQ ID NO: 66618 - DNA, 295 bp, Homo sapiens; identical to SEQ ID NO: 46219
  misc_feature 1..295: note = chr20:49346464-49346759
  misc_feature 1..295: note = hypo
  source 1..295: mol_type = genomic DNA

SEQ ID NO: 66619 - DNA, 26 bp, Homo sapiens
  misc_feature 1..26: note = chr20:49350870-49350896
  misc_feature 1..26: note = hypo
  source 1..26: mol_type = genomic DNA
aactaggtagtgtgccggtccttttt

SEQ ID NO: 66620 - DNA, 28 bp, Homo sapiens
  misc_feature 1..28: note = chr20:49378043-49378071
  misc_feature 1..28: note = hypo
  source 1..28: mol_type = genomic DNA
ggcggagtttttgcgctaggttatctac

SEQ ID NO: 66621 - DNA, 30 bp, Homo sapiens; identical to SEQ ID NO: 16619
  misc_feature 1..30: note = chr20:49380822-49380852
  misc_feature 1..30: note = hypo
  source 1..30: mol_type = genomic DNA

SEQ ID NO: 66622 - DNA, 30 bp, Homo sapiens; identical to SEQ ID NO: 46224
  misc_feature 1..30: note = chr20:49502935-49502965
  misc_feature 1..30: note = hypo
  source 1..30: mol_type = genomic DNA

SEQ ID NO: 66623 - DNA, 20 bp, Homo sapiens
  misc_feature 1..20: note = chr20:52275978-52275998
  misc_feature 1..20: note = hypo
  source 1..20: mol_type = genomic DNA
tttttttttttgagacggag

SEQ ID NO: 66624 - DNA, 76 bp, Homo sapiens; identical to SEQ ID NO: 46226
  misc_feature 1..76: note = chr20:52341635-52341711
  misc_feature 1..76: note = hypo
  source 1..76: mol_type = genomic DNA

SEQ ID NO: 66625 - DNA, 30 bp, Homo sapiens; identical to SEQ ID NO: 46227
  misc_feature 1..30: note = chr20:52484713-52484743
  misc_feature 1..30: note = hypo
  source 1..30: mol_type = genomic DNA

SEQ ID NO: 66626 - DNA, 40 bp, Homo sapiens; identical to SEQ ID NO: 46228
  misc_feature 1..40: note = chr20:52693155-52693195
  misc_feature 1..40: note = hypo
  source 1..40: mol_type = genomic DNA

SEQ ID NO: 66627 - DNA, 99 bp, Homo sapiens; identical to SEQ ID NO: 46229
  misc_feature 1..99: note = chr20:52693375-52693474
  misc_feature 1..99: note = hypo
  source 1..99: mol_type = genomic DNA

SEQ ID NO: 66628 - DNA, 30 bp, Homo sapiens; identical to SEQ ID NO: 46230
  misc_feature 1..30: note = chr20:52773951-52773981
  misc_feature 1..30: note = hypo
  source 1..30: mol_type = genomic DNA

SEQ ID NO: 66629 - DNA, 198 bp, Homo sapiens; identical to SEQ ID NO: 46231
  misc_feature 1..198: note = chr20:52867324-52867522
  misc_feature 1..198: note = hypo
  source 1..198: mol_type = genomic DNA

SEQ ID NO: 66630 - DNA, 79 bp, Homo sapiens; identical to SEQ ID NO: 46232
  misc_feature 1..79: note = chr20:53051998-53052077
  misc_feature 1..79: note = hypo
  source 1..79: mol_type = genomic DNA

SEQ ID NO: 66631 - DNA, 24 bp, Homo sapiens
  misc_feature 1..24: note = chr20:53209356-53209380
  misc_feature 1..24: note = hypo
  source 1..24: mol_type = genomic DNA
caccacgcccggccagataaattt

SEQ ID NO: 66632 - DNA, 23 bp, Homo sapiens
  misc_feature 1..23: note = chr20:53535735-53535758
  misc_feature 1..23: note = hypo
  source 1..23: mol_type = genomic DNA
aaaaccaggaggggccgggcgcg

SEQ ID NO: 66633 - DNA, 30 bp, Homo sapiens; identical to SEQ ID NO: 46235
  misc_feature 1..30: note = chr20:53866697-53866727
  misc_feature 1..30: note = hypo
  source 1..30: mol_type = genomic DNA

SEQ ID NO: 66634 - DNA, 18 bp, Homo sapiens
  misc_feature 1..18: note = chr20:54585945-54585963
  misc_feature 1..18: note = hypo
  source 1..18: mol_type = genomic DNA
tttgaggtgcagtctcgc

SEQ ID NO: 66635 - DNA, 101 bp, Homo sapiens; identical to SEQ ID NO: 46237
  misc_feature 1..101: note = chr20:55378966-55379067
  misc_feature 1..101: note = hypo
  source 1..101: mol_type = genomic DNA

SEQ ID NO: 66636 - DNA, 38 bp, Homo sapiens; identical to SEQ ID NO: 46238
  misc_feature 1..38: note = chr20:55379439-55379477
  misc_feature 1..38: note = hypo
  source 1..38: mol_type = genomic DNA

SEQ ID NO: 66637 - DNA, 146 bp, Homo sapiens
  misc_feature 1..146: note = chr20:55693381-55693527
  misc_feature 1..146: note = hypo
  source 1..146: mol_type = genomic DNA
accccacctaagcaccgctcaccccactacacccgcagcactgcccgcctcacagagcagggccccacctgcctcagagtaagaaaccagcagctccaccacccctggaggctgccttggcgcagcactggaaacattcataagaa

SEQ ID NO: 66638 - skipped

SEQ ID NO: 66639 - DNA, 30 bp, Homo sapiens; identical to SEQ ID NO: 16624
  misc_feature 1..30: note = chr20:55925381-55925411
  misc_feature 1..30: note = hypo
  source 1..30: mol_type = genomic DNA

SEQ ID NO: 66640 - DNA, 215 bp, Homo sapiens; identical to SEQ ID NO: 46241
  misc_feature 1..215: note = chr20:55958990-55959205
  misc_feature 1..215: note = hypo
  source 1..215: mol_type = genomic DNA

SEQ ID NO: 66641 - DNA, 94 bp, Homo sapiens; identical to SEQ ID NO: 46242
  misc_feature 1..94: note = chr20:55959325-55959419
  misc_feature 1..94: note = hypo
  source 1..94: mol_type = genomic DNA

SEQ ID NO: 66642 - DNA, 117 bp, Homo sapiens; identical to SEQ ID NO: 46243
  misc_feature 1..117: note = chr20:55969858-55969975
  misc_feature 1..117: note = hypo
  source 1..117: mol_type = genomic DNA

SEQ ID NO: 66643 - DNA, 35 bp, Homo sapiens; identical to SEQ ID NO: 46244
  misc_feature 1..35: note = chr20:55989687-55989722
  misc_feature 1..35: note = hypo
  source 1..35: mol_type = genomic DNA

SEQ ID NO: 66644 - DNA, 30 bp, Homo sapiens; identical to SEQ ID NO: 46245
  misc_feature 1..30: note = chr20:56041897-56041927
  misc_feature 1..30: note = hypo
  source 1..30: mol_type = genomic DNA

SEQ ID NO: 66645 - DNA, 23 bp, Homo sapiens
  misc_feature 1..23: note = chr20:56053945-56053968
  misc_feature 1..23: note = hypo
  source 1..23: mol_type = genomic DNA
gttatccaaattagccgggcacg

SEQ ID NO: 66646 - DNA, 30 bp, Homo sapiens; identical to SEQ ID NO: 46247
  misc_feature 1..30: note = chr20:56065208-56065238
  misc_feature 1..30: note = hypo
  source 1..30: mol_type = genomic DNA

SEQ ID NO: 66647 - DNA, 30 bp, Homo sapiens; identical to SEQ ID NO: 46248
  misc_feature 1..30: note = chr20:56265981-56266011
  misc_feature 1..30: note = hypo
  source 1..30: mol_type = genomic DNA

SEQ ID NO: 66648 - DNA, 180 bp, Homo sapiens; identical to SEQ ID NO: 46249
  misc_feature 1..180: note = chr20:56271495-56271675
  misc_feature 1..180: note = hypo
  source 1..180: mol_type = genomic DNA

SEQ ID NO: 66649 - DNA, 30 bp, Homo sapiens; identical to SEQ ID NO: 46250
  misc_feature 1..30: note = chr20:56385780-56385810
  misc_feature 1..30: note = hypo
  source 1..30: mol_type = genomic DNA

SEQ ID NO: 66650 - DNA, 60 bp, Homo sapiens
  misc_feature 1..60: note = chr20:56766190-56766250
  misc_feature 1..60: note = hypo
  source 1..60: mol_type = genomic DNA
tctggtcagttagaatcctccatcctggccgggcgcggtggctcacgcctgtaatcccag

SEQ ID NO: 66651 - DNA, 30 bp, Homo sapiens; identical to SEQ ID NO: 46252
  misc_feature 1..30: note = chr20:56771631-56771661
  misc_feature 1..30: note = hypo
  source 1..30: mol_type = genomic DNA

SEQ ID NO: 66652 - DNA, 305 bp, Homo sapiens; identical to SEQ ID NO: 46253
  misc_feature 1..305: note = chr20:56771994-56772299
  misc_feature 1..305: note = hypo
  source 1..305: mol_type = genomic DNA

SEQ ID NO: 66653 - DNA, 30 bp, Homo sapiens; identical to SEQ ID NO: 46254
  misc_feature 1..30: note = chr20:56780688-56780718
  misc_feature 1..30: note = hypo
  source 1..30: mol_type = genomic DNA

SEQ ID NO: 66654 - DNA, 40 bp, Homo sapiens; identical to SEQ ID NO: 46255
  misc_feature 1..40: note = chr20:56781064-56781104
  misc_feature 1..40: note = hypo
  source 1..40: mol_type = genomic DNA

SEQ ID NO: 66655 - DNA, 30 bp, Homo sapiens; identical to SEQ ID NO: 46256
  misc_feature 1..30: note = chr20:56839640-56839670
  misc_feature 1..30: note = hypo
  source 1..30: mol_type = genomic DNA

SEQ ID NO: 66656 - DNA, 30 bp, Homo sapiens; identical to SEQ ID NO: 16627
  misc_feature 1..30: note = chr20:57198958-57198988
  misc_feature 1..30: note = hypo
  source 1..30: mol_type = genomic DNA

SEQ ID NO: 66657 - DNA, 32 bp, Homo sapiens; identical to SEQ ID NO: 46258
  misc_feature 1..32: note = chr20:57268913-57268945
  misc_feature 1..32: note = hypo
  source 1..32: mol_type = genomic DNA

SEQ ID NO: 66658 - DNA, 38 bp, Homo sapiens; identical to SEQ ID NO: 46259
  misc_feature 1..38: note = chr20:57392369-57392407
  misc_feature 1..38: note = hypo
  source 1..38: mol_type = genomic DNA

SEQ ID NO: 66659 - DNA, 30 bp, Homo sapiens; identical to SEQ ID NO: 46260
  misc_feature 1..30: note = chr20:57398016-57398046
  misc_feature 1..30: note = hypo
  source 1..30: mol_type = genomic DNA

SEQ ID NO: 66660 - DNA, 76 bp, Homo sapiens; identical to SEQ ID NO: 46261
  misc_feature 1..76: note = chr20:57622769-57622845
  misc_feature 1..76: note = hypo
  source 1..76: mol_type = genomic DNA

SEQ ID NO: 66661 - DNA, 76 bp, Homo sapiens; identical to SEQ ID NO: 46262
  misc_feature 1..76: note = chr20:57622905-57622981
  misc_feature 1..76: note = hypo
  source 1..76: mol_type = genomic DNA

SEQ ID NO: 66662 - DNA, 51 bp, Homo sapiens; identical to SEQ ID NO: 46263
  misc_feature 1..51: note = chr20:57699771-57699822
  misc_feature 1..51: note = hypo
  source 1..51: mol_type = genomic DNA

SEQ ID NO: 66663 - DNA, 197 bp, Homo sapiens; identical to SEQ ID NO: 46264
  misc_feature 1..197: note = chr20:58283870-58284067
  misc_feature 1..197: note = hypo
  source 1..197: mol_type = genomic DNA

SEQ ID NO: 66664 - DNA, 159 bp, Homo sapiens; identical to SEQ ID NO: 46265
  misc_feature 1..159: note = chr20:58311576-58311735
  misc_feature 1..159: note = hypo
  source 1..159: mol_type = genomic DNA

SEQ ID NO: 66665 - DNA, 68 bp, Homo sapiens; identical to SEQ ID NO: 46266
  misc_feature 1..68: note = chr20:58348402-58348470
  misc_feature 1..68: note = hypo
  source 1..68: mol_type = genomic DNA

SEQ ID NO: 66666 - DNA, 317 bp, Homo sapiens; identical to SEQ ID NO: 46267
  misc_feature 1..317: note = chr20:58507720-58508037
  misc_feature 1..317: note = hypo
  source 1..317: mol_type = genomic DNA

SEQ ID NO: 66667 - DNA, 303 bp, Homo sapiens; identical to SEQ ID NO: 46268
  misc_feature 1..303: note = chr20:58514097-58514400
  misc_feature 1..303: note = hypo
  source 1..303: mol_type = genomic DNA

SEQ ID NO: 66668 - DNA, 30 bp, Homo sapiens; identical to SEQ ID NO: 46269
  misc_feature 1..30: note = chr20:58671797-58671827
  misc_feature 1..30: note = hypo
  source 1..30: mol_type = genomic DNA

SEQ ID NO: 66669 - DNA, 99 bp, Homo sapiens; identical to SEQ ID NO: 46270
  misc_feature 1..99: note = chr20:59005702-59005801
  misc_feature 1..99: note = hypo
  source 1..99: mol_type = genomic DNA

SEQ ID NO: 66670 - DNA, 31 bp, Homo sapiens; identical to SEQ ID NO: 46271
  misc_feature 1..31: note = chr20:59185805-59185836
  misc_feature 1..31: note = hypo
  source 1..31: mol_type = genomic DNA

SEQ ID NO: 66671 - DNA, 185 bp, Homo sapiens; identical to SEQ ID NO: 46272
  misc_feature 1..185: note = chr20:59232938-59233123
  misc_feature 1..185: note = hypo
  source 1..185: mol_type = genomic DNA

SEQ ID NO: 66672 - DNA, 30 bp, Homo sapiens; identical to SEQ ID NO: 46273
  misc_feature 1..30: note = chr20:59598638-59598668
  misc_feature 1..30: note = hypo
  source 1..30: mol_type = genomic DNA

SEQ ID NO: 66673 - DNA, 185 bp, Homo sapiens; identical to SEQ ID NO: 46274
  misc_feature 1..185: note = chr20:59708146-59708331
  misc_feature 1..185: note = hypo
  source 1..185: mol_type = genomic DNA

SEQ ID NO: 66674 - DNA, 94 bp, Homo sapiens; identical to SEQ ID NO: 46275
  misc_feature 1..94: note = chr20:59821803-59821897
  misc_feature 1..94: note = hypo
  source 1..94: mol_type = genomic DNA

SEQ ID NO: 66675 - DNA, 30 bp, Homo sapiens; identical to SEQ ID NO: 46276
  misc_feature 1..30: note = chr20:59855416-59855446
  misc_feature 1..30: note = hypo
  source 1..30: mol_type = genomic DNA

SEQ ID NO: 66676 - skipped

SEQ ID NO: 66677 - DNA, 30 bp, Homo sapiens; identical to SEQ ID NO: 46278
  misc_feature 1..30: note = chr20:59967982-59968012
  misc_feature 1..30: note = hypo
  source 1..30: mol_type = genomic DNA

SEQ ID NO: 66678 - DNA, 33 bp, Homo sapiens
  misc_feature 1..33: note = chr20:59973072-59973105
  misc_feature 1..33: note = hypo
  source 1..33: mol_type = genomic DNA
catggcaagcttcacctgcgtgtcctgaaccag

SEQ ID NO: 66679 - DNA, 158 bp, Homo sapiens; identical to SEQ ID NO: 46280
  misc_feature 1..158: note = chr20:60120725-60120883
  misc_feature 1..158: note = hypo
  source 1..158: mol_type = genomic DNA

SEQ ID NO: 66680 - DNA, 30 bp, Homo sapiens; identical to SEQ ID NO: 46281
  misc_feature 1..30: note = chr20:60121193-60121223
  misc_feature 1..30: note = hypo
  source 1..30: mol_type = genomic DNA

SEQ ID NO: 66681 - DNA, 30 bp, Homo sapiens; identical to SEQ ID NO: 46282
  misc_feature 1..30: note = chr20:60122026-60122056
  misc_feature 1..30: note = hypo
  source 1..30: mol_type = genomic DNA

SEQ ID NO: 66682 - DNA, 36 bp, Homo sapiens; identical to SEQ ID NO: 46283
  misc_feature 1..36: note = chr20:60162590-60162626
  misc_feature 1..36: note = hypo
  source 1..36: mol_type = genomic DNA

SEQ ID NO: 66683 - DNA, 30 bp, Homo sapiens; identical to SEQ ID NO: 46284
  misc_feature 1..30: note = chr20:60174306-60174336
  misc_feature 1..30: note = hypo
  source 1..30: mol_type = genomic DNA

SEQ ID NO: 66684 - DNA, 159 bp, Homo sapiens; identical to SEQ ID NO: 46285
  misc_feature 1..159: note = chr20:60175455-60175614
  misc_feature 1..159: note = hypo
  source 1..159: mol_type = genomic DNA

SEQ ID NO: 66685 - DNA, 30 bp, Homo sapiens; identical to SEQ ID NO: 46286
  misc_feature 1..30: note = chr20:60176588-60176618
  misc_feature 1..30: note = hypo
  source 1..30: mol_type = genomic DNA

SEQ ID NO: 66686 - DNA, 30 bp, Homo sapiens; identical to SEQ ID NO: 16634
  misc_feature 1..30: note = chr20:60202364-60202394
  misc_feature 1..30: note = hypo
  source 1..30: mol_type = genomic DNA

SEQ ID NO: 66687 - DNA, 21 bp, Homo sapiens
  misc_feature 1..21: note = chr20:60202624-60202645
  misc_feature 1..21: note = hypo
  source 1..21: mol_type = genomic DNA
ttgtgtcgaccatgactgctt

SEQ ID NO: 66688 - DNA, 30 bp, Homo sapiens; identical to SEQ ID NO: 46289
  misc_feature 1..30: note = chr20:60210184-60210214
  misc_feature 1..30: note = hypo
  source 1..30: mol_type = genomic DNA

SEQ ID NO: 66689 - DNA, 164 bp, Homo sapiens; identical to SEQ ID NO: 46290
  misc_feature 1..164: note = chr20:60225027-60225191
  misc_feature 1..164: note = hypo
  source 1..164: mol_type = genomic DNA

SEQ ID NO: 66690 - DNA, 182 bp, Homo sapiens; identical to SEQ ID NO: 46291
  misc_feature 1..182: note = chr20:60227182-60227364
  misc_feature 1..182: note = hypo
  source 1..182: mol_type = genomic DNA

SEQ ID NO: 66691 - DNA, 158 bp, Homo sapiens; identical to SEQ ID NO: 46293
  misc_feature 1..158: note = chr20:60237356-60237514
  misc_feature 1..158: note = hypo
  source 1..158: mol_type = genomic DNA

SEQ ID NO: 66692 - DNA, 90 bp, Homo sapiens; identical to SEQ ID NO: 25792
  misc_feature 1..90: note = chr20:60238291-60238381
  misc_feature 1..90: note = hypo
  source 1..90: mol_type = genomic DNA

SEQ ID NO: 66693 - DNA, 29 bp, Homo sapiens
  misc_feature 1..29: note = chr20:60238848-60238877
  misc_feature 1..29: note = hypo
  source 1..29: mol_type = genomic DNA
gggcaccactgaacacggggtaaaccaat

SEQ ID NO: 66694 - DNA, 67 bp, Homo sapiens
  misc_feature 1..67: note = chr20:60238980-60239047
  misc_feature 1..67: note = hypo
  source 1..67: mol_type = genomic DNA
tgacactgtcctctgtccagcaccggtccacgttgaggtgtctgtgtgccaccgggacccttccgta

SEQ ID NO: 66695 - DNA, 27 bp, Homo sapiens
  misc_feature 1..27: note = chr20:60244107-60244134
  misc_feature 1..27: note = hypo
  source 1..27: mol_type = genomic DNA
ttccttcaccctcggggatggtgcctg

SEQ ID NO: 66696 - DNA, 54 bp, Homo sapiens; identical to SEQ ID NO: 46297
  misc_feature 1..54: note = chr20:60281411-60281465
  misc_feature 1..54: note = hypo
  source 1..54: mol_type = genomic DNA

SEQ ID NO: 66697 - DNA, 71 bp, Homo sapiens; identical to SEQ ID NO: 46298
  misc_feature 1..71: note = chr20:60281806-60281877
  misc_feature 1..71: note = hypo
  source 1..71: mol_type = genomic DNA

SEQ ID NO: 66698 - DNA, 183 bp, Homo sapiens; identical to SEQ ID NO: 46299
  misc_feature 1..183: note = chr20:60304145-60304328
  misc_feature 1..183: note = hypo
  source 1..183: mol_type = genomic DNA

SEQ ID NO: 66699 - DNA, 56 bp, Homo sapiens; identical to SEQ ID NO: 46301
  misc_feature 1..56: note = chr20:60355322-60355378
  misc_feature 1..56: note = hypo
  source 1..56: mol_type = genomic DNA

SEQ ID NO: 66700 - DNA, 100 bp, Homo sapiens
  misc_feature 1..100: note = chr20:60359749-60359849
  misc_feature 1..100: note = hypo
  source 1..100: mol_type = genomic DNA
gtaatcccagttcctcgggacagttctcaaggccctccgatatcctgtgcccccaggagaatgtaagcccagttcctcggaacagttctccaggccctca

SEQ ID NO: 66701 - DNA, 127 bp, Homo sapiens
  misc_feature 1..127: note = chr20:60374909-60375036
  misc_feature 1..127: note = hypo
  source 1..127: mol_type = genomic DNA
agcctcataacaccacggtccctgcggggcctcgagtggggcctctgcagtggctctgccccgctccccatctctcatgcaacctccctgagagcccagggccatctccgcttgtcttcatggcccg

SEQ ID NO: 66702 - DNA, 250 bp, Homo sapiens
  misc_feature 1..250: note = chr20:60375070-60375320
  misc_feature 1..250: note = hypo
  source 1..250: mol_type = genomic DNA
tcggtgggcacagtcaccgggccggcttccccgcctgtgcttcctctgaggggttccccagcccacagcatggtccagggccgggtggggccagcatcctctactccctccttgaagcctgtgcagggctgcatcttctttgtgtgcaagcaagcgagcggcctgcagccccaagggccctttgtgagtgctgcaaagccccgaagaccagaccgcactccctcgagtgcacacacggtgcttctgggaa

SEQ ID NO: 66703 - DNA, 164 bp, Homo sapiens; identical to SEQ ID NO: 46304
  misc_feature 1..164: note = chr20:60385207-60385371
  misc_feature 1..164: note = hypo
  source 1..164: mol_type = genomic DNA

SEQ ID NO: 66704 - DNA, 243 bp, Homo sapiens; identical to SEQ ID NO: 46305
  misc_feature 1..243: note = chr20:60415719-60415962
  misc_feature 1..243: note = hypo
  source 1..243: mol_type = genomic DNA

SEQ ID NO: 66705 - DNA, 72 bp, Homo sapiens; identical to SEQ ID NO: 46306
  misc_feature 1..72: note = chr20:60428149-60428221
  misc_feature 1..72: note = hypo
  source 1..72: mol_type = genomic DNA

SEQ ID NO: 66706 - DNA, 30 bp, Homo sapiens; identical to SEQ ID NO: 46307
  misc_feature 1..30: note = chr20:60439765-60439795
  misc_feature 1..30: note = hypo
  source 1..30: mol_type = genomic DNA

SEQ ID NO: 66707 - DNA, 30 bp, Homo sapiens; identical to SEQ ID NO: 46308
  misc_feature 1..30: note = chr20:60447479-60447509
  misc_feature 1..30: note = hypo
  source 1..30: mol_type = genomic DNA

SEQ ID NO: 66708 - DNA, 241 bp, Homo sapiens; identical to SEQ ID NO: 46309
  misc_feature 1..241: note = chr20:60448710-60448951
  misc_feature 1..241: note = hypo
  source 1..241: mol_type = genomic DNA

SEQ ID NO: 66709 - DNA, 30 bp, Homo sapiens; identical to SEQ ID NO: 46310
  misc_feature 1..30: note = chr20:60449466-60449496
  misc_feature 1..30: note = hypo
  source 1..30: mol_type = genomic DNA

SEQ ID NO: 66710 - DNA, 152 bp, Homo sapiens; identical to SEQ ID NO: 46311
  misc_feature 1..152: note = chr20:60452936-60453088
  misc_feature 1..152: note = hypo
  source 1..152: mol_type = genomic DNA

SEQ ID NO: 66711 - DNA, 136 bp, Homo sapiens; identical to SEQ ID NO: 46313
  misc_feature 1..136: note = chr20:60454749-60454885
  misc_feature 1..136: note = hypo
  source 1..136: mol_type = genomic DNA

SEQ ID NO: 66712 - DNA, 30 bp, Homo sapiens; identical to SEQ ID NO: 46314
  misc_feature 1..30: note = chr20:60457286-60457316
  misc_feature 1..30: note = hypo
  source 1..30: mol_type = genomic DNA

SEQ ID NO: 66713 - DNA, 30 bp, Homo sapiens; identical to SEQ ID NO: 46316
  misc_feature 1..30: note = chr20:60492778-60492808
  misc_feature 1..30: note = hypo
  source 1..30: mol_type = genomic DNA

SEQ ID NO: 66714 - DNA, 30 bp, Homo sapiens; identical to SEQ ID NO: 46317
  misc_feature 1..30: note = chr20:60495131-60495161
  misc_feature 1..30: note = hypo
  source 1..30: mol_type = genomic DNA

SEQ ID NO: 66715 - DNA, 111 bp, Homo sapiens; identical to SEQ ID NO: 46318
  misc_feature 1..111: note = chr20:60502200-60502311
  misc_feature 1..111: note = hypo
  source 1..111: mol_type = genomic DNA

SEQ ID NO: 66716 - DNA, 40 bp, Homo sapiens; identical to SEQ ID NO: 46319
  misc_feature 1..40: note = chr20:60502586-60502626
  misc_feature 1..40: note = hypo
  source 1..40: mol_type = genomic DNA

SEQ ID NO: 66717 - DNA, 198 bp, Homo sapiens
  misc_feature 1..198: note = chr20:60502832-60503030
  misc_feature 1..198: note = hypo
  source 1..198: mol_type = genomic DNA
ggctgtgagtttccacgtgaatgccacaccccgctgtgtgcgtgtgtgcaggtgtgggtgtggccgtgtgctctgccgtgtctgttgaggtgccgtgcgcagtggctgtgtgcgtgtgtgcagctgcgggtgtgggtgtggccgtgtgctttgccgtgtctgttgaggtgccgtacgcagtggtgtggctgcccatgg

SEQ ID NO: 66718 - DNA, 179 bp, Homo sapiens; identical to SEQ ID NO: 46321
  misc_feature 1..179: note = chr20:60515823-60516002
  misc_feature 1..179: note = hypo
  source 1..179: mol_type = genomic DNA

SEQ ID NO: 66719 - DNA, 107 bp, Homo sapiens; identical to SEQ ID NO: 46322
  misc_feature 1..107: note = chr20:60552230-60552337
  misc_feature 1..107: note = hypo
  source 1..107: mol_type = genomic DNA

SEQ ID NO: 66720 - DNA, 46 bp, Homo sapiens; identical to SEQ ID NO: 46323
  misc_feature 1..46: note = chr20:60578805-60578851
  misc_feature 1..46: note = hypo
  source 1..46: mol_type = genomic DNA

SEQ ID NO: 66721 - DNA, 179 bp, Homo sapiens; identical to SEQ ID NO: 46325
  misc_feature 1..179: note = chr20:60781327-60781506
  misc_feature 1..179: note = hypo
  source 1..179: mol_type = genomic DNA

SEQ ID NO: 66722 - DNA, 52 bp, Homo sapiens
  misc_feature 1..52: note = chr20:60790124-60790176
  misc_feature 1..52: note = hypo
  source 1..52: mol_type = genomic DNA
tggcgaagcggcccctgcccgggcacctcctctggaccgcccctgcacgcct

SEQ ID NO: 66723 - DNA, 34 bp, Homo sapiens; identical to SEQ ID NO: 46327
  misc_feature 1..34: note = chr20:60803825-60803859
  misc_feature 1..34: note = hypo
  source 1..34: mol_type = genomic DNA

SEQ ID NO: 66724 - DNA, 66 bp, Homo sapiens; identical to SEQ ID NO: 46329
  misc_feature 1..66: note = chr20:60921238-60921304
  misc_feature 1..66: note = hypo
  source 1..66: mol_type = genomic DNA

SEQ ID NO: 66725 - DNA, 41 bp, Homo sapiens; identical to SEQ ID NO: 46330
  misc_feature 1..41: note = chr20:60921597-60921638
  misc_feature 1..41: note = hypo
  source 1..41: mol_type = genomic DNA

SEQ ID NO: 66726 - DNA, 61 bp, Homo sapiens; identical to SEQ ID NO: 46331
  misc_feature 1..61: note = chr20:60921962-60922023
  misc_feature 1..61: note = hypo
  source 1..61: mol_type = genomic DNA

SEQ ID NO: 66727 - DNA, 260 bp, Homo sapiens; identical to SEQ ID NO: 46332
  misc_feature 1..260: note = chr20:60925281-60925541
  misc_feature 1..260: note = hypo
  source 1..260: mol_type = genomic DNA

SEQ ID NO: 66728 - DNA, 110 bp, Homo sapiens; identical to SEQ ID NO: 46333
  misc_feature 1..110: note = chr20:60925847-60925957
  misc_feature 1..110: note = hypo
  source 1..110: mol_type = genomic DNA

SEQ ID NO: 66729 - DNA, 228 bp, Homo sapiens; identical to SEQ ID NO: 46334
  misc_feature 1..228: note = chr20:60953312-60953540
  misc_feature 1..228: note = hypo
  source 1..228: mol_type = genomic DNA

SEQ ID NO: 66730 - DNA, 20 bp, Homo sapiens
  misc_feature 1..20: note = chr20:60970933-60970953
  misc_feature 1..20: note = hypo
  source 1..20: mol_type = genomic DNA
ctctcagggtgcagccggtg

SEQ ID NO: 66731 - DNA, 120 bp, Homo sapiens
  misc_feature 1..120: note = chr20:60984010-60984130
  misc_feature 1..120: note = hypo
  source 1..120: mol_type = genomic DNA
tgagggacaaggaggaatgctgaggaaggaacggggtctcttcctgggtctggtgaacccccttgctaggctcccgctgccagtcttctcccctccccagggtgtcgatgggtggccaaa

SEQ ID NO: 66732 - DNA, 30 bp, Homo sapiens; identical to SEQ ID NO: 16655
  misc_feature 1..30: note = chr20:60984485-60984515
  misc_feature 1..30: note = hypo
  source 1..30: mol_type = genomic DNA

SEQ ID NO: 66733 - DNA, 52 bp, Homo sapiens
  misc_feature 1..52: note = chr20:61288016-61288068
  misc_feature 1..52: note = hypo
  source 1..52: mol_type = genomic DNA
gggacccatgaggtgcggtacgtctcggccgggcagagcgtggcgtgcggct

SEQ ID NO: 66734 - DNA, 307 bp, Homo sapiens; identical to SEQ ID NO: 25807
  misc_feature 1..307: note = chr20:61288156-61288463
  misc_feature 1..307: note = hypo
  source 1..307: mol_type = genomic DNA

SEQ ID NO: 66735 - DNA, 319 bp, Homo sapiens; identical to SEQ ID NO: 46339
  misc_feature 1..319: note = chr20:61291131-61291450
  misc_feature 1..319: note = hypo
  source 1..319: mol_type = genomic DNA

SEQ ID NO: 66736 - DNA, 116 bp, Homo sapiens
  misc_feature 1..116: note = chr20:61294577-61294693
  misc_feature 1..116: note = hypo
  source 1..116: mol_type = genomic DNA
taactagggctgcaccgtctgttcctgattcttcagaatccatttacatttggccacctcctcaaacaagagcatttgaatgttccaggcattcagagttgcgttcatcggaacca

SEQ ID NO: 66737 - DNA, 15 bp, Homo sapiens
  misc_feature 1..15: note = chr20:61294857-61294872
  misc_feature 1..15: note = hypo
  source 1..15: mol_type = genomic DNA
cgacatggacatgtc

SEQ ID NO: 66738 - DNA, 84 bp, Homo sapiens; identical to SEQ ID NO: 46341
  misc_feature 1..84: note = chr20:61305619-61305703
  misc_feature 1..84: note = hypo
  source 1..84: mol_type = genomic DNA

SEQ ID NO: 66739 - DNA, 30 bp, Homo sapiens; identical to SEQ ID NO: 46342
  misc_feature 1..30: note = chr20:61305919-61305949
  misc_feature 1..30: note = hypo
  source 1..30: mol_type = genomic DNA

SEQ ID NO: 66740 - DNA, 50 bp, Homo sapiens; identical to SEQ ID NO: 46343
  misc_feature 1..50: note = chr20:61312710-61312760
  misc_feature 1..50: note = hypo
  source 1..50: mol_type = genomic DNA

SEQ ID NO: 66741 - DNA, 34 bp, Homo sapiens; identical to SEQ ID NO: 46344
  misc_feature 1..34: note = chr20:61314672-61314706
  misc_feature 1..34: note = hypo
  source 1..34: mol_type = genomic DNA

SEQ ID NO: 66742 - DNA, 30 bp, Homo sapiens; identical to SEQ ID NO: 46345
  misc_feature 1..30: note = chr20:61318633-61318663
  misc_feature 1..30: note = hypo
  source 1..30: mol_type = genomic DNA

SEQ ID NO: 66743 - DNA, 115 bp, Homo sapiens; identical to SEQ ID NO: 46346
  misc_feature 1..115: note = chr20:61321299-61321414
  misc_feature 1..115: note = hypo
  source 1..115: mol_type = genomic DNA

SEQ ID NO: 66744 - DNA, 160 bp, Homo sapiens; identical to SEQ ID NO: 46347
  misc_feature 1..160: note = chr20:61329188-61329348
  misc_feature 1..160: note = hypo
  source 1..160: mol_type = genomic DNA

SEQ ID NO: 66745 - DNA, 131 bp, Homo sapiens; identical to SEQ ID NO: 46348
  misc_feature 1..131: note = chr20:61330920-61331051
  misc_feature 1..131: note = hypo
  source 1..131: mol_type = genomic DNA

SEQ ID NO: 66746 - DNA, 30 bp, Homo sapiens; identical to SEQ ID NO: 46349
  misc_feature 1..30: note = chr20:61368079-61368109
  misc_feature 1..30: note = hypo
  source 1..30: mol_type = genomic DNA

SEQ ID NO: 66747 - DNA, 136 bp, Homo sapiens; identical to SEQ ID NO: 46350
  misc_feature 1..136: note = chr20:61374450-61374586
  misc_feature 1..136: note = hypo
  source 1..136: mol_type = genomic DNA

SEQ ID NO: 66748 - DNA, 215 bp, Homo sapiens; identical to SEQ ID NO: 46351
  misc_feature 1..215: note = chr20:61393835-61394050
  misc_feature 1..215: note = hypo
  source 1..215: mol_type = genomic DNA

SEQ ID NO: 66749 - DNA, 22 bp, Homo sapiens
  misc_feature 1..22: note = chr20:61411096-61411118
  misc_feature 1..22: note = hypo
  source 1..22: mol_type = genomic DNA
agttagaaagctcttcgttgtg

SEQ ID NO: 66750 - DNA, 126 bp, Homo sapiens
  misc_feature 1..126: note = chr20:61412187-61412313
  misc_feature 1..126: note = hypo
  source 1..126: mol_type = genomic DNA
gagcccaggtgccaccgagggaatgcaacgtgccacaccccaagacatgacacttgtgagaacagtgtggcccagcccccactccgggcacagcctcggacaccctgcccgcctccgcccatggag

SEQ ID NO: 66751 - DNA, 30 bp, Homo sapiens; identical to SEQ ID NO: 46354
  misc_feature 1..30: note = chr20:61424994-61425024
  misc_feature 1..30: note = hypo
  source 1..30: mol_type = genomic DNA

SEQ ID NO: 66752 - DNA, 58 bp, Homo sapiens; identical to SEQ ID NO: 46355
  misc_feature 1..58: note = chr20:61472103-61472161
  misc_feature 1..58: note = hypo
  source 1..58: mol_type = genomic DNA

SEQ ID NO: 66753 - DNA, 206 bp, Homo sapiens
  misc_feature 1..206: note = chr20:61506330-61506536
  misc_feature 1..206: note = hypo
  source 1..206: mol_type = genomic DNA
ctgggagtgacccaccccccacccccattttcttcatcagtcaccgaaactttcgccccacaggtagctgaccctaaattcagtgaaatccagaactttcctggcacactggagaggacggcagaacgctgggatggatttatcgtgcaagaccagcttgatgtccttagggcttggaggtcaccccttcacgaggattgtgagga

SEQ ID NO: 66754 - DNA, 30 bp, Homo sapiens; identical to SEQ ID NO: 46357
  misc_feature 1..30: note = chr20:61541112-61541142
  misc_feature 1..30: note = hypo
  source 1..30: mol_type = genomic DNA

SEQ ID NO: 66755 - DNA, 76 bp, Homo sapiens; identical to SEQ ID NO: 46358
  misc_feature 1..76: note = chr20:61567431-61567507
  misc_feature 1..76: note = hypo
  source 1..76: mol_type = genomic DNA

SEQ ID NO: 66756 - DNA, 331 bp, Homo sapiens; identical to SEQ ID NO: 46359
  misc_feature 1..331: note = chr20:61570543-61570874
  misc_feature 1..331: note = hypo
  source 1..331: mol_type = genomic DNA

SEQ ID NO: 66757 - DNA, 30 bp, Homo sapiens; identical to SEQ ID NO: 46360
  misc_feature 1..30: note = chr20:61571213-61571243
  misc_feature 1..30: note = hypo
  source 1..30: mol_type = genomic DNA

SEQ ID NO: 66758 - DNA, 30 bp, Homo sapiens; identical to SEQ ID NO: 46361
  misc_feature 1..30: note = chr20:61618995-61619025
  misc_feature 1..30: note = hypo
  source 1..30: mol_type = genomic DNA

SEQ ID NO: 66759 - DNA, 39 bp, Homo sapiens; identical to SEQ ID NO: 46362
  misc_feature 1..39: note = chr20:61655625-61655664
  misc_feature 1..39: note = hypo
  source 1..39: mol_type = genomic DNA

SEQ ID NO: 66760 - DNA, 30 bp, Homo sapiens; identical to SEQ ID NO: 46363
  misc_feature 1..30: note = chr20:61666827-61666857
  misc_feature 1..30: note = hypo
  source 1..30: mol_type = genomic DNA

SEQ ID NO: 66761 - DNA, 105 bp, Homo sapiens; identical to SEQ ID NO: 46364
  misc_feature 1..105: note = chr20:61695646-61695751
  misc_feature 1..105: note = hypo
  source 1..105: mol_type = genomic DNA

SEQ ID NO: 66762 - DNA, 189 bp, Homo sapiens; identical to SEQ ID NO: 46365
  misc_feature 1..189: note = chr20:61714761-61714950
  misc_feature 1..189: note = hypo
  source 1..189: mol_type = genomic DNA

SEQ ID NO: 66763 - DNA, 136 bp, Homo sapiens; identical to SEQ ID NO: 16663
  misc_feature 1..136: note = chr20:61725275-61725411
  misc_feature 1..136: note = hypo
  source 1..136: mol_type = genomic DNA

SEQ ID NO: 66764 - DNA, 34 bp, Homo sapiens; identical to SEQ ID NO: 46367
  misc_feature 1..34: note = chr20:61749778-61749812
  misc_feature 1..34: note = hypo
  source 1..34: mol_type = genomic DNA

SEQ ID NO: 66765 - DNA, 41 bp, Homo sapiens
  misc_feature 1..41: note = chr20:61763628-61763669
  misc_feature 1..41: note = hypo
  source 1..41: mol_type = genomic DNA
tatgtctgttacgccgggcgccggcccgagtcctaaagata

SEQ ID NO: 66766 - DNA, 30 bp, Homo sapiens; identical to SEQ ID NO: 46370
  misc_feature 1..30: note = chr20:61799802-61799832
  misc_feature 1..30: note = hypo
  source 1..30: mol_type = genomic DNA

SEQ ID NO: 66767 - DNA, 30 bp, Homo sapiens; identical to SEQ ID NO: 46371
  misc_feature 1..30: note = chr20:61820146-61820176
  misc_feature 1..30: note = hypo
  source 1..30: mol_type = genomic DNA

SEQ ID NO: 66768 - DNA, 35 bp, Homo sapiens; identical to SEQ ID NO: 46372
  misc_feature 1..35: note = chr20:61823119-61823154
  misc_feature 1..35: note = hypo
  source 1..35: mol_type = genomic DNA

SEQ ID NO: 66769 - DNA, 18 bp, Homo sapiens
  misc_feature 1..18: note = chr20:61838526-61838544
  misc_feature 1..18: note = hypo
  source 1..18: mol_type = genomic DNA
cagctgcattaaccccgg

SEQ ID NO: 66770 - DNA, 102 bp, Homo sapiens; identical to SEQ ID NO: 46374
  misc_feature 1..102: note = chr20:61883273-61883375
  misc_feature 1..102: note = hypo
  source 1..102: mol_type = genomic DNA

SEQ ID NO: 66771 - DNA, 33 bp, Homo sapiens; identical to SEQ ID NO: 46375
  misc_feature 1..33: note = chr20:61941734-61941767
  misc_feature 1..33: note = hypo
  source 1..33: mol_type = genomic DNA

SEQ ID NO: 66772 - DNA, 30 bp, Homo sapiens; identical to SEQ ID NO: 46376
  misc_feature 1..30: note = chr20:61965232-61965262
  misc_feature 1..30: note = hypo
  source 1..30: mol_type = genomic DNA

SEQ ID NO: 66773 - DNA, 345 bp, Homo sapiens
  misc_feature 1..345: note = chr20:61973846-61974191
  misc_feature 1..345: note = hypo
  source 1..345: mol_type = genomic DNA
cctgagaggaggtaacgtcgatgcaaccacgttggcaaacccttcgtcagcagctcattgagccgaccacgcacccttccttcccacggcagagcgggagctcctgggtcagcctccctgccaaagtctgttcacagcagccccgagctggcgacgggtaaataagatggtggagccacgcggcggagcccgcagcacagtggccgcgcagcgagcaatgacccgggatcgggagccgacagaagggcacgcctggcgcggccacgcacagaacccagggccaggcaacgcggggcagaggtgttgggtgacctcgggcgggtcgtggccggccgggctgggcag

SEQ ID NO: 66774 - DNA, 55 bp, Homo sapiens
  misc_feature 1..55: note = chr20:61974354-61974409
  misc_feature 1..55: note = hypo
  source 1..55: mol_type = genomic DNA
gcagacagggagtgtaaacggcacagtcacgtggaagacacgttggcattatctc

SEQ ID NO: 66775 - DNA, 150 bp, Homo sapiens
  misc_feature 1..150: note = chr20:61980710-61980860
  misc_feature 1..150: note = hypo
  source 1..150: mol_type = genomic DNA
cctgtggcccctcaccgtgccgtccgccgaggcccactgtgtcccaaagccagagacggcaccgggatccaccctgtgccagccactcggggccccctgccccgctcagcctgggacctgcggccacatagcaggcttgggaagaggctg

SEQ ID NO: 66776 - DNA, 361 bp, Homo sapiens
  misc_feature 1..361: note = chr20:61980975-61981336
  misc_feature 1..361: note = hypo
  source 1..361: mol_type = genomic DNA
cgcccaacacagccatgggcgggacttaccgagaagtctgtgtcttcggccttcaggtggtctgcaatgtactggacgccctccaccgcccgggtcagggccggcgacaggggcaggtgcgggggcggcgctttggtgctgcgggtcttgaccgtggcgctcggggacaccgaagagggctccttcttgcatgtgcatttgcacggagagggctggtctgggggtgggagctcagccgagtgggtgttgcgagaggccagggcgccggcagcctggccatctgcctcgggggcggcatcgtctcggggaacacagtactggatgctccgagaccggcaccggacgccgccttccaccgctt

SEQ ID NO: 66777 - DNA, 98 bp, Homo sapiens; identical to SEQ ID NO: 46379
  misc_feature 1..98: note = chr20:61982236-61982334
  misc_feature 1..98: note = hypo
  source 1..98: mol_type = genomic DNA

SEQ ID NO: 66778 - DNA, 36 bp, Homo sapiens; identical to SEQ ID NO: 46380
  misc_feature 1..36: note = chr20:61982611-61982647
  misc_feature 1..36: note = hypo
  source 1..36: mol_type = genomic DNA

SEQ ID NO: 66779 - DNA, 30 bp, Homo sapiens; identical to SEQ ID NO: 46381
  misc_feature 1..30: note = chr20:61986659-61986689
  misc_feature 1..30: note = hypo
  source 1..30: mol_type = genomic DNA

SEQ ID NO: 66780 - DNA, 183 bp, Homo sapiens; identical to SEQ ID NO: 46382
  misc_feature 1..183: note = chr20:61990886-61991069
  misc_feature 1..183: note = hypo
  source 1..183: mol_type = genomic DNA

SEQ ID NO: 66781 - DNA, 89 bp, Homo sapiens; identical to SEQ ID NO: 46383
  misc_feature 1..89: note = chr20:62011874-62011963
  misc_feature 1..89: note = hypo
  source 1..89: mol_type = genomic DNA

SEQ ID NO: 66782 - DNA, 116 bp, Homo sapiens; identical to SEQ ID NO: 46384
  misc_feature 1..116: note = chr20:62031637-62031753
  misc_feature 1..116: note = hypo
  source 1..116: mol_type = genomic DNA

SEQ ID NO: 66783 - DNA, 85 bp, Homo sapiens
  misc_feature 1..85: note = chr20:62031973-62032058
  misc_feature 1..85: note = hypo
  source 1..85: mol_type = genomic DNA
gacagccagaggcaacggcgcaaatggggaagctgcagccaccgtcacggccagaggatggcagactgcaatggcgtggggcgcg

SEQ ID NO: 66784 - DNA, 270 bp, Homo sapiens
  misc_feature 1..270: note = chr20:62032095-62032365
  misc_feature 1..270: note = hypo
  source 1..270: mol_type = genomic DNA
cagagggatggcgtccagcgggaccaccagctctgggcgcctcagtgcgagacccctccgtgagacccctcctgccctgcgcgtgtctctggagcccgtcccttgggcccctcgcccgccccacctgttcgcagggtccagggcgtccgtacctggcacagccagggggcatggggcgacctcagggagttcctgtccacatgcattaaggcaacgactttgtaaaacccaggcggagttggcgtgtggcgatggcgatgtgcacgtgcc

SEQ ID NO: 66785 - DNA, 159 bp, Homo sapiens; identical to SEQ ID NO: 46386
  misc_feature 1..159: note = chr20:62033495-62033654
  misc_feature 1..159: note = hypo
  source 1..159: mol_type = genomic DNA

SEQ ID NO: 66786 - DNA, 36 bp, Homo sapiens
  misc_feature 1..36: note = chr20:62037523-62037559
  misc_feature 1..36: note = hypo
  source 1..36: mol_type = genomic DNA
gcccggaaaccccaccgggacccaaggccgcaggtc

SEQ ID NO: 66787 - DNA, 134 bp, Homo sapiens
  misc_feature 1..134: note = chr20:62037598-62037732
  misc_feature 1..134: note = hypo
  source 1..134: mol_type = genomic DNA
aacaggcctgccctttgtgcctcccctgggctcggctgagacaaccccccgcctgttgccacgctggcaacaccccgtcatcactcccgcccctcctcacaccgggctgatgtcggccgcggccctgagcagag

SEQ ID NO: 66788 - DNA, 86 bp, Homo sapiens; identical to SEQ ID NO: 46388
  misc_feature 1..86: note = chr20:62038039-62038125
  misc_feature 1..86: note = hypo
  source 1..86: mol_type = genomic DNA

SEQ ID NO: 66789 - DNA, 183 bp, Homo sapiens; identical to SEQ ID NO: 46389
  misc_feature 1..183: note = chr20:62038491-62038674
  misc_feature 1..183: note = hypo
  source 1..183: mol_type = genomic DNA

SEQ ID NO: 66790 - DNA, 26 bp, Homo sapiens
  misc_feature 1..26: note = chr20:62046201-62046227
  misc_feature 1..26: note = hypo
  source 1..26: mol_type = genomic DNA
caccacatccatccccggagaggatg

SEQ ID NO: 66791 - DNA, 161 bp, Homo sapiens
  misc_feature 1..161: note = chr20:62046421-62046582
  misc_feature 1..161: note = hypo
  source 1..161: mol_type = genomic DNA
cttggcagccacgcctcgggggctggagaagacacgatctttcaaactgaccttctggctgctcccacgggaaccgacagacagacagaaaaacagggagagaagtcactctgcaaagaacacaggccgtgtctgctcatggccgacgccgcccatgcgcc

SEQ ID NO: 66792 - DNA, 54 bp, Homo sapiens; identical to SEQ ID NO: 46391
  misc_feature 1..54: note = chr20:62050926-62050980
  misc_feature 1..54: note = hypo
  source 1..54: mol_type = genomic DNA

SEQ ID NO: 66793 - DNA, 30 bp, Homo sapiens; identical to SEQ ID NO: 46392
  misc_feature 1..30: note = chr20:62052467-62052497
  misc_feature 1..30: note = hypo
  source 1..30: mol_type = genomic DNA

SEQ ID NO: 66794 - DNA, 122 bp, Homo sapiens; identical to SEQ ID NO: 46393
  misc_feature 1..122: note = chr20:62053217-62053339
  misc_feature 1..122: note = hypo
  source 1..122: mol_type = genomic DNA

SEQ ID NO: 66795 - DNA, 38 bp, Homo sapiens; identical to SEQ ID NO: 16678
  misc_feature 1..38: note = chr20:62054264-62054302
  misc_feature 1..38: note = hypo
  source 1..38: mol_type = genomic DNA

SEQ ID NO: 66796 - DNA, 30 bp, Homo sapiens; identical to SEQ ID NO: 46396
  misc_feature 1..30: note = chr20:62090117-62090147
  misc_feature 1..30: note = hypo
  source 1..30: mol_type = genomic DNA

SEQ ID NO: 66797 - DNA, 110 bp, Homo sapiens
  misc_feature 1..110: note = chr20:62090414-62090524
  misc_feature 1..110: note = hypo
  source 1..110: mol_type = genomic DNA
tgaggtccgtccgtgcggccacaggaaggacgaggcagcggcccccagacacggagaggatgaaggagtaccctaaacacgaaggaacctgagggcaggctcggcaagga

SEQ ID NO: 66798 - DNA, 39 bp, Homo sapiens; identical to SEQ ID NO: 16681
  misc_feature 1..39: note = chr20:62097848-62097887
  misc_feature 1..39: note = hypo
  source 1..39: mol_type = genomic DNA

SEQ ID NO: 66799 - DNA, 79 bp, Homo sapiens
  misc_feature 1..79: note = chr20:62115266-62115345
  misc_feature 1..79: note = hypo
  source 1..79: mol_type = genomic DNA
ccctgacttcaggacctgctctggggcctcagcggccccaggactgaccctgagtcccagtggccgccagtcagagcca

SEQ ID NO: 66800 - DNA, 57 bp, Homo sapiens
  misc_feature 1..57: note = chr20:62126061-62126118
  misc_feature 1..57: note = hypo
  source 1..57: mol_type = genomic DNA
ggccctcgacctccccgtgccacctgccggtgcctcgctctgggccagggggtccag

SEQ ID NO: 66801 - DNA, 45 bp, Homo sapiens
  misc_feature 1..45: note = chr20:62126429-62126474
  misc_feature 1..45: note = hypo
  source 1..45: mol_type = genomic DNA
ccacgatcagcactgcgcagtccgcctgcccggcaggggacacag

SEQ ID NO: 66802 - DNA, 30 bp, Homo sapiens; identical to SEQ ID NO: 46401
  misc_feature 1..30: note = chr20:62132074-62132104
  misc_feature 1..30: note = hypo
  source 1..30: mol_type = genomic DNA

SEQ ID NO: 66803 - DNA, 96 bp, Homo sapiens; identical to SEQ ID NO: 46402
  misc_feature 1..96: note = chr20:62153366-62153462
  misc_feature 1..96: note = hypo
  source 1..96: mol_type = genomic DNA

SEQ ID NO: 66804 - DNA, 33 bp, Homo sapiens; identical to SEQ ID NO: 25834
  misc_feature 1..33: note = chr20:62165598-62165631
  misc_feature 1..33: note = hypo
  source 1..33: mol_type = genomic DNA

SEQ ID NO: 66805 - DNA, 93 bp, Homo sapiens
  misc_feature 1..93: note = chr20:62165762-62165855
  misc_feature 1..93: note = hypo
  source 1..93: mol_type = genomic DNA
tccccacagttgctgttggtgcttcctcagtaccacccctgcctcccctccctcagaacggctccctcctgccctgcacgctctggccaagct

SEQ ID NO: 66806 - DNA, 30 bp, Homo sapiens; identical to SEQ ID NO: 16686
  misc_feature 1..30: note = chr20:62167765-62167795
  misc_feature 1..30: note = hypo
  source 1..30: mol_type = genomic DNA

SEQ ID NO: 66807 - DNA, 237 bp, Homo sapiens; identical to SEQ ID NO: 46405
  misc_feature 1..237: note = chr20:62168240-62168477
  misc_feature 1..237: note = hypo
  source 1..237: mol_type = genomic DNA

SEQ ID NO: 66808 - DNA, 16 bp, Homo sapiens
  misc_feature 1..16: note = chr20:62170163-62170179
  misc_feature 1..16: note = hypo
  source 1..16: mol_type = genomic DNA
atgtccaggaagcctc

SEQ ID NO: 66809 - DNA, 252 bp, Homo sapiens; identical to SEQ ID NO: 46407
  misc_feature 1..252: note = chr20:62172062-62172314
  misc_feature 1..252: note = hypo
  source 1..252: mol_type = genomic DNA

SEQ ID NO: 66810 - DNA, 278 bp, Homo sapiens; identical to SEQ ID NO: 25839
  misc_feature 1..278: note = chr20:62172667-62172945
  misc_feature 1..278: note = hypo
  source 1..278: mol_type = genomic DNA

SEQ ID NO: 66811 - DNA, 83 bp, Homo sapiens; identical to SEQ ID NO: 46409
  misc_feature 1..83: note = chr20:62204292-62204375
  misc_feature 1..83: note = hypo
  source 1..83: mol_type = genomic DNA

SEQ ID NO: 66812 - DNA, 56 bp, Homo sapiens; identical to SEQ ID NO: 46410
  misc_feature 1..56: note = chr20:62221347-62221403
  misc_feature 1..56: note = hypo
  source 1..56: mol_type = genomic DNA

SEQ ID NO: 66813 - DNA, 35 bp, Homo sapiens; identical to SEQ ID NO: 46411
  misc_feature 1..35: note = chr20:62274577-62274612
  misc_feature 1..35: note = hypo
  source 1..35: mol_type = genomic DNA

SEQ ID NO: 66814 - DNA, 87 bp, Homo sapiens; identical to SEQ ID NO: 46412
  misc_feature 1..87: note = chr20:62281540-62281627
  misc_feature 1..87: note = hypo
  source 1..87: mol_type = genomic DNA

SEQ ID NO: 66815 - DNA, 30 bp, Homo sapiens; identical to SEQ ID NO: 46413
  misc_feature 1..30: note = chr20:62310644-62310674
  misc_feature 1..30: note = hypo
  source 1..30: mol_type = genomic DNA

SEQ ID NO: 66816 - DNA, 30 bp, Homo sapiens; identical to SEQ ID NO: 46414
  misc_feature 1..30: note = chr20:62311251-62311281
  misc_feature 1..30: note = hypo
  source 1..30: mol_type = genomic DNA

SEQ ID NO: 66817 - DNA, 283 bp, Homo sapiens; identical to SEQ ID NO: 25841
  misc_feature 1..283: note = chr20:62320923-62321206
  misc_feature 1..283: note = hypo
  source 1..283: mol_type = genomic DNA

SEQ ID NO: 66818 - DNA, 297 bp, Homo sapiens
  misc_feature 1..297: note = chr20:62321341-62321638
  misc_feature 1..297: note = hypo
  source 1..297: mol_type = genomic DNA
agcgtggggcccctgcagcagatgagggtcttcacttcggtgaactgaacccttgaagcggctgtgggcagggcagcagggctatggccaccccccaggttcgcctttgccgacgcaagagcccaactgccctcctgggtgcgtccccacgtcagggtgtatgacaactttggccatgtcatccgagacgtggcccagttcttccgtgttgccgagcgaactgtgagttcctgcccagggaggggatgagggtgttgtccccagaggagccagaaatgggtccacccacccccatgg

SEQ ID NO: 66819 - DNA, 30 bp, Homo sapiens; identical to SEQ ID NO: 16693
  misc_feature 1..30: note = chr20:62329526-62329556
  misc_feature 1..30: note = hypo
  source 1..30: mol_type = genomic DNA

SEQ ID NO: 66820 - DNA, 30 bp, Homo sapiens; identical to SEQ ID NO: 46417
  misc_feature 1..30: note = chr20:62331916-62331946
  misc_feature 1..30: note = hypo
  source 1..30: mol_type = genomic DNA

SEQ ID NO: 66821 - DNA, 45 bp, Homo sapiens; identical to SEQ ID NO: 46418
  misc_feature 1..45: note = chr20:62340242-62340287
  misc_feature 1..45: note = hypo
  source 1..45: mol_type = genomic DNA

SEQ ID NO: 66822 - DNA, 81 bp, Homo sapiens
  misc_feature 1..81: note = chr20:62383137-62383218
  misc_feature 1..81: note = hypo
  source 1..81: mol_type = genomic DNA
atgaagccccgcccccggtgggtctccccatgaagccccgccccccggtgggtctcccatgaagccccgccccccggtggg

SEQ ID NO: 66823 - DNA, 427 bp, Homo sapiens
  misc_feature 1..427: note = chr20:62383289-62383716
  misc_feature 1..427: note = hypo
  source 1..427: mol_type = genomic DNA
cagcgatgctccagagcctcttccgccccgacagcagccccacctctgcccggagcccggggcgcctccactgcctctcctcacacagctgcccgccgcgagctccccctgcaccctgcgcctcggggtgggcgttccaggactccccgaacccttggggccgccccgctctgggctgcctgtgccccacccgcctcactggttgatctcacccacttgagatgccctcgccaggccttttttggcaaatctgcctccctgttcccaggctgcctttttctattatttcctccccaagcaaatccatccactccacacctgctacctgacaacgacctgccagtgctgagctccagggtgggcgcggtgggtgcagacaggtcggcaggcacaaggacagggttctccctcccgaggcagggcgggg

SEQ ID NO: 66824 - DNA, 266 bp, Homo sapiens; identical to SEQ ID NO: 46420
  misc_feature 1..266: note = chr20:62383922-62384188
  misc_feature 1..266: note = hypo
  source 1..266: mol_type = genomic DNA

SEQ ID NO: 66825 - DNA, 30 bp, Homo sapiens; identical to SEQ ID NO: 46421
  misc_feature 1..30: note = chr20:62398516-62398546
  misc_feature 1..30: note = hypo
  source 1..30: mol_type = genomic DNA

SEQ ID NO: 66826 - DNA, 98 bp, Homo sapiens; identical to SEQ ID NO: 46422
  misc_feature 1..98: note = chr20:62400802-62400900
  misc_feature 1..98: note = hypo
  source 1..98: mol_type = genomic DNA

SEQ ID NO: 66827 - DNA, 212 bp, Homo sapiens; identical to SEQ ID NO: 46423
  misc_feature 1..212: note = chr20:62481430-62481642
  misc_feature 1..212: note = hypo
  source 1..212: mol_type = genomic DNA

SEQ ID NO: 66828 - DNA, 69 bp, Homo sapiens; identical to SEQ ID NO: 25849
  misc_feature 1..69: note = chr20:62488224-62488293
  misc_feature 1..69: note = hypo
  source 1..69: mol_type = genomic DNA

SEQ ID NO: 66829 - DNA, 96 bp, Homo sapiens
  misc_feature 1..96: note = chr20:62488350-62488446
  misc_feature 1..96: note = hypo
  source 1..96: mol_type = genomic DNA
acacagtggtgccagggcaggaaccctgggggcatttgcaggcctgtgctgcgagactgcagtggcgctcaggacacacctcggagaagagcaagc

SEQ ID NO: 66830 - DNA, 36 bp, Homo sapiens; identical to SEQ ID NO: 46425
  misc_feature 1..36: note = chr20:62662189-62662225
  misc_feature 1..36: note = hypo
  source 1..36: mol_type = genomic DNA

SEQ ID NO: 66831 - DNA, 171 bp, Homo sapiens; identical to SEQ ID NO: 46426
  misc_feature 1..171: note = chr20:62722776-62722947
  misc_feature 1..171: note = hypo
  source 1..171: mol_type = genomic DNA

SEQ ID NO: 66832 - DNA, 30 bp, Homo sapiens; identical to SEQ ID NO: 46427
  misc_feature 1..30: note = chr20:62737760-62737790
  misc_feature 1..30: note = hypo
  source 1..30: mol_type = genomic DNA

SEQ ID NO: 66833 - DNA, 36 bp, Homo sapiens; identical to SEQ ID NO: 16700
  misc_feature 1..36: note = chr20:62762699-62762735
  misc_feature 1..36: note = hypo
  source 1..36: mol_type = genomic DNA

SEQ ID NO: 66834 - DNA, 100 bp, Homo sapiens; identical to SEQ ID NO: 46429
  misc_feature 1..100: note = chr20:62766351-62766451
  misc_feature 1..100: note = hypo
  source 1..100: mol_type = genomic DNA

SEQ ID NO: 66835 - DNA, 45 bp, Homo sapiens; identical to SEQ ID NO: 46430
  misc_feature 1..45: note = chr20:62871836-62871881
  misc_feature 1..45: note = hypo
  source 1..45: mol_type = genomic DNA

SEQ ID NO: 66836 - DNA, 30 bp, Homo sapiens; identical to SEQ ID NO: 46431
  misc_feature 1..30: note = chr20:62873290-62873320
  misc_feature 1..30: note = hypo
  source 1..30: mol_type = genomic DNA

SEQ ID NO: 66837 - DNA, 33 bp, Homo sapiens; identical to SEQ ID NO: 46432
  misc_feature 1..33: note = chr21:15442571-15442604
  misc_feature 1..33: note = hypo
  source 1..33: mol_type = genomic DNA

SEQ ID NO: 66838 - DNA, 30 bp, Homo sapiens; identical to SEQ ID NO: 46433
  misc_feature 1..30: note = chr21:15444814-15444844
  misc_feature 1..30: note = hypo
  source 1..30: mol_type = genomic DNA

SEQ ID NO: 66839 - DNA, 60 bp, Homo sapiens; identical to SEQ ID NO: 46434
  misc_feature 1..60: note = chr21:15446528-15446588
  misc_feature 1..60: note = hypo
  source 1..60: mol_type = genomic DNA

SEQ ID NO: 66840 - DNA, 85 bp, Homo sapiens; identical to SEQ ID NO: 46435
  misc_feature 1..85: note = chr21:15694247-15694332
  misc_feature 1..85: note = hypo
  source 1..85: mol_type = genomic DNA

SEQ ID NO: 66841 - DNA, 30 bp, Homo sapiens; identical to SEQ ID NO: 46436
  misc_feature 1..30: note = chr21:15762808-15762838
  misc_feature 1..30: note = hypo
  source 1..30: mol_type = genomic DNA

SEQ ID NO: 66842 - DNA, 19 bp, Homo sapiens
  misc_feature 1..19: note = chr21:15869848-15869867
  misc_feature 1..19: note = hypo
  source 1..19: mol_type = genomic DNA
gtcgcggtgagccgagatc

SEQ ID NO: 66843 - DNA, 81 bp, Homo sapiens; identical to SEQ ID NO: 46438
  misc_feature 1..81: note = chr21:19274379-19274460
  misc_feature 1..81: note = hypo
  source 1..81: mol_type = genomic DNA

SEQ ID NO: 66844 - DNA, 172 bp, Homo sapiens; identical to SEQ ID NO: 46439
  misc_feature 1..172: note = chr21:20359980-20360152
  misc_feature 1..172: note = hypo
  source 1..172: mol_type = genomic DNA

SEQ ID NO: 66845 - DNA, 33 bp, Homo sapiens; identical to SEQ ID NO: 46440
  misc_feature 1..33: note = chr21:23970030-23970063
  misc_feature 1..33: note = hypo
  source 1..33: mol_type = genomic DNA

SEQ ID NO: 66846 - DNA, 41 bp, Homo sapiens; identical to SEQ ID NO: 46441
  misc_feature 1..41: note = chr21:25338183-25338224
  misc_feature 1..41: note = hypo
  source 1..41: mol_type = genomic DNA

SEQ ID NO: 66847 - DNA, 23 bp, Homo sapiens
  misc_feature 1..23: note = chr21:26737215-26737238
  misc_feature 1..23: note = hypo
  source 1..23: mol_type = genomic DNA
actgcgcccggccgagggatttt

SEQ ID NO: 66848 - DNA, 243 bp, Homo sapiens; identical to SEQ ID NO: 58899
  misc_feature 1..243: note = chr21:28217690-28217933
  misc_feature 1..243: note = hypo
  source 1..243: mol_type = genomic DNA

SEQ ID NO: 66849 - DNA, 17 bp, Homo sapiens
  misc_feature 1..17: note = chr21:30266890-30266907
  misc_feature 1..17: note = hypo
  source 1..17: mol_type = genomic DNA
tccgtctcaaaaaaaaa

SEQ ID NO: 66850 - DNA, 38 bp, Homo sapiens; identical to SEQ ID NO: 46445
  misc_feature 1..38: note = chr21:31057101-31057139
  misc_feature 1..38: note = hypo
  source 1..38: mol_type = genomic DNA

SEQ ID NO: 66851 - DNA, 139 bp, Homo sapiens; identical to SEQ ID NO: 46446
  misc_feature 1..139: note = chr21:31059342-31059481
  misc_feature 1..139: note = hypo
  source 1..139: mol_type = genomic DNA

SEQ ID NO: 66852 - DNA, 30 bp, Homo sapiens; identical to SEQ ID NO: 46447
  misc_feature 1..30: note = chr21:32592616-32592646
  misc_feature 1..30: note = hypo
  source 1..30: mol_type = genomic DNA

SEQ ID NO: 66853 - DNA, 30 bp, Homo sapiens; identical to SEQ ID NO: 46448
  misc_feature 1..30: note = chr21:33630406-33630436
  misc_feature 1..30: note = hypo
  source 1..30: mol_type = genomic DNA

SEQ ID NO: 66854 - DNA, 30 bp, Homo sapiens; identical to SEQ ID NO: 46449
  misc_feature 1..30: note = chr21:33694588-33694618
  misc_feature 1..30: note = hypo
  source 1..30: mol_type = genomic DNA

SEQ ID NO: 66855 - DNA, 278 bp, Homo sapiens; identical to SEQ ID NO: 46451
  misc_feature 1..278: note = chr21:33954157-33954435
  misc_feature 1..278: note = hypo
  source 1..278: mol_type = genomic DNA

SEQ ID NO: 66856 - DNA, 30 bp, Homo sapiens; identical to SEQ ID NO: 46453
  misc_feature 1..30: note = chr21:34127723-34127753
  misc_feature 1..30: note = hypo
  source 1..30: mol_type = genomic DNA

SEQ ID NO: 66857 - DNA, 95 bp, Homo sapiens; identical to SEQ ID NO: 16704
  misc_feature 1..95: note = chr21:34459377-34459472
  misc_feature 1..95: note = hypo
  source 1..95: mol_type = genomic DNA

SEQ ID NO: 66858 - DNA, 30 bp, Homo sapiens; identical to SEQ ID NO: 46455
  misc_feature 1..30: note = chr21:34466163-34466193
  misc_feature 1..30: note = hypo
  source 1..30: mol_type = genomic DNA

SEQ ID NO: 66859 - DNA, 62 bp, Homo sapiens; identical to SEQ ID NO: 46456
  misc_feature 1..62: note = chr21:34471025-34471087
  misc_feature 1..62: note = hypo
  source 1..62: mol_type = genomic DNA

SEQ ID NO: 66860 - DNA, 222 bp, Homo sapiens; identical to SEQ ID NO: 46457
  misc_feature 1..222: note = chr21:34508376-34508598
  misc_feature 1..222: note = hypo
  source 1..222: mol_type = genomic DNA

SEQ ID NO: 66861 - DNA, 64 bp, Homo sapiens
  misc_feature 1..64: note = chr21:37527958-37528022
  misc_feature 1..64: note = hypo
  source 1..64: mol_type = genomic DNA
cacagctgggtggggacagggcctgtgctcaggtgagcactgcctaccgcgcaccctccaggtg

SEQ ID NO: 66862 - DNA, 19 bp, Homo sapiens
  misc_feature 1..19: note = chr21:37699121-37699140
  misc_feature 1..19: note = hypo
  source 1..19: mol_type = genomic DNA
ttttttttttgagaccgag

SEQ ID NO: 66863 - DNA, 133 bp, Homo sapiens; identical to SEQ ID NO: 46460
  misc_feature 1..133: note = chr21:37750031-37750164
  misc_feature 1..133: note = hypo
  source 1..133: mol_type = genomic DNA

SEQ ID NO: 66864 - DNA, 78 bp, Homo sapiens; identical to SEQ ID NO: 25857
  misc_feature 1..78: note = chr21:37758492-37758570
  misc_feature 1..78: note = hypo
  source 1..78: mol_type = genomic DNA

SEQ ID NO: 66865 - DNA, 17 bp, Homo sapiens
  misc_feature 1..17: note = chr21:37775141-37775158
  misc_feature 1..17: note = hypo
  source 1..17: mol_type = genomic DNA
cacgccaggtgtgtttc

SEQ ID NO: 66866 - DNA, 30 bp, Homo sapiens; identical to SEQ ID NO: 46463
  misc_feature 1..30: note = chr21:37781662-37781692
  misc_feature 1..30: note = hypo
  source 1..30: mol_type = genomic DNA

SEQ ID NO: 66867 - DNA, 79 bp, Homo sapiens
  misc_feature 1..79: note = chr21:38092100-38092179
  misc_feature 1..79: note = hypo
  source 1..79: mol_type = genomic DNA
gacccttcccttccacggcaggtggagctcacgggcaacagtatttatgaatacatccatccttctgaccacgatgaga

SEQ ID NO: 66868 - DNA, 68 bp, Homo sapiens
  misc_feature 1..68: note = chr21:38092221-38092289
  misc_feature 1..68: note = hypo
  source 1..68: mol_type = genomic DNA
tgctccaaggtattccatccagagggaaaaaaaaaaacagactaaaagcaaggcgacattcttaaatg

SEQ ID NO: 66869 - DNA, 40 bp, Homo sapiens; identical to SEQ ID NO: 46465
  misc_feature 1..40: note = chr21:38363098-38363138
  misc_feature 1..40: note = hypo
  source 1..40: mol_type = genomic DNA

SEQ ID NO: 66870 - DNA, 30 bp, Homo sapiens; identical to SEQ ID NO: 46467
  misc_feature 1..30: note = chr21:38823635-38823665
  misc_feature 1..30: note = hypo
  source 1..30: mol_type = genomic DNA

SEQ ID NO: 66871 - DNA, 72 bp, Homo sapiens; identical to SEQ ID NO: 46468
  misc_feature 1..72: note = chr21:38918489-38918561
  misc_feature 1..72: note = hypo
  source 1..72: mol_type = genomic DNA

SEQ ID NO: 66872 - DNA, 98 bp, Homo sapiens
  misc_feature 1..98: note = chr21:38935380-38935478
  misc_feature 1..98: note = hypo
  source 1..98: mol_type = genomic DNA
ggagaccatttttcacgcctggccggctctgtgcttaagtggccccatcgcagccagagtagcctcattacagctgaagtccctggtaggtctcctcc

SEQ ID NO: 66873 - DNA, 30 bp, Homo sapiens; identical to SEQ ID NO: 46470
  misc_feature 1..30: note = chr21:38987670-38987700
  misc_feature 1..30: note = hypo
  source 1..30: mol_type = genomic DNA

SEQ ID NO: 66874 - DNA, 30 bp, Homo sapiens; identical to SEQ ID NO: 46471
  misc_feature 1..30: note = chr21:40510674-40510704
  misc_feature 1..30: note = hypo
  source 1..30: mol_type = genomic DNA

SEQ ID NO: 66875 - DNA, 39 bp, Homo sapiens; identical to SEQ ID NO: 46472
  misc_feature 1..39: note = chr21:42448116-42448155
  misc_feature 1..39: note = hypo
  source 1..39: mol_type = genomic DNA

SEQ ID NO: 66876 - DNA, 30 bp, Homo sapiens; identical to SEQ ID NO: 16710
  misc_feature 1..30: note = chr21:42613756-42613786
  misc_feature 1..30: note = hypo
  source 1..30: mol_type = genomic DNA

SEQ ID NO: 66877 - DNA, 30 bp, Homo sapiens; identical to SEQ ID NO: 46474
  misc_feature 1..30: note = chr21:42953643-42953673
  misc_feature 1..30: note = hypo
  source 1..30: mol_type = genomic DNA

SEQ ID NO: 66878 - DNA, 30 bp, Homo sapiens; identical to SEQ ID NO: 46475
  misc_feature 1..30: note = chr21:43033404-43033434
  misc_feature 1..30: note = hypo
  source 1..30: mol_type = genomic DNA

SEQ ID NO: 66879 - DNA, 382 bp, Homo sapiens; identical to SEQ ID NO: 46476
  misc_feature 1..382: note = chr21:43248539-43248921
  misc_feature 1..382: note = hypo
  source 1..382: mol_type = genomic DNA

SEQ ID NO: 66880 - DNA, 42 bp, Homo sapiens; identical to SEQ ID NO: 46477
  misc_feature 1..42: note = chr21:43255693-43255735
  misc_feature 1..42: note = hypo
  source 1..42: mol_type = genomic DNA

SEQ ID NO: 66881 - DNA, 38 bp, Homo sapiens; identical to SEQ ID NO: 46479
  misc_feature 1..38: note = chr21:43493035-43493073
  misc_feature 1..38: note = hypo
  source 1..38: mol_type = genomic DNA

SEQ ID NO: 66882 - DNA, 70 bp, Homo sapiens; identical to SEQ ID NO: 46480
  misc_feature 1..70: note = chr21:43725826-43725896
  misc_feature 1..70: note = hypo
  source 1..70: mol_type = genomic DNA

SEQ ID NO: 66883 - DNA, 187 bp, Homo sapiens
  misc_feature 1..187: note = chr21:43786496-43786683
  misc_feature 1..187: note = hypo
  source 1..187: mol_type = genomic DNA
gagcaggaagaagcacgccttacctgtctgggcctcggccagggtgccgagggccagcatggacaccaggaccagggcgcagatcaccttgttctccatggtggccattgcctcctctctgctccaaaggcgaccccgagtcagggatgagaggccgcccgagccccggattttatagggcaggctc

SEQ ID NO: 66884 - DNA, 28 bp, Homo sapiens
  misc_feature 1..28: note = chr21:43786713-43786741
  misc_feature 1..28: note = hypo
  source 1..28: mol_type = genomic DNA
gcctaaggaggcccggggatcctctgag

SEQ ID NO: 66885 - DNA, 45 bp, Homo sapiens; identical to SEQ ID NO: 46482
  misc_feature 1..45: note = chr21:43864728-43864773
  misc_feature 1..45: note = hypo
  source 1..45: mol_type = genomic DNA

SEQ ID NO: 66886 - DNA, 30 bp, Homo sapiens; identical to SEQ ID NO: 46483
  misc_feature 1..30: note = chr21:43991300-43991330
  misc_feature 1..30: note = hypo
  source 1..30: mol_type = genomic DNA

SEQ ID NO: 66887 - DNA, 30 bp, Homo sapiens; identical to SEQ ID NO: 46484
  misc_feature 1..30: note = chr21:44093215-44093245
  misc_feature 1..30: note = hypo
  source 1..30: mol_type = genomic DNA

SEQ ID NO: 66888 - DNA, 378 bp, Homo sapiens; identical to SEQ ID NO: 46486
  misc_feature 1..378: note = chr21:44338174-44338552
  misc_feature 1..378: note = hypo
  source 1..378: mol_type = genomic DNA

SEQ ID NO: 66889 - DNA, 46 bp, Homo sapiens; identical to SEQ ID NO: 46487
  misc_feature 1..46: note = chr21:44480679-44480725
  misc_feature 1..46: note = hypo
  source 1..46: mol_type = genomic DNA

SEQ ID NO: 66890 - DNA, 30 bp, Homo sapiens; identical to SEQ ID NO: 46488
  misc_feature 1..30: note = chr21:44482657-44482687
  misc_feature 1..30: note = hypo
  source 1..30: mol_type = genomic DNA

SEQ ID NO: 66891 - DNA, 34 bp, Homo sapiens; identical to SEQ ID NO: 46489
  misc_feature 1..34: note = chr21:44482920-44482954
  misc_feature 1..34: note = hypo
  source 1..34: mol_type = genomic DNA

SEQ ID NO: 66892 - DNA, 242 bp, Homo sapiens
  misc_feature 1..242: note = chr21:44836846-44837088
  misc_feature 1..242: note = hypo
  source 1..242: mol_type = genomic DNA
cagcagcgggagccccgacgtgaggagggtgctggggagcggggcagccccagggccatcacagggggcgatcacaaacggggcaggggccggctggggggcctgggagcagccgggtgcagcggccgggtggtgctgtaactggagcagcctgtgggaacagaggacaggtggtcactgcgccggctcgcagggttctcgggtttccgagtgcccgtgtggcagggcccgcccgaggagct

SEQ ID NO: 66893 - DNA, 43 bp, Homo sapiens; identical to SEQ ID NO: 46491
  misc_feature 1..43: note = chr21:44837378-44837421
  misc_feature 1..43: note = hypo
  source 1..43: mol_type = genomic DNA

SEQ ID NO: 66894 - DNA, 51 bp, Homo sapiens
  misc_feature 1..51: note = chr21:44866552-44866603
  misc_feature 1..51: note = hypo
  source 1..51: mol_type = genomic DNA
tactggcacttgggccggtgtgaagccacccccctgccatgaaaaatggct

SEQ ID NO: 66895 - DNA, 192 bp, Homo sapiens; identical to SEQ ID NO: 25865
  misc_feature 1..192: note = chr21:44866711-44866903
  misc_feature 1..192: note = hypo
  source 1..192: mol_type = genomic DNA

SEQ ID NO: 66896 - DNA, 30 bp, Homo sapiens; identical to SEQ ID NO: 46493
  misc_feature 1..30: note = chr21:44871839-44871869
  misc_feature 1..30: note = hypo
  source 1..30: mol_type = genomic DNA

SEQ ID NO: 66897 - DNA, 58 bp, Homo sapiens; identical to SEQ ID NO: 46494
  misc_feature 1..58: note = chr21:45140870-45140928
  misc_feature 1..58: note = hypo
  source 1..58: mol_type = genomic DNA

SEQ ID NO: 66898 - DNA, 57 bp, Homo sapiens; identical to SEQ ID NO: 16716
  misc_feature 1..57: note = chr21:45170351-45170408
  misc_feature 1..57: note = hypo
  source 1..57: mol_type = genomic DNA

SEQ ID NO: 66899 - skipped

SEQ ID NO: 66900 - DNA, 36 bp, Homo sapiens; identical to SEQ ID NO: 46497
  misc_feature 1..36: note = chr21:45201243-45201279
  misc_feature 1..36: note = hypo
  source 1..36: mol_type = genomic DNA

SEQ ID NO: 66901 - DNA, 30 bp, Homo sapiens; identical to SEQ ID NO: 16718
  misc_feature 1..30: note = chr21:45232947-45232977
  misc_feature 1..30: note = hypo
  source 1..30: mol_type = genomic DNA

SEQ ID NO: 66902 - DNA, 30 bp, Homo sapiens; identical to SEQ ID NO: 16719
  misc_feature 1..30: note = chr21:45247147-45247177
  misc_feature 1..30: note = hypo
  source 1..30: mol_type = genomic DNA

SEQ ID NO: 66903 - DNA, 30 bp, Homo sapiens; identical to SEQ ID NO: 46500
  misc_feature 1..30: note = chr21:45268919-45268949
  misc_feature 1..30: note = hypo
  source 1..30: mol_type = genomic DNA

SEQ ID NO: 66904 - DNA, 30 bp, Homo sapiens; identical to SEQ ID NO: 46501
  misc_feature 1..30: note = chr21:45273343-45273373
  misc_feature 1..30: note = hypo
  source 1..30: mol_type = genomic DNA

SEQ ID NO: 66905 - DNA, 138 bp, Homo sapiens
  misc_feature 1..138: note = chr21:45273579-45273717
  misc_feature 1..138: note = hypo
  source 1..138: mol_type = genomic DNA
ggtgatcctatgaaccgccccagagaaacactcctgcatctcacagcgttctccctcgtgctcttgtcttctctttcctaccagattccaaattctcttcccaagaggtggcatgaacctgtgagtcccagctgcaac

SEQ ID NO: 66906 - DNA, 99 bp, Homo sapiens; identical to SEQ ID NO: 46503
  misc_feature 1..99: note = chr21:45276620-45276719
  misc_feature 1..99: note = hypo
  source 1..99: mol_type = genomic DNA

SEQ ID NO: 66907 - DNA, 30 bp, Homo sapiens; identical to SEQ ID NO: 46504
  misc_feature 1..30: note = chr21:45299990-45300020
  misc_feature 1..30: note = hypo
  source 1..30: mol_type = genomic DNA

SEQ ID NO: 66908 - DNA, 30 bp, Homo sapiens; identical to SEQ ID NO: 46505
  misc_feature 1..30: note = chr21:45352946-45352976
  misc_feature 1..30: note = hypo
  source 1..30: mol_type = genomic DNA

SEQ ID NO: 66909 - DNA, 97 bp, Homo sapiens; identical to SEQ ID NO: 46506
  misc_feature 1..97: note = chr21:45365737-45365834
  misc_feature 1..97: note = hypo
  source 1..97: mol_type = genomic DNA

SEQ ID NO: 66910 - DNA, 34 bp, Homo sapiens; identical to SEQ ID NO: 46507
  misc_feature 1..34: note = chr21:45411880-45411914
  misc_feature 1..34: note = hypo
  source 1..34: mol_type = genomic DNA

SEQ ID NO: 66911 - DNA, 65 bp, Homo sapiens; identical to SEQ ID NO: 46508
  misc_feature 1..65: note = chr21:45516505-45516570
  misc_feature 1..65: note = hypo
  source 1..65: mol_type = genomic DNA

SEQ ID NO: 66912 - DNA, 88 bp, Homo sapiens; identical to SEQ ID NO: 46509
  misc_feature 1..88: note = chr21:45583747-45583835
  misc_feature 1..88: note = hypo
  source 1..88: mol_type = genomic DNA

SEQ ID NO: 66913 - DNA, 30 bp, Homo sapiens; identical to SEQ ID NO: 46510
  misc_feature 1..30: note = chr21:45657028-45657058
  misc_feature 1..30: note = hypo
  source 1..30: mol_type = genomic DNA

SEQ ID NO: 66914 - DNA, 131 bp, Homo sapiens; identical to SEQ ID NO: 46511
  misc_feature 1..131: note = chr21:45681620-45681751
  misc_feature 1..131: note = hypo
  source 1..131: mol_type = genomic DNA

SEQ ID NO: 66915 - DNA, 79 bp, Homo sapiens; identical to SEQ ID NO: 46512
  misc_feature 1..79: note = chr21:45682528-45682607
  misc_feature 1..79: note = hypo
  source 1..79: mol_type = genomic DNA

SEQ ID NO: 66916 - DNA, 30 bp, Homo sapiens; identical to SEQ ID NO: 46513
  misc_feature 1..30: note = chr21:45710106-45710136
  misc_feature 1..30: note = hypo
  source 1..30: mol_type = genomic DNA

SEQ ID NO: 66917 - DNA, 30 bp, Homo sapiens; identical to SEQ ID NO: 46514
  misc_feature 1..30: note = chr21:45713048-45713078
  misc_feature 1..30: note = hypo
  source 1..30: mol_type = genomic DNA

SEQ ID NO: 66918 - DNA, 34 bp, Homo sapiens; identical to SEQ ID NO: 46515
  misc_feature 1..34: note = chr21:45713421-45713455
  misc_feature 1..34: note = hypo
  source 1..34: mol_type = genomic DNA

SEQ ID NO: 66919 - DNA, 30 bp, Homo sapiens; identical to SEQ ID NO: 46516
  misc_feature 1..30: note = chr21:45727181-45727211
  misc_feature 1..30: note = hypo
  source 1..30: mol_type = genomic DNA

SEQ ID NO: 66920 - DNA, 30 bp, Homo sapiens; identical to SEQ ID NO: 46517
  misc_feature 1..30: note = chr21:45749126-45749156
  misc_feature 1..30: note = hypo
  source 1..30: mol_type = genomic DNA

SEQ ID NO: 66921 - DNA, 106 bp, Homo sapiens; identical to SEQ ID NO: 46518
  misc_feature 1..106: note = chr21:45750020-45750126
  misc_feature 1..106: note = hypo
  source 1..106: mol_type = genomic DNA

SEQ ID NO: 66922 - DNA, 30 bp, Homo sapiens; identical to SEQ ID NO: 46519
  misc_feature 1..30: note = chr21:45753810-45753840
  misc_feature 1..30: note = hypo
  source 1..30: mol_type = genomic DNA

SEQ ID NO: 66923 - DNA, 45 bp, Homo sapiens
  misc_feature 1..45: note = chr21:45791109-45791154
  misc_feature 1..45: note = hypo
  source 1..45: mol_type = genomic DNA
ccatggccgcctccctccagtctctgcctccgtgtcccgtggccg

SEQ ID NO: 66924 - DNA, 30 bp, Homo sapiens; identical to SEQ ID NO: 46521
  misc_feature 1..30: note = chr21:45824465-45824495
  misc_feature 1..30: note = hypo
  source 1..30: mol_type = genomic DNA

SEQ ID NO: 66925 - DNA, 68 bp, Homo sapiens; identical to SEQ ID NO: 46522
  misc_feature 1..68: note = chr21:45844751-45844819
  misc_feature 1..68: note = hypo
  source 1..68: mol_type = genomic DNA

SEQ ID NO: 66926 - DNA, 196 bp, Homo sapiens; identical to SEQ ID NO: 46523
  misc_feature 1..196: note = chr21:45929175-45929371
  misc_feature 1..196: note = hypo
  source 1..196: mol_type = genomic DNA

SEQ ID NO: 66927 - DNA, 30 bp, Homo sapiens; identical to SEQ ID NO: 46524
  misc_feature 1..30: note = chr21:45939784-45939814
  misc_feature 1..30: note = hypo
  source 1..30: mol_type = genomic DNA

SEQ ID NO: 66928 - DNA, 135 bp, Homo sapiens; identical to SEQ ID NO: 46525
  misc_feature 1..135: note = chr21:45959906-45960041
  misc_feature 1..135: note = hypo
  source 1..135: mol_type = genomic DNA

SEQ ID NO: 66929 - DNA, 30 bp, Homo sapiens; identical to SEQ ID NO: 16724
  misc_feature 1..30: note = chr21:46015435-46015465
  misc_feature 1..30: note = hypo
  source 1..30: mol_type = genomic DNA

SEQ ID NO: 66930 - DNA, 38 bp, Homo sapiens; identical to SEQ ID NO: 46527
  misc_feature 1..38: note = chr21:46035197-46035235
  misc_feature 1..38: note = hypo
  source 1..38: mol_type = genomic DNA

SEQ ID NO: 66931 - DNA, 70 bp, Homo sapiens
  misc_feature 1..70: note = chr21:46036572-46036642
  misc_feature 1..70: note = hypo
  source 1..70: mol_type = genomic DNA
ggtcagcacccaattcgagagctctgctcagcagtgagaatgagacaccgtgacaatgcggctgcgcacc

SEQ ID NO: 66932 - DNA, 60 bp, Homo sapiens; identical to SEQ ID NO: 25875
  misc_feature 1..60: note = chr21:46036767-46036827
  misc_feature 1..60: note = hypo
  source 1..60: mol_type = genomic DNA

SEQ ID NO: 66933 - DNA, 58 bp, Homo sapiens; identical to SEQ ID NO: 46529
  misc_feature 1..58: note = chr21:46068645-46068703
  misc_feature 1..58: note = hypo
  source 1..58: mol_type = genomic DNA

SEQ ID NO: 66934 - DNA, 30 bp, Homo sapiens; identical to SEQ ID NO: 46530
  misc_feature 1..30: note = chr21:46169786-46169816
  misc_feature 1..30: note = hypo
  source 1..30: mol_type = genomic DNA

SEQ ID NO: 66935 - DNA, 33 bp, Homo sapiens; identical to SEQ ID NO: 46531
  misc_feature 1..33: note = chr21:46184045-46184078
  misc_feature 1..33: note = hypo
  source 1..33: mol_type = genomic DNA

SEQ ID NO: 66936 - DNA, 102 bp, Homo sapiens; identical to SEQ ID NO: 46532
  misc_feature 1..102: note = chr21:46184437-46184539
  misc_feature 1..102: note = hypo
  source 1..102: mol_type = genomic DNA

SEQ ID NO: 66937 - DNA, 30 bp, Homo sapiens; identical to SEQ ID NO: 46533
  misc_feature 1..30: note = chr21:46206196-46206226
  misc_feature 1..30: note = hypo
  source 1..30: mol_type = genomic DNA

SEQ ID NO: 66938 - DNA, 202 bp, Homo sapiens; identical to SEQ ID NO: 46534
  misc_feature 1..202: note = chr21:46238872-46239074
  misc_feature 1..202: note = hypo
  source 1..202: mol_type = genomic DNA

SEQ ID NO: 66939 - DNA, 199 bp, Homo sapiens
  misc_feature 1..199: note = chr21:46256917-46257116
  misc_feature 1..199: note = hypo
  source 1..199: mol_type = genomic DNA
agtcacgcgaggctccgaggcagcaggtttcaggggcacctccgtgcagtccccggcacccagggtgcagcccccagcacctccgtgtagcccccgacacccagggtgcagcccccggcacctccgtgtagcccccggcacccaggcagtccccggcacctccgtgtagctcccggcacccagggtgcagctcctggcc

SEQ ID NO: 66940 - DNA, 43 bp, Homo sapiens
  misc_feature 1..43: note = chr21:46257273-46257316
  misc_feature 1..43: note = hypo
  source 1..43: mol_type = genomic DNA
tcatgaattagcctggtagacaggaggccggagaagcccggat

SEQ ID NO: 66941 - DNA, 175 bp, Homo sapiens; identical to SEQ ID NO: 46536
  misc_feature 1..175: note = chr21:46257708-46257883
  misc_feature 1..175: note = hypo
  source 1..175: mol_type = genomic DNA

SEQ ID NO: 66942 - DNA, 78 bp, Homo sapiens; identical to SEQ ID NO: 46537
  misc_feature 1..78: note = chr21:46273062-46273140
  misc_feature 1..78: note = hypo
  source 1..78: mol_type = genomic DNA

SEQ ID NO: 66943 - DNA, 353 bp, Homo sapiens; identical to SEQ ID NO: 46538
  misc_feature 1..353: note = chr21:46308526-46308879
  misc_feature 1..353: note = hypo
  source 1..353: mol_type = genomic DNA

SEQ ID NO: 66944 - DNA, 40 bp, Homo sapiens; identical to SEQ ID NO: 46539
  misc_feature 1..40: note = chr21:46309364-46309404
  misc_feature 1..40: note = hypo
  source 1..40: mol_type = genomic DNA

SEQ ID NO: 66945 - DNA, 292 bp, Homo sapiens
  misc_feature 1..292: note = chr21:46310491-46310783
  misc_feature 1..292: note = hypo
  source 1..292: mol_type = genomic DNA
ggccagtggggactcggcactgcctcctgccacagccccgccctccctcctgcgttcgtgcactgacaggccaggttgtgggagaatgcagggacaaggggtttttacagatgtggaagctggcatcaagccgctggcaggcaggagccacacacaccctgaggcatcctcagagacggcactgccacgggctctcctgctccccagaggaggaagctgcaggaccgagtgtctgagtacctgtggcagggcaccccccgacacctgccaagtgttccgactgagtcacccc

SEQ ID NO: 66946 - DNA, 122 bp, Homo sapiens; identical to SEQ ID NO: 46541
  misc_feature 1..122: note = chr21:46311753-46311875
  misc_feature 1..122: note = hypo
  source 1..122: mol_type = genomic DNA

SEQ ID NO: 66947 - DNA, 58 bp, Homo sapiens; identical to SEQ ID NO: 46542
  misc_feature 1..58: note = chr21:46317030-46317088
  misc_feature 1..58: note = hypo
  source 1..58: mol_type = genomic DNA

SEQ ID NO: 66948 - DNA, 54 bp, Homo sapiens; identical to SEQ ID NO: 46544
  misc_feature 1..54: note = chr21:46318785-46318839
  misc_feature 1..54: note = hypo
  source 1..54: mol_type = genomic DNA

SEQ ID NO: 66949 - DNA, 13 bp, Homo sapiens
  misc_feature 1..13: note = chr21:46319143-46319156
  misc_feature 1..13: note = hypo
  source 1..13: mol_type = genomic DNA
gtctgccccgctc

SEQ ID NO: 66950 - DNA, 46 bp, Homo sapiens; identical to SEQ ID NO: 25882
  misc_feature 1..46: note = chr21:46319459-46319505
  misc_feature 1..46: note = hypo
  source 1..46: mol_type = genomic DNA

SEQ ID NO: 66951 - DNA, 38 bp, Homo sapiens; identical to SEQ ID NO: 46546
  misc_feature 1..38: note = chr21:46321598-46321636
  misc_feature 1..38: note = hypo
  source 1..38: mol_type = genomic DNA

SEQ ID NO: 66952 - DNA, 23 bp, Homo sapiens
  misc_feature 1..23: note = chr21:46359164-46359187
  misc_feature 1..23: note = hypo
  source 1..23: mol_type = genomic DNA
gatgagcagggctcccgttccca

SEQ ID NO: 66953 - DNA, 117 bp, Homo sapiens
  misc_feature 1..117: note = chr21:46359248-46359365
  misc_feature 1..117: note = hypo
  source 1..117: mol_type = genomic DNA
ttctaaagaactgttctgaggactaaatggaatagtgtaaaaaataaattgacatgaagtgaaggtcaattaaaatgcactagcttggccaggcgcagtgtggctcatgcctgtaat

SEQ ID NO: 66954 - DNA, 33 bp, Homo sapiens; identical to SEQ ID NO: 46548
  misc_feature 1..33: note = chr21:46424460-46424493
  misc_feature 1..33: note = hypo
  source 1..33: mol_type = genomic DNA

SEQ ID NO: 66955 - DNA, 65 bp, Homo sapiens; identical to SEQ ID NO: 46549
  misc_feature 1..65: note = chr21:46431841-46431906
  misc_feature 1..65: note = hypo
  source 1..65: mol_type = genomic DNA

SEQ ID NO: 66956 - DNA, 46 bp, Homo sapiens; identical to SEQ ID NO: 46550
  misc_feature 1..46: note = chr21:46439310-46439356
  misc_feature 1..46: note = hypo
  source 1..46: mol_type = genomic DNA

SEQ ID NO: 66957 - DNA, 94 bp, Homo sapiens; identical to SEQ ID NO: 25884
  misc_feature 1..94: note = chr21:46452280-46452374
  misc_feature 1..94: note = hypo
  source 1..94: mol_type = genomic DNA

SEQ ID NO: 66958 - DNA, 34 bp, Homo sapiens; identical to SEQ ID NO: 46552
  misc_feature 1..34: note = chr21:46549475-46549509
  misc_feature 1..34: note = hypo
  source 1..34: mol_type = genomic DNA

SEQ ID NO: 66959 - DNA, 85 bp, Homo sapiens; identical to SEQ ID NO: 46553
  misc_feature 1..85: note = chr21:46677808-46677893
  misc_feature 1..85: note = hypo
  source 1..85: mol_type = genomic DNA

SEQ ID NO: 66960 - DNA, 30 bp, Homo sapiens; identical to SEQ ID NO: 46554
  misc_feature 1..30: note = chr21:46839039-46839069
  misc_feature 1..30: note = hypo
  source 1..30: mol_type = genomic DNA

SEQ ID NO: 66961 - DNA, 62 bp, Homo sapiens; identical to SEQ ID NO: 46555
  misc_feature 1..62: note = chr21:46844701-46844763
  misc_feature 1..62: note = hypo
  source 1..62: mol_type = genomic DNA

SEQ ID NO: 66962 - DNA, 30 bp, Homo sapiens; identical to SEQ ID NO: 46556
  misc_feature 1..30: note = chr21:46848585-46848615
  misc_feature 1..30: note = hypo
  source 1..30: mol_type = genomic DNA

SEQ ID NO: 66963 - DNA, 30 bp, Homo sapiens; identical to SEQ ID NO: 46557
  misc_feature 1..30: note = chr21:46853427-46853457
  misc_feature 1..30: note = hypo
  source 1..30: mol_type = genomic DNA

SEQ ID NO: 66964 - DNA, 83 bp, Homo sapiens; identical to SEQ ID NO: 46558
  misc_feature 1..83: note = chr21:46863752-46863835
  misc_feature 1..83: note = hypo
  source 1..83: mol_type = genomic DNA

SEQ ID NO: 66965 - DNA, 305 bp, Homo sapiens; identical to SEQ ID NO: 46559
  misc_feature 1..305: note = chr21:46864146-46864451
  misc_feature 1..305: note = hypo
  source 1..305: mol_type = genomic DNA

SEQ ID NO: 66966 - DNA, 79 bp, Homo sapiens; identical to SEQ ID NO: 46560
  misc_feature 1..79: note = chr21:46894771-46894850
  misc_feature 1..79: note = hypo
  source 1..79: mol_type = genomic DNA

SEQ ID NO: 66967 - DNA, 30 bp, Homo sapiens; identical to SEQ ID NO: 46561
  misc_feature 1..30: note = chr21:46895400-46895430
  misc_feature 1..30: note = hypo
  source 1..30: mol_type = genomic DNA

SEQ ID NO: 66968 - DNA, 106 bp, Homo sapiens; identical to SEQ ID NO: 46562
  misc_feature 1..106: note = chr21:46908905-46909011
  misc_feature 1..106: note = hypo
  source 1..106: mol_type = genomic DNA

SEQ ID NO: 66969 - DNA, 30 bp, Homo sapiens; identical to SEQ ID NO: 46563
  misc_feature 1..30: note = chr21:46909213-46909243
  misc_feature 1..30: note = hypo
  source 1..30: mol_type = genomic DNA

SEQ ID NO: 66970 - DNA, 35 bp, Homo sapiens; identical to SEQ ID NO: 46564
  misc_feature 1..35: note = chr21:46909499-46909534
  misc_feature 1..35: note = hypo
  source 1..35: mol_type = genomic DNA

SEQ ID NO: 66971 - DNA, 388 bp, Homo sapiens; identical to SEQ ID NO: 46565
  misc_feature 1..388: note = chr21:46912094-46912482
  misc_feature 1..388: note = hypo
  source 1..388: mol_type = genomic DNA

SEQ ID NO: 66972 - DNA, 163 bp, Homo sapiens; identical to SEQ ID NO: 46566
  misc_feature 1..163: note = chr21:46921470-46921633
  misc_feature 1..163: note = hypo
  source 1..163: mol_type = genomic DNA

SEQ ID NO: 66973 - DNA, 84 bp, Homo sapiens; identical to SEQ ID NO: 46567
  misc_feature 1..84: note = chr21:46925361-46925445
  misc_feature 1..84: note = hypo
  source 1..84: mol_type = genomic DNA

SEQ ID NO: 66974 - DNA, 26 bp, Homo sapiens
  misc_feature 1..26: note = chr21:46925754-46925780
  misc_feature 1..26: note = hypo
  source 1..26: mol_type = genomic DNA
aggctctgggctacacgccaggccat

SEQ ID NO: 66975 - DNA, 20 bp, Homo sapiens
  misc_feature 1..20: note = chr21:46926439-46926459
  misc_feature 1..20: note = hypo
  source 1..20: mol_type = genomic DNA
ggtggcaggagtggccgctc

SEQ ID NO: 66976 - DNA, 19 bp, Homo sapiens
  misc_feature 1..19: note = chr21:46926565-46926584
  misc_feature 1..19: note = hypo
  source 1..19: mol_type = genomic DNA
catccgtgggagcctccat

SEQ ID NO: 66977 - DNA, 89 bp, Homo sapiens; identical to SEQ ID NO: 46570
  misc_feature 1..89: note = chr21:46934071-46934160
  misc_feature 1..89: note = hypo
  source 1..89: mol_type = genomic DNA

SEQ ID NO: 66978 - DNA, 34 bp, Homo sapiens
  misc_feature 1..34: note = chr21:46935936-46935970
  misc_feature 1..34: note = hypo
  source 1..34: mol_type = genomic DNA
cctgggccgggggctgccgcgggtggtggccccg

SEQ ID NO: 66979 - DNA, 30 bp, Homo sapiens; identical to SEQ ID NO: 46572
  misc_feature 1..30: note = chr21:46978498-46978528
  misc_feature 1..30: note = hypo
  source 1..30: mol_type = genomic DNA

SEQ ID NO: 66980 - DNA, 54 bp, Homo sapiens; identical to SEQ ID NO: 46573
  misc_feature 1..54: note = chr21:46999805-46999859
  misc_feature 1..54: note = hypo
  source 1..54: mol_type = genomic DNA

SEQ ID NO: 66981 - DNA, 77 bp, Homo sapiens; identical to SEQ ID NO: 46574
  misc_feature 1..77: note = chr21:47013235-47013312
  misc_feature 1..77: note = hypo
  source 1..77: mol_type = genomic DNA

SEQ ID NO: 66982 - DNA, 49 bp, Homo sapiens; identical to SEQ ID NO: 46575
  misc_feature 1..49: note = chr21:47019157-47019206
  misc_feature 1..49: note = hypo
  source 1..49: mol_type = genomic DNA

SEQ ID NO: 66983 - DNA, 39 bp, Homo sapiens; identical to SEQ ID NO: 46576
  misc_feature 1..39: note = chr21:47026381-47026420
  misc_feature 1..39: note = hypo
  source 1..39: mol_type = genomic DNA

SEQ ID NO: 66984 - DNA, 67 bp, Homo sapiens; identical to SEQ ID NO: 46577
  misc_feature 1..67: note = chr21:47026666-47026733
  misc_feature 1..67: note = hypo
  source 1..67: mol_type = genomic DNA

SEQ ID NO: 66985 - DNA, 30 bp, Homo sapiens; identical to SEQ ID NO: 46578
  misc_feature 1..30: note = chr21:47036096-47036126
  misc_feature 1..30: note = hypo
  source 1..30: mol_type = genomic DNA

SEQ ID NO: 66986 - DNA, 120 bp, Homo sapiens; identical to SEQ ID NO: 46579
  misc_feature 1..120: note = chr21:47213460-47213580
  misc_feature 1..120: note = hypo
  source 1..120: mol_type = genomic DNA

SEQ ID NO: 66987 - DNA, 69 bp, Homo sapiens; identical to SEQ ID NO: 46580
  misc_feature 1..69: note = chr21:47287081-47287150
  misc_feature 1..69: note = hypo
  source 1..69: mol_type = genomic DNA

SEQ ID NO: 66988 - DNA, 32 bp, Homo sapiens; identical to SEQ ID NO: 46581
  misc_feature 1..32: note = chr21:47287393-47287425
  misc_feature 1..32: note = hypo
  source 1..32: mol_type = genomic DNA

SEQ ID NO: 66989 - DNA, 30 bp, Homo sapiens; identical to SEQ ID NO: 46582
  misc_feature 1..30: note = chr21:47328429-47328459
  misc_feature 1..30: note = hypo
  source 1..30: mol_type = genomic DNA

SEQ ID NO: 66990 - DNA, 30 bp, Homo sapiens; identical to SEQ ID NO: 46583
  misc_feature 1..30: note = chr21:47365874-47365904
  misc_feature 1..30: note = hypo
  source 1..30: mol_type = genomic DNA

SEQ ID NO: 66991 - DNA, 157 bp, Homo sapiens
  misc_feature 1..157: note = chr21:47404017-47404174
  misc_feature 1..157: note = hypo
  source 1..157: mol_type = genomic DNA
gccttccaggagggccggcctcagggccacagggcaagtccagctgtgtgtcagccacggccagggtggggcagcctgtccatctgggtgacgtcgcgccctgggacgggtagcgatggcgccaggggccgcccgcctcacgcccgccgtgcctgtt

SEQ ID NO: 66992 - DNA, 35 bp, Homo sapiens; identical to SEQ ID NO: 46585
  misc_feature 1..35: note = chr21:47417760-47417795
  misc_feature 1..35: note = hypo
  source 1..35: mol_type = genomic DNA

SEQ ID NO: 66993 - DNA, 30 bp, Homo sapiens; identical to SEQ ID NO: 46586
  misc_feature 1..30: note = chr21:47418458-47418488
  misc_feature 1..30: note = hypo
  source 1..30: mol_type = genomic DNA

SEQ ID NO: 66994 - DNA, 30 bp, Homo sapiens; identical to SEQ ID NO: 46587
  misc_feature 1..30: note = chr21:47420466-47420496
  misc_feature 1..30: note = hypo
  source 1..30: mol_type = genomic DNA

SEQ ID NO: 66995 - DNA, 34 bp, Homo sapiens; identical to SEQ ID NO: 46588
  misc_feature 1..34: note = chr21:47421299-47421333
  misc_feature 1..34: note = hypo
  source 1..34: mol_type = genomic DNA

SEQ ID NO: 66996 - DNA, 92 bp, Homo sapiens; identical to SEQ ID NO: 46589
  misc_feature 1..92: note = chr21:47422662-47422754
  misc_feature 1..92: note = hypo
  source 1..92: mol_type = genomic DNA

SEQ ID NO: 66997 - DNA, 142 bp, Homo sapiens; identical to SEQ ID NO: 46590
  misc_feature 1..142: note = chr21:47425521-47425663
  misc_feature 1..142: note = hypo
  source 1..142: mol_type = genomic DNA

SEQ ID NO: 66998 - DNA, 53 bp, Homo sapiens; identical to SEQ ID NO: 46591
  misc_feature 1..53: note = chr21:47457442-47457495
  misc_feature 1..53: note = hypo
  source 1..53: mol_type = genomic DNA

SEQ ID NO: 66999 - DNA, 35 bp, Homo sapiens; identical to SEQ ID NO: 46592
  misc_feature 1..35: note = chr21:47459822-47459857
  misc_feature 1..35: note = hypo
  source 1..35: mol_type = genomic DNA

SEQ ID NO: 67000 - DNA, 65 bp, Homo sapiens; identical to SEQ ID NO: 46593
  misc_feature 1..65: note = chr21:47471074-47471139
  misc_feature 1..65: note = hypo
  source 1..65: mol_type = genomic DNA

SEQ ID NO: 67001 - DNA, 67 bp, Homo sapiens; identical to SEQ ID NO: 46594
  misc_feature 1..67: note = chr21:47475296-47475363
  misc_feature 1..67: note = hypo
  source 1..67: mol_type = genomic DNA

SEQ ID NO: 67002 - DNA, 30 bp, Homo sapiens; identical to SEQ ID NO: 46595
  misc_feature 1..30: note = chr21:47487782-47487812
  misc_feature 1..30: note = hypo
  source 1..30: mol_type = genomic DNA

SEQ ID NO: 67003 - DNA, 78 bp, Homo sapiens; identical to SEQ ID NO: 46596
  misc_feature 1..78: note = chr21:47489936-47490014
  misc_feature 1..78: note = hypo
  source 1..78: mol_type = genomic DNA

SEQ ID NO: 67004 - DNA, 30 bp, Homo sapiens; identical to SEQ ID NO: 16747
  misc_feature 1..30: note = chr21:47501864-47501894
  misc_feature 1..30: note = hypo
  source 1..30: mol_type = genomic DNA

SEQ ID NO: 67005 - DNA, 34 bp, Homo sapiens; identical to SEQ ID NO: 16748
  misc_feature 1..34: note = chr21:47503061-47503095
  misc_feature 1..34: note = hypo
  source 1..34: mol_type = genomic DNA

SEQ ID NO: 67006 - DNA, 93 bp, Homo sapiens; identical to SEQ ID NO: 46600
  misc_feature 1..93: note = chr21:47531922-47532015
  misc_feature 1..93: note = hypo
  source 1..93: mol_type = genomic DNA

SEQ ID NO: 67007 - DNA, 30 bp, Homo sapiens; identical to SEQ ID NO: 46601
  misc_feature 1..30: note = chr21:47539603-47539633
  misc_feature 1..30: note = hypo
  source 1..30: mol_type = genomic DNA

SEQ ID NO: 67008 - DNA, 30 bp, Homo sapiens; identical to SEQ ID NO: 46602
  misc_feature 1..30: note = chr21:47546044-47546074
  misc_feature 1..30: note = hypo
  source 1..30: mol_type = genomic DNA

SEQ ID NO: 67009 - DNA, 43 bp, Homo sapiens; identical to SEQ ID NO: 46603
  misc_feature 1..43: note = chr21:47565176-47565219
  misc_feature 1..43: note = hypo
  source 1..43: mol_type = genomic DNA

SEQ ID NO: 67010 - DNA, 62 bp, Homo sapiens; identical to SEQ ID NO: 46604
  misc_feature 1..62: note = chr21:47570296-47570358
  misc_feature 1..62: note = hypo
  source 1..62: mol_type = genomic DNA

SEQ ID NO: 67011 - DNA, 30 bp, Homo sapiens; identical to SEQ ID NO: 46605
  misc_feature 1..30: note = chr21:47689638-47689668
  misc_feature 1..30: note = hypo
  source 1..30: mol_type = genomic DNA

SEQ ID NO: 67012 - DNA, 37 bp, Homo sapiens; identical to SEQ ID NO: 16750
  misc_feature 1..37: note = chr21:47737928-47737965
  misc_feature 1..37: note = hypo
  source 1..37: mol_type = genomic DNA

SEQ ID NO: 67013 - DNA, 92 bp, Homo sapiens; identical to SEQ ID NO: 25901
  misc_feature 1..92: note = chr21:47746178-47746270
  misc_feature 1..92: note = hypo
  source 1..92: mol_type = genomic DNA

SEQ ID NO: 67014 - DNA, 21 bp, Homo sapiens
  misc_feature 1..21: note = chr21:47746393-47746414
  misc_feature 1..21: note = hypo
  source 1..21: mol_type = genomic DNA
agagtccggtaaccaaggagg

SEQ ID NO: 67015 - DNA, 30 bp, Homo sapiens; identical to SEQ ID NO: 46608
  misc_feature 1..30: note = chr21:47771781-47771811
  misc_feature 1..30: note = hypo
  source 1..30: mol_type = genomic DNA

SEQ ID NO: 67016 - DNA, 30 bp, Homo sapiens; identical to SEQ ID NO: 46609
  misc_feature 1..30: note = chr21:47772056-47772086
  misc_feature 1..30: note = hypo
  source 1..30: mol_type = genomic DNA

SEQ ID NO: 67017 - DNA, 44 bp, Homo sapiens; identical to SEQ ID NO: 46610
  misc_feature 1..44: note = chr21:47799181-47799225
  misc_feature 1..44: note = hypo
  source 1..44: mol_type = genomic DNA

SEQ ID NO: 67018 - DNA, 37 bp, Homo sapiens; identical to SEQ ID NO: 46611
  misc_feature 1..37: note = chr22:17330739-17330776
  misc_feature 1..37: note = hypo
  source 1..37: mol_type = genomic DNA

SEQ ID NO: 67019 - skipped

SEQ ID NO: 67020 - DNA, 96 bp, Homo sapiens
  misc_feature 1..96: note = chr22:18110593-18110689
  misc_feature 1..96: note = hypo
  source 1..96: mol_type = genomic DNA
aaaaagaaaaaaagaaaaaaacacagttcataaagtgaacgaccttgtcaaaacactggttggaagcaggtctcttccctccgcactgtttcctat

SEQ ID NO: 67021 - DNA, 30 bp, Homo sapiens; identical to SEQ ID NO: 46614
  misc_feature 1..30: note = chr22:18265801-18265831
  misc_feature 1..30: note = hypo
  source 1..30: mol_type = genomic DNA

SEQ ID NO: 67022 - DNA, 34 bp, Homo sapiens
  misc_feature 1..34: note = chr22:18328093-18328127
  misc_feature 1..34: note = hypo
  source 1..34: mol_type = genomic DNA
gggtaacgtggggaacgcatactgtctggcaaga

SEQ ID NO: 67023 - DNA, 30 bp, Homo sapiens; identical to SEQ ID NO: 46616
  misc_feature 1..30: note = chr22:18355680-18355710
  misc_feature 1..30: note = hypo
  source 1..30: mol_type = genomic DNA

SEQ ID NO: 67024 - DNA, 30 bp, Homo sapiens; identical to SEQ ID NO: 16753
  misc_feature 1..30: note = chr22:18553893-18553923
  misc_feature 1..30: note = hypo
  source 1..30: mol_type = genomic DNA

SEQ ID NO: 67025 - DNA, 53 bp, Homo sapiens; identical to SEQ ID NO: 46618
  misc_feature 1..53: note = chr22:18634479-18634532
  misc_feature 1..53: note = hypo
  source 1..53: mol_type = genomic DNA

SEQ ID NO: 67026 - DNA, 27 bp, Homo sapiens
  misc_feature 1..27: note = chr22:19117537-19117564
  misc_feature 1..27: note = hypo
  source 1..27: mol_type = genomic DNA
catgcactgcagccccgacccacccat

SEQ ID NO: 67027 - DNA, 82 bp, Homo sapiens
  misc_feature 1..82: note = chr22:19117594-19117676
  misc_feature 1..82: note = hypo
  source 1..82: mol_type = genomic DNA
gactcacctgcccggctctctaccctgaggggcctgccgcctctgctcccaaacacagagctgctttcgtctaccaggcttg

SEQ ID NO: 67028 - DNA, 30 bp, Homo sapiens; identical to SEQ ID NO: 46620
  misc_feature 1..30: note = chr22:19444363-19444393
  misc_feature 1..30: note = hypo
  source 1..30: mol_type = genomic DNA

SEQ ID NO: 67029 - DNA, 43 bp, Homo sapiens; identical to SEQ ID NO: 46621
  misc_feature 1..43: note = chr22:19771799-19771842
  misc_feature 1..43: note = hypo
  source 1..43: mol_type = genomic DNA

SEQ ID NO: 67030 - DNA, 78 bp, Homo sapiens; identical to SEQ ID NO: 46622
  misc_feature 1..78: note = chr22:19965000-19965078
  misc_feature 1..78: note = hypo
  source 1..78: mol_type = genomic DNA

SEQ ID NO: 67031 - DNA, 151 bp, Homo sapiens; identical to SEQ ID NO: 46623
  misc_feature 1..151: note = chr22:20166058-20166209
  misc_feature 1..151: note = hypo
  source 1..151: mol_type = genomic DNA

SEQ ID NO: 67032 - DNA, 33 bp, Homo sapiens; identical to SEQ ID NO: 46624
  misc_feature 1..33: note = chr22:20308760-20308793
  misc_feature 1..33: note = hypo
  source 1..33: mol_type = genomic DNA

SEQ ID NO: 67033 - DNA, 39 bp, Homo sapiens; identical to SEQ ID NO: 46625
  misc_feature 1..39: note = chr22:20749338-20749377
  misc_feature 1..39: note = hypo
  source 1..39: mol_type = genomic DNA

SEQ ID NO: 67034 - DNA, 22 bp, Homo sapiens
  misc_feature 1..22: note = chr22:20765425-20765447
  misc_feature 1..22: note = hypo
  source 1..22: mol_type = genomic DNA
ccgtgcccggccaaaaaggact

SEQ ID NO: 67035 - DNA, 20 bp, Homo sapiens
  misc_feature 1..20: note = chr22:20851286-20851306
  misc_feature 1..20: note = hypo
  source 1..20: mol_type = genomic DNA
gggcttggtggctggcgcct

SEQ ID NO: 67036 - DNA, 34 bp, Homo sapiens; identical to SEQ ID NO: 46628
  misc_feature 1..34: note = chr22:21024902-21024936
  misc_feature 1..34: note = hypo
  source 1..34: mol_type = genomic DNA

SEQ ID NO: 67037 - DNA, 88 bp, Homo sapiens; identical to SEQ ID NO: 46629
  misc_feature 1..88: note = chr22:21105305-21105393
  misc_feature 1..88: note = hypo
  source 1..88: mol_type = genomic DNA

SEQ ID NO: 67038 - DNA, 30 bp, Homo sapiens; identical to SEQ ID NO: 46630
  misc_feature 1..30: note = chr22:21150528-21150558
  misc_feature 1..30: note = hypo
  source 1..30: mol_type = genomic DNA

SEQ ID NO: 67039 - DNA, 23 bp, Homo sapiens
  misc_feature 1..23: note = chr22:21154000-21154023
  misc_feature 1..23: note = hypo
  source 1..23: mol_type = genomic DNA
gccaagaacgcctccacaatcac

SEQ ID NO: 67040 - DNA, 91 bp, Homo sapiens; identical to SEQ ID NO: 46632
  misc_feature 1..91: note = chr22:21214252-21214343
  misc_feature 1..91: note = hypo
  source 1..91: mol_type = genomic DNA

SEQ ID NO: 67041 - DNA, 34 bp, Homo sapiens; identical to SEQ ID NO: 46633
  misc_feature 1..34: note = chr22:21380309-21380343
  misc_feature 1..34: note = hypo
  source 1..34: mol_type = genomic DNA

SEQ ID NO: 67042 - DNA, 58 bp, Homo sapiens; identical to SEQ ID NO: 46634
  misc_feature 1..58: note = chr22:21982983-21983041
  misc_feature 1..58: note = hypo
  source 1..58: mol_type = genomic DNA

SEQ ID NO: 67043 - DNA, 87 bp, Homo sapiens; identical to SEQ ID NO: 46635
  misc_feature 1..87: note = chr22:21986707-21986794
  misc_feature 1..87: note = hypo
  source 1..87: mol_type = genomic DNA

SEQ ID NO: 67044 - DNA, 30 bp, Homo sapiens; identical to SEQ ID NO: 46636
  misc_feature 1..30: note = chr22:22058379-22058409
  misc_feature 1..30: note = hypo
  source 1..30: mol_type = genomic DNA

SEQ ID NO: 67045 - DNA, 30 bp, Homo sapiens; identical to SEQ ID NO: 46637
  misc_feature 1..30: note = chr22:22344036-22344066
  misc_feature 1..30: note = hypo
  source 1..30: mol_type = genomic DNA

SEQ ID NO: 67046 - DNA, 321 bp, Homo sapiens; identical to SEQ ID NO: 46638
  misc_feature 1..321: note = chr22:22899633-22899954
  misc_feature 1..321: note = hypo
  source 1..321: mol_type = genomic DNA

SEQ ID NO: 67047 - DNA, 153 bp, Homo sapiens; identical to SEQ ID NO: 46640
  misc_feature 1..153: note = chr22:23453131-23453284
  misc_feature 1..153: note = hypo
  source 1..153: mol_type = genomic DNA

SEQ ID NO: 67048 - DNA, 15 bp, Homo sapiens
  misc_feature 1..15: note = chr22:23791432-23791447
  misc_feature 1..15: note = hypo
  source 1..15: mol_type = genomic DNA
cggggccagtccctg

SEQ ID NO: 67049 - DNA, 82 bp, Homo sapiens; identical to SEQ ID NO: 46642
  misc_feature 1..82: note = chr22:23915601-23915683
  misc_feature 1..82: note = hypo
  source 1..82: mol_type = genomic DNA

SEQ ID NO: 67050 - DNA, 42 bp, Homo sapiens; identical to SEQ ID NO: 16758
  misc_feature 1..42: note = chr22:24374229-24374271
  misc_feature 1..42: note = hypo
  source 1..42: mol_type = genomic DNA

SEQ ID NO: 67051 - DNA, 42 bp, Homo sapiens; identical to SEQ ID NO: 46645
  misc_feature 1..42: note = chr22:24646515-24646557
  misc_feature 1..42: note = hypo
  source 1..42: mol_type = genomic DNA

SEQ ID NO: 67052 - DNA, 30 bp, Homo sapiens; identical to SEQ ID NO: 46646
  misc_feature 1..30: note = chr22:25091239-25091269
  misc_feature 1..30: note = hypo
  source 1..30: mol_type = genomic DNA

SEQ ID NO: 67053 - DNA, 21 bp, Homo sapiens
  misc_feature 1..21: note = chr22:25171155-25171176
  misc_feature 1..21: note = hypo
  source 1..21: mol_type = genomic DNA
tcctcacgtggaagagtggaa

SEQ ID NO: 67054 - DNA, 30 bp, Homo sapiens; identical to SEQ ID NO: 46648
  misc_feature 1..30: note = chr22:26763231-26763261
  misc_feature 1..30: note = hypo
  source 1..30: mol_type = genomic DNA

SEQ ID NO: 67055 - DNA, 38 bp, Homo sapiens; identical to SEQ ID NO: 46649
  misc_feature 1..38: note = chr22:26932483-26932521
  misc_feature 1..38: note = hypo
  source 1..38: mol_type = genomic DNA

SEQ ID NO: 67056 - DNA, 19 bp, Homo sapiens
  misc_feature 1..19: note = chr22:26965186-26965205
  misc_feature 1..19: note = hypo
  source 1..19: mol_type = genomic DNA
accccgttccagtaacagt

SEQ ID NO: 67057 - DNA, 21 bp, Homo sapiens
  misc_feature 1..21: note = chr22:26991250-26991271
  misc_feature 1..21: note = hypo
  source 1..21: mol_type = genomic DNA
gcctgtgaggccaggcgcagt

SEQ ID NO: 67058 - DNA, 20 bp, Homo sapiens
  misc_feature 1..20: note = chr22:27010657-27010677
  misc_feature 1..20: note = hypo
  source 1..20: mol_type = genomic DNA
taaaaacaagtaaatcggcc

SEQ ID NO: 67059 - DNA, 71 bp, Homo sapiens; identical to SEQ ID NO: 46653
  misc_feature 1..71: note = chr22:27045927-27045998
  misc_feature 1..71: note = hypo
  source 1..71: mol_type = genomic DNA

SEQ ID NO: 67060 - DNA, 64 bp, Homo sapiens; identical to SEQ ID NO: 46654
  misc_feature 1..64: note = chr22:28007163-28007227
  misc_feature 1..64: note = hypo
  source 1..64: mol_type = genomic DNA

SEQ ID NO: 67061 - DNA, 45 bp, Homo sapiens
  misc_feature 1..45: note = chr22:28371679-28371724
  misc_feature 1..45: note = hypo
  source 1..45: mol_type = genomic DNA
tcatatatagtggcataaaatcgtttgtagcgttttcttattctt

SEQ ID NO: 67062 - DNA, 30 bp, Homo sapiens; identical to SEQ ID NO: 46656
  misc_feature 1..30: note = chr22:29167679-29167709
  misc_feature 1..30: note = hypo
  source 1..30: mol_type = genomic DNA

SEQ ID NO: 67063 - DNA, 30 bp, Homo sapiens; identical to SEQ ID NO: 46657
  misc_feature 1..30: note = chr22:29168256-29168286
  misc_feature 1..30: note = hypo
  source 1..30: mol_type = genomic DNA

SEQ ID NO: 67064 - DNA, 160 bp, Homo sapiens
  misc_feature 1..160: note = chr22:29445592-29445752
  misc_feature 1..160: note = hypo
  source 1..160: mol_type = genomic DNA
agggcctcagctacccggagcaggaggggcagtccccacctagcctcgcaccccggggcccggcccgtgcctttcctccgagcggcagtggcagcctgctcttccccaccgtggtgcacgtggccccgccctcccacctggagagcggcagcacgtccag

SEQ ID NO: 67065 - DNA, 402 bp, Homo sapiens
  misc_feature 1..402: note = chr22:29445923-29446325
  misc_feature 1..402: note = hypo
  source 1..402: mol_type = genomic DNA
cttccgcagctccctcagcagcgactatgaccccttcatctaccgcagccggagcccctgtcgtgccagtgaggcggggggctcgggcagctcgggccggggacctgccctgtgcttcgagggctccccgcctcccgaggagctcccggcggtgcacagtcatggtgctgggcggggcgagccttggccgggccctgcctctccctcgggggatcaggtgtccacctgcagcctggagatgaactacagcagcaactcctccctggagcacagggggcccaatagctctacctcagaagtggggctcgaggcttctcctggggccgcccctgacctcaggaggacctggaaggggggccacgagttgccgtcgtgtgcctgctgctgcgagccccagccctc

SEQ ID NO: 67066 - DNA, 20 bp, Homo sapiens
  misc_feature 1..20: note = chr22:29701033-29701053
  misc_feature 1..20: note = hypo
  source 1..20: mol_type = genomic DNA
ccggccgggaatgttaagac

SEQ ID NO: 67067 - DNA, 30 bp, Homo sapiens; identical to SEQ ID NO: 46660
  misc_feature 1..30: note = chr22:29736031-29736061
  misc_feature 1..30: note = hypo
  source 1..30: mol_type = genomic DNA

SEQ ID NO: 67068 - DNA, 24 bp, Homo sapiens
  misc_feature 1..24: note = chr22:29977939-29977963
  misc_feature 1..24: note = hypo
  source 1..24: mol_type = genomic DNA
agtggaagccgtcctcttgtgctg

SEQ ID NO: 67069 - DNA, 34 bp, Homo sapiens; identical to SEQ ID NO: 46663
  misc_feature 1..34: note = chr22:29997189-29997223
  misc_feature 1..34: note = hypo
  source 1..34: mol_type = genomic DNA

SEQ ID NO: 67070 - DNA, 36 bp, Homo sapiens; identical to SEQ ID NO: 46664
  misc_feature 1..36: note = chr22:29998650-29998686
  misc_feature 1..36: note = hypo
  source 1..36: mol_type = genomic DNA

SEQ ID NO: 67071 - DNA, 30 bp, Homo sapiens; identical to SEQ ID NO: 46665
  misc_feature 1..30: note = chr22:30091110-30091140
  misc_feature 1..30: note = hypo
  source 1..30: mol_type = genomic DNA

SEQ ID NO: 67072 - DNA, 29 bp, Homo sapiens
  misc_feature 1..29: note = chr22:30233129-30233158
  misc_feature 1..29: note = hypo
  source 1..29: mol_type = genomic DNA
gtaggcagggctgggcgcgatggctcacg

SEQ ID NO: 67073 - DNA, 30 bp, Homo sapiens; identical to SEQ ID NO: 46668
  misc_feature 1..30: note = chr22:30768004-30768034
  misc_feature 1..30: note = hypo
  source 1..30: mol_type = genomic DNA

SEQ ID NO: 67074 - DNA, 102 bp, Homo sapiens; identical to SEQ ID NO: 46669
  misc_feature 1..102: note = chr22:30783894-30783996
  misc_feature 1..102: note = hypo
  source 1..102: mol_type = genomic DNA

SEQ ID NO: 67075 - DNA, 319 bp, Homo sapiens; identical to SEQ ID NO: 46670
  misc_feature 1..319: note = chr22:30857340-30857659
  misc_feature 1..319: note = hypo
  source 1..319: mol_type = genomic DNA

SEQ ID NO: 67076 - DNA, 30 bp, Homo sapiens; identical to SEQ ID NO: 46671
  misc_feature 1..30: note = chr22:30924831-30924861
  misc_feature 1..30: note = hypo
  source 1..30: mol_type = genomic DNA

SEQ ID NO: 67077 - DNA, 30 bp, Homo sapiens; identical to SEQ ID NO: 46672
  misc_feature 1..30: note = chr22:30940902-30940932
  misc_feature 1..30: note = hypo
  source 1..30: mol_type = genomic DNA

SEQ ID NO: 67078 - DNA, 30 bp, Homo sapiens; identical to SEQ ID NO: 46673
  misc_feature 1..30: note = chr22:31460423-31460453
  misc_feature 1..30: note = hypo
  source 1..30: mol_type = genomic DNA

SEQ ID NO: 67079 - DNA, 35 bp, Homo sapiens; identical to SEQ ID NO: 16768
  misc_feature 1..35: note = chr22:32014233-32014268
  misc_feature 1..35: note = hypo
  source 1..35: mol_type = genomic DNA

SEQ ID NO: 67080 - DNA, 29 bp, Homo sapiens
  misc_feature 1..29: note = chr22:32356777-32356806
  misc_feature 1..29: note = hypo
  source 1..29: mol_type = genomic DNA
aaaaactccgtccccgccccccccccccc

SEQ ID NO: 67081 - DNA, 80 bp, Homo sapiens; identical to SEQ ID NO: 46676
  misc_feature 1..80: note = chr22:32701637-32701717
  misc_feature 1..80: note = hypo
  source 1..80: mol_type = genomic DNA

SEQ ID NO: 67082 - DNA, 30 bp, Homo sapiens; identical to SEQ ID NO: 46677
  misc_feature 1..30: note = chr22:32748880-32748910
  misc_feature 1..30: note = hypo
  source 1..30: mol_type = genomic DNA

SEQ ID NO: 67083 - DNA, 24 bp, Homo sapiens
  misc_feature 1..24: note = chr22:33170623-33170647
  misc_feature 1..24: note = hypo
  source 1..24: mol_type = genomic DNA
gctggagtgcaatggcgcacgatc

SEQ ID NO: 67084 - DNA, 149 bp, Homo sapiens; identical to SEQ ID NO: 46679
  misc_feature 1..149: note = chr22:33255195-33255344
  misc_feature 1..149: note = hypo
  source 1..149: mol_type = genomic DNA

SEQ ID NO: 67085 - DNA, 35 bp, Homo sapiens; identical to SEQ ID NO: 46680
  misc_feature 1..35: note = chr22:35079349-35079384
  misc_feature 1..35: note = hypo
  source 1..35: mol_type = genomic DNA

SEQ ID NO: 67086 - DNA, 30 bp, Homo sapiens; identical to SEQ ID NO: 5266
  misc_feature 1..30: note = chr22:35768487-35768517
  misc_feature 1..30: note = hypo
  source 1..30: mol_type = genomic DNA

SEQ ID NO: 67087 - DNA, 96 bp, Homo sapiens; identical to SEQ ID NO: 46682
  misc_feature 1..96: note = chr22:35822686-35822782
  misc_feature 1..96: note = hypo
  source 1..96: mol_type = genomic DNA

SEQ ID NO: 67088 - DNA, 34 bp, Homo sapiens
  misc_feature 1..34: note = chr22:35848324-35848358
  misc_feature 1..34: note = hypo
  source 1..34: mol_type = genomic DNA
gtcacaccctggaaccgtgtggtgtttctgttgt

SEQ ID NO: 67089 - DNA, 30 bp, Homo sapiens; identical to SEQ ID NO: 46684
  misc_feature 1..30: note = chr22:35964914-35964944
  misc_feature 1..30: note = hypo
  source 1..30: mol_type = genomic DNA

SEQ ID NO: 67090 - DNA, 25 bp, Homo sapiens
  misc_feature 1..25: note = chr22:36246202-36246227
  misc_feature 1..25: note = hypo
  source 1..25: mol_type = genomic DNA
ccgtgtgcacgcatgcgcattctct

SEQ ID NO: 67091 - DNA, 25 bp, Homo sapiens
  misc_feature 1..25: note = chr22:36246287-36246312
  misc_feature 1..25: note = hypo
  source 1..25: mol_type = genomic DNA
tcactgtctccggcagagacaggtg

SEQ ID NO: 67092 - DNA, 70 bp, Homo sapiens; identical to SEQ ID NO: 46687
  misc_feature 1..70: note = chr22:36585930-36586000
  misc_feature 1..70: note = hypo
  source 1..70: mol_type = genomic DNA

SEQ ID NO: 67093 - DNA, 150 bp, Homo sapiens; identical to SEQ ID NO: 46688
  misc_feature 1..150: note = chr22:36684196-36684346
  misc_feature 1..150: note = hypo
  source 1..150: mol_type = genomic DNA

SEQ ID NO: 67094 - DNA, 30 bp, Homo sapiens; identical to SEQ ID NO: 16776
  misc_feature 1..30: note = chr22:36878964-36878994
  misc_feature 1..30: note = hypo
  source 1..30: mol_type = genomic DNA

SEQ ID NO: 67095 - DNA, 126 bp, Homo sapiens; identical to SEQ ID NO: 46690
  misc_feature 1..126: note = chr22:36902430-36902556
  misc_feature 1..126: note = hypo
  source 1..126: mol_type = genomic DNA

SEQ ID NO: 67096 - DNA, 41 bp, Homo sapiens; identical to SEQ ID NO: 46691
  misc_feature 1..41: note = chr22:36906156-36906197
  misc_feature 1..41: note = hypo
  source 1..41: mol_type = genomic DNA

SEQ ID NO: 67097 - DNA, 117 bp, Homo sapiens; identical to SEQ ID NO: 46692
  misc_feature 1..117: note = chr22:37321872-37321989
  misc_feature 1..117: note = hypo
  source 1..117: mol_type = genomic DNA

SEQ ID NO: 67098 - DNA, 82 bp, Homo sapiens; identical to SEQ ID NO: 46693
  misc_feature 1..82: note = chr22:37328816-37328898
  misc_feature 1..82: note = hypo
  source 1..82: mol_type = genomic DNA

SEQ ID NO: 67099 - DNA, 30 bp, Homo sapiens; identical to SEQ ID NO: 46694
  misc_feature 1..30: note = chr22:37334157-37334187
  misc_feature 1..30: note = hypo
  source 1..30: mol_type = genomic DNA

SEQ ID NO: 67100 - DNA, 50 bp, Homo sapiens; identical to SEQ ID NO: 46695
  misc_feature 1..50: note = chr22:37335158-37335208
  misc_feature 1..50: note = hypo
  source 1..50: mol_type = genomic DNA

SEQ ID NO: 67101 - DNA, 30 bp, Homo sapiens; identical to SEQ ID NO: 46696
  misc_feature 1..30: note = chr22:37348896-37348926
  misc_feature 1..30: note = hypo
  source 1..30: mol_type = genomic DNA

SEQ ID NO: 67102 - DNA, 30 bp, Homo sapiens; identical to SEQ ID NO: 46697
  misc_feature 1..30: note = chr22:37367531-37367561
  misc_feature 1..30: note = hypo
  source 1..30: mol_type = genomic DNA

SEQ ID NO: 67103 - DNA, 30 bp, Homo sapiens; identical to SEQ ID NO: 46698
  misc_feature 1..30: note = chr22:37367799-37367829
  misc_feature 1..30: note = hypo
  source 1..30: mol_type = genomic DNA

SEQ ID NO: 67104 - DNA, 30 bp, Homo sapiens; identical to SEQ ID NO: 46699
  misc_feature 1..30: note = chr22:37395982-37396012
  misc_feature 1..30: note = hypo
  source 1..30: mol_type = genomic DNA

SEQ ID NO: 67105 - DNA, 30 bp, Homo sapiens; identical to SEQ ID NO: 46700
  misc_feature 1..30: note = chr22:37770782-37770812
  misc_feature 1..30: note = hypo
  source 1..30: mol_type = genomic DNA

SEQ ID NO: 67106 - DNA, 30 bp, Homo sapiens; identical to SEQ ID NO: 46701
  misc_feature 1..30: note = chr22:38085235-38085265
  misc_feature 1..30: note = hypo
  source 1..30: mol_type = genomic DNA

SEQ ID NO: 67107 - DNA, 89 bp, Homo sapiens
  misc_feature 1..89: note = chr22:38199680-38199769
  misc_feature 1..89: note = hypo
  source 1..89: mol_type = genomic DNA
gaccataccgggatgcgttcatcattttgaccagcaacaaactcccactcccagggtattgtttaagtgaacagtgaccggcctctatg

SEQ ID NO: 67108 - DNA, 99 bp, Homo sapiens
  misc_feature 1..99: note = chr22:38199894-38199993
  misc_feature 1..99: note = hypo
  source 1..99: mol_type = genomic DNA
ctagggtctctgaggtctctcctgctggcctctgggcccctaaagcccctcgagcttcagaactccctacagacagtggcgccccgtgtccgcctcgtc

SEQ ID NO: 67109 - DNA, 30 bp, Homo sapiens; identical to SEQ ID NO: 16779
  misc_feature 1..30: note = chr22:38520276-38520306
  misc_feature 1..30: note = hypo
  source 1..30: mol_type = genomic DNA

SEQ ID NO: 67110 - DNA, 84 bp, Homo sapiens; identical to SEQ ID NO: 46704
  misc_feature 1..84: note = chr22:38578330-38578414
  misc_feature 1..84: note = hypo
  source 1..84: mol_type = genomic DNA

SEQ ID NO: 67111 - DNA, 24 bp, Homo sapiens
  misc_feature 1..24: note = chr22:38578714-38578738
  misc_feature 1..24: note = hypo
  source 1..24: mol_type = genomic DNA
gcccggctccgaaatttttaacat

SEQ ID NO: 67112 - DNA, 136 bp, Homo sapiens; identical to SEQ ID NO: 46706
  misc_feature 1..136: note = chr22:38679362-38679498
  misc_feature 1..136: note = hypo
  source 1..136: mol_type = genomic DNA

SEQ ID NO: 67113 - DNA, 89 bp, Homo sapiens; identical to SEQ ID NO: 46707
  misc_feature 1..89: note = chr22:38694504-38694593
  misc_feature 1..89: note = hypo
  source 1..89: mol_type = genomic DNA

SEQ ID NO: 67114 - DNA, 30 bp, Homo sapiens; identical to SEQ ID NO: 46708
  misc_feature 1..30: note = chr22:38841845-38841875
  misc_feature 1..30: note = hypo
  source 1..30: mol_type = genomic DNA

SEQ ID NO: 67115 - DNA, 30 bp, Homo sapiens; identical to SEQ ID NO: 46709
  misc_feature 1..30: note = chr22:39228205-39228235
  misc_feature 1..30: note = hypo
  source 1..30: mol_type = genomic DNA

SEQ ID NO: 67116 - DNA, 32 bp, Homo sapiens; identical to SEQ ID NO: 46710
  misc_feature 1..32: note = chr22:39530973-39531005
  misc_feature 1..32: note = hypo
  source 1..32: mol_type = genomic DNA

SEQ ID NO: 67117 - DNA, 182 bp, Homo sapiens; identical to SEQ ID NO: 46711
  misc_feature 1..182: note = chr22:39756856-39757038
  misc_feature 1..182: note = hypo
  source 1..182: mol_type = genomic DNA

SEQ ID NO: 67118 - DNA, 79 bp, Homo sapiens; identical to SEQ ID NO: 46712
  misc_feature 1..79: note = chr22:39770483-39770562
  misc_feature 1..79: note = hypo
  source 1..79: mol_type = genomic DNA

SEQ ID NO: 67119 - DNA, 135 bp, Homo sapiens; identical to SEQ ID NO: 46713
  misc_feature 1..135: note = chr22:39877264-39877399
  misc_feature 1..135: note = hypo
  source 1..135: mol_type = genomic DNA

SEQ ID NO: 67120 - DNA, 206 bp, Homo sapiens; identical to SEQ ID NO: 46715
  misc_feature 1..206: note = chr22:40018133-40018339
  misc_feature 1..206: note = hypo
  source 1..206: mol_type = genomic DNA

SEQ ID NO: 67121 - DNA, 50 bp, Homo sapiens; identical to SEQ ID NO: 46716
  misc_feature 1..50: note = chr22:40037034-40037084
  misc_feature 1..50: note = hypo
  source 1..50: mol_type = genomic DNA

SEQ ID NO: 67122 - DNA, 37 bp, Homo sapiens; identical to SEQ ID NO: 25931
  misc_feature 1..37: note = chr22:40042590-40042627
  misc_feature 1..37: note = hypo
  source 1..37: mol_type = genomic DNA

SEQ ID NO: 67123 - DNA, 117 bp, Homo sapiens; identical to SEQ ID NO: 25932
  misc_feature 1..117: note = chr22:40042743-40042860
  misc_feature 1..117: note = hypo
  source 1..117: mol_type = genomic DNA

SEQ ID NO: 67124 - DNA, 41 bp, Homo sapiens; identical to SEQ ID NO: 46718
  misc_feature 1..41: note = chr22:40055020-40055061
  misc_feature 1..41: note = hypo
  source 1..41: mol_type = genomic DNA

SEQ ID NO: 67125 - DNA, 30 bp, Homo sapiens; identical to SEQ ID NO: 46719
  misc_feature 1..30: note = chr22:40055554-40055584
  misc_feature 1..30: note = hypo
  source 1..30: mol_type = genomic DNA

SEQ ID NO: 67126 - DNA, 97 bp, Homo sapiens; identical to SEQ ID NO: 46720
  misc_feature 1..97: note = chr22:40073967-40074064
  misc_feature 1..97: note = hypo
  source 1..97: mol_type = genomic DNA

SEQ ID NO: 67127 - DNA, 37 bp, Homo sapiens; identical to SEQ ID NO: 46721
  misc_feature 1..37: note = chr22:40095526-40095563
  misc_feature 1..37: note = hypo
  source 1..37: mol_type = genomic DNA

SEQ ID NO: 67128 - DNA, 30 bp, Homo sapiens; identical to SEQ ID NO: 46722
  misc_feature 1..30: note = chr22:40113507-40113537
  misc_feature 1..30: note = hypo
  source 1..30: mol_type = genomic DNA

SEQ ID NO: 67129 - DNA, 26 bp, Homo sapiens
  misc_feature 1..26: note = chr22:40548285-40548311
  misc_feature 1..26: note = hypo
  source 1..26: mol_type = genomic DNA
cctcaaaattttggacggaaaagttt

SEQ ID NO: 67130 - DNA, 20 bp, Homo sapiens
  misc_feature 1..20: note = chr22:40991418-40991438
  misc_feature 1..20: note = hypo
  source 1..20: mol_type = genomic DNA
ccggccgagaaatgcctttt

SEQ ID NO: 67131 - DNA, 81 bp, Homo sapiens; identical to SEQ ID NO: 46726
  misc_feature 1..81: note = chr22:41578499-41578580
  misc_feature 1..81: note = hypo
  source 1..81: mol_type = genomic DNA

SEQ ID NO: 67132 - DNA, 313 bp, Homo sapiens
  misc_feature 1..313: note = chr22:41634542-41634855
  misc_feature 1..313: note = hypo
  source 1..313: mol_type = genomic DNA
aaggccatggcgggcaggtaaaccagggcgttgtgggccaggtttagcgtggccagcgcacccagtgccccgaacgtccccggccgcagctcctccagtgcgttcccctccagctccagccgccgcaacgagcccagcccgtccagcgcctcctggggcagctcacgcaggtggttggaggccaggttgagcaggagcaggcggcccaggccacggaaggcgccctcggccaccagctccacctcgcagtggcgcaggtccaggtgtgtgaggtgaggcacgccctggaaggcggctgcggggatcaccttca

SEQ ID NO: 67133 - DNA, 30 bp, Homo sapiens; identical to SEQ ID NO: 16787
  misc_feature 1..30: note = chr22:41637166-41637196
  misc_feature 1..30: note = hypo
  source 1..30: mol_type = genomic DNA

SEQ ID NO: 67134 - DNA, 66 bp, Homo sapiens
  misc_feature 1..66: note = chr22:41657350-41657416
  misc_feature 1..66: note = hypo
  source 1..66: mol_type = genomic DNA
ggttgagtgccagccctgggattagcatccagaactgtcagcctactatgccgagtgcacctcaag

SEQ ID NO: 67135 - DNA, 30 bp, Homo sapiens; identical to SEQ ID NO: 46730
  misc_feature 1..30: note = chr22:41668138-41668168
  misc_feature 1..30: note = hypo
  source 1..30: mol_type = genomic DNA

SEQ ID NO: 67136 - DNA, 44 bp, Homo sapiens; identical to SEQ ID NO: 46731
  misc_feature 1..44: note = chr22:41776124-41776168
  misc_feature 1..44: note = hypo
  source 1..44: mol_type = genomic DNA

SEQ ID NO: 67137 - DNA, 81 bp, Homo sapiens; identical to SEQ ID NO: 46732
  misc_feature 1..81: note = chr22:41839301-41839382
  misc_feature 1..81: note = hypo
  source 1..81: mol_type = genomic DNA

SEQ ID NO: 67138 - DNA, 21 bp, Homo sapiens
  misc_feature 1..21: note = chr22:41839922-41839943
  misc_feature 1..21: note = hypo
  source 1..21: mol_type = genomic DNA
cccggccggaaggtttttcag

SEQ ID NO: 67139 - DNA, 18 bp, Homo sapiens
  misc_feature 1..18: note = chr22:41939343-41939361
  misc_feature 1..18: note = hypo
  source 1..18: mol_type = genomic DNA
tgcattgacccgaggcga

SEQ ID NO: 67140 - DNA, 42 bp, Homo sapiens; identical to SEQ ID NO: 46735
  misc_feature 1..42: note = chr22:42109080-42109122
  misc_feature 1..42: note = hypo
  source 1..42: mol_type = genomic DNA

SEQ ID NO: 67141 - DNA, 127 bp, Homo sapiens; identical to SEQ ID NO: 46736
  misc_feature 1..127: note = chr22:42395163-42395290
  misc_feature 1..127: note = hypo
  source 1..127: mol_type = genomic DNA

SEQ ID NO: 67142 - DNA, 51 bp, Homo sapiens; identical to SEQ ID NO: 46737
  misc_feature 1..51: note = chr22:42667191-42667242
  misc_feature 1..51: note = hypo
  source 1..51: mol_type = genomic DNA

SEQ ID NO: 67143 - DNA, 30 bp, Homo sapiens; identical to SEQ ID NO: 46738
  misc_feature 1..30: note = chr22:42675831-42675861
  misc_feature 1..30: note = hypo
  source 1..30: mol_type = genomic DNA

SEQ ID NO: 67144 - DNA, 30 bp, Homo sapiens; identical to SEQ ID NO: 46739
  misc_feature 1..30: note = chr22:42829925-42829955
  misc_feature 1..30: note = hypo
  source 1..30: mol_type = genomic DNA

SEQ ID NO: 67145 - DNA, 47 bp, Homo sapiens; identical to SEQ ID NO: 46740
  misc_feature 1..47: note = chr22:42963266-42963313
  misc_feature 1..47: note = hypo
  source 1..47: mol_type = genomic DNA

SEQ ID NO: 67146 - DNA, 30 bp, Homo sapiens; identical to SEQ ID NO: 16790
  misc_feature 1..30: note = chr22:42995705-42995735
  misc_feature 1..30: note = hypo
  source 1..30: mol_type = genomic DNA

SEQ ID NO: 67147 - DNA, 30 bp, Homo sapiens; identical to SEQ ID NO: 16792
  misc_feature 1..30: note = chr22:43083005-43083035
  misc_feature 1..30: note = hypo
  source 1..30: mol_type = genomic DNA

SEQ ID NO: 67148 - DNA, 21 bp, Homo sapiens
  misc_feature 1..21: note = chr22:43434477-43434498
  misc_feature 1..21: note = hypo
  source 1..21: mol_type = genomic DNA
agccatcgctcctcccacagc

SEQ ID NO: 67149 - DNA, 194 bp, Homo sapiens; identical to SEQ ID NO: 46745
  misc_feature 1..194: note = chr22:43524923-43525117
  misc_feature 1..194: note = hypo
  source 1..194: mol_type = genomic DNA

SEQ ID NO: 67150 - DNA, 30 bp, Homo sapiens; identical to SEQ ID NO: 46746
  misc_feature 1..30: note = chr22:43570284-43570314
  misc_feature 1..30: note = hypo
  source 1..30: mol_type = genomic DNA

SEQ ID NO: 67151 - DNA, 30 bp, Homo sapiens; identical to SEQ ID NO: 16795
  misc_feature 1..30: note = chr22:43581330-43581360
  misc_feature 1..30: note = hypo
  source 1..30: mol_type = genomic DNA

SEQ ID NO: 67152 - DNA, 262 bp, Homo sapiens; identical to SEQ ID NO: 46748
  misc_feature 1..262: note = chr22:43601093-43601355
  misc_feature 1..262: note = hypo
  source 1..262: mol_type = genomic DNA

SEQ ID NO: 67153 - DNA, 202 bp, Homo sapiens; identical to SEQ ID NO: 46749
  misc_feature 1..202: note = chr22:43603869-43604071
  misc_feature 1..202: note = hypo
  source 1..202: mol_type = genomic DNA

SEQ ID NO: 67154 - DNA, 30 bp, Homo sapiens; identical to SEQ ID NO: 46750
  misc_feature 1..30: note = chr22:43665130-43665160
  misc_feature 1..30: note = hypo
  source 1..30: mol_type = genomic DNA

SEQ ID NO: 67155 - DNA, 119 bp, Homo sapiens; identical to SEQ ID NO: 46751
  misc_feature 1..119: note = chr22:43677877-43677996
  misc_feature 1..119: note = hypo
  source 1..119: mol_type = genomic DNA

SEQ ID NO: 67156 - DNA, 30 bp, Homo sapiens; identical to SEQ ID NO: 46752
  misc_feature 1..30: note = chr22:43689691-43689721
  misc_feature 1..30: note = hypo
  source 1..30: mol_type = genomic DNA

SEQ ID NO: 67157 - DNA, 30 bp, Homo sapiens; identical to SEQ ID NO: 46753
  misc_feature 1..30: note = chr22:43735330-43735360
  misc_feature 1..30: note = hypo
  source 1..30: mol_type = genomic DNA

SEQ ID NO: 67158 - DNA, 107 bp, Homo sapiens; identical to SEQ ID NO: 25942
  misc_feature 1..107: note = chr22:44455600-44455707
  misc_feature 1..107: note = hypo
  source 1..107: mol_type = genomic DNA

SEQ ID NO: 67159 - DNA, 14 bp, Homo sapiens
  misc_feature 1..14: note = chr22:44455740-44455754
  misc_feature 1..14: note = hypo
  source 1..14: mol_type = genomic DNA
gtgtttgctcagca

SEQ ID NO: 67160 - DNA, 30 bp, Homo sapiens; identical to SEQ ID NO: 46755
  misc_feature 1..30: note = chr22:44484781-44484811
  misc_feature 1..30: note = hypo
  source 1..30: mol_type = genomic DNA

SEQ ID NO: 67161 - DNA, 36 bp, Homo sapiens; identical to SEQ ID NO: 46756
  misc_feature 1..36: note = chr22:44527455-44527491
  misc_feature 1..36: note = hypo
  source 1..36: mol_type = genomic DNA

SEQ ID NO: 67162 - DNA, 39 bp, Homo sapiens; identical to SEQ ID NO: 16798
  misc_feature 1..39: note = chr22:44538737-44538776
  misc_feature 1..39: note = hypo
  source 1..39: mol_type = genomic DNA

SEQ ID NO: 67163 - DNA, 60 bp, Homo sapiens; identical to SEQ ID NO: 46758
  misc_feature 1..60: note = chr22:44564136-44564196
  misc_feature 1..60: note = hypo
  source 1..60: mol_type = genomic DNA

SEQ ID NO: 67164 - DNA, 63 bp, Homo sapiens; identical to SEQ ID NO: 46759
  misc_feature 1..63: note = chr22:44564434-44564497
  misc_feature 1..63: note = hypo
  source 1..63: mol_type = genomic DNA

SEQ ID NO: 67165 - DNA, 62 bp, Homo sapiens; identical to SEQ ID NO: 46760
  misc_feature 1..62: note = chr22:44580537-44580599
  misc_feature 1..62: note = hypo
  source 1..62: mol_type = genomic DNA

SEQ ID NO: 67166 - DNA, 180 bp, Homo sapiens; identical to SEQ ID NO: 46761
  misc_feature 1..180: note = chr22:44664413-44664593
  misc_feature 1..180: note = hypo
  source 1..180: mol_type = genomic DNA

SEQ ID NO: 67167 - DNA, 30 bp, Homo sapiens; identical to SEQ ID NO: 46762
  misc_feature 1..30: note = chr22:44671280-44671310
  misc_feature 1..30: note = hypo
  source 1..30: mol_type = genomic DNA

SEQ ID NO: 67168 - DNA, 93 bp, Homo sapiens; identical to SEQ ID NO: 46763
  misc_feature 1..93: note = chr22:44681409-44681502
  misc_feature 1..93: note = hypo
  source 1..93: mol_type = genomic DNA

SEQ ID NO: 67169 - DNA, 70 bp, Homo sapiens; identical to SEQ ID NO: 46764
  misc_feature 1..70: note = chr22:44698506-44698576
  misc_feature 1..70: note = hypo
  source 1..70: mol_type = genomic DNA

SEQ ID NO: 67170 - DNA, 133 bp, Homo sapiens; identical to SEQ ID NO: 46765
  misc_feature 1..133: note = chr22:45020626-45020759
  misc_feature 1..133: note = hypo
  source 1..133: mol_type = genomic DNA

SEQ ID NO: 67171 - DNA, 163 bp, Homo sapiens; identical to SEQ ID NO: 46766
  misc_feature 1..163: note = chr22:45075725-45075888
  misc_feature 1..163: note = hypo
  source 1..163: mol_type = genomic DNA

SEQ ID NO: 67172 - DNA, 23 bp, Homo sapiens
  misc_feature 1..23: note = chr22:45088743-45088766
  misc_feature 1..23: note = hypo
  source 1..23: mol_type = genomic DNA
tctcagcacggggccaggcacag

SEQ ID NO: 67173 - DNA, 41 bp, Homo sapiens; identical to SEQ ID NO: 46768
  misc_feature 1..41: note = chr22:45093092-45093133
  misc_feature 1..41: note = hypo
  source 1..41: mol_type = genomic DNA

SEQ ID NO: 67174 - DNA, 104 bp, Homo sapiens; identical to SEQ ID NO: 46769
  misc_feature 1..104: note = chr22:45137806-45137910
  misc_feature 1..104: note = hypo
  source 1..104: mol_type = genomic DNA

SEQ ID NO: 67175 - DNA, 161 bp, Homo sapiens
  misc_feature 1..161: note = chr22:45277322-45277483
  misc_feature 1..161: note = hypo
  source 1..161: mol_type = genomic DNA
aatgcatacttggcacagagtagccaatatagaagacgtgtgcctcacacggttcactttgttcatcaataaaagaatataaaaatcttgttcacccagtggtaagtgtattaaaatagatctgtatcatacagcacagtttctcccggagtcgtgagaat

SEQ ID NO: 67176 - DNA, 30 bp, Homo sapiens; identical to SEQ ID NO: 46772
  misc_feature 1..30: note = chr22:45604343-45604373
  misc_feature 1..30: note = hypo
  source 1..30: mol_type = genomic DNA

SEQ ID NO: 67177 - DNA, 106 bp, Homo sapiens; identical to SEQ ID NO: 46773
  misc_feature 1..106: note = chr22:45931289-45931395
  misc_feature 1..106: note = hypo
  source 1..106: mol_type = genomic DNA

SEQ ID NO: 67178 - DNA, 30 bp, Homo sapiens; identical to SEQ ID NO: 46774
  misc_feature 1..30: note = chr22:45981309-45981339
  misc_feature 1..30: note = hypo
  source 1..30: mol_type = genomic DNA

SEQ ID NO: 67179 - DNA, 86 bp, Homo sapiens; identical to SEQ ID NO: 46776
  misc_feature 1..86: note = chr22:46521906-46521992
  misc_feature 1..86: note = hypo
  source 1..86: mol_type = genomic DNA

SEQ ID NO: 67180 - DNA, 38 bp, Homo sapiens; identical to SEQ ID NO: 46777
  misc_feature 1..38: note = chr22:46719152-46719190
  misc_feature 1..38: note = hypo
  source 1..38: mol_type = genomic DNA

SEQ ID NO: 67181 - DNA, 120 bp, Homo sapiens; identical to SEQ ID NO: 46778
  misc_feature 1..120: note = chr22:46805005-46805125
  misc_feature 1..120: note = hypo
  source 1..120: mol_type = genomic DNA

SEQ ID NO: 67182 - DNA, 148 bp, Homo sapiens; identical to SEQ ID NO: 46779
  misc_feature 1..148: note = chr22:46929253-46929401
  misc_feature 1..148: note = hypo
  source 1..148: mol_type = genomic DNA

SEQ ID NO: 67183 - DNA, 57 bp, Homo sapiens; identical to SEQ ID NO: 46780
  misc_feature 1..57: note = chr22:46929652-46929709
  misc_feature 1..57: note = hypo
  source 1..57: mol_type = genomic DNA

SEQ ID NO: 67184 - DNA, 252 bp, Homo sapiens; identical to SEQ ID NO: 46781
  misc_feature 1..252: note = chr22:46931788-46932040
  misc_feature 1..252: note = hypo
  source 1..252: mol_type = genomic DNA

SEQ ID NO: 67185 - skipped

SEQ ID NO: 67186 - DNA, 92 bp, Homo sapiens
  misc_feature 1..92: note = chr22:47005154-47005246
  misc_feature 1..92: note = hypo
  source 1..92: mol_type = genomic DNA
ccgcgcaggagcctgggtccaccttctcctggctgtgtgcttccttaaacacggaaggtgttccgcagcctgctgtgcggggtagccctgtg

SEQ ID NO: 67187 - DNA, 57 bp, Homo sapiens; identical to SEQ ID NO: 46783
  misc_feature 1..57: note = chr22:47005505-47005562
  misc_feature 1..57: note = hypo
  source 1..57: mol_type = genomic DNA

SEQ ID NO: 67188 - DNA, 77 bp, Homo sapiens; identical to SEQ ID NO: 46784
  misc_feature 1..77: note = chr22:47054535-47054612
  misc_feature 1..77: note = hypo
  source 1..77: mol_type = genomic DNA

SEQ ID NO: 67189 - DNA, 36 bp, Homo sapiens; identical to SEQ ID NO: 46786
  misc_feature 1..36: note = chr22:47428866-47428902
  misc_feature 1..36: note = hypo
  source 1..36: mol_type = genomic DNA

SEQ ID NO: 67190 - DNA, 141 bp, Homo sapiens
  misc_feature 1..141: note = chr22:47525705-47525846
  misc_feature 1..141: note = hypo
  source 1..141: mol_type = genomic DNA
gtggggctgtgtcagcgtcactgccgctgagtcaccacgtgcactgtgcctgtcatccctttctgggacagcatgtcactttccttggtgtcaccaatcatctcccttaggagtctgtgaaccacccactccctccctccc

SEQ ID NO: 67191 - DNA, 39 bp, Homo sapiens; identical to SEQ ID NO: 25952
  misc_feature 1..39: note = chr22:47525885-47525924
  misc_feature 1..39: note = hypo
  source 1..39: mol_type = genomic DNA

SEQ ID NO: 67192 - DNA, 30 bp, Homo sapiens; identical to SEQ ID NO: 46788
  misc_feature 1..30: note = chr22:47840461-47840491
  misc_feature 1..30: note = hypo
  source 1..30: mol_type = genomic DNA

SEQ ID NO: 67193 - DNA, 68 bp, Homo sapiens; identical to SEQ ID NO: 46789
  misc_feature 1..68: note = chr22:48027676-48027744
  misc_feature 1..68: note = hypo
  source 1..68: mol_type = genomic DNA

SEQ ID NO: 67194 - DNA, 34 bp, Homo sapiens; identical to SEQ ID NO: 46790
  misc_feature 1..34: note = chr22:48553477-48553511
  misc_feature 1..34: note = hypo
  source 1..34: mol_type = genomic DNA

SEQ ID NO: 67195 - DNA, 30 bp, Homo sapiens; identical to SEQ ID NO: 46791
  misc_feature 1..30: note = chr22:48661129-48661159
  misc_feature 1..30: note = hypo
  source 1..30: mol_type = genomic DNA

SEQ ID NO: 67196 - DNA, 30 bp, Homo sapiens; identical to SEQ ID NO: 46792
  misc_feature 1..30: note = chr22:48728717-48728747
  misc_feature 1..30: note = hypo
  source 1..30: mol_type = genomic DNA

SEQ ID NO: 67197 - DNA, 30 bp, Homo sapiens; identical to SEQ ID NO: 46793
  misc_feature 1..30: note = chr22:48793754-48793784
  misc_feature 1..30: note = hypo
  source 1..30: mol_type = genomic DNA

SEQ ID NO: 67198 - DNA, 119 bp, Homo sapiens; identical to SEQ ID NO: 46794
  misc_feature 1..119: note = chr22:48917425-48917544
  misc_feature 1..119: note = hypo
  source 1..119: mol_type = genomic DNA

SEQ ID NO: 67199 - DNA, 54 bp, Homo sapiens
  misc_feature 1..54: note = chr22:48931827-48931881
  misc_feature 1..54: note = hypo
  source 1..54: mol_type = genomic DNA
ccccccaggagtgcccgtgttgtcgagcccccgccacagagctgcaccgccgct

SEQ ID NO: 67200 - DNA, 41 bp, Homo sapiens; identical to SEQ ID NO: 25954
  misc_feature 1..41: note = chr22:48932027-48932068
  misc_feature 1..41: note = hypo
  source 1..41: mol_type = genomic DNA

SEQ ID NO: 67201 - DNA, 106 bp, Homo sapiens; identical to SEQ ID NO: 46796
  misc_feature 1..106: note = chr22:48976157-48976263
  misc_feature 1..106: note = hypo
  source 1..106: mol_type = genomic DNA

SEQ ID NO: 67202 - DNA, 144 bp, Homo sapiens; identical to SEQ ID NO: 46797
  misc_feature 1..144: note = chr22:48987212-48987356
  misc_feature 1..144: note = hypo
  source 1..144: mol_type = genomic DNA

SEQ ID NO: 67203 - DNA, 80 bp, Homo sapiens; identical to SEQ ID NO: 46798
  misc_feature 1..80: note = chr22:49048024-49048104
  misc_feature 1..80: note = hypo
  source 1..80: mol_type = genomic DNA

SEQ ID NO: 67204 - DNA, 177 bp, Homo sapiens; identical to SEQ ID NO: 46799
  misc_feature 1..177: note = chr22:49115640-49115817
  misc_feature 1..177: note = hypo
  source 1..177: mol_type = genomic DNA

SEQ ID NO: 67205 - DNA, 30 bp, Homo sapiens; identical to SEQ ID NO: 16811
  misc_feature 1..30: note = chr22:49117093-49117123
  misc_feature 1..30: note = hypo
  source 1..30: mol_type = genomic DNA

SEQ ID NO: 67206 - DNA, 30 bp, Homo sapiens; identical to SEQ ID NO: 46801
  misc_feature 1..30: note = chr22:49138471-49138501
  misc_feature 1..30: note = hypo
  source 1..30: mol_type = genomic DNA

SEQ ID NO: 67207 - DNA, 30 bp, Homo sapiens; identical to SEQ ID NO: 46802
  misc_feature 1..30: note = chr22:49145839-49145869
  misc_feature 1..30: note = hypo
  source 1..30: mol_type = genomic DNA

SEQ ID NO: 67208 - DNA, 30 bp, Homo sapiens; identical to SEQ ID NO: 46803
  misc_feature 1..30: note = chr22:49147007-49147037
  misc_feature 1..30: note = hypo
  source 1..30: mol_type = genomic DNA

SEQ ID NO: 67209 - DNA, 30 bp, Homo sapiens; identical to SEQ ID NO: 46804
  misc_feature 1..30: note = chr22:49247250-49247280
  misc_feature 1..30: note = hypo
  source 1..30: mol_type = genomic DNA

SEQ ID NO: 67210 - DNA, 30 bp, Homo sapiens; identical to SEQ ID NO: 46805
  misc_feature 1..30: note = chr22:49277436-49277466
  misc_feature 1..30: note = hypo
  source 1..30: mol_type = genomic DNA

SEQ ID NO: 67211 - DNA, 40 bp, Homo sapiens; identical to SEQ ID NO: 46806
  misc_feature 1..40: note = chr22:49387651-49387691
  misc_feature 1..40: note = hypo
  source 1..40: mol_type = genomic DNA

SEQ ID NO: 67212 - DNA, 39 bp, Homo sapiens; identical to SEQ ID NO: 46807
  misc_feature 1..39: note = chr22:49447333-49447372
  misc_feature 1..39: note = hypo
  source 1..39: mol_type = genomic DNA

SEQ ID NO: 67213 - DNA, 36 bp, Homo sapiens; identical to SEQ ID NO: 46808
  misc_feature 1..36: note = chr22:49491699-49491735
  misc_feature 1..36: note = hypo
  source 1..36: mol_type = genomic DNA

SEQ ID NO: 67214 - DNA, 100 bp, Homo sapiens; identical to SEQ ID NO: 46809
  misc_feature 1..100: note = chr22:49508009-49508109
  misc_feature 1..100: note = hypo
  source 1..100: mol_type = genomic DNA

SEQ ID NO: 67215 - DNA, 30 bp, Homo sapiens; identical to SEQ ID NO: 46810
  misc_feature 1..30: note = chr22:49510169-49510199
  misc_feature 1..30: note = hypo
  source 1..30: mol_type = genomic DNA

SEQ ID NO: 67216 - DNA, 253 bp, Homo sapiens; identical to SEQ ID NO: 46811
  misc_feature 1..253: note = chr22:49637528-49637781
  misc_feature 1..253: note = hypo
  source 1..253: mol_type = genomic DNA

SEQ ID NO: 67217 - DNA, 30 bp, Homo sapiens; identical to SEQ ID NO: 46812
  misc_feature 1..30: note = chr22:49694859-49694889
  misc_feature 1..30: note = hypo
  source 1..30: mol_type = genomic DNA

SEQ ID NO: 67218 - DNA, 39 bp, Homo sapiens; identical to SEQ ID NO: 46813
  misc_feature 1..39: note = chr22:49785322-49785361
  misc_feature 1..39: note = hypo
  source 1..39: mol_type = genomic DNA

SEQ ID NO: 67219 - DNA, 30 bp, Homo sapiens; identical to SEQ ID NO: 46814
  misc_feature 1..30: note = chr22:49814696-49814726
  misc_feature 1..30: note = hypo
  source 1..30: mol_type = genomic DNA

SEQ ID NO: 67220 - DNA, 32 bp, Homo sapiens; identical to SEQ ID NO: 46815
  misc_feature 1..32: note = chr22:49831409-49831441
  misc_feature 1..32: note = hypo
  source 1..32: mol_type = genomic DNA

SEQ ID NO: 67221 - DNA, 40 bp, Homo sapiens; identical to SEQ ID NO: 46816
  misc_feature 1..40: note = chr22:49831947-49831987
  misc_feature 1..40: note = hypo
  source 1..40: mol_type = genomic DNA

SEQ ID NO: 67222 - DNA, 30 bp, Homo sapiens; identical to SEQ ID NO: 46817
  misc_feature 1..30: note = chr22:49851741-49851771
  misc_feature 1..30: note = hypo
  source 1..30: mol_type = genomic DNA

SEQ ID NO: 67223 - DNA, 30 bp, Homo sapiens; identical to SEQ ID NO: 46818
  misc_feature 1..30: note = chr22:49852487-49852517
  misc_feature 1..30: note = hypo
  source 1..30: mol_type = genomic DNA

SEQ ID NO: 67224 - DNA, 149 bp, Homo sapiens; identical to SEQ ID NO: 46819
  misc_feature 1..149: note = chr22:49864707-49864856
  misc_feature 1..149: note = hypo
  source 1..149: mol_type = genomic DNA

SEQ ID NO: 67225 - DNA, 43 bp, Homo sapiens; identical to SEQ ID NO: 46820
  misc_feature 1..43: note = chr22:49868142-49868185
  misc_feature 1..43: note = hypo
  source 1..43: mol_type = genomic DNA

SEQ ID NO: 67226 - DNA, 39 bp, Homo sapiens; identical to SEQ ID NO: 46821
  misc_feature 1..39: note = chr22:49888284-49888323
  misc_feature 1..39: note = hypo
  source 1..39: mol_type = genomic DNA

SEQ ID NO: 67227 - DNA, 58 bp, Homo sapiens; identical to SEQ ID NO: 46822
  misc_feature 1..58: note = chr22:49911506-49911564
  misc_feature 1..58: note = hypo
  source 1..58: mol_type = genomic DNA

SEQ ID NO: 67228 - DNA, 99 bp, Homo sapiens; identical to SEQ ID NO: 46823
  misc_feature 1..99: note = chr22:49934854-49934953
  misc_feature 1..99: note = hypo
  source 1..99: mol_type = genomic DNA

SEQ ID NO: 67229 - DNA, 30 bp, Homo sapiens; identical to SEQ ID NO: 46824
  misc_feature 1..30: note = chr22:49937851-49937881
  misc_feature 1..30: note = hypo
  source 1..30: mol_type = genomic DNA

SEQ ID NO: 67230 - DNA, 39 bp, Homo sapiens; identical to SEQ ID NO: 46825
  misc_feature 1..39: note = chr22:49941794-49941833
  misc_feature 1..39: note = hypo
  source 1..39: mol_type = genomic DNA

SEQ ID NO: 67231 - DNA, 51 bp, Homo sapiens; identical to SEQ ID NO: 46826
  misc_feature 1..51: note = chr22:49943168-49943219
  misc_feature 1..51: note = hypo
  source 1..51: mol_type = genomic DNA

SEQ ID NO: 67232 - DNA, 30 bp, Homo sapiens; identical to SEQ ID NO: 46827
  misc_feature 1..30: note = chr22:49948590-49948620
  misc_feature 1..30: note = hypo
  source 1..30: mol_type = genomic DNA

SEQ ID NO: 67233 - DNA, 30 bp, Homo sapiens; identical to SEQ ID NO: 46828
  misc_feature 1..30: note = chr22:49959175-49959205
  misc_feature 1..30: note = hypo
  source 1..30: mol_type = genomic DNA

SEQ ID NO: 67234 - DNA, 30 bp, Homo sapiens; identical to SEQ ID NO: 46829
  misc_feature 1..30: note = chr22:49963888-49963918
  misc_feature 1..30: note = hypo
  source 1..30: mol_type = genomic DNA

SEQ ID NO: 67235 - DNA, 175 bp, Homo sapiens; identical to SEQ ID NO: 46830
  misc_feature 1..175: note = chr22:49967997-49968172
  misc_feature 1..175: note = hypo
  source 1..175: mol_type = genomic DNA

SEQ ID NO: 67236 - DNA, 74 bp, Homo sapiens; identical to SEQ ID NO: 46831
  misc_feature 1..74: note = chr22:49970518-49970592
  misc_feature 1..74: note = hypo
  source 1..74: mol_type = genomic DNA

SEQ ID NO: 67237 - DNA, 30 bp, Homo sapiens; identical to SEQ ID NO: 46832
  misc_feature 1..30: note = chr22:49977657-49977687
  misc_feature 1..30: note = hypo
  source 1..30: mol_type = genomic DNA

SEQ ID NO: 67238 - DNA, 33 bp, Homo sapiens; identical to SEQ ID NO: 25960
  misc_feature 1..33: note = chr22:49979613-49979646
  misc_feature 1..33: note = hypo
  source 1..33: mol_type = genomic DNA

SEQ ID NO: 67239 - DNA, 187 bp, Homo sapiens; identical to SEQ ID NO: 46834
  misc_feature 1..187: note = chr22:49980189-49980376
  misc_feature 1..187: note = hypo
  source 1..187: mol_type = genomic DNA

SEQ ID NO: 67240 - DNA, 30 bp, Homo sapiens; identical to SEQ ID NO: 46835
  misc_feature 1..30: note = chr22:49980591-49980621
  misc_feature 1..30: note = hypo
  source 1..30: mol_type = genomic DNA

SEQ ID NO: 67241 - DNA, 189 bp, Homo sapiens; identical to SEQ ID NO: 46836
  misc_feature 1..189: note = chr22:49983668-49983857
  misc_feature 1..189: note = hypo
  source 1..189: mol_type = genomic DNA

SEQ ID NO: 67242 - DNA, 33 bp, Homo sapiens; identical to SEQ ID NO: 46837
  misc_feature 1..33: note = chr22:49992716-49992749
  misc_feature 1..33: note = hypo
  source 1..33: mol_type = genomic DNA

SEQ ID NO: 67243 - DNA, 35 bp, Homo sapiens; identical to SEQ ID NO: 46838
  misc_feature 1..35: note = chr22:49994264-49994299
  misc_feature 1..35: note = hypo
  source 1..35: mol_type = genomic DNA

SEQ ID NO: 67244 - DNA, 30 bp, Homo sapiens; identical to SEQ ID NO: 46839
  misc_feature 1..30: note = chr22:49996899-49996929
  misc_feature 1..30: note = hypo
  source 1..30: mol_type = genomic DNA

SEQ ID NO: 67245 - DNA, 30 bp, Homo sapiens; identical to SEQ ID NO: 46840
  misc_feature 1..30: note = chr22:50000658-50000688
  misc_feature 1..30: note = hypo
  source 1..30: mol_type = genomic DNA

SEQ ID NO: 67246 - DNA, 38 bp, Homo sapiens
  misc_feature 1..38: note = chr22:50001661-50001699
  misc_feature 1..38: note = hypo
  source 1..38: mol_type = genomic DNA
taccatgattaatgtcgtgcgcaggcctctcctgggtg

SEQ ID NO: 67247 - DNA, 219 bp, Homo sapiens
  misc_feature 1..219: note = chr22:50002568-50002787
  misc_feature 1..219: note = hypo
  source 1..219: mol_type = genomic DNA
agctggagacattctcgtgttcacggtcacagctctgctcctttgagaaataagcggcacgatgtttttctagtgggtttgcctttttctcagtgatggtaaaagtgctgtgtatgttaaggtgagtgactcaggaccaaggtgagtcttgactcctcttggctttgcgctgagagcacctgggagagtcaagggagcacacaggacagtccctgcttc

SEQ ID NO: 67248 - DNA, 48 bp, Homo sapiens; identical to SEQ ID NO: 25963
  misc_feature 1..48: note = chr22:50003234-50003282
  misc_feature 1..48: note = hypo
  source 1..48: mol_type = genomic DNA

SEQ ID NO: 67249 - DNA, 176 bp, Homo sapiens; identical to SEQ ID NO: 46844
  misc_feature 1..176: note = chr22:50007867-50008043
  misc_feature 1..176: note = hypo
  source 1..176: mol_type = genomic DNA

SEQ ID NO: 67250 - DNA, 38 bp, Homo sapiens; identical to SEQ ID NO: 46845
  misc_feature 1..38: note = chr22:50008747-50008785
  misc_feature 1..38: note = hypo
  source 1..38: mol_type = genomic DNA

SEQ ID NO: 67251 - DNA, 135 bp, Homo sapiens
  misc_feature 1..135: note = chr22:50010258-50010393
  misc_feature 1..135: note = hypo
  source 1..135: mol_type = genomic DNA
atcttttcaagaaaagataaagaaagaaacaagagtaacaggaggccagaagcaagggcatctactgcagacagcggtgccgcggggctggagctgaagctacccaaggagccccaggctcgggagcctccaggc

SEQ ID NO: 67252 - DNA, 30 bp, Homo sapiens; identical to SEQ ID NO: 16820
  misc_feature 1..30: note = chr22:50010606-50010636
  misc_feature 1..30: note = hypo
  source 1..30: mol_type = genomic DNA

SEQ ID NO: 67253 - DNA, 46 bp, Homo sapiens; identical to SEQ ID NO: 46848
  misc_feature 1..46: note = chr22:50013222-50013268
  misc_feature 1..46: note = hypo
  source 1..46: mol_type = genomic DNA

SEQ ID NO: 67254 - DNA, 158 bp, Homo sapiens; identical to SEQ ID NO: 46849
  misc_feature 1..158: note = chr22:50015975-50016133
  misc_feature 1..158: note = hypo
  source 1..158: mol_type = genomic DNA

SEQ ID NO: 67255 - DNA, 30 bp, Homo sapiens; identical to SEQ ID NO: 16821
  misc_feature 1..30: note = chr22:50024083-50024113
  misc_feature 1..30: note = hypo
  source 1..30: mol_type = genomic DNA

SEQ ID NO: 67256 - DNA, 30 bp, Homo sapiens; identical to SEQ ID NO: 46851
  misc_feature 1..30: note = chr22:50025118-50025148
  misc_feature 1..30: note = hypo
  source 1..30: mol_type = genomic DNA

SEQ ID NO: 67257 - DNA, 30 bp, Homo sapiens; identical to SEQ ID NO: 46852
  misc_feature 1..30: note = chr22:50025649-50025679
  misc_feature 1..30: note = hypo
  source 1..30: mol_type = genomic DNA

SEQ ID NO: 67258 - DNA, 100 bp, Homo sapiens; identical to SEQ ID NO: 46853
  misc_feature 1..100: note = chr22:50031154-50031254
  misc_feature 1..100: note = hypo
  source 1..100: mol_type = genomic DNA

SEQ ID NO: 67259 - DNA, 46 bp, Homo sapiens; identical to SEQ ID NO: 46855
  misc_feature 1..46: note = chr22:50032443-50032489
  misc_feature 1..46: note = hypo
  source 1..46: mol_type = genomic DNA

SEQ ID NO: 67260 - DNA, 30 bp, Homo sapiens; identical to SEQ ID NO: 46856
  misc_feature 1..30: note = chr22:50041973-50042003
  misc_feature 1..30: note = hypo
  source 1..30: mol_type = genomic DNA

SEQ ID NO: 67261 - DNA, 34 bp, Homo sapiens; identical to SEQ ID NO: 46857
  misc_feature 1..34: note = chr22:50054601-50054635
  misc_feature 1..34: note = hypo
  source 1..34: mol_type = genomic DNA

SEQ ID NO: 67262 - DNA, 60 bp, Homo sapiens; identical to SEQ ID NO: 46858
  misc_feature 1..60: note = chr22:50119416-50119476
  misc_feature 1..60: note = hypo
  source 1..60: mol_type = genomic DNA

SEQ ID NO: 67263 - DNA, 132 bp, Homo sapiens
  misc_feature 1..132: note = chr22:50149299-50149431
  misc_feature 1..132: note = hypo
  source 1..132: mol_type = genomic DNA
ccctttccatggcaacgccccataaggtgccacccctttccatggcaacgacccataaggtgccacccctttccatggcaacgccccatacggtgccacccctttccatggcaacgccccatacggtgccac

SEQ ID NO: 67264 - DNA, 152 bp, Homo sapiens; identical to SEQ ID NO: 46860
  misc_feature 1..152: note = chr22:50170583-50170735
  misc_feature 1..152: note = hypo
  source 1..152: mol_type = genomic DNA

SEQ ID NO: 67265 - DNA, 65 bp, Homo sapiens; identical to SEQ ID NO: 46861
  misc_feature 1..65: note = chr22:50251106-50251171
  misc_feature 1..65: note = hypo
  source 1..65: mol_type = genomic DNA

SEQ ID NO: 67266 - DNA, 30 bp, Homo sapiens; identical to SEQ ID NO: 46862
  misc_feature 1..30: note = chr22:50439060-50439090
  misc_feature 1..30: note = hypo
  source 1..30: mol_type = genomic DNA

SEQ ID NO: 67267 - DNA, 115 bp, Homo sapiens
  misc_feature 1..115: note = chr22:50466890-50467005
  misc_feature 1..115: note = hypo
  source 1..115: mol_type = genomic DNA
ctgcaggaggaacttcgcctcccgtggggcaagaggcatctccgtgagtgggtcccagcccctgaatcgcagtgggaatcagggaggcggcaacacctgcgtgccgtcataaaga

SEQ ID NO: 67268 - DNA, 10 bp, Homo sapiens
  misc_feature 1..10: note = chr22:50467035-50467045
  misc_feature 1..10: note = hypo
  source 1..10: mol_type = genomic DNA
cacaccgtcc

SEQ ID NO: 67269 - DNA, 30 bp, Homo sapiens; identical to SEQ ID NO: 46864
  misc_feature 1..30: note = chr22:50470583-50470613
  misc_feature 1..30: note = hypo
  source 1..30: mol_type = genomic DNA

SEQ ID NO: 67270 - DNA, 92 bp, Homo sapiens; identical to SEQ ID NO: 46865
  misc_feature 1..92: note = chr22:50507025-50507117
  misc_feature 1..92: note = hypo
  source 1..92: mol_type = genomic DNA

SEQ ID NO: 67271 - DNA, 30 bp, Homo sapiens; identical to SEQ ID NO: 46866
  misc_feature 1..30: note = chr22:50509901-50509931
  misc_feature 1..30: note = hypo
  source 1..30: mol_type = genomic DNA

SEQ ID NO: 67272 - DNA, 57 bp, Homo sapiens; identical to SEQ ID NO: 46867
  misc_feature 1..57: note = chr22:50512688-50512745
  misc_feature 1..57: note = hypo
  source 1..57: mol_type = genomic DNA

SEQ ID NO: 67273 - DNA, 30 bp, Homo sapiens; identical to SEQ ID NO: 46868
  misc_feature 1..30: note = chr22:50526328-50526358
  misc_feature 1..30: note = hypo
  source 1..30: mol_type = genomic DNA

SEQ ID NO: 67274 - DNA, 75 bp, Homo sapiens; identical to SEQ ID NO: 46869
  misc_feature 1..75: note = chr22:50529523-50529598
  misc_feature 1..75: note = hypo
  source 1..75: mol_type = genomic DNA

SEQ ID NO: 67275 - DNA, 45 bp, Homo sapiens; identical to SEQ ID NO: 46870
  misc_feature 1..45: note = chr22:50582635-50582680
  misc_feature 1..45: note = hypo
  source 1..45: mol_type = genomic DNA

SEQ ID NO: 67276 - DNA, 287 bp, Homo sapiens; identical to SEQ ID NO: 46871
  misc_feature 1..287: note = chr22:50686625-50686912
  misc_feature 1..287: note = hypo
  source 1..287: mol_type = genomic DNA

SEQ ID NO: 67277 - DNA, 158 bp, Homo sapiens; identical to SEQ ID NO: 46872
  misc_feature 1..158: note = chr22:50695362-50695520
  misc_feature 1..158: note = hypo
  source 1..158: mol_type = genomic DNA

SEQ ID NO: 67278 - DNA, 30 bp, Homo sapiens; identical to SEQ ID NO: 46873
  misc_feature 1..30: note = chr22:50764712-50764742
  misc_feature 1..30: note = hypo
  source 1..30: mol_type = genomic DNA

SEQ ID NO: 67279 - DNA, 24 bp, Homo sapiens
  misc_feature 1..24: note = chr22:50899269-50899293
  misc_feature 1..24: note = hypo
  source 1..24: mol_type = genomic DNA
tgtatctgtgtcacacgaaggcaa

SEQ ID NO: 67280 - DNA, 36 bp, Homo sapiens
  misc_feature 1..36: note = chr22:50899672-50899708
  misc_feature 1..36: note = hypo
  source 1..36: mol_type = genomic DNA
agcgcagccaccgggaaggagcggaccaccacctgc

SEQ ID NO: 67281 - DNA, 50 bp, Homo sapiens; identical to SEQ ID NO: 46875
  misc_feature 1..50: note = chr22:50922613-50922663
  misc_feature 1..50: note = hypo
  source 1..50: mol_type = genomic DNA

SEQ ID NO: 67282 - DNA, 63 bp, Homo sapiens
  misc_feature 1..63: note = chr22:50943262-50943325
  misc_feature 1..63: note = hypo
  source 1..63: mol_type = genomic DNA
gcaccacctcaggccgtccaccaagcccagtcatgcggcggaagaggccgtaggagttggcca

SEQ ID NO: 67283 - DNA, 96 bp, Homo sapiens; identical to SEQ ID NO: 46877
  misc_feature 1..96: note = chr22:50944404-50944500
  misc_feature 1..96: note = hypo
  source 1..96: mol_type = genomic DNA

SEQ ID NO: 67284 - DNA, 69 bp, Homo sapiens; identical to SEQ ID NO: 46878
  misc_feature 1..69: note = chr22:50954977-50955046
  misc_feature 1..69: note = hypo
  source 1..69: mol_type = genomic DNA

SEQ ID NO: 67285 - DNA, 41 bp, Homo sapiens; identical to SEQ ID NO: 46879
  misc_feature 1..41: note = chr22:50977129-50977170
  misc_feature 1..41: note = hypo
  source 1..41: mol_type = genomic DNA

SEQ ID NO: 67286 - DNA, 143 bp, Homo sapiens; identical to SEQ ID NO: 46880
  misc_feature 1..143: note = chrX:2836217-2836360
  misc_feature 1..143: note = hypo
  source 1..143: mol_type = genomic DNA

SEQ ID NO: 67287 - DNA, 128 bp, Homo sapiens; identical to SEQ ID NO: 46881
  misc_feature 1..128: note = chrX:2931204-2931332
  misc_feature 1..128: note = hypo
  source 1..128: mol_type = genomic DNA

SEQ ID NO: 67288 - DNA, 20 bp, Homo sapiens
  misc_feature 1..20: note = chrX:3478216-3478236
  misc_feature 1..20: note = hypo
  source 1..20: mol_type = genomic DNA
agtaacgcagttccccctcc

SEQ ID NO: 67289 - DNA, 41 bp, Homo sapiens
  misc_feature 1..41: note = chrX:3746571-3746612
  misc_feature 1..41: note = hypo
  source 1..41: mol_type = genomic DNA
ctcaccaagcaggagcgggcccctccctcacgcggagccgc

SEQ ID NO: 67290 - DNA, 30 bp, Homo sapiens; identical to SEQ ID NO: 46884
  misc_feature 1..30: note = chrX:5757324-5757354
  misc_feature 1..30: note = hypo
  source 1..30: mol_type = genomic DNA

SEQ ID NO: 67291 - DNA, 30 bp, Homo sapiens; identical to SEQ ID NO: 46885
  misc_feature 1..30: note = chrX:11773720-11773750
  misc_feature 1..30: note = hypo
  source 1..30: mol_type = genomic DNA

SEQ ID NO: 67292 - DNA, 31 bp, Homo sapiens; identical to SEQ ID NO: 46886
  misc_feature 1..31: note = chrX:19435201-19435232
  misc_feature 1..31: note = hypo
  source 1..31: mol_type = genomic DNA

SEQ ID NO: 67293 - DNA, 43 bp, Homo sapiens; identical to SEQ ID NO: 46887
  misc_feature 1..43: note = chrX:20160928-20160971
  misc_feature 1..43: note = hypo
  source 1..43: mol_type = genomic DNA

SEQ ID NO: 67294 - DNA, 16 bp, Homo sapiens
  misc_feature 1..16: note = chrX:23714117-23714133
  misc_feature 1..16: note = hypo
  source 1..16: mol_type = genomic DNA
cacaactcagctgggc

SEQ ID NO: 67295 - DNA, 54 bp, Homo sapiens; identical to SEQ ID NO: 46889
  misc_feature 1..54: note = chrX:41331697-41331751
  misc_feature 1..54: note = hypo
  source 1..54: mol_type = genomic DNA

SEQ ID NO: 67296 - DNA, 22 bp, Homo sapiens
  misc_feature 1..22: note = chrX:44136212-44136234
  misc_feature 1..22: note = hypo
  source 1..22: mol_type = genomic DNA
acttacagctgaggccgggcac

SEQ ID NO: 67297 - DNA, 21 bp, Homo sapiens
  misc_feature 1..21: note = chrX:44755607-44755628
  misc_feature 1..21: note = hypo
  source 1..21: mol_type = genomic DNA
tcaccgcgcccggccaaaaat

SEQ ID NO: 67298 - DNA, 52 bp, Homo sapiens; identical to SEQ ID NO: 46892
  misc_feature 1..52: note = chrX:44922962-44923014
  misc_feature 1..52: note = hypo
  source 1..52: mol_type = genomic DNA

SEQ ID NO: 67299 - DNA, 40 bp, Homo sapiens; identical to SEQ ID NO: 46893
  misc_feature 1..40: note = chrX:58297213-58297253
  misc_feature 1..40: note = hypo
  source 1..40: mol_type = genomic DNA

SEQ ID NO: 67300 - DNA, 30 bp, Homo sapiens; identical to SEQ ID NO: 46894
  misc_feature 1..30: note = chrX:58304829-58304859
  misc_feature 1..30: note = hypo
  source 1..30: mol_type = genomic DNA

SEQ ID NO: 67301 - DNA, 32 bp, Homo sapiens; identical to SEQ ID NO: 46895
  misc_feature 1..32: note = chrX:78711051-78711083
  misc_feature 1..32: note = hypo
  source 1..32: mol_type = genomic DNA

SEQ ID NO: 67302 - DNA, 30 bp, Homo sapiens; identical to SEQ ID NO: 46896
  misc_feature 1..30: note = chrX:97101386-97101416
  misc_feature 1..30: note = hypo
  source 1..30: mol_type = genomic DNA

SEQ ID NO: 67303 - DNA, 128 bp, Homo sapiens; identical to SEQ ID NO: 46897
  misc_feature 1..128: note = chrX:97285068-97285196
  misc_feature 1..128: note = hypo
  source 1..128: mol_type = genomic DNA

SEQ ID NO: 67304 - DNA, 35 bp, Homo sapiens; identical to SEQ ID NO: 46898
  misc_feature 1..35: note = chrX:122924429-122924464
  misc_feature 1..35: note = hypo
  source 1..35: mol_type = genomic DNA

SEQ ID NO: 67305 - DNA, 30 bp, Homo sapiens; identical to SEQ ID NO: 46899
  misc_feature 1..30: note = chrY:14621298-14621328
  misc_feature 1..30: note = hypo
  source 1..30: mol_type = genomic DNA

SEQ ID NO: 67306 - DNA, 35 bp, Homo sapiens; identical to SEQ ID NO: 46900
  misc_feature 1..35: note = chrY:22918547-22918582
  misc_feature 1..35: note = hypo
  source 1..35: mol_type = genomic DNA

SEQ ID NO: 67307 - DNA, 30 bp, Homo sapiens; identical to SEQ ID NO: 46901
  misc_feature 1..30: note = chrY:23111758-23111788
  misc_feature 1..30: note = hypo
  source 1..30: mol_type = genomic DNA

SEQ ID NO: 67308 - DNA, 45 bp, Homo sapiens; identical to SEQ ID NO: 46902
  misc_feature 1..45: note = AC225595.1_16282-19523:1184-1229
  misc_feature 1..45: note = hypo
  source 1..45: mol_type = genomic DNA

SEQ ID NO: 67309 - DNA, 30 bp, Homo sapiens; identical to SEQ ID NO: 46903
  misc_feature 1..30: note = AC239873.3_5604-11530:5296-5326
  misc_feature 1..30: note = hypo
  source 1..30: mol_type = genomic DNA

SEQ ID NO: 67310 - DNA, 30 bp, Homo sapiens; identical to SEQ ID NO: 16832
  misc_feature 1..30: note = AEKP01139090.1_11256-14570:719-749
  misc_feature 1..30: note = hypo
  source 1..30: mol_type = genomic DNA

SEQ ID NO: 67311 - DNA, 41 bp, Homo sapiens; identical to SEQ ID NO: 46905
  misc_feature 1..41: note = AEKP01149800.1_88-7643:5268-5309
  misc_feature 1..41: note = hypo
  source 1..41: mol_type = genomic DNA

SEQ ID NO: 67312 - DNA, 86 bp, Homo sapiens; identical to SEQ ID NO: 16833
  misc_feature 1..86: note = AEKP01153556.1_1-5252:404-490
  misc_feature 1..86: note = hypo
  source 1..86: mol_type = genomic DNA

SEQ ID NO: 67313 - DNA, 30 bp, Homo sapiens; identical to SEQ ID NO: 46907
  misc_feature 1..30: note = AEKP01166227.1_44013-111583:24167-24197
  misc_feature 1..30: note = hypo
  source 1..30: mol_type = genomic DNA

SEQ ID NO: 67314 - DNA, 58 bp, Homo sapiens; identical to SEQ ID NO: 46908
  misc_feature 1..58: note = AEKP01188815.1_1-4777:2612-2670
  misc_feature 1..58: note = hypo
  source 1..58: mol_type = genomic DNA

SEQ ID NO: 67315 - DNA, 151 bp, Homo sapiens; identical to SEQ ID NO: 46909
  misc_feature 1..151: note = AEKP01196136.1_22995-25251:459-610
  misc_feature 1..151: note = hypo
  source 1..151: mol_type = genomic DNA

SEQ ID NO: 67316 - DNA, 30 bp, Homo sapiens; identical to SEQ ID NO: 46910
  misc_feature 1..30: note = AEKP01229474.1_1-1021:874-904
  misc_feature 1..30: note = hypo
  source 1..30: mol_type = genomic DNA

SEQ ID NO: 67317 - DNA, 22 bp, Homo sapiens
  misc_feature 1..22: note = CR936360.14_69981-85448:11336-11358
  misc_feature 1..22: note = hypo
  source 1..22: mol_type = genomic DNA
ctagtttgagccagccggccgc

SEQ ID NO: 67318 - DNA, 30 bp, Homo sapiens; identical to SEQ ID NO: 46912
  misc_feature 1..30: note = FP565324.3_2001-29640:15187-15217
  misc_feature 1..30: note = hypo
  source 1..30: mol_type = genomic DNA

SEQ ID NO: 67319 - DNA, 47 bp, Homo sapiens; identical to SEQ ID NO: 46913
  misc_feature 1..47: note = FP565324.3_2001-29640:19686-19733
  misc_feature 1..47: note = hypo
  source 1..47: mol_type = genomic DNA

SEQ ID NO: 67320 - DNA, 18 bp, Homo sapiens
  misc_feature 1..18: note = JH636052.4:2022610-2022628
  misc_feature 1..18: note = hypo
  source 1..18: mol_type = genomic DNA
aacaataaaacaggccgg

SEQ ID NO: 67321 - DNA, 61 bp, Homo sapiens; identical to SEQ ID NO: 46915
  misc_feature 1..61: note = NW_001838014.1_249000-295694:3702-3763
  misc_feature 1..61: note = hypo
  source 1..61: mol_type = genomic DNA

SEQ ID NO: 67322 - DNA, 42 bp, Homo sapiens; identical to SEQ ID NO: 46916
  misc_feature 1..42: note = NW_001838014.1_249000-295694:4094-4136
  misc_feature 1..42: note = hypo
  source 1..42: mol_type = genomic DNA

SEQ ID NO: 67323 - DNA, 60 bp, Homo sapiens; identical to SEQ ID NO: 46917
  misc_feature 1..60: note = NW_001838014.1_249000-295694:7207-7267
  misc_feature 1..60: note = hypo
  source 1..60: mol_type = genomic DNA

SEQ ID NO: 67324 - DNA, 311 bp, Homo sapiens; identical to SEQ ID NO: 46918
  misc_feature 1..311: note = NW_001838014.1_249000-295694:13512-13823
  misc_feature 1..311: note = hypo
  source 1..311: mol_type = genomic DNA

SEQ ID NO: 67325 - DNA, 84 bp, Homo sapiens; identical to SEQ ID NO: 46919
  misc_feature 1..84: note = NW_001838056.1_145425-224902:42711-42795
  misc_feature 1..84: note = hypo
  source 1..84: mol_type = genomic DNA

SEQ ID NO: 67326 - DNA, 30 bp, Homo sapiens; identical to SEQ ID NO: 46920
  misc_feature 1..30: note = NW_001839407.1_42766-49957:1184-1214
  misc_feature 1..30: note = hypo
  source 1..30: mol_type = genomic DNA

SEQ ID NO: 67327 - DNA, 23 bp, Homo sapiens
  misc_feature 1..23: note = NW_001839609.1_1-3470:1139-1162
  misc_feature 1..23: note = hypo
  source 1..23: mol_type = genomic DNA
caaagcgaggcactgcgagcctg

SEQ ID NO: 67328 - DNA, 90 bp, Homo sapiens; identical to SEQ ID NO: 46922
  misc_feature 1..90: note = NW_001839760.1_243903-260476:6752-6842
  misc_feature 1..90: note = hypo
  source 1..90: mol_type = genomic DNA

SEQ ID NO: 67329 - DNA, 22 bp, Homo sapiens
  misc_feature 1..22: note = NW_001840754.1_117-3691:2515-2537
  misc_feature 1..22: note = hypo
  source 1..22: mol_type = genomic DNA
gggctaccgcagggagggtgcc

SEQ ID NO: 67330 - DNA, 30 bp, Homo sapiens; identical to SEQ ID NO: 46924
  misc_feature 1..30: note = NW_001840841.1_1-4205:1669-1699
  misc_feature 1..30: note = hypo
  source 1..30: mol_type = genomic DNA

SEQ ID NO: 67331 - DNA, 43 bp, Homo sapiens; identical to SEQ ID NO: 46925
  misc_feature 1..43: note = NW_001841011.1_96346-168555:37241-37284
  misc_feature 1..43: note = hypo
  source 1..43: mol_type = genomic DNA

SEQ ID NO: 67332 - DNA, 140 bp, Homo sapiens; identical to SEQ ID NO: 46926
  misc_feature 1..140: note = NW_001841051.1_40144-46142:4777-4917
  misc_feature 1..140: note = hypo
  source 1..140: mol_type = genomic DNA

SEQ ID NO: 67333 - DNA, 46 bp, Homo sapiens; identical to SEQ ID NO: 46927
  misc_feature 1..46: note = NW_001841110.1_111-11841:9069-9115
  misc_feature 1..46: note = hypo
  source 1..46: mol_type = genomic DNA

SEQ ID NO: 67334 - DNA, 55 bp, Homo sapiens; identical to SEQ ID NO: 46928
  misc_feature 1..55: note = NW_001841145.1_177495-186900:5222-5277
  misc_feature 1..55: note = hypo
  source 1..55: mol_type = genomic DNA

SEQ ID NO: 67335 - DNA, 69 bp, Homo sapiens; identical to SEQ ID NO: 46929
  misc_feature 1..69: note = NW_001842432.1_1-179261:101291-101360
  misc_feature 1..69: note = hypo
  source 1..69: mol_type = genomic DNA

SEQ ID NO: 67336 - DNA, 38 bp, Homo sapiens
  misc_feature 1..38: note = AC006359.3_31144-32210:157-195
  misc_feature 1..38: note = hyper
  source 1..38: mol_type = genomic DNA
ctttctgcccccacccgccgctgcggctttttgcccca

SEQ ID NO: 67337 - DNA, 18 bp, Homo sapiens
  misc_feature 1..18: note = AC010098.8_29020-31687:1483-1501
  misc_feature 1..18: note = hyper
  source 1..18: mol_type = genomic DNA
gcggctttttgcccccgc

SEQ ID NO: 67338 - DNA, 41 bp, Homo sapiens
  misc_feature 1..41: note = AC010098.8_29020-31687:525-566
  misc_feature 1..41: note = hyper
  source 1..41: mol_type = genomic DNA
agcggctttttgcacccccgccgccgcggctttttgtcccc

SEQ ID NO: 67339 - DNA, 179 bp, Homo sapiens
  misc_feature 1..179: note = AC018688.9_35552-170204:78812-78991
  misc_feature 1..179: note = hypo
  source 1..179: mol_type = genomic DNA
ttggccttggctagccggttccccgcccccgctggtgggctgcctcgccctgggtggggtgtgccccaccatgtgccaggactgggtccggtgcagagtgcccttcttcctgggaagggtgtggctgaaaaggcggcctccttgcccgtcatgcaacacacgttcgtggggaacctggt

SEQ ID NO: 67340 - DNA, 94 bp, Homo sapiens
  misc_feature 1..94: note = AC018688.9_35552-170204:82698-82792
  misc_feature 1..94: note = hypo
  source 1..94: mol_type = genomic DNA
ccaccccaccctccacgcgtcggctgatgaaaccatttctctacaatttattaaaaagattatctgggcctggcactgtagctcatgcctgtca

SEQ ID NO: 67341 - DNA, 120 bp, Homo sapiens
  misc_feature 1..120: note = AC127380.4_153-32188:9589-9709
  misc_feature 1..120: note = hyper
  source 1..120: mol_type = genomic DNA
gcaaaaagccgctgcgggcaaataaccgcggcacggggcgggggcggggggcgcaaaaagccgcatcggcggggcgcaaaaagccgcggtagcgggggaacaaaaagccgcggcagcggg

SEQ ID NO: 67342 - DNA, 30 bp, Homo sapiens
  misc_feature 1..30: note = AC137488.2_1-70728:40075-40105
  misc_feature 1..30: note = hypo
  source 1..30: mol_type = genomic DNA
tgttaatgatccctccgcaggttcacctac

SEQ ID NO: 67343 - DNA, 40 bp, Homo sapiens
  misc_feature 1..40: note = AC145029.2_135730-137748:1618-1658
  misc_feature 1..40: note = hyper
  source 1..40: mol_type = genomic DNA
cgcggtgggcagaaagccgtgggggcggggtgcaaaaagc

SEQ ID NO: 67344 - DNA, 198 bp, Homo sapiens
  misc_feature 1..198: note = AC188622.2_1-37519:11868-12066
  misc_feature 1..198: note = hypo
  source 1..198: mol_type = genomic DNA
gtgtcttgagttttgcgtatgactctgcttcaacttgcctggtggtttcatgctattctgattcctctacaatgtaatgctttgtgagacgatggcagacacaaggcagatcctcagaatacactcccgatgatattagcttcttgtgcaatcagccaacacacagaacatgaagcttgcccccgatgtttgccacag

SEQ ID NO: 67345 - DNA, 30 bp, Homo sapiens
  misc_feature 1..30: note = AC207871.4_32367-39588:2999-3029
  misc_feature 1..30: note = hypo
  source 1..30: mol_type = genomic DNA
tagcttcgtggtcgccgggggctgggggtg

SEQ ID NO: 67346 - DNA, 45 bp, Homo sapiens
  misc_feature 1..45: note = AC211344.3_7702-13588:3836-3881
  misc_feature 1..45: note = hyper
  source 1..45: mol_type = genomic DNA
ggagctcttgatgtgcgggaaatgcagacccggcactggaatttc

SEQ ID NO: 67347 - DNA, 598 bp, Homo sapiens
  misc_feature 1..598: note = AC211950.2_11234-25326:13291-13889
  misc_feature 1..598: note = hyper
  source 1..598: mol_type = genomic DNA
cgtgcttgggggaggcggcagtttcctctgatcttctcccagataagaggcacagatgtcgtcaacaggagaaacaacggggaatacaaactaagagacataaaccagataagaaactggagaatgcgggcgtcgatcccgctacctctcgcatgctaagcgagcgctctaccgcctgagctaattcctcactgaggaggcccgccaccccacccattttcctggttatcaggagcctgccggtactttgggccgccaaatccctggcaggacaagattgagggcggagcttctcagatactgccttgggcaaacttctacgagcctgagagtgtgaagaatacggatttccaaaataggtcatgagggagacctctctcctcacttcccaatttcgccttcttcatctctcggaattagagagcacgttccagttggagaagcaccacctggaactgcctggcttgcgggcacagctattccagcccgctctagagttgtgatcctcacctgctccctgcaggcaaggccacccggaagtagcggggcagcttctcccagccccagaacttcacgccatacgcgcctcatcttcaat

SEQ ID NO: 67348 - DNA, 18 bp, Homo sapiens
  misc_feature 1..18: note = AC211950.2_11234-25326:180-198
  misc_feature 1..18: note = hyper
  source 1..18: mol_type = genomic DNA
aagcggcttttttttaat

SEQ ID NO: 67349 - DNA, 95 bp, Homo sapiens
  misc_feature 1..95: note = AC211950.2_11234-25326:25-120
  misc_feature 1..95: note = hyper
  source 1..95: mol_type = genomic DNA
tcagaaaagtttcttcggtgattggaataacgttcgcctttaaacttctcaagagatttagggtgggttttagtaagcggggccggttagctcag

SEQ ID NO: 67350 - DNA, 152 bp, Homo sapiens
  misc_feature 1..152: note = AC211950.2_11234-25326:8748-8900
  misc_feature 1..152: note = hyper
  source 1..152: mol_type = genomic DNA
gcttctgtgggtgctcgtttgacacgcgctcccggctccgcgcagtggctgtttctggatgagtctggagactccgcctgcagtcctgtgctggctccaccttggcagggatggagctcaggaatgttgagtggtcccgaaaaaccaggtgg

SEQ ID NO: 67351 - DNA, 173 bp, Homo sapiens
  misc_feature 1..173: note = AC225595.1_16282-19523:1056-1229
  misc_feature 1..173: note = hypo
  source 1..173: mol_type = genomic DNA
gaaatcatcaaactacgaagattgaagcgttgcaggacatggtgactgacatgatgtctccccggcttcatcggtcatgtgtgatgagcccaactgataacgcaatagcagcccagctgtcggtctgtgcagaaggatagtctcggaagacatctgcccggccagatccaagc

SEQ ID NO: 67352 - DNA, 74 bp, Homo sapiens
  misc_feature 1..74: note = AC231386.2_19255-24791:4032-4106
  misc_feature 1..74: note = hyper
  source 1..74: mol_type = genomic DNA
gaccgggggcgaaggcgacaggggtctgtggaagagacctgtcggcggagagcggtccacgttttcctggagaa

SEQ ID NO: 67353 - DNA, 30 bp, Homo sapiens; identical to SEQ ID NO: 46903
  misc_feature 1..30: note = AC239873.3_5604-11530:5296-5326
  misc_feature 1..30: note = hypo
  source 1..30: mol_type = genomic DNA

SEQ ID NO: 67354 - DNA, 259 bp, Homo sapiens
  misc_feature 1..259: note = AC241442.1_28021-33880:323-582
  misc_feature 1..259: note = hyper
  source 1..259: mol_type = genomic DNA
gtgggggtggggaaccgtgccttccgcgcacgcgcgccgctgggcctgagcgtgcagtcggtcgggtgggcgagggcgccgccctggtggcggaagcgcctcctccagggctcccccgaacggcggcgccgggaccccgctctccttgggctctttgcctcagaccccacgtggcgatgacccggcctcggtgtgcgcgtcggtgcggaggccggcccttcgagctgggtcccgagatcgctgacgtctggcctccact

SEQ ID NO: 67355 - DNA, 420 bp, Homo sapiens
  misc_feature 1..420: note = AC241851.2_88-34049:15133-15553
  misc_feature 1..420: note = hyper
  source 1..420: mol_type = genomic DNA
gcccccaccgcccgggctttttgcgccgcggctttttgctgctatttgtccctgccaccgcggcgttttgcccccgcagccgcggctccttgccccctacgcggcttcctgcctccgccaccgtggctttttatcaccccagccgctttttgaaccccccgccgcgggtttttgccgccgcggcttcttgcccccctcgccgcggctttttacccccacagcggcggctttctgcccctgcctctgagggtttttgcggctttatgtccccgctgtcgtggctttttgccgccgcggcttttggccccctccgccgcggctttttgcggcttttggcacccaacgccgcggctttttggggcttttggtccccgccaccggggcttttttcccccaccgccgcaggtttttcccgcccct

SEQ ID NO: 67356 - DNA, 30 bp, Homo sapiens
  misc_feature 1..30: note = AEKP01008621.1_1-2685:1692-1722
  misc_feature 1..30: note = hypo
  source 1..30: mol_type = genomic DNA
tgtgctagaggctggcggtggcagcaggga

SEQ ID NO: 67357 - DNA, 30 bp, Homo sapiens
  misc_feature 1..30: note = AEKP01044741.1_1-4554:2853-2883
  misc_feature 1..30: note = hypo
  source 1..30: mol_type = genomic DNA
gtaaaggtcccaggtcgcagggccagtctt

SEQ ID NO: 67358 - DNA, 30 bp, Homo sapiens
  misc_feature 1..30: note = AEKP01132292.1_2033-9536:6910-6940
  misc_feature 1..30: note = hypo
  source 1..30: mol_type = genomic DNA
ccattactgatccagcgagtcaacctatga

SEQ ID NO: 67359 - DNA, 30 bp, Homo sapiens; identical to SEQ ID NO: 16832
  misc_feature 1..30: note = AEKP01139090.1_11256-14570:719-749
  misc_feature 1..30: note = hypo
  source 1..30: mol_type = genomic DNA

SEQ ID NO: 67360 - DNA, 30 bp, Homo sapiens
  misc_feature 1..30: note = AEKP01146324.1_36063-42453:2576-2606
  misc_feature 1..30: note = hypo
  source 1..30: mol_type = genomic DNA
tggcacagagagaggcggagattcacccaa

SEQ ID NO: 67361 - DNA, 21 bp, Homo sapiens
  misc_feature 1..21: note = AEKP01149800.1_88-7643:5248-5269
  misc_feature 1..21: note = hypo
  source 1..21: mol_type = genomic DNA
gtgtgagggtgtgagcgggtg

SEQ ID NO: 67362 - DNA, 30 bp, Homo sapiens
  misc_feature 1..30: note = AEKP01149800.1_88-7643:5586-5616
  misc_feature 1..30: note = hypo
  source 1..30: mol_type = genomic DNA
tttctagtaaagtttcgtttccagagacag

SEQ ID NO: 67363 - DNA, 158 bp, Homo sapiens
  misc_feature 1..158: note = AEKP01153556.1_1-5252:377-535
  misc_feature 1..158: note = hypo
  source 1..158: mol_type = genomic DNA
aatcaccatcagcaccgtcatcaccgtcatcaccattatctccaccactgttgctgtgaacgcatactgcactattatcacctgaggtacagtgacaacgttgtgtgatgctaaaatgtgagcttttctatctgccgatgattcggcctttgtccctc

SEQ ID NO: 67364 - DNA, 42 bp, Homo sapiens
  misc_feature 1..42: note = AEKP01153556.1_1-5252:995-1037
  misc_feature 1..42: note = hypo
  source 1..42: mol_type = genomic DNA
cacccgcctcacctccgcatgaaaccccgaccataaccccga

SEQ ID NO: 67365 - DNA, 30 bp, Homo sapiens
  misc_feature 1..30: note = AEKP01160869.1_25046-30418:2610-2640
  misc_feature 1..30: note = hypo
  source 1..30: mol_type = genomic DNA
gtctctctacttccccgtgcccccatcccg

SEQ ID NO: 67366 - DNA, 49 bp, Homo sapiens
  misc_feature 1..49: note = AEKP01166227.1_44013-111583:24167-24216
  misc_feature 1..49: note = hypo
  source 1..49: mol_type = genomic DNA
acctagactgttgaccgaggacctgaaagagaagcgtctccagagagat

SEQ ID NO: 67367 - DNA, 123 bp, Homo sapiens; identical to SEQ ID NO: 38671
  misc_feature 1..123: note = AEKP01168736.1_1-4752:1196-1319
  misc_feature 1..123: note = hyper
  source 1..123: mol_type = genomic DNA

SEQ ID NO: 67368 - DNA, 280 bp, Homo sapiens
  misc_feature 1..280: note = AEKP01168736.1_1-4752:1533-1813
  misc_feature 1..280: note = hyper
  source 1..280: mol_type = genomic DNA
ggcggaggtggaggtcggacagcacaagtgagagtgagggggtctgcaggtagagctggcattggaggggtgggaacgtggacggcggctgagcggggggcgcgtgcaggtcggagccggcaggtgaggagccagggtctaagctagggcccggggtccaaaggaaaggctttcagatctgagctccgcggctctggcggcggtggagctgggagcccgcggtggccggctggggacgggggcaggagcagaggggtcgcgccgcggccactggaacccg

SEQ ID NO: 67369 - DNA, 940 bp, Homo sapiens
  misc_feature 1..940: note = AEKP01168736.1_1-4752:1873-2813
  misc_feature 1..940: note = hyper
  source 1..940: mol_type = genomic DNA
gcgctgaccggggcgctcagctttgtgctcctggcggccgccatcggcacggacttctggtatatcattgacaccgagcggctggagaggactggcccgggggcgcaggacctgctggggtccatcaatcgcagccagcccgagcctctgagctcccactccggcctctggcggacctgccggggtaagggtgcaccccgtggctgggagctgtggctgcgaacgccccctgcgcggtgccctgctcccttgggacctgttgcttggcgcgcactcctcccccaagtccctaaaatacaatgtctagggactcggggggaaggtgagcagaaggccgggactgcgaaaacccttccgagaggcacccggctgcgatcccaactgctctagctctccccgcgccctccccgggtggggcacttagggtgagcatgggggcaaagccgcagacgagggtgctgcacagaactccggggtcctgcacccatggattcctccgtcctatccagtgcagagcccgtgcacaccgctgatgaaccccttcaggctggagaacgtgacagtcagcgaatcgagccggcaacttctcagtgagtccggggagggtgaggatggagggagcgccccggtcctagccgtgagttctggagcctttcccaaaacagccgggcttcggggcctgcggagagggcggctggggtggcctctgacagcccagcctgagaatggagtgggcttaagaccggggggcagggtctctcctgatccacctgtaacgttttgtggtttagggttcattcagctcacgttgactaatggctttctttgcaccgttttgatggatggttaagacacaggccatcccctcaaggggctcacagtggtgctgggacaaatgtggagacgcgcagttagagtccagcagcgtgaggaagggaag

SEQ ID NO: 67370 - DNA, 30 bp, Homo sapiens
  misc_feature 1..30: note = AEKP01171299.1_4392-9704:2569-2599
  misc_feature 1..30: note = hypo
  source 1..30: mol_type = genomic DNA
acttccctggagtgccgtgtggccgttgta

SEQ ID NO: 67371 - DNA, 273 bp, Homo sapiens
  misc_feature 1..273: note = AEKP01171767.1_199-12179:10825-11098
  misc_feature 1..273: note = hyper
  source 1..273: mol_type = genomic DNA
tttccatggaccccacgcaagctccctgcccggtgtctcgggggtgtgggggttgggggagccgccgggggcggggtccccgcctgcccaggccggacccatgtcagcggacgtcactgcgggaagcgcggccggcgggggcgacccggggtctgcgcggctctcacccggtggcgcgccgcagccgcaggcaatttatctccgtctccccgctcttaaaacacttttatcaaaattggcggtcacaccgcgctgaaccgtggtggcctcaat

SEQ ID NO: 67372 - DNA, 30 bp, Homo sapiens
  misc_feature 1..30: note = AEKP01184864.1_3582-5885:670-700
  misc_feature 1..30: note = hypo
  source 1..30: mol_type = genomic DNA
tgtccttaagcaacccgtggctatttgtct

SEQ ID NO: 67373 - DNA, 58 bp, Homo sapiens; identical to SEQ ID NO: 46908
  misc_feature 1..58: note = AEKP01188815.1_1-4777:2612-2670
  misc_feature 1..58: note = hypo
  source 1..58: mol_type = genomic DNA

SEQ ID NO: 67374 - DNA, 30 bp, Homo sapiens
  misc_feature 1..30: note = AEKP01193750.1_12147-15056:206-236
  misc_feature 1..30: note = hypo
  source 1..30: mol_type = genomic DNA
acaaggtgtccagctcgggattaatttcta

SEQ ID NO: 67375 - DNA, 213 bp, Homo sapiens
  misc_feature 1..213: note = AEKP01196136.1_22995-25251:442-655
  misc_feature 1..213: note = hypo
  source 1..213: mol_type = genomic DNA
tgacgacagagttcacgtgctggaagagtcaacggcgtttttaaagaggcagggcaacgcgcactacagtgagggatcttacaggcctgtttttgagggaaaatggtaagtgagctacagcgagcacacgtgtgtagatcccagttacaggtccgtcaagatggctagagaatacacacactgcccagcccatacacacgtgcaaaggcacac

SEQ ID NO: 67376 - DNA, 61 bp, Homo sapiens
  misc_feature 1..61: note = AEKP01196137.1_1-1039:721-782
  misc_feature 1..61: note = hypo
  source 1..61: mol_type = genomic DNA
ggctgtgcagctgagcggggcagcaggacccgggacatgcactgcacgggaggaggagcag

SEQ ID NO: 67377 - DNA, 196 bp, Homo sapiens
  misc_feature 1..196: note = AEKP01197830.1_1-1408:29-225
  misc_feature 1..196: note = hyper
  source 1..196: mol_type = genomic DNA
tcggggtggcggtcccggggctgccgggctgcgggtcggccacattcctgcctttgccgggcggggggggcgcctggagggaaccccggcccgacaccccgcggctttgggctcccacggggccgcgcgcctcttcccagccgggccccccatcccggggcagagggcccagagccttcctcgaccttgggagaaa

SEQ ID NO: 67378 - DNA, 78 bp, Homo sapiens
  misc_feature 1..78: note = AEKP01197830.1_1-1408:476-554
  misc_feature 1..78: note = hyper
  source 1..78: mol_type = genomic DNA
tcagaaaagctggagcggggccgcagcccggccctgccccccggcatggggacttcctccccccggtgaaggcggccg

SEQ ID NO: 67379 - DNA, 39 bp, Homo sapiens
  misc_feature 1..39: note = AEKP01210344.1_1299-2924:730-769
  misc_feature 1..39: note = hypo
  source 1..39: mol_type = genomic DNA
gacatgaaaggcacacgggtgacaggacggacaccccag

SEQ ID NO: 67380 - DNA, 30 bp, Homo sapiens
  misc_feature 1..30: note = AEKP01213519.1_104-1403:796-826
  misc_feature 1..30: note = hypo
  source 1..30: mol_type = genomic DNA
tgtcccagggctcaccgccattcatgaaga

SEQ ID NO: 67381 - DNA, 23 bp, Homo sapiens
  misc_feature 1..23: note = AEKP01218892.1_1-1226:1010-1033
  misc_feature 1..23: note = hypo
  source 1..23: mol_type = genomic DNA
gaggctgcaggggcacgggcggg

SEQ ID NO: 67382 - DNA, 26 bp, Homo sapiens
  misc_feature 1..26: note = AEKP01225640.1_1-1497:736-762
  misc_feature 1..26: note = hypo
  source 1..26: mol_type = genomic DNA
gccctgggacccttccggggttgggc

SEQ ID NO: 67383 - DNA, 197 bp, Homo sapiens; identical to SEQ ID NO: 39017
  misc_feature 1..197: note = chr1:100436557-100436754
  misc_feature 1..197: note = hypo
  source 1..197: mol_type = genomic DNA

SEQ ID NO: 67384 - DNA, 86 bp, Homo sapiens; identical to SEQ ID NO: 4943
  misc_feature 1..86: note = chr1:100437183-100437269
  misc_feature 1..86: note = hypo
  source 1..86: mol_type = genomic DNA

SEQ ID NO: 67385 - DNA, 242 bp, Homo sapiens
  misc_feature 1..242: note = chr1:10057380-10057622
  misc_feature 1..242: note = hyper
  source 1..242: mol_type = genomic DNA
tggccctaggtaaggcggaggggaggcggcggcggcgcgaggctcgccgtgggtctcgggatcaggcgaaggcggccgggccgggcctgtaggtacgtcctctgtccgtgcctccgccctgctgcgcccaccgtcgcccagtcgcccccgagtccgctggtccttggcgcctccgtccatcgggcgcgggaccccagtccttcagtcccccagtccgtcctttcccgcgcccacccgccccc

SEQ ID NO: 67386 - DNA, 34 bp, Homo sapiens; identical to SEQ ID NO: 39019
  misc_feature 1..34: note = chr1:100814764-100814798
  misc_feature 1..34: note = hypo
  source 1..34: mol_type = genomic DNA

SEQ ID NO: 67387 - DNA, 30 bp, Homo sapiens; identical to SEQ ID NO: 39020
  misc_feature 1..30: note = chr1:100928393-100928423
  misc_feature 1..30: note = hypo
  source 1..30: mol_type = genomic DNA

SEQ ID NO: 67388 - DNA, 155 bp, Homo sapiens
  misc_feature 1..155: note = chr1:10094917-10095072
  misc_feature 1..155: note = hypo
  source 1..155: mol_type = genomic DNA
tcaggactgcccattcggcgttactttgtttttttcgaatacagcagaaatgtaatcttaagtgaagagaatattacacagtttctttcattcggtaggaaatctccttagaatcgctttattttatgtgggtttttttttgtttgtttgttttt

SEQ ID NO: 67389 - DNA, 361 bp, Homo sapiens; identical to SEQ ID NO: 1776
  misc_feature 1..361: note = chr1:101004456-101004817
  misc_feature 1..361: note = hyper
  source 1..361: mol_type = genomic DNA

SEQ ID NO: 67390 - DNA, 92 bp, Homo sapiens; identical to SEQ ID NO: 26494
  misc_feature 1..92: note = chr1:101004842-101004934
  misc_feature 1..92: note = hyper
  source 1..92: mol_type = genomic DNA

SEQ ID NO: 67391 - DNA, 880 bp, Homo sapiens
  misc_feature 1..880: note = chr1:101004935-101005815
  misc_feature 1..880: note = hyper
  source 1..880: mol_type = genomic DNA
ctacctgctcatcacccgggcgcccgccacctaccaggcgctgtaccagaggcgccacacggcgggcatgctggcgctgtcctgggcgctcgccctgggcctcgtgctgctgctcccgccctgggcaccgcggcccggcgccgcgccaccgcgagtccactacccggcgctgctggccgccgcggcgctgctggcgcagacagctctgctgctgcactgctacctgggcatcgtgcgccgcgtgcgtgtcagcgtcaagcgggtcagcgtgctcaacttccacctgctgcaccagttgcccggctgcgccgccgccgccgccgccttcccgggcgcccagcacgcgccgggccccggtggcgccgcgcacccggcgcaggcccagcccctgccgcccgcgctgcacccgcggcgggcacagcggcgtctcagcggcctgtcggtgctgctgctctgctgcgtcttcctgctggccacgcagccactggtgtgggtgagcctggccagcggcttctcgctgccggtgccctggggagtgcaggcggccagctggctcctgtgctgcgccctgtccgcgctcaatccgctgctctacacgtggaggaacgaggagttccgccgctccgtgcgctcagtcctgccgggcgtcggcgacgcggcggccgctgccgttgccgccacagccgtgcccgcagtgtcccaggcgcaactgggcacccgcgccgcgggccagcactggtaacctagccggggcccgagggaagcggagatccccggcttccgacgtccttgggcaccgtcgcctccttccctcctagggcatcccctgcctgaacgaagacttccgccgcgaagcccgatagatcgggggaaaatgggg

SEQ ID NO: 67392 - DNA, 86 bp, Homo sapiens
  misc_feature 1..86: note = chr1:10103747-10103833
  misc_feature 1..86: note = hypo
  source 1..86: mol_type = genomic DNA
agtgctgggattacaggcgtgatccaacgcgctgggccgggatgcttcttataaatagatggtgtaatcaccgttggccaggtggc

SEQ ID NO: 67393 - DNA, 55 bp, Homo sapiens
  misc_feature 1..55: note = chr1:10166572-10166627
  misc_feature 1..55: note = hypo
  source 1..55: mol_type = genomic DNA
tccacccctaccacccgcctcacccagtgccacgagcagacgcccctcctccctg

SEQ ID NO: 67394 - DNA, 363 bp, Homo sapiens
  misc_feature 1..363: note = chr1:101701718-101702081
  misc_feature 1..363: note = hyper
  source 1..363: mol_type = genomic DNA
gcccaacaccaaaaccggcgctggttcatttctctgtgcactctgggaaagccactgcccctcagaccgcagttgcgagtagcacgaggatctggggtggcggggggagtacaggaacctcccggttcattctccctcccgggctgcttgtctcctccgtacctctcgcagccccttcccagcctctcctccccagagcgccgccgacactcgccgggccgcggctcaggttttctgctgctcgcgcgaaagtggctcggggagctcctggccacaagctcagcacaccgatcctcctagggctgcggggggtgtgggaccagggcggtgcgctacgagactccgggccgtcctctgcctcct

SEQ ID NO: 67395 - DNA, 233 bp, Homo sapiens
  misc_feature 1..233: note = chr1:101702369-101702602
  misc_feature 1..233: note = hyper
  source 1..233: mol_type = genomic DNA
ccagctgacagagggcgtggggggttaaggcattaacccctcccagcctcttcctgaagaaaccacccagccttggcgcggcgctgggtgacttcgcgtagcaggcagggaactggccgcggcgagcgggactggccattggagtgctccgctgcggagggaggggaccccgactcgagtaagtttgcgagagcactacgcagtcagtcgggggcagcagcaagatgcgaagc

SEQ ID NO: 67396 - DNA, 193 bp, Homo sapiens; identical to SEQ ID NO: 26497
  misc_feature 1..193: note = chr1:101702603-101702796
  misc_feature 1..193: note = hyper
  source 1..193: mol_type = genomic DNA

SEQ ID NO: 67397 - DNA, 79 bp, Homo sapiens
  misc_feature 1..79: note = chr1:101703188-101703267
  misc_feature 1..79: note = hyper
  source 1..79: mol_type = genomic DNA
tctgctgaccagtgccgtcttagaaagtttctttgtaactttctagtcctaggagaggagtcaacgtgttgggggactg

SEQ ID NO: 67398 - DNA, 76 bp, Homo sapiens; identical to SEQ ID NO: 26499
  misc_feature 1..76: note = chr1:101703566-101703642
  misc_feature 1..76: note = hyper
  source 1..76: mol_type = genomic DNA

SEQ ID NO: 67399 - DNA, 83 bp, Homo sapiens
  misc_feature 1..83: note = chr1:101721485-101721568
  misc_feature 1..83: note = hypo
  source 1..83: mol_type = genomic DNA
agttggtcaggaagccgcgcagcagccatggcttttaagaataccgggcactttgggaggccgaggtggacggatcacaaggt

SEQ ID NO: 67400 - DNA, 394 bp, Homo sapiens; identical to SEQ ID NO: 26500
  misc_feature 1..394: note = chr1:101775094-101775488
  misc_feature 1..394: note = hyper
  source 1..394: mol_type = genomic DNA

SEQ ID NO: 67401 - DNA, 30 bp, Homo sapiens
  misc_feature 1..30: note = chr1:101918826-101918856
  misc_feature 1..30: note = hypo
  source 1..30: mol_type = genomic DNA
ccccaggaacctccacgtgttcagctccca

SEQ ID NO: 67402 - DNA, 30 bp, Homo sapiens
  misc_feature 1..30: note = chr1:10206714-10206744
  misc_feature 1..30: note = hypo
  source 1..30: mol_type = genomic DNA
aaagggcctccctgtcgccaccctctcctc

SEQ ID NO: 67403 - DNA, 23 bp, Homo sapiens
  misc_feature 1..23: note = chr1:10232969-10232992
  misc_feature 1..23: note = hypo
  source 1..23: mol_type = genomic DNA
ttgtgttacaactgccgacagga

SEQ ID NO: 67404 - DNA, 50 bp, Homo sapiens
  misc_feature 1..50: note = chr1:1025254-1025304
  misc_feature 1..50: note = hypo
  source 1..50: mol_type = genomic DNA
tgaacagggcctgcccgtggcacgctgacacaggccggcatcctcgtggc

SEQ ID NO: 67405 - DNA, 122 bp, Homo sapiens
  misc_feature 1..122: note = chr1:103572643-103572765
  misc_feature 1..122: note = hyper
  source 1..122: mol_type = genomic DNA
agccagatgccttttcgggaaagggcgggggaaagagggagggagaaggcggaggggaggagtgaagtcgctctccctccgtgggtactgacagggttgcagacttccgagcaggtctggcc

SEQ ID NO: 67406 - DNA, 278 bp, Homo sapiens
  misc_feature 1..278: note = chr1:103573422-103573700
  misc_feature 1..278: note = hyper
  source 1..278: mol_type = genomic DNA
ctccctttattgtcccgcctacattcatctctttctccagtttccaattccaacctggtagcagctacaatctggattgtatttaagggaattgcttttttttttttttcttgaagagcggggaggaagggtaaagtggggggaggggcgcagaagcagtaggaccgacggcaatctcccacctccccaaatccattttttcttacctcctctgacctctctagcttggaagaggaaggtcaatgcgagggttgttacggtgaaatcccagagccacc

SEQ ID NO: 67407 - DNA, 467 bp, Homo sapiens; identical to SEQ ID NO: 26503
  misc_feature 1..467: note = chr1:103573701-103574168
  misc_feature 1..467: note = hyper
  source 1..467: mol_type = genomic DNA

SEQ ID NO: 67408 - DNA, 30 bp, Homo sapiens; identical to SEQ ID NO: 38694
  misc_feature 1..30: note = chr1:1045970-1046000
  misc_feature 1..30: note = hypo
  source 1..30: mol_type = genomic DNA

SEQ ID NO: 67409 - DNA, 30 bp, Homo sapiens
  misc_feature 1..30: note = chr1:10493353-10493383
  misc_feature 1..30: note = hypo
  source 1..30: mol_type = genomic DNA
cccaaccctccaaatcgagaggggtgggtg

SEQ ID NO: 67410 - DNA, 297 bp, Homo sapiens
  misc_feature 1..297: note = chr1:1049888-1050185
  misc_feature 1..297: note = hypo
  source 1..297: mol_type = genomic DNA
tatctcaggggttcccgggatgctgcctgtgcaccccagggctgaggtgactgcgtgtggaaacacctgcctgactggcttttaggaggagtactgggggcgggatgtgtgtcaggaaaacaacgtttctgtataattcataaacatgtatgttaaaaacaacgtggccatgacggatcctggctgaatgcaaacggggaacataaacctgagtaatcaggcgcatcactgaacatcccaggcggccgcccctaccctggggctcaaaaccggctccctctgcgagggtttcccagg

SEQ ID NO: 67411 - DNA, 92 bp, Homo sapiens
  misc_feature 1..92: note = chr1:10534389-10534481
  misc_feature 1..92: note = hypo
  source 1..92: mol_type = genomic DNA
atttccaagtttcttcgcattcatccattggcaagtccctaaatgtgcccatggcactgtggggatgggcagagattaactcaataagaata

SEQ ID NO: 67412 - DNA, 33 bp, Homo sapiens
  misc_feature 1..33: note = chr1:1053775-1053808
  misc_feature 1..33: note = hypo
  source 1..33: mol_type = genomic DNA
gagcagagcccctgccggcgtgggccaacctga

SEQ ID NO: 67413 - DNA, 30 bp, Homo sapiens
  misc_feature 1..30: note = chr1:1056382-1056412
  misc_feature 1..30: note = hypo
  source 1..30: mol_type = genomic DNA
gacctcagtgaggctcggttttgggggcct

SEQ ID NO: 67414 - DNA, 30 bp, Homo sapiens
  misc_feature 1..30: note = chr1:1058888-1058918
  misc_feature 1..30: note = hypo
  source 1..30: mol_type = genomic DNA
gcacacctgcgcacacgccacacacacctg

SEQ ID NO: 67415 - DNA, 35 bp, Homo sapiens
  misc_feature 1..35: note = chr1:10601654-10601689
  misc_feature 1..35: note = hypo
  source 1..35: mol_type = genomic DNA
tccatctgttgtgaacggaccgtcttccttccctg

SEQ ID NO: 67416 - DNA, 37 bp, Homo sapiens
  misc_feature 1..37: note = chr1:1066357-1066394
  misc_feature 1..37: note = hypo
  source 1..37: mol_type = genomic DNA
tcgccgcagggtccccggctcccgaggctgctgtggg

SEQ ID NO: 67417 - DNA, 169 bp, Homo sapiens
  misc_feature 1..169: note = chr1:1067634-1067803
  misc_feature 1..169: note = hypo
  source 1..169: mol_type = genomic DNA
ctcctgcctgagacccgccgccatcgccgccgcgagccctgcgttgggcattggggccaggcacctgccaggagggcctcttccgaggtggggtgtcacctgggatgtgtccgctggcaaatgggagaaacaccagggcggctgccggggaggtcgatgtcagggagcc

SEQ ID NO: 67418 - DNA, 35 bp, Homo sapiens
  misc_feature 1..35: note = chr1:1068726-1068761
  misc_feature 1..35: note = hypo
  source 1..35: mol_type = genomic DNA
tcctgccaaggatgacgctccggctgggtgggcac

SEQ ID NO: 67419 - DNA, 23 bp, Homo sapiens
  misc_feature 1..23: note = chr1:107161642-107161665
  misc_feature 1..23: note = hypo
  source 1..23: mol_type = genomic DNA
tgagaccccgtctaaatatatat

SEQ ID NO: 67420 - DNA, 18 bp, Homo sapiens
  misc_feature 1..18: note = chr1:107598664-107598682
  misc_feature 1..18: note = hypo
  source 1..18: mol_type = genomic DNA
gtgagttaggccgggcgc

SEQ ID NO: 67421 - DNA, 109 bp, Homo sapiens
  misc_feature 1..109: note = chr1:107600250-107600359
  misc_feature 1..109: note = hyper
  source 1..109: mol_type = genomic DNA
tggtgctgtccacctcgccttttcacccggccactcactggaaacaggcgctcctctacctgaacgagccggtgcaagtggagcaagacacggacgtttcaggagagat

SEQ ID NO: 67422 - DNA, 1154 bp, Homo sapiens; identical to SEQ ID NO: 26504
  misc_feature 1..1154: note = chr1:107682621-107683775
  misc_feature 1..1154: note = hyper
  source 1..1154: mol_type = genomic DNA

SEQ ID NO: 67423 - DNA, 719 bp, Homo sapiens; identical to SEQ ID NO: 26505
  misc_feature 1..719: note = chr1:107683776-107684495
  misc_feature 1..719: note = hyper
  source 1..719: mol_type = genomic DNA

SEQ ID NO: 67424 - DNA, 30 bp, Homo sapiens
  misc_feature 1..30: note = chr1:10783213-10783243
  misc_feature 1..30: note = hypo
  source 1..30: mol_type = genomic DNA
gacgtgggaaggccccgcctgccagtgtgg

SEQ ID NO: 67425 - DNA, 462 bp, Homo sapiens
  misc_feature 1..462: note = chr1:1080476-1080938
  misc_feature 1..462: note = hypo
  source 1..462: mol_type = genomic DNA
caccccacagccccccgctcctcccctccacacccaaccacagtccctcctggctgacaccgtggcccctcctggcctgtgctccccgggaacctcagtcagtgtcacttgaactccagcaccggacctggccccgtccatccagcctctgccccgagagccccgcccgtatctccagaggacacgccctgccaggggacaggcgggagcagctgagggccgcccggggaaggaaggcaaggagggcatgtaatcgcctgaccacatggccgacccccttgtgacctcatgacccccaccaccttcatggccgaccccacctgacctcatggccgacctgacctgaccgcacggctgacccaaccccatctcatgactgaccccacctgactttatggctcaccccagtgaccccatggccaaccccacctgacctcatggccgacccgatctgacctcatg

SEQ ID NO: 67426 - DNA, 30 bp, Homo sapiens
  misc_feature 1..30: note = chr1:10819797-10819827
  misc_feature 1..30: note = hypo
  source 1..30: mol_type = genomic DNA
catggggaggaagagcgcaggcaggtgagc

SEQ ID NO: 67427 - DNA, 57 bp, Homo sapiens
  misc_feature 1..57: note = chr1:1083618-1083675
  misc_feature 1..57: note = hypo
  source 1..57: mol_type = genomic DNA
gtgggggtggagagccgaggtgccggtgcgtccctgggttgccgcacgtatatccct

SEQ ID NO: 67428 - DNA, 169 bp, Homo sapiens
  misc_feature 1..169: note = chr1:10838656-10838825
  misc_feature 1..169: note = hypo
  source 1..169: mol_type = genomic DNA
tcccaactcccctctcgcggtctttcttcctgaatctgattcctaaaatgtcttccagtggacacgaggaggagagctcccatccaaactgttcccaggcaaacgtgtccttgctcttgatccgtgtggaattccaagtccccctggcagagagcggcttctgggactc

SEQ ID NO: 67429 - DNA, 190 bp, Homo sapiens
  misc_feature 1..190: note = chr1:108432636-108432826
  misc_feature 1..190: note = hypo
  source 1..190: mol_type = genomic DNA
tgagaaacttatttacggcttatactccagattttagctctgctcactatttcacaatcttaattttataaaaataaaattttattctttcttagtatcaatgcttaggttttgcactaaaatcaccgtatcagcaagaagtagtaaattgtgagtcagatttgtgtacatatatcggagtccacagtgc

SEQ ID NO: 67430 - DNA, 482 bp, Homo sapiens
  misc_feature 1..482: note = chr1:108506595-108507077
  misc_feature 1..482: note = hyper
  source 1..482: mol_type = genomic DNA
ctgcaggaaggaaagcggaatctctagtgaaacttctcatttcctgtcgctgctgagagaggctggactcgctccttctcacatggcttaggaagagctgtaaacgggagcttgccggctggccaccagctcaggggccctgggggcggcctccgggttctgctccctgttcttccctttgaccaatgtcactcctggacagataacgggaccaaacgcccttcacttcctcgagtcctcatgtatgtcatggttcctcttttaggaaaacatgagtacaagacgcaaagcaaaagaagagactaaaggcaaattaccccatcacctcgtttcgtccctccccttcgttattatagaagagcttgatcaaattccctttgtcgcgccacacacacgcagagtaggtgaagggcaccctaagacaacttatttctttcccgcctcacagaaagcctttacgaaatcctcacaccatctccgga

SEQ ID NO: 67431 - DNA, 228 bp, Homo sapiens; identical to SEQ ID NO: 77
  misc_feature 1..228: note = chr1:108507148-108507376
  misc_feature 1..228: note = hyper
  source 1..228: mol_type = genomic DNA

SEQ ID NO: 67432 - DNA, 113 bp, Homo sapiens; identical to SEQ ID NO: 78
  misc_feature 1..113: note = chr1:108507494-108507607
  misc_feature 1..113: note = hyper
  source 1..113: mol_type = genomic DNA

SEQ ID NO: 67433 - DNA, 550 bp, Homo sapiens; identical to SEQ ID NO: 79
  misc_feature 1..550: note = chr1:108507657-108508207
  misc_feature 1..550: note = hyper
  source 1..550: mol_type = genomic DNA

SEQ ID NO: 67434 - DNA, 340 bp, Homo sapiens; identical to SEQ ID NO: 80
  misc_feature 1..340: note = chr1:108508208-108508548
  misc_feature 1..340: note = hyper
  source 1..340: mol_type = genomic DNA

SEQ ID NO: 67435 - DNA, 38 bp, Homo sapiens; identical to SEQ ID NO: 81
  misc_feature 1..38: note = chr1:108508549-108508587
  misc_feature 1..38: note = hyper
  source 1..38: mol_type = genomic DNA

SEQ ID NO: 67436 - DNA, 287 bp, Homo sapiens
  misc_feature 1..287: note = chr1:10854374-10854661
  misc_feature 1..287: note = hyper
  source 1..287: mol_type = genomic DNA
ttactaactttgccccgcgactaccagggccttttccccctcgccaccccctgagtgtaccgggtgtcggcgggacaactacgcacaatgagggccgcacccccacactccactcggtcagaaacgcacactccgccccgtggcccagtgatccaggtttgggggagctccatactcaggagaggcgctactgccgcttttccggtgggcacgcacccgcacccgcaccgtagccagcgtggctggaaggaggtcctcgccgcgcccagagccggctttccaagctg

SEQ ID NO: 67437 - DNA, 30 bp, Homo sapiens
  misc_feature 1..30: note = chr1:10856927-10856957
  misc_feature 1..30: note = hyper
  source 1..30: mol_type = genomic DNA
gagtcgcacggcctgcggaggagcatctga

SEQ ID NO: 67438 - DNA, 30 bp, Homo sapiens; identical to SEQ ID NO: 39021
  misc_feature 1..30: note = chr1:109076927-109076957
  misc_feature 1..30: note = hypo
  source 1..30: mol_type = genomic DNA

SEQ ID NO: 67439 - DNA, 643 bp, Homo sapiens
  misc_feature 1..643: note = chr1:109203578-109204221
  misc_feature 1..643: note = hyper
  source 1..643: mol_type = genomic DNA
gctcactgaaaccaacgcttctgtctttgtacgggccgtcgcttccatcatcctgcggtaagcagcatgcccaaccgaaaaaacaaagctcgtcgcggagccgccagcgtcctcaactcagcgccgccctgacgcccgcgcacgcacggcctcgctgcgtgacgctaccgccgcggctacgccggcgcccgcacccgcgcctcggcctccccgcggggctcgccaacctcgtgcgctctcacggtcggccttgggccccgggagcctcatggtgcgccgagctccgtccctctaggctctcagttccaaggcgtcggttttgcgtctcgtaacggccgctgtggcgcatgcccagaagccattttcaaggtcctcttccgaaccttggcgaggacccctgcgcctgccgcgccgttgaccccgctagcgtgcggctgcgacgcggcacggtacggcagctgttggcgaaggcccccaactccgagcgcgtccgcagaccgcgagccggaaggcggcttgggcggctgttgagttcgtggcgctcccgaggcgtggcaaaggcctaaaaacggtcctggccagcggaaggcggcaagaggagcagcaaggctccacgcgaggcggccggcggctggagtcccag

SEQ ID NO: 67440 - DNA, 30 bp, Homo sapiens; identical to SEQ ID NO: 39022
  misc_feature 1..30: note = chr1:109370476-109370506
  misc_feature 1..30: note = hypo
  source 1..30: mol_type = genomic DNA

SEQ ID NO: 67441 - DNA, 274 bp, Homo sapiens
  misc_feature 1..274: note = chr1:10948439-10948713
  misc_feature 1..274: note = hyper
  source 1..274: mol_type = genomic DNA
ctcaagtgcctcattcgcgccctacccaggtccccgcccaggatcacaggatttgtgaccctggccttggccttgtccctaaaaccgtcacccgggtctcccaggcgagaggggcgggaggctccagacgcccagagcccacagcttcccgcccggggcggctgagcggtcccggggagagccctggagagagacagagaaggggaggcgtggagcggggcccccacagcagaagaggggcaggagggaggcgagagggggccggagtctggcc

SEQ ID NO: 67442 - DNA, 314 bp, Homo sapiens
  misc_feature 1..314: note = chr1:10948746-10949060
  misc_feature 1..314: note = hyper
  source 1..314: mol_type = genomic DNA
cgcggcccgggggtcccagacggggcgcccctccccacccggcccgccctgccccaccccccggcgcgggaggcccctgctccgcagtcggcggcgcccgggggagggggcgctgtgggggctcccggccgcccgccgcctgatgcgtatcgatcgcagcccggggtcgacgcgggggcaccagctgccggcgggcggggcgaccgcacattagcgcggccgggaccactccccggaacgcgggccgggcagcccattagacgcccccgggcggccgggcgaccactgcacgggcggggcgaggctggctccaa

SEQ ID NO: 67443 - DNA, 42 bp, Homo sapiens
  misc_feature 1..42: note = chr1:1094962-1095004
  misc_feature 1..42: note = hypo
  source 1..42: mol_type = genomic DNA
ggggcgacgggggcacgcccagtgccccgccactctccatgt

SEQ ID NO: 67444 - DNA, 30 bp, Homo sapiens
  misc_feature 1..30: note = chr1:1095467-1095497
  misc_feature 1..30: note = hypo
  source 1..30: mol_type = genomic DNA
acaggcgtgagccaccgcacccggatggtg

SEQ ID NO: 67445 - DNA, 98 bp, Homo sapiens
  misc_feature 1..98: note = chr1:109585374-109585472
  misc_feature 1..98: note = hypo
  source 1..98: mol_type = genomic DNA
tattccacaaatatacgtgatgttcaaccgagcttaattaagcatccaggaagtataaccataaggaagaatacaattacacaaacctgtaagaacat

SEQ ID NO: 67446 - DNA, 37 bp, Homo sapiens
  misc_feature 1..37: note = chr1:109585772-109585809
  misc_feature 1..37: note = hypo
  source 1..37: mol_type = genomic DNA
aagaacatcatcctcacagaggcgaaagtccagagtg

SEQ ID NO: 67447 - DNA, 18 bp, Homo sapiens
  misc_feature 1..18: note = chr1:10959337-10959355
  misc_feature 1..18: note = hypo
  source 1..18: mol_type = genomic DNA
taccctgtagggggccgg

SEQ ID NO: 67448 - DNA, 28 bp, Homo sapiens
  misc_feature 1..28: note = chr1:109593505-109593533
  misc_feature 1..28: note = hypo
  source 1..28: mol_type = genomic DNA
tcaagggccaggcaccgcggctcacgcc

SEQ ID NO: 67449 - DNA, 36 bp, Homo sapiens; identical to SEQ ID NO: 39026
  misc_feature 1..36: note = chr1:109631646-109631682
  misc_feature 1..36: note = hypo
  source 1..36: mol_type = genomic DNA

SEQ ID NO: 67450 - DNA, 30 bp, Homo sapiens
  misc_feature 1..30: note = chr1:109642384-109642414
  misc_feature 1..30: note = hypo
  source 1..30: mol_type = genomic DNA
gacaaattaaagtcacgatcacagaaaaac

SEQ ID NO: 67451 - DNA, 103 bp, Homo sapiens; identical to SEQ ID NO: 39027
  misc_feature 1..103: note = chr1:109644233-109644336
  misc_feature 1..103: note = hypo
  source 1..103: mol_type = genomic DNA

SEQ ID NO: 67452 - DNA, 35 bp, Homo sapiens
  misc_feature 1..35: note = chr1:109646883-109646918
  misc_feature 1..35: note = hypo
  source 1..35: mol_type = genomic DNA
attacagaagttagccaccgcgcccctccatagtt

SEQ ID NO: 67453 - DNA, 71 bp, Homo sapiens; identical to SEQ ID NO: 26513
  misc_feature 1..71: note = chr1:109656220-109656291
  misc_feature 1..71: note = hyper
  source 1..71: mol_type = genomic DNA

SEQ ID NO: 67454 - DNA, 576 bp, Homo sapiens
  misc_feature 1..576: note = chr1:109656494-109657070
  misc_feature 1..576: note = hyper
  source 1..576: mol_type = genomic DNA
cgccgcgcgcaccagcggcggcggctgccatggcgacccgcaggtgagctgcagaggcgcgcgtggtccctgccccacccgcgcggagccagagaggaggcggttgtcaaggcgacgtgggtaggaggagaggacagagggaggaggaaggatgggcggtgttggcgtagccgcagggaggtgactgaagcgagcctggcctcttgcatcctccgcctgtgtacctccctcccctttttttccgccttctgccagcagaagcagcagccgcagcacctgagccgctactgccgctcactcaggacaacgctatggctgagcctgggcacagccaccatctctccgccagagtcaggggaagaactgagaggcgcataccccggctgtggcggctgctgctctgggctgggaccgccttccaggtgacccagggaacgggaccggagcttcatgcctgcaaagaggtactgccgcccccctacccgatcccgctttggtcacaaaagtcttggatccaggcggagaccttggggacccaggcgcagagagtttcagacgccacggagtttagatttc

SEQ ID NO: 67455 - DNA, 30 bp, Homo sapiens
  misc_feature 1..30: note = chr1:109679322-109679352
  misc_feature 1..30: note = hypo
  source 1..30: mol_type = genomic DNA
ataccctgaaaataacgaactcctgtgtct

SEQ ID NO: 67456 - DNA, 30 bp, Homo sapiens; identical to SEQ ID NO: 39028
  misc_feature 1..30: note = chr1:109701309-109701339
  misc_feature 1..30: note = hypo
  source 1..30: mol_type = genomic DNA

SEQ ID NO: 67457 - DNA, 110 bp, Homo sapiens
  misc_feature 1..110: note = chr1:109772113-109772223
  misc_feature 1..110: note = hypo
  source 1..110: mol_type = genomic DNA
aagttggaagcagagcggtttgagaacctccgagagattgggaaccttctgcacccttctgtacccatcagtaacgatgaggtaggtggctgtgccgcagcaggaggctg

SEQ ID NO: 67458 - DNA, 30 bp, Homo sapiens
  misc_feature 1..30: note = chr1:109797867-109797897
  misc_feature 1..30: note = hypo
  source 1..30: mol_type = genomic DNA
ctcttctttctttcccgcccctgcccatgc

SEQ ID NO: 67459 - DNA, 61 bp, Homo sapiens
  misc_feature 1..61: note = chr1:109941488-109941549
  misc_feature 1..61: note = hypo
  source 1..61: mol_type = genomic DNA
cgctgttccctttaccgcagaagctgcacacacaacttctacaacacgtagcacaggtaaa

SEQ ID NO: 67460 - DNA, 78 bp, Homo sapiens
  misc_feature 1..78: note = chr1:110009016-110009094
  misc_feature 1..78: note = hyper
  source 1..78: mol_type = genomic DNA
cggtcccggaggcttcggcgaggaggacccggagtcccccccgccccgcggcggaactaaccacggaggcctctggtc

SEQ ID NO: 67461 - DNA, 235 bp, Homo sapiens; identical to SEQ ID NO: 26515
  misc_feature 1..235: note = chr1:110009583-110009818
  misc_feature 1..235: note = hyper
  source 1..235: mol_type = genomic DNA

SEQ ID NO: 67462 - DNA, 30 bp, Homo sapiens
  misc_feature 1..30: note = chr1:110010091-110010121
  misc_feature 1..30: note = hyper
  source 1..30: mol_type = genomic DNA
gaggggggagaaggacgacggggacgaggt

SEQ ID NO: 67463 - DNA, 80 bp, Homo sapiens
  misc_feature 1..80: note = chr1:110086023-110086103
  misc_feature 1..80: note = hypo
  source 1..80: mol_type = genomic DNA
gcctggccatcctctcggtgtcagccatcaatgtggagcgctactattacgtagtccaccccatgcgctacgaggtgcgc

SEQ ID NO: 67464 - DNA, 30 bp, Homo sapiens
  misc_feature 1..30: note = chr1:110186147-110186177
  misc_feature 1..30: note = hyper
  source 1..30: mol_type = genomic DNA
tccccagaaatcgggcggaggtttaggcct

SEQ ID NO: 67465 - DNA, 449 bp, Homo sapiens
  misc_feature 1..449: note = chr1:1102215-1102664
  misc_feature 1..449: note = hypo
  source 1..449: mol_type = genomic DNA
gagggccgagcggggcgggcagagggcccgtgtcagccccactccgacctagtcctcggccgtctggccaggacacttcggccccccaggtgcccaccccaggacccaaagctggtggctgctggactcggcagggctggcgggtggggctcacccgggcccctgccctccggcgatgctgtcctcagtgccccaggaggacgaggccccccagctactgagcttcccagcgagtcccatgcaaccctcagccgggcggcccccggacccagctcgggcagccgtggccatcttactgggcagcattggatggagtcaggtctctaatactgcctggtaatgatgacggcggagccctgcacgcagcgaccggccgaccccgtcccggcccccagggcctcccgccgagccccacactcccctcccacacagcccgctcaccggacccc

SEQ ID NO: 67466 - DNA, 697 bp, Homo sapiens
  misc_feature 1..697: note = chr1:110282542-110283239
  misc_feature 1..697: note = hyper
  source 1..697: mol_type = genomic DNA
gcggttcagcgactgcgcagctcccacccattcccaacccccgcccgctaacgttccccggcccggggctgccgagtccctgcgtcctgccggggcggtggttaagcggcccctaggcccggctccggcgtggtctcctccgcccctccccacagggcccgcgatcccagaggctgggcaggggtcgacatccgtggctcggcagctcgaaaaggctcccgcgtagagctgctcctgctggagatcgcggacccagagacccgccctctccgcgtcagtctctttgaccgagcggctctaccgttgagacggcactcaccccacgaatatcccagtacccgagaaccatagacgactcgcacgacatggtgacgggcttccgagccttcgaggactagggaaactgtgagcgggaggggctttatacccgacataagggggcggggcccacgcgcgggcgccctgactccgcctccgccccgttctccgtcccttgcctccgcggctccacagggccgtgcgcaggcgcgactaatgccggcgttggggttcagggcctggcgaccccgaggcgggacccgggcaggagtgctgcaggagagcaaaggacccgaggttgaggctcctcccttccccgcgggtgggagccagacttcattcattaatggtgccagtgaagacgcgaaaagcaccacta

SEQ ID NO: 67467 - DNA, 55 bp, Homo sapiens
  misc_feature 1..55: note = chr1:110305550-110305605
  misc_feature 1..55: note = hypo
  source 1..55: mol_type = genomic DNA
gtggtgtgtgtgtcccgggtgggggtggtgttagtctgtgcgggtcaagggtatg

SEQ ID NO: 67468 - DNA, 91 bp, Homo sapiens
  misc_feature 1..91: note = chr1:11036267-11036358
  misc_feature 1..91: note = hypo
  source 1..91: mol_type = genomic DNA
gctccatgggaacaccgtgggctgaacacaggcaagccagacggccctgcgggagaggagggaagggggtggggacatgcaccgcccagct

SEQ ID NO: 67469 - DNA, 475 bp, Homo sapiens
  misc_feature 1..475: note = chr1:110610423-110610898
  misc_feature 1..475: note = hyper
  source 1..475: mol_type = genomic DNA
cgccgtgggcaggaccccggtgaggcctcggtgcccttcttgggggttctcagcgttggcccagaagcctcagcccgggtctaagaacttgggactctcctcgactttggcgatcggccgggtcatccggctcagggcctcagcggcagcgggcaaaactctagtaggagtctcttgccgagggcgtgtttcgacgtcagagccaaactcgggacagactagccaagcgcggacggcgcgagagtggctggcagcgccagcacgcagcctgggttcagagcaaggctgggcgctctcagcaaagggcggcctggggctgcgcgggcggcggactgcaggcgggagaagagcgaggtgcgccaggctctggggcgcgcaactgcccagcctcgtgaaagatcgcgccgcagatggggcgcagctgcgcgctcactcgtgtggactggaaacgctccgagccggttattttaaaaac

SEQ ID NO: 67470 - DNA, 232 bp, Homo sapiens; identical to SEQ ID NO: 83
  misc_feature 1..232: note = chr1:110611045-110611277
  misc_feature 1..232: note = hyper
  source 1..232: mol_type = genomic DNA

SEQ ID NO: 67471 - DNA, 80 bp, Homo sapiens; identical to SEQ ID NO: 84
  misc_feature 1..80: note = chr1:110611434-110611514
  misc_feature 1..80: note = hyper
  source 1..80: mol_type = genomic DNA

SEQ ID NO: 67472 - DNA, 141 bp, Homo sapiens; identical to SEQ ID NO: 85
  misc_feature 1..141: note = chr1:110611653-110611794
  misc_feature 1..141: note = hyper
  source 1..141: mol_type = genomic DNA

SEQ ID NO: 67473 - DNA, 398 bp, Homo sapiens
  misc_feature 1..398: note = chr1:110612294-110612692
  misc_feature 1..398: note = hyper
  source 1..398: mol_type = genomic DNA
cagggaggccagcttagtatgagaaataagaatacagttattccgtcttgaggacagccctggcattgcacgaccagtcgcggccagactgtgccagtctgccgcacaggcagcacccttcctgtgaaggctaggcccggggaggagagacgggccaagaccaggccgcagtccccagccgaccccgatttgaccactctaggttgaggcccagcctcagggccctcaaagggcgccagacacaaaagccgcgcttcttcgtcaggtctcagtgtggctccacagccctcggccgggtctgggcttcagggtaggtggcagttccagtccaacttcggcagagcatgctctctccttcccaggtccaactgctttcgggccccgactggactccgggc

SEQ ID NO: 67474 - DNA, 21 bp, Homo sapiens
  misc_feature 1..21: note = chr1:110613458-110613479
  misc_feature 1..21: note = hyper
  source 1..21: mol_type = genomic DNA
ggagcccgggaaccccctccc

SEQ ID NO: 67475 - DNA, 876 bp, Homo sapiens
  misc_feature 1..876: note = chr1:110626790-110627666
  misc_feature 1..876: note = hyper
  source 1..876: mol_type = genomic DNA
ccctcgcgtggccgggcgcagatccccgtgcacgggtcctccgcacacccttgccagcccgcagggattgttcgccgcgttggtgactccttcccaaaatgggaataaaagatcgaaatagctagtaagcatgcaaagtttattgtcaacctcaagtctctataaaaccagatcaaagggaacaggcgtttggtttcttcccagatcgctggggggcctcggggctcaggaagccccaggagtccagcccgctgccgctcactgcgctcttctctccagccgggtccaagggctcgagcatcgcaacctgcggcctgagttggccccgggcgcacgcgagggaaatggatgcagtgcccgtgaacttggggcctgaataattgataacaacccgctgggtgcccgtcgcgcggccaggcctgcggggagcggagccggaggcagcaagcaaaggaaacgcacgagccgggagcgcgggcgcgcggggccacgaaagaccgaccgactgtccgacgggcggtgggacaagaggacggatgctgtgggggggccccggaacccgccgccacaactcgcggcccacgcgggtcgcagccgccagccgtagggagctgccgagcagcgacgttccgcattccatcgggttcccgcgccctactgggcttgtgcggcgcagtgcctgcgtgtgctttcgttttctcaaggccattctgataaaacatacgtgctggttccctttcttttctcagaatgattcttcaaggcgaatgactcgaaatggagatttcttctaacaccgcgtgatcaccgacaacttttgcaggacgggatgaaactcctctgggtttccagtcagatgtgcgagtgggctctctt

SEQ ID NO: 67476 - DNA, 249 bp, Homo sapiens; identical to SEQ ID NO: 26525
  misc_feature 1..249: note = chr1:110672833-110673082
  misc_feature 1..249: note = hyper
  source 1..249: mol_type = genomic DNA

SEQ ID NO: 67477 - DNA, 269 bp, Homo sapiens; identical to SEQ ID NO: 26526
  misc_feature 1..269: note = chr1:110673083-110673352
  misc_feature 1..269: note = hyper
  source 1..269: mol_type = genomic DNA

SEQ ID NO: 67478 - DNA, 613 bp, Homo sapiens; identical to SEQ ID NO: 26527
  misc_feature 1..613: note = chr1:110692884-110693497
  misc_feature 1..613: note = hyper
  source 1..613: mol_type = genomic DNA

SEQ ID NO: 67479 - DNA, 560 bp, Homo sapiens
  misc_feature 1..560: note = chr1:110693736-110694296
  misc_feature 1..560: note = hyper
  source 1..560: mol_type = genomic DNA
cgtacgcacgggttggacaccgggcttcagcttctggtgctcagaagggcccaagaactccggaggaaattgggcttagctgcggaggcaagcgcccgcggagaaccggagggggcctgtccggcccatccgcggcttgaaactgcgcgcccagggcgcagttccactgggagcctcttacgcagctggagaccccagccccagccgctcggcctcaggcctgtgaccttgacagtaacattggcaagcgaagcagaactgtcacgcccgagatgaatatttaattctcagtcctggggctggtcctcgctggattcggagctagcagagagcccttcctccctcgtgggaagcgcatctggggaacggaatggctgagacaggggacgtgcgtgtggtgcccatctggagggggcgccgtcctggcgggtcgagaggcctctgctgcatttatgcctgtgtgcgccgtgctctgaagcgatgctggatgctcgcagtactatgggtgggccgctccccaggggcgcggctgccttggaaagaagcgtgatgtttccttt

SEQ ID NO: 67480 - DNA, 159 bp, Homo sapiens
  misc_feature 1..159: note = chr1:110726609-110726768
  misc_feature 1..159: note = hypo
  source 1..159: mol_type = genomic DNA
ctctagcatggagatcgccaacacttccgcaactccaagatagacagtttttcacatttgaacatctctgaaagcacgctgtttccgacgatcagtgaggcaattatacaagcctgttttttctgtttttgttggttttttttgacggagtctcgctct

SEQ ID NO: 67481 - DNA, 104 bp, Homo sapiens
  misc_feature 1..104: note = chr1:11073857-11073961
  misc_feature 1..104: note = hypo
  source 1..104: mol_type = genomic DNA
cggtgctgctctccacggttacagcccagtttccaggggcgtgtgggcttcgctacaggaatccagtgtctcagtgtatgagaggtgtccggctggtagaagga

SEQ ID NO: 67482 - DNA, 241 bp, Homo sapiens
  misc_feature 1..241: note = chr1:110754116-110754357
  misc_feature 1..241: note = hyper
  source 1..241: mol_type = genomic DNA
ttcttatgatcagctcggtgtgtgtctcctcctaccgcgggcgcaagtcggggaacaagcctccgtccaaaacatgtctgaaggaggagatggccaagggcgaggcgtcggagaagatcatcatcaacgtgggcggcacgcgacatgagacctaccgcagcaccctgcgcaccctaccgggaacccgcctcgcctggctggccgaccccgacggcgggggccggcccgagaccgatggcgg

SEQ ID NO: 67483 - DNA, 765 bp, Homo sapiens
  misc_feature 1..765: note = chr1:110883470-110884235
  misc_feature 1..765: note = hypo
  source 1..765: mol_type = genomic DNA
cgcaccatagactaccgaaaaggtgatagttgggcatatatccagtatgaaagcctggatgcagcgcatgctgcctggacccatatgcggggcttcccacttggtggcccagatcgacgccttagagtagactttgccgacaccgaacatcgttaccagcagcagtatctgcagcctctgcccttgactcattatgagctggtgacagatgcttttggacatcgggcaccagaccctttgaggggtgctcgggataggacaccacccttactatacagagatcgtgatagggacctttatcctgactctgattgggtgccacccccacccccagtccgagaacgcagcactcggactgcagctacttctgtgcctgcttacgagccactggatagcctagatcgcaggcgggatggttggtccttggaccgggacagaggtgatcgagatctgcccagcagcagagaccagcctaggaagcgaaggctgcctgaggagagtggaggacgtcatctggataggtctcctgagagtgaccgcccacgaaaacgtcactgcgctccttctcctgaccgcagtccagaattgagcagtagccgggatcgttacaacagcgacaatgatcgatcttcccgtcttctcttggaaaggccctctccaatcagagacagacgaggtagtttggagaagagccagggtgacaagcgagaccgtaaaaactctgcatcagctgaacgagataggaagcaccggacaactgctccc

SEQ ID NO: 67484 - DNA, 29 bp, Homo sapiens
  misc_feature 1..29: note = chr1:11089945-11089974
  misc_feature 1..29: note = hypo
  source 1..29: mol_type = genomic DNA
gctgggattacaggcgtgagccacacctg

SEQ ID NO: 67485 - DNA, 19 bp, Homo sapiens
  misc_feature 1..19: note = chr1:11091314-11091333
  misc_feature 1..19: note = hypo
  source 1..19: mol_type = genomic DNA
tcatgcctgtaatcccggc

SEQ ID NO: 67486 - DNA, 42 bp, Homo sapiens
  misc_feature 1..42: note = chr1:110949152-110949194
  misc_feature 1..42: note = hypo
  source 1..42: mol_type = genomic DNA
attaagttctagggccgggcgcggttgctcacgcctgtaatc

SEQ ID NO: 67487 - DNA, 62 bp, Homo sapiens
  misc_feature 1..62: note = chr1:11095139-11095201
  misc_feature 1..62: note = hypo
  source 1..62: mol_type = genomic DNA
gacgcactgccccaccgcctcggtgcacgtctatgccacctaggttacgtatttcatcactc

SEQ ID NO: 67488 - DNA, 165 bp, Homo sapiens
  misc_feature 1..165: note = chr1:111039979-111040144
  misc_feature 1..165: note = hypo
  source 1..165: mol_type = genomic DNA
gtgctttcctgagtccgcgcttttcctgggagtcccagacgcagaccagtcagggtgagagtggactgggaatccaagaatcttcagaaattattcttcggcttgaaagtctgatgaatgaactgattacggctggtgcagaaagtgccccgtggacactctatc

SEQ ID NO: 67489 - DNA, 30 bp, Homo sapiens
  misc_feature 1..30: note = chr1:11104788-11104818
  misc_feature 1..30: note = hypo
  source 1..30: mol_type = genomic DNA
gtaggcagagaggagcgcaccccgccgcct

SEQ ID NO: 67490 - DNA, 674 bp, Homo sapiens
  misc_feature 1..674: note = chr1:111097796-111098470
  misc_feature 1..674: note = hyper
  source 1..674: mol_type = genomic DNA
aggaatcagcattcccgttgtagagatcggtggaccgatgctctcagaggcttccacaagcgtttgtattgtttggggcggtcggaactcagcgctgcggaagccggtgtatctgagtctctccacgtggctctacttttctgcagccctgtagaaataaacctgggtcctcgctccctggcctggggaaggaggtctgcaggggtctgtgggggccctggaggcgccttcccagctgcacaggctcagtcggaccagcagaggtcactgcgtgggaaagagtggggcgccaacccgcgcagagcccagccggcgaccgcccccgcgtccccgcggagctccctgccttctgccgcagtcctccgagggctgggcttctggggcaggtcatggctattgcaaccaaagggaggcccgggtgccagtgggcggccgccgcggtgtggagggcgccagggcggtacggcgcagcgggccgcactcttgggacgccccgcctgctctgcggagcctgcctgggatgccctttcctggtcacggactccgccggcagccggggcgggacggaccagaggctaccaactgggggcttctgctgcctgggacacggggatccacattgccgtccgaatcccatcgccaaagcctgtatgtgcagccgagtgggagagtgg

SEQ ID NO: 67491 - DNA, 947 bp, Homo sapiens
  misc_feature 1..947: note = chr1:111149588-111150535
  misc_feature 1..947: note = hyper
  source 1..947: mol_type = genomic DNA
ccaccagctcctctccgtgccctccgccccgcgccacgcaaaccccagagggtcccgagcccattctgtgcactcttcttgagcagggtgcaagttccccttgatctccccggtctgggacctgccgagcagacggcagtggtcggcaagggcttgccgccgcggactcagcccaagcctgctgcgctgcaggctgcgccgccgggtgccccgcagcccctctgggcgccgcagccgggcagggaaggcagcacgcgccgcgcaacgccccgacacggatttacccttccggatgggcaccggggcctccatgttcctaggttacggccagcgccggcagaaccccggcagcgggcggcggcggggtgcgggcggccagccgggagccggctctgcagtcccgcgggcggcgcgtacggagctcccggccgccgcccgcagccgcaccgcgccacgcagcgccgcacctggctcgacggcgaactcgaattaaaggggccggcgggggccggggccggggccggggcgacaagctgccctccgccgccaccgagctcgtcacctcgttgggcccccgggcctcagcccccgccccgcgaggaaaacattctttggcagagcccgacttactaaccagaacctccaggagagctcagctgggtgctgccgggccggggagatgggggagggcagaagttgaggggcactggtgagaggctcctgccaacgtaatgaagtaggcaaggaggagataatcaatagcagctaccccaggcccacagcgggatccagccccgggagagacgtgttgctattattgtggtgcctccagacaggatctgcagacccctttcttgccctttctcccgccagcgcgaccccttctccagatcggcttcccacctccctgttacccagcaaagatttggcttcgcagggaaatgcag

SEQ ID NO: 67492 - DNA, 30 bp, Homo sapiens
  misc_feature 1..30: note = chr1:11115120-11115150
  misc_feature 1..30: note = hypo
  source 1..30: mol_type = genomic DNA
cggctcctggaagttcgtgctctggggacc

SEQ ID NO: 67493 - DNA, 30 bp, Homo sapiens
  misc_feature 1..30: note = chr1:11118714-11118744
  misc_feature 1..30: note = hypo
  source 1..30: mol_type = genomic DNA
ctactgaaccctccccgaccaggtgttttc

SEQ ID NO: 67494 - DNA, 38 bp, Homo sapiens
  misc_feature 1..38: note = chr1:111204435-111204473
  misc_feature 1..38: note = hypo
  source 1..38: mol_type = genomic DNA
catcataatgtcagccgggcgcggtggctcacgcctat

SEQ ID NO: 67495 - DNA, 278 bp, Homo sapiens
  misc_feature 1..278: note = chr1:111216695-111216973
  misc_feature 1..278: note = hyper
  source 1..278: mol_type = genomic DNA
tgaggatgaccagcacggacacgatggcgatgccccgggccggcccggagctctcggggtactcgaagagcagccacacctggcgctggaagtcgcggcggggcaagggccgctcctcctcccgcaggaagccctcgtcctcgcggaacttctccatggcctcctcgcccagctggtagaagcggatctcctcggagaaaatgtcgatgggcacgttgaccggccggcggatgcggcccccggactgatagtagtagaggatggcgtcgaagctgggc

SEQ ID NO: 67496 - DNA, 381 bp, Homo sapiens; identical to SEQ ID NO: 89
  misc_feature 1..381: note = chr1:111217194-111217575
  misc_feature 1..381: note = hyper
  source 1..381: mol_type = genomic DNA

SEQ ID NO: 67497 - DNA, 136 bp, Homo sapiens; identical to SEQ ID NO: 90
  misc_feature 1..136: note = chr1:111217576-111217712
  misc_feature 1..136: note = hyper
  source 1..136: mol_type = genomic DNA

SEQ ID NO: 67498 - DNA, 179 bp, Homo sapiens; identical to SEQ ID NO: 91
  misc_feature 1..179: note = chr1:111217713-111217892
  misc_feature 1..179: note = hyper
  source 1..179: mol_type = genomic DNA

SEQ ID NO: 67499 - DNA, 145 bp, Homo sapiens; identical to SEQ ID NO: 26537
  misc_feature 1..145: note = chr1:111217923-111218068
  misc_feature 1..145: note = hyper
  source 1..145: mol_type = genomic DNA

SEQ ID NO: 67500 - DNA, 42 bp, Homo sapiens
  misc_feature 1..42: note = chr1:11124188-11124230
  misc_feature 1..42: note = hypo
  source 1..42: mol_type = genomic DNA
gctgtcagagacctccgctttgagctgcgctgccatagagct

SEQ ID NO: 67501 - DNA, 201 bp, Homo sapiens
  misc_feature 1..201: note = chr1:11131698-11131899
  misc_feature 1..201: note = hypo
  source 1..201: mol_type = genomic DNA
cagagtaaaaggcagcgtcatcccgtgggcctctgctggctccttccccatctcctgctcttctctacccgctctgctcatgcaggcccacttgctgctgctcagcatgcccagtgaactagccccagggcctctgggctcgctgtgctgtggctccagaactcttctctaggtcactgcaggtctcgtcaatgtcgcatt

SEQ ID NO: 67502 - DNA, 43 bp, Homo sapiens
  misc_feature 1..43: note = chr1:11139758-11139801
  misc_feature 1..43: note = hypo
  source 1..43: mol_type = genomic DNA
gcttcttaccttgagcaggggcatctctcgggcctgctggatt

SEQ ID NO: 67503 - DNA, 30 bp, Homo sapiens
  misc_feature 1..30: note = chr1:11141247-11141277
  misc_feature 1..30: note = hypo
  source 1..30: mol_type = genomic DNA
taatgggtgtcatcccgggcgtagctgagc

SEQ ID NO: 67504 - DNA, 715 bp, Homo sapiens
  misc_feature 1..715: note = chr1:111505931-111506646
  misc_feature 1..715: note = hyper
  source 1..715: mol_type = genomic DNA
tgagtcacataagagcgtcggccatcttggttttcatctcccgtggagatctactcggtccgcctattaaacttgagacgctggggtcccgcggagccgctgtgtcaggctctaaagaggttttacatttcccagaggaaagcgctctatgggctttaagcgccgcggagacaagcgcttcccgcctgggtggcgcactctgcgggctccaactcctctcaactacacagcgtccggaaacgacggccgactccacatccctaagacggacagaggggcagccgtggggaggattcgaaaccggtacttaccaacgcgaggcgttgcctgaattttcctctgcgggtttcaggaagaccctccgtaggttatttgacattttagtggggagaaaggggacacctcatccagaaaagtgggaagcgtggggccgagtttcccaatggggcgagaaccagagcgagggaatgttgggctggagttgcccacagcaactgtgaggggttcgaccttaacggagggcgacagcgggctctcgagagggtgtatccccaggcttcgggacgaggtcgcgcaccgcgcagaaaccggaaggctcctggcggtggactgcgccctcacagccctacgctgagagagaatcggcgtgagtctccgccctcagagcctacgacaactctccagactccgccggagcaggcgcagggggcgtggc

SEQ ID NO: 67505 - DNA, 41 bp, Homo sapiens; identical to SEQ ID NO: 26539
  misc_feature 1..41: note = chr1:111813546-111813587
  misc_feature 1..41: note = hyper
  source 1..41: mol_type = genomic DNA

SEQ ID NO: 67506 - DNA, 110 bp, Homo sapiens
  misc_feature 1..110: note = chr1:11193073-11193183
  misc_feature 1..110: note = hypo
  source 1..110: mol_type = genomic DNA
gcacacaggaggacacgagccagccagggtgctgggtctcacaggtggcctgcttctgatcaccttgtaccagctgcggtcgtgctctgtggcggcgctgtagtactgca

SEQ ID NO: 67507 - DNA, 199 bp, Homo sapiens; identical to SEQ ID NO: 39035
  misc_feature 1..199: note = chr1:112084890-112085089
  misc_feature 1..199: note = hypo
  source 1..199: mol_type = genomic DNA

SEQ ID NO: 67508 - DNA, 16 bp, Homo sapiens
  misc_feature 1..16: note = chr1:112192214-112192230
  misc_feature 1..16: note = hypo
  source 1..16: mol_type = genomic DNA
acgaccagaatattag

SEQ ID NO: 67509 - DNA, 496 bp, Homo sapiens
  misc_feature 1..496: note = chr1:112282866-112283362
  misc_feature 1..496: note = hyper
  source 1..496: mol_type = genomic DNA
cgctctcgcctttggcgaagcgctctaaggccgggacgctcctttgttattcaaaaggagccgggcgagcgccagccaggccctggaggatggagttgcggccaataggctcgataggccgatgggctccgcagaccggtggggggtgctcctcccagcccagccctggacgccgggctccgcgcccgccagcgctgctccctcccagcgcggagacgccgcgcccggccgggacagccggggacggtggcggagagcacggagagtaattaagcaattagcgacgtgttgttaaaaggtaattaacggggaaaagtttgccccaggcaggattagaggtctctgagtgggacaactgtaagaacaccagagaaggcacgaacggtgccggcgccgccatcggtccgtccgtggcagccaaaagtgccagatatgctaactattgaaagatgcgcgggtggcgcacgcctgtaatcccagcactttgagaggccga

SEQ ID NO: 67510 - DNA, 279 bp, Homo sapiens
  misc_feature 1..279: note = chr1:112531573-112531852
  misc_feature 1..279: note = hyper
  source 1..279: mol_type = genomic DNA
ttcgatccctctccccggggccgcgacggcccttggcgtcacgtagagacctttcccagagctcgcggggtggaagtggcgtcgggcaggaccagatggactggcccccagcctctggtagacacaccgccggctcgccgagctggagaactttgcgaagcgccccaaaccgctccgggtttccactttcagccatttctctccttgtcccctcaccaagagcggggacggagcaagccttcgccacctgtctctggcacccgccgagggaagacaggc

SEQ ID NO: 67511 - DNA, 679 bp, Homo sapiens
  misc_feature 1..679: note = chr1:112533107-112533786
  misc_feature 1..679: note = hyper
  source 1..679: mol_type = genomic DNA
ggtggcagggagggccggcgtgtgcgcgcgtggggtatgtgtgcacctagctgtgtgtctatttctcgctgactgtccacagggcagcagcacctgcttgagaccaagcccggcgacctggcaaggtggggccccctaccgcgcaatctttgcggctggcccccggctctcagctccgagtgcagaggctgaagaggtacccgggggacacactgcctctaaccccacctatgagccgctctcctctcggaggacgaaggcaccatcagaaggtcgagattcgccctcctctcccgccacgtctacccactacctagaccgggagtctggacttgggagcgtgaactctcacccgagccggtccccttacaactggagcccgcccagcccctcagtccctccctgaagcccatgggtccccactgctccgtgcctcgtcgacccaggatggggagtgggaaggtcagcatgtgcccacagggccaggtgtccggcccagattcccaccctcagggcggcggcgcgcaaagggcgcagtccccgccgctgggcggacccgcggctccggctttcccggtgtctccagcctcggtgcccggaatcctggatctcggcctggcgctccggaagcgaggcagctccgtgccccagcagggacggggaacgcttggcttgagag

SEQ ID NO: 67512 - DNA, 152 bp, Homo sapiens; identical to SEQ ID NO: 39037
  misc_feature 1..152: note = chr1:112784462-112784614
  misc_feature 1..152: note = hypo
  source 1..152: mol_type = genomic DNA

SEQ ID NO: 67513 - DNA, 102 bp, Homo sapiens
  misc_feature 1..102: note = chr1:113051583-113051685
  misc_feature 1..102: note = hyper
  source 1..102: mol_type = genomic DNA
tccgcacactaggcccgcagctcccttcagcgccgcagaccccctgacaccgcacccggtcctcaggcagcgcgccccagaccccgggttcggcacgccgtc

SEQ ID NO: 67514 - DNA, 57 bp, Homo sapiens
  misc_feature 1..57: note = chr1:113052056-113052113
  misc_feature 1..57: note = hyper
  source 1..57: mol_type = genomic DNA
cgtcctggtggtaagtgtggctctcaggctgggcgggtgaggcgcttggtaggagag

SEQ ID NO: 67515 - DNA, 671 bp, Homo sapiens
  misc_feature 1..671: note = chr1:113392209-113392880
  misc_feature 1..671: note = hyper
  source 1..671: mol_type = genomic DNA
cccaccccctggagacgtggtctcccctcccgcgagggtccctccgaccccacccgggcaactagggcaccgcgggctgttacccaactaaccattaagcgcggagccgagcgcgtgcgtggcacggagaggcggggcgggtctggtctgcgctctcggcaccatgcggcccccaagacgtagagcttccctgcctcggtttgaagggaccgctgggctgcctgattacgcgcccccggccgagcctgcgcactggggacgcagtcggccctcgcgtcctctgctgcccgaaacaagcgcgtggaaagcttggtcggggcttctcacagccgcgcgcacagactggttctccccccgcgtctcccgggagcgtcgccgccacctgcacgcgtccggcacacaaacgtcggtctcaccccttagtttctggaagagaaaaaggaaaagccaccgagaggcctgaccctgaggggtcggggggagatgcgggcgcgtagtagagggaagcgactgaggagcggggactgggcagcatttgaatggatgcgggtgccgctggcacccgggaagacgcctgggagccggcgctggggagccgggcatgggctgggatgtgtttggattccaatctgggcctgacaccagttcagtgacctcgggaagttccccaa

SEQ ID NO: 67516 - DNA, 135 bp, Homo sapiens; identical to SEQ ID NO: 26545
  misc_feature 1..135: note = chr1:113497971-113498106
  misc_feature 1..135: note = hyper
  source 1..135: mol_type = genomic DNA

SEQ ID NO: 67517 - DNA, 81 bp, Homo sapiens
  misc_feature 1..81: note = chr1:113498107-113498188
  misc_feature 1..81: note = hyper
  source 1..81: mol_type = genomic DNA
ccttggctgtggggaatgcggctctccgcaccactctcgcaagtcaccaggtggggcaaggatcggcgggccaagaaggtt

SEQ ID NO: 67518 - DNA, 30 bp, Homo sapiens
  misc_feature 1..30: note = chr1:113617180-113617210
  misc_feature 1..30: note = hypo
  source 1..30: mol_type = genomic DNA
actaactgagcagcacgtttattaactgac

SEQ ID NO: 67519 - DNA, 86 bp, Homo sapiens; identical to SEQ ID NO: 39038
  misc_feature 1..86: note = chr1:113751201-113751287
  misc_feature 1..86: note = hypo
  source 1..86: mol_type = genomic DNA

SEQ ID NO: 67520 - DNA, 30 bp, Homo sapiens
  misc_feature 1..30: note = chr1:11376239-11376269
  misc_feature 1..30: note = hypo
  source 1..30: mol_type = genomic DNA
acagcttctatttcacggagccatctcaga

SEQ ID NO: 67521 - DNA, 30 bp, Homo sapiens
  misc_feature 1..30: note = chr1:11380230-11380260
  misc_feature 1..30: note = hyper
  source 1..30: mol_type = genomic DNA
actccactcccactccggcggcctgttcca

SEQ ID NO: 67522 - DNA, 42 bp, Homo sapiens
  misc_feature 1..42: note = chr1:11417975-11418017
  misc_feature 1..42: note = hypo
  source 1..42: mol_type = genomic DNA
taatttgcatcgctgcggaaagcagggcgcatgcaggcggag

SEQ ID NO: 67523 - DNA, 59 bp, Homo sapiens
  misc_feature 1..59: note = chr1:114355897-114355956
  misc_feature 1..59: note = hypo
  source 1..59: mol_type = genomic DNA
gtatttatttagagacgggcggggcggggctcggtgtctcaggccggtaatcccagagc

SEQ ID NO: 67524 - DNA, 120 bp, Homo sapiens
  misc_feature 1..120: note = chr1:114448980-114449100
  misc_feature 1..120: note = hypo
  source 1..120: mol_type = genomic DNA
aaacttgcctcatcttaagaatccacctaatgtgctgggtggttctccagctctctccccaccccacccttaagtctccaagagattaagatcaggagtaagtttgggaattgctgacta

SEQ ID NO: 67525 - DNA, 378 bp, Homo sapiens
  misc_feature 1..378: note = chr1:1145504-1145882
  misc_feature 1..378: note = hypo
  source 1..378: mol_type = genomic DNA
acaagtgcagtgagacgtcttagccctcgggagtgtttctcttcagcccctgacaccatggaggcgaacaggcacctccgcctcccgagggacacagatgtcgcttagacgcccggggtgtcttccctgcgggaagcctgcagggctgctcccgccttgttcccgagctgtggcctcgggcgtgactggcgctcgggagcaggctctgtgctgctcgaaggataccccactcccagacaccagcttgagaagattcccgcacggccggggacggccccagggccttgggagcgtctgtggacacctgtggtgtgggccgaggagctgggagctcatctgaacacgccagcactcgcgcatccacgctgctggcggatg

SEQ ID NO: 67526 - DNA, 240 bp, Homo sapiens
  misc_feature 1..240: note = chr1:1146646-1146886
  misc_feature 1..240: note = hypo
  source 1..240: mol_type = genomic DNA
ctctccagtcagaggcgggcacggcccaagcctccatgccacaggtgtgcagcccacagtgccggtcggagactcccgtctgccaaggtttttattgtggtcccgcggggcaggaggtatgcatggcatacgtaagcagagagccggaggcagccatcggcacctagaacggtgcagagttggcccaggagcgtggcggggcaggcggcctgcacctgccctgctcgcccagcagaccct

SEQ ID NO: 67527 - DNA, 383 bp, Homo sapiens; identical to SEQ ID NO: 26547
  misc_feature 1..383: note = chr1:114695312-114695695
  misc_feature 1..383: note = hyper
  source 1..383: mol_type = genomic DNA

SEQ ID NO: 67528 - DNA, 41 bp, Homo sapiens; identical to SEQ ID NO: 1801
  misc_feature 1..41: note = chr1:114695696-114695737
  misc_feature 1..41: note = hyper
  source 1..41: mol_type = genomic DNA

SEQ ID NO: 67529 - DNA, 384 bp, Homo sapiens
  misc_feature 1..384: note = chr1:114695799-114696183
  misc_feature 1..384: note = hyper
  source 1..384: mol_type = genomic DNA
cgcacggacccggggacctcgacactcgctaggaggcaagccctattcctcagccgggcgcccctcgtctcccgctctctccatggacccctctcctggcaaatcgcccgcagagcgagcttggagatgcgagggaaactgaagccccaagggtgccccgtcctgggagcctggctgtctgcggggtcccccgcattccgcagtagtaatacaggagggccgggggcttctaccccaacctccgctccccttcgggtctctcctggctgtgcaagcgatgggccagagggctggacgaggctggctcccaatccagaatcccgagctggggagttctctctaggttctggggctcctgggaccggggctttggggaagggagat

SEQ ID NO: 67530 - DNA, 52 bp, Homo sapiens
  misc_feature 1..52: note = chr1:114696412-114696464
  misc_feature 1..52: note = hyper
  source 1..52: mol_type = genomic DNA
tgccgagcagcagctcgaacccgcgccccggccgcactggggcggggcacga

SEQ ID NO: 67531 - DNA, 676 bp, Homo sapiens
  misc_feature 1..676: note = chr1:114696540-114697216
  misc_feature 1..676: note = hyper
  source 1..676: mol_type = genomic DNA
cgcccctcacgtggcatcccgcggcagctggcgagtctggcgcctcgcggccgccccctctacactcagggactggcctgagtccggggggtgggggtttcgaggcgggaagccgggctgtcccgaatctcggagggtgcaaggccaggaaagagtccgggttcccactccgcattcactgcctggtgtgaccttgggcgtctctgagcctcaattttcctctccgtaaaggaggtgtaatgattttaagtacttcacggactccctggggatagaaagatcgtgtttgtgaaaacactgggtaaactgccacatgccacacgaatgacagagaaatagataaccccgtaacagaaagagcgacggtcaggcagggtctgggaggaccttggccgaggttcctgacgggagcagttagactggcccccgagtcccagcttcggaggtagaagaccccaagacaggcgggcgatgcgaactgcaagactttccgagctccgcaatcctgcggtccgcggtacccgcatgttgctatggcgacgggaggcagcggccgtctctctccatggcaacgggagggaaaagtttctggcaaacaggaatggggggtcatttcaagagggcgcagggcgctcagttccgccgacccacctccttgcttcggtgaaacagcacc

SEQ ID NO: 67532 - DNA, 257 bp, Homo sapiens
  misc_feature 1..257: note = chr1:114697661-114697918
  misc_feature 1..257: note = hyper
  source 1..257: mol_type = genomic DNA
cggagggaggagattcggagccttagctcctggcggtctccactgcgcgccatctgtgccaaccggcccttggacttgcgatcccctagcagctggtgcctggggcaccaagggctaaggcaaggcctgtgaggaccctggcccagccaggcggcttttccaccgtgaggcgccccctggctctgtccacggtgctgaagacccagttggtgctaccatcgcgtgggcataagtttaggggacgagggagaggcaat

SEQ ID NO: 67533 - DNA, 96 bp, Homo sapiens
  misc_feature 1..96: note = chr1:115055222-115055318
  misc_feature 1..96: note = hypo
  source 1..96: mol_type = genomic DNA
tcaagccgtgctcctcgcaattacctgggaccgtagatgcacgccaccatgacttagctgatcttttttttccctttgcctcgaagaggctggggt

SEQ ID NO: 67534 - DNA, 1123 bp, Homo sapiens
  misc_feature 1..1123: note = chr1:11538873-11539996
  misc_feature 1..1123: note = hyper
  source 1..1123: mol_type = genomic DNA
tgcaggggcggggaccgacccccaggggtcgctgcgccttgcgcttcccccgcccgcgggcgccagggccgggctgaaccaccgcgcggatcggcagggggagcggcggcgaagacagcgccagacagcgggtcccagagaccgcagcgcgcggcgtggcgcagggtctcgccggccactgattcaaggcgcggcggcgcggagcccgagaggcgccagggattgggcggcagcgcggctccggagcctggctcggacacccccgcgacccgtggtaggagcccggacccaaacaaaggcgggcggcgaataaaaggcggcggcggagcggagtgctcgggttgcgagctgaggactgggattcgcgcgcagcttcccgcggtctgcttgccctggagcggagggggagccccagcctcctgcggctccgagaagcttccccctgcgacttccgcgaggagacgagtctgcgcagcgtggtggccgccgccccccgaccctctgcgcactctctcccgcgccggcggctcagcctagccccgttcggccggccgaggtgagtgcacggccgcggggcgccatccgggcttggtctcggggctgggggatgcattgctaggaggagggggaagtcctccgcgccgtccgcaccccgacctgcttggcgccgcgcgcgaagttctctcgctctccagccagcccgggatgcgggcctcggagccccccgggaaagacggtcaggggtggacagaacccaagcttgccctctacgaccgggccccagctccgcaccatctccccgcgggactgcagcattcttggtcggccaaggggagttggatgttggatgtccaggaacggcaaggcttccgacctctggcccctgcttgtcccctctgagggatatctgggtccataaaagttgagcgtcagtctgaagccgcccttggatcgggctctcgcccatgctagagcggagggaggggacagagtaaggctaatgaccccctccacccactccctacctagcgtactcgtgctctcggagggacatttccccgattaacctggctgcaggtccggccggggagggcgcgtgggggcttggggcgggccgggccag

SEQ ID NO: 67535 - DNA, 140 bp, Homo sapiens; identical to SEQ ID NO: 26052
  misc_feature 1..140: note = chr1:11540039-11540179
  misc_feature 1..140: note = hyper
  source 1..140: mol_type = genomic DNA

SEQ ID NO: 67536 - DNA, 17 bp, Homo sapiens
  misc_feature 1..17: note = chr1:11540380-11540397
  misc_feature 1..17: note = hyper
  source 1..17: mol_type = genomic DNA
cgcgcacactcacaccc

SEQ ID NO: 67537 - DNA, 94 bp, Homo sapiens
  misc_feature 1..94: note = chr1:115631944-115632038
  misc_feature 1..94: note = hyper
  source 1..94: mol_type = genomic DNA
gccccctgccctgaccggccctcccggctcctggtctcacccagaagagcaggttgaagccaagcagcaggtacttgatgcaccgcaggccccc

SEQ ID NO: 67538 - DNA, 533 bp, Homo sapiens
  misc_feature 1..533: note = chr1:115632104-115632637
  misc_feature 1..533: note = hyper
  source 1..533: mol_type = genomic DNA
ggggagcggcaggctccggcggggagggggcggagcggggaggaccggggcggggcctccggggggcggggcggggcccggcggggaggggcgcgtggaccccaagcggcgtggctggcgacgggtgggggcgccagcgggtggagatcgagcagcccgagggagcacgttcgctcttctcccggacccagggaccaccttccttccctccagtgggcgcaccgccgccggctatcggagcacctgcagggcgggagcgcccaccggggactggggacccatttaatcagcgccctgtgcggagaccggtttgaggcccgggcgatgcttgagggataagcacttggtctcgtggctatggaaatctaggaaggtgacctcgggtagaagagctaagtggggtcggaggttgccccgaagctggcaggaccagtcgcggggcacctgactgagtgtccagggctgcggctccgcggcgcggagcaagcacacaagcagcttctaggggaccctccctccggcccctcccccct

SEQ ID NO: 67539 - DNA, 30 bp, Homo sapiens
  misc_feature 1..30: note = chr1:115828832-115828862
  misc_feature 1..30: note = hypo
  source 1..30: mol_type = genomic DNA
tttgagtcaatgccccggcacccgctgtca

SEQ ID NO: 67540 - DNA, 170 bp, Homo sapiens
  misc_feature 1..170: note = chr1:115880037-115880207
  misc_feature 1..170: note = hyper
  source 1..170: mol_type = genomic DNA
actcaaggcgctccccgccctaaccttccacgcccgcttctcccacacctggcagcagacagctggagatgaagcgtgtgacccaagtggcagggctgaaccttggcgacctctacctgaggttgtccaacgcggctccgtggagggccccggtacgccggacggacccc

SEQ ID NO: 67541 - DNA, 587 bp, Homo sapiens
  misc_feature 1..587: note = chr1:115880208-115880795
  misc_feature 1..587: note = hyper
  source 1..587: mol_type = genomic DNA
gcgttggctcgcagacttcctgcgttaacccccggggccctcagtcacgactcccagcccttccgagacgcgctgagggaactgccccaggtctagcgcgccccgttccgctcctccccctacctgggggccgcgcagcactttccctactcggcgctcacctcagccagcgcgctctgcgctccccccgcggtgctggccgccactcctcccgccctggcgcgccagctgccggcgcatccctctccgcgcccattcgctctccctcacttgcgcgttatccacttctagccctcgagctagaccctggcatggccgtgggcttctgcaggcgccagggctgctccctggactgcaggccatcctgggactagggactccacgaccagaactaacgctgttccctcggtccgactcgtcctcccgcgagggtcccgcgcccccacacccactcgggacatttctcagggctgctcttcggcctgcgggagcctcgggggtaaccagagagctcgccagaccggtatccttgcaaactctcccgcgaagcccagccacccctgcccgcgcccgcgctgcgcccctct

SEQ ID NO: 67542 - DNA, 171 bp, Homo sapiens
  misc_feature 1..171: note = chr1:115880872-115881043
  misc_feature 1..171: note = hyper
  source 1..171: mol_type = genomic DNA
cgagctgctctcacacaggcttcttgaattcttagcccctcctcccgtactcctgagtcacacgctccaaatcctggcccccatccctcccctccccaccaccagccccgcacctgctgtggctgggctgtggtgcccggctggagggggtcctggggactacagacggat

SEQ ID NO: 67543 - DNA, 30 bp, Homo sapiens
  misc_feature 1..30: note = chr1:11591786-11591816
  misc_feature 1..30: note = hypo
  source 1..30: mol_type = genomic DNA
ctgggtgccatgctgcgtacttgcccgggg

SEQ ID NO: 67544 - DNA, 99 bp, Homo sapiens
  misc_feature 1..99: note = chr1:11596484-11596583
  misc_feature 1..99: note = hypo
  source 1..99: mol_type = genomic DNA
cttcttctgcatcatcgccccatttgccaagttcggcaagattgtggcactcaacacgggcgtgtccatcctctacacgctgaccgtcagcaccgccct

SEQ ID NO: 67545 - DNA, 30 bp, Homo sapiens; identical to SEQ ID NO: 26053
  misc_feature 1..30: note = chr1:11611023-11611053
  misc_feature 1..30: note = hyper
  source 1..30: mol_type = genomic DNA

SEQ ID NO: 67546 - DNA, 142 bp, Homo sapiens
  misc_feature 1..142: note = chr1:116213911-116214053
  misc_feature 1..142: note = hypo
  source 1..142: mol_type = genomic DNA
gggtgtgacttgacacggtgtgaaagtggaggggcgcgagcactcaggtgggtgaacagcctgcggcctcctttccctggctgcaaagccgccactcaactctgctccagcccaggtttcggggagccgggatccacttggg

SEQ ID NO: 67547 - DNA, 196 bp, Homo sapiens
  misc_feature 1..196: note = chr1:116214288-116214484
  misc_feature 1..196: note = hypo
  source 1..196: mol_type = genomic DNA
cccaggcaggggaggcgcagtgcaggttggactgtgtaaggaaatggcagcatggcgaggtttgtgccgcggcctacaagcagggctgcatgctccccaggcagactgtggcagagccaagcccctcacttgtagggaagcgtgtctcctaggtgccccagtaggggaggtctgccagcatcgctgtgctgtgggg

SEQ ID NO: 67548 - DNA, 45 bp, Homo sapiens; identical to SEQ ID NO: 39042
  misc_feature 1..45: note = chr1:116214942-116214987
  misc_feature 1..45: note = hypo
  source 1..45: mol_type = genomic DNA

SEQ ID NO: 67549 - DNA, 30 bp, Homo sapiens
  misc_feature 1..30: note = chr1:116247777-116247807
  misc_feature 1..30: note = hypo
  source 1..30: mol_type = genomic DNA
caactgagggtggggcgctggctggagcca

SEQ ID NO: 67550 - DNA, 166 bp, Homo sapiens
  misc_feature 1..166: note = chr1:116371021-116371187
  misc_feature 1..166: note = hyper
  source 1..166: mol_type = genomic DNA
caccgtgtccacaggcgcccactggtgtggcgtcctgagagtgcgtgcgtgagcgagcgagcggcttatcctagactgaagacccagggaaacagatctgtgtggaggatgtttctgttttcagcagaacagacgcagcccccgagtcagtgccgtcagaagacac

SEQ ID NO: 67551 - DNA, 407 bp, Homo sapiens
  misc_feature 1..407: note = chr1:116371188-116371595
  misc_feature 1..407: note = hyper
  source 1..407: mol_type = genomic DNA
tcagtcaattcagtggaaaacacttccagtgtgaggcgttcgccggcgccccttagacgcggccgggtctgaggcgcctgccgagcgaggtggcgcggcccgggagctgtggtcgaagcccctgggcctggcgtgtaggctgcgcgggcggcggcgggctgggggcggggctctccgccctccgcgcgggtccgcctggcccctcccccgcccaccccgcgcccgtcccgcctcccccaccttctcccagaggaggtgacagacgggcctgtaatttggttccattcgctcgactggagcaacacctgcccccctcccctgggacgcgagggtctcatcccaaaccagacaagaagccaaagacaaatcccagcccacatgcagatccgacgcggaaaggagcgcgg

SEQ ID NO: 67552 - DNA, 1644 bp, Homo sapiens
  misc_feature 1..1644: note = chr1:116380300-116381944
  misc_feature 1..1644: note = hyper
  source 1..1644: mol_type = genomic DNA
agaagtggctcatctcgggtgtctccacgaggttctcctggcctggaaaatcccccctgcgagcccccgggctcgccagacaaccccacctgcctgcgtcggaaaccttccctcgtcgccctgctgaccagagagaacaggtagcgagcttcttccccggccgtctctcgaggcggccgtctcgctgggccaccgcagcctccgccacccgagcgacggcgcccgtccggatccgtagcgtttcgcggacgccgggacaggcggccccccgcggcgcaccccgccctacacgtccaggacgtggttgagataggagatgtagcagatggccaggcgcaggatctcgatcttggagagcttcttgtccgggggcagcgtgggcagcaatttgcggagctcggcgaaggccaagttgaaggcttccacgcggatgcgctcgcgggtggcgtgggccgagcggtacttggccgtggcgcgccggcggcggcgcttctcctcgcggctcagctgctgcgggtgcgggtagagcgcggctcggctgccgcccttgccgtcgccctcggcctcctccaccggctccaggtccgacacgctgccgagcaccttggtgtccgtgccgcccagggactccggatccgagtgcgccgagctgggatggtccgaatctgctgcttggtccggactcagcatcattttggaggctgaggaggggtcggaaaattaatcagtaaaaggaatcagggtattttgctggaaggatggctgccgaggcctaccacgccggtcctcccagcggacgcgcggcccgggccccctccccacagcaggccggcgcgcgacgcgggagggcgccgataggatctggcccgagggcgcgagccctgcgcctcgccctggcgcgggagccggcggggacgcggttgacccaggccgcatactagactggacacctcgacttgcagacggccacagcgggcctgtggccctgggcctggggaacaaccgcaggcctgtggggtcgcgactgggtttttgtgcctcttccggccaaatgccaaccgcgctattcctcctccctcccttcgtccccttcccggacaaacgagcgatttcgaacaacgaatacatctgggttttcacgggggcggggagacgcggggtgcacttctcgccccgagggcctccggcgaagcaacccggcagccgcggcgcccgagggcctggcgctggtctggggctgcgccgggggcgcctggctctggggtgcggccggtcaggaatccccatcctggagcgcaggcggagagccagtggctgggggcgggaaggcttcttggacccctcgcgcttctccgaaatcgtaaagaaatgactaaacaaacgtgggggagcctttaaaaagaaaattgactccgatgccctcgcaggctcccggagcaccatctgtcacgcagacagccacacacataggggacctagggacacggcgacgtgggatcagacaatgcgcccggcagtctggcgaccaccttgcgggaaaatgccggcagccgggccgctgagggaggagaggatgcagagggaagggaagagaagggaagggcccggggcggggcaggcggggactagcgggtgcagcgcgtg

SEQ ID NO: 67553 - DNA, 111 bp, Homo sapiens; identical to SEQ ID NO: 26566
  misc_feature 1..111: note = chr1:116382387-116382498
  misc_feature 1..111: note = hyper
  source 1..111: mol_type = genomic DNA

SEQ ID NO: 67554 - DNA, 30 bp, Homo sapiens
  misc_feature 1..30: note = chr1:11645732-11645762
  misc_feature 1..30: note = hypo
  source 1..30: mol_type = genomic DNA
gggaagcttctgcatcggagaagggcacac

SEQ ID NO: 67555 - DNA, 61 bp, Homo sapiens; identical to SEQ ID NO: 39043
  misc_feature 1..61: note = chr1:116574202-116574263
  misc_feature 1..61: note = hypo
  source 1..61: mol_type = genomic DNA

SEQ ID NO: 67556 - DNA, 771 bp, Homo sapiens
  misc_feature 1..771: note = chr1:116710521-116711292
  misc_feature 1..771: note = hyper
  source 1..771: mol_type = genomic DNA
gaatgccccgaagggcgtaggctcggggtctcccagccaggacacacaaggcaggctggggagccagggtcagccagggcacgccgctgagatgtctttcctgctccttctccccgggaagcaagggaagcaaaaggccagaggggtgctgggatcgctgtccgcagcaccagccttctcctgggacgtgttcagaaagagggaggctacagtgggcggggagagaagaaggaagagaaggtgggcagaaagggggcaagatgaagcggcaaggaggaaggaaaggagaagctaaggagggaggatggggaggcggcgacaatggccgcgctaccggtcgcccactgtgctgcggtgggtcggggcccactgcccctcgctggggcacctggggagggggcgctggggcacctggagagggcgcgcaggagcagcgggccgagccttctgcggggatggggtgggaagagaagaaatgaagacacagaggagtagaacaaagaggcgggagcaccccgccaggggaccgggaagggtcgaggaaaactgctgccgcgccccactgggttttaacaacgcccgggatgggggaagggctcccacttgcgccccaagcgcatgcggagaaggttcggcagcgcctcctgccggccgcccggagggtccgcggtggcgccagccccgatcgcagccgcgcaggcccgagggcccctacccgcacggtgaattgtcttccacgcactagtattttctcctcgctttcaactgaat

SEQ ID NO: 67557 - DNA, 634 bp, Homo sapiens
  misc_feature 1..634: note = chr1:1168350-1168984
  misc_feature 1..634: note = hypo
  source 1..634: mol_type = genomic DNA
ccgcgactacctgcgcgcctggcacagcgaggacgtgtctctgggcgcctggctggcgccggtggacgtccagcgggagcacgacccgcgcttcgacaccgaataccggtcccgcggctgcagcaaccagtacctggtgacgcacaagcagagcctggaggacatgctggagaagcacgcgacgctggcgcgcgagggccgcctgtgcaagcgcgaggtgcagctgcgcctgtcctacgtgtacgactggtccgcgccgccctcgcagtgctgccagagaagggagggcatcccctgagccgccgcggcccggccctccgggacacctgcttcacccggcggcgccttggggcaggtgccgagcgggcgcactacgcccgggccccaaggcccccgtcccgcagccacgcttgtggtcgctgcgtcccggtctgcgtttgggagacccctgggggttgccggggcagcgcgccgtgtccaggtggaggtgcccgttcctggacctcagcgagcctgagccgggcccggccgcacgctgacccccgtgctgtccccgaccggctcacggggctgggctccgatcttccgtgtctcttatcagtggcgtttctcacgtctgcgtctcagatctaac

SEQ ID NO: 67558 - DNA, 30 bp, Homo sapiens
  misc_feature 1..30: note = chr1:116946453-116946483
  misc_feature 1..30: note = hypo
  source 1..30: mol_type = genomic DNA
tatttgaactgtgttcgtgtgcatataaat

SEQ ID NO: 67559 - DNA, 30 bp, Homo sapiens
  misc_feature 1..30: note = chr1:11721254-11721284
  misc_feature 1..30: note = hypo
  source 1..30: mol_type = genomic DNA
cactcattactgggccggctggtacggccc

SEQ ID NO: 67560 - DNA, 30 bp, Homo sapiens
  misc_feature 1..30: note = chr1:1172140-1172170
  misc_feature 1..30: note = hypo
  source 1..30: mol_type = genomic DNA
tctgaggtgagctggcgtctccctctccca

SEQ ID NO: 67561 - DNA, 30 bp, Homo sapiens
  misc_feature 1..30: note = chr1:117239297-117239327
  misc_feature 1..30: note = hypo
  source 1..30: mol_type = genomic DNA
ggatgcatggaaaatcgaaggcttgcctga

SEQ ID NO: 67562 - DNA, 190 bp, Homo sapiens
  misc_feature 1..190: note = chr1:1173900-1174090
  misc_feature 1..190: note = hypo
  source 1..190: mol_type = genomic DNA
tggccaagcccagcccgtgagcgacggccccaggacgcggcgccgagctctgcccccagctccagctcccagcggcgtcggagcacagcagatcccagggcagcgctctgcaggcaggaaagagcttccccttgggacagcgcgctgagcagcccccagctgagggtgggagccccgtccctggacccct

SEQ ID NO: 67563 - DNA, 30 bp, Homo sapiens
  misc_feature 1..30: note = chr1:11740384-11740414
  misc_feature 1..30: note = hypo
  source 1..30: mol_type = genomic DNA
tctgtggttctgggacgtgcctcacctgga

SEQ ID NO: 67564 - DNA, 51 bp, Homo sapiens
  misc_feature 1..51: note = chr1:1174339-1174390
  misc_feature 1..51: note = hypo
  source 1..51: mol_type = genomic DNA
acagatgtgcagacacgtgggcacacacgcaccagtcgcagggacacacaa

SEQ ID NO: 67565 - DNA, 359 bp, Homo sapiens
  misc_feature 1..359: note = chr1:117452844-117453203
  misc_feature 1..359: note = hyper
  source 1..359: mol_type = genomic DNA
ggccgctgctgctggcgctcctgtcgttgggtgagtgtgcgcggggctcagcggggcacacggggactggcgaggccctggagggctcggcggggcgcggctgcagcgcgcggcctggggcgccgagggtgcccgggctgctcccgggaaacccggccggggtgcgcgggttgttcggcccggcggggagcggccgcggggccgcccggagcctggcgcgaatccgctcgggccccgcgcgcggggtgcaagtggccgctccgccaggccgagcctcgcccccaacatgtgccggggggagtggcccggggccgtctttcccccaggtctccctacctgttggccgccgggagcccggc

SEQ ID NO: 67566 - DNA, 278 bp, Homo sapiens
  misc_feature 1..278: note = chr1:11751289-11751567
  misc_feature 1..278: note = hyper
  source 1..278: mol_type = genomic DNA
cctgacagacgcggccgcagctgagcgcgcagcctcgctccattgttggggtccaccgaggaccgcccgccgcggccctttgtcgcccgccctgcgcggggccgctccagaggcgccacaactgccggagcccctcccgtcccacgcgccctgggccgcgccgaggcggctcttacgcaccgggaggagtgggcctgcctcgcccggtgcccgcacggctgctgggctgcgcccgcctttgtctgcctcctttgtctgccccgcgccctcgcggcggc

SEQ ID NO: 67567 - DNA, 210 bp, Homo sapiens
  misc_feature 1..210: note = chr1:11752448-11752658
  misc_feature 1..210: note = hyper
  source 1..210: mol_type = genomic DNA
cggggtcgctgagtgcgcccggaaccagcaccgccggtggccccgcgccgtcccatctgtgcccaggaaggtactcagcctggctcccccgacggcgctggtctttcgcctgtggtctcccgctctgtccctcctgctccccaccgccggcttttggcttttctccgtccgctcgtcaagggtctcagccgccttcggggccggggtatg

SEQ ID NO: 67568 - DNA, 34 bp, Homo sapiens
  misc_feature 1..34: note = chr1:117665071-117665105
  misc_feature 1..34: note = hyper
  source 1..34: mol_type = genomic DNA
atggagggcttacttcggccgggccagggagcgc

SEQ ID NO: 67569 - DNA, 30 bp, Homo sapiens
  misc_feature 1..30: note = chr1:1177998-1178028
  misc_feature 1..30: note = hypo
  source 1..30: mol_type = genomic DNA
ccacaaacacagaagcgtactgtccagcct

SEQ ID NO: 67570 - DNA, 30 bp, Homo sapiens
  misc_feature 1..30: note = chr1:11780195-11780225
  misc_feature 1..30: note = hypo
  source 1..30: mol_type = genomic DNA
attgaattatcacaacgaccttttcaagta

SEQ ID NO: 67571 - DNA, 30 bp, Homo sapiens
  misc_feature 1..30: note = chr1:1178721-1178751
  misc_feature 1..30: note = hypo
  source 1..30: mol_type = genomic DNA
gtccctaacaggacccgcacccggggccgg

SEQ ID NO: 67572 - DNA, 30 bp, Homo sapiens
  misc_feature 1..30: note = chr1:1179038-1179068
  misc_feature 1..30: note = hypo
  source 1..30: mol_type = genomic DNA
ctcccgggaccctcacgctcactgtgggca

SEQ ID NO: 67573 - DNA, 76 bp, Homo sapiens; identical to SEQ ID NO: 38854
  misc_feature 1..76: note = chr1:11792825-11792901
  misc_feature 1..76: note = hypo
  source 1..76: mol_type = genomic DNA

SEQ ID NO: 67574 - DNA, 30 bp, Homo sapiens
  misc_feature 1..30: note = chr1:118173786-118173816
  misc_feature 1..30: note = hypo
  source 1..30: mol_type = genomic DNA
atgagaagctggagtcgctgcctttctttc

SEQ ID NO: 67575 - DNA, 36 bp, Homo sapiens
  misc_feature 1..36: note = chr1:11822246-11822282
  misc_feature 1..36: note = hyper
  source 1..36: mol_type = genomic DNA
tccgacgtcccctcccgcccgcgacctgccgacctg

SEQ ID NO: 67576 - DNA, 110 bp, Homo sapiens
  misc_feature 1..110: note = chr1:118277822-118277932
  misc_feature 1..110: note = hyper
  source 1..110: mol_type = genomic DNA
gaggggccaatgtgacgagcagcattcctctttcactttcattttgtgctgtttactttataaaagttagtgtctacagaggctaggagtttgtccgtgctatttttatt

SEQ ID NO: 67577 - DNA, 30 bp, Homo sapiens
  misc_feature 1..30: note = chr1:11839862-11839892
  misc_feature 1..30: note = hypo
  source 1..30: mol_type = genomic DNA
ttcctcagctggagccgctgggcaacagcc

SEQ ID NO: 67578 - DNA, 33 bp, Homo sapiens
  misc_feature 1..33: note = chr1:11848300-11848333
  misc_feature 1..33: note = hypo
  source 1..33: mol_type = genomic DNA
aggaagtacctgcagcgccggtgcctcgaggca

SEQ ID NO: 67579 - DNA, 30 bp, Homo sapiens
  misc_feature 1..30: note = chr1:118522258-118522288
  misc_feature 1..30: note = hypo
  source 1..30: mol_type = genomic DNA
gtttgaataaaactgcgctgagaagtacta

SEQ ID NO: 67580 - DNA, 83 bp, Homo sapiens; identical to SEQ ID NO: 38855
  misc_feature 1..83: note = chr1:11854720-11854803
  misc_feature 1..83: note = hypo
  source 1..83: mol_type = genomic DNA

SEQ ID NO: 67581 - DNA, 30 bp, Homo sapiens
  misc_feature 1..30: note = chr1:11861082-11861112
  misc_feature 1..30: note = hypo
  source 1..30: mol_type = genomic DNA
ggggatgggatcctgcggatcctcagcgtg

SEQ ID NO: 67582 - DNA, 286 bp, Homo sapiens
  misc_feature 1..286: note = chr1:118727824-118728110
  misc_feature 1..286: note = hyper
  source 1..286: mol_type = genomic DNA
ctgcctaagcgtccccgctaccacagtaaccgaagccacgcccagttcctgaaccacgtcggctcccctcccccaacaccgttcggaatccttgggtcaaccgcctccgtctccacagcaacggagtttcagagcgcgcggcagcttgggggcggggttcccagtcccccggtcaaattttaggacttttcagcaggaaagctgcacaactggaggagggcaggacgaggctggcctcgcaggtcgggctacgttcttctacggtctgaggcgttgtctagaaact

SEQ ID NO: 67583 - DNA, 186 bp, Homo sapiens
  misc_feature 1..186: note = chr1:1190209-1190395
  misc_feature 1..186: note = hypo
  source 1..186: mol_type = genomic DNA
caggagctccaagaacgcaggagcagcccgcggtcggcagcaagtttgcatttctaagtgaccacatctaataaaatgaaaaacgggtttactaaaacaggtccaaagacaacacggaagataagctacaaatccagcacacaaggcccacccacaccagccccagcggcccgtggccaggacagg

SEQ ID NO: 67584 - DNA, 317 bp, Homo sapiens
  misc_feature 1..317: note = chr1:11919143-11919460
  misc_feature 1..317: note = hyper
  source 1..317: mol_type = genomic DNA
gtgggaggtggagaccgggcagagccgaccttgtatagaaatgggccgggtcgggccggggggcaggaacgcgctggagacacagacaagtccccgtctcccgcttcttcctttcctgcaaatgtccaggtgtcctaggttggcgctttcttcctgcctccccaccccaccgttgctggaaaaggcagggaggaccccggctttccgaggaccgacgtgagcgcggggagcacggggtgactcacagcgaaaacagccccggccaagaccccgccacccgcggcgcctctcccctccccgcgcgagttccctggccc

SEQ ID NO: 67585 - DNA, 85 bp, Homo sapiens; identical to SEQ ID NO: 38856
  misc_feature 1..85: note = chr1:11936694-11936779
  misc_feature 1..85: note = hypo
  source 1..85: mol_type = genomic DNA

SEQ ID NO: 67586 - DNA, 30 bp, Homo sapiens
  misc_feature 1..30: note = chr1:11938065-11938095
  misc_feature 1..30: note = hypo
  source 1..30: mol_type = genomic DNA
tgaagaccaaggggacgagatctcagtgtc

SEQ ID NO: 67587 - DNA, 30 bp, Homo sapiens
  misc_feature 1..30: note = chr1:11938661-11938691
  misc_feature 1..30: note = hypo
  source 1..30: mol_type = genomic DNA
tgtccaaccccatggcgcccttgccctcca

SEQ ID NO: 67588 - DNA, 30 bp, Homo sapiens
  misc_feature 1..30: note = chr1:11939935-11939965
  misc_feature 1..30: note = hypo
  source 1..30: mol_type = genomic DNA
ggaaggctggccagacggaagtggcacccc

SEQ ID NO: 67589 - DNA, 60 bp, Homo sapiens
  misc_feature 1..60: note = chr1:119521978-119522038
  misc_feature 1..60: note = hyper
  source 1..60: mol_type = genomic DNA
cgtcacgatcccacaggatgactttcctttttaacagactagctacgatatatactgacc

SEQ ID NO: 67590 - DNA, 138 bp, Homo sapiens; identical to SEQ ID NO: 26571
  misc_feature 1..138: note = chr1:119522297-119522435
  misc_feature 1..138: note = hyper
  source 1..138: mol_type = genomic DNA

SEQ ID NO: 67591 - DNA, 289 bp, Homo sapiens; identical to SEQ ID NO: 26572
  misc_feature 1..289: note = chr1:119522565-119522854
  misc_feature 1..289: note = hyper
  source 1..289: mol_type = genomic DNA

SEQ ID NO: 67592 - DNA, 15 bp, Homo sapiens
  misc_feature 1..15: note = chr1:119522925-119522940
  misc_feature 1..15: note = hyper
  source 1..15: mol_type = genomic DNA
cggttcatccagttg

SEQ ID NO: 67593 - DNA, 165 bp, Homo sapiens
  misc_feature 1..165: note = chr1:119526767-119526932
  misc_feature 1..165: note = hyper
  source 1..165: mol_type = genomic DNA
tagcagttgagctgacgggtgcgtgcgagaatgcgagacctgccacgtgtacacgtgtacgcggagtgtcgatctgcctgcgtgtccttggatgtgcctgtctaggtgcccacccgcgcgcgccaccacatccccaggcctctggaacgcagctgctgtgtggcc

SEQ ID NO: 67594 - DNA, 416 bp, Homo sapiens; identical to SEQ ID NO: 26575
  misc_feature 1..416: note = chr1:119527236-119527652
  misc_feature 1..416: note = hyper
  source 1..416: mol_type = genomic DNA

SEQ ID NO: 67595 - DNA, 310 bp, Homo sapiens
  misc_feature 1..310: note = chr1:119527868-119528178
  misc_feature 1..310: note = hyper
  source 1..310: mol_type = genomic DNA
tcacccgggaagagacgctgccctgggcacaatagggtcgcctgcattactcctccatacacacatctttaaatgtgtccctgtgtgtgttcgttagggtgctgtattacagaaaaagaaaggcctaaaaacacccccagccctggtcgcgcctttcgctaccgcctgagtctggagccgacagctccacctcttctgctccctggaccgccgcgtctccacgccacggcgccctttttactaaaagatcttttctcatcctatcagcaaatcgttaagaaaggcttagccattgcgggggctccaactt

SEQ ID NO: 67596 - DNA, 726 bp, Homo sapiens
  misc_feature 1..726: note = chr1:119528611-119529337
  misc_feature 1..726: note = hyper
  source 1..726: mol_type = genomic DNA
acataaggccctagacgggctccgtgcgatctggggcctcccaagagaaaacttccccgggacaggacgtctgccacgcgcagctaaacaacttctgttttttccgccgtggggaaaataaaagaaccttacaaattctaaggcgtcataacccctgcaagaacttctaactgtatgaaggcccacgcgagattttgacaatagataaatgagctgaggaaatagggtctggccagcgaagggaaacacacagtagccctgggtgcctttctggaatgcccacgcaggggtccgcgtggacaagcacttgcattcaaatacaggaaaaggcttggacggtcgaaataaatctccttttaattttcttttcatcgactaataaaaataattccccagcactaaactcaaataccgtaacgggccacaaaaacacggagaattcataaaactctatctctgcaggtcacccgctaatcgcattattattagcctcgggagcatggaaattgaactgtcactgcctaaagagaaaatgtaagcgacagctgtccctcctctgagttggacagctttgtggctgagatccccaagctcctgagccccagaccgtctctatcccagtgcaggccgctgccccctccccgggcttgtcagcgtgtgaagcggggtctactccccagctctggctgttcagcaggagcaccttccagcatggttttagaagtc

SEQ ID NO: 67597 - DNA, 189 bp, Homo sapiens
  misc_feature 1..189: note = chr1:119529378-119529567
  misc_feature 1..189: note = hyper
  source 1..189: mol_type = genomic DNA
cgttgtatgtgcgcgcgcgcacactcaagattcttccgacaacagctgttcccccgggctgtttttgcacagttgaaatcttggcacttaacacaaaacgttaaagttggcttctcccctcctagggttctgttaaaatacagacatgacatcccccctgctttttacatgttccgtgcacataatata

SEQ ID NO: 67598 - DNA, 135 bp, Homo sapiens
  misc_feature 1..135: note = chr1:119529777-119529912
  misc_feature 1..135: note = hyper
  source 1..135: mol_type = genomic DNA
caactggtcattccccgaagactgaggtattggattggagaacgccgcgccagtcctcccgagttctcagaagcgagtcctagatctcggctcccgccgttgccttcggcccgcgcccctcccaatcccagggac

SEQ ID NO: 67599 - DNA, 144 bp, Homo sapiens; identical to SEQ ID NO: 1805
  misc_feature 1..144: note = chr1:119530005-119530149
  misc_feature 1..144: note = hyper
  source 1..144: mol_type = genomic DNA

SEQ ID NO: 67600 - DNA, 307 bp, Homo sapiens; identical to SEQ ID NO: 1806
  misc_feature 1..307: note = chr1:119530201-119530508
  misc_feature 1..307: note = hyper
  source 1..307: mol_type = genomic DNA

SEQ ID NO: 67601 - DNA, 47 bp, Homo sapiens; identical to SEQ ID NO: 1807
  misc_feature 1..47: note = chr1:119530553-119530600
  misc_feature 1..47: note = hyper
  source 1..47: mol_type = genomic DNA

SEQ ID NO: 67602 - DNA, 685 bp, Homo sapiens
  misc_feature 1..685: note = chr1:119530601-119531286
  misc_feature 1..685: note = hyper
  source 1..685: mol_type = genomic DNA
gatccgacctgcgcccctacgctggcccagctgctaggaactagcgccccgagcgccgcccgctcgctgcatgagcgcccgagtcctgcttcccacccaccggggcaggcgctcacagactgtgtccactgaacttcatcttgtttttgttattattattattctctctcctctctctctctctctctctctcccctccctctctttttctctcctccccctctctctctcttcctctctgccttcccgtcctccctgtgatccaaacttctgggaaacttttttttccgctaaattcctcccttcccgaggaacagggggcaggcggtgcgctcctgtccgaggggtgagggagagggagggggaggaagaaaaagactgagggggaaaaaagccagcccccaaccaatagcgaggagggaacaagagaaactccgagagcgcgaaccaatgagaggaagggagagactgaggcccgggccaaagcgcagcgccagtcgtcccctggatgctcctgggccgactttaacccctggcttcccggtttccccatgggttactccaagagggaggtaggacagttgaaagttgaggtctgatctgcgcctttacaaactcctgcaaatcccaaatccatacgtttttcttccagatctgctggtctcatagacgctgcaagtccaga

SEQ ID NO: 67603 - DNA, 396 bp, Homo sapiens
  misc_feature 1..396: note = chr1:119531601-119531997
  misc_feature 1..396: note = hyper
  source 1..396: mol_type = genomic DNA
agagcaaggggcgggcggcggagcgcggggtttagggcgagctcctcaggcgtattccagctgggccccctcacgccgcaaatactctctttccctacggcccgaacgctgggctgcgcttcgcctgttccgggctcttgttgcagagaacctatggagaggtgacaggcaagaacagctaggaactttaacagaagagaaggagctttttcaaaattccctgcaaatcccgttacctcaagaccatggctttcccggccagctgatctcccccctggccgccccctgccttttgcgatctctaaggactgcattcaacatggatttctaaggaattaaaaaatccaacgctcctggccattcttaattcccacacctcttcccaagttacgccac

SEQ ID NO: 67604 - DNA, 71 bp, Homo sapiens
  misc_feature 1..71: note = chr1:119535278-119535349
  misc_feature 1..71: note = hyper
  source 1..71: mol_type = genomic DNA
ggccgcacctccagtcgctcctttaagtcgcagagagctgcgggacccgcataagtcgttaactattcaag

SEQ ID NO: 67605 - DNA, 148 bp, Homo sapiens; identical to SEQ ID NO: 26587
  misc_feature 1..148: note = chr1:119535573-119535721
  misc_feature 1..148: note = hyper
  source 1..148: mol_type = genomic DNA

SEQ ID NO: 67606 - DNA, 249 bp, Homo sapiens
  misc_feature 1..249: note = chr1:119536142-119536391
  misc_feature 1..249: note = hyper
  source 1..249: mol_type = genomic DNA
gcactctcaggagttcgggattgcttagcagcaccataaaacccaatccaaagtcggcgagttttgaggccccaacgtgcaccccgaaaaaaatacgggtacatcagcaactaccatatactttttataggaagctaagtacaagcgtcatgcacgtatcatgtgtgactacacaaagccatatgtttatccggcagcacacataagcatgcatacacttcgtacacccacacgcgttgtatccatgta

SEQ ID NO: 67607 - DNA, 30 bp, Homo sapiens; identical to SEQ ID NO: 26588
  misc_feature 1..30: note = chr1:119536719-119536749
  misc_feature 1..30: note = hyper
  source 1..30: mol_type = genomic DNA

SEQ ID NO: 67608 - skipped

SEQ ID NO: 67609 - DNA, 146 bp, Homo sapiens
  misc_feature 1..146: note = chr1:119543069-119543215
  misc_feature 1..146: note = hyper
  source 1..146: mol_type = genomic DNA
cgaagagcgggtagatgccggccaagcaaagtgctcgaaagtgtagctgggacgcccacgccggaagcctggagaggcaagttgcgagttcgcagggcttgggagttttttgcggcggaagaagctgaatctaggggctgagtccc

SEQ ID NO: 67610 - DNA, 1280 bp, Homo sapiens
  misc_feature 1..1280: note = chr1:119543273-119544553
  misc_feature 1..1280: note = hyper
  source 1..1280: mol_type = genomic DNA
cgagattgagagctctttctgcggaacctgcctccggagtcagatgagcaaggggaccgccacgtcctcaccgagctcccagcggcctttggggcgggtccggggacaagccggaggactaggcttctcccagagcgcggctgtctttcccggaaagacccaagtgcgcgatgtcagcccgcctgcacttcatctgagttgtccttatgtggccatttctgtttcaaatttcagatttttctactaaaaaaggatgggttaaaacagctgagagcgcgcctgctctttcccgccctgggttctacatctctctagccgcccaccagactgcatctccaatctgggagctatcctcaccttgggagggtggggcaacaatgttattctcgtttcccgataaggaaaccaacgtccctacaacttgacgttaaatggtcccaggttcctgagcctcaaatctaggactattacctaggtcacctaaaaatttttgttctttccactcccccgagggtgattctgttagcctcgcaggcccttctcccacccgtcatttgaagtcatcgaccccggggcagccccaacagttctgtgcgggcctgcgcgcaccgccctcaccttgcgcgccaggcatctcacctcagccgggcaggtgcagaggtgacaggcgcggcagccgcggttcgtccggccgaggggcaggaggaggctggccgccgccttctgctgcccgcaggctgagggggcaggggagggggaacagggctgggaaactgccgtcagcgggtcccggccccgcctcccgaacgcaacgtccaggaaacctcagaactttctattgtctgagaagcttcactgaacaaattgtccctaaaactttagagctgcgaagagcggatcagggcaggttctagtgtggccctgtgccccggagcctgcctgccataaagtgtgaccggaagcccccccccccccgcccactgtcagaaccactgaggagagaagagcgcggcgccttagtgccgccctgcgtcgtggtcgggaagccgagcaagcggtgtggacgccccaggagcagggggatccaggcctaaactcatgggttccgaatgggcaagggagcagaatcaagcatcggtgggcgcttatagaaagcgcgtctgtcttggaacacccttaccagggtacccaaccccagcgccaggtttcctggccttgcaaggagaggttgaatttgtcaggattccccactctagaaggtggctcgtggtggtgaagct

SEQ ID NO: 67611 - DNA, 112 bp, Homo sapiens
  misc_feature 1..112: note = chr1:119545108-119545220
  misc_feature 1..112: note = hyper
  source 1..112: mol_type = genomic DNA
atagtgtaaggaattcgacttctcaagctcagcattttcaattccttaatttgtccctgggtgaccgttagcaattgtggctgtagatcacatggggcggaccaggtagaat

SEQ ID NO: 67612 - DNA, 340 bp, Homo sapiens
  misc_feature 1..340: note = chr1:119548577-119548917
  misc_feature 1..340: note = hyper
  source 1..340: mol_type = genomic DNA
aagcacattcctggacggcgactttgaatccaggccaagaaaagagaggtacaccaatattgggattctgtattttgggggtctaattggtgagtacagaacaaaggagtggagaggaaggcaaaataacctaagtaatagaaaatccagccatagactgcagtggaaattaatggcacgagaagccttgggggcaaaggtaaggggtcgcagttgaatgccacccgaactcatccagatgccgctgcgttcaagctctcccagcacccgcggccgaagtaaataacaattctcttaatgctaaggcagcaaggagagggcactgcgaactgcagacttt

SEQ ID NO: 67613 - DNA, 606 bp, Homo sapiens; identical to SEQ ID NO: 1811
  misc_feature 1..606: note = chr1:119549129-119549735
  misc_feature 1..606: note = hyper
  source 1..606: mol_type = genomic DNA

SEQ ID NO: 67614 - DNA, 807 bp, Homo sapiens
  misc_feature 1..807: note = chr1:119549914-119550721
  misc_feature 1..807: note = hyper
  source 1..807: mol_type = genomic DNA
cgtctaccccaacccgggtattaccctcttttccgtcttctagaaggggaaaaccatgctgttttgaattcaacatatttagattctgaaaatcgacggcccttcccttctttcctaggaaggcctgccccgtaggcacaaccttcggagaaacgggcggcgcgtgagttccctggagccgcctcctgggcatccaggctcctgtcgcacggctggtgcggcgcccactgggcgtggggactgggcccaaggctcccgggaccgggtcgtggttaacgccgaggccaagcccttcgaagaactctgagttctctgcctgacgttttgtccctcaggaagtgtcccttcccgacttttgagggtgtcttgttctttgacggggtggccctgtgggggaggaaggagaagtgttcctccactgctgttctgtggagcgggacctggctttgttcggcctccctgctctcgggagcctgtactccggctcgcacgcctgactgctggccctggccgctgctcgggccccgcgcaggcacacgggacaaggcgaagccccgacgcccagagggcgcttgggcccagcacacccgcgcacagcccaggaaacgggaaaggccactgtctgcttccctttcgcagattctatccgctggcacgcgaaggtcacacgggctctcaatgctaatttggaatgggaagcaccacgaagggttgaggtagcctggtggccctgactgcgcagggtgcggacagtgagcccgtatccagcttcgctgccacgcgcctagcagcccggcggccccggcc

SEQ ID NO: 67615 - DNA, 320 bp, Homo sapiens
  misc_feature 1..320: note = chr1:119551013-119551333
  misc_feature 1..320: note = hyper
  source 1..320: mol_type = genomic DNA
cggggtagtgggcgggagacaagggtctcagaacagaggggctggcccggcgcggcgggccaggaactcccgggcgtgtgtgtgcagtggtgcggggtgggggtggaggtgaggtctcctttagttcctgggatctgggaatcccggcttctcgatctcatccggcgcggagatcttaagggtcggtggaccagttagtgtgtacggcctcacccctccgcctccagctttcgaggctctccgcttcagagctccaaaggaaaacttctgcgacttcaagaacgtcctgcgcattcacatggggtcgcttcctggctggt

SEQ ID NO: 67616 - DNA, 358 bp, Homo sapiens
  misc_feature 1..358: note = chr1:11958880-11959238
  misc_feature 1..358: note = hyper
  source 1..358: mol_type = genomic DNA
gccgggacccgagggcgctccaggttggctccgcgggtcgcatcacctgccaagtgctcgggagccgcagcacgggcaccaggggggtccaggatggaggggccacggaggtctccaagggaactgcccgggctgagattggccagggagggggccaggaactagtggagctacggagccgccagtggatctgaggacccacctggatccgaggtcggcccctgtccccggtgctgaaatgcgggcgcccgcggggttcacggccaggactcagccctggagtccctgagaccgctagccccgtagcaatcccctatgtaggatttgtttcaagggctcagaccggcacagagccccc

SEQ ID NO: 67617 - DNA, 153 bp, Homo sapiens
  misc_feature 1..153: note = chr1:119683985-119684138
  misc_feature 1..153: note = hypo
  source 1..153: mol_type = genomic DNA
tttgttgaaccctaccgtaatgtgctgggcactgaaggtacagagaaagacatatcttgtcttcaagttgtgtacagtctaatagagtagcggataaataaatgatgtacacttaataggtgttaaagaagcaagcaccgcaagttttaagga

SEQ ID NO: 67618 - DNA, 304 bp, Homo sapiens
  misc_feature 1..304: note = chr1:119869950-119870254
  misc_feature 1..304: note = hyper
  source 1..304: mol_type = genomic DNA
tccctgccaggtgtccgaggcccgaccgcgccccgcccccaccgcgcccccctccccgcaccccgcccctcctgctcccggctttcatgtggatcaaggctggaggatgacaagctcctgactgatagatacatggagacttcgctggtgatttattggctttctgcacctgacgagaaccactaggcctatctgaggagggaaatatatgggctttcctgactccaagtggcagccccggggcgagcatgtgatgtcaagctgggcagaggaaagcggagctgtgcaccggcctgtgtactgt

SEQ ID NO: 67619 - DNA, 110 bp, Homo sapiens
  misc_feature 1..110: note = chr1:120190340-120190450
  misc_feature 1..110: note = hyper
  source 1..110: mol_type = genomic DNA
tgggcttggtttctccgagggtctctgatgcccccttcggtggtcggcgggacggtcctattccctcttgcatcgctgtctcctccctcaagtctcagcctcctcctccc

SEQ ID NO: 67620 - DNA, 281 bp, Homo sapiens
  misc_feature 1..281: note = chr1:120190519-120190800
  misc_feature 1..281: note = hyper
  source 1..281: mol_type = genomic DNA
cggggccctgcgccccaggggagcggacaacggtccactttacgaggcacaacttcgcccagccgttccgccaccgcactcgaacacacaccccatccccgcagcggtcgggtctggtcccgatcagccccatccccgggaggcggttgagcccagccacagccacgctcctacctgcgaggcggctggcgcggcgaggagctagggcaccgagcgccccggcccgagccccgcaccgcagcgcgtctgcccttgtgcggcggcggcggctgcagcggccg

SEQ ID NO: 67621 - DNA, 147 bp, Homo sapiens
  misc_feature 1..147: note = chr1:120191165-120191312
  misc_feature 1..147: note = hyper
  source 1..147: mol_type = genomic DNA
gctgcactccgagctcgcggcaccggttgcgggcagccggtgggacgctgccgctgagctgtcccatggttcgggagggctctgcggtgggagaggccttttctttaaaaactgggaagtttgtggtgggttcgctttttaaaaatt

SEQ ID NO: 67622 - DNA, 63 bp, Homo sapiens
  misc_feature 1..63: note = chr1:120254521-120254584
  misc_feature 1..63: note = hyper
  source 1..63: mol_type = genomic DNA
gagatgactggggagcgggagctggagaatactgcccagttactctagcgcgccaggccgaac

SEQ ID NO: 67623 - DNA, 145 bp, Homo sapiens
  misc_feature 1..145: note = chr1:120321244-120321389
  misc_feature 1..145: note = hypo
  source 1..145: mol_type = genomic DNA
ctttgttcaagtgcacgtagctggttaagtggtggtgccagggactccggactcctactctcgtgaaaactcttgtgcctgaaaattattgtaaaatatctggaattattattattatttatttttattttttgagacggagtct

SEQ ID NO: 67624 - DNA, 15 bp, Homo sapiens
  misc_feature 1..15: note = chr1:12041510-12041525
  misc_feature 1..15: note = hypo
  source 1..15: mol_type = genomic DNA
cgctgctgcactcca

SEQ ID NO: 67625 - DNA, 76 bp, Homo sapiens; identical to SEQ ID NO: 38857
  misc_feature 1..76: note = chr1:12078805-12078881
  misc_feature 1..76: note = hypo
  source 1..76: mol_type = genomic DNA

SEQ ID NO: 67626 - DNA, 432 bp, Homo sapiens; identical to SEQ ID NO: 26058
  misc_feature 1..432: note = chr1:12123122-12123554
  misc_feature 1..432: note = hyper
  source 1..432: mol_type = genomic DNA

SEQ ID NO: 67627 - DNA, 163 bp, Homo sapiens
  misc_feature 1..163: note = chr1:12123787-12123950
  misc_feature 1..163: note = hyper
  source 1..163: mol_type = genomic DNA
cgcaagggaggacactcctcaccccgttccctgcccagctggagtgagggggcgcgggtgacaagcaggaacaccggaatatgctagcacccacaggtgggaggctggctgaagggctagtggtggggggcgcctccttctcaccccgcgatggctgggactg

SEQ ID NO: 67628 - DNA, 94 bp, Homo sapiens
  misc_feature 1..94: note = chr1:12175071-12175165
  misc_feature 1..94: note = hypo
  source 1..94: mol_type = genomic DNA
tttttattattaaaaatttcaaacatattcagatgtagagtgagtcagagatggctgcgtactatcacccagctttaaacggttatggagtcat

SEQ ID NO: 67629 - DNA, 23 bp, Homo sapiens
  misc_feature 1..23: note = chr1:1218784-1218807
  misc_feature 1..23: note = hypo
  source 1..23: mol_type = genomic DNA
atggggcttctgggccgggcacg

SEQ ID NO: 67630 - DNA, 30 bp, Homo sapiens
  misc_feature 1..30: note = chr1:12201701-12201731
  misc_feature 1..30: note = hypo
  source 1..30: mol_type = genomic DNA
gggactcccaggacacgggacttgcagtag

SEQ ID NO: 67631 - DNA, 20 bp, Homo sapiens
  misc_feature 1..20: note = chr1:12204539-12204559
  misc_feature 1..20: note = hypo
  source 1..20: mol_type = genomic DNA
actcaaagccactgtcggcc

SEQ ID NO: 67632 - DNA, 30 bp, Homo sapiens
  misc_feature 1..30: note = chr1:1222237-1222267
  misc_feature 1..30: note = hypo
  source 1..30: mol_type = genomic DNA
cagagccgccctctccgccactgtcccccg

SEQ ID NO: 67633 - DNA, 30 bp, Homo sapiens
  misc_feature 1..30: note = chr1:12227408-12227438
  misc_feature 1..30: note = hyper
  source 1..30: mol_type = genomic DNA
tccgggcccggcacacgtgcgctcggggca

SEQ ID NO: 67634 - DNA, 81 bp, Homo sapiens
  misc_feature 1..81: note = chr1:12227644-12227725
  misc_feature 1..81: note = hyper
  source 1..81: mol_type = genomic DNA
ctgccccactgcccacgccgggcaccctcttcaaaagacttccttttcctctgggcgacggttttccgatttcttagaaat

SEQ ID NO: 67635 - DNA, 44 bp, Homo sapiens
  misc_feature 1..44: note = chr1:1223161-1223205
  misc_feature 1..44: note = hypo
  source 1..44: mol_type = genomic DNA
gcaccacagcttcagcgtccggccagggacggaggccaccatca

SEQ ID NO: 67636 - DNA, 83 bp, Homo sapiens
  misc_feature 1..83: note = chr1:1223512-1223595
  misc_feature 1..83: note = hypo
  source 1..83: mol_type = genomic DNA
tagagggcctgggaacggggcagtccccgtggaggcccgcactccatcccccgtgtccccgctccattccctgtgtctctgct

SEQ ID NO: 67637 - DNA, 639 bp, Homo sapiens
  misc_feature 1..639: note = chr1:12251319-12251958
  misc_feature 1..639: note = hypo
  source 1..639: mol_type = genomic DNA
ctcttcacagccccacggggcaggcggtgggagaactgtgcccacgtgagggttgaggaggtggtgcgtgggagagtggtgcgcatgctcgtgctgcgaggagcaggactgcggggaggagcgaaactgctgggaagagcgggactgcggggaagagcgggacttcggggaggagcggcactgcggggaggagcaggactgcagggaggagcgggactgtggggaggagcgggacttcggggaggagcgggactgcgggggacgagcgcgactgcgggggacgagcaggactgcggagagtagcgggactgcggagagtagcgggactgcggagagtagcaggactgccggtcctgcccctggactctggccggtgttgtgtgtgccccatgctgaggcggtccgccagcctcctggagatccgctgtctgagagtgctgggctgtctgggagggcagcgtgggtgtggcggaggcaggcgtgaccgtttgccgccctctcgctgctctagaccaggtggaaactcaagcctgcactcgggaacagaaccgcatctgcacctgcaggcccggctggtactgcgcgctgagcaagcaggaggggtgccggctgtgcgcgccgctgcgcaagtgccgcccg

SEQ ID NO: 67638 - DNA, 30 bp, Homo sapiens
  misc_feature 1..30: note = chr1:1226147-1226177
  misc_feature 1..30: note = hypo
  source 1..30: mol_type = genomic DNA
agacaagggcagggccggaactgacccagc

SEQ ID NO: 67639 - DNA, 56 bp, Homo sapiens
  misc_feature 1..56: note = chr1:12304691-12304747
  misc_feature 1..56: note = hypo
  source 1..56: mol_type = genomic DNA
ttataaaagtatcaacgtgaaagggatttctcaggtttaaacgtgtttctcctctt

SEQ ID NO: 67640 - DNA, 64 bp, Homo sapiens
  misc_feature 1..64: note = chr1:1234696-1234760
  misc_feature 1..64: note = hypo
  source 1..64: mol_type = genomic DNA
agcccgcccagggcccgtgctcacttacctgcagcagcgtctggagggccggagcaggaggggg

SEQ ID NO: 67641 - DNA, 103 bp, Homo sapiens; identical to SEQ ID NO: 38707
  misc_feature 1..103: note = chr1:1235178-1235281
  misc_feature 1..103: note = hypo
  source 1..103: mol_type = genomic DNA

SEQ ID NO: 67642 - DNA, 177 bp, Homo sapiens; identical to SEQ ID NO: 38708
  misc_feature 1..177: note = chr1:1235901-1236078
  misc_feature 1..177: note = hypo
  source 1..177: mol_type = genomic DNA

SEQ ID NO: 67643 - DNA, 252 bp, Homo sapiens
  misc_feature 1..252: note = chr1:1238230-1238482
  misc_feature 1..252: note = hypo
  source 1..252: mol_type = genomic DNA
cttcaggtgagccagcgcagctcggttccaggccaggcacagcccacaggtggcagggaggccgcgctcaccatgtggtagttcaccacctcctgtaggctgtcagcgaacctctgcagacattcctggaggagcagatgggaacccgtgctgagatggcaaatccgggcccaggtcacccagccacgccctctgagcccctgggcggtgcagacaccggcctgcttctggcctggacgccctcaaggggct

SEQ ID NO: 67644 - DNA, 188 bp, Homo sapiens
  misc_feature 1..188: note = chr1:1239479-1239667
  misc_feature 1..188: note = hypo
  source 1..188: mol_type = genomic DNA
cctcaatctccaccacgtccgtctccacctcgtcaatggtcgccctaaagcaagaacggggctggctggggtcacctgcagcctcagccccctcggggcttcacctccccccgcacctccctgaggggctccaccatgggaaggggctttcaggaaacaggctgggagacagacgcctgcctgctacg

SEQ ID NO: 67645 - DNA, 345 bp, Homo sapiens
  misc_feature 1..345: note = chr1:1245007-1245352
  misc_feature 1..345: note = hypo
  source 1..345: mol_type = genomic DNA
agggggcgggcaggccggccccaccctcctgacggtcaccctggtccctgaagctgcctggatatggtcgccatgcaggaagccgcccagcacctcctcggcacacacgacttcagcgccttccagtccgctggcagcccggtgccgagccccgtgcgaacgctgcgccgggtctccgtttccccaggccaagccagccccttggtcacccccgaggagagcaggtgaggaagggcccctgggctgtggccctgccctcaagtcacgtgctgattttagctccagcacctcccccagttttaaggcaaggtgaggcgggaggcaggcagccgggagtcctcagga

SEQ ID NO: 67646 - DNA, 30 bp, Homo sapiens
  misc_feature 1..30: note = chr1:1247668-1247698
  misc_feature 1..30: note = hypo
  source 1..30: mol_type = genomic DNA
acgcggcaggtgaagcgcagctggtgctca

SEQ ID NO: 67647 - DNA, 35 bp, Homo sapiens
  misc_feature 1..35: note = chr1:1253245-1253280
  misc_feature 1..35: note = hypo
  source 1..35: mol_type = genomic DNA
tttttttttttgagccggagtctcgcgtctcgctc

SEQ ID NO: 67648 - DNA, 35 bp, Homo sapiens
  misc_feature 1..35: note = chr1:1253520-1253555
  misc_feature 1..35: note = hypo
  source 1..35: mol_type = genomic DNA
attacaggcgtgagccaccgcgcctggccaaggca

SEQ ID NO: 67649 - DNA, 30 bp, Homo sapiens
  misc_feature 1..30: note = chr1:12551925-12551955
  misc_feature 1..30: note = hypo
  source 1..30: mol_type = genomic DNA
agggcttaacatggccgacaagctccagct

SEQ ID NO: 67650 - DNA, 100 bp, Homo sapiens
  misc_feature 1..100: note = chr1:1257399-1257499
  misc_feature 1..100: note = hypo
  source 1..100: mol_type = genomic DNA
gcctgttcctgcccccgctgggtgtgagctctctgagagcagggtctcagctgtctcctccctctgcatctcctaccccaagccacgccaggctcacaga

SEQ ID NO: 67651 - DNA, 30 bp, Homo sapiens
  misc_feature 1..30: note = chr1:1264857-1264887
  misc_feature 1..30: note = hypo
  source 1..30: mol_type = genomic DNA
gtgccatgcttgtgccgtttgcgtgtccca

SEQ ID NO: 67652 - DNA, 57 bp, Homo sapiens
  misc_feature 1..57: note = chr1:12655969-12656026
  misc_feature 1..57: note = hyper
  source 1..57: mol_type = genomic DNA
gacgccgtgatgtcacgggcgccgctgacctgtggctgaacccggagctgtaaatga

SEQ ID NO: 67653 - DNA, 30 bp, Homo sapiens
  misc_feature 1..30: note = chr1:1266025-1266055
  misc_feature 1..30: note = hypo
  source 1..30: mol_type = genomic DNA
gtacagctggccatgcggttcctacagctt

SEQ ID NO: 67654 - DNA, 1138 bp, Homo sapiens
  misc_feature 1..1138: note = chr1:1267047-1268185
  misc_feature 1..1138: note = hypo
  source 1..1138: mol_type = genomic DNA
ggccatgaaaatggccgtggaggagatcaacaacaagtcggatctgctgcccgggctgcgcctgggctacgacctctttgatacgtgctcggagcctgtggtggccatgaagcccagcctcatgttcctggccaaggcaggcagccgcgacatcgccgcctactgcaactacacgcagtaccagccccgtgtgctggctgtcatcgggccccactcgtcagagctcgccatggtcaccggcaagttcttcagcttcttcctcatgccccaggtgggcgccccccaccatcacccacccccacccagccctgcccgtgggagcccctgtgtcaggagatgcctcttggcccttgcaggtcagctacggtgctagcatggagctgctgagcgcccgggagaccttcccctccttcttccgcaccgtgcccagcgaccgtgtgcagctgacggccgccgcggagctgctgcaggagttcggctggaactgggtggccgccctgggcagcgacgacgagtacggccggcagggcctgagcatcttctcggccctggccgcggcacgcggcatctgcatcgcgcacgagggcctggtgccgctgccccgtgccgatgactcgcggctggggaaggtgcaggacgtcctgcaccaggtgaaccagagcagcgtgcaggtggtgctgctgttcgcctccgtgcacgccgcccacgccctcttcaactacagcatcagcagcaggctctcgcccaaggtgtgggtggccagcgaggcctggctgacctctgacctggtcatggggctgcccggcatggcccagatgggcacggtgcttggcttcctccagaggggtgcccagctgcacgagttcccccagtacgtgaagacgcacctggccctggccaccgacccggccttctgctctgccctgggcgagagggagcagggtctggaggaggacgtggtgggccagcgctgcccgcagtgtgactgcatcacgctgcagaacgtgagcgcagggctaaatcaccaccagacgttctctgtctacgcagctgtgtatagcgtggcccaggccctgcacaacactcttcagtgcaacgcctcaggctgccccgcgcaggaccccgtgaagccctggca

SEQ ID NO: 67655 - DNA, 30 bp, Homo sapiens
  misc_feature 1..30: note = chr1:1273471-1273501
  misc_feature 1..30: note = hypo
  source 1..30: mol_type = genomic DNA
aggccagggggcagccgggtggggcagcgg

SEQ ID NO: 67656 - DNA, 17 bp, Homo sapiens
  misc_feature 1..17: note = chr1:12805063-12805080
  misc_feature 1..17: note = hypo
  source 1..17: mol_type = genomic DNA
aacgcatgcctcctctg

SEQ ID NO: 67657 - DNA, 30 bp, Homo sapiens
  misc_feature 1..30: note = chr1:1280896-1280926
  misc_feature 1..30: note = hypo
  source 1..30: mol_type = genomic DNA
ctccgctgaaactcacggcagctgccaggg

SEQ ID NO: 67658 - DNA, 82 bp, Homo sapiens
  misc_feature 1..82: note = chr1:1308761-1308843
  misc_feature 1..82: note = hypo
  source 1..82: mol_type = genomic DNA
tcaccccgtgcattccgggtgctccctaaaccccagtcctgtccccctgtacttctgccatccgggtcggcctccccaggga

SEQ ID NO: 67659 - DNA, 253 bp, Homo sapiens
  misc_feature 1..253: note = chr1:1309067-1309320
  misc_feature 1..253: note = hypo
  source 1..253: mol_type = genomic DNA
gagagacctcacacccggcaaatggagctccagacccgcaggaaaggctgagtcctctgagaatttattactacggatcacagcagcaacgggcgggaagggcggcgccagactcatttgccccgcaggtagatcttgggggtctgccagccttcgggggcttcctttagccccgccttcagccagatgcgcctcaggtctttctcgaacttgatctgcaagacgcagagagagggaccgccaagtaattcgt

SEQ ID NO: 67660 - DNA, 93 bp, Homo sapiens
  misc_feature 1..93: note = chr1:1341737-1341830
  misc_feature 1..93: note = hypo
  source 1..93: mol_type = genomic DNA
aaaaaaaaaccggggtacgttagatgctaggttcatgaggctgagacgggagtggtgaggcgcagtaatgaggcggcacgtggacagagtgga

SEQ ID NO: 67661 - DNA, 30 bp, Homo sapiens
  misc_feature 1..30: note = chr1:1344048-1344078
  misc_feature 1..30: note = hypo
  source 1..30: mol_type = genomic DNA
actccagatttaactcgcttcaaatgtctt

SEQ ID NO: 67662 - DNA, 215 bp, Homo sapiens
  misc_feature 1..215: note = chr1:1355522-1355737
  misc_feature 1..215: note = hyper
  source 1..215: mol_type = genomic DNA
cgcagcgccgccccgcgccccgcagcggcagccacgagcagggcgccgtccaggcccgcgccgccggccgccagcagctccagcaccgccagccgcccgcccgcggccgcccagtgcgccgccgtccagccgcgcgcgtcctccgcctccgctgccgcgggtcccgggcccggagcctccagcaggcgcgcggccagcagcgtgtggcccagggc

SEQ ID NO: 67663 - DNA, 30 bp, Homo sapiens
  misc_feature 1..30: note = chr1:1356905-1356935
  misc_feature 1..30: note = hypo
  source 1..30: mol_type = genomic DNA
acctcccccaggaagcgcagccttggatgt

SEQ ID NO: 67664 - DNA, 46 bp, Homo sapiens; identical to SEQ ID NO: 38715
  misc_feature 1..46: note = chr1:1363856-1363902
  misc_feature 1..46: note = hypo
  source 1..46: mol_type = genomic DNA

SEQ ID NO: 67665 - DNA, 132 bp, Homo sapiens
  misc_feature 1..132: note = chr1:1371107-1371239
  misc_feature 1..132: note = hyper
  source 1..132: mol_type = genomic DNA
gcgccccgtccctcgcgcgcgatgctcccctggacggcgctcggcctggccctgagcttgcggctggcgctggcgcggagcggcgcggagcgcggtgagtgcggcgggcggccgggccggggctggggcttc

SEQ ID NO: 67666 - DNA, 340 bp, Homo sapiens
  misc_feature 1..340: note = chr1:13839429-13839769
  misc_feature 1..340: note = hyper
  source 1..340: mol_type = genomic DNA
ctcccccagcctagccggctcggctcacctttgggcagtttggatgcgttctcctggatccaggagaagaggtgggcgaagtcacagtcgcacagccaggggttcccgtccagacgcagggagcgcagcgcgggcagcgcggccagggcggccacgctgaggctgcgcaggttgttgtcgttgagctccagcacctgcagcgactccagggtctcgaaggcgtcctcgtgcacgcccaccaggttgttgttagccaggctaagcttcaccagcctcccggccgagcggaaggcgccggcgcccagctgggtcaagttgttgtagctgaggtcgaggaaca

SEQ ID NO: 67667 - DNA, 177 bp, Homo sapiens; identical to SEQ ID NO: 26061
  misc_feature 1..177: note = chr1:13840521-13840698
  misc_feature 1..177: note = hyper
  source 1..177: mol_type = genomic DNA

SEQ ID NO: 67668 - DNA, 77 bp, Homo sapiens
  misc_feature 1..77: note = chr1:13854197-13854274
  misc_feature 1..77: note = hypo
  source 1..77: mol_type = genomic DNA
aaatgatagttttagaagactatttaatgatataaaaagtcatacaattaagtgaaaatcaacggtttacaaaacct

SEQ ID NO: 67669 - DNA, 21 bp, Homo sapiens
  misc_feature 1..21: note = chr1:13882124-13882145
  misc_feature 1..21: note = hypo
  source 1..21: mol_type = genomic DNA
aagagtcgcttctttctttgg

SEQ ID NO: 67670 - DNA, 193 bp, Homo sapiens
  misc_feature 1..193: note = chr1:13910055-13910248
  misc_feature 1..193: note = hyper
  source 1..193: mol_type = genomic DNA
taatttttaaaaccccgtttgttgcatgtggtccctttccctcctgttgttgagcagaataaaagcccattttgccagggcccgcagtcctggcggcccccgcagctgcggccctgtaactttaaacctggcctgagatcatcgttttggcgccggccaaacagagcccgagggcgggcctagcgcgcccgga

SEQ ID NO: 67671 - DNA, 388 bp, Homo sapiens
  misc_feature 1..388: note = chr1:13910310-13910698
  misc_feature 1..388: note = hyper
  source 1..388: mol_type = genomic DNA
cgctcggaaagttctcaactgcaaagtttgctgtccggctgcctagggtctgggaagctcgggcaccctccctctccggggctcctgctcccacccctccggcccccccaccgtcgcgctcctccaggctgggcctgtggccgcggtgctttttaattttcccccagctcagaatcttgctgctcggcccccaggagagcaacaactcaacgggaacgatgtggaaggtgtcagctctgctcttcgttttgggaagcgcgtcgctctgggtcctggcagaaggaggtaagacccagcgcaagtggcttcctgccgtcgctgatggggacgagcgagcagagacttgctggaatgcccgggcctggtattcgaggttgtccaggggagc

SEQ ID NO: 67672 - DNA, 58 bp, Homo sapiens
  misc_feature 1..58: note = chr1:13910699-13910757
  misc_feature 1..58: note = hyper
  source 1..58: mol_type = genomic DNA
cgggggagctgagggtgtgtgcgtgtcaggcggctgagcgccggaggaggagaggcag

SEQ ID NO: 67673 - DNA, 134 bp, Homo sapiens
  misc_feature 1..134: note = chr1:13910793-13910927
  misc_feature 1..134: note = hyper
  source 1..134: mol_type = genomic DNA
cgcgggtgtgccgggaggagccccggaatccacaggctgcgaggtgggcagcacagggggcctccctccgagtcggcagcaccagagagatcgggtggaaggttcacagtaggcagccccgcttgctggcagca

SEQ ID NO: 67674 - DNA, 160 bp, Homo sapiens
  misc_feature 1..160: note = chr1:13936570-13936730
  misc_feature 1..160: note = hypo
  source 1..160: mol_type = genomic DNA
aacaaaaaataaaaaaataaagctgaataacgttctgttgcatgtatagaccatactgtgtatccattcttctgtctgcagacgcttgggttgctaccacttttggctgttgtgaataatgctgctatgaacatgtgtgtacaaccgtctcttcaagatc

SEQ ID NO: 67675 - DNA, 730 bp, Homo sapiens
  misc_feature 1..730: note = chr1:14026466-14027196
  misc_feature 1..730: note = hyper
  source 1..730: mol_type = genomic DNA
cctagccctagggtgcggtcggacttgccgcgacgccagccgccggggttccttcccgaggcgccgccatgggatccgcggtgacctacgaggggcggctgggtggtggccattgggcgacggcgcagggtcaagggccgggctctgggatcgtggggagaccgggggtcccggagccccccagccccgcaggccactgcctcgccgcccgacgtcacttccgactggagtcaagatggcggcggcgcggccgcgggcgccggggccggcgaaacagcggcggcggcggcggccctcggtgctctgaggcgctggcgcggcgggcgcgggtaaggagtggcgcgggtgggcggcctctgggctcgcgccgggacgctggtccctccccccgaggagcgcggcggcgacggcggcggcgacacgctggggacccggcgccgcagggatggccgggtcggcggacgcgccccctcagaggtcccgggcgtgccgggggccccgggacgaggcgcgggcctccgggtcggtggccccgcgggtgggtggcggcgccgggctcctccttgtcggccgtggggtccctgcggcgaagttcgggattcggtttgtcgccgtgaagagccgcgcgccccgcgggggacgcgtgcgggctgcagagactggccgggtgcgggcggcggtggggccacctggggccccacgtggggccgggcgccgtcccaattgtcaa

SEQ ID NO: 67676 - DNA, 116 bp, Homo sapiens
  misc_feature 1..116: note = chr1:14079260-14079376
  misc_feature 1..116: note = hypo
  source 1..116: mol_type = genomic DNA
gacgggatgcctgggcgtttaccaggtgtgcgatcttggacagctcatgtcacctttctgagatgaagtttccctagccttaaaaatgaatatcatcatatcgatgatgcttgtgc

SEQ ID NO: 67677 - DNA, 54 bp, Homo sapiens
  misc_feature 1..54: note = chr1:14125568-14125622
  misc_feature 1..54: note = hypo
  source 1..54: mol_type = genomic DNA
aaacacagaggtctccgccacttacttcgtcactaagtccggcatgttcaccat

SEQ ID NO: 67678 - DNA, 194 bp, Homo sapiens; identical to SEQ ID NO: 38860
  misc_feature 1..194: note = chr1:14139406-14139600
  misc_feature 1..194: note = hypo
  source 1..194: mol_type = genomic DNA

SEQ ID NO: 67679 - DNA, 928 bp, Homo sapiens
  misc_feature 1..928: note = chr1:14218911-14219839
  misc_feature 1..928: note = hyper
  source 1..928: mol_type = genomic DNA
ccctaaatgctggcccgagatgatgcagcctctctggagttagcatcttcatgattagcaggtggaatagcaaaataaacccagcactggcagaaatagctgttggaatcatgcaaaaagtacccctctcctccttttccagagaagcggccccttttggtttggagcaggggacagatccttcatacacagtagggttgggtcggctaagatgaagtactcagatctctgtatcaccggagcgccctaggggatgtgtggcattttctccttttctcttcttggtctctggattttatcgcaggcagtcgggtctcccgtgcctggcacttccttggctgtgggcaggaagaggttacagcagccctggagcctgctgggctgagttagcacttccctccgcatccagaatatctcccaggaactgccccctttgcatcgccgcaccggggtggcggcgcgggctgggggccgctgcagcaggtctcagtccctccctgctgccacgcgaggagtggggagcggcagggcctaggcgtcccgagtggaggatgagccggagacgcctgcgggtccggagctgcaccgcgcccgtgcggcccgcgccgcccgcctcccgcgctctccctttggcagcagccggacgcctggcgcgtgcaggacctggggccgcggcgctcgcgcggggacgcgggagcccagggtcggcgctgcaggcagcggggcggcgccagcaaggccagctccccggggaccctggggcagcctcgcgccctgcctgcctccctggactgagacgccgcggggcctgggcagcgctctgccggcagctggtgctggaacacagccggggctgagctgctcccggggaccctgccccttccaggtgaccccaggagaagcagccccgggccggggggcaagttcc

SEQ ID NO: 67680 - DNA, 112 bp, Homo sapiens
  misc_feature 1..112: note = chr1:1471673-1471785
  misc_feature 1..112: note = hypo
  source 1..112: mol_type = genomic DNA
gtgccctttcctccacggctgccaccgcgcctgccaggcccactgcccctggtgtttcttctgctcctctatccctgggaggtgctgtcggaggccacgggggctctaccca

SEQ ID NO: 67681 - DNA, 60 bp, Homo sapiens; identical to SEQ ID NO: 14211
  misc_feature 1..60: note = chr1:14730412-14730472
  misc_feature 1..60: note = hypo
  source 1..60: mol_type = genomic DNA

SEQ ID NO: 67682 - DNA, 346 bp, Homo sapiens
  misc_feature 1..346: note = chr1:1475298-1475644
  misc_feature 1..346: note = hyper
  source 1..346: mol_type = genomic DNA
cgtaggccttggtagggggagcgcagcgggtatggggatcgcaggctggggaggggagcgcaggccggggtggggggagcgcaggcccgggaggggaccgcgggccggggagggggaagcgcaggccggggtggggggagcgtaggccggagagaggagcgtagggagtgtggggatcgcaggttggggaggggagcggaggccggggtgggggagcgcaggccggggaggggagcgcaggccggggaggggagcgcaggccggggaggggagcgcaggccgcacgggcggtaaacaaggcgcgggaggtgggccaggcggcgcgcgcgggcggggagcagggggc

SEQ ID NO: 67683 - DNA, 85 bp, Homo sapiens
  misc_feature 1..85: note = chr1:1476254-1476339
  misc_feature 1..85: note = hyper
  source 1..85: mol_type = genomic DNA
cggtcctggaggggcgccgaggcccttcccgccccactgctccgccctacgtcctggactcccaggtcgccgggtgcgggactgc

SEQ ID NO: 67684 - DNA, 51 bp, Homo sapiens; identical to SEQ ID NO: 26600
  misc_feature 1..51: note = chr1:147775362-147775413
  misc_feature 1..51: note = hyper
  source 1..51: mol_type = genomic DNA

SEQ ID NO: 67685 - DNA, 100 bp, Homo sapiens
  misc_feature 1..100: note = chr1:147775523-147775623
  misc_feature 1..100: note = hyper
  source 1..100: mol_type = genomic DNA
aggctttggagcctgcacaattgttctacaaaaggcagtagctccgccgaacgttggatcgtcccttggtctggtgataccagaacgagagttgactgtg

SEQ ID NO: 67686 - DNA, 30 bp, Homo sapiens; identical to SEQ ID NO: 38716
  misc_feature 1..30: note = chr1:1483034-1483064
  misc_feature 1..30: note = hypo
  source 1..30: mol_type = genomic DNA

SEQ ID NO: 67687 - DNA, 694 bp, Homo sapiens
  misc_feature 1..694: note = chr1:14924504-14925198
  misc_feature 1..694: note = hyper
  source 1..694: mol_type = genomic DNA
cctcatctctgtccccgccaatattcagcccggctaagaagcttaggagctggctaaggctgctcctccacctggatgcacacacagggctagggctgtggagaggcgggagcaccagcggcccacgccgaggaagataggcgctccctcctggggtgggcagcgcaggtctggcctgcgggtggggggtggagagtgagaggcacgcggggcaccagctcagctcccctctggggatttcgtactcgcagtttaaggaaccggtggagcacgaactccactcctgagctggcgcaagcgtctcccttccatggagatccaccccggctcccctctgaggccccctttccaagcaccctctcttccgagcacccagcacctccccaaccttagcacggctcggggcaccagttctccagggcgggggctgccccaccgctcaagggaggggacagagggccggcctcggtccaggcgacccctgcccctcgccaggggcgccaccttggccccctcccgactgccgtccgccgcctccgcccccccggggggtgtgtctccgaagtacgggggcgcgggaggccaagggtgcccccagcctccgaccgagaccccctcccgagccggcggcgaatggtaggctccatttaaagagtgcctggtggcgcgcggtgtccttcttggagcagctctc

SEQ ID NO: 67688 - DNA, 1005 bp, Homo sapiens
  misc_feature 1..1005: note = chr1:14925199-14926204
  misc_feature 1..1005: note = hyper
  source 1..1005: mol_type = genomic DNA
gcgcccgcccgccggggtctcggcgatcgctgctcctcctcctccttctcctcctcttttttctcctccgcctcctccccccgccgcctcgccaccgccgcggctagggctggaggcgccgctgtcattcctgtgccggaggaaccggcgctgccggtgcctgggggtcggggcgcgggcgaagccgggccgcggaggacacaacaggtagagccgggggtgcccggccgcgcgccccccgcgcatcatgcagctctttgtcacctctctcgcccccaggccaaaatcctgagcatgatggaagacaataagcagctcgcgctccgcatcgatggggcggtccagtcggccagccaggaggtgaccaacctgcgagccgaactcacggccaccaaccggagactggcggaactgagcggcggcggcggccccggcccgggcccgggagccgcggccagcgcctcggcggcgggggactcggcggcgacgaacatggagaacccccagcttggagcgcaaggtaggatcgccccggcgcccagggcggaggaaggcgagcagagcacgcccggcctcggaggtggccggggacccggggtcccccacacccggggcgaaatcgctttgcattctggcttgtaaccctttccgcccggcggtggccaccgctgctctccggctgggagttgcaggctgctgtcattcacgaaaacccgagcgcagtgtgcacggggtcacacggtcacaccggccccggccagcctgagcgaggcgcagccggcgggtcccttccggcatcagaaagtgccctttccgtggcaccagccccctagctccgtgcaaacttttcatgccggggccttttccccaccccccgcaggggtgaatggcacagttccccccacttccttaggctccttcccagagagagctccgggctctgccgccgtggttgggatagaggattgcactgctgtgcacttttctccgcggatgccaaatccc

SEQ ID NO: 67689 - DNA, 251 bp, Homo sapiens
  misc_feature 1..251: note = chr1:150185824-150186075
  misc_feature 1..251: note = hyper
  source 1..251: mol_type = genomic DNA
taagaatctgacccacgagtttcagtccaagtaacctggacctgcccagaggaagcaaagcggaagtaggatccaaaacgctttcagcaggccgcctgcgcccccgcgcatgcgcaggtctctgactttgaccgttttggcgggtgcgcgccagccctagtttatctagaggggaagggcggtgcgggaccacgtgactggggttgcggcatttctggcccaatccgagacggtttcgtagagcgccctgt

SEQ ID NO: 67690 - DNA, 40 bp, Homo sapiens
  misc_feature 1..40: note = chr1:1502515-1502555
  misc_feature 1..40: note = hypo
  source 1..40: mol_type = genomic DNA
gcaggacaggccatgcggctccacgcgcacctccgaagat

SEQ ID NO: 67691 - DNA, 30 bp, Homo sapiens
  misc_feature 1..30: note = chr1:150504403-150504433
  misc_feature 1..30: note = hypo
  source 1..30: mol_type = genomic DNA
acacccttgctctgtcgcccaggctggagt

SEQ ID NO: 67692 - DNA, 30 bp, Homo sapiens
  misc_feature 1..30: note = chr1:150529962-150529992
  misc_feature 1..30: note = hypo
  source 1..30: mol_type = genomic DNA
cactcaggtgtctggcgccccattttcctc

SEQ ID NO: 67693 - DNA, 138 bp, Homo sapiens
  misc_feature 1..138: note = chr1:150565309-150565447
  misc_feature 1..138: note = hypo
  source 1..138: mol_type = genomic DNA
gattacaggcatgagccaccgcacctggcctggtttaccctttcattgacagtggagcctgtgcccactgcattaaagttgaagctctgtcactggcgatttggcagattcccctagagctgtcgccaattccagcca

SEQ ID NO: 67694 - DNA, 149 bp, Homo sapiens
  misc_feature 1..149: note = chr1:150602992-150603141
  misc_feature 1..149: note = hypo
  source 1..149: mol_type = genomic DNA
aacatttggtaaatacggttaatactagttaacctatccagaattacagtttaacatttcctgggcgtctgtctgtatgtggatggtactgtgttagttggggggggtacgtgtatagtaaggcagtctctgcccttagaaagcttaca

SEQ ID NO: 67695 - DNA, 30 bp, Homo sapiens
  misc_feature 1..30: note = chr1:150693359-150693389
  misc_feature 1..30: note = hypo
  source 1..30: mol_type = genomic DNA
ccttcaacggtcacccgctggggcgcgaca

SEQ ID NO: 67696 - DNA, 104 bp, Homo sapiens
  misc_feature 1..104: note = chr1:150850631-150850735
  misc_feature 1..104: note = hypo
  source 1..104: mol_type = genomic DNA
tttcctggtaataggaagcattgagctattcgaggtaggcactgtccaaaatgctttatatgtatttactcatttaatcctcacaacaacgatgaggtaggttc

SEQ ID NO: 67697 - DNA, 50 bp, Homo sapiens
  misc_feature 1..50: note = chr1:150940902-150940952
  misc_feature 1..50: note = hypo
  source 1..50: mol_type = genomic DNA
aatgttccaaggtggcgttgggaggtgcccgcagccgagttttctccttt

SEQ ID NO: 67698 - DNA, 58 bp, Homo sapiens
  misc_feature 1..58: note = chr1:150947697-150947755
  misc_feature 1..58: note = hyper
  source 1..58: mol_type = genomic DNA
ccacttccagccccacggggcgcgggcggaggagggtgcagcccggggatcctgccca

SEQ ID NO: 67699 - DNA, 61 bp, Homo sapiens
  misc_feature 1..61: note = chr1:151032676-151032737
  misc_feature 1..61: note = hyper
  source 1..61: mol_type = genomic DNA
ggcccccagtcagcacgggggtgctggaagagatcgggaataatagcgcagaccaatgagc

SEQ ID NO: 67700 - DNA, 34 bp, Homo sapiens
  misc_feature 1..34: note = chr1:151080126-151080160
  misc_feature 1..34: note = hypo
  source 1..34: mol_type = genomic DNA
aatagctgggtgaggcggctcacggctgtaatcc

SEQ ID NO: 67701 - DNA, 37 bp, Homo sapiens
  misc_feature 1..37: note = chr1:151104646-151104683
  misc_feature 1..37: note = hypo
  source 1..37: mol_type = genomic DNA
tctctgggggagccccgaggggcgagttaaggcagct

SEQ ID NO: 67702 - DNA, 145 bp, Homo sapiens
  misc_feature 1..145: note = chr1:151106046-151106191
  misc_feature 1..145: note = hypo
  source 1..145: mol_type = genomic DNA
acctaggcccagaggcgccggcagttcccaggcctgacatcatcgtccctcccgctgctactcagcctcactcctacagcctccaccatcctcaggattcacctctcctgactcctcagcatacagcccacgcactacccctcac

SEQ ID NO: 67703 - DNA, 114 bp, Homo sapiens
  misc_feature 1..114: note = chr1:151118621-151118735
  misc_feature 1..114: note = hyper
  source 1..114: mol_type = genomic DNA
caaataatcccttttcgcgcttcccagtccagcgggatgcgactcgacgaaagcccaattgaacgaggtgcccagactctgctctcaccagtacagttacggggctcggccact

SEQ ID NO: 67704 - DNA, 120 bp, Homo sapiens
  misc_feature 1..120: note = chr1:151169648-151169768
  misc_feature 1..120: note = hypo
  source 1..120: mol_type = genomic DNA
attctatggatgttcgggtcctaggttactttatgaggacccacaagacatctggaaagaggataaccaggtcattctgggggttacaaaacctgttttttttgtttgtttgttttgttt

SEQ ID NO: 67705 - DNA, 138 bp, Homo sapiens
  misc_feature 1..138: note = chr1:151170068-151170206
  misc_feature 1..138: note = hypo
  source 1..138: mol_type = genomic DNA
aatggagttatttcatgggccatgagtttgagaggatctatctgaccgactcttaccccgaatgttttaccattcctctttatttattcattccacagataattatggagcccctactatgtacgaagtcactggagg

SEQ ID NO: 67706 - DNA, 94 bp, Homo sapiens
  misc_feature 1..94: note = chr1:151252667-151252761
  misc_feature 1..94: note = hypo
  source 1..94: mol_type = genomic DNA
tacttcaaaggagctcggaaactctccgggtgcgccggggagtcctggttccggtgtcctgggactcctgggcagggtaacgaaaccactttta

SEQ ID NO: 67707 - DNA, 84 bp, Homo sapiens; identical to SEQ ID NO: 39049
  misc_feature 1..84: note = chr1:151300852-151300936
  misc_feature 1..84: note = hypo
  source 1..84: mol_type = genomic DNA

SEQ ID NO: 67708 - DNA, 30 bp, Homo sapiens; identical to SEQ ID NO: 39050
  misc_feature 1..30: note = chr1:151345799-151345829
  misc_feature 1..30: note = hypo
  source 1..30: mol_type = genomic DNA

SEQ ID NO: 67709 - DNA, 81 bp, Homo sapiens
  misc_feature 1..81: note = chr1:151347981-151348062
  misc_feature 1..81: note = hypo
  source 1..81: mol_type = genomic DNA
tgctactagaggtgacgggcgccatgccgggccctacacactaacaattagctcaggttccgcccatggcacagctggaga

SEQ ID NO: 67710 - DNA, 60 bp, Homo sapiens
  misc_feature 1..60: note = chr1:151445917-151445977
  misc_feature 1..60: note = hyper
  source 1..60: mol_type = genomic DNA
ggtgggtgggtataccgggaggggacagctggagccgcgaaggcgcgggggcccgcggcg

SEQ ID NO: 67711 - DNA, 71 bp, Homo sapiens
  misc_feature 1..71: note = chr1:151481576-151481647
  misc_feature 1..71: note = hypo
  source 1..71: mol_type = genomic DNA
ttgaagaacagatgacgaaggcggtgactcagaggctcccacttatccttgtaattcgtgttcatggtgct

SEQ ID NO: 67712 - DNA, 44 bp, Homo sapiens
  misc_feature 1..44: note = chr1:15149251-15149295
  misc_feature 1..44: note = hypo
  source 1..44: mol_type = genomic DNA
cccactcacctccatcgctggctctgtggcgagtgctcctttcc

SEQ ID NO: 67713 - DNA, 69 bp, Homo sapiens
  misc_feature 1..69: note = chr1:151513143-151513212
  misc_feature 1..69: note = hyper
  source 1..69: mol_type = genomic DNA
ctcctgcctgggactcggcgccggcgagcccgtgcttgggccgcgggtctcaggcgtcttttgggcagc

SEQ ID NO: 67714 - DNA, 54 bp, Homo sapiens
  misc_feature 1..54: note = chr1:151678593-151678647
  misc_feature 1..54: note = hypo
  source 1..54: mol_type = genomic DNA
gctttcatcctgacacgtgggcaagagctgggctcagcgcggggtgacagggag

SEQ ID NO: 67715 - DNA, 316 bp, Homo sapiens
  misc_feature 1..316: note = chr1:151689335-151689651
  misc_feature 1..316: note = hyper
  source 1..316: mol_type = genomic DNA
gtcagtctcaggggtcgaatacaaattctctaccctggagagggacgcacaatccaggcacgagccacgccctctttctatctccatcctccctgactcccttcccgcccccagaagagcagctggtcctgttgataataacccttcccccatcttactccccagtcaggagttgggcaaagcactaagatggagaatttatagaggaaccctaaagtggggtccattgttccgggggctggagctgtccccggtgctggaagactcagcagatggggggtggcggggaaagaggggagcccggcatctggggagc

SEQ ID NO: 67716 - DNA, 544 bp, Homo sapiens
  misc_feature 1..544: note = chr1:151693862-151694406
  misc_feature 1..544: note = hyper
  source 1..544: mol_type = genomic DNA
caccccccaagcccccgccccggagctcacccctcagttccctcagcccctagcccctgcttcgctgaaggggccgggcttgggggcagggcggggccgggggcggggcctcgccggctcgcggccggtcgccttgacgaccgcagcaagatggagacgctgccaggcttgctgcagcggcccgaccccggggcgcttagcgcagcgcagctggagcagctgcgaaaattcaaggtgggtgcgcccgcgcccccatccagcgtccaccaaagtgtagctgccccaggactggggccccagactgggaagagagccgccgagagaaggggagcgggagcctgttccctgataaagtggggagggcgcaggggagacccccggcggacctctaggcgtctgatcccagcacagagcgcgacgggcatctgagagtgcaggaagaactaactcagggactcggccagagaaatgggccgaaattactgccagacacatccgaccttagtaaaggcccctcatcctgaacaagcggcagaatgatatt

SEQ ID NO: 67717 - DNA, 77 bp, Homo sapiens
  misc_feature 1..77: note = chr1:151801573-151801650
  misc_feature 1..77: note = hyper
  source 1..77: mol_type = genomic DNA
ccccggcctggcagtcggccccaccccctcccatctccctgcctctgtccagcatttctcctcgccttttttcacaa

SEQ ID NO: 67718 - DNA, 61 bp, Homo sapiens
  misc_feature 1..61: note = chr1:152009237-152009298
  misc_feature 1..61: note = hyper
  source 1..61: mol_type = genomic DNA
cccagttccctcccacgaggctgatttttcctgctgtttcctgccacgtccacacataagt

SEQ ID NO: 67719 - DNA, 272 bp, Homo sapiens
  misc_feature 1..272: note = chr1:152080369-152080641
  misc_feature 1..272: note = hyper
  source 1..272: mol_type = genomic DNA
cgcggaattttctgtcgcgctcctggcggcgcagctgctgttcttccctttccggacggagctgctcttcctctaggatttttctgtagcgttcttggcggcgcagctgctcttgctccgtttcttggcgcagctgttcctcctcacggaattttctctccagttcctggcggcgcagctgctgttcctcctggaggaattttctctctcgttcctgacggcggagctgctgttcctcttcgcggaattttctgtcacgctcttggcggcgc

SEQ ID NO: 67720 - DNA, 105 bp, Homo sapiens
  misc_feature 1..105: note = chr1:152083260-152083365
  misc_feature 1..105: note = hyper
  source 1..105: mol_type = genomic DNA
agaaaccgttgttcccgctgctggcgctcctcggccctcagctgcctctcccgctgctcccgcaatgggggcctggccgacagcctctgacggcccctctcgctc

SEQ ID NO: 67721 - DNA, 119 bp, Homo sapiens; identical to SEQ ID NO: 26608
  misc_feature 1..119: note = chr1:152083590-152083709
  misc_feature 1..119: note = hyper
  source 1..119: mol_type = genomic DNA

SEQ ID NO: 67722 - DNA, 739 bp, Homo sapiens
  misc_feature 1..739: note = chr1:152083710-152084449
  misc_feature 1..739: note = hyper
  source 1..739: mol_type = genomic DNA
cgcttcagccgctgctcgcgcctttcctgctgctcgcgccttagttgctgctggcgcctctcctcctgctcctcgctcttcagcagctgctggcgcctctcttcctccggctcctcgcgcttcagccgctgctcgcgcctctcctcctgctcgagtctctccacctcctcgcgcttcagtcgctgctcgagcctctcttcctgctcgcgcttcagccgctgctggcgcctctcctcctcgcgcttcagcagctgatcgcgcctctcctcctgctcgcgcttcagccgctgctctcgcctctcctgctcgagcctcttctcctcctcgcgcttcagcagctgctcgcgcctctcctcctgctcgcgtcttagttgttgctcgctcctcaaccgctgctggagcctctcttcctcctcctggcgcttcagccgctgctcgcgcctctcctcttgctcccgccttagttgctgctcgcgcctctcctgctgctcgcgcctctcctcctcctcgagcttcagccaacgttcgcgcctctcctcctcctggtcgcgcttcagctgctgcttgcgcctctcctgctcgtgcctctccgtctcctcctcgcgcttcagccaatcgcgcctctcctcctgctcgcgcttcagccgctgctcgcgcctctcctgctcgtgcttctgctcgtgcctctcctcctcctgctcgcgcctcagctgctgctcgcgcctcagctgctgctcgc

SEQ ID NO: 67723 - DNA, 859 bp, Homo sapiens
  misc_feature 1..859: note = chr1:152084689-152085548
  misc_feature 1..859: note = hyper
  source 1..859: mol_type = genomic DNA
gcctctcctcctgctgctcgcgcctctcctgctgctcgcgcctctcctcctgctgctcgcgcctctcctcctcctgcttgcgccttagttgctgctcgcgcctcagcctttgctgctgctgctcttcctcctggcgctccctcctcagctcttgccgctccagcttccgtagctgctcttcttcctcctggagctctctttgccgctgcggctcctcttcctgcaacttctcttcttccttccggagcactgtctcgcgcttcctccactctttctcttcttcctcctggaacactctgtcttgccgctctcgcctttgctgctgtttctcctcgcggcccttcctcctcagctccagcagctcccgccttcgcagttgctcttcgtctggaaactcctcagtttcgtgacctttgcaactctgcagctgctcttcctctgcacggcgctcttcccgttcttgccattcttgcctttgccgccacagctcctcgtcgcggcgctgcctgtcgcgctgttcaagtcgctcttgtttctcactttgctcctctccctcagctagctccctctcctgttcctgcctcttctgcctgcgtcgttgcccaggttcttcttccagttgtctgtcccggggctcgaatctcctttggtcttcttcttgcctgcgatcttgtaacaggctctcctttccgtcacaccgggctcgcttctcctcatccagtcccgtggcctggccgagagcatagtaacaagcttgagccactttgaaaataaataggaggaattcgttgaaatcgacacgcccattactgtcaagatccagaagttccaggatcagatctaccgtcttagggtcatg

SEQ ID NO: 67724 - DNA, 30 bp, Homo sapiens
  misc_feature 1..30: note = chr1:152192377-152192407
  misc_feature 1..30: note = hypo
  source 1..30: mol_type = genomic DNA
gactcatatgggccacggcttgaagacctc

SEQ ID NO: 67725 - DNA, 66 bp, Homo sapiens
  misc_feature 1..66: note = chr1:152276060-152276126
  misc_feature 1..66: note = hypo
  source 1..66: mol_type = genomic DNA
tcctctccttgaccccgggtgtccacgaatggtgtcctgaccctcttgggacgctgagtgcctgga

SEQ ID NO: 67726 - DNA, 30 bp, Homo sapiens
  misc_feature 1..30: note = chr1:152282667-152282697
  misc_feature 1..30: note = hypo
  source 1..30: mol_type = genomic DNA
gaaggttcatggtgacgtgaccctgagtgc

SEQ ID NO: 67727 - DNA, 51 bp, Homo sapiens; identical to SEQ ID NO: 39054
  misc_feature 1..51: note = chr1:152286249-152286300
  misc_feature 1..51: note = hypo
  source 1..51: mol_type = genomic DNA

SEQ ID NO: 67728 - DNA, 168 bp, Homo sapiens; identical to SEQ ID NO: 26611
  misc_feature 1..168: note = chr1:152487789-152487957
  misc_feature 1..168: note = hyper
  source 1..168: mol_type = genomic DNA

SEQ ID NO: 67729 - DNA, 252 bp, Homo sapiens
  misc_feature 1..252: note = chr1:152487999-152488251
  misc_feature 1..252: note = hyper
  source 1..252: mol_type = genomic DNA
cggcgactcaggctgctgcggctccagctccaccagttgctgctgcttcccaaggagacgccgccgacagcggagtagtggttgctgctgctgcgggggcggcagccagaggtcccagcgctccaacaaccggagctcaggatgctgctccggctgctgagaggcccgcaacccccagcgctgcgctagagaaacccgcccagcccagagcgggcccgccccgctgcggctcccacgcggggctgggcctcg

SEQ ID NO: 67730 - DNA, 85 bp, Homo sapiens
  misc_feature 1..85: note = chr1:15251189-15251274
  misc_feature 1..85: note = hyper
  source 1..85: mol_type = genomic DNA
cagcgcgcggagccccgagccccgggcgggtgcagcgggaggcgtgcgggacgcagagtgagttcctcggcgtggggaccggggc

SEQ ID NO: 67731 - DNA, 81 bp, Homo sapiens; identical to SEQ ID NO: 26071
  misc_feature 1..81: note = chr1:15251499-15251580
  misc_feature 1..81: note = hyper
  source 1..81: mol_type = genomic DNA

SEQ ID NO: 67732 - DNA, 16 bp, Homo sapiens
  misc_feature 1..16: note = chr1:152696808-152696824
  misc_feature 1..16: note = hypo
  source 1..16: mol_type = genomic DNA
ggagtcttgctctgtc

SEQ ID NO: 67733 - DNA, 127 bp, Homo sapiens
  misc_feature 1..127: note = chr1:15314099-15314226
  misc_feature 1..127: note = hypo
  source 1..127: mol_type = genomic DNA
gacaggaatgagcttcgcgtatgttggggacccagaagccattgtagctggaaagtgaaggatggagagggagcaggagatgaggggaggggcactttcatgcggggctctgcggtcctgggtaagg

SEQ ID NO: 67734 - DNA, 30 bp, Homo sapiens
  misc_feature 1..30: note = chr1:153395112-153395142
  misc_feature 1..30: note = hyper
  source 1..30: mol_type = genomic DNA
gtgctgtgagctgtccgtggtgctgaattc

SEQ ID NO: 67735 - DNA, 79 bp, Homo sapiens; identical to SEQ ID NO: 26613
  misc_feature 1..79: note = chr1:153438376-153438455
  misc_feature 1..79: note = hyper
  source 1..79: mol_type = genomic DNA

SEQ ID NO: 67736 - DNA, 375 bp, Homo sapiens
  misc_feature 1..375: note = chr1:1535001-1535376
  misc_feature 1..375: note = hyper
  source 1..375: mol_type = genomic DNA
cgcggcaggaggccccgaggagcacgcgctcgcacgggaagcgcgtgtaggcgccgcgccacgagcagttgagcgcgaaggcgcgcacgcggcgcgcggcggccggggccaggcgccactgcaggaggacgctgcggttgcgcaggacgctggcgcgcagggagcggccggccggggcgtgcagcacgcagcccggagcctggcagcggaagccgcgcgcggggctgcggaagcacaggcgcccgccgcccgcctcggggccctcgggcagcaccttgtaggggcaccagggcgcgtcgggggtcggctcccagcccggcggcgtcggggcggccgcggcgcagggcggcggcgcgcaggcggccagcagcagca

SEQ ID NO: 67737 - DNA, 109 bp, Homo sapiens; identical to SEQ ID NO: 14268
  misc_feature 1..109: note = chr1:153539476-153539585
  misc_feature 1..109: note = hypo
  source 1..109: mol_type = genomic DNA

SEQ ID NO: 67738 - DNA, 219 bp, Homo sapiens; identical to SEQ ID NO: 39057
  misc_feature 1..219: note = chr1:153540023-153540242
  misc_feature 1..219: note = hypo
  source 1..219: mol_type = genomic DNA

SEQ ID NO: 67739 - DNA, 193 bp, Homo sapiens
  misc_feature 1..193: note = chr1:1535748-1535941
  misc_feature 1..193: note = hyper
  source 1..193: mol_type = genomic DNA
caccttggacccctgcggcttttccgagccgaaactcacgggctgtggccggcttcgtttcgcgtcgtgcagctccgcgaccgcccgtggccacaccagtcggggacttcgtgctttacgatgggggcgcagcggtctggcacgcgcaggaccccgggccttgcaccccaacgctggccgccctggacccgcg

SEQ ID NO: 67740 - DNA, 150 bp, Homo sapiens; identical to SEQ ID NO: 39058
  misc_feature 1..150: note = chr1:153608334-153608484
  misc_feature 1..150: note = hypo
  source 1..150: mol_type = genomic DNA

SEQ ID NO: 67741 - DNA, 40 bp, Homo sapiens
  misc_feature 1..40: note = chr1:153620461-153620501
  misc_feature 1..40: note = hypo
  source 1..40: mol_type = genomic DNA
gggcaacaagagtgaaactccatctcgaaaaaaaaaaggt

SEQ ID NO: 67742 - DNA, 89 bp, Homo sapiens
  misc_feature 1..89: note = chr1:153644958-153645047
  misc_feature 1..89: note = hypo
  source 1..89: mol_type = genomic DNA
gagactctcccatttcggcctccctagtagttgggactactcaaaggcacaggccacaccactccgagctaattttatttttttttttg

SEQ ID NO: 67743 - DNA, 87 bp, Homo sapiens
  misc_feature 1..87: note = chr1:153650936-153651023
  misc_feature 1..87: note = hyper
  source 1..87: mol_type = genomic DNA
ctccaaagaggtaggcgtggggcggccgagaccggggaagatggtccacggggaagcgcgcgggctgggcggcggggaggaaggagt

SEQ ID NO: 67744 - DNA, 989 bp, Homo sapiens
  misc_feature 1..989: note = chr1:153651443-153652432
  misc_feature 1..989: note = hyper
  source 1..989: mol_type = genomic DNA
gagccccggggtgagcgtccccgtcccgctcctgctccttcccatagggacgcgcctgatgcctgggaccggccgctgagcccaaggggaccgaggaggccatggtaggagcgctcgcctgctgcggtgcccgctgaggccatgccggggccccggcgccccgctggctcccgcctgcgcctgctcctgctcctgctgctgccgccgctgctgctgctgctccggggcagccacgcgggcaacctgacggtagccgtggtactgccgctggccaatacctcgtacccctggtcgtgggcgcgcgtgggacccgccgtggagctggccctggcccaggtgaaggcgcgccccgacttgctgccgggctggacggtccgcacggtgctgggcagcagcgaaaacgcgctgggcgtctgctccgacaccgcagcgcccctggccgcggtggacctcaagtgggagcacaaccccgctgtgttcctgggccccggctgcgtgtacgccgccgccccagtggggcgcttcaccgcgcactggcgggtcccgctgctgaccgccggcgccccggcgctgggcttcggtgtcaaggacgagtatgcgctgaccacccgcgcggggcccagctacgccaagctgggggacttcgtggcggcgctgcaccgacggctgggctgggagcgccaagcgctcatgctctacgcctaccggccgggtgacgaagagcactgcttcttcctcgtggaggggctgttcatgcgggtccgcgaccgcctcaatattacggtggaccacctggagttcgccgaggacgacctcagccactacaccaggctgctgcggaccatgccgcgcaaaggccgaggtgagacgctggcacaccccgtcccgccgcttagccgcagggcctcccctctgacctgccggaggcatcgggactttctctctcatctgggggcactcttctttctcctcgccgttcttcattctac

SEQ ID NO: 67745 - DNA, 65 bp, Homo sapiens
  misc_feature 1..65: note = chr1:153662197-153662262
  misc_feature 1..65: note = hypo
  source 1..65: mol_type = genomic DNA
gacagacgctgcacccggtgtgacggtgtggccggccgcacagttgcagccgtcaagtcctgcac

SEQ ID NO: 67746 - DNA, 102 bp, Homo sapiens; identical to SEQ ID NO: 39060
  misc_feature 1..102: note = chr1:153937070-153937172
  misc_feature 1..102: note = hypo
  source 1..102: mol_type = genomic DNA

SEQ ID NO: 67747 - DNA, 80 bp, Homo sapiens
  misc_feature 1..80: note = chr1:154098530-154098610
  misc_feature 1..80: note = hypo
  source 1..80: mol_type = genomic DNA
accgcgcccggccaagaaatgtttttaatgaaacctgaaaccccaaatgatatatacacaatgaccgcaaatgcagatat

SEQ ID NO: 67748 - DNA, 22 bp, Homo sapiens
  misc_feature 1..22: note = chr1:154107501-154107523
  misc_feature 1..22: note = hypo
  source 1..22: mol_type = genomic DNA
ccacgcccggcctctgtgtacc

SEQ ID NO: 67749 - DNA, 23 bp, Homo sapiens
  misc_feature 1..23: note = chr1:154156755-154156778
  misc_feature 1..23: note = hypo
  source 1..23: mol_type = genomic DNA
gccggcctcggcctcccaaagtg

SEQ ID NO: 67750 - DNA, 176 bp, Homo sapiens
  misc_feature 1..176: note = chr1:154238843-154239019
  misc_feature 1..176: note = hypo
  source 1..176: mol_type = genomic DNA
ttgaagctggaaaaccgaccaaaattcccttgcattggtatagctagaaaggctacagatatcacctcatctcaggaataagggccaggtagctagctgagctaatcctcctgtctgtttcctcctcccccaggtgtttcagtcacctccagtaacacgggcgtgccagatatctc

SEQ ID NO: 67751 - DNA, 30 bp, Homo sapiens
  misc_feature 1..30: note = chr1:154292635-154292665
  misc_feature 1..30: note = hypo
  source 1..30: mol_type = genomic DNA
tgtgtgatcttgggccgggcacggtggctc

SEQ ID NO: 67752 - DNA, 43 bp, Homo sapiens
  misc_feature 1..43: note = chr1:154298110-154298153
  misc_feature 1..43: note = hyper
  source 1..43: mol_type = genomic DNA
ccccgccccagcccccggcatgggcagtacggggccgccgggg

SEQ ID NO: 67753 - DNA, 221 bp, Homo sapiens; identical to SEQ ID NO: 26616
  misc_feature 1..221: note = chr1:154298253-154298474
  misc_feature 1..221: note = hyper
  source 1..221: mol_type = genomic DNA

SEQ ID NO: 67754 - DNA, 30 bp, Homo sapiens
  misc_feature 1..30: note = chr1:154302983-154303013
  misc_feature 1..30: note = hypo
  source 1..30: mol_type = genomic DNA
gcaaggacaacctaccgttgggactgaggg

SEQ ID NO: 67755 - DNA, 30 bp, Homo sapiens; identical to SEQ ID NO: 39064
  misc_feature 1..30: note = chr1:154305492-154305522
  misc_feature 1..30: note = hypo
  source 1..30: mol_type = genomic DNA

SEQ ID NO: 67756 - DNA, 129 bp, Homo sapiens
  misc_feature 1..129: note = chr1:154324138-154324267
  misc_feature 1..129: note = hypo
  source 1..129: mol_type = genomic DNA
tgttttttaactctgcgcttttccgcatgcctcacatcttcctggcttctcaagtgagtatcaaggaagctaaagtcttatattaaagggagctttcctccagggaagggagggcggatgaggatgggg

SEQ ID NO: 67757 - DNA, 138 bp, Homo sapiens
  misc_feature 1..138: note = chr1:154325447-154325585
  misc_feature 1..138: note = hyper
  source 1..138: mol_type = genomic DNA
ccctttcctcctggtcgcttgcttccatatgtgaacccttacttgcttcccaatccagcccggagcccgtggtctggtactcgtcgctttgccccggaacattccagccttgggtcagcccagcgtctcccagggtga

SEQ ID NO: 67758 - DNA, 36 bp, Homo sapiens
  misc_feature 1..36: note = chr1:154474549-154474585
  misc_feature 1..36: note = hyper
  source 1..36: mol_type = genomic DNA
tgctccgtgcgcccccggccggccgtcgcccacgcc

SEQ ID NO: 67759 - DNA, 35 bp, Homo sapiens
  misc_feature 1..35: note = chr1:154474743-154474778
  misc_feature 1..35: note = hyper
  source 1..35: mol_type = genomic DNA
gggcgccgggggcttccccctgctctttcctcctg

SEQ ID NO: 67760 - DNA, 81 bp, Homo sapiens; identical to SEQ ID NO: 95
  misc_feature 1..81: note = chr1:154474987-154475068
  misc_feature 1..81: note = hyper
  source 1..81: mol_type = genomic DNA

SEQ ID NO: 67761 - DNA, 173 bp, Homo sapiens; identical to SEQ ID NO: 96
  misc_feature 1..173: note = chr1:154475371-154475544
  misc_feature 1..173: note = hyper
  source 1..173: mol_type = genomic DNA

SEQ ID NO: 67762 - DNA, 54 bp, Homo sapiens; identical to SEQ ID NO: 39065
  misc_feature 1..54: note = chr1:154499777-154499831
  misc_feature 1..54: note = hypo
  source 1..54: mol_type = genomic DNA

SEQ ID NO: 67763 - DNA, 78 bp, Homo sapiens
  misc_feature 1..78: note = chr1:154516767-154516845
  misc_feature 1..78: note = hypo
  source 1..78: mol_type = genomic DNA
taacataacaggtgacgtctacggaggcagatttgtaatgcagtgcaggcagtggggccgttgcgttttgcaccccac

SEQ ID NO: 67764 - DNA, 32 bp, Homo sapiens
  misc_feature 1..32: note = chr1:154533446-154533478
  misc_feature 1..32: note = hypo
  source 1..32: mol_type = genomic DNA
aaaaatttaaaagatcggccgggcgcggtgac

SEQ ID NO: 67765 - DNA, 37 bp, Homo sapiens
  misc_feature 1..37: note = chr1:154536500-154536537
  misc_feature 1..37: note = hypo
  source 1..37: mol_type = genomic DNA
ggattacaggtgtgagccatcacgcctggccccaagg

SEQ ID NO: 67766 - DNA, 227 bp, Homo sapiens
  misc_feature 1..227: note = chr1:154540058-154540285
  misc_feature 1..227: note = hyper
  source 1..227: mol_type = genomic DNA
ctcttgccccttctccgaccatgctgcaggtcctgccccaactttaggacttcagaactcctccaccgtgccgtggaggaacagcccttcttccacctcacgcacaccctaccacggcagaaccaatcgaagactatcccagccggggaccccccttttttttcctgggacccagcgtttccgcctccggggcgcagactcctccccctcaccgtcccaattgtatt

SEQ ID NO: 67767 - DNA, 189 bp, Homo sapiens
  misc_feature 1..189: note = chr1:154682354-154682543
  misc_feature 1..189: note = hypo
  source 1..189: mol_type = genomic DNA
gggttgtggcccccacgctggtgctcaccaactgcctgaccgtgggatggtcactttgttcccttggatcttggtttcctcatctatattgataatcagaactaccaattgcaaaacctttatagtttacaaagcattttcacagatatcatcttattcgatcacctgagcctccgatggtaggaatta

SEQ ID NO: 67768 - DNA, 30 bp, Homo sapiens
  misc_feature 1..30: note = chr1:154685747-154685777
  misc_feature 1..30: note = hypo
  source 1..30: mol_type = genomic DNA
gcccacaagacataccggtagattgcaaat

SEQ ID NO: 67769 - DNA, 47 bp, Homo sapiens; identical to SEQ ID NO: 26621
  misc_feature 1..47: note = chr1:154733207-154733254
  misc_feature 1..47: note = hyper
  source 1..47: mol_type = genomic DNA

SEQ ID NO: 67770 - DNA, 85 bp, Homo sapiens
  misc_feature 1..85: note = chr1:15479692-15479777
  misc_feature 1..85: note = hyper
  source 1..85: mol_type = genomic DNA
agggggagagggaggcggtggcctccccaggaaggaggagaggtgagtatcccgccaggtaaaggcggggcggctggcggagctg

SEQ ID NO: 67771 - DNA, 116 bp, Homo sapiens
  misc_feature 1..116: note = chr1:15480110-15480226
  misc_feature 1..116: note = hyper
  source 1..116: mol_type = genomic DNA
gcccgggggtggtgccgagggccgggagggagggtcggccggtgggcggtgcttctccgggctggaggccgctcctggccggcaccgccctccgcctcccgcggtccctccctccc

SEQ ID NO: 67772 - DNA, 179 bp, Homo sapiens
  misc_feature 1..179: note = chr1:154808666-154808845
  misc_feature 1..179: note = hypo
  source 1..179: mol_type = genomic DNA
tgagtgttgagcagccggaagagcagccagaaggtacctcgtacaagtgaggagatggtaggactcccacagtacccctgggtccctcttgctgttgtaataggaggagccagaggaacaccccacctgatactcgactggccttaatttgggctcctgccccccgtctattttgccct

SEQ ID NO: 67773 - DNA, 125 bp, Homo sapiens
  misc_feature 1..125: note = chr1:15480940-15481065
  misc_feature 1..125: note = hyper
  source 1..125: mol_type = genomic DNA
acgggggtaaagaatcgggcatgagcaaagtggattgaaactcgagtccttccctgagcgcgtcggtttcttcatctgtgaaactgacatgacaacgtcccagggtgcggcggggcattcatgcc

SEQ ID NO: 67774 - DNA, 30 bp, Homo sapiens; identical to SEQ ID NO: 39069
  misc_feature 1..30: note = chr1:154851806-154851836
  misc_feature 1..30: note = hypo
  source 1..30: mol_type = genomic DNA

SEQ ID NO: 67775 - DNA, 21 bp, Homo sapiens
  misc_feature 1..21: note = chr1:154954412-154954433
  misc_feature 1..21: note = hypo
  source 1..21: mol_type = genomic DNA
tcaccgcgcccggcctttttt

SEQ ID NO: 67776 - DNA, 30 bp, Homo sapiens
  misc_feature 1..30: note = chr1:155019681-155019711
  misc_feature 1..30: note = hypo
  source 1..30: mol_type = genomic DNA
actggaggtgaaggtcgggggagactccat

SEQ ID NO: 67777 - DNA, 309 bp, Homo sapiens
  misc_feature 1..309: note = chr1:155043397-155043706
  misc_feature 1..309: note = hyper
  source 1..309: mol_type = genomic DNA
tgtgggggtctcacccggctcccagcggccccaggccagcctccttttcgcagaaccaggcgggcgcgctcgctcccgcggctggggctggcgcgcggacgcgccgctgataacgcatgtgcgaaagagacgcggggcccagtcagctttctccgcactcagacgcacgccctaactgtcgggcgctcccacttgacacggacacacgcccctgccggccgcccagccccttgcaggtgcaagggcggatgcctcagcgaccacgggagccgggctggggaggttggtggggggcggggggagtcttaa

SEQ ID NO: 67778 - DNA, 45 bp, Homo sapiens
  misc_feature 1..45: note = chr1:155054426-155054471
  misc_feature 1..45: note = hyper
  source 1..45: mol_type = genomic DNA
cgcagggaggaggggcggaggtgtcgggcgcgctgattctccccc

SEQ ID NO: 67779 - DNA, 199 bp, Homo sapiens
  misc_feature 1..199: note = chr1:155055105-155055304
  misc_feature 1..199: note = hyper
  source 1..199: mol_type = genomic DNA
tttctgcaagagaggcgagaggctataggggatgaagtggagcaagaagagagaacagtacgaaggggcagggcacaacccggtccccaggtcccagcccacccccacccttccgcaggaggcgcggccctagaggcggggttagctgcggagcttcgcgtgggcccagcggcacctctctctccgcactgctagggag

SEQ ID NO: 67780 - DNA, 30 bp, Homo sapiens
  misc_feature 1..30: note = chr1:155064834-155064864
  misc_feature 1..30: note = hypo
  source 1..30: mol_type = genomic DNA
tcctccagtctcctccggtgtggcctgggg

SEQ ID NO: 67781 - DNA, 31 bp, Homo sapiens
  misc_feature 1..31: note = chr1:155113365-155113396
  misc_feature 1..31: note = hypo
  source 1..31: mol_type = genomic DNA
tctatagtgcctaggcgggacagaactcctt

SEQ ID NO: 67782 - DNA, 66 bp, Homo sapiens
  misc_feature 1..66: note = chr1:155146189-155146255
  misc_feature 1..66: note = hyper
  source 1..66: mol_type = genomic DNA
aagaaatggctcccccgtcaaatacctttccatattccccaaccccccgaccggctttcgagaacc

SEQ ID NO: 67783 - DNA, 29 bp, Homo sapiens
  misc_feature 1..29: note = chr1:155147233-155147262
  misc_feature 1..29: note = hyper
  source 1..29: mol_type = genomic DNA
cggagaagggggtgccgctgaccgggttg

SEQ ID NO: 67784 - DNA, 30 bp, Homo sapiens
  misc_feature 1..30: note = chr1:155154997-155155027
  misc_feature 1..30: note = hypo
  source 1..30: mol_type = genomic DNA
aagacctccttcacccgtatcttaaaattc

SEQ ID NO: 67785 - DNA, 98 bp, Homo sapiens; identical to SEQ ID NO: 14271
  misc_feature 1..98: note = chr1:155160925-155161023
  misc_feature 1..98: note = hypo
  source 1..98: mol_type = genomic DNA

SEQ ID NO: 67786 - DNA, 30 bp, Homo sapiens
  misc_feature 1..30: note = chr1:155176630-155176660
  misc_feature 1..30: note = hypo
  source 1..30: mol_type = genomic DNA
ctcaaaaagacaaaacgaaaacaaaaaaaa

SEQ ID NO: 67787 - DNA, 30 bp, Homo sapiens
  misc_feature 1..30: note = chr1:1552463-1552493
  misc_feature 1..30: note = hypo
  source 1..30: mol_type = genomic DNA
ccatgctggcctccccgcctcagggcttca

SEQ ID NO: 67788 - DNA, 36 bp, Homo sapiens
  misc_feature 1..36: note = chr1:155311784-155311820
  misc_feature 1..36: note = hypo
  source 1..36: mol_type = genomic DNA
gtgcagacaggatagcggttccggtggatcttgtaa

SEQ ID NO: 67789 - DNA, 21 bp, Homo sapiens
  misc_feature 1..21: note = chr1:155563460-155563481
  misc_feature 1..21: note = hypo
  source 1..21: mol_type = genomic DNA
aataaaattgccattcgggcc

SEQ ID NO: 67790 - DNA, 23 bp, Homo sapiens
  misc_feature 1..23: note = chr1:155578174-155578197
  misc_feature 1..23: note = hypo
  source 1..23: mol_type = genomic DNA
ctaccctcacattctcgaatttc

SEQ ID NO: 67791 - DNA, 120 bp, Homo sapiens
  misc_feature 1..120: note = chr1:155578917-155579037
  misc_feature 1..120: note = hypo
  source 1..120: mol_type = genomic DNA
cttgccttgtttctaaatacacacaagaatgttaatcatagcacctaatagcccaaaaattggaaacaatcccaaaagctattatcagcagtatatatatatatatatatatatatattt

SEQ ID NO: 67792 - DNA, 30 bp, Homo sapiens
  misc_feature 1..30: note = chr1:155659966-155659996
  misc_feature 1..30: note = hypo
  source 1..30: mol_type = genomic DNA
aagagtaggtaatgtcggtgatagatataa

SEQ ID NO: 67793 - DNA, 59 bp, Homo sapiens; identical to SEQ ID NO: 39074
  misc_feature 1..59: note = chr1:155668700-155668759
  misc_feature 1..59: note = hypo
  source 1..59: mol_type = genomic DNA

SEQ ID NO: 67794 - DNA, 30 bp, Homo sapiens
  misc_feature 1..30: note = chr1:155675909-155675939
  misc_feature 1..30: note = hypo
  source 1..30: mol_type = genomic DNA
cctcctaagtagctacgactacagtcctgc

SEQ ID NO: 67795 - DNA, 181 bp, Homo sapiens
  misc_feature 1..181: note = chr1:15573580-15573761
  misc_feature 1..181: note = hyper
  source 1..181: mol_type = genomic DNA
gaaatggggcaggctcgtggggcctggagcattcagcaggcggtaacccagtgggcgttccctgcacggtgccacgccccctctgccgcgcaggccacgccctcatctattaggctggaccccgcggcgcctggcggcgttgccatggcaacgcgcgtacacaggccggccgggcgggcgg

SEQ ID NO: 67796 - DNA, 30 bp, Homo sapiens
  misc_feature 1..30: note = chr1:15573999-15574029
  misc_feature 1..30: note = hyper
  source 1..30: mol_type = genomic DNA
cctggatccaggctccggtccccaggagca

SEQ ID NO: 67797 - DNA, 34 bp, Homo sapiens; identical to SEQ ID NO: 39075
  misc_feature 1..34: note = chr1:155826302-155826336
  misc_feature 1..34: note = hypo
  source 1..34: mol_type = genomic DNA

SEQ ID NO: 67798 - DNA, 58 bp, Homo sapiens
  misc_feature 1..58: note = chr1:155830324-155830382
  misc_feature 1..58: note = hyper
  source 1..58: mol_type = genomic DNA
cctgtttccctgggccgccttttcaaaaagggggactgaccagcgttgatgctggcgg

SEQ ID NO: 67799 - DNA, 30 bp, Homo sapiens
  misc_feature 1..30: note = chr1:155888002-155888032
  misc_feature 1..30: note = hypo
  source 1..30: mol_type = genomic DNA
ttagcaatggtaatacgtgttttgttttgt

SEQ ID NO: 67800 - DNA, 23 bp, Homo sapiens
  misc_feature 1..23: note = chr1:155892702-155892725
  misc_feature 1..23: note = hypo
  source 1..23: mol_type = genomic DNA
aaagacagtcctggccgggcgcg

SEQ ID NO: 67801 - DNA, 23 bp, Homo sapiens
  misc_feature 1..23: note = chr1:155892965-155892988
  misc_feature 1..23: note = hypo
  source 1..23: mol_type = genomic DNA
agcctgggcgacagaaaaaaaaa

SEQ ID NO: 67802 - DNA, 42 bp, Homo sapiens
  misc_feature 1..42: note = chr1:155893814-155893856
  misc_feature 1..42: note = hypo
  source 1..42: mol_type = genomic DNA
ttgcttttttttggccgggcgtggtggttcacgcctgtaatc

SEQ ID NO: 67803 - DNA, 29 bp, Homo sapiens
  misc_feature 1..29: note = chr1:155905289-155905318
  misc_feature 1..29: note = hypo
  source 1..29: mol_type = genomic DNA
ggtaggattacaggcgtgagccaccgcgc

SEQ ID NO: 67804 - DNA, 30 bp, Homo sapiens
  misc_feature 1..30: note = chr1:155911541-155911571
  misc_feature 1..30: note = hypo
  source 1..30: mol_type = genomic DNA
ctgggccaatgcctccggaggcagtgtgct

SEQ ID NO: 67805 - DNA, 30 bp, Homo sapiens; identical to SEQ ID NO: 39078
  misc_feature 1..30: note = chr1:155911924-155911954
  misc_feature 1..30: note = hypo
  source 1..30: mol_type = genomic DNA

SEQ ID NO: 67806 - DNA, 220 bp, Homo sapiens
  misc_feature 1..220: note = chr1:155912424-155912644
  misc_feature 1..220: note = hypo
  source 1..220: mol_type = genomic DNA
tactgtctcctgaggcgggagccccggcaggctctggcaggcaccttcagggatctgcggttgaggctgtggccccagggcggaggctgggtgcaacaggtggccctaaagcaggtaggcaggcggtgggtcgcaagcaacccccgggagagccgcccttctaccctgctcaccaacctggacagagggacacccgggtgaagggcgcaagctgaacaca

SEQ ID NO: 67807 - DNA, 143 bp, Homo sapiens
  misc_feature 1..143: note = chr1:155954169-155954312
  misc_feature 1..143: note = hypo
  source 1..143: mol_type = genomic DNA
gtcccccacactcaccgtttcctgaggtcaatggcagaggactgggatacattccctgccaacacaaaaggagatgagaagtgtctagctaaagccagacaaaggcgcccagggcttcctcccccacccgcttcacctagatc

SEQ ID NO: 67808 - DNA, 30 bp, Homo sapiens
  misc_feature 1..30: note = chr1:15599088-15599118
  misc_feature 1..30: note = hyper
  source 1..30: mol_type = genomic DNA
gcagctgcagggtggcgcttatccacattg

SEQ ID NO: 67809 - DNA, 20 bp, Homo sapiens
  misc_feature 1..20: note = chr1:156010528-156010548
  misc_feature 1..20: note = hypo
  source 1..20: mol_type = genomic DNA
caccgcgcccagccagtcca

SEQ ID NO: 67810 - DNA, 204 bp, Homo sapiens
  misc_feature 1..204: note = chr1:156030654-156030858
  misc_feature 1..204: note = hypo
  source 1..204: mol_type = genomic DNA
caggcgtgagccaccgcgcctggcctcaagtgggtttctgaggggctatttcttgctcattagttgggggaccggccctcaccacagattccagaagcccagcaatgcacactcagccctcagtgggctgtctctgaaggtcctgtccctttttcgcttcccccccgctggagctgcttctcccgcttgcgggagcccaggctg

SEQ ID NO: 67811 - DNA, 105 bp, Homo sapiens; identical to SEQ ID NO: 39082
  misc_feature 1..105: note = chr1:156031479-156031584
  misc_feature 1..105: note = hypo
  source 1..105: mol_type = genomic DNA

SEQ ID NO: 67812 - DNA, 52 bp, Homo sapiens
  misc_feature 1..52: note = chr1:156212895-156212947
  misc_feature 1..52: note = hypo
  source 1..52: mol_type = genomic DNA
gttggctgaccacatcggctttcaggaggcctatcggcgcttctacggcccg

SEQ ID NO: 67813 - DNA, 542 bp, Homo sapiens
  misc_feature 1..542: note = chr1:156215329-156215871
  misc_feature 1..542: note = hyper
  source 1..542: mol_type = genomic DNA
agtagcaggagaggccggtgcacaggaaggagttgagtgcggcggcaggcacaaagaactggtgcaggtggccgtgcagccaggaggccggcatggagtaggcggcataggggaaggcgcagcctgcggtgaggtgggggcgtgcagctgaggcctgaggggcgcgcccctatgtcccgcgtcccacccctcgccccgctccgggacgcccagaccccgcgctcccgcgcctgtccggctcacccagactgtagaggctgagcgcgccgtagtcgaggaagtagcagatgtggcgcatgcggggcgacatggagctgaaggtgtgcgcgcagcacgacgcgaaggggtagaggcaggcgggcagcaggaagaccagcagcggccagtggtacggctccgcacggaagccggggccgcccgccagcgccaggagccgccacaggaagtacctgcggcgggcgcgtgctcaggccgccgcggacccccgcgactgccgctgcagcccgtgggcctggacggtccctgcccgcctgggtaccccc

SEQ ID NO: 67814 - DNA, 30 bp, Homo sapiens
  misc_feature 1..30: note = chr1:156216765-156216795
  misc_feature 1..30: note = hypo
  source 1..30: mol_type = genomic DNA
cactgaggggcttggcggcctcagcccagc

SEQ ID NO: 67815 - DNA, 30 bp, Homo sapiens
  misc_feature 1..30: note = chr1:156232727-156232757
  misc_feature 1..30: note = hypo
  source 1..30: mol_type = genomic DNA
ggcttgacaagagctcggtcctgtgtgact

SEQ ID NO: 67816 - DNA, 39 bp, Homo sapiens
  misc_feature 1..39: note = chr1:156233282-156233321
  misc_feature 1..39: note = hypo
  source 1..39: mol_type = genomic DNA
ttctcctggatgctgcgctcattccgacaggagcgtcca

SEQ ID NO: 67817 - DNA, 206 bp, Homo sapiens; identical to SEQ ID NO: 39083
  misc_feature 1..206: note = chr1:156253833-156254039
  misc_feature 1..206: note = hypo
  source 1..206: mol_type = genomic DNA

SEQ ID NO: 67818 - DNA, 33 bp, Homo sapiens
  misc_feature 1..33: note = chr1:156268868-156268901
  misc_feature 1..33: note = hypo
  source 1..33: mol_type = genomic DNA
ctgccatctcctcctcggcgcccaactcttcct

SEQ ID NO: 67819 - DNA, 91 bp, Homo sapiens
  misc_feature 1..91: note = chr1:156271355-156271446
  misc_feature 1..91: note = hypo
  source 1..91: mol_type = genomic DNA
agctttttttttttttcttttgcatacactcaaaccaatctgcacacacacacccattttgagcccatcaaagccccggacccagccacaa

SEQ ID NO: 67820 - DNA, 179 bp, Homo sapiens
  misc_feature 1..179: note = chr1:1563080-1563259
  misc_feature 1..179: note = hypo
  source 1..179: mol_type = genomic DNA
ctgagtgctgggtgccgggcggacgccatcaacagcacccagagcacagcactgcacgtggccgtgcagaggggcttcctggaggtggtgcgggccctgtgtgagcgcggctgtgacgtcaacctgcccgtgagtgctgctccctggcctgggtgccccctgcccgtgagtgcttgtcc

SEQ ID NO: 67821 - DNA, 116 bp, Homo sapiens
  misc_feature 1..116: note = chr1:156339144-156339260
  misc_feature 1..116: note = hyper
  source 1..116: mol_type = genomic DNA
ctacaaccacaaaaccgacgctgccctctggcaccggagcaaccacagtaacgcggacaatgaattttactttcgctacccaagtgagtgcggggtgagggcgcgcgggaagcaaa

SEQ ID NO: 67822 - DNA, 760 bp, Homo sapiens
  misc_feature 1..760: note = chr1:156357837-156358597
  misc_feature 1..760: note = hyper
  source 1..760: mol_type = genomic DNA
ccgcggggccagcggcgttgagggaaggttctccggaagcagccgctgttctggcttggcgcaagtgcgtgtggacgacagcaggatttcctgcccagggacatctggataagaggcccaaggtccccaggagcccccaggtgcttctgccctgtgtggccagagccccctcggccaggagttagaagctgctcctctgacctctggaggacccggcactccgaaccccgcgcagcctgggaaaggcctgagattccccgctattgggattcacatcacgacgcggcggccccaactcggggaggaattagacacggcgtgagtgtcccaagtgcggggcggtggccgtcccggggcagacgagcgcggctgccgcgtccccccacctcaccccgatattccgctcccaccgtcgggaactcccccaccgccgcctccggccctgcgcgccccttctcctttgtctggcccgcccactcccagccggtccgccgcgccgccccgcgcgccccggcccgtgcgcccgccgccgccgcccaggaacaatgcgggccaatgtctccgggcgggcgagccggctatgcaaatgcccaacggcctgtgagaatccccttcgccgccgcctgggcttccacggcctgaaaagggctggcggccgggcctgggtgggggaggcggccactgcatagggatgagctgttgtcccggagcgcccgggacagagcgccattgtctgtgctgcagtcgtctgatagccagt

SEQ ID NO: 67823 - DNA, 103 bp, Homo sapiens; identical to SEQ ID NO: 38718
  misc_feature 1..103: note = chr1:1563663-1563766
  misc_feature 1..103: note = hypo
  source 1..103: mol_type = genomic DNA

SEQ ID NO: 67824 - DNA, 1120 bp, Homo sapiens
  misc_feature 1..1120: note = chr1:156390096-156391216
  misc_feature 1..1120: note = hyper
  source 1..1120: mol_type = genomic DNA
gaggccggctttccccgggcccctctgcgcagtgtatggggttatttttactttcggttatctagctttatgaagactccacaccactcatacagctagataaccaaagataacaaccaaccccgcctcctggctgctgtcgccgcctcttccacgcagcctcccggccgccgccgccgccagcacctccgcagcttcccggtcgcccgtcagcgggagtaggagggaagggacacgagtggagttgagggggagggtgaagagagaaatgaagtccgagacaaaacaacaacaaaaacctcagacacggagatacagacacgacagagaccgaaaaaggcgtggaaaggacgcgatgacccgtggcgtcgaagtcggggagttgaccccgatccagacccaaaaagtttctggtgccccatttcccgctctcccattcgggccaggagcaggagttccgctggtcccaggtggaagggacgcgcgggcttttcgtgccacccgggaagaccgcagcgacccaggcagaggcctccccagcctcgccgggtctccactgcccttctctggaagatcgagggcgcatccgacagccagagccctgccttcggcggagcccgagcctggcgcgggatggaaatggggagccgcggtgccggcccggccacgtcgccaactcagaaaggcgttggaagcgaagcggagcccttgtgggggaaagagccggattcaagaggccgactaaaaggggaaatgggcagccaaaccccggaggtaaaaaccccagagatgtcctaataggaagcagggaaatcccggcgacccaaagagagaggaaaggctgtggggggcgggtgggggcgacccagagactcccaagcgagtctctcaaggagagaaggaaacagcagagaccccacccgggaagagatccgggagagtacccatgagaggggcggaggggaggaaagcagagggcgacagggcaggtgaccagagtcccaggccctgcagagccccggataaacggctttgttcaaagaggaccagagatcacccagggttgtgaaaatggccgggggttcgaggcgagcggtgctctaggggtgggaaaggggtg

SEQ ID NO: 67825 - DNA, 346 bp, Homo sapiens
  misc_feature 1..346: note = chr1:156391242-156391588
  misc_feature 1..346: note = hyper
  source 1..346: mol_type = genomic DNA
cgaagagggtgggggctcggccggcccctcgtggcggacgcgcgggcacgccggattccgaggcgctcgcccacctcgtgctccacgctggccaggccacttacatcgagcccagggtgcccatccgtgctctcccgcgcggtcctcccggccagttcccgcccctggagcgccagggccctgagttccagatgccggggctcagcgggcgccgggcagaggaggctgccctgctcttagcctccgccgagcctaggcgagcagggtggagcgggtctcacctcctagctccctcctctgcctctgccgcggctctggccccggcgcgctccggctccggactttt

SEQ ID NO: 67826 - DNA, 48 bp, Homo sapiens; identical to SEQ ID NO: 1821
  misc_feature 1..48: note = chr1:156405367-156405415
  misc_feature 1..48: note = hyper
  source 1..48: mol_type = genomic DNA

SEQ ID NO: 67827 - DNA, 437 bp, Homo sapiens; identical to SEQ ID NO: 1822
  misc_feature 1..437: note = chr1:156405634-156406071
  misc_feature 1..437: note = hyper
  source 1..437: mol_type = genomic DNA

SEQ ID NO: 67828 - DNA, 509 bp, Homo sapiens
  misc_feature 1..509: note = chr1:156406104-156406613
  misc_feature 1..509: note = hyper
  source 1..509: mol_type = genomic DNA
cgaacccgaccccgggaaatcctcctagccgccgcctcccagcgccgggtctccccgagcgtgtgctctcggctgcgaggccctgcatgcgcagtgtctgggttcgcggcgtcaagcggagcctcggtccagcctgggcagccgagagcgcggggactgctgaacgcggtccgctccccgccagccgttcgggaccccagcctgggggaaagccgacagcgtccctctccgcgcaaactccacgcggcagcctggactgggatgtggggccagggggctgaataattaacaaccaggagaagccggggagagcgggaagcctggcaagccagggaaagggaagatgagacagagagacatagagagacagggacagagggagacagagagggggctaagagcgacgcgggcgagagaggaagaaaggctggggagaaggaaaaatgagataaataaaggaaaaaagagaagcgaagggcggtgggagaggcagccgggcctctctggga

SEQ ID NO: 67829 - DNA, 146 bp, Homo sapiens
  misc_feature 1..146: note = chr1:156432169-156432315
  misc_feature 1..146: note = hypo
  source 1..146: mol_type = genomic DNA
tggcccctcacactccgcgttcgcctctgcagcacctgggctaggtacagagaagcagccacaccctgttcggaggaagccaagccggatctgctttcctccacagccgctccatctgccccagggcacggctgtgccaggtatga

SEQ ID NO: 67830 - DNA, 47 bp, Homo sapiens; identical to SEQ ID NO: 14276
  misc_feature 1..47: note = chr1:156433495-156433542
  misc_feature 1..47: note = hypo
  source 1..47: mol_type = genomic DNA

SEQ ID NO: 67831 - DNA, 30 bp, Homo sapiens
  misc_feature 1..30: note = chr1:156434427-156434457
  misc_feature 1..30: note = hypo
  source 1..30: mol_type = genomic DNA
acccattcatctggccgcccaggagcccct

SEQ ID NO: 67832 - DNA, 37 bp, Homo sapiens
  misc_feature 1..37: note = chr1:156441193-156441230
  misc_feature 1..37: note = hypo
  source 1..37: mol_type = genomic DNA
tacaggtgtgagccaccgcgcccggccagaatcaact

SEQ ID NO: 67833 - DNA, 333 bp, Homo sapiens
  misc_feature 1..333: note = chr1:156468600-156468933
  misc_feature 1..333: note = hyper
  source 1..333: mol_type = genomic DNA
gtcccccaatcaccccgtataaagaggtcctcagccactcccacaatagtcctaccccacccccatctcctgcccaacacactgggaaaccacaggaaggaaattcattcccaggcagggccgtgggagctgggacagccagactaagtcctggggcgggtgtgaccccgtggccacaagcgggtggacatctgtgaacactgacatgtgccttttcaatgctctcctcagctactgagaccttcctgttggggttgggagaggagtgggaggtggacagctcccaaacgccaaaacacccaatctcaggctgacctgcgctcccctcctatc

SEQ ID NO: 67834 - DNA, 51 bp, Homo sapiens; identical to SEQ ID NO: 26633
  misc_feature 1..51: note = chr1:156474407-156474458
  misc_feature 1..51: note = hyper
  source 1..51: mol_type = genomic DNA

SEQ ID NO: 67835 - DNA, 30 bp, Homo sapiens; identical to SEQ ID NO: 38862
  misc_feature 1..30: note = chr1:15651124-15651154
  misc_feature 1..30: note = hypo
  source 1..30: mol_type = genomic DNA

SEQ ID NO: 67836 - DNA, 167 bp, Homo sapiens
  misc_feature 1..167: note = chr1:156594060-156594227
  misc_feature 1..167: note = hyper
  source 1..167: mol_type = genomic DNA
ctccctctcccaggccgcgccgcccttcctccccctccgctcccatccgctggccctccccaggatccccgccaccccctaggtgtggtgtttccgtaccaacccagccggggccggtaccagttcaattactacgaggcgaagcaggcgtgcgaggagcaggacgg

SEQ ID NO: 67837 - DNA, 624 bp, Homo sapiens
  misc_feature 1..624: note = chr1:156594429-156595053
  misc_feature 1..624: note = hyper
  source 1..624: mol_type = genomic DNA
gctgctcgagggctccgtgcgctaccctgtgctcaccgcacgcgccccgtgcggcggccgaggccggcccgggatccgcagctacggaccccgcgaccggatgcgcgaccgctacgacgccttctgcttcacctccgcgctggcgggtgaggcgcgggacgaaggcagggtcttggggaggggtctgaaaaatgtgggggacgaggagtggacctcagcttgagatcagggcagggtctccgggtccctccaaggcaccgcccccccatcagcccgcccgcccgcccaggctccagctcacctctccaaaccctccctgcacttttgcctcgatcccccaactcctcttacccaagctcgatccagcacctctgcggtcccgcaccccaactccgcctcctgggtgtcagccgcccctctccgcccaccctgccctcggtcggtgacccgctgtggtccccaggccaagtgttcttcgtgcccgggcggctgacgctgtctgaagcccacgcggcgtgccggcgacgcggcgccgtggtggccaaggttgggcacctctacgccgcctggaagttttcggggctagaccagtgcgacggcggctggctggctgacggcagtgtg

SEQ ID NO: 67838 - DNA, 104 bp, Homo sapiens; identical to SEQ ID NO: 5748
  misc_feature 1..104: note = chr1:156595080-156595184
  misc_feature 1..104: note = hyper
  source 1..104: mol_type = genomic DNA

SEQ ID NO: 67839 - DNA, 44 bp, Homo sapiens; identical to SEQ ID NO: 26637
  misc_feature 1..44: note = chr1:156595221-156595265
  misc_feature 1..44: note = hyper
  source 1..44: mol_type = genomic DNA

SEQ ID NO: 67840 - DNA, 169 bp, Homo sapiens; identical to SEQ ID NO: 5749
  misc_feature 1..169: note = chr1:156611775-156611944
  misc_feature 1..169: note = hyper
  source 1..169: mol_type = genomic DNA

SEQ ID NO: 67841 - DNA, 126 bp, Homo sapiens; identical to SEQ ID NO: 26639
  misc_feature 1..126: note = chr1:156611993-156612119
  misc_feature 1..126: note = hyper
  source 1..126: mol_type = genomic DNA

SEQ ID NO: 67842 - DNA, 544 bp, Homo sapiens; identical to SEQ ID NO: 26640
  misc_feature 1..544: note = chr1:156626475-156627019
  misc_feature 1..544: note = hyper
  source 1..544: mol_type = genomic DNA

SEQ ID NO: 67843 - DNA, 15 bp, Homo sapiens
  misc_feature 1..15: note = chr1:156627083-156627098
  misc_feature 1..15: note = hyper
  source 1..15: mol_type = genomic DNA
cggagagtggaggtt

SEQ ID NO: 67844 - DNA, 30 bp, Homo sapiens
  misc_feature 1..30: note = chr1:156636236-156636266
  misc_feature 1..30: note = hypo
  source 1..30: mol_type = genomic DNA
aaaaaaaaaaagaaacgcaaacctggtcag

SEQ ID NO: 67845 - skipped

SEQ ID NO: 67846 - DNA, 222 bp, Homo sapiens
  misc_feature 1..222: note = chr1:156646634-156646856
  misc_feature 1..222: note = hyper
  source 1..222: mol_type = genomic DNA
cgtagagcctctagctcgcgctccagctctgccacctggctactcagccaggcccgggcgcatttctctgcctcgacggcgcgccggttgcgggctacctcctccgtcgtccgctcccgggccagccgcagctgctggcatcggcctgccacgccctccagctcttcagccaggttgtcgcgcgccacctcggccgcgtgcttctcccgccagcgttggtca

SEQ ID NO: 67847 - DNA, 90 bp, Homo sapiens
  misc_feature 1..90: note = chr1:156676449-156676539
  misc_feature 1..90: note = hyper
  source 1..90: mol_type = genomic DNA
gagatggcagggagacggagaaacagaaacggaggtcaggcggggagcctcggggacaggcctgggacccgaggccggaaaccgcagagg

SEQ ID NO: 67848 - DNA, 34 bp, Homo sapiens; identical to SEQ ID NO: 39087
  misc_feature 1..34: note = chr1:156690386-156690420
  misc_feature 1..34: note = hypo
  source 1..34: mol_type = genomic DNA

SEQ ID NO: 67849 - DNA, 34 bp, Homo sapiens
  misc_feature 1..34: note = chr1:1566945-1566979
  misc_feature 1..34: note = hyper
  source 1..34: mol_type = genomic DNA
cgcaacctggcaccctccgcggcccttgcctacc

SEQ ID NO: 67850 - DNA, 121 bp, Homo sapiens
  misc_feature 1..121: note = chr1:1567229-1567350
  misc_feature 1..121: note = hyper
  source 1..121: mol_type = genomic DNA
ctaccctttcctaagcgggagccctggcgctgcccttcccgggctgcctggggccctcttcgctcccccctccgaggaccccgcccagcaggccatgcccaggcctctgcccctggcccac

SEQ ID NO: 67851 - DNA, 132 bp, Homo sapiens; identical to SEQ ID NO: 25993
  misc_feature 1..132: note = chr1:1567781-1567913
  misc_feature 1..132: note = hyper
  source 1..132: mol_type = genomic DNA

SEQ ID NO: 67852 - DNA, 30 bp, Homo sapiens
  misc_feature 1..30: note = chr1:156783716-156783746
  misc_feature 1..30: note = hyper
  source 1..30: mol_type = genomic DNA
gcagccgcgcgtgggcgctgtcctcgccca

SEQ ID NO: 67853 - DNA, 199 bp, Homo sapiens; identical to SEQ ID NO: 26642
  misc_feature 1..199: note = chr1:156814754-156814953
  misc_feature 1..199: note = hyper
  source 1..199: mol_type = genomic DNA

SEQ ID NO: 67854 - DNA, 210 bp, Homo sapiens; identical to SEQ ID NO: 1825
  misc_feature 1..210: note = chr1:156815030-156815240
  misc_feature 1..210: note = hyper
  source 1..210: mol_type = genomic DNA

SEQ ID NO: 67855 - DNA, 480 bp, Homo sapiens; identical to SEQ ID NO: 26644
  misc_feature 1..480: note = chr1:156815273-156815753
  misc_feature 1..480: note = hyper
  source 1..480: mol_type = genomic DNA

SEQ ID NO: 67856 - DNA, 505 bp, Homo sapiens
  misc_feature 1..505: note = chr1:156818562-156819067
  misc_feature 1..505: note = hyper
  source 1..505: mol_type = genomic DNA
acctgggccctaccacggagtacaacttgcgggtcctggcttcctgggtcttcatagcctcgctgagctccgccctcacctgcctgtggtcccgaagaaattggcctcgtccggtcccgcccccgctccggccccgcccccggcactcacgactccttgtagtacacgatgaagctgagcaggtcgcgggcctccagtggctcatagcgctcccagcgtagcaggatgcggtctgcctccgtcacgttggacacgaagcgcagggtgcgagtctggcctgggtggggcgaggggcctgctcgcaaccgcgcctgccagctgcttgagcgcccaccctgaccccgcggcatcccattcccagtgagacctctgaggagaacttctcagagtgtccccctcgagctttctccctcccccgggtgtgcgtgtctagtgtgtggccgcgtgtccaccggcactggggttggggtctcacaggcggcgcggtctccgttggtgcgggggt

SEQ ID NO: 67857 - DNA, 56 bp, Homo sapiens
  misc_feature 1..56: note = chr1:156823879-156823935
  misc_feature 1..56: note = hypo
  source 1..56: mol_type = genomic DNA
ggttggggaagaggtcgcgcaggctctccagtccgtagacacggaagagcagcagg

SEQ ID NO: 67858 - DNA, 124 bp, Homo sapiens
  misc_feature 1..124: note = chr1:156829116-156829240
  misc_feature 1..124: note = hyper
  source 1..124: mol_type = genomic DNA
ccgctgcggctgcagcggctcccgccaaccctttgtccccaccacaggcttcttccaagtggggctgcaccgccggaggggcagccagcgcgcccgggcttctggggagcgctgtgtctagatt

SEQ ID NO: 67859 - DNA, 100 bp, Homo sapiens
  misc_feature 1..100: note = chr1:156829475-156829575
  misc_feature 1..100: note = hyper
  source 1..100: mol_type = genomic DNA
tgagctcaggctgctcggtcggtctgtgtgtccctgtctcggggacttggggggccatccgtgctggggccttggcggagagaaccgtgagcctctagga

SEQ ID NO: 67860 - DNA, 83 bp, Homo sapiens; identical to SEQ ID NO: 26648
  misc_feature 1..83: note = chr1:156830265-156830348
  misc_feature 1..83: note = hyper
  source 1..83: mol_type = genomic DNA

SEQ ID NO: 67861 - DNA, 246 bp, Homo sapiens
  misc_feature 1..246: note = chr1:156830950-156831196
  misc_feature 1..246: note = hyper
  source 1..246: mol_type = genomic DNA
cgggcggtgggggggcgcggggacaggcaggcattgcagtgccccgagggcgcggactcgctgcttgtttgctggtcaggcaggacgagcacggcggaaggctggcaccacgcagccttcggcgctgcccgggcgttcctccgcagccgccgctgccctagcaagctttatggtcagtgcctggatgtcccctagtgttcagggcagctgggccgccggcttcagggagatcgaagggggaaatct

SEQ ID NO: 67862 - DNA, 180 bp, Homo sapiens
  misc_feature 1..180: note = chr1:156838167-156838347
  misc_feature 1..180: note = hypo
  source 1..180: mol_type = genomic DNA
tgcctggggtgacatcgcctgggctccaggtcattgaggagggtgggggaaggagcagccccgcagtagagttctggggccactcccagctctaacaccccttggccctcgggcgtcctgggtggccaggtgtgcccacgctgaaggtccaggtgcccaatgcctcggtggatgtggggg

SEQ ID NO: 67863 - DNA, 389 bp, Homo sapiens
  misc_feature 1..389: note = chr1:156843312-156843701
  misc_feature 1..389: note = hypo
  source 1..389: mol_type = genomic DNA
cctgccctttgatttcgggttctactcgctttgcccgtggacttgtcgggtgtgtgccaggctccctccagctgcgccctgacctcctgctgttgctctttctggcccacagtcccggccagtgtgcagctgcacacggcggtggagatgcaccactggtgcatccccttctctgtggatgggcagccggcaccgtctctgcgctggctcttcaatggctccgtgctcaatgagaccagcttcatcttcactgagttcctggagccggcagccaatgagaccgtgcggcacgggtgtctgcgcctcaaccagcccacccacgtcaacaacggcaactacacgctgctggctgccaaccccttcggccaggcctccgcctccatcatggc

SEQ ID NO: 67864 - DNA, 91 bp, Homo sapiens
  misc_feature 1..91: note = chr1:156849311-156849402
  misc_feature 1..91: note = hypo
  source 1..91: mol_type = genomic DNA
gggctctgtctccttcgctatcccagatggaaacagcaccttcggtttttgcctcttagacctgagagccaccactgtttgtttatttatt

SEQ ID NO: 67865 - DNA, 270 bp, Homo sapiens
  misc_feature 1..270: note = chr1:156849702-156849972
  misc_feature 1..270: note = hypo
  source 1..270: mol_type = genomic DNA
tatttttaatgatggggctggggtaggctgtgccttgacgggctgtcccaggcgcccctggaattgatgcagtgtccgcccgtggcaggtgggaggccgcaccatgctgcccattcgctggatgccgcccgagagcatcctgtaccgtaagttcaccaccgagagcgacgtgtggagcttcggcgtggtgctctgggagatcttcacctacggcaagcagccctggtaccagctctccaacacggaggtcagccccggcccatggtcacc

SEQ ID NO: 67866 - DNA, 425 bp, Homo sapiens; identical to SEQ ID NO: 99
  misc_feature 1..425: note = chr1:156863061-156863486
  misc_feature 1..425: note = hyper
  source 1..425: mol_type = genomic DNA

SEQ ID NO: 67867 - DNA, 84 bp, Homo sapiens; identical to SEQ ID NO: 26651
  misc_feature 1..84: note = chr1:156863640-156863724
  misc_feature 1..84: note = hyper
  source 1..84: mol_type = genomic DNA

SEQ ID NO: 67868 - DNA, 96 bp, Homo sapiens
  misc_feature 1..96: note = chr1:156866303-156866399
  misc_feature 1..96: note = hypo
  source 1..96: mol_type = genomic DNA
actggcgacagcctgcgggaggggttgcgattgatgtgtgaatcaggatccctgcaggtgagtgggccctggggcgtagcccgctcactgctggtg

SEQ ID NO: 67869 - DNA, 195 bp, Homo sapiens
  misc_feature 1..195: note = chr1:156890228-156890423
  misc_feature 1..195: note = hyper
  source 1..195: mol_type = genomic DNA
acccatcagctcctgcgatctctggccggcctcgccctgcctgctccgccgggcctggcccgcccctcgggttctggctccgccacccgccctcgtgggctctcccctcgccttgctctgccctgcggcgccccctgtcggccccgcgtgctctctgcggttgcccctttccctcgggcccgcccgcctcgcgcg

SEQ ID NO: 67870 - DNA, 146 bp, Homo sapiens
  misc_feature 1..146: note = chr1:156890673-156890819
  misc_feature 1..146: note = hyper
  source 1..146: mol_type = genomic DNA
accaaaaagggagagcgcgcggccaaagagaagccagcgaccgttctgcctcccgtgggggaggaggagcccaaaagccctggtacgctggcgccggggtttggggatcgggcttccaggctgcgtcttcccgggttcccactagc

SEQ ID NO: 67871 - DNA, 261 bp, Homo sapiens
  misc_feature 1..261: note = chr1:156893504-156893765
  misc_feature 1..261: note = hyper
  source 1..261: mol_type = genomic DNA
cagaagaggggaccccgttgtctaccgtgcacgcacgcccgttagtcccctttctccgagctcttgctttccccgtttcctatcaagtgttttcagcgtccgtacttccaagcgtttgcaagttgaatggctgcaaaaatatccgtctgaggagggcccctccgcccgcgcgggagagcttggggatgcgggggtgggcgtggccccttctctcacgcccctgcctgcccccgcagaggagtaccagtgctccggggtcct

SEQ ID NO: 67872 - DNA, 188 bp, Homo sapiens
  misc_feature 1..188: note = chr1:156893791-156893979
  misc_feature 1..188: note = hyper
  source 1..188: mol_type = genomic DNA
cgcggtggggctacacggacttccccaaagttgtcaaccggccccgcccccacccgcccttcgtcccctccgcctctttgtcggaaaaggccaccttaggtgagtgacagtggagctccccggtgcctgccagggccgcctagtccatcctcagcctcccttcccacgccgggccaaatggagggacg

SEQ ID NO: 67873 - DNA, 280 bp, Homo sapiens
  misc_feature 1..280: note = chr1:156894012-156894292
  misc_feature 1..280: note = hyper
  source 1..280: mol_type = genomic DNA
cgacgaggccggtggggaggtgggggagtctcccgtcttcctttccaacccagcagaggcgcgagtggccggagaggcagagtccgcaggccggcgcctcccctctggcggtgtcctccaatcccacccgggcacccgtgggccggcccggcgtggggccctggaggtggctgttcccctccctcctcacctctgccttccagacgatccgcggctgtcggggtcctgcagcctcaatagcctggagagcaaatacgtgttcttccggcccaccatccag

SEQ ID NO: 67874 - DNA, 30 bp, Homo sapiens
  misc_feature 1..30: note = chr1:156897401-156897431
  misc_feature 1..30: note = hyper
  source 1..30: mol_type = genomic DNA
gggtttcaaccacatcggtgacgagggcgc

SEQ ID NO: 67875 - DNA, 40 bp, Homo sapiens
  misc_feature 1..40: note = chr1:156897769-156897809
  misc_feature 1..40: note = hyper
  source 1..40: mol_type = genomic DNA
aaagggacacaggagcgctcgcgatcggtgaggagctacc

SEQ ID NO: 67876 - DNA, 30 bp, Homo sapiens
  misc_feature 1..30: note = chr1:156915778-156915808
  misc_feature 1..30: note = hypo
  source 1..30: mol_type = genomic DNA
aatgagggtctggcacgaggcccactgcct

SEQ ID NO: 67877 - DNA, 30 bp, Homo sapiens; identical to SEQ ID NO: 39092
  misc_feature 1..30: note = chr1:157086435-157086465
  misc_feature 1..30: note = hypo
  source 1..30: mol_type = genomic DNA

SEQ ID NO: 67878 - DNA, 31 bp, Homo sapiens
  misc_feature 1..31: note = chr1:15714388-15714419
  misc_feature 1..31: note = hypo
  source 1..31: mol_type = genomic DNA
aagaaaaagactctcccgcagtgatccctta

SEQ ID NO: 67879 - DNA, 37 bp, Homo sapiens
  misc_feature 1..37: note = chr1:157247210-157247247
  misc_feature 1..37: note = hypo
  source 1..37: mol_type = genomic DNA
gtaggaggttttggccggctcaggaagggatgggggt

SEQ ID NO: 67880 - DNA, 96 bp, Homo sapiens
  misc_feature 1..96: note = chr1:157247367-157247463
  misc_feature 1..96: note = hypo
  source 1..96: mol_type = genomic DNA
ttgaaacgggagtcaggtggaggtggattattaggaggcttccatgtagagccgcggcccagtggcctgcagggcctctgacggcagaggcaagca

SEQ ID NO: 67881 - DNA, 48 bp, Homo sapiens
  misc_feature 1..48: note = chr1:157346340-157346388
  misc_feature 1..48: note = hypo
  source 1..48: mol_type = genomic DNA
tcaatacttggaaggcgctggtcagcgcagaagcgaggctggtgggca

SEQ ID NO: 67882 - DNA, 162 bp, Homo sapiens; identical to SEQ ID NO: 39094
  misc_feature 1..162: note = chr1:157458773-157458935
  misc_feature 1..162: note = hypo
  source 1..162: mol_type = genomic DNA

SEQ ID NO: 67883 - DNA, 227 bp, Homo sapiens
  misc_feature 1..227: note = chr1:157490582-157490809
  misc_feature 1..227: note = hypo
  source 1..227: mol_type = genomic DNA
ctctaaagtcagtggcgctcttgcgcccagcccgccaacccgcgctctcagccccaacgccatcacttcagaagcacttcaggaaatatagcagtttagagagctgccagctgtgttacttcgccctgaggagtgcctttctgatcaagcactgtgagggttatcagagggtccgcggaggaaacattttgtccgcatctgtggcccgggcacgggaaacttacctg

SEQ ID NO: 67884 - DNA, 191 bp, Homo sapiens; identical to SEQ ID NO: 39096
  misc_feature 1..191: note = chr1:157527405-157527596
  misc_feature 1..191: note = hypo
  source 1..191: mol_type = genomic DNA

SEQ ID NO: 67885 - DNA, 87 bp, Homo sapiens; identical to SEQ ID NO: 39097
  misc_feature 1..87: note = chr1:157543012-157543099
  misc_feature 1..87: note = hypo
  source 1..87: mol_type = genomic DNA

SEQ ID NO: 67886 - DNA, 30 bp, Homo sapiens
  misc_feature 1..30: note = chr1:157543676-157543706
  misc_feature 1..30: note = hypo
  source 1..30: mol_type = genomic DNA
tttttcttagtatttcgtaggtagttttat

SEQ ID NO: 67887 - DNA, 38 bp, Homo sapiens
  misc_feature 1..38: note = chr1:157608817-157608855
  misc_feature 1..38: note = hypo
  source 1..38: mol_type = genomic DNA
aacctaccggccaggcgcggtggctcacacttgtaatt

SEQ ID NO: 67888 - DNA, 36 bp, Homo sapiens; identical to SEQ ID NO: 39098
  misc_feature 1..36: note = chr1:157791984-157792020
  misc_feature 1..36: note = hypo
  source 1..36: mol_type = genomic DNA

SEQ ID NO: 67889 - DNA, 412 bp, Homo sapiens
  misc_feature 1..412: note = chr1:157895130-157895542
  misc_feature 1..412: note = hypo
  source 1..412: mol_type = genomic DNA
actgtgagaggtgagcggcatggtctgaatctgctagccggcggctccctgctggggtcagtttccttctgtagcagcgaggatgctccaaggtgacgacaagaaacagggcgtgaggagggtaagaggccctatgggcactgtagtcttgtgatgggggaggtggtggcagcggcagcggtggcagagagctagaggagggtgagaaggtggacgcggggccatgtatcccgagctcttcaccagagcccagcacagctctgccggaagcacccctgcagggttagaccagcaggtgcgaggtgcgacgtgggaaagagtccagggccggcggggtgctatgaggcgaggacttcctgagccgaggaccgggtgggttgtgagttgcgaccagcctcgctgacggacccta

SEQ ID NO: 67890 - DNA, 22 bp, Homo sapiens
  misc_feature 1..22: note = chr1:157905741-157905763
  misc_feature 1..22: note = hypo
  source 1..22: mol_type = genomic DNA
aattaagctataggccgggtgc

SEQ ID NO: 67891 - DNA, 138 bp, Homo sapiens
  misc_feature 1..138: note = chr1:157963288-157963426
  misc_feature 1..138: note = hyper
  source 1..138: mol_type = genomic DNA
ggaaatgagtttgtgcgcgtgagtgtgcgcgcgcgcgtgtgtgtgtgcaggggcgggcgcgggcgggcggggggcgggctcccgggctcccgggctcccctcctccccagcccgctcctctggctcgctcgccaactc

SEQ ID NO: 67892 - DNA, 73 bp, Homo sapiens
  misc_feature 1..73: note = chr1:157963443-157963516
  misc_feature 1..73: note = hyper
  source 1..73: mol_type = genomic DNA
cgggcgcacggcgggcggacagcatgctgagcctcctcgtctggatcctcactctctccgatactttctccca

SEQ ID NO: 67893 - DNA, 154 bp, Homo sapiens; identical to SEQ ID NO: 26658
  misc_feature 1..154: note = chr1:157963737-157963891
  misc_feature 1..154: note = hyper
  source 1..154: mol_type = genomic DNA

SEQ ID NO: 67894 - DNA, 30 bp, Homo sapiens
  misc_feature 1..30: note = chr1:158064583-158064613
  misc_feature 1..30: note = hypo
  source 1..30: mol_type = genomic DNA
ctcaacacctatagccggggccctgcctct

SEQ ID NO: 67895 - DNA, 55 bp, Homo sapiens
  misc_feature 1..55: note = chr1:158064823-158064878
  misc_feature 1..55: note = hypo
  source 1..55: mol_type = genomic DNA
tacgccacagccactcgattctcctacacctcccagcactcggactacggccagc

SEQ ID NO: 67896 - DNA, 530 bp, Homo sapiens
  misc_feature 1..530: note = chr1:158083182-158083712
  misc_feature 1..530: note = hyper
  source 1..530: mol_type = genomic DNA
ccttttgagattctccggacctgcgcgccgcccgctcggcagggggctcggcaggcgcgggcggcgggtgggggcgggaggctctgcccgctcggtggctgccgcggcctcctccgcgctgctctccacgcctggcttattatgcacgaggcaggcaatttgccttcctccccggggacccatctcggagacaagaaggtagtttgttctctgtaatggcttctgctggagtgcggcggggcccaggcgcgagcgggggcacgggcggggagttggcagcgaaggatgcgcccggcgccccccggcggccgcccggagcccgaggtcggcgcgggaggagcgctgactccgcgggccgagccctcccctgccctcctctgctcctccgtaactcctgagctgtggcctgcctttctgctgcctccacgtccctactcttcctttctgccaccccgtttgcttcttaaaggttgtcctttgtttctgccatttcccctgtctttcagcttcatattcgttgggtgccccca

SEQ ID NO: 67897 - DNA, 30 bp, Homo sapiens
  misc_feature 1..30: note = chr1:158120029-158120059
  misc_feature 1..30: note = hypo
  source 1..30: mol_type = genomic DNA
atttcatactagctccgactagtcttaaat

SEQ ID NO: 67898 - DNA, 40 bp, Homo sapiens
  misc_feature 1..40: note = chr1:158129286-158129326
  misc_feature 1..40: note = hypo
  source 1..40: mol_type = genomic DNA
gattacaggtgtgagccacctcacccggcagacccaacta

SEQ ID NO: 67899 - DNA, 93 bp, Homo sapiens
  misc_feature 1..93: note = chr1:158150556-158150649
  misc_feature 1..93: note = hyper
  source 1..93: mol_type = genomic DNA
ataatggttgtaaagcgtcccacacgttgacccaaagtctcctttgaaacaggaaattgagacacgccggttgtgaaacctactgaagtgagc

SEQ ID NO: 67900 - DNA, 147 bp, Homo sapiens; identical to SEQ ID NO: 1829
  misc_feature 1..147: note = chr1:158150650-158150797
  misc_feature 1..147: note = hyper
  source 1..147: mol_type = genomic DNA

SEQ ID NO: 67901 - DNA, 358 bp, Homo sapiens
  misc_feature 1..358: note = chr1:158150798-158151156
  misc_feature 1..358: note = hyper
  source 1..358: mol_type = genomic DNA
gaaagggacgtgagctgagcggcgggggagaagagtgcgcaggtcagagggcggcgcgcagcggcgctccgcgaggtccccacgccgggcgatatggggtgcctgctgtttctgctgctctgggcgctcctccaggcttggggaagcgctgaaggtgggtggaacgagggcgcttgagtgcactcgcgggagggcggagagagggagctgggtagggacggggagggcaacgcctgatggggactggtgagacccgggacgcactggcgcgatctaggtagaaaactcgctgctccctggctccggggagaggcagcgcggcacagagttcgctggcatcagccgcctcctgaagctc

SEQ ID NO: 67902 - DNA, 30 bp, Homo sapiens
  misc_feature 1..30: note = chr1:158165497-158165527
  misc_feature 1..30: note = hypo
  source 1..30: mol_type = genomic DNA
cctcagccttcctgtcggcatcagggggca

SEQ ID NO: 67903 - DNA, 141 bp, Homo sapiens; identical to SEQ ID NO: 14282
  misc_feature 1..141: note = chr1:158169208-158169349
  misc_feature 1..141: note = hypo
  source 1..141: mol_type = genomic DNA

SEQ ID NO: 67904 - DNA, 30 bp, Homo sapiens
  misc_feature 1..30: note = chr1:158232713-158232743
  misc_feature 1..30: note = hypo
  source 1..30: mol_type = genomic DNA
aataacctgaaatgacgactacctttgtct

SEQ ID NO: 67905 - DNA, 60 bp, Homo sapiens; identical to SEQ ID NO: 39101
  misc_feature 1..60: note = chr1:158237112-158237172
  misc_feature 1..60: note = hypo
  source 1..60: mol_type = genomic DNA

SEQ ID NO: 67906 - DNA, 20 bp, Homo sapiens
  misc_feature 1..20: note = chr1:158366698-158366718
  misc_feature 1..20: note = hypo
  source 1..20: mol_type = genomic DNA
tattttggccaggggcggtg

SEQ ID NO: 67907 - DNA, 30 bp, Homo sapiens; identical to SEQ ID NO: 39103
  misc_feature 1..30: note = chr1:158578092-158578122
  misc_feature 1..30: note = hypo
  source 1..30: mol_type = genomic DNA

SEQ ID NO: 67908 - DNA, 16 bp, Homo sapiens
  misc_feature 1..16: note = chr1:158591676-158591692
  misc_feature 1..16: note = hypo
  source 1..16: mol_type = genomic DNA
ggagtcttgctctgtc

SEQ ID NO: 67909 - DNA, 15 bp, Homo sapiens
  misc_feature 1..15: note = chr1:158591932-158591947
  misc_feature 1..15: note = hypo
  source 1..15: mol_type = genomic DNA
cgtgagccactgcac

SEQ ID NO: 67910 - DNA, 42 bp, Homo sapiens
  misc_feature 1..42: note = chr1:158639312-158639354
  misc_feature 1..42: note = hypo
  source 1..42: mol_type = genomic DNA
gtggcagccttttcacgtagggcatcccgccgggctaacagc

SEQ ID NO: 67911 - DNA, 178 bp, Homo sapiens; identical to SEQ ID NO: 39107
  misc_feature 1..178: note = chr1:158669704-158669882
  misc_feature 1..178: note = hypo
  source 1..178: mol_type = genomic DNA

SEQ ID NO: 67912 - DNA, 300 bp, Homo sapiens
  misc_feature 1..300: note = chr1:158672332-158672632
  misc_feature 1..300: note = hypo
  source 1..300: mol_type = genomic DNA
attacaggcatgagccaccgtgcctggccgtgacctccacattttcttcagactttcttacttagaaacctcactttgacccaaacgtacatcctcacctattataggctgttaaattgtgtcccctgaaaatttgtaggttgagtttctaacccccagttcctcggaatgtggttgtacttggacatacagtatttaaagaggtaacaaagttcaaatgaggaaattagggtggcccttaattcaatagggccagtgtccttacaagaagaggaaaccggccgggcgcggtgtctcacg

SEQ ID NO: 67913 - DNA, 183 bp, Homo sapiens
  misc_feature 1..183: note = chr1:158686993-158687176
  misc_feature 1..183: note = hypo
  source 1..183: mol_type = genomic DNA
gaacagttttttaatcgcattgttcatgtccttgtttctcaggctataaatgatgggattgaagaatggagcaagtacagtaaacatcagtgcaatggctgtgtccaaaactggtggataagtgtcgctgaaacgcaagtacatgagtgatacactgccaaagaatatcgggaagaccatgag

SEQ ID NO: 67914 - DNA, 135 bp, Homo sapiens
  misc_feature 1..135: note = chr1:158687415-158687550
  misc_feature 1..135: note = hypo
  source 1..135: mol_type = genomic DNA
aaatcatcacaatctcgggaagcaggataaggaaaccgaagaggcaggaacctgcagagagttgagcacagagccggggggtcatgatcatttgatagcgaagagggttgcagatggcaacgtatctgtcaatgg

SEQ ID NO: 67915 - DNA, 30 bp, Homo sapiens
  misc_feature 1..30: note = chr1:158710956-158710986
  misc_feature 1..30: note = hypo
  source 1..30: mol_type = genomic DNA
gcataaatcaaaacacgtacggtgggttta

SEQ ID NO: 67916 - DNA, 32 bp, Homo sapiens
  misc_feature 1..32: note = chr1:158712034-158712066
  misc_feature 1..32: note = hypo
  source 1..32: mol_type = genomic DNA
aagtagggcaagggccgggcgcggtggctcac

SEQ ID NO: 67917 - DNA, 30 bp, Homo sapiens
  misc_feature 1..30: note = chr1:158712492-158712522
  misc_feature 1..30: note = hypo
  source 1..30: mol_type = genomic DNA
gagaaagccttctgacggctctcaccagag

SEQ ID NO: 67918 - DNA, 107 bp, Homo sapiens; identical to SEQ ID NO: 39109
  misc_feature 1..107: note = chr1:158723718-158723825
  misc_feature 1..107: note = hypo
  source 1..107: mol_type = genomic DNA

SEQ ID NO: 67919 - DNA, 17 bp, Homo sapiens
  misc_feature 1..17: note = chr1:158730575-158730592
  misc_feature 1..17: note = hypo
  source 1..17: mol_type = genomic DNA
ctgggtgcagtggctcg

SEQ ID NO: 67920 - DNA, 30 bp, Homo sapiens
  misc_feature 1..30: note = chr1:158746532-158746562
  misc_feature 1..30: note = hypo
  source 1..30: mol_type = genomic DNA
atgatttccttgttacgaagactgtagata

SEQ ID NO: 67921 - DNA, 32 bp, Homo sapiens
  misc_feature 1..32: note = chr1:158760470-158760502
  misc_feature 1..32: note = hypo
  source 1..32: mol_type = genomic DNA
ggcgtgagccactgcgccgggcctttgatagg

SEQ ID NO: 67922 - DNA, 42 bp, Homo sapiens; identical to SEQ ID NO: 39112
  misc_feature 1..42: note = chr1:158815297-158815339
  misc_feature 1..42: note = hypo
  source 1..42: mol_type = genomic DNA

SEQ ID NO: 67923 - DNA, 39 bp, Homo sapiens
  misc_feature 1..39: note = chr1:158840962-158841001
  misc_feature 1..39: note = hypo
  source 1..39: mol_type = genomic DNA
actggattttttaatgccactatccggcagtgattaaat

SEQ ID NO: 67924 - DNA, 60 bp, Homo sapiens
  misc_feature 1..60: note = chr1:159088824-159088884
  misc_feature 1..60: note = hypo
  source 1..60: mol_type = genomic DNA
ctcacaccagaactccgaataaagaagcaatggctccttgggatccgctcctcttttact

SEQ ID NO: 67925 - DNA, 114 bp, Homo sapiens
  misc_feature 1..114: note = chr1:15911093-15911207
  misc_feature 1..114: note = hyper
  source 1..114: mol_type = genomic DNA
cggggccagcaggggcgcctgtctcggtgctttccatgcccgacagccagcaagcagtccctccacgtgtacccggcccccgtccttccggccttacctcgccccaggccggtt

SEQ ID NO: 67926 - DNA, 15 bp, Homo sapiens
  misc_feature 1..15: note = chr1:159141385-159141400
  misc_feature 1..15: note = hyper
  source 1..15: mol_type = genomic DNA
ccgcgactgcagcag

SEQ ID NO: 67927 - DNA, 112 bp, Homo sapiens
  misc_feature 1..112: note = chr1:159141432-159141544
  misc_feature 1..112: note = hyper
  source 1..112: mol_type = genomic DNA
cgggctccgaagcggctcgggggcgccctttcggtcaacatcgtagtccaccccctccccatccccagcccccggggattcaggctcgccagcgcccagccagggagccggc

SEQ ID NO: 67928 - DNA, 162 bp, Homo sapiens
  misc_feature 1..162: note = chr1:159141599-159141761
  misc_feature 1..162: note = hyper
  source 1..162: mol_type = genomic DNA
cgcctgctgctgggcgcccggcggggccaacctctcccaggacggtgagtgagggagggggcggcgcctggggaggtggggagtgacccgaggcgggggctgggatcgggagtctcgcggaaggagcctgttggctttgtttggaaccggggttaaagtcac

SEQ ID NO: 67929 - DNA, 64 bp, Homo sapiens; identical to SEQ ID NO: 26665
  misc_feature 1..64: note = chr1:159158305-159158369
  misc_feature 1..64: note = hyper
  source 1..64: mol_type = genomic DNA

SEQ ID NO: 67930 - DNA, 40 bp, Homo sapiens; identical to SEQ ID NO: 1832
  misc_feature 1..40: note = chr1:159158471-159158511
  misc_feature 1..40: note = hyper
  source 1..40: mol_type = genomic DNA

SEQ ID NO: 67931 - DNA, 79 bp, Homo sapiens
  misc_feature 1..79: note = chr1:159187230-159187309
  misc_feature 1..79: note = hypo
  source 1..79: mol_type = genomic DNA
taatgcctacatgttcgagacttagctctggtgtttcctgacctgagcccatcctctctgtccccgcaagctgggttgg

SEQ ID NO: 67932 - DNA, 33 bp, Homo sapiens
  misc_feature 1..33: note = chr1:159202103-159202136
  misc_feature 1..33: note = hypo
  source 1..33: mol_type = genomic DNA
tgagccaccgcgcccagccgacatggtcttgtg

SEQ ID NO: 67933 - DNA, 30 bp, Homo sapiens; identical to SEQ ID NO: 38863
  misc_feature 1..30: note = chr1:15928989-15929019
  misc_feature 1..30: note = hypo
  source 1..30: mol_type = genomic DNA

SEQ ID NO: 67934 - DNA, 442 bp, Homo sapiens
  misc_feature 1..442: note = chr1:15929958-15930400
  misc_feature 1..442: note = hyper
  source 1..442: mol_type = genomic DNA
gaacattcgccagaacgaaagcggcagccaggagaagccctcgcaggtgctgtagggatccaagcgcttgagctgagtccgaaactcgcacagcaacctcgggaggataaactccagcaaccagaatcgggttggcgtcgcctagcaaccaggagccaaatgcgcggacgccaggcattggcctgcacgtgtcacgtgagccagcgccgctgcccagtgggagattacgccgcaggcacgtgatgcggcgcaaccgccctttggcagagcttttcgcgaaggcagttgtggctctgagcgcataggcgaggcattcctggggtttgcgccgtatccttttacaaagtcctggctttggctggtgcgaccaaagaaaggaaaccggcgcttgagacttgtctgggctggctatggtgaagcagtgaaacggtgcagaattgtg

SEQ ID NO: 67935 - DNA, 24 bp, Homo sapiens
  misc_feature 1..24: note = chr1:159448019-159448043
  misc_feature 1..24: note = hypo
  source 1..24: mol_type = genomic DNA
tttttttttttgagacggagtctg

SEQ ID NO: 67936 - DNA, 51 bp, Homo sapiens
  misc_feature 1..51: note = chr1:159642793-159642844
  misc_feature 1..51: note = hypo
  source 1..51: mol_type = genomic DNA
tggtcacagccccagcgggttcctcccccaagctcacggtatcagatgaac

SEQ ID NO: 67937 - DNA, 41 bp, Homo sapiens; identical to SEQ ID NO: 39114
  misc_feature 1..41: note = chr1:159650169-159650210
  misc_feature 1..41: note = hypo
  source 1..41: mol_type = genomic DNA

SEQ ID NO: 67938 - DNA, 26 bp, Homo sapiens
  misc_feature 1..26: note = chr1:159679196-159679222
  misc_feature 1..26: note = hypo
  source 1..26: mol_type = genomic DNA
agactccgtctcggaaaaaaaaaaaa

SEQ ID NO: 67939 - DNA, 96 bp, Homo sapiens
  misc_feature 1..96: note = chr1:159683839-159683935
  misc_feature 1..96: note = hypo
  source 1..96: mol_type = genomic DNA
ggctttgagaggcttcgttaacggtgctttgagggatacataggaagtatccgactctttgggaaacacaaaagccttcctcgacatgtctgtgag

SEQ ID NO: 67940 - DNA, 267 bp, Homo sapiens
  misc_feature 1..267: note = chr1:159750379-159750646
  misc_feature 1..267: note = hyper
  source 1..267: mol_type = genomic DNA
ccccagggcatccagcgtgaaggaggtagaactaggccggcccgcgaggaggcaggggcaggcgccagtgacgcaatgactgcaacatgccgccagggtgcagcagagcccgaccccgggttgttccatccgcagcaaacaattcctaactcgctccaggtcttccttcttagctgagtgggttgaaccccgtggaagtaaccccccgcccattatgatgatccagccaatcaccgcgtgatctgctcggacggggcgggatcgcgg

SEQ ID NO: 67941 - DNA, 95 bp, Homo sapiens
  misc_feature 1..95: note = chr1:159750677-159750772
  misc_feature 1..95: note = hyper
  source 1..95: mol_type = genomic DNA
cgcgttccagccccgccccaggttctgggccaatccccgcggctgggcagagcgacccgagggcggcgccctgcagaccacgtggcccgggaggc

SEQ ID NO: 67942 - DNA, 114 bp, Homo sapiens; identical to SEQ ID NO: 26669
  misc_feature 1..114: note = chr1:159751133-159751247
  misc_feature 1..114: note = hyper
  source 1..114: mol_type = genomic DNA

SEQ ID NO: 67943 - DNA, 79 bp, Homo sapiens
  misc_feature 1..79: note = chr1:159869607-159869686
  misc_feature 1..79: note = hypo
  source 1..79: mol_type = genomic DNA
ccgctgtaatggcaacggggagagggttggggcatccctttctccccaactcctccgctcagcgcgctccacatttcca

SEQ ID NO: 67944 - DNA, 23 bp, Homo sapiens
  misc_feature 1..23: note = chr1:159876328-159876351
  misc_feature 1..23: note = hypo
  source 1..23: mol_type = genomic DNA
agaacatttaggagccgggcatg

SEQ ID NO: 67945 - DNA, 169 bp, Homo sapiens; identical to SEQ ID NO: 14290
  misc_feature 1..169: note = chr1:159883486-159883655
  misc_feature 1..169: note = hypo
  source 1..169: mol_type = genomic DNA

SEQ ID NO: 67946 - DNA, 45 bp, Homo sapiens
  misc_feature 1..45: note = chr1:159915746-159915791
  misc_feature 1..45: note = hyper
  source 1..45: mol_type = genomic DNA
acgggcgaccctctccgctccccgaacgggcgcgccacagaggcg

SEQ ID NO: 67947 - DNA, 19 bp, Homo sapiens
  misc_feature 1..19: note = chr1:159930262-159930281
  misc_feature 1..19: note = hypo
  source 1..19: mol_type = genomic DNA
ttttttcctttgagacgga

SEQ ID NO: 67948 - DNA, 91 bp, Homo sapiens
  misc_feature 1..91: note = chr1:159931588-159931679
  misc_feature 1..91: note = hypo
  source 1..91: mol_type = genomic DNA
agacggactgcaggccgctcactgggggcgtatagacctgctgagtttataagttatgcactcaagaagtttacctttggccgggcgtggc

SEQ ID NO: 67949 - DNA, 72 bp, Homo sapiens
  misc_feature 1..72: note = chr1:159932029-159932101
  misc_feature 1..72: note = hypo
  source 1..72: mol_type = genomic DNA
tattgccaatgatttcgttttaagagtggagatgaggctacaaagatggactgcaggcggctcactgggggt

SEQ ID NO: 67950 - DNA, 71 bp, Homo sapiens; identical to SEQ ID NO: 39120
  misc_feature 1..71: note = chr1:160025702-160025773
  misc_feature 1..71: note = hypo
  source 1..71: mol_type = genomic DNA

SEQ ID NO: 67951 - DNA, 257 bp, Homo sapiens
  misc_feature 1..257: note = chr1:160039671-160039928
  misc_feature 1..257: note = hyper
  source 1..257: mol_type = genomic DNA
ggcaggggaacaagacggtggtaccgctgaggccaggcagggtagggactgaggatctgggaccccgatgtctctggagagttagggggacaggacccggccggggcggcagaactccttcatcagggccagggtcttaccttgggtccgaggtggagtggccccttggatgggccgcggggcagcgggacagatggacggacggggcgggcaggagttaggagcagagctgtgcgacgggccgggccaggactctt

SEQ ID NO: 67952 - DNA, 171 bp, Homo sapiens
  misc_feature 1..171: note = chr1:160040333-160040504
  misc_feature 1..171: note = hyper
  source 1..171: mol_type = genomic DNA
ggaagaaaagggaggcggtcctgtcagcgatgggttacgagagctggagccggggggcgggactgggaccgagttaacgaagtggaaatgaattcaggaccggcccagtggccctgcaggcagcgccgaaggcggcgcctggaagtgagattggggcggagtaggcctggg

SEQ ID NO: 67953 - DNA, 76 bp, Homo sapiens
  misc_feature 1..76: note = chr1:160135228-160135304
  misc_feature 1..76: note = hypo
  source 1..76: mol_type = genomic DNA
ttgttatctcctccacgttctttgtttaaactattggtctgccgggcgcggtggctcacacctgtaatcccagcac

SEQ ID NO: 67954 - DNA, 173 bp, Homo sapiens
  misc_feature 1..173: note = chr1:160370097-160370270
  misc_feature 1..173: note = hyper
  source 1..173: mol_type = genomic DNA
cattcccctgcccaccgttcgggacccgagtgtcagccccaccgcggattcccaggatcggggagggccgctgggcatctgaaggcgcagggctgggggagcggcgactccgggaagagcggggccgcagacaatggacgcggcggtaggaggggcggcggctgtgggaacag

SEQ ID NO: 67955 - DNA, 30 bp, Homo sapiens; identical to SEQ ID NO: 26673
  misc_feature 1..30: note = chr1:160370599-160370629
  misc_feature 1..30: note = hyper
  source 1..30: mol_type = genomic DNA

SEQ ID NO: 67956 - DNA, 36 bp, Homo sapiens; identical to SEQ ID NO: 39121
  misc_feature 1..36: note = chr1:160451199-160451235
  misc_feature 1..36: note = hypo
  source 1..36: mol_type = genomic DNA

SEQ ID NO: 67957 - DNA, 30 bp, Homo sapiens
  misc_feature 1..30: note = chr1:16049826-16049856
  misc_feature 1..30: note = hypo
  source 1..30: mol_type = genomic DNA
aggctctgagatccccggaaatctggaaaa

SEQ ID NO: 67958 - DNA, 30 bp, Homo sapiens
  misc_feature 1..30: note = chr1:160503724-160503754
  misc_feature 1..30: note = hypo
  source 1..30: mol_type = genomic DNA
ccagttgtcccagaacgaattgttgaaatg

SEQ ID NO: 67959 - DNA, 30 bp, Homo sapiens
  misc_feature 1..30: note = chr1:160508436-160508466
  misc_feature 1..30: note = hypo
  source 1..30: mol_type = genomic DNA
gcctcccaatacaggcgtgagccactgtgc

SEQ ID NO: 67960 - DNA, 97 bp, Homo sapiens
  misc_feature 1..97: note = chr1:160523172-160523269
  misc_feature 1..97: note = hypo
  source 1..97: mol_type = genomic DNA
cttctcttgaacaaacggaacaaaaacactgaagacagaatgagaacaagcagaaagaacatagccagcacgctcagcaacccggtgtggtgagtac

SEQ ID NO: 67961 - DNA, 17 bp, Homo sapiens
  misc_feature 1..17: note = chr1:160524877-160524894
  misc_feature 1..17: note = hypo
  source 1..17: mol_type = genomic DNA
tttttttttttgagacg

SEQ ID NO: 67962 - DNA, 73 bp, Homo sapiens
  misc_feature 1..73: note = chr1:16059027-16059100
  misc_feature 1..73: note = hypo
  source 1..73: mol_type = genomic DNA
agctttgagtgggggcggggctgcaaggcctgcagaaggaaagctctggctgctcacccgggggcctggctct

SEQ ID NO: 67963 - DNA, 126 bp, Homo sapiens
  misc_feature 1..126: note = chr1:16059358-16059484
  misc_feature 1..126: note = hypo
  source 1..126: mol_type = genomic DNA
ctcctgcctcagccccgggggtgagtgcctgctgctcttaaaacaaacccagaagagtcctcactgtccttgccgtctcttgctgcgcacaagcctgccaggctgggagcccgaggccctcaagcc

SEQ ID NO: 67964 - DNA, 30 bp, Homo sapiens
  misc_feature 1..30: note = chr1:160654992-160655022
  misc_feature 1..30: note = hypo
  source 1..30: mol_type = genomic DNA
tcagagtgagacctgcgctagaggaggcag

SEQ ID NO: 67965 - DNA, 94 bp, Homo sapiens
  misc_feature 1..94: note = chr1:160693863-160693957
  misc_feature 1..94: note = hypo
  source 1..94: mol_type = genomic DNA
ggtcaacttctcacccgtggtaacccgagccctggtattatacacataggtcctgtcctcctgaaaacgggtcaggactggccaggcgcagtgg

SEQ ID NO: 67966 - DNA, 30 bp, Homo sapiens
  misc_feature 1..30: note = chr1:160698365-160698395
  misc_feature 1..30: note = hypo
  source 1..30: mol_type = genomic DNA
agcattttggccaggcgcagtggctcacac

SEQ ID NO: 67967 - DNA, 25 bp, Homo sapiens
  misc_feature 1..25: note = chr1:160752829-160752854
  misc_feature 1..25: note = hypo
  source 1..25: mol_type = genomic DNA
gaaaacaaccctgaacgcaggtgac

SEQ ID NO: 67968 - DNA, 197 bp, Homo sapiens
  misc_feature 1..197: note = chr1:160787406-160787603
  misc_feature 1..197: note = hypo
  source 1..197: mol_type = genomic DNA
tttttgcacaatcttcgcaacaatcctacagagtagatattctcgtttttcccctttatatggataaagaaactgaggctcagaaaagataagggacttatccaaggtcacaccataaaagctggtttcgaaccctgagctctatcttctgctcttccgtagaaggaagcagaaaaaaggtacggtctacccaggat

SEQ ID NO: 67969 - DNA, 30 bp, Homo sapiens; identical to SEQ ID NO: 39124
  misc_feature 1..30: note = chr1:160820959-160820989
  misc_feature 1..30: note = hypo
  source 1..30: mol_type = genomic DNA

SEQ ID NO: 67970 - DNA, 30 bp, Homo sapiens; identical to SEQ ID NO: 14294
  misc_feature 1..30: note = chr1:160853373-160853403
  misc_feature 1..30: note = hypo
  source 1..30: mol_type = genomic DNA

SEQ ID NO: 67971 - DNA, 101 bp, Homo sapiens
  misc_feature 1..101: note = chr1:160880601-160880702
  misc_feature 1..101: note = hypo
  source 1..101: mol_type = genomic DNA
gggagagagtgaaggcgcacctacaaggggcttatcaggaccacttatcctctcaaatttctactcttgagtgcgagttaaagaaacaacttaaagaatga

SEQ ID NO: 67972 - DNA, 120 bp, Homo sapiens
  misc_feature 1..120: note = chr1:160883883-160884003
  misc_feature 1..120: note = hypo
  source 1..120: mol_type = genomic DNA
caggtgtggagaggcaacccgccccatcatgagccactgtgcccagcctgaattaaattttttaaagtttaattgagcaatgaacagttcccgaaactggcagcctcccaagccagagta

SEQ ID NO: 67973 - DNA, 151 bp, Homo sapiens
  misc_feature 1..151: note = chr1:160953002-160953153
  misc_feature 1..151: note = hypo
  source 1..151: mol_type = genomic DNA
ctcaaaaaaataaaaaagaacggcctcgaatctactcgcagggacctcaggtatggaagtttcttctgtcttttgggaatccagccaggtcaggcctgagtcccagatcccaaagacacccacaaccctggggtaccggggacagtctcaa

SEQ ID NO: 67974 - DNA, 27 bp, Homo sapiens
  misc_feature 1..27: note = chr1:160992336-160992363
  misc_feature 1..27: note = hypo
  source 1..27: mol_type = genomic DNA
cttaatagtcttggccgggtgcgtggc

SEQ ID NO: 67975 - DNA, 57 bp, Homo sapiens; identical to SEQ ID NO: 14297
  misc_feature 1..57: note = chr1:161007705-161007762
  misc_feature 1..57: note = hypo
  source 1..57: mol_type = genomic DNA

SEQ ID NO: 67976 - DNA, 193 bp, Homo sapiens
  misc_feature 1..193: note = chr1:161044630-161044823
  misc_feature 1..193: note = hypo
  source 1..193: mol_type = genomic DNA
cctccacccccatgacgtcacccagagccgcaggctgttcccacggtgcccctccctccaccaggcaggtctaggcagaggtcctttctccctgctgcccagcctgacctgggcaccccccacacacacccggggaagatccacacgtgtgccatcccacatgcttccacaggcatcacgtcatccaacactg

SEQ ID NO: 67977 - DNA, 181 bp, Homo sapiens; identical to SEQ ID NO: 39131
  misc_feature 1..181: note = chr1:161056643-161056824
  misc_feature 1..181: note = hypo
  source 1..181: mol_type = genomic DNA

SEQ ID NO: 67978 - DNA, 30 bp, Homo sapiens
  misc_feature 1..30: note = chr1:161059519-161059549
  misc_feature 1..30: note = hypo
  source 1..30: mol_type = genomic DNA
tccaggctttacctgcgagtatgtggaagg

SEQ ID NO: 67979 - DNA, 30 bp, Homo sapiens
  misc_feature 1..30: note = chr1:161062448-161062478
  misc_feature 1..30: note = hypo
  source 1..30: mol_type = genomic DNA
ccatgacaggctgcacgcctcagccaaacc

SEQ ID NO: 67980 - DNA, 646 bp, Homo sapiens
  misc_feature 1..646: note = chr1:161067928-161068574
  misc_feature 1..646: note = hyper
  source 1..646: mol_type = genomic DNA
caaatcagttcacagcggagatcacaggggtttattctaaggacccgactgtcctccgactttctgaggttaacaatcttgcaggatttttattgacctgatacagctcccgtagccttggtggcaccaccatacggttcccgatagccacccaggtgtcctgtctccacggtaactgctgctttgcgaccttcggtttgcagcggtcgcgctgcagccgctgcagtggttgctgggcgaccacggagagaaagccgggacttgaggtgggaaccccggctggcgtccggtagggggaggttcccggggaagcccgcggaaggcgaggtgcctggcctgccatgtaggggctcgttccaagccgcagaccccaccgccctccctctccccggggcccatggcggtggccgtgcccccgggtcgggccgcaggctcaggctgggcctggaggccagtggcgcgggacgcgcttttggctagagctttccattcatgcaccgaactgcggggacggttctatctcgtaggtggtctcctagcaggaggagcgagagagcccagcagcgatacggtggttttcgacccagctaggggccaggccgtacgattgggagcccggggcagccccccgcgcagtcaccacgac

SEQ ID NO: 67981 - DNA, 78 bp, Homo sapiens
  misc_feature 1..78: note = chr1:161121163-161121241
  misc_feature 1..78: note = hypo
  source 1..78: mol_type = genomic DNA
cccctaaaggcagaacgagacaaggatgtctgctggtaacactgtcttttttttattttgagacggagtcttgctctg

SEQ ID NO: 67982 - DNA, 224 bp, Homo sapiens
  misc_feature 1..224: note = chr1:161228649-161228873
  misc_feature 1..224: note = hyper
  source 1..224: mol_type = genomic DNA
agctgtaacccctgccgcagagcccggcaactttcagctgtcgcccgcggagccccgagggccactcgcctcacctgtgcgtgcagcgcctcgcgcgccctgtccggctgcggagatgagcgaggtgagcggtgcggcccccggcgctgtcggcagggctgcggcggggagggtgctgcggctcgggatcccagggaggcgagggagagcgaggcagaccggag

SEQ ID NO: 67983 - DNA, 124 bp, Homo sapiens
  misc_feature 1..124: note = chr1:161275455-161275579
  misc_feature 1..124: note = hyper
  source 1..124: mol_type = genomic DNA
ggggtgggggggtggcgatcacttgtccgagttcaggcccatcatgttcttgagggcgtttttgaggctggttctgctgggggacttgacagcaggccggagctccgggctctgctcatccttt

SEQ ID NO: 67984 - DNA, 484 bp, Homo sapiens; identical to SEQ ID NO: 26677
  misc_feature 1..484: note = chr1:161275639-161276123
  misc_feature 1..484: note = hyper
  source 1..484: mol_type = genomic DNA

SEQ ID NO: 67985 - DNA, 41 bp, Homo sapiens
  misc_feature 1..41: note = chr1:161358973-161359014
  misc_feature 1..41: note = hypo
  source 1..41: mol_type = genomic DNA
atgtaaagcaggccacgcacggtggtggctcacgccttaat

SEQ ID NO: 67986 - DNA, 360 bp, Homo sapiens
  misc_feature 1..360: note = chr1:161367762-161368122
  misc_feature 1..360: note = hypo
  source 1..360: mol_type = genomic DNA
ttaaaggcgtgaaacaccgcgcctggccaaaaaatgttttattttaaattcaaaatgctgtaatggaggctgggtgcagtggctttttttactcagcatacttgagattcatgttgttgtatatgtgagcagttccgtcctttttttggctgagtaacattccattgtatggatcggtctttcacttgttgattgacatttggatagtctacagtttggggctattacaaatagagctgctatgaatgtttgtgtacaggcgtttgtatgggcatatgctctatttactcttggtaaatacctaggagtggaatggctgagtcatattgtagtagtttaacgcttttaaaaacccccaaa

SEQ ID NO: 67987 - DNA, 140 bp, Homo sapiens
  misc_feature 1..140: note = chr1:161409851-161409991
  misc_feature 1..140: note = hyper
  source 1..140: mol_type = genomic DNA
acaccctccaaacaccgcaagcctccttccccggcgcacaggcacgcagccacaggccaagctgcgacgcgagctccgcgcgcgggatctccgcaaaaggtccgcccgatgcgttgggcgggaatcgagcccgggtcaac

SEQ ID NO: 67988 - DNA, 169 bp, Homo sapiens; identical to SEQ ID NO: 39134
  misc_feature 1..169: note = chr1:161442404-161442573
  misc_feature 1..169: note = hypo
  source 1..169: mol_type = genomic DNA

SEQ ID NO: 67989 - DNA, 252 bp, Homo sapiens
  misc_feature 1..252: note = chr1:161450235-161450487
  misc_feature 1..252: note = hypo
  source 1..252: mol_type = genomic DNA
attgggccagtctttcgtggatgctccaatgggacggaggcccatggcaggttgtgaccagtgaagggtggctggtggcgagctctgctgtgacagcttccattggcatttgccatcagtgcataggtggttcagtggtagaattcttgcctgccacgcaggaggcccaggtttgattcctggcccatgcagcacgccctcccattttggtgctgcagcagcaccaaggcgtagctgcgttcgcctctgccg

SEQ ID NO: 67990 - DNA, 29 bp, Homo sapiens
  misc_feature 1..29: note = chr1:161471750-161471779
  misc_feature 1..29: note = hypo
  source 1..29: mol_type = genomic DNA
ccaccgcacctggccggttctcttgaatc

SEQ ID NO: 67991 - DNA, 215 bp, Homo sapiens
  misc_feature 1..215: note = chr1:161481646-161481861
  misc_feature 1..215: note = hypo
  source 1..215: mol_type = genomic DNA
gctcaccagggctgccggctggacctgagccagcgagaaggggcttgtgcgagttcagctgggagccagggagggagcagcgatggggggatggccagggctcaaatcgcttggtcaactctgagtctaatttctgggcctaaagaggacctcgctggagatgagaagagaaacaccagtcccagatacagaggagagggcggtgttcaaatttc

SEQ ID NO: 67992 - DNA, 99 bp, Homo sapiens
  misc_feature 1..99: note = chr1:161493379-161493478
  misc_feature 1..99: note = hypo
  source 1..99: mol_type = genomic DNA
acatgagggacatcccgaccgtactctgcgtcctcctttcccaggtgttgcgttctctcttgggctgagtggcgaggtctctcccgagtcccagggcca

SEQ ID NO: 67993 - DNA, 184 bp, Homo sapiens
  misc_feature 1..184: note = chr1:161494827-161495011
  misc_feature 1..184: note = hyper
  source 1..184: mol_type = genomic DNA
gcaagatgaaggagacggccgaggcgtacctgggccagcccgtgaagcacgcagtgatcaccgtgcccgcctatttcaatgactcgcagcgccaggccaccaaggacgcgggggccatcgcggggctcaacgtgttgcggatcatcaatgagcccacggcagctgccatcgcctatgggctgga

SEQ ID NO: 67994 - DNA, 283 bp, Homo sapiens
  misc_feature 1..283: note = chr1:161509756-161510039
  misc_feature 1..283: note = hyper
  source 1..283: mol_type = genomic DNA
ccattttggattccccgaagacccttcgttcctgcattctcttctgctctccttttctcaacctcttctgctggaagctgagtcctgctccagatctaggcaagtgctagcgcagaaaaaagacctgcctcgctcagggctatgagccgcgccctgaagcacggaaagctaattgtgtcactggtttcaaatcaacctcaatttttttggagacgtgagtgctgagcattttttcttcagtgaagtgacttggcagccaaaatcgccaacgcccgtctctgtg

SEQ ID NO: 67995 - DNA, 163 bp, Homo sapiens
  misc_feature 1..163: note = chr1:161510099-161510262
  misc_feature 1..163: note = hyper
  source 1..163: mol_type = genomic DNA
ggacggaagtcgcattttgtgaaccctgggtttttgaaactttgactgaaaaaactgcgtgcgatgctatccgctgggagcgctggggccttggcgctcaaaaccagccgcggtgctaaccgcagggagctctggtagcagacctccgcgttgtgtggttccc

SEQ ID NO: 67996 - DNA, 17 bp, Homo sapiens
  misc_feature 1..17: note = chr1:161529750-161529767
  misc_feature 1..17: note = hypo
  source 1..17: mol_type = genomic DNA
aaagcctcactctgtcg

SEQ ID NO: 67997 - DNA, 34 bp, Homo sapiens
  misc_feature 1..34: note = chr1:161577201-161577235
  misc_feature 1..34: note = hypo
  source 1..34: mol_type = genomic DNA
gggctgctgtgcaggcggccgtgttgatggggga

SEQ ID NO: 67998 - DNA, 30 bp, Homo sapiens; identical to SEQ ID NO: 39137
  misc_feature 1..30: note = chr1:161577640-161577670
  misc_feature 1..30: note = hypo
  source 1..30: mol_type = genomic DNA

SEQ ID NO: 67999 - DNA, 128 bp, Homo sapiens; identical to SEQ ID NO: 26682
  misc_feature 1..128: note = chr1:161581762-161581890
  misc_feature 1..128: note = hyper
  source 1..128: mol_type = genomic DNA

SEQ ID NO: 68000 - DNA, 413 bp, Homo sapiens
  misc_feature 1..413: note = chr1:161582234-161582647
  misc_feature 1..413: note = hyper
  source 1..413: mol_type = genomic DNA
cggaggaaaatcccccggcggtgctcaactgcggctttctctctcggctgtgagccggctccgccctccggcttccagagcaagtggcttctgcgttcaccgccccccgccgtttgtggggcggggccgattcataagaatcggttctcaccaatggagggcttagcatgtttaacctcaggatcataaacaaaagacactgctagaacggtcgggaaagtcatacgctttgcttatcttatatatagatttctaaaattccaaaccggggacgcgttggtggtgtagtggtgagcacagctgcctttcaagcagttaacgcgggttcgattcccgggtaacgaaacgtttttgtctttccttctacgaaaaacttttctgagccggagcctccagcgcgctgtgtattcgtt

SEQ ID NO: 68001 - DNA, 81 bp, Homo sapiens
  misc_feature 1..81: note = chr1:161591283-161591364
  misc_feature 1..81: note = hyper
  source 1..81: mol_type = genomic DNA
ctaggcaagtgctagcgcggaaaaaagacctgcctcgctcagggctgtgagccgcgccctgaagcacggaaagctaattgt

SEQ ID NO: 68002 - DNA, 140 bp, Homo sapiens
  misc_feature 1..140: note = chr1:161591628-161591768
  misc_feature 1..140: note = hyper
  source 1..140: mol_type = genomic DNA
gctctcaaaaccagccgcggtgctaaccgccgggatccctggcagctgacctccgcgttgtgtggttcccaatgtcctcttctgccttagtgctgtacgggtaattttgaggtatttggtttttccgactagggttgtag

SEQ ID NO: 68003 - DNA, 231 bp, Homo sapiens
  misc_feature 1..231: note = chr1:161695622-161695853
  misc_feature 1..231: note = hyper
  source 1..231: mol_type = genomic DNA
tgcaagtgccctatgcgccagtgttcgagggtgagccgctagtcctgcgctgccgcggctggtacgacaaggtggtctacaagcttcactactaccacgacggccaggccgtgcgctacttccactccagcgccaactacactgtgttacaggcgcgtgccagcgacagcgggcgctaccagtgctcgggcaccatgcgcatcccggtggagagcgcgcccatgttctccg

SEQ ID NO: 68004 - DNA, 277 bp, Homo sapiens
  misc_feature 1..277: note = chr1:161697067-161697344
  misc_feature 1..277: note = hyper
  source 1..277: mol_type = genomic DNA
cccagctccatgggccgcagccttggctcctggtaataggccgctttccttcagaaagcccccggtgtccagatcggtcccgttggtcacctccgtccggaacaccacctccaccgggctgcagttcccggcgagcggcgccccgactgcggggccacccgcctgcgctccgccgacgcccttggaacaatcggctggagccctgaaacccgacgtggaccttctgctccgagaaatgcagctgctcaaaggccttctgagccgggtggtcctggaa

SEQ ID NO: 68005 - DNA, 45 bp, Homo sapiens; identical to SEQ ID NO: 39138
  misc_feature 1..45: note = chr1:161879452-161879497
  misc_feature 1..45: note = hypo
  source 1..45: mol_type = genomic DNA

SEQ ID NO: 68006 - DNA, 54 bp, Homo sapiens
  misc_feature 1..54: note = chr1:161913485-161913539
  misc_feature 1..54: note = hypo
  source 1..54: mol_type = genomic DNA
agttctgccaggtctcgaacaaaaaatcaccttttcacacgcacacaaaaagcc

SEQ ID NO: 68007 - DNA, 30 bp, Homo sapiens
  misc_feature 1..30: note = chr1:162389828-162389858
  misc_feature 1..30: note = hypo
  source 1..30: mol_type = genomic DNA
gatcacgctattcaacgtacagacacaggt

SEQ ID NO: 68008 - DNA, 161 bp, Homo sapiens
  misc_feature 1..161: note = chr1:1625727-1625888
  misc_feature 1..161: note = hypo
  source 1..161: mol_type = genomic DNA
atctcataaataaataaataaataaatattacttttacgttttgttaaacttccacttgtttttgtttccgttgcatgaaccttcgtaaagcttcaggaggctgatggcagcctccttccccaggcttccccgtggcgcccgcagccgggttgggccagag

SEQ ID NO: 68009 - DNA, 500 bp, Homo sapiens
  misc_feature 1..500: note = chr1:162792053-162792553
  misc_feature 1..500: note = hyper
  source 1..500: mol_type = genomic DNA
ttgtcgccagtgcctcgatttttgcatttaaaatgaggcgaaagaacaaatggaataattatagaaaattttagcctctagcaaaacactgtgaagcagctccagcctgtggtggaagatgtgcgaaagggatgggggaacgctgtggaccggtgtggagtctaggacgacaggtggtgggctctgtccccacgcgcctcgcggccagcagaggccccctcactgcggccgccgggcgggactggcgcgggcggcgctgggctgggcccgggaggctggcatccctgggtgctccggtgcggtactagggggcgacggctgagccgtgggtggagccgctgggtcagtctcggatagaaataaactgggaaactgctgtggtctctgttgcttgcgtgctcggttttcgtgcttatcacgctgatgatgaggaaggtggttttggttacggagtgagcaggtgaacgcctccccgtggaccccaccggactgggtgggga

SEQ ID NO: 68010 - DNA, 30 bp, Homo sapiens; identical to SEQ ID NO: 39140
  misc_feature 1..30: note = chr1:163363352-163363382
  misc_feature 1..30: note = hypo
  source 1..30: mol_type = genomic DNA

SEQ ID NO: 68011 - DNA, 196 bp, Homo sapiens
  misc_feature 1..196: note = chr1:16375246-16375442
  misc_feature 1..196: note = hyper
  source 1..196: mol_type = genomic DNA
gggtgacttgattggcggtgctaagaggcttcagtgtaacattatacagacttgggtttgaaatccacgtatgaccctggcccgttggcctctctgagcccggcttcctcctctacaaaatggagatcgcaaccgtccccacccgatagcgagagggcgcacacccgcattccaggctggacgggtctctgggcag

SEQ ID NO: 68012 - DNA, 172 bp, Homo sapiens
  misc_feature 1..172: note = chr1:164290500-164290672
  misc_feature 1..172: note = hyper
  source 1..172: mol_type = genomic DNA
atgcaaaaaaaactgcgccgtgttcccctctgttgtgtgcgccgcgtccggggagcctgggccgtgcctccctggcgtatgcaggtcgccggcgcagccgccagctccgggggccgcgcttccagccacccgcagccggcggggcccgccgggcagcacgggaatcgcggag

SEQ ID NO: 68013 - DNA, 34 bp, Homo sapiens
  misc_feature 1..34: note = chr1:16455953-16455987
  misc_feature 1..34: note = hypo
  source 1..34: mol_type = genomic DNA
cgatggcagtgtagccggccgccatgaagtgctc

SEQ ID NO: 68014 - DNA, 40 bp, Homo sapiens
  misc_feature 1..40: note = chr1:164637945-164637985
  misc_feature 1..40: note = hypo
  source 1..40: mol_type = genomic DNA
tggcactgccaggaccggctcctcgcgccaatgtggcagc

SEQ ID NO: 68015 - DNA, 30 bp, Homo sapiens
  misc_feature 1..30: note = chr1:164642633-164642663
  misc_feature 1..30: note = hypo
  source 1..30: mol_type = genomic DNA
gccaccacgtctctccgctttcatcagccc

SEQ ID NO: 68016 - DNA, 30 bp, Homo sapiens
  misc_feature 1..30: note = chr1:164667343-164667373
  misc_feature 1..30: note = hypo
  source 1..30: mol_type = genomic DNA
tatctcccagggcaccgattgttaagaggg

SEQ ID NO: 68017 - DNA, 30 bp, Homo sapiens
  misc_feature 1..30: note = chr1:164708418-164708448
  misc_feature 1..30: note = hypo
  source 1..30: mol_type = genomic DNA
taaggattcccctggcgcaaaccaatcata

SEQ ID NO: 68018 - DNA, 359 bp, Homo sapiens
  misc_feature 1..359: note = chr1:16475073-16475432
  misc_feature 1..359: note = hypo
  source 1..359: mol_type = genomic DNA
ggccctgcagcagctcggggcacttcttgtagtagacacggacggagagcagcgccacacaggcaccgatatcctggaaggccaggtagaagcctttgcgggtgagcggccccacggagcgctcctccacgttcagcttcacgtggcgtgcctcgaagtcgctgctgacggtgatctcatcgggcgcaatggtgtcaatcttggtgaacaggcgcttctggaagttggtgccgtagtccaggtccgactcggcatagtagaggttgaaagtctccttgcaggagctggcgccaccagggaagctgttgcagtcacgtacagtaaacttgagctcaatgaagatacgctcagcctctcct

SEQ ID NO: 68019 - DNA, 68 bp, Homo sapiens
  misc_feature 1..68: note = chr1:16482476-16482544
  misc_feature 1..68: note = hyper
  source 1..68: mol_type = genomic DNA
acccgcacgcctgcacgccggcctcggtgtccgctcccgcccgccggcctgcgcgcaacttctgcccc

SEQ ID NO: 68020 - DNA, 30 bp, Homo sapiens
  misc_feature 1..30: note = chr1:16483726-16483756
  misc_feature 1..30: note = hypo
  source 1..30: mol_type = genomic DNA
cctactcttgggaagcgggtccagacatct

SEQ ID NO: 68021 - DNA, 67 bp, Homo sapiens; identical to SEQ ID NO: 26690
  misc_feature 1..67: note = chr1:165086960-165087027
  misc_feature 1..67: note = hyper
  source 1..67: mol_type = genomic DNA

SEQ ID NO: 68022 - DNA, 220 bp, Homo sapiens
  misc_feature 1..220: note = chr1:165204374-165204594
  misc_feature 1..220: note = hyper
  source 1..220: mol_type = genomic DNA
gagagacagttagagcgtatagggggcgatgcagtcgatggtatctgtagcacagtacccagaagacccgggagctaggaccaaaccaggagtcagctcagtccaaaggaaatcagggttcaggtagcgacggtgtccgtgcgtttcttcactagtgcatgtgcgaggagggctggaggcatgagcgaaagagggaaggcaatctcggtctccaaaaaat

SEQ ID NO: 68023 - DNA, 541 bp, Homo sapiens
  misc_feature 1..541: note = chr1:165204825-165205366
  misc_feature 1..541: note = hyper
  source 1..541: mol_type = genomic DNA
cccgggcccgcctgacgtcacctgggaacgcgcggcggcgcggggcggcgcggacccgggacgacctcgccgcgacctggcctcgcctccgcccgcgcggggctttgctccgcgggaattaaaggaaggagaaatgttagtacacttttaattggaaaccgagttcttctttcagagcggcttgtttactcaggattgggcattagaactcaggggaggctctaattgaagtgacggctttggagattatggggaacatatggccctaccgccgggctctttatctgcattttctcataaaactgccgtccgtgtgtgtttctgcgcctggcctcttgcatttctaaggggcctttgaagacagggccgaatgcgcgcgggggcttcaggcactttgcgctccacggcgggtcccgcagcccggcccgagccggccctggaagcttcgccctggactagactggcaccgacgccgcccccagcctgagcgctgagagggaaaacgagagctagaaaggaaagaaatcggactggtgactgc

SEQ ID NO: 68024 - DNA, 191 bp, Homo sapiens
  misc_feature 1..191: note = chr1:165321596-165321787
  misc_feature 1..191: note = hyper
  source 1..191: mol_type = genomic DNA
cctgaactaggatggcggcacaggttgaaggagagggcttcagttcaggccccaactactgtcctaaaagcccctgcatccgagggttctgcagaaaaccaggaaggcgacagtgaaagggcgaacgggctgtgcgcttagctccgaatggcagcagagccatttccgagcccaaactgtccggactccag

SEQ ID NO: 68025 - DNA, 37 bp, Homo sapiens
  misc_feature 1..37: note = chr1:165322183-165322220
  misc_feature 1..37: note = hyper
  source 1..37: mol_type = genomic DNA
aagggaagttctgctcgctgggcgtgtctcttgggcc

SEQ ID NO: 68026 - DNA, 30 bp, Homo sapiens
  misc_feature 1..30: note = chr1:165323443-165323473
  misc_feature 1..30: note = hyper
  source 1..30: mol_type = genomic DNA
gcgctccccatttcccggctgcactcttct

SEQ ID NO: 68027 - DNA, 1660 bp, Homo sapiens
  misc_feature 1..1660: note = chr1:165323697-165325357
  misc_feature 1..1660: note = hyper
  source 1..1660: mol_type = genomic DNA
cgctgcccgcccgggtactgcctgctctggcttccgctctcttccgaggctgggcaagtccaaaagttcccgaaaggggggttcaaagaggggcgctcagtgcacgtgatttcgtttcatctagggtgttgggggtggggagattcctcactggatttggtttctccagcagaactgtctcatcctccacattcatgccgctctagcggttccgagtgaaagaggcaagaggtttaaaggacagaaggaaaactccctcctgctaaaaataaataaataaaataaaataaaataaaatacgggcttcccaaacttgaaaagctccaagggcagagtgggtgggggagccgtaaccagaatctctggcttcagctctgcaagacccgtgtgtggacactcttccggggtccttgactcgctgctcctcctctgtcgctgcaaaggagttgtgaggggggacccacaggacccgacatccagctccagttaattaacgcggagcctagggcccagccgcgcggtctaatccccgcgctgcgttgcctactggcccagaaaagtctctctcggccttgcccatggctgaaattggggctggagttggtgggggagagaagcctcctcgaacttgggcgctccaggcctcgggtctcggatgctattgcctctaggccgcgagaagagggcggcatttatgagacgtcgatcagctccgagattaaaaatccagccctgggtatttttaatcacttgccactcagacgcctacgaacaagctcgcccgcccctcgcggctttggggaattcggtgcccagtgcgtgaggcctggggcggcttgttggatttatttgggtagggacgacccacaagcactgacggacagatagtgatggggctcaatttagtgtatgaagaggggcgctagcttccctatcgcggaccaggtcccagagagcggggctccagagctcagcgccaagcggaaagagagtgcgcccaggacgcacggcctgaacactcacccagcagcgaggagaaggaggccgaggtgtcgatcgcgctttggaagttctcctccatctttaggccgtccagcatgttcgggccgggccgggaggacctgtagaggagaagaaacgatgcgtctgacgtccgtgcccgctgggactcggcgccagcagccaccgcactcctgggaaagaactgagggagtgtccagggcgaccagaatcagccaggaggatagggtccagccaagagaatgtagggtgggaggagagatcagtcacagcgaactgctctggctgatctgatttcacttgaagtcaacacgttatgtacttaggcctccgccccccaactgcgtttctccttctcctgcccccctcacccccacctacatcccttgccccaggttttccatcccgaatccgactccgccccaacctatacgaaggtgggccctcgggacgtctctgcaggaacgcagctactggggtatattgggtatataaagagtgggtaccctccctcgagcgaccgggtccaggcacgcgggacgatggggtttgcaatcccgcgtcccagccgccccgttgcggccctcacctgccccaggtcgagaaggggcactgtaagggacccggagggcgtcccgcc

SEQ ID NO: 68028 - DNA, 811 bp, Homo sapiens
  misc_feature 1..811: note = chr1:165325394-165326205
  misc_feature 1..811: note = hyper
  source 1..811: mol_type = genomic DNA
cgcgcaggagccggtgtgcggggcgcgcggggaggtcctcccgccagtcggccagtgccgggaatgtctgcagaagcaaaagagtcgcctcggggaggagccccggctggcccggctcactcttggatgcatttcaagtcaactttcagaaacacgcccgcccgagccacagcctaggcacgggcagccttacttacctggtaggcgagctctctcccagtgactggagcagagagaagttgcggagcgctgctggaagcttctgcccgggaaggcgtcgcccccgagactgcagccggaggagccgccctcggcttcggagcgccggggagggagccggagcgaacgccggccgctggctctgctcctcggcgcgcccaggctgggccgggacgtggtcgcgagctgccggccttcccgggacgtcctaccagcccgcgtcgctcctcagcgggaggagagggccagttgcttctccaaggctaggagggaaggcagaggcccagggtcctgggtgcgagtcggccctgcttcgccggggcggatcctgcagcttctgacaggggccgcggcgctgcgtgcgcggcggcggagagggggtggggtgcgctgggcggggggctggcagcgcgtcccgtggcggggccgtggtgctccctttcccagcctggctgcgcggccaccacacggccgctgccctctgagcccctccgcctctgggagctctcggacacgctaagtttcctcccctccacgtgtaactgttacctcggggcgctctggcccggtcgccccccagtgcccctcaccc

SEQ ID NO: 68029 - DNA, 195 bp, Homo sapiens
  misc_feature 1..195: note = chr1:165326296-165326491
  misc_feature 1..195: note = hyper
  source 1..195: mol_type = genomic DNA
cgctgcaatccttacccgggccccgggaagcgctgagaagctgtttagcgccagtagatgtgggcccagcagctcctagctcctcaaacccctcatcacccgagggctcatgccagtttccaacttcctttaaggtcgaaccatattcactcatggggcgtacagaggccatgggactcacggcctaagaatcat

SEQ ID NO: 68030 - DNA, 30 bp, Homo sapiens
  misc_feature 1..30: note = chr1:16532867-16532897
  misc_feature 1..30: note = hyper
  source 1..30: mol_type = genomic DNA
aggaccagttcacctcggaggccctggcct

SEQ ID NO: 68031 - DNA, 438 bp, Homo sapiens
  misc_feature 1..438: note = chr1:16533298-16533736
  misc_feature 1..438: note = hyper
  source 1..438: mol_type = genomic DNA
ctagagccaaccttccgcgcggacagtcgcgccagcaaccccctttgtgtgtccccctccctctatggcccggttcccgctaagtccccggaccgcgtactccccggcccgcccccgccccgccgggtccccgcgcgcgcccacctcctgcagcttgcagtcccgcaggctcagcgtggccaggacgccgctgccgcgtacgtcggggatatcctgccacagcgagaaggtggagcctcgcgccgagcgctgcgcccggaaggagctgctgggggagaggttggcccgcggcggccccggcccctcctctgcgccctcggcctcgtcccccgggccctcctcctcgcgctgctgccgccgcagttcgcgggcgctggccacgtcgctgtattcctgatagaggacggctgggggaaagacgggcgggggagagcgtgg

SEQ ID NO: 68032 - DNA, 257 bp, Homo sapiens
  misc_feature 1..257: note = chr1:16534506-16534763
  misc_feature 1..257: note = hypo
  source 1..257: mol_type = genomic DNA
agagaagagtgcagccgggtcatcagctccgatgccgagaagcgcctccgctcaggaccttcgaggctcactcgggtggacccagacaactccaccctgggctcctctgtgctcagggcctgctcttgcactacctggccaggctctaggaagacagcgtgggcctcggggcagccggggacctcttcacgctggtacacccgcatcttgcgccctagggttgggggcaaggagtgagagcacgggctggggtctcc

SEQ ID NO: 68033 - DNA, 209 bp, Homo sapiens; identical to SEQ ID NO: 26700
  misc_feature 1..209: note = chr1:165345473-165345682
  misc_feature 1..209: note = hyper
  source 1..209: mol_type = genomic DNA

SEQ ID NO: 68034 - DNA, 67 bp, Homo sapiens; identical to SEQ ID NO: 38867
  misc_feature 1..67: note = chr1:16535138-16535205
  misc_feature 1..67: note = hypo
  source 1..67: mol_type = genomic DNA

SEQ ID NO: 68035 - DNA, 317 bp, Homo sapiens
  misc_feature 1..317: note = chr1:165414227-165414544
  misc_feature 1..317: note = hyper
  source 1..317: mol_type = genomic DNA
aacaagagtggtcatcgcttcctagcagcccggggagcacaggctgggccagccctctgggattagtcaggaatctgcctctagatcggagagtccacatagtgcgtttgagacggctgtggcggcagcagctggtgcctgtcagtaatcacgcataatgctgccgccgccgccgccgccgccgtcaccgctactcttgccaccgccgtcgctgctgcttgagatcctgttgctagtttgattaactcagggttgggctgctgcgtgcgactcttccagctcccggcgcgtccccagaggtccctaccgggtggcac

SEQ ID NO: 68036 - DNA, 13 bp, Homo sapiens
  misc_feature 1..13: note = chr1:165414545-165414558
  misc_feature 1..13: note = hyper
  source 1..13: mol_type = genomic DNA
atctattatctag

SEQ ID NO: 68037 - DNA, 76 bp, Homo sapiens
  misc_feature 1..76: note = chr1:16542965-16543041
  misc_feature 1..76: note = hyper
  source 1..76: mol_type = genomic DNA
tgctgactgaaacagcgtctcccggttgtctgccaccgcctgcttggccaggtagcgctcgcgcagttatcttggt

SEQ ID NO: 68038 - DNA, 73 bp, Homo sapiens
  misc_feature 1..73: note = chr1:16553382-16553455
  misc_feature 1..73: note = hyper
  source 1..73: mol_type = genomic DNA
gctgcggaaggcgcacgaatcctacggccggctgggcacctactgctgcagagggttgcgcaggcgcaggcgt

SEQ ID NO: 68039 - DNA, 263 bp, Homo sapiens
  misc_feature 1..263: note = chr1:16553469-16553732
  misc_feature 1..263: note = hyper
  source 1..263: mol_type = genomic DNA
cgagccctcagagtcggggttgggccgggcctggggtcaagggcagggttacggccccctagggagactccgcccctggcggaccccgccccacccctccacatgagacggcgcgcgcaggctcagttcctcggcgtagcacagcggctcccaggcgcgctcagctcggcgaagggtgcggcgctatgccggggtactctcctgggctgctctcccaggaggagagggaaggacccctaagcccctcccctcacgatctcggc

SEQ ID NO: 68040 - DNA, 30 bp, Homo sapiens
  misc_feature 1..30: note = chr1:165550859-165550889
  misc_feature 1..30: note = hypo
  source 1..30: mol_type = genomic DNA
gagtcccggaggccccggggccctgggatg

SEQ ID NO: 68041 - DNA, 30 bp, Homo sapiens
  misc_feature 1..30: note = chr1:165624524-165624554
  misc_feature 1..30: note = hypo
  source 1..30: mol_type = genomic DNA
tgatagaatggcttgcgaatgttgaaagca

SEQ ID NO: 68042 - DNA, 23 bp, Homo sapiens
  misc_feature 1..23: note = chr1:165664216-165664239
  misc_feature 1..23: note = hypo
  source 1..23: mol_type = genomic DNA
aaaaaggacgatgagctataaag

SEQ ID NO: 68043 - DNA, 36 bp, Homo sapiens; identical to SEQ ID NO: 39142
  misc_feature 1..36: note = chr1:165809083-165809119
  misc_feature 1..36: note = hypo
  source 1..36: mol_type = genomic DNA

SEQ ID NO: 68044 - DNA, 30 bp, Homo sapiens
  misc_feature 1..30: note = chr1:166104124-166104154
  misc_feature 1..30: note = hypo
  source 1..30: mol_type = genomic DNA
atttactacctacagcgtaaagtactgctt

SEQ ID NO: 68045 - DNA, 116 bp, Homo sapiens
  misc_feature 1..116: note = chr1:166134166-166134282
  misc_feature 1..116: note = hyper
  source 1..116: mol_type = genomic DNA
ccttttagctattgtcgttgccacctgctcagagtctagttctgaaaggaggcgggtgcggagttatgaaaatttggtaaatataaaagtcccggacgcgaccgcccgtagcctgc

SEQ ID NO: 68046 - DNA, 608 bp, Homo sapiens; identical to SEQ ID NO: 26703
  misc_feature 1..608: note = chr1:166134283-166134891
  misc_feature 1..608: note = hyper
  source 1..608: mol_type = genomic DNA

SEQ ID NO: 68047 - DNA, 653 bp, Homo sapiens; identical to SEQ ID NO: 26704
  misc_feature 1..653: note = chr1:166134933-166135586
  misc_feature 1..653: note = hyper
  source 1..653: mol_type = genomic DNA

SEQ ID NO: 68048 - DNA, 19 bp, Homo sapiens
  misc_feature 1..19: note = chr1:166312814-166312833
  misc_feature 1..19: note = hypo
  source 1..19: mol_type = genomic DNA
agcacgctgtcacctctca

SEQ ID NO: 68049 - DNA, 230 bp, Homo sapiens
  misc_feature 1..230: note = chr1:166360872-166361102
  misc_feature 1..230: note = hypo
  source 1..230: mol_type = genomic DNA
aaccatctataaagtcgttatgcttatgaattcccatacaattataaaactagaacaaatttatacattaaatctaaatgaagctaaaatacaatgaaattcaaatgtgcgttaatgtaatgtgatggatgatgctggtttgtgaaattaaattgagcctctaaatgtgaataaggtactgagtactaaggggaagattattctgagtggccatgcgatgactcatgtct

SEQ ID NO: 68050 - DNA, 18 bp, Homo sapiens
  misc_feature 1..18: note = chr1:166479382-166479400
  misc_feature 1..18: note = hypo
  source 1..18: mol_type = genomic DNA
aggcgtgagccaccgcgc

SEQ ID NO: 68051 - DNA, 94 bp, Homo sapiens
  misc_feature 1..94: note = chr1:166853653-166853747
  misc_feature 1..94: note = hyper
  source 1..94: mol_type = genomic DNA
tagaggaagaagagacggccctgagcgcagcatcacctcggccggttggagtctgcccggctgccgccagggggtgatgcgccctcacctttcc

SEQ ID NO: 68052 - DNA, 175 bp, Homo sapiens
  misc_feature 1..175: note = chr1:166916746-166916921
  misc_feature 1..175: note = hyper
  source 1..175: mol_type = genomic DNA
gaacgcaagcctgcacgcctgaatagcggcagctggctttggagaaaaatgggacaactgtctcctgcccggctttcaagagctgccattctttctttccaggggctgagccaatttctcggtgccacccactctcgcgcctgcccccagcccccgtttcctcccccgctcgggc

SEQ ID NO: 68053 - DNA, 14 bp, Homo sapiens
  misc_feature 1..14: note = chr1:166916936-166916950
  misc_feature 1..14: note = hyper
  source 1..14: mol_type = genomic DNA
cgactacaatgcag

SEQ ID NO: 68054 - DNA, 36 bp, Homo sapiens
  misc_feature 1..36: note = chr1:16693059-16693095
  misc_feature 1..36: note = hypo
  source 1..36: mol_type = genomic DNA
gattacaggcgtgagccaccgcgcctggccagtaat

SEQ ID NO: 68055 - DNA, 196 bp, Homo sapiens; identical to SEQ ID NO: 26708
  misc_feature 1..196: note = chr1:166945272-166945468
  misc_feature 1..196: note = hyper
  source 1..196: mol_type = genomic DNA

SEQ ID NO: 68056 - DNA, 30 bp, Homo sapiens
  misc_feature 1..30: note = chr1:166958831-166958861
  misc_feature 1..30: note = hypo
  source 1..30: mol_type = genomic DNA
gaagaggaaggcccccgtttgtggccctgg

SEQ ID NO: 68057 - DNA, 25 bp, Homo sapiens
  misc_feature 1..25: note = chr1:1671766-1671791
  misc_feature 1..25: note = hypo
  source 1..25: mol_type = genomic DNA
tctttttttttgagacgggagtctc

SEQ ID NO: 68058 - DNA, 30 bp, Homo sapiens
  misc_feature 1..30: note = chr1:167274768-167274798
  misc_feature 1..30: note = hypo
  source 1..30: mol_type = genomic DNA
ctcatatcatgtaaccgtttattcctggta

SEQ ID NO: 68059 - DNA, 30 bp, Homo sapiens
  misc_feature 1..30: note = chr1:167340601-167340631
  misc_feature 1..30: note = hypo
  source 1..30: mol_type = genomic DNA
accagttttaattaccgtaaaattttctct

SEQ ID NO: 68060 - DNA, 48 bp, Homo sapiens
  misc_feature 1..48: note = chr1:16736310-16736358
  misc_feature 1..48: note = hypo
  source 1..48: mol_type = genomic DNA
agctgaggtgggcaccggggtcagggtcctgggcgacttctgggctgt

SEQ ID NO: 68061 - DNA, 30 bp, Homo sapiens
  misc_feature 1..30: note = chr1:167393583-167393613
  misc_feature 1..30: note = hypo
  source 1..30: mol_type = genomic DNA
ctgcgtgcatgggcacgtgtgcattgctca

SEQ ID NO: 68062 - DNA, 77 bp, Homo sapiens
  misc_feature 1..77: note = chr1:167505794-167505871
  misc_feature 1..77: note = hypo
  source 1..77: mol_type = genomic DNA
ataattaactcacttcgaaatcccttgcttcctcatggaacgtttgtggcagagttgctcagcgtgcccacaagaca

SEQ ID NO: 68063 - DNA, 30 bp, Homo sapiens
  misc_feature 1..30: note = chr1:167525159-167525189
  misc_feature 1..30: note = hypo
  source 1..30: mol_type = genomic DNA
tttaagctttggtcacgtctttttggagca

SEQ ID NO: 68064 - DNA, 769 bp, Homo sapiens
  misc_feature 1..769: note = chr1:167599108-167599877
  misc_feature 1..769: note = hyper
  source 1..769: mol_type = genomic DNA
acaaaagaaggaaatcgaaaagagaggaaacaaaaagaattaaaggaccactctaattcttgaagggacaggaaaaagaaagaaggcgcattaagggagggagacgttgagaaggactgagaccgtggcaaagcccagggtcctgagaaacttcgcgagacagaggggcccggtggctgcccatccccatgtttgggcacatggagtcgtggctcccgctcttgagtcctgccctgggagggacagtatctgtttagatttgcgtctaaatttaaaccctgatcgtcggcctccctccccgctccccaccctcccctcccctccccttcctccctccctccctcctcctccttcctcgttctctcgcgcagggcccccgcggccggggcagtcccgcagccgagcgcagccgggcgcgcgccaccgcccactcgccctgtgcccgccgcagcccgaaactggccacggccgggagcggaggggacagcggggatcgtgagctccggcccgggcgagcgggtgcgtctgccgcagagtcggcacctgaaggacatggaggtaaaggaccccggagggagacgcggggctgagcggtgagcggtgtatcgggcgccccttccccgggcggctgcccctgccctgagcatggagcacgcggctcatcgctgctgccaactagaagggcaaatgcctgctgttccgacgcctccttgaccaactccgaaggatcgtccctggtcccacctaggacacccgggttgggaggctg

SEQ ID NO: 68065 - DNA, 30 bp, Homo sapiens
  misc_feature 1..30: note = chr1:167608107-167608137
  misc_feature 1..30: note = hypo
  source 1..30: mol_type = genomic DNA
caatttaccaatggtcgtacttaaagtcag

SEQ ID NO: 68066 - DNA, 38 bp, Homo sapiens; identical to SEQ ID NO: 39144
  misc_feature 1..38: note = chr1:167789113-167789151
  misc_feature 1..38: note = hypo
  source 1..38: mol_type = genomic DNA

SEQ ID NO: 68067 - DNA, 98 bp, Homo sapiens
  misc_feature 1..98: note = chr1:167823344-167823442
  misc_feature 1..98: note = hypo
  source 1..98: mol_type = genomic DNA
gagatttaggcgtgagccaccgcgcccggccatagttagacaatctttagccgagtccagtgagtcccaggcaatgttaagttcgcttacaatctgga

SEQ ID NO: 68068 - DNA, 16 bp, Homo sapiens
  misc_feature 1..16: note = chr1:168004664-168004680
  misc_feature 1..16: note = hypo
  source 1..16: mol_type = genomic DNA
acggagtgagactctg

SEQ ID NO: 68069 - DNA, 30 bp, Homo sapiens; identical to SEQ ID NO: 39146
  misc_feature 1..30: note = chr1:168058977-168059007
  misc_feature 1..30: note = hypo
  source 1..30: mol_type = genomic DNA

SEQ ID NO: 68070 - DNA, 34 bp, Homo sapiens
  misc_feature 1..34: note = chr1:168116121-168116155
  misc_feature 1..34: note = hypo
  source 1..34: mol_type = genomic DNA
cctattagaactacacgtagaagccgggtgcggt

SEQ ID NO: 68071 - DNA, 77 bp, Homo sapiens
  misc_feature 1..77: note = chr1:168150740-168150817
  misc_feature 1..77: note = hypo
  source 1..77: mol_type = genomic DNA
cacccggcctcctctccatataactttctgtgacaaattgccgattggtgcaaaagtaattgcggtttttaattgca

SEQ ID NO: 68072 - DNA, 43 bp, Homo sapiens
  misc_feature 1..43: note = chr1:168151281-168151324
  misc_feature 1..43: note = hypo
  source 1..43: mol_type = genomic DNA
acagagtaagactccgtcccccaccctccgccaaaaaaaaaaa

SEQ ID NO: 68073 - DNA, 277 bp, Homo sapiens
  misc_feature 1..277: note = chr1:16861465-16861742
  misc_feature 1..277: note = hyper
  source 1..277: mol_type = genomic DNA
gcgtctccggggtggcgacgggaaagaaggtgggcttattgggtgcagctccacgggggctggcatctctgccgggctgtgtacacctgagcgagaagctcagtcgctctctaaagctgctcccgcggatgacggacacggagacaaataggaacggtgtgtcgtgagaggtggtccacaagcacttgccctccttcgcccggctttaaccccgctgcggagactgttctgcttctggcccttggagcaggccggctgacagcgtagtgaaggaaga

SEQ ID NO: 68074 - DNA, 349 bp, Homo sapiens; identical to SEQ ID NO: 26710
  misc_feature 1..349: note = chr1:169396286-169396635
  misc_feature 1..349: note = hyper
  source 1..349: mol_type = genomic DNA

SEQ ID NO: 68075 - DNA, 53 bp, Homo sapiens; identical to SEQ ID NO: 102
  misc_feature 1..53: note = chr1:169396636-169396689
  misc_feature 1..53: note = hyper
  source 1..53: mol_type = genomic DNA

SEQ ID NO: 68076 - DNA, 193 bp, Homo sapiens; identical to SEQ ID NO: 103
  misc_feature 1..193: note = chr1:169396730-169396923
  misc_feature 1..193: note = hyper
  source 1..193: mol_type = genomic DNA

SEQ ID NO: 68077 - DNA, 26 bp, Homo sapiens
  misc_feature 1..26: note = chr1:169457163-169457189
  misc_feature 1..26: note = hypo
  source 1..26: mol_type = genomic DNA
agagcgagactcgcgagtactcgtct

SEQ ID NO: 68078 - DNA, 30 bp, Homo sapiens; identical to SEQ ID NO: 26080
  misc_feature 1..30: note = chr1:17033955-17033985
  misc_feature 1..30: note = hyper
  source 1..30: mol_type = genomic DNA

SEQ ID NO: 68079 - DNA, 35 bp, Homo sapiens
  misc_feature 1..35: note = chr1:17034330-17034365
  misc_feature 1..35: note = hyper
  source 1..35: mol_type = genomic DNA
ccgccctgccggctccgccccgtctcccctccgca

SEQ ID NO: 68080 - DNA, 39 bp, Homo sapiens
  misc_feature 1..39: note = chr1:170629373-170629412
  misc_feature 1..39: note = hyper
  source 1..39: mol_type = genomic DNA
cctcgaaactccctgcggtgatgtcggggctagaggaat

SEQ ID NO: 68081 - DNA, 266 bp, Homo sapiens
  misc_feature 1..266: note = chr1:170630336-170630602
  misc_feature 1..266: note = hyper
  source 1..266: mol_type = genomic DNA
acagcaacgttaaaacgcaactgtgtaaatgaggatagagagtgcgaaaggagggagaggcgaggagctgctctatttctagggaggttttggggagactgatcagctccaaggacagaccgctgggaagggaaaaacggcccacatcgaactggatgccggatggaaacctctctgcgctattagactgcgtccagtacagcagatggcacgagcacgtgcggcgctcagcttaggctctcggaggcagctgagttggaaatccc

SEQ ID NO: 68082 - DNA, 1037 bp, Homo sapiens
  misc_feature 1..1037: note = chr1:170630603-170631640
  misc_feature 1..1037: note = hyper
  source 1..1037: mol_type = genomic DNA
acggaaagcacccacaagctcccactctgcgctggcccacccgcgtgcacgcccaccccccacgcgcgtccctggctcagaagcgcacagatgtttactgcttagagccggtaccgctggggagatcgagcgacttgcgcggcgcacagtgcggcgctggcagggctctgggctcccggtcgggggttcgagcggccaagggatgggggtgggggcggggagagtggggggagggcgaaagaccgccgagaggaggggggagtgggtggactaatgatgaaaaagtctcctccatcccagttccttaattaaatgcatggaaagaaccgaggcgagcacatctggtttcaatctacagccctttgatggcatcaaatgttcttttcccagatcagggctggaagttctgggctaactatggccgtttggagcccagaaaccatttacacacactcgtacccttctttctctccagtcgagcctcttgactataggacgaaaaaaaaaaaaagtctagcaatcaagggagtgcgggagtacggatgcgtgtgtgtgtgtgtgagtgcgcgtttaaagaacataaaacgccacaaataagcacttaatattttactgagtcgtcatacagtaactcatttctaatgagactgttaaagctgttaccaaattccaacaggtcatgaaaaaactgctcagcacctctctgtcttctgtcaggttagggctccgcagacggacgacagaggattatccgtagacttagatgggggttcctccgcccctctctgtcctcctgccaccacagccaggctggacgcagaaccgcacggaagcctccccaactcctgcctctgggagtgctcctgcctgcttcaaggaatctgggcagcgggaccctctgggtttagcgtcctcgcctggggaagcaactttggccttaccgtagaagttacaaaattggcgggggtagggagaaagattataatatatatttggagtcctttcttccagtttaataaacacgtacttttctcatt

SEQ ID NO: 68083 - DNA, 33 bp, Homo sapiens; identical to SEQ ID NO: 26717
  misc_feature 1..33: note = chr1:170633073-170633106
  misc_feature 1..33: note = hyper
  source 1..33: mol_type = genomic DNA

SEQ ID NO: 68084 - DNA, 256 bp, Homo sapiens
  misc_feature 1..256: note = chr1:170633381-170633637
  misc_feature 1..256: note = hyper
  source 1..256: mol_type = genomic DNA
ttctggagcggcaaccggcgctgggcggccgcttggacagcccgggcaacctcgacaccctgcaggcgaaaaagaacttctccgtcagtcacctgctagacctggaggaagccggggacatggtggcggcacaggcggatgagaacgtgggcgaggctggccggagcctgctggagtcgccgggactcaccagcggcagcgacaccccgcagcaggacagtgagtgaggggcgcatgcccacgggggtgtgtgccc

SEQ ID NO: 68085 - DNA, 391 bp, Homo sapiens
  misc_feature 1..391: note = chr1:170633892-170634283
  misc_feature 1..391: note = hyper
  source 1..391: mol_type = genomic DNA
ggctaggcaccggctcggttcatcccgcacgcggggcggcggggctgggctgggaaaaggtcttagcggggtgcaaactcagagagccagcgctgtttgggaaagcagcaggttaaagatgctgagtcgggttggaagggcttctctcgggcagcgtatgacggcttgagggagggcaccaggcacagggagcaggacttggcgctgctcaggctgcactctccacgcgggcaccgtaaggccgggcgcgaccgggaggccccgagagaacgcccggccccagacgctggagctgctctctgccccctgctgttgcctctaccgcaaatgggtttgagactggcagagtcaaaagcccggctggcttgggaaaactcgggccaagcaaagg

SEQ ID NO: 68086 - DNA, 168 bp, Homo sapiens
  misc_feature 1..168: note = chr1:170637642-170637810
  misc_feature 1..168: note = hyper
  source 1..168: mol_type = genomic DNA
ctggctcccgggccgcggcgggatgcaaatacaaaacagcgacgcgggaaatcgatttgtcacaaagggagaggtgtaaacgcagcgcaaaggaattgcttgcccaatctaccagccacactctctcgggaccttgccccgccaacttctcttcgccagagaaacgcc

SEQ ID NO: 68087 - DNA, 504 bp, Homo sapiens
  misc_feature 1..504: note = chr1:170640121-170640625
  misc_feature 1..504: note = hyper
  source 1..504: mol_type = genomic DNA
agaagctctaattcccgagaactttggggcttatttttaccatcattgagtctgcccaggctcagctctcttacaaaggtataaatctgaaattcatgtattaatttgaatccccaagatccgagttatgagaaagggcaagggcaggctctactcctattttgtttactttcaccgagttactgtgaagtgattggaaactttcttaacgggcagagagagaatacacggaaactcggatgcagtaataaagttgacataggagtcggaacagggggctctttttggatctcacctttactggggcttgaggttgtggaatgggtggaagagtaattaactgaatgaagaattttaacgttgaaaacagagcccacagtatttttggttatagtggtgtggtctctgcctcggcaaagaaacaaacacccccaccccatcttcgcagttctcctctctgctgtagcgacgccaggcgctgctttccgccgggtaaattagcgg

SEQ ID NO: 68088 - DNA, 43 bp, Homo sapiens
  misc_feature 1..43: note = chr1:170640664-170640707
  misc_feature 1..43: note = hyper
  source 1..43: mol_type = genomic DNA
cgaaagggggcgcgctcctcccaggctgcgctggtacctatcc

SEQ ID NO: 68089 - DNA, 120 bp, Homo sapiens
  misc_feature 1..120: note = chr1:171452989-171453109
  misc_feature 1..120: note = hypo
  source 1..120: mol_type = genomic DNA
accgcgcccggccatacgtgtcagtcttatgaccttggttaatgtaatttcatctgattgctgaagttgttctccattgctcaagacagatgatttggctgggcgtggtggctcatgccg

SEQ ID NO: 68090 - DNA, 56 bp, Homo sapiens
  misc_feature 1..56: note = chr1:171555005-171555061
  misc_feature 1..56: note = hypo
  source 1..56: mol_type = genomic DNA
ttttttgtgtgtttgcgtatacataatgaggtgtcttggggcgaggggcctgtcta

SEQ ID NO: 68091 - DNA, 37 bp, Homo sapiens
  misc_feature 1..37: note = chr1:171625525-171625562
  misc_feature 1..37: note = hypo
  source 1..37: mol_type = genomic DNA
acactgacccttggccgggcgcggtgactcatgcctg

SEQ ID NO: 68092 - DNA, 30 bp, Homo sapiens
  misc_feature 1..30: note = chr1:171707361-171707391
  misc_feature 1..30: note = hypo
  source 1..30: mol_type = genomic DNA
gcgtcccaagtgcggcgattgcaggcatga

SEQ ID NO: 68093 - DNA, 111 bp, Homo sapiens
  misc_feature 1..111: note = chr1:171731284-171731395
  misc_feature 1..111: note = hypo
  source 1..111: mol_type = genomic DNA
cgacttcagcagcttcgggcctgtctctgaggtggtcattgtcaaggagactcagtggtccaggggttttggtttcatcaccatcaccaacccagacgccatgagagccat

SEQ ID NO: 68094 - DNA, 1087 bp, Homo sapiens; identical to SEQ ID NO: 26724
  misc_feature 1..1087: note = chr1:171810200-171811287
  misc_feature 1..1087: note = hyper
  source 1..1087: mol_type = genomic DNA

SEQ ID NO: 68095 - DNA, 323 bp, Homo sapiens
  misc_feature 1..323: note = chr1:171811320-171811643
  misc_feature 1..323: note = hyper
  source 1..323: mol_type = genomic DNA
cgccgaaagcttcccagtgcccctctcctgttttcccagctcaacacccccctccttttcctgtcgccctccgtgaggctccctgtgaggctgtggggctttatcccccgagccccctcccttaggtggagatgctttccttctcgccagggttctcgttcctctcagctgtctactgttgcctgcctctagctggggaggcggggtgcgaggagaaagacgtcgtttgttgtggtgaagctttatccagagacgcttccccaccattctcctcccggagagtcgaagaataaaaggtggtgtgtttgcgtgtgcacctattc

SEQ ID NO: 68096 - DNA, 30 bp, Homo sapiens
  misc_feature 1..30: note = chr1:17215966-17215996
  misc_feature 1..30: note = hyper
  source 1..30: mol_type = genomic DNA
gggcgaaggcaattccgctgttctggctcc

SEQ ID NO: 68097 - DNA, 30 bp, Homo sapiens
  misc_feature 1..30: note = chr1:172815503-172815533
  misc_feature 1..30: note = hypo
  source 1..30: mol_type = genomic DNA
gggatccccaaggcccggccatggccgggg

SEQ ID NO: 68098 - DNA, 17 bp, Homo sapiens
  misc_feature 1..17: note = chr1:172902655-172902672
  misc_feature 1..17: note = hypo
  source 1..17: mol_type = genomic DNA
atagcagacttgggccg

SEQ ID NO: 68099 - DNA, 16 bp, Homo sapiens
  misc_feature 1..16: note = chr1:172943420-172943436
  misc_feature 1..16: note = hypo
  source 1..16: mol_type = genomic DNA
ccgtctcaaaaaacta

SEQ ID NO: 68100 - DNA, 30 bp, Homo sapiens; identical to SEQ ID NO: 39153
  misc_feature 1..30: note = chr1:173090762-173090792
  misc_feature 1..30: note = hypo
  source 1..30: mol_type = genomic DNA

SEQ ID NO: 68101 - DNA, 61 bp, Homo sapiens; identical to SEQ ID NO: 39154
  misc_feature 1..61: note = chr1:173477004-173477065
  misc_feature 1..61: note = hypo
  source 1..61: mol_type = genomic DNA

SEQ ID NO: 68102 - DNA, 411 bp, Homo sapiens; identical to SEQ ID NO: 26726
  misc_feature 1..411: note = chr1:173638647-173639058
  misc_feature 1..411: note = hyper
  source 1..411: mol_type = genomic DNA

SEQ ID NO: 68103 - DNA, 146 bp, Homo sapiens
  misc_feature 1..146: note = chr1:173794930-173795076
  misc_feature 1..146: note = hypo
  source 1..146: mol_type = genomic DNA
ccttatgtgtagaagcgaaattcactctcattatattcattatacggcagttttttttccctgagtttttagaaagaccacaaaaaggtaaccacgtaatatatagaatactctgcttttggttgatgccttaaaaaaatccttct

SEQ ID NO: 68104 - DNA, 82 bp, Homo sapiens
  misc_feature 1..82: note = chr1:173897008-173897090
  misc_feature 1..82: note = hypo
  source 1..82: mol_type = genomic DNA
tgttgcccaggctgtcgtgttttcctgtttctcaaataaatcttttattatttttttttttgagatggagtctcgctctgtc

SEQ ID NO: 68105 - DNA, 21 bp, Homo sapiens
  misc_feature 1..21: note = chr1:173897630-173897651
  misc_feature 1..21: note = hypo
  source 1..21: mol_type = genomic DNA
aagctccgtctcgaggaaaaa

SEQ ID NO: 68106 - DNA, 84 bp, Homo sapiens
  misc_feature 1..84: note = chr1:173993036-173993120
  misc_feature 1..84: note = hypo
  source 1..84: mol_type = genomic DNA
gcagtatgatttttacgttgtttatttttatctcgtcaatatttcaattaaaaatacgttaaaggacagatagatgcagtggct

SEQ ID NO: 68107 - DNA, 30 bp, Homo sapiens
  misc_feature 1..30: note = chr1:17416193-17416223
  misc_feature 1..30: note = hypo
  source 1..30: mol_type = genomic DNA
ggagcctccttaccccgtcctccatccctg

SEQ ID NO: 68108 - DNA, 30 bp, Homo sapiens; identical to SEQ ID NO: 39158
  misc_feature 1..30: note = chr1:174421982-174422012
  misc_feature 1..30: note = hypo
  source 1..30: mol_type = genomic DNA

SEQ ID NO: 68109 - DNA, 30 bp, Homo sapiens
  misc_feature 1..30: note = chr1:17444308-17444338
  misc_feature 1..30: note = hypo
  source 1..30: mol_type = genomic DNA
gcgcccactccctagcggtgcccagttcag

SEQ ID NO: 68110 - DNA, 44 bp, Homo sapiens
  misc_feature 1..44: note = chr1:17445869-17445913
  misc_feature 1..44: note = hyper
  source 1..44: mol_type = genomic DNA
ccccgccgcagtgcccgcgctcgctggtccggggcggccgggag

SEQ ID NO: 68111 - DNA, 38 bp, Homo sapiens
  misc_feature 1..38: note = chr1:174956311-174956349
  misc_feature 1..38: note = hypo
  source 1..38: mol_type = genomic DNA
tttttttttttgagacggagtcttgctctgtcgccagg

SEQ ID NO: 68112 - DNA, 18 bp, Homo sapiens
  misc_feature 1..18: note = chr1:17498377-17498395
  misc_feature 1..18: note = hypo
  source 1..18: mol_type = genomic DNA
gcccggcctctttttttt

SEQ ID NO: 68113 - DNA, 47 bp, Homo sapiens
  misc_feature 1..47: note = chr1:175048461-175048508
  misc_feature 1..47: note = hypo
  source 1..47: mol_type = genomic DNA
ctcccagatctaagccgccactgcagcggccacgggaccttctccct

SEQ ID NO: 68114 - DNA, 89 bp, Homo sapiens
  misc_feature 1..89: note = chr1:175346485-175346574
  misc_feature 1..89: note = hypo
  source 1..89: mol_type = genomic DNA
tgaacagttagccatcgattttatataactgctaattaccaaattagcctgcggctctaggcagggatgggctgcgcttagaatcagtt

SEQ ID NO: 68115 - DNA, 504 bp, Homo sapiens
  misc_feature 1..504: note = chr1:175354872-175355376
  misc_feature 1..504: note = hypo
  source 1..504: mol_type = genomic DNA
ttgtcattttacaaacgggaaacctgaggcccatagtggggaaggatttatatcaagcacagatctggttgccagtagaggtaggatgagaagctagttttcctctcctagtgagggagcgctgcttttcctgtatgctggaaacctcttgcttccttctcgcggtgtctatgacaaggccaatgctctgacacaccttgcctcattcctaatactcctcttgctgtgatgacaccaccggttggctccacccctctttccctccttgtgcgtctctcccccaccgcagccttacctgttgtgaactgagtggtggcagaatcgctctcgttggtccctcggacggcactgactgacacctcgtatcgggagccaggccgcagggcctgcactgagtattggctcaggggaggctgcagccggaaggtggtcctcccaccttccccgcccaccaggccatatttcaaaagaatgaaatcgactttggctcgagggggaatccac

SEQ ID NO: 68116 - DNA, 347 bp, Homo sapiens
  misc_feature 1..347: note = chr1:175365589-175365936
  misc_feature 1..347: note = hypo
  source 1..347: mol_type = genomic DNA
agaactaagaaaagacgctactatcatgaatgcccatgatctcatgtaggagaaaagaaaaatgaagcaggacggggaaatggtacgtacgggtggccaccttggcagtgatgggaaggctgaggatgttgctaatgacagcgtagacgctgatgttgtaggtgagacctggctccagctccgtgatggtgacaccactccaatctccaggcacccgctgctggagctggaggccccccagggccgtcggctggtaagagatcacatattccgtcactgccatcggcccgtcccattccagctcaatggacctgtcgctgataccagccactcgcaagtcctctgga

SEQ ID NO: 68117 - DNA, 78 bp, Homo sapiens; identical to SEQ ID NO: 14308
  misc_feature 1..78: note = chr1:175372494-175372572
  misc_feature 1..78: note = hypo
  source 1..78: mol_type = genomic DNA

SEQ ID NO: 68118 - DNA, 246 bp, Homo sapiens
  misc_feature 1..246: note = chr1:175375200-175375446
  misc_feature 1..246: note = hypo
  source 1..246: mol_type = genomic DNA
cttttttcctttgaccgtgtgaagagatgccggggttttgctgggagtgcgttttcgctggaagtgcattggtccttcttgttcactctccctctctgctcagccctctccttcccctcctgagaccacgctgcgagctcccggactctacctgtggcagcactttcttggcagcagttggcgttgcactggtctcgcagcaccgacacctccctctccagcatctcgatccggctcagcagctcc

SEQ ID NO: 68119 - DNA, 18 bp, Homo sapiens
  misc_feature 1..18: note = chr1:175388664-175388682
  misc_feature 1..18: note = hypo
  source 1..18: mol_type = genomic DNA
aattcctctgtggcacga

SEQ ID NO: 68120 - DNA, 30 bp, Homo sapiens
  misc_feature 1..30: note = chr1:175415084-175415114
  misc_feature 1..30: note = hypo
  source 1..30: mol_type = genomic DNA
attatgggaaacacacggttcctgtgtgtc

SEQ ID NO: 68121 - DNA, 30 bp, Homo sapiens
  misc_feature 1..30: note = chr1:175421411-175421441
  misc_feature 1..30: note = hypo
  source 1..30: mol_type = genomic DNA
cagcagtgaacaaagcgccctgctcgaaag

SEQ ID NO: 68122 - DNA, 30 bp, Homo sapiens
  misc_feature 1..30: note = chr1:175463981-175464011
  misc_feature 1..30: note = hypo
  source 1..30: mol_type = genomic DNA
aggaaggatggcacacggttcttagtgtct

SEQ ID NO: 68123 - DNA, 152 bp, Homo sapiens
  misc_feature 1..152: note = chr1:175472199-175472351
  misc_feature 1..152: note = hypo
  source 1..152: mol_type = genomic DNA
gaaaataggatgccccgccgcagtggcgcatgagtggacacaggtccatatgaacagccagtacacgttgctgaggatgactgggagaccagaggacccatggctgagggaagagaagcctccctaagatgagaaggcgcagctgaatgggc

SEQ ID NO: 68124 - DNA, 35 bp, Homo sapiens
  misc_feature 1..35: note = chr1:175861012-175861047
  misc_feature 1..35: note = hypo
  source 1..35: mol_type = genomic DNA
aaactggaccatgagcgtcccgatgttgcttcata

SEQ ID NO: 68125 - DNA, 20 bp, Homo sapiens
  misc_feature 1..20: note = chr1:176318951-176318971
  misc_feature 1..20: note = hypo
  source 1..20: mol_type = genomic DNA
cagcacgctgtcacctctca

SEQ ID NO: 68126 - DNA, 104 bp, Homo sapiens
  misc_feature 1..104: note = chr1:176694805-176694909
  misc_feature 1..104: note = hypo
  source 1..104: mol_type = genomic DNA
cacatcttccacacccggttacacacacacgcacgcgcgcgcacacacacactcacgggtttagtcattttaatcataacagatttattttagtgctgaaatat

SEQ ID NO: 68127 - DNA, 40 bp, Homo sapiens
  misc_feature 1..40: note = chr1:1767616-1767656
  misc_feature 1..40: note = hypo
  source 1..40: mol_type = genomic DNA
caatgtggagagtcccggctcctcacgcccaacaacgctg

SEQ ID NO: 68128 - DNA, 39 bp, Homo sapiens
  misc_feature 1..39: note = chr1:17679581-17679620
  misc_feature 1..39: note = hypo
  source 1..39: mol_type = genomic DNA
gaaagctttgatgggcgggagaagcgggttggtctgggt

SEQ ID NO: 68129 - DNA, 140 bp, Homo sapiens
  misc_feature 1..140: note = chr1:17689938-17690078
  misc_feature 1..140: note = hypo
  source 1..140: mol_type = genomic DNA
agagaagggtggggccgctcagattgcgctgcaggctgcccgctgctgcctgtgacctgaaccctcacttccctgcaggtgaacatgctggtgctagggaagcacctgggcatccccaagcccttcgggcccgtcatcaa

SEQ ID NO: 68130 - DNA, 142 bp, Homo sapiens; identical to SEQ ID NO: 26727
  misc_feature 1..142: note = chr1:177133445-177133587
  misc_feature 1..142: note = hyper
  source 1..142: mol_type = genomic DNA

SEQ ID NO: 68131 - DNA, 474 bp, Homo sapiens
  misc_feature 1..474: note = chr1:177133689-177134163
  misc_feature 1..474: note = hyper
  source 1..474: mol_type = genomic DNA
cgtgatgcttttgagcttgcactccagctccttggatggatccacgtcgccggcggccgtggccagcaccgccgccggcccccagcagcaggcgagcagggcgcagagcccggctaaagccatcttgagccccggccgccttcctcctagcgctgcgatggtgggggaggaagcgagcggggagggagcgagggagcgagcgcgggaggcgggggaggttagggaggggatggagagccgggagagccctggaccccggaatgagatgccgcttgcagagtcctgggtttaagctctgatgtctggagagccccggattctttgtttcccggagctgcttatctggagaagggaaagcgggggaggggggagaggagaaaaagggaaggaaggacgtcgaaaggaaagaggaagggagctgaggattctagggaatcaggtcagcccccagctggctgccggtgctcctgcctc

SEQ ID NO: 68132 - DNA, 40 bp, Homo sapiens; identical to SEQ ID NO: 26729
  misc_feature 1..40: note = chr1:177140105-177140145
  misc_feature 1..40: note = hyper
  source 1..40: mol_type = genomic DNA

SEQ ID NO: 68133 - DNA, 28 bp, Homo sapiens
  misc_feature 1..28: note = chr1:177140146-177140174
  misc_feature 1..28: note = hyper
  source 1..28: mol_type = genomic DNA
cgccgggctgcagctctgggatgcaatc

SEQ ID NO: 68134 - DNA, 390 bp, Homo sapiens; identical to SEQ ID NO: 26731
  misc_feature 1..390: note = chr1:177140304-177140694
  misc_feature 1..390: note = hyper
  source 1..390: mol_type = genomic DNA

SEQ ID NO: 68135 - DNA, 481 bp, Homo sapiens; identical to SEQ ID NO: 26732
  misc_feature 1..481: note = chr1:177150773-177151254
  misc_feature 1..481: note = hyper
  source 1..481: mol_type = genomic DNA

SEQ ID NO: 68136 - DNA, 86 bp, Homo sapiens
  misc_feature 1..86: note = chr1:17757487-17757573
  misc_feature 1..86: note = hypo
  source 1..86: mol_type = genomic DNA
atgccaataaaataacgccgatgaaagttcccaaccatgccaataaaaatgtatttgttggccaggcgcggtggctcacacctgta

SEQ ID NO: 68137 - DNA, 37 bp, Homo sapiens
  misc_feature 1..37: note = chr1:17787462-17787499
  misc_feature 1..37: note = hypo
  source 1..37: mol_type = genomic DNA
tggctcacgccggatcgcctgaggtcgggagttccag

SEQ ID NO: 68138 - DNA, 46 bp, Homo sapiens
  misc_feature 1..46: note = chr1:178006897-178006943
  misc_feature 1..46: note = hyper
  source 1..46: mol_type = genomic DNA
gcagcgcggtagtgccggccgctgccctgtccggctctcctgcaac

SEQ ID NO: 68139 - DNA, 108 bp, Homo sapiens
  misc_feature 1..108: note = chr1:178063625-178063733
  misc_feature 1..108: note = hyper
  source 1..108: mol_type = genomic DNA
ccatggagctctctccgtcgtccggaggagccgcggaggcgctgtcctggccggagatgttcccggcgctggagtccgactcgccgctgcccccggaggacctggacg

SEQ ID NO: 68140 - DNA, 45 bp, Homo sapiens
  misc_feature 1..45: note = chr1:178531753-178531798
  misc_feature 1..45: note = hypo
  source 1..45: mol_type = genomic DNA
caacatgtcgggaaccgtaaacccttgtcgcgggggaaaagctag

SEQ ID NO: 68141 - DNA, 30 bp, Homo sapiens
  misc_feature 1..30: note = chr1:178617443-178617473
  misc_feature 1..30: note = hypo
  source 1..30: mol_type = genomic DNA
ctttgtagaatgtcccgcaatgtgggtgtg

SEQ ID NO: 68142 - DNA, 93 bp, Homo sapiens
  misc_feature 1..93: note = chr1:17865877-17865970
  misc_feature 1..93: note = hyper
  source 1..93: mol_type = genomic DNA
ctccccgcggagaaccggggaaggagaaccgggaggcgggaagtggggaccccggggtaggtgaaggagcgaggaggtcgccgtgtggccggg

SEQ ID NO: 68143 - DNA, 16 bp, Homo sapiens
  misc_feature 1..16: note = chr1:178665797-178665813
  misc_feature 1..16: note = hypo
  source 1..16: mol_type = genomic DNA
gcgacagagccagact

SEQ ID NO: 68144 - DNA, 30 bp, Homo sapiens; identical to SEQ ID NO: 39167
  misc_feature 1..30: note = chr1:178857986-178858016
  misc_feature 1..30: note = hypo
  source 1..30: mol_type = genomic DNA

SEQ ID NO: 68145 - DNA, 280 bp, Homo sapiens
  misc_feature 1..280: note = chr1:178994064-178994344
  misc_feature 1..280: note = hypo
  source 1..280: mol_type = genomic DNA
gaattctgttcagtacgccttactgattaaatgaactatgtggcctgaagaaaaagtgtcagctcagtctttccccatcacgcatcttattccatggagtaacctgcattatatttcagggtcaggcacactaagtttgcgctttagtatatggtgaataaatggatggacacagtggcggctctgtataagtcagctgaaagcaaacaaagggaaggcagaatctttcattcacacgatttatccgcgcccactgggtgcactacggtcgggcattggc

SEQ ID NO: 68146 - DNA, 30 bp, Homo sapiens
  misc_feature 1..30: note = chr1:179050657-179050687
  misc_feature 1..30: note = hyper
  source 1..30: mol_type = genomic DNA
gctggtgttttgctgcggtttcatttccct

SEQ ID NO: 68147 - DNA, 36 bp, Homo sapiens
  misc_feature 1..36: note = chr1:179262288-179262324
  misc_feature 1..36: note = hypo
  source 1..36: mol_type = genomic DNA
gggattacaggcgtgagccaccgcacctggcctcaa

SEQ ID NO: 68148 - DNA, 26 bp, Homo sapiens
  misc_feature 1..26: note = chr1:179333328-179333354
  misc_feature 1..26: note = hypo
  source 1..26: mol_type = genomic DNA
tcatgcctgtaatcccggcactttgg

SEQ ID NO: 68149 - DNA, 375 bp, Homo sapiens
  misc_feature 1..375: note = chr1:179544716-179545091
  misc_feature 1..375: note = hyper
  source 1..375: mol_type = genomic DNA
aatccgtaccttcctcgggccgctcgctctccaacagcgccaccacctcggtgccctcctcgccggagcctcggacctcatccacgtccaccaccgtggcggcgggcgctcggggctcccccggggtccccgcccgtccggagcccgacggctcgggcccagcctcctggcgcccgcggcctccgccgctcctctcggcctttgccctcttgttctccttgtgcggagtcctgccgcctcgcccgcgggactccctggaggagctccgcgccctcctctccatcctcagagctgccgggcggctggagcagcagcgcgggagcgctaggggcacgggagcgcagtccctgtggagtcgctgcgggtccgcgtggc

SEQ ID NO: 68150 - DNA, 212 bp, Homo sapiens
  misc_feature 1..212: note = chr1:179545092-179545304
  misc_feature 1..212: note = hyper
  source 1..212: mol_type = genomic DNA
tgcccgggggaccctaaagaccgtcgggtgggggctgagggcgaggggcgggacaccggggccgcgggcggggcgcacccggaaccccgacagctgtgtcttggtggagctgtggactgcgcccgccgactcccacggccggggcggcgctgaagcagagagaggcctgggtgggagagccggccccgggcagggtgcgggcgttgaaaagt

SEQ ID NO: 68151 - DNA, 29 bp, Homo sapiens
  misc_feature 1..29: note = chr1:179704902-179704931
  misc_feature 1..29: note = hypo
  source 1..29: mol_type = genomic DNA
gctgggataacaggcgtgagccaccgccc

SEQ ID NO: 68152 - DNA, 407 bp, Homo sapiens
  misc_feature 1..407: note = chr1:179711932-179712339
  misc_feature 1..407: note = hyper
  source 1..407: mol_type = genomic DNA
tgactgatctgatcccgccctgccacgaggcccgggtacccctcagcggcggggacatccaggtgtccctggatttccagggcacagtgcgggccggaaataggaacacagaggagcccttcgggaggctctcgaggcagtctctttccagtggatagcgacacaccctggtccctaagattctcatgctctccgaattttccgtcctggacccgatctgtagggcgcaaagtcccctgtactgaggcgttcccagggcgcccgcctcccgcgtttacatttcttaggcaaaaaggcagcggagctaagcaggggtgtttggaaggcgcccgttgcgctgtttgactgcgtggcttcacttggcccgcgtgcatcagcctctctggcgggggattctccccggactc

SEQ ID NO: 68153 - DNA, 144 bp, Homo sapiens; identical to SEQ ID NO: 26737
  misc_feature 1..144: note = chr1:179712410-179712554
  misc_feature 1..144: note = hyper
  source 1..144: mol_type = genomic DNA

SEQ ID NO: 68154 - DNA, 24 bp, Homo sapiens
  misc_feature 1..24: note = chr1:179712567-179712591
  misc_feature 1..24: note = hyper
  source 1..24: mol_type = genomic DNA
cggggcctcatcgtgcaggggagc

SEQ ID NO: 68155 - DNA, 142 bp, Homo sapiens; identical to SEQ ID NO: 26739
  misc_feature 1..142: note = chr1:179712592-179712734
  misc_feature 1..142: note = hyper
  source 1..142: mol_type = genomic DNA

SEQ ID NO: 68156 - DNA, 345 bp, Homo sapiens; identical to SEQ ID NO: 26740
  misc_feature 1..345: note = chr1:179712830-179713175
  misc_feature 1..345: note = hyper
  source 1..345: mol_type = genomic DNA

SEQ ID NO: 68157 - DNA, 209 bp, Homo sapiens
  misc_feature 1..209: note = chr1:179743860-179744069
  misc_feature 1..209: note = hypo
  source 1..209: mol_type = genomic DNA
tccaggcagaagtcacggccaggacagcctgtttccacccgcagaccctggacgaactcatctccatgctgtccccactgacctcatttttagttctggctgagtgaatctctcaaggctagggagagtttccctgagcccccaggcccgtctgttccactgaaaaacattcccatagtgttaccggtagcaggtcttgactgcaaatt

SEQ ID NO: 68158 - DNA, 188 bp, Homo sapiens
  misc_feature 1..188: note = chr1:179781711-179781899
  misc_feature 1..188: note = hypo
  source 1..188: mol_type = genomic DNA
agcctttgggatgaacgggctgggtggaatcgcagccaaattattcgcagccccgttcagcatgcgtgcggtagggatagctaataactgccccgaagggttatcgcgaggatgtagtaagatgcgtgggggtgcttagcatgatgccacacagggaggagccccgcaatcagcggcagctgttcctc

SEQ ID NO: 68159 - DNA, 30 bp, Homo sapiens; identical to SEQ ID NO: 14309
  misc_feature 1..30: note = chr1:179849955-179849985
  misc_feature 1..30: note = hypo
  source 1..30: mol_type = genomic DNA

SEQ ID NO: 68160 - DNA, 30 bp, Homo sapiens; identical to SEQ ID NO: 39172
  misc_feature 1..30: note = chr1:180096076-180096106
  misc_feature 1..30: note = hypo
  source 1..30: mol_type = genomic DNA

SEQ ID NO: 68161 - DNA, 30 bp, Homo sapiens; identical to SEQ ID NO: 39173
  misc_feature 1..30: note = chr1:180137119-180137149
  misc_feature 1..30: note = hypo
  source 1..30: mol_type = genomic DNA

SEQ ID NO: 68162 - DNA, 616 bp, Homo sapiens
  misc_feature 1..616: note = chr1:180198061-180198677
  misc_feature 1..616: note = hyper
  source 1..616: mol_type = genomic DNA
tctggaaggaaatgccgtgggggctgggggcaggagagcggctgggtcttggggcagacggggtgggcttcccgcgcctgcagcccggaggcgtcgagcgcctgatggagcgtcagaggagacctcgtcccagcgttgggccttctgttgtatttctgccagaaactcgcgttgaggagaatttgttttaagcgtttctctacctgtccatgcatctcgtaaatacagtaagcatggcaagccctttcgctggttaaccccggcgtccgtgtgctcactgccgccctgcacgcacgaggtcgcggatggttcaaagcacccgcggtggcagccggagaggcagagcgggctctagggacctaagacagggccgagctggacgactggtggcagggcggccggggaggccccgccgcggggaggtttgggccccctaccctgcggaactggaggcaagtgcggactccggctgcaggccgcggtctgcggggacgcgcgcggggggcctgcgtcccgccacctccgcgcacagcccctggtccccttccccagcccgggccggcgccgcccgccgcgtgactcgcgcgttccgggccgagtacgggctgtcccttgg

SEQ ID NO: 68163 - DNA, 44 bp, Homo sapiens
  misc_feature 1..44: note = chr1:180201524-180201568
  misc_feature 1..44: note = hyper
  source 1..44: mol_type = genomic DNA
gacaactttgatgttcgacgtcagggagtcgctttgctaaaatg

SEQ ID NO: 68164 - DNA, 158 bp, Homo sapiens; identical to SEQ ID NO: 5816
  misc_feature 1..158: note = chr1:180202237-180202395
  misc_feature 1..158: note = hyper
  source 1..158: mol_type = genomic DNA

SEQ ID NO: 68165 - DNA, 646 bp, Homo sapiens; identical to SEQ ID NO: 26743
  misc_feature 1..646: note = chr1:180202648-180203294
  misc_feature 1..646: note = hyper
  source 1..646: mol_type = genomic DNA

SEQ ID NO: 68166 - DNA, 254 bp, Homo sapiens; identical to SEQ ID NO: 26744
  misc_feature 1..254: note = chr1:180203354-180203608
  misc_feature 1..254: note = hyper
  source 1..254: mol_type = genomic DNA

SEQ ID NO: 68167 - DNA, 588 bp, Homo sapiens; identical to SEQ ID NO: 1847
  misc_feature 1..588: note = chr1:180203633-180204221
  misc_feature 1..588: note = hyper
  source 1..588: mol_type = genomic DNA

SEQ ID NO: 68168 - DNA, 398 bp, Homo sapiens; identical to SEQ ID NO: 1848
  misc_feature 1..398: note = chr1:180204222-180204620
  misc_feature 1..398: note = hyper
  source 1..398: mol_type = genomic DNA

SEQ ID NO: 68169 - DNA, 474 bp, Homo sapiens; identical to SEQ ID NO: 26747
  misc_feature 1..474: note = chr1:180204897-180205371
  misc_feature 1..474: note = hyper
  source 1..474: mol_type = genomic DNA

SEQ ID NO: 68170 - DNA, 60 bp, Homo sapiens; identical to SEQ ID NO: 26748
  misc_feature 1..60: note = chr1:180206312-180206372
  misc_feature 1..60: note = hyper
  source 1..60: mol_type = genomic DNA

SEQ ID NO: 68171 - DNA, 264 bp, Homo sapiens
  misc_feature 1..264: note = chr1:180235531-180235795
  misc_feature 1..264: note = hypo
  source 1..264: mol_type = genomic DNA
tcggcacaaaatgcacggcctgccagcagggtatccccccaacccaggtggtccgcaaggcccaggactttgtctaccacctgcactgctttgcttgcatcatctgcaaccggcagctggccacgggggacgaattctacctcatggaggacgggcggctggtgtgcaaggaagactacgagacagccaagcagaacggtaagcagcatggccccgcatggtcccctctccaggcctttgtttgggccacgccctctgcctgag

SEQ ID NO: 68172 - DNA, 179 bp, Homo sapiens
  misc_feature 1..179: note = chr1:18033374-18033553
  misc_feature 1..179: note = hypo
  source 1..179: mol_type = genomic DNA
gctccccctctgcatcgtgggcccttccaggtgccgggcttgtaggttccagagggtcctggatttgggagacctgggtttgagttctggctctgtcaccggtttgctgggtgatcctctgtgaatccaatcctgtccagatgtgctgcactctcgctgggttccggtactgggatgcg

SEQ ID NO: 68173 - DNA, 239 bp, Homo sapiens
  misc_feature 1..239: note = chr1:180881341-180881580
  misc_feature 1..239: note = hyper
  source 1..239: mol_type = genomic DNA
gaatgcccctggttgcgacccccgtcccgcgctggggaaagtgatctgctcgagagcccccaggaccctgagaaccggtccccacccaaggcggcggcgggcaattccggcaccgcggcagacgggatgcgcggagcgcgttccctccgggtttccctcacgcctctggagagcgggaaccaacgaccttgacctcggaggaaacggctctacggagcgatggacggccccacagagag

SEQ ID NO: 68174 - DNA, 428 bp, Homo sapiens; identical to SEQ ID NO: 26750
  misc_feature 1..428: note = chr1:180882004-180882432
  misc_feature 1..428: note = hyper
  source 1..428: mol_type = genomic DNA

SEQ ID NO: 68175 - DNA, 30 bp, Homo sapiens
  misc_feature 1..30: note = chr1:180885601-180885631
  misc_feature 1..30: note = hypo
  source 1..30: mol_type = genomic DNA
caaggcagggagagccgggactccatcaga

SEQ ID NO: 68176 - DNA, 32 bp, Homo sapiens
  misc_feature 1..32: note = chr1:180891177-180891209
  misc_feature 1..32: note = hypo
  source 1..32: mol_type = genomic DNA
ggaggctcaggagcccgcgccagggcggccag

SEQ ID NO: 68177 - DNA, 30 bp, Homo sapiens
  misc_feature 1..30: note = chr1:180896448-180896478
  misc_feature 1..30: note = hypo
  source 1..30: mol_type = genomic DNA
agttaccccaaagagcgcatctgcccccag

SEQ ID NO: 68178 - DNA, 30 bp, Homo sapiens; identical to SEQ ID NO: 39175
  misc_feature 1..30: note = chr1:180910386-180910416
  misc_feature 1..30: note = hypo
  source 1..30: mol_type = genomic DNA

SEQ ID NO: 68179 - DNA, 99 bp, Homo sapiens; identical to SEQ ID NO: 39176
  misc_feature 1..99: note = chr1:180925089-180925188
  misc_feature 1..99: note = hypo
  source 1..99: mol_type = genomic DNA

SEQ ID NO: 68180 - DNA, 30 bp, Homo sapiens
  misc_feature 1..30: note = chr1:180925404-180925434
  misc_feature 1..30: note = hypo
  source 1..30: mol_type = genomic DNA
tgccaggctgcctgccgggcctgcctttgt

SEQ ID NO: 68181 - DNA, 22 bp, Homo sapiens
  misc_feature 1..22: note = chr1:181013386-181013408
  misc_feature 1..22: note = hypo
  source 1..22: mol_type = genomic DNA
ctgcgcccggcctgatcttttt

SEQ ID NO: 68182 - DNA, 47 bp, Homo sapiens
  misc_feature 1..47: note = chr1:181286584-181286631
  misc_feature 1..47: note = hyper
  source 1..47: mol_type = genomic DNA
aggaaggggccatcccgcccgcaaacgagaatcgggtactccagtgg

SEQ ID NO: 68183 - DNA, 149 bp, Homo sapiens
  misc_feature 1..149: note = chr1:181286935-181287084
  misc_feature 1..149: note = hyper
  source 1..149: mol_type = genomic DNA
tggtgggcatgtatgcgagttctctttctgattgccagaaatttcttttccactgtgtgagcaagagacagatttttttaaattgtctctcttctcttttatttattttgttctccatttgtggccctcacctccgcctgccttccttc

SEQ ID NO: 68184 - DNA, 897 bp, Homo sapiens
  misc_feature 1..897: note = chr1:181287305-181288202
  misc_feature 1..897: note = hyper
  source 1..897: mol_type = genomic DNA
cgcatgcactgcctgcggggctgcgctgcactccccggcggcgccacgggtctggcccccgcgcttctacgtgttggggggatgcatggaccttggagatccgtagttggccctaaccttctcggaatctcctctgcacgcgctgcctgttcctcctctgcacgctctgtccgttcctttgcaacttctgtgggaattgtcctggcgtgggaaacgcccccgcgctctttggcacttagggtgtgagtgttgcgccccttgccgcagcgctcagggcagcatcccgctcgaggatgcagggttctcaccaagcagtgagggggactcacgcgccgccggggagcggagccaggctccgagaagggagcaggctcgagccgctgggttttcgcaagccttggggcctctggccgcccttccatgcctccgggcgcgggcggctcagcaggtccccggcttcgggaagttttgtgcgcggatcgctggtggggagggcgcgcgggccagtggctgagcttgcagcgaagtttccgtgaaggaaactgcatgtgcctttggaggcgactcgggactgctgtagggtggactgggtgtctatggagttgcgggtcagagcgagtagggtgggtcctttcctgggacaggactgggaattggggctcgaagtaggggaggaaagagcacagaggaagccaggctgcatagggtgacttgctttttgatccggcttgagtctccttgtgcgagagtggttgtgcgtcctttcccagggatggaacatccagttttctgtgcttttttgctttgtgcccatgtcttggagagaataatgggagacactaacccaccgacgtctcccttgagatcgcggcttcctccttgcgcagaggactgagg

SEQ ID NO: 68185 - DNA, 179 bp, Homo sapiens
  misc_feature 1..179: note = chr1:181381915-181382094
  misc_feature 1..179: note = hypo
  source 1..179: mol_type = genomic DNA
tctaaaccttaccaacgcggcatatcattatttctttaatctgtgtcttctgcagtagactgtaagtttatgagggcaagaatccagtccactttgttaaattctggacacctgggggcccagcctggtccgccgcggatgctcctaatttcaacatcatttatcgagctccactgtgt

SEQ ID NO: 68186 - DNA, 1063 bp, Homo sapiens
  misc_feature 1..1063: note = chr1:181451296-181452359
  misc_feature 1..1063: note = hyper
  source 1..1063: mol_type = genomic DNA
ttggaaatgcctggccgtgttcgtggagcctgggaggtgcggaggagcggcgacgcggccatggcgctaggcgcgcaaaggccccgacaccttactagggcggcggcgggcccgtggcaccgctcccggcaccgaacagggcacagcactggggacacctctctgcagggacccaagacgcgcgtgcgtgtgcgccccacgccaggccctcgctctcttgcggagactccgccgcatcgctggctgcacctgcctctctcttctcggcattacttgggggaaaggggactcttcactggacctttgcagaggtggctgctaccctttggccacataaatcaagaaggcaagccagcctcaccttccaggaacctccagccttccggctgcgtccccgcccctcccgcctggccagctcctcccccgcttctcccagcgctcttgcgcgcctcgctgcgcctctgcgcgccgctcgctgtcctctgcctcgcctccccattctccttccgcatcttctccagtgctccgccgagggcgctgcctgcggggaagagggagactgagccgttagtgaggaagttcggtctgtggacaagtgtggtgccaggccgccgcgaggctcggctgcaacctgttcctcgcccgccggtgctcgccgcccgcccgctcgcactcccgccctctcggcggcgcagccgcggatcgctgttgcatgctgatccggggaggcggcggtggcgagcgctccgggcggatgctggcactcaggcttcgctgctctctggatgctgctcaacttctagcccaagcgcaggagctttgaagtcatttgtcccttttcgcttggatcgacttcttattttgagattttgggcattgcggtttacgcaggaacctcaatatcgctctccccacctccctccctctttctccaacctttggatgcgtctctgctggcagatataaagacccaagtcttcgcggtggaatttcttagatggacttgcaggggctggcgttataaagcatgtcatcgtaaccccgtcctcgtctttgtttattt

SEQ ID NO: 68187 - DNA, 295 bp, Homo sapiens; identical to SEQ ID NO: 26754
  misc_feature 1..295: note = chr1:181452691-181452986
  misc_feature 1..295: note = hyper
  source 1..295: mol_type = genomic DNA

SEQ ID NO: 68188 - DNA, 60 bp, Homo sapiens; identical to SEQ ID NO: 26755
  misc_feature 1..60: note = chr1:181453050-181453110
  misc_feature 1..60: note = hyper
  source 1..60: mol_type = genomic DNA

SEQ ID NO: 68189 - DNA, 736 bp, Homo sapiens
  misc_feature 1..736: note = chr1:181454613-181455349
  misc_feature 1..736: note = hyper
  source 1..736: mol_type = genomic DNA
ctcccacagcaaccccggctgggcttctccctctctcctctctgcatcccgctcccctgctccactctcacagagtgatcccaggccatccattgcctgagttgaacgtatctagctagggtggaggtttcgggcgggggaggggtcgggtccctgcagtcacgcctgccggtgcgctgcacaaagcggacagatctcattgtgttgtgtgctgcggctgcaaatattcctctaggcagtctacggatttcccagctgggccctcctttctcactcggcttctacggttctctaaatcttcccatccaccaggtgctgccttgctgtgcccctctcttaggggcgtgtttattcagacaggcgccctcccgtttctttgcggtagacaaagccgcccaaccgccccgcgggtggcaaagtgtgccagcagccatcgttggcacctcggacagcgccgctgaaactcccggcggcccggggctccccagttacccgggttcagcacctcgggtacttctggccgggcccagccttggagctgagaaaccaggcacgtttcctacaccacgtggtcaccttttttcacgttttctcttccgctgcaaagacaccgcctttccaccaggcgttgcgagcgcgcaaggtgcggctgtgagtcttactcctccctttccttgtctttggccaaaaatggaccaaagagagtcaaacgggagactctcgagggagttgattt

SEQ ID NO: 68190 - DNA, 173 bp, Homo sapiens
  misc_feature 1..173: note = chr1:18152682-18152855
  misc_feature 1..173: note = hyper
  source 1..173: mol_type = genomic DNA
agatgttctttagcccgcaggtgttcgagcagccggggcccagcatcccacgggccattgtggaatccgtggagtcctgcgagatctccctgcgccccctgctggtctcccacgtgatggcctgcgggggcaacaccctctatcccgggttcacaaagcgcctgttcagggag

SEQ ID NO: 68191 - DNA, 312 bp, Homo sapiens
  misc_feature 1..312: note = chr1:181701511-181701823
  misc_feature 1..312: note = hypo
  source 1..312: mol_type = genomic DNA
cttggcaggagggagcggaggcgccggcaccacatgtccgtgtgggagcagcgtaccagccagctgaggaagcacatgcagatgtccagccaggaggccctcaacagagaggaggcgccgaccatgaacccgctcaaccccctcaacccgctcagctccctcaacccgctcaatgcccaccccagcctttatcggcgacccagggccattgagggcctggccctgggcctggccctggagaagttcgaggaggagcgcatcagccgtggggggtccctcaagggggatggaggggaccgatccagtgccctg

SEQ ID NO: 68192 - DNA, 44 bp, Homo sapiens
  misc_feature 1..44: note = chr1:181727256-181727300
  misc_feature 1..44: note = hypo
  source 1..44: mol_type = genomic DNA
gagaggcacaagagccgactgagccccagcgatggttccctccc

SEQ ID NO: 68193 - DNA, 49 bp, Homo sapiens
  misc_feature 1..49: note = chr1:181767758-181767807
  misc_feature 1..49: note = hypo
  source 1..49: mol_type = genomic DNA
gtggtgaggaggagacgctcactttcgaagcagccgtggctactagcct

SEQ ID NO: 68194 - DNA, 101 bp, Homo sapiens
  misc_feature 1..101: note = chr1:181922685-181922786
  misc_feature 1..101: note = hypo
  source 1..101: mol_type = genomic DNA
gcatgtactatgtatcggacatcatgccaggccgtaggggactaaagaaatgagaaagacatggtccttgcatcagcggagtttttcggggggaccaaaaa

SEQ ID NO: 68195 - DNA, 238 bp, Homo sapiens
  misc_feature 1..238: note = chr1:182026109-182026347
  misc_feature 1..238: note = hyper
  source 1..238: mol_type = genomic DNA
gcacgaaggccttcccgcagtctggacacgggtagggtttctcgcctgtgtgggtgcggatgtgcttccggtggtcggaggaccaggtgtaggccttgtcgcagaaggagcactggtagggccgctcgcccgtgtgcaggcgcctgtgctgctggagtgtgccgcggtgggagtaggccttcccgcatagctcgcacgcgtagcgcttggcggcgccgccgcgcgtctccgcggggct

SEQ ID NO: 68196 - DNA, 30 bp, Homo sapiens
  misc_feature 1..30: note = chr1:182270970-182271000
  misc_feature 1..30: note = hypo
  source 1..30: mol_type = genomic DNA
acttggcttattcaccgtgatgctgttaac

SEQ ID NO: 68197 - DNA, 178 bp, Homo sapiens
  misc_feature 1..178: note = chr1:182584162-182584340
  misc_feature 1..178: note = hyper
  source 1..178: mol_type = genomic DNA
agagcagcaaatatccgcggctcgccgccccgggctctgtggcaccatcagcagcttgcgcaggacacagacgtcggctcacgcgccgcagccctcggccccggaagagccgcggccgcggagcagcgaacgcgtgcctgccagggaaaagcagtcaccaggaacgcggcgttttggt

SEQ ID NO: 68198 - DNA, 141 bp, Homo sapiens
  misc_feature 1..141: note = chr1:182584403-182584544
  misc_feature 1..141: note = hyper
  source 1..141: mol_type = genomic DNA
cggcctgcggctccggaaggcgaagctcttccaggaagcagcggcggccccactggccctctcaggctgcggagaaagggcgggaggccgcggggctctccaggactcagtggtttcggagaaactcgacttcccaggctc

SEQ ID NO: 68199 - DNA, 30 bp, Homo sapiens
  misc_feature 1..30: note = chr1:182650639-182650669
  misc_feature 1..30: note = hypo
  source 1..30: mol_type = genomic DNA
agacacctagaatcacgcagcaaggagaat

SEQ ID NO: 68200 - DNA, 63 bp, Homo sapiens
  misc_feature 1..63: note = chr1:182758405-182758468
  misc_feature 1..63: note = hyper
  source 1..63: mol_type = genomic DNA
ccgaagagacctgaacgccgatgggcagttgggattctccgtacgcctcggaaacagcagccc

SEQ ID NO: 68201 - DNA, 29 bp, Homo sapiens
  misc_feature 1..29: note = chr1:182807578-182807607
  misc_feature 1..29: note = hypo
  source 1..29: mol_type = genomic DNA
gccaggcagaatgcccgccttcactgagc

SEQ ID NO: 68202 - DNA, 21 bp, Homo sapiens
  misc_feature 1..21: note = chr1:182815386-182815407
  misc_feature 1..21: note = hypo
  source 1..21: mol_type = genomic DNA
tttgagatggagtttcgcttt

SEQ ID NO: 68203 - DNA, 30 bp, Homo sapiens
  misc_feature 1..30: note = chr1:182911546-182911576
  misc_feature 1..30: note = hyper
  source 1..30: mol_type = genomic DNA
aggcagggcgcgtgccgggtgcctgcgggc

SEQ ID NO: 68204 - DNA, 40 bp, Homo sapiens
  misc_feature 1..40: note = chr1:182922085-182922125
  misc_feature 1..40: note = hyper
  source 1..40: mol_type = genomic DNA
cgctttccccttcaccgggcgaggggaggccaccaccgac

SEQ ID NO: 68205 - DNA, 234 bp, Homo sapiens
  misc_feature 1..234: note = chr1:183058613-183058847
  misc_feature 1..234: note = hypo
  source 1..234: mol_type = genomic DNA
taaaacagtttcaagcgtgattgcaaaaagtttctcctcattggaaagggacatttgatatttatctgccaaactctttactactttccaattaaagataaatttaaagaagtttctgaaatgataatgtgctttacggggaaggtgatttaactagaaagaagcttttaaaaaaatgactatttaatctataacactaaatacaccaataatttagatcgacttctgattgaa

SEQ ID NO: 68206 - DNA, 158 bp, Homo sapiens; identical to SEQ ID NO: 39180
  misc_feature 1..158: note = chr1:183129382-183129540
  misc_feature 1..158: note = hypo
  source 1..158: mol_type = genomic DNA

SEQ ID NO: 68207 - DNA, 30 bp, Homo sapiens
  misc_feature 1..30: note = chr1:183204607-183204637
  misc_feature 1..30: note = hypo
  source 1..30: mol_type = genomic DNA
aatcagaccagctcccgtactctttgccct

SEQ ID NO: 68208 - DNA, 448 bp, Homo sapiens
  misc_feature 1..448: note = chr1:183385871-183386319
  misc_feature 1..448: note = hyper
  source 1..448: mol_type = genomic DNA
gaggtttttaacaagcgagcccagttcagcgcaccttttaagtttaaagatgaatatttttagcctaagccacctcgccctgtctttaccgctgtggtgtggttttcactaaacctccctaggagggctcgcgcagtcctcaggctccggataaacacgtgtgcccgcatccagctccggcgcgccctgcatttcagcaccgccgcctctggagagcgccttgctggcgggccaggtcagggcctcccacacgctctctcatccatcccagcccactcgcttttccctactcctcgcttctctcagtttcaagaaaaagcacccccaacttctaacttctcaattcctgcttctaaagtgacctccgcgtccctctttccgtgtctaaacgctcatgccccacgcctttgagtcctacgagcagctgcgaagccgcgtggcttcccac

SEQ ID NO: 68209 - DNA, 229 bp, Homo sapiens; identical to SEQ ID NO: 26760
  misc_feature 1..229: note = chr1:183386598-183386827
  misc_feature 1..229: note = hyper
  source 1..229: mol_type = genomic DNA

SEQ ID NO: 68210 - DNA, 677 bp, Homo sapiens; identical to SEQ ID NO: 26761
  misc_feature 1..677: note = chr1:183386946-183387623
  misc_feature 1..677: note = hyper
  source 1..677: mol_type = genomic DNA

SEQ ID NO: 68211 - skipped

SEQ ID NO: 68212 - DNA, 41 bp, Homo sapiens
  misc_feature 1..41: note = chr1:183462983-183463024
  misc_feature 1..41: note = hypo
  source 1..41: mol_type = genomic DNA
ggattacaggcgtgagtcatagcacccggccactttactgg

SEQ ID NO: 68213 - DNA, 331 bp, Homo sapiens; identical to SEQ ID NO: 26763
  misc_feature 1..331: note = chr1:183774098-183774429
  misc_feature 1..331: note = hyper
  source 1..331: mol_type = genomic DNA

SEQ ID NO: 68214 - DNA, 32 bp, Homo sapiens
  misc_feature 1..32: note = chr1:18387093-18387125
  misc_feature 1..32: note = hypo
  source 1..32: mol_type = genomic DNA
ggctgtttatcggcacgcggcgacgcatcact

SEQ ID NO: 68215 - DNA, 30 bp, Homo sapiens
  misc_feature 1..30: note = chr1:183907120-183907150
  misc_feature 1..30: note = hypo
  source 1..30: mol_type = genomic DNA
tagagcatcctgactcgagtggccataata

SEQ ID NO: 68216 - DNA, 1392 bp, Homo sapiens
  misc_feature 1..1392: note = chr1:184005438-184006830
  misc_feature 1..1392: note = hyper
  source 1..1392: mol_type = genomic DNA
tcccctggccctccccgcagcagacacagggaccaggtccaagcttctttcctccggggacaaaacttggctgtttatctttcccagggcatcttcgtctctccccgggacgtggaaccccgatgcaccggcagggacagcccggagcgctcgcaggagaccaggcccacggtggtgccatggttgggcacactccgcgggctccgcccaatctccacccctaggtccaggtccccctaggagagctaggagcacatttccagcctggagcaggagcccggcaccggaaagtcagagcagcgcactgcggcgccccagccactgcggagcccctggccaaccgcagttacgttccatctgtcgtatctacatgggaatacggcgacaggcaccctatcccctcacgtcagggctagcagtatgaggtggggaaagaggaaacctcgagagttaaaagcgagggaactgaaagtccccttgaggggtgtcccccatgccccttgtgggacaaagccccaattcgcaggctaccctccagagctccagcggtccggttctccccatcagcaccctctgcgcacactgacccgcgcgtccctccgcagcctgaccgcccgatccgccagccaccggcgcgggcagcgagggggtgtgtgcgccagattttccgcgtgcccccccgcccctccagcggctccctcgccctgcagctgctgctccgggcgctgtccgcgctgggcaggccgcccccgcgtcccgccgcggcggcccggggcccgtgcgcgctcaccagatggccatcctgctcttggggtagtccagccgctccaggcagccgaggaagtgcggcagcgtgtgcgccgcgttgcgggcgaggaccgccacgagcaccgtggggctctgcaggggcgactccgggaaaaccaccggctcctctccgtcgtcctccgagtcccgctcggcgacgaagcgcgctcggcagccttcgcggagcagggctgaggagaggagcagtagcgaccaggcgagggtggcagcagggcgcgcagccatgttccgggccgaggcgggcggcggggaagtcctggcgcgagcgcccggctgggctgcctgagggcggcggcggctgccggggagcaaggggctgcgaggggcggccgggggatgcggcttgccgcggccggccggctcacacactggcctcggcggctgcggttcccaggaccctcccgccgccgctgcaccgcccaggccccagtgcgggtgcgcagcgtacctgcagccgctggcgctcccctgcgcctcgggctcgcagacagtagtggccgaggggctgtgtgccctgagtcctgaggaaagttcctctagtccaggttccgctcgtacagctga

SEQ ID NO: 68217 - DNA, 51 bp, Homo sapiens
  misc_feature 1..51: note = chr1:18433884-18433935
  misc_feature 1..51: note = hyper
  source 1..51: mol_type = genomic DNA
catcaggctgagtagcggggagggcgatggtaatcccggggataggagggg

SEQ ID NO: 68218 - skipped

SEQ ID NO: 68219 - DNA, 65 bp, Homo sapiens; identical to SEQ ID NO: 26082
  misc_feature 1..65: note = chr1:18434751-18434816
  misc_feature 1..65: note = hyper
  source 1..65: mol_type = genomic DNA

SEQ ID NO: 68220 - DNA, 98 bp, Homo sapiens
  misc_feature 1..98: note = chr1:18435431-18435529
  misc_feature 1..98: note = hyper
  source 1..98: mol_type = genomic DNA
gcagggaggtatggacgcttccggggctggggagttgtgagcagctcagtgtgtgtgtgtgtgtgtgtgtgtgtgtgtcccgccgtgtggacttgctc

SEQ ID NO: 68221 - DNA, 665 bp, Homo sapiens
  misc_feature 1..665: note = chr1:18436334-18436999
  misc_feature 1..665: note = hyper
  source 1..665: mol_type = genomic DNA
ggacattgcagggggcgggggttggaggctggggacctaaggtaagcacccctttccctgggaatgcgcagaacagagagacgcggcagggtgaaggagaggactgatgagaagggcttgttgggaaaccctggctccgtcaggaccccaccctgcgagctctccctggaacccgggagcagggttcttctggctgcccggctgcagagagctgacccggcatcctgacgcctcaaatccctttgcccgcctctgcgggctgcgggaggcgggggttggcgtgcctgagggtgagcgcatctgggccggtgcagccagcgcggcctcggagctccgctgctcaggatgaaggaagagcgcagacgcggatcgcgaatgggaaactttccgcgtctggggcgcagagggagatccgaggcagccgggagccctctcttctccgcagaggagagcacacgagggtggggtccctccttcctccttccaagtctgtgcccagaatggggggcggggtgcgagaagagtccgtgagagacgcaagaggcgggctgtgccggaggagggcgcccttcctggaggtggccgagagaggtgcacctggcagcggctttgcagggccacctgcctccgagggcgcagagaggagcaacccgcgccggccttca

SEQ ID NO: 68222 - DNA, 388 bp, Homo sapiens; identical to SEQ ID NO: 26085
  misc_feature 1..388: note = chr1:18437043-18437431
  misc_feature 1..388: note = hyper
  source 1..388: mol_type = genomic DNA

SEQ ID NO: 68223 - DNA, 413 bp, Homo sapiens
  misc_feature 1..413: note = chr1:18437432-18437845
  misc_feature 1..413: note = hyper
  source 1..413: mol_type = genomic DNA
ggggtctccgggattgcgcgggcggaggtgggcggccctgcgggttctcgggttctcgggttctctgtctccgcagccgcgtgtcagcaggtggatgggatggaggggctgtctccgctaggccgccgcaaccgcaacgccgagactgcgggggctgtgcgcgcgcgagcgggtgtgacgactttatatatttatcctcccttcacacgcccccttcccactgggcggggcctctggcgcggcagggtttcttctccagccccaactgggggagttaagggccctaatcccttgcaggctgcctcgcccatgcccctccagcgtggccccgcccctagccataaactccacccctcttccaccccataaccgctctgcaaatgggagtttttcattttcgtgttttaagtgca

SEQ ID NO: 68224 - DNA, 30 bp, Homo sapiens
  misc_feature 1..30: note = chr1:184442660-184442690
  misc_feature 1..30: note = hypo
  source 1..30: mol_type = genomic DNA
agcagatgattctagcggtctttggggata

SEQ ID NO: 68225 - DNA, 30 bp, Homo sapiens
  misc_feature 1..30: note = chr1:18448183-18448213
  misc_feature 1..30: note = hypo
  source 1..30: mol_type = genomic DNA
tctcagccattcctacgtgctcagtggtgt

SEQ ID NO: 68226 - DNA, 25 bp, Homo sapiens
  misc_feature 1..25: note = chr1:184608977-184609002
  misc_feature 1..25: note = hypo
  source 1..25: mol_type = genomic DNA
acaaaggggcttggccgggcgcagt

SEQ ID NO: 68227 - DNA, 62 bp, Homo sapiens
  misc_feature 1..62: note = chr1:184633288-184633350
  misc_feature 1..62: note = hyper
  source 1..62: mol_type = genomic DNA
gtccgcaggagggatcgacgcctctgtctccccgaagtgagggcgctcgctgcggagctggg

SEQ ID NO: 68228 - DNA, 23 bp, Homo sapiens
  misc_feature 1..23: note = chr1:184721182-184721205
  misc_feature 1..23: note = hypo
  source 1..23: mol_type = genomic DNA
ggccaagtcggctttttctaaag

SEQ ID NO: 68229 - DNA, 100 bp, Homo sapiens
  misc_feature 1..100: note = chr1:184725924-184726024
  misc_feature 1..100: note = hypo
  source 1..100: mol_type = genomic DNA
cttgctcgcctgctgctcctgagaggcaactgactggtaccagtccactgccccaggcttggggatccttgcttttatctactaacgtggatgctgtgaa

SEQ ID NO: 68230 - DNA, 122 bp, Homo sapiens
  misc_feature 1..122: note = chr1:184764179-184764301
  misc_feature 1..122: note = hypo
  source 1..122: mol_type = genomic DNA
tgacagcaggacatccgggtttggagcatcctccaccacccactgacactcatgaatacgggctaccttgatctcctctgcattcacactggccgtggcctgggccgcgctgctttgccctc

SEQ ID NO: 68231 - DNA, 120 bp, Homo sapiens
  misc_feature 1..120: note = chr1:185073818-185073938
  misc_feature 1..120: note = hypo
  source 1..120: mol_type = genomic DNA
ttttaaactgtacaccgttctgagtagcctgaggaaatcttgtgccgttccacttgggacatgaattatccccgtgtccagcatatctttgctgtatatgctactcgttcattagtcact

SEQ ID NO: 68232 - DNA, 160 bp, Homo sapiens
  misc_feature 1..160: note = chr1:1856211-1856371
  misc_feature 1..160: note = hypo
  source 1..160: mol_type = genomic DNA
acctgtcctccagggcgcctgagtctcgctcaggcccagcttagctgaacccacgtccccacctgtgtcctccctgccctcaccccctctccttagagcaccctttctccatgcaacgcccgtctcgggctctgcctccaggacccgccctgagccaggc

SEQ ID NO: 68233 - DNA, 30 bp, Homo sapiens
  misc_feature 1..30: note = chr1:1857232-1857262
  misc_feature 1..30: note = hypo
  source 1..30: mol_type = genomic DNA
aggacacagactctccggcaatcacatagc

SEQ ID NO: 68234 - DNA, 30 bp, Homo sapiens
  misc_feature 1..30: note = chr1:1857706-1857736
  misc_feature 1..30: note = hypo
  source 1..30: mol_type = genomic DNA
tgggtcccacctgcacgcagcaggctggag

SEQ ID NO: 68235 - DNA, 67 bp, Homo sapiens
  misc_feature 1..67: note = chr1:1861815-1861882
  misc_feature 1..67: note = hypo
  source 1..67: mol_type = genomic DNA
gtccgtgtccctctgcggcaggcgcgggggccactgggtggaggacaagccccggggggggctcaca

SEQ ID NO: 68236 - DNA, 102 bp, Homo sapiens
  misc_feature 1..102: note = chr1:186649596-186649698
  misc_feature 1..102: note = hyper
  source 1..102: mol_type = genomic DNA
accaagcccatgtgacgaaatgactgtttctttccgccttttcgtaccccccacaaatttttccctcctctccccttaaaaaaattgcgtaagcccggtggg

SEQ ID NO: 68237 - DNA, 77 bp, Homo sapiens
  misc_feature 1..77: note = chr1:186649956-186650033
  misc_feature 1..77: note = hyper
  source 1..77: mol_type = genomic DNA
ctccaggaatctgagcggccctgaggtccgggggcgcagggaatcccctctcccgccgccgccgccgtgtctggtct

SEQ ID NO: 68238 - DNA, 40 bp, Homo sapiens
  misc_feature 1..40: note = chr1:186797074-186797114
  misc_feature 1..40: note = hypo
  source 1..40: mol_type = genomic DNA
caggcgtgagccaccgtgcccagcccgaaaaatgtttatt

SEQ ID NO: 68239 - DNA, 122 bp, Homo sapiens
  misc_feature 1..122: note = chr1:18703326-18703448
  misc_feature 1..122: note = hypo
  source 1..122: mol_type = genomic DNA
acgcgggttgggagccgcctcctggacggcagcgctgagttcgacgggaaggagctggtgctggagcgggttcccgccgagctcaatggctccatgtatcgctgcaccgcccagaacccact

SEQ ID NO: 68240 - DNA, 30 bp, Homo sapiens
  misc_feature 1..30: note = chr1:187043706-187043736
  misc_feature 1..30: note = hypo
  source 1..30: mol_type = genomic DNA
acacctgacattgaacggatgagattgacg

SEQ ID NO: 68241 - DNA, 61 bp, Homo sapiens
  misc_feature 1..61: note = chr1:1874726-1874787
  misc_feature 1..61: note = hypo
  source 1..61: mol_type = genomic DNA
gcgagcagactccaccgcagacacgccaacacacgcagctggctcccgggtcaccgcaggc

SEQ ID NO: 68242 - DNA, 22 bp, Homo sapiens
  misc_feature 1..22: note = chr1:187755700-187755722
  misc_feature 1..22: note = hypo
  source 1..22: mol_type = genomic DNA
ccgctcccggccatcaataatt

SEQ ID NO: 68243 - DNA, 30 bp, Homo sapiens
  misc_feature 1..30: note = chr1:18801486-18801516
  misc_feature 1..30: note = hypo
  source 1..30: mol_type = genomic DNA
gagagaccagattggcggcaggcacgcaca

SEQ ID NO: 68244 - DNA, 30 bp, Homo sapiens; identical to SEQ ID NO: 38873
  misc_feature 1..30: note = chr1:18818951-18818981
  misc_feature 1..30: note = hypo
  source 1..30: mol_type = genomic DNA

SEQ ID NO: 68245 - DNA, 30 bp, Homo sapiens
  misc_feature 1..30: note = chr1:1888198-1888228
  misc_feature 1..30: note = hypo
  source 1..30: mol_type = genomic DNA
caatgagctccttgtcgagggacagctgcc

SEQ ID NO: 68246 - DNA, 44 bp, Homo sapiens
  misc_feature 1..44: note = chr1:18956211-18956255
  misc_feature 1..44: note = hyper
  source 1..44: mol_type = genomic DNA
gtattttgcctccagcgtggggccagagacgctctttcccccgg

SEQ ID NO: 68247 - DNA, 141 bp, Homo sapiens; identical to SEQ ID NO: 26088
  misc_feature 1..141: note = chr1:18956470-18956611
  misc_feature 1..141: note = hyper
  source 1..141: mol_type = genomic DNA

SEQ ID NO: 68248 - DNA, 875 bp, Homo sapiens
  misc_feature 1..875: note = chr1:18956738-18957613
  misc_feature 1..875: note = hyper
  source 1..875: mol_type = genomic DNA
cggcaggaaggtagagtaagaaccggacaccggggctctgacattacacagaaaaggtcagaattcctcccttcaagtcaccctaggccggttcccggggagcctcactggaggaatttcagagggtgtaagacgagggagaagatgagaaatagggcggactctggccctcggaggccagagaaaaggcgagactccagagaggcgccggacccgaggcagacattcccatacagccgggactccgagagcagccgtgggcgacctgggggccggggactcggcggatccggcccattcatcaaaggaaggcactgggacaaagttggccccctccccttctcccccagcccccaactcgccgggatcggctccctctcttttcacggcggttcaaattctcccccaaaacgaggtcgagccggggattagaaaagagggaaaaaaatattcgttggcgatttcttttcgttattggtcctccgctcccttgcgccctggcccccttccctcctcatgaataaaagaaaagtccgaacctatcagatcgcgctcactgcctcctcctcctcctcctcctcctcctcctcgtacttcggtgaacacttttgcacaacttacccagctgatcactcgcgccccctcgcttttccatttctctttccccaaccccgtcaccccctgtctcctccgtccagccctgaaacccgaggaggctccttcttccgtctgtccccgggtctcctaggggacggggctgtgaaagctggtgtggagggagaagcgagtgtggtccggagaaagaaggcgtggagaagagggagggagcgagagcgagagaataaatatataaataaatacgagaacgaaatcca

SEQ ID NO: 68249 - DNA, 244 bp, Homo sapiens; identical to SEQ ID NO: 26090
  misc_feature 1..244: note = chr1:18957985-18958229
  misc_feature 1..244: note = hyper
  source 1..244: mol_type = genomic DNA

SEQ ID NO: 68250 - DNA, 71 bp, Homo sapiens
  misc_feature 1..71: note = chr1:18958358-18958429
  misc_feature 1..71: note = hyper
  source 1..71: mol_type = genomic DNA
cgcttctgcgtgggtttcactgcccggcggccttcgtttcgcaggtcgctagctgccggtctttacccgca

SEQ ID NO: 68251 - DNA, 439 bp, Homo sapiens
  misc_feature 1..439: note = chr1:18958829-18959268
  misc_feature 1..439: note = hyper
  source 1..439: mol_type = genomic DNA
tagagaacctctaaacggcgagaggggcacggcaatgtccaaacgagaagaaagagctgattttgtaaagcgtccttcctaaacatccagcgcccgcccggggagacccgataggacgggcggcggcgaaccgggtcctggctggagaaaaggctgggagcgcacagcggagagacccgctcctgtgtttttgttctgttttctttttaaactaatggaaggcctcaacctgtcactgagggatcatttggcttctgagggtaggtagcctagggtgtcacagagaagtcattagaaatatgtgcgactttttttttttaaattactcttcctgtgatcgtttgagtccctggcgcgtgaggaaggggagaggaggcagggagggggtgggtgggctggcagcctgcgatccgggaggagctcccttgggcagcgagac

SEQ ID NO: 68252 - DNA, 121 bp, Homo sapiens; identical to SEQ ID NO: 26094
  misc_feature 1..121: note = chr1:18959269-18959390
  misc_feature 1..121: note = hyper
  source 1..121: mol_type = genomic DNA

SEQ ID NO: 68253 - DNA, 492 bp, Homo sapiens
  misc_feature 1..492: note = chr1:18959455-18959947
  misc_feature 1..492: note = hyper
  source 1..492: mol_type = genomic DNA
cgcagaatactgaggagagccgagtgccggtcgctaaagaggctcttgaatataaagttgggcgctcgagagctcttgagcgctaatggcatatcccgccacggagaccgagtgactccgactttgcgacgcacgatttctgattaaatccgagagtggcttcagacaccgacttttacaaagagaggtggggggaccgggagagcgagggagggggcggtaggaacggcccagcagcggagcctcttctcgcctcctccctttcaattacagtcagctccctccactcccgcggctgtgaaatcgttctaatcttccagatctccgcagccgctgagtccccaaattggggggatcgaggccggattagtgcgctgggtgtccccccaatcttctgtgaggaaattgtgtagactttgcattaaggcaaccaggcgttctcccctccccagcacacaccagtgatgcctgtcttcccggttcccaaagtca

SEQ ID NO: 68254 - DNA, 170 bp, Homo sapiens
  misc_feature 1..170: note = chr1:18960861-18961031
  misc_feature 1..170: note = hyper
  source 1..170: mol_type = genomic DNA
ctgcctaaccacatccgccacaagatagtggagatggcccaccatggcatccggccctgtgtcatctcccgacagctgcgtgtctcccacggctgcgtctccaagattctttgccgctaccaggagaccgggtccatccggcctggggccatcggcggcagcaagcccag

SEQ ID NO: 68255 - DNA, 1220 bp, Homo sapiens
  misc_feature 1..1220: note = chr1:18962727-18963947
  misc_feature 1..1220: note = hyper
  source 1..1220: mol_type = genomic DNA
gaggtttagtgagttcgattagccgcgtgctcagaatcaagttcgggaagaaagaggaggaggatgaagcggacaagaaggaggacgacggcgaaaagaaggccaaacacagcatcgacggcatcctgggcgacaaaggtagggaacttccctgggctgcgaggccccagcccgggttttcccacgctccggtgtgcgggccagtggttcgctcccgccgccggagcaggcgaccagaactccagcggagaaactctcatgctgcggggcagctgggagccgctcaggctttgccgacagcgccccctcggtgcgcaccccggatgccggctagatgcgaagcccgcgccttctttgcgctatggaggccgggcacggacggcctgtgagtcccgggagagcccggctgcggggctgcgcgcctggtctaccccaatactgcggggagtgcgtcctcccgggctggcgttttggctgctactctcggcgtcgatcaattatttataggaaacttgggcaagggggcgggggacgggagggagggagagaggaaggaggagccggcccgcggctccctaaatgaatttgttaaccagacccccacacgctctctaaacggtcccttgaaaccccgcctgacagttgactgaccgctgcaatcaataaaaattagccagggccgccgcctgactcagccccgcgttgccagggcggactgggggacagagagtgccttcctctgtggcgtgcgccggcagggctgggagtggaggccaagttcccagatgcccagggtcggaggatcgcagtgggggagagacccaggctccacacaccctctccccattcttagcacggcttccgcgggcaggctggagtctgagtcctgcgccatgctttttctcaggatcagctaaggagggcgtttagttttcaagcgcccggaagcccgggaaaggggattgtgcttttgtttcttgacgggaggaagtttcgagagaaggaagggaaagtttttcctcattaccccctccccttcctcattgccctcataattcccctcctaagtctctttgagacttggtaagtgcacgttaaggggcgacagggagagaaacagaaatggaagacccagagtcacaaagactgacagttaaagaaaaggccccaaacacatacgcggagaggcggcaggctgagggaatcggaaagacagtggc

SEQ ID NO: 68256 - DNA, 231 bp, Homo sapiens
  misc_feature 1..231: note = chr1:18964253-18964484
  misc_feature 1..231: note = hyper
  source 1..231: mol_type = genomic DNA
agcgaagggaaggggcggccattgacagacagggcccctagtgatgccgcagtcccgcccgggacaaaagggcgagggaagaaagggagccagctgtgccgggcgccccgctgtgcccggcctgccgaggggccacgggtctgcggcgggaggcagccctgcactgccaagcggtccttggctaggccagtcggcccagagccctgggacacctgccgggggacccagtcc

SEQ ID NO: 68257 - DNA, 137 bp, Homo sapiens
  misc_feature 1..137: note = chr1:18965943-18966080
  misc_feature 1..137: note = hyper
  source 1..137: mol_type = genomic DNA
tgagtattctcagaccgttgccgataggtgcttgccccagtcaagcttggctcacctggaaagggaagtggacagttccttgcccccatgcacttagactccctcctcttcacccctttctccgaggatcaggggat

SEQ ID NO: 68258 - DNA, 30 bp, Homo sapiens
  misc_feature 1..30: note = chr1:18966326-18966356
  misc_feature 1..30: note = hyper
  source 1..30: mol_type = genomic DNA
taagccaaaactgaccggatcagaccaggg

SEQ ID NO: 68259 - DNA, 41 bp, Homo sapiens; identical to SEQ ID NO: 26100
  misc_feature 1..41: note = chr1:18966656-18966697
  misc_feature 1..41: note = hyper
  source 1..41: mol_type = genomic DNA

SEQ ID NO: 68260 - DNA, 129 bp, Homo sapiens; identical to SEQ ID NO: 26101
  misc_feature 1..129: note = chr1:18968003-18968132
  misc_feature 1..129: note = hyper
  source 1..129: mol_type = genomic DNA

SEQ ID NO: 68261 - DNA, 1483 bp, Homo sapiens
  misc_feature 1..1483: note = chr1:18969348-18970831
  misc_feature 1..1483: note = hyper
  source 1..1483: mol_type = genomic DNA
gggggagaggtgaggcggggaaggagtccagtgagagcgcagggggaactaccagcatgggaaggggaggggcctggaggaggaagagacggggtcgagggcaaaggggaggcgggggccaaaggaaagggtgtggggaggggatgcgaagggagggggtcggctgcacttggaacttcaacctcctgggagaggaaaagcgtctgcgggtcgctacagcctcgggaggggtgaagggaagttgtgtgcgccccaagtccagctcaaaagaggccccgagggcattctagggcgccttgggcacgcgtgccaggcccccggtttggcagccgagctgagcgagggtggattgcgaggggcactggggccgccgcggagctctgcgtgtcggctgccagtgaattggccgatttccccagtctgagggtcagcgaacggacctttccatggcttggtcgccctggtcctggaggtgcgctgggcccgagctccggtggagaccaagggaggggtggggagaggcagcggagacagagagccacagaggaggagagagctagaaaattcagagtgagaaagtctgagcgcagcagaagagaatcttgcgcacagtttgaggacgctggaaaatgcggaggcgccgagggaggcgccgagcagcaggaagaaagacaaagagatgcagaatcaccgagagactggccctgggacaggcggatcaggagagccagcgggacctagagacagcccgcgggagagcacgggccgagagggcgagtgctcaaagccgggcagcggctaggggaagataggaggcgggcgagccgcggccgcccttttgatccttcgtggcttcgccttatcagaagcgctttcggtgacatccgcacaaaggcagttcatcatattacagcacgtcccggcggctcgctgcgatcctgccgcttaattagaggcgagcgagctgggccggcagggcgggagggaggccgaccccgaggcgggaggccgggttctgcgctccaacccggggcgctgggcaggggccagcccgcgtgcctggcggtgttgggacgtggagagagggagaggccgggaactgcattcagagcgttgctaaattaacaggccggcccgggcttcactgcccggagagtgaagctcgccgccttccaatttagccgccgccccttctaagttcttgggaagggatggcgctccggccactttcccctcttccaggctgcgaacgctgcggactggagggcgagtaatggggaggcaacccagggcgagctgaaggcttagtgcaactccgggtccaggtcgcacccaccagccccccgcggctgtgttccatcccctcctccgaccgccttgctctccatccgaacccaggtgtgccaggctggagcaatctgagaggggcaaagtgcatcgtggtcgaggttctactgtccatcccacccgcaactcactagcg

SEQ ID NO: 68262 - DNA, 367 bp, Homo sapiens
  misc_feature 1..367: note = chr1:18971716-18972083
  misc_feature 1..367: note = hyper
  source 1..367: mol_type = genomic DNA
ctctggagtggcccgcgtcggcgggctgggccttgcttcgccacgggttcgagggagaggcggagggaggagcggctgggctgcggagcctcttgccttcactgcactctttgtctgacaccacgaaaagaccgaagatcaaagaggcccccgagcgggacagaaaaaggggtggggcggcgggcgcgataagtagctcggaaaactccaccctaaacttttctgggtcctttccatgggacccagaccctacagaacctcacccaagtgggcgagtgggcggccggccgtgggttctctacagtcccaagcctccgcgagggcgacaggtggagagggacagctacggctgcgggctccaattcag

SEQ ID NO: 68263 - DNA, 30 bp, Homo sapiens
  misc_feature 1..30: note = chr1:18972559-18972589
  misc_feature 1..30: note = hyper
  source 1..30: mol_type = genomic DNA
cattctcctccctcccgctgcctgcaaatg

SEQ ID NO: 68264 - DNA, 163 bp, Homo sapiens
  misc_feature 1..163: note = chr1:18972950-18973113
  misc_feature 1..163: note = hyper
  source 1..163: mol_type = genomic DNA
agtgaggataagagccgctcctggcctccccaggcagcaggaaattagggccgggaaagcggtttggaaactggtcagcgggtgcaggcgggcagagggtgggaggcgtcaggagttcgtcctcctccccggggcgccccctccccgccgccctctcggcaca

SEQ ID NO: 68265 - DNA, 73 bp, Homo sapiens; identical to SEQ ID NO: 26105
  misc_feature 1..73: note = chr1:18973661-18973734
  misc_feature 1..73: note = hyper
  source 1..73: mol_type = genomic DNA

SEQ ID NO: 68266 - DNA, 30 bp, Homo sapiens
  misc_feature 1..30: note = chr1:18978567-18978597
  misc_feature 1..30: note = hyper
  source 1..30: mol_type = genomic DNA
gcagcaagagaatcccgggcagcagcggaa

SEQ ID NO: 68267 - DNA, 38 bp, Homo sapiens
  misc_feature 1..38: note = chr1:19020254-19020292
  misc_feature 1..38: note = hyper
  source 1..38: mol_type = genomic DNA
gggcacattcctgggcgctttctcgttcccacgtctgg

SEQ ID NO: 68268 - DNA, 15 bp, Homo sapiens
  misc_feature 1..15: note = chr1:19043052-19043067
  misc_feature 1..15: note = hyper
  source 1..15: mol_type = genomic DNA
cctcttttctccctt

SEQ ID NO: 68269 - DNA, 29 bp, Homo sapiens
  misc_feature 1..29: note = chr1:19043114-19043143
  misc_feature 1..29: note = hyper
  source 1..29: mol_type = genomic DNA
cgtctccctgatcgcgtcataaccctgag

SEQ ID NO: 68270 - DNA, 391 bp, Homo sapiens; identical to SEQ ID NO: 26108
  misc_feature 1..391: note = chr1:19043352-19043743
  misc_feature 1..391: note = hyper
  source 1..391: mol_type = genomic DNA

SEQ ID NO: 68271 - DNA, 151 bp, Homo sapiens; identical to SEQ ID NO: 5351
  misc_feature 1..151: note = chr1:19043756-19043907
  misc_feature 1..151: note = hyper
  source 1..151: mol_type = genomic DNA

SEQ ID NO: 68272 - DNA, 561 bp, Homo sapiens
  misc_feature 1..561: note = chr1:190444251-190444812
  misc_feature 1..561: note = hyper
  source 1..561: mol_type = genomic DNA
aaaggaaggagtgaccgtcagcaataatactttaacacagagcctaagaagtcattcaacagttctaaaccctacttcgcagtcagacaaggacagtgattagggttttataaagcaggcattctgaggaatcgtcgtttactaacgttaaatatagctcattaaaataaataaatattaacgcaaaaaggtactaagagactccagagatcttaagtctattctctcatacagaagaggtttgctcaagtttggcttaggaaggttggaaatggagcattctggaaggatggaaaccccctggcgcaccccactctatggggctgcaaatgcccacaccaagcacacgttcgctgcaggggctgagtgcagagcctgagctagcaggtcagagtaggggacacctttcctacacgcatgggttattcccacatcaacaccaagcctggggccagctggtcaaccaggcaccttgctctcctccgttccctgagctcaggtggcataggcgttgccgtgagctgcggagaaatctccacgcagagtcgcctgttgataacc

SEQ ID NO: 68273 - DNA, 59 bp, Homo sapiens
  misc_feature 1..59: note = chr1:190445138-190445197
  misc_feature 1..59: note = hyper
  source 1..59: mol_type = genomic DNA
ctagtgacctagtgacgggtgaggggcgccaagtggtgcggaccacagtctcaaccccc

SEQ ID NO: 68274 - DNA, 456 bp, Homo sapiens; identical to SEQ ID NO: 26769
  misc_feature 1..456: note = chr1:190445198-190445654
  misc_feature 1..456: note = hyper
  source 1..456: mol_type = genomic DNA

SEQ ID NO: 68275 - DNA, 169 bp, Homo sapiens
  misc_feature 1..169: note = chr1:190447121-190447290
  misc_feature 1..169: note = hyper
  source 1..169: mol_type = genomic DNA
tttaagagttacctgcgttgggaccattatcattaggattaatagtattccatcagtgcatttcactagtatttcccttgaacattttcacttgcagcaactgagggaggcgtagtaaggaagcccaacacaaccaattcccccactccccaaataaaccactacgacc

SEQ ID NO: 68276 - skipped

SEQ ID NO: 68277 - DNA, 374 bp, Homo sapiens
  misc_feature 1..374: note = chr1:190447388-190447762
  misc_feature 1..374: note = hyper
  source 1..374: mol_type = genomic DNA
cgagtcgctaggcgctttcgggggcgctgtgccggtgaggcttaggcaaggggacggggaaccgtggttagatgcagcagcggcggcagcagccctcccaggtcccacttctttggcgttcctgctgcctgtgactcaagacaattgacttccacctgaaccctcagctccgaacgccttgcattagaagctagagctttggaggttctgaggacggtccctggggagcaagtggtaggtttcgaggcgcccgcttcccctctgattcctgcagtaactgagagagagtgtgccagaaatggctttgctgccgaatgcattatcttgccattttcgtgtcccaatactgaacaaacgatcgcctgatcgatcgg

SEQ ID NO: 68278 - DNA, 30 bp, Homo sapiens
  misc_feature 1..30: note = chr1:190448036-190448066
  misc_feature 1..30: note = hyper
  source 1..30: mol_type = genomic DNA
ccctccccatgggttcgctctcagagctgg

SEQ ID NO: 68279 - DNA, 30 bp, Homo sapiens
  misc_feature 1..30: note = chr1:1905791-1905821
  misc_feature 1..30: note = hypo
  source 1..30: mol_type = genomic DNA
ccagacactgaggcccgccctgcctgcctc

SEQ ID NO: 68280 - DNA, 242 bp, Homo sapiens
  misc_feature 1..242: note = chr1:19075291-19075533
  misc_feature 1..242: note = hypo
  source 1..242: mol_type = genomic DNA
cctgctgcttgtaagcgcttcctctgtaactcaggcgtaactgttatacattaaaagaaattaaaagcattttgaaggtttcgtgtactcaattgattgtcattatgcagctgctccaaaagggactctgaggggtgtccaagaagcctttggacctaatttagaggatcagcgtagaaactgtgtttctcttgctccccactgggtcctctagtgccaagcagctgcgaggtttctagtga

SEQ ID NO: 68281 - DNA, 44 bp, Homo sapiens
  misc_feature 1..44: note = chr1:1910323-1910367
  misc_feature 1..44: note = hypo
  source 1..44: mol_type = genomic DNA
acaaagcctcttcttcgtgctgagctgggcgtgggaaggcatca

SEQ ID NO: 68282 - DNA, 30 bp, Homo sapiens
  misc_feature 1..30: note = chr1:19119663-19119693
  misc_feature 1..30: note = hypo
  source 1..30: mol_type = genomic DNA
ggctgcccaagcctccgcctggccctgcac

SEQ ID NO: 68283 - DNA, 34 bp, Homo sapiens
  misc_feature 1..34: note = chr1:191390212-191390246
  misc_feature 1..34: note = hypo
  source 1..34: mol_type = genomic DNA
aaagttagagaatgtcggccgggcacggtggctc

SEQ ID NO: 68284 - DNA, 30 bp, Homo sapiens
  misc_feature 1..30: note = chr1:1914161-1914191
  misc_feature 1..30: note = hypo
  source 1..30: mol_type = genomic DNA
gctcggggccgcctgcgggtagggatgggg

SEQ ID NO: 68285 - DNA, 558 bp, Homo sapiens
  misc_feature 1..558: note = chr1:1914559-1915117
  misc_feature 1..558: note = hypo
  source 1..558: mol_type = genomic DNA
cacggagagcgatcacggagggggaacgctcccctaacggtggaaagccaactaataggaagggatggtgcaactggaaactcaccccttagaagccatcacagcaggaatgaattctggcaagaaacacggagggatgccagcgctcgtgtgaaaggggacacggagcgggatttcccagcctcaaagcttctgcccacaagctacgcatcagtttccaagggaacggtgtcgctgcactgaagaagccagcggccccacagtggggctggcagccatcacgtgtcccatgagaggacacccgagggactggtcatcacccccaggggcatcgagcacgggcgctgtgcgggacagcccctggcctgcaatcctcagaaccgcaacgtccgcctgtcacagaagaaccgaggctccttctgactgggggaggcgaggggccaccctcgacacaacgccacatgggcttcaggcacggctctgggatgcggggccgaggggcacagggggtcttgctgccattctgcagctcttctgtaagttcggaattgtttcaaa

SEQ ID NO: 68286 - DNA, 30 bp, Homo sapiens
  misc_feature 1..30: note = chr1:19147954-19147984
  misc_feature 1..30: note = hypo
  source 1..30: mol_type = genomic DNA
gagaagggctgtggacggagatagggaggc

SEQ ID NO: 68287 - DNA, 30 bp, Homo sapiens; identical to SEQ ID NO: 39183
  misc_feature 1..30: note = chr1:191565747-191565777
  misc_feature 1..30: note = hypo
  source 1..30: mol_type = genomic DNA

SEQ ID NO: 68288 - DNA, 155 bp, Homo sapiens
  misc_feature 1..155: note = chr1:191763145-191763300
  misc_feature 1..155: note = hypo
  source 1..155: mol_type = genomic DNA
cttactttttaatttttttgtttgtttgttttaactctccaaagtgacaatggaaacttctacttttctaaaaaaaaattaaggatatgctcccaactccgcattttggctcttgctttttgatataagatagatattctcgcattttgcagtac

SEQ ID NO: 68289 - DNA, 30 bp, Homo sapiens
  misc_feature 1..30: note = chr1:19204137-19204167
  misc_feature 1..30: note = hypo
  source 1..30: mol_type = genomic DNA
aggagctggctcccccggttgcccaggggc

SEQ ID NO: 68290 - DNA, 124 bp, Homo sapiens
  misc_feature 1..124: note = chr1:19213653-19213777
  misc_feature 1..124: note = hypo
  source 1..124: mol_type = genomic DNA
ggtgttggtccaaaccgcaccattttgtcagctccccgctattttgcagacctcgggccaagtgaaacatttcacaggagctcaggccatgagaaccatccggctcagccgcctgaccgcaagg

SEQ ID NO: 68291 - DNA, 38 bp, Homo sapiens
  misc_feature 1..38: note = chr1:192175514-192175552
  misc_feature 1..38: note = hypo
  source 1..38: mol_type = genomic DNA
tcctgacctcatgatcagcccgccgcagcctcccaaag

SEQ ID NO: 68292 - DNA, 142 bp, Homo sapiens
  misc_feature 1..142: note = chr1:1935065-1935207
  misc_feature 1..142: note = hyper
  source 1..142: mol_type = genomic DNA
gttctgcctggggggcgggggtcaaacccttccagctcagccccagggtcaaacgcatccgcccccacacccacctctggctggcctgggtcccaggttctcgggctccggaggcacagacaccccgggctgctcaggcagg

SEQ ID NO: 68293 - DNA, 58 bp, Homo sapiens
  misc_feature 1..58: note = chr1:1935231-1935289
  misc_feature 1..58: note = hyper
  source 1..58: mol_type = genomic DNA
cgcggcgccggcggcgtggtttggggcgggcagctccatggcaacggaagactccatc

SEQ ID NO: 68294 - DNA, 280 bp, Homo sapiens
  misc_feature 1..280: note = chr1:1935290-1935570
  misc_feature 1..280: note = hyper
  source 1..280: mol_type = genomic DNA
tggccggagggggagcctcgcccgttctgctccccggctggagcgggtggtttggtccgacccaccaccgaccgcgcgggccggggccggggcaaggaggtcgcgggccccgaggcgcggctgaagggccaggccacaggccgcggggcggggacgtctccggggtcccagacagccaggcctggcccagggccaaggcttggaggtgacagacagacttggggggcctggaggagctcagcaccggcgcgttggcccagaggaccggggcgggtgcatg

SEQ ID NO: 68295 - DNA, 188 bp, Homo sapiens
  misc_feature 1..188: note = chr1:193668360-193668548
  misc_feature 1..188: note = hypo
  source 1..188: mol_type = genomic DNA
tgcttctgaaacagtcgtgcacaagcagcttagtgcacctgtgctaaaaaccaatggaaggcattccttttcggagactcaaatataactaaacatctagcttcattctctcaaaatgagtgtaactaattagaatagcaaaaacgttactttttattacaagactgtgttaacgcagttgctttagt

SEQ ID NO: 68296 - DNA, 126 bp, Homo sapiens
  misc_feature 1..126: note = chr1:194532864-194532990
  misc_feature 1..126: note = hypo
  source 1..126: mol_type = genomic DNA
tataacattccaaaccgactaagacagattaatacttcaagtacaatacaatcaacatcagcatttaatctgatgaagacattttctgagaggtcttccttagcttcaccacgcataattgtgatt

SEQ ID NO: 68297 - DNA, 37 bp, Homo sapiens
  misc_feature 1..37: note = chr1:194626743-194626780
  misc_feature 1..37: note = hypo
  source 1..37: mol_type = genomic DNA
ctaactttagtctggcgcggtggctcactcctgtaat

SEQ ID NO: 68298 - DNA, 84 bp, Homo sapiens
  misc_feature 1..84: note = chr1:194827966-194828050
  misc_feature 1..84: note = hypo
  source 1..84: mol_type = genomic DNA
gaattcttactatgtcgggtgccggtggctcacgtctgcaatcccagtgagaggtgacagcatgctggcagtcctcacagccct

SEQ ID NO: 68299 - DNA, 981 bp, Homo sapiens
  misc_feature 1..981: note = chr1:1950396-1951377
  misc_feature 1..981: note = hyper
  source 1..981: mol_type = genomic DNA
cccctccccacccaccgccggcgcagccagaagcagccacgcagacgtgcgaccccccacaaaccgcctcgggacgaggttctgccgcgcccgtgggccacagtgtccacgcggggcttgtgccggtgtcgcctcccatgaagacacccggagggtcccgtctgcggcgcgtgagggcagcggtcccggagagccagaccccggccagggagagctgcccgcgagggagggggcgcggctggcggaggggggcgggatggggcggggggcggggggaggagaggggagcggcgggcggggccgggctgcagggagcggcgggctggggcgggctcggggcgggctccgcgctccgtccgccccctcgcgcccgcgccgcgctcgctcagctcccgcccgcctgtgccgcctgtgcggccgccgggagccaagtttgcgcggaccccgtcccgagcccgccgcggccatggacgcgcccgcccggctgctggccccgctcctgctcctctgcgcgcagcagctccgcggcaccaggtgagcgggcggggtccgcgcggcgcggggtcgggggcggtggggggcccgcgtcggcccgagatagcggctgggagagcggccggcgcgagccccgggccccggaccccaagtctgagagccccgcgtcctccctccccggggtcttgccccgcgggcccctcgttggactcgcccggacgctgcccttgggctcgggacgcggcgacccccgcgctggccgcccccgcccggtgctgtccgccgtcctggtgctgaacctgggctgggcgagggcgtcggagcctcccggttcccctgctccgcggcgcgcgtggagggtccccgggtccgcggcactcgcgggtccctgcccggcgggtgccttgaggagaggaaagacctgagaactcggtgcggggaggctgctccctttgcgggggagccgttccccgttcccccagtgag

SEQ ID NO: 68300 - DNA, 30 bp, Homo sapiens
  misc_feature 1..30: note = chr1:1953110-1953140
  misc_feature 1..30: note = hypo
  source 1..30: mol_type = genomic DNA
ggctgccggcacctccgtctccctggagaa

SEQ ID NO: 68301 - DNA, 217 bp, Homo sapiens; identical to SEQ ID NO: 39185
  misc_feature 1..217: note = chr1:195732322-195732539
  misc_feature 1..217: note = hypo
  source 1..217: mol_type = genomic DNA

SEQ ID NO: 68302 - DNA, 30 bp, Homo sapiens
  misc_feature 1..30: note = chr1:1960572-1960602
  misc_feature 1..30: note = hypo
  source 1..30: mol_type = genomic DNA
ctgcacttccacctgcggaggaaccgcggc

SEQ ID NO: 68303 - DNA, 74 bp, Homo sapiens
  misc_feature 1..74: note = chr1:1961524-1961598
  misc_feature 1..74: note = hypo
  source 1..74: mol_type = genomic DNA
tgggctcctacaggtcggtgggggtggagacaggggagacgaagaaggagggggcagcccgctcaggaggccag

SEQ ID NO: 68304 - DNA, 64 bp, Homo sapiens; identical to SEQ ID NO: 26773
  misc_feature 1..64: note = chr1:196577371-196577435
  misc_feature 1..64: note = hyper
  source 1..64: mol_type = genomic DNA

SEQ ID NO: 68305 - DNA, 680 bp, Homo sapiens
  misc_feature 1..680: note = chr1:196577707-196578387
  misc_feature 1..680: note = hyper
  source 1..680: mol_type = genomic DNA
acgctgccaaggaaccgcccccaggctcggcaccgcctctggtccccaggactagggggaggcgggtataaaaagttacttcgccgaaaaagacgcgcggtgcctagaaagaggggagaggggtgggagtgagcgccgcttgatggtgaagcactttccttaaaggcagttgccagatcctcccagagggcagcctcccggctactgttccctcgggcgggcttgcatccggcacagccctgagctggcgggaatcgggggcggtgggtttcggccccagacgcggccaacccggctctccccgcaatctccctgtggagatggagctggaggcccagccaatgagactccccctcattagcatagcacagtgacggcacgggggtgccttggggacaaccaatgggggcgagctaattagcggattgcggggctccagacccttctctgggaggaggggggccagggtgcttggagtgttccactatgccacgagctccctcgctttgattgccttcagtccaggtgggcgggatgaaaaaattgcacgtttctggaaagggaatccccactctcagccccaggaaaatcccatttttttctcacattctgaaagaagggaggtgtttccctgaactcggggaaaaagaagggccaccttaggccgctgaagagaagca

SEQ ID NO: 68306 - DNA, 103 bp, Homo sapiens; identical to SEQ ID NO: 38875
  misc_feature 1..103: note = chr1:19676719-19676822
  misc_feature 1..103: note = hypo
  source 1..103: mol_type = genomic DNA

SEQ ID NO: 68307 - DNA, 53 bp, Homo sapiens
  misc_feature 1..53: note = chr1:19683185-19683238
  misc_feature 1..53: note = hypo
  source 1..53: mol_type = genomic DNA
cagccacagcatcaccgtggaggtcaacttgtaatgggcggtgcgaccgctgg

SEQ ID NO: 68308 - DNA, 30 bp, Homo sapiens
  misc_feature 1..30: note = chr1:197091622-197091652
  misc_feature 1..30: note = hypo
  source 1..30: mol_type = genomic DNA
tacgctgacatatagcgtcaaatggcacat

SEQ ID NO: 68309 - DNA, 30 bp, Homo sapiens
  misc_feature 1..30: note = chr1:19739205-19739235
  misc_feature 1..30: note = hypo
  source 1..30: mol_type = genomic DNA
ggaaagaatgagaagcgccaaggcacaagt

SEQ ID NO: 68310 - DNA, 74 bp, Homo sapiens
  misc_feature 1..74: note = chr1:1974645-1974719
  misc_feature 1..74: note = hypo
  source 1..74: mol_type = genomic DNA
cattgccatggtgaccgtggttctggtgctgcctcctcagacgcaccagcctcgcgccgcgtctgaaataaccc

SEQ ID NO: 68311 - DNA, 30 bp, Homo sapiens; identical to SEQ ID NO: 39186
  misc_feature 1..30: note = chr1:197771436-197771466
  misc_feature 1..30: note = hypo
  source 1..30: mol_type = genomic DNA

SEQ ID NO: 68312 - DNA, 146 bp, Homo sapiens
  misc_feature 1..146: note = chr1:197879400-197879546
  misc_feature 1..146: note = hyper
  source 1..146: mol_type = genomic DNA
aaacgcacagattcacggctttccttcctgacactgcaggcataaaagacagtgttaaccaaagaatcatggactctagaggaattggaagatccttaacgaccacatcctcctagcagaaatttgtattctaaagtgtgagcttt

SEQ ID NO: 68313 - DNA, 55 bp, Homo sapiens
  misc_feature 1..55: note = chr1:197879606-197879661
  misc_feature 1..55: note = hyper
  source 1..55: mol_type = genomic DNA
atgcatgtcgttaccaaatacctagaacggtattggaccgcaaagaggttaaacc

SEQ ID NO: 68314 - DNA, 1355 bp, Homo sapiens; identical to SEQ ID NO: 26776
  misc_feature 1..1355: note = chr1:197879716-197881071
  misc_feature 1..1355: note = hyper
  source 1..1355: mol_type = genomic DNA

SEQ ID NO: 68315 - DNA, 192 bp, Homo sapiens; identical to SEQ ID NO: 26777
  misc_feature 1..192: note = chr1:197881412-197881604
  misc_feature 1..192: note = hyper
  source 1..192: mol_type = genomic DNA

SEQ ID NO: 68316 - DNA, 156 bp, Homo sapiens
  misc_feature 1..156: note = chr1:197882052-197882208
  misc_feature 1..156: note = hyper
  source 1..156: mol_type = genomic DNA
ggatggaaggggggccgagaagacactgtttctcacacgtgtaggggttaactggaaactggcttcacccacatttttttgttgttgttcagtcctaacccagcgcagccgtttctgcgcctgatctcagcggacgcagtgcgggacttctccctt

SEQ ID NO: 68317 - DNA, 67 bp, Homo sapiens
  misc_feature 1..67: note = chr1:197882427-197882494
  misc_feature 1..67: note = hyper
  source 1..67: mol_type = genomic DNA
ttggccgggaagtaccgcccagcgaaaggctggcaagggtgcgcagctggagcgtggcctcgggtac

SEQ ID NO: 68318 - DNA, 279 bp, Homo sapiens
  misc_feature 1..279: note = chr1:197885015-197885294
  misc_feature 1..279: note = hyper
  source 1..279: mol_type = genomic DNA
ccctggcttttctcccgtcatctttctagctttggccacagttcccggtcgggctcccccgggcggagggaagcgggtctgcggccgggcggctcttgtgaggtatctaggatgtgccaggacacaggcaccgcagtcctgggaaaggcggcgggaagtagtggggaacgcaggctgacgaaggggacggaaggaacagagagcggccggcgcgtcctcctctctgggtaaagccgcgttggttcctgccgcagcgctgtgcttcggactcctaggggg

SEQ ID NO: 68319 - DNA, 30 bp, Homo sapiens
  misc_feature 1..30: note = chr1:197885683-197885713
  misc_feature 1..30: note = hyper
  source 1..30: mol_type = genomic DNA
gggaagagaataagccgccctatggccaag

SEQ ID NO: 68320 - DNA, 21 bp, Homo sapiens
  misc_feature 1..21: note = chr1:197886252-197886273
  misc_feature 1..21: note = hyper
  source 1..21: mol_type = genomic DNA
cgcgcgcgtgtgtgtgttttg

SEQ ID NO: 68321 - DNA, 216 bp, Homo sapiens; identical to SEQ ID NO: 26781
  misc_feature 1..216: note = chr1:197886851-197887067
  misc_feature 1..216: note = hyper
  source 1..216: mol_type = genomic DNA

SEQ ID NO: 68322 - DNA, 311 bp, Homo sapiens; identical to SEQ ID NO: 110
  misc_feature 1..311: note = chr1:197887146-197887457
  misc_feature 1..311: note = hyper
  source 1..311: mol_type = genomic DNA

SEQ ID NO: 68323 - DNA, 416 bp, Homo sapiens; identical to SEQ ID NO: 111
  misc_feature 1..416: note = chr1:197887706-197888122
  misc_feature 1..416: note = hyper
  source 1..416: mol_type = genomic DNA

SEQ ID NO: 68324 - DNA, 60 bp, Homo sapiens; identical to SEQ ID NO: 26784
  misc_feature 1..60: note = chr1:197888180-197888240
  misc_feature 1..60: note = hyper
  source 1..60: mol_type = genomic DNA

SEQ ID NO: 68325 - DNA, 30 bp, Homo sapiens
  misc_feature 1..30: note = chr1:197888441-197888471
  misc_feature 1..30: note = hyper
  source 1..30: mol_type = genomic DNA
ggggactgtatacagcgggctggacagcgg

SEQ ID NO: 68326 - DNA, 975 bp, Homo sapiens
  misc_feature 1..975: note = chr1:197888681-197889656
  misc_feature 1..975: note = hyper
  source 1..975: mol_type = genomic DNA
aaaataacctgtgctcgttgaaatttccttttcactcccttatcatttccgttgttttattttgtgtgcgtcgaaaaccacaatttttagcttgtaattatttgaattcggaaacgatcaccaaactgtagtcaatattttcctagtcctttttaagcgaggctccggatggctgggatgtctttaggttagtagtcccgggaggacgcgaacgccggttcaggcagacacggaagaaagcaagcgggccgcaaagagagaaatcacaaatgtttcccctgacttttgcctttgtgcagtggaccctggcccctgccgctctccctgcacaccctgggcttggtctgcctgggggagaaccccgcgtcgtgcggctacaccgcgcgccctcctcagccttgcggtgtgctttctttgcagggcatgcccccgctcagcccggagaagcccgccctgtgcgccggctgcgggggcaagatctcggacaggtactatctgctggctgtggacaaacagtggcatctgagatgcctgaagtgctgtgaatgtaagctggccctcgagtccgagctcacctgctttgccaaggacggtagcatttactgcaaggaggattactacaggtactcccctacacccccacttcctacgcccgagtacacctggaggggccatctgcctgagcccggaatcccctctccgtcccctaccttttgccccattccgggtgctgttatcatttcggagaccaggcaaacccactgcatatgccttcaagctgtaatctccctgaccgacggtgagggtgggtgggagggacattaaaaatctagagctttatcagcgaataccacgcactcccatcacttctcagcttggctggcggaacttggggaaatctggggaagagtaaatggacgtggtctccgtctaccgagacttgattgggtgtttgttttccgcttgctacgaatt

SEQ ID NO: 68327 - DNA, 288 bp, Homo sapiens
  misc_feature 1..288: note = chr1:197890549-197890837
  misc_feature 1..288: note = hyper
  source 1..288: mol_type = genomic DNA
acaagactctgaccacgggcgaccatttcggcatgaaggacagcctggtgtactgccgcgcccacttcgagaccctcttgcaaggagagtatccaccgcagctgagctacacggagctggcggccaagagcggcggcctggccctgccttacttcaacggtacgggcaccgtgcagaaagggcggccccggaagcggaagagcccagcgctgggagtggacatcgtcaattacaactcaggtgtgcctcctatcctcacccccggcgcagccccggcctccctgagga

SEQ ID NO: 68328 - DNA, 205 bp, Homo sapiens
  misc_feature 1..205: note = chr1:198097470-198097675
  misc_feature 1..205: note = hypo
  source 1..205: mol_type = genomic DNA
gctcaaaactactctcgtattttcagactgaactagtggttatattcatgaacttacaagtccttcagttatctgagtgatcttgtaaaagtagcttacctttctagttctgccttttttccttattcaaaaaataagttatgttgggggagcgtttatttaatatttaatcaggtgaccattatttgttcggcaatatgaagta

SEQ ID NO: 68329 - DNA, 150 bp, Homo sapiens
  misc_feature 1..150: note = chr1:198124631-198124781
  misc_feature 1..150: note = hypo
  source 1..150: mol_type = genomic DNA
aggcactgtatatctcggtgagctgttgtatcctcattccttagaacattgcctagcccatttatgaatatttgttgagccacatgaatcaaggcctccttttgagatcgtgaacgttttcatttatttatttatttttttgagacggat

SEQ ID NO: 68330 - DNA, 222 bp, Homo sapiens
  misc_feature 1..222: note = chr1:198181340-198181562
  misc_feature 1..222: note = hypo
  source 1..222: mol_type = genomic DNA
taaccgatgagcaaacgaaaggtgtgctgtagccacaggtgcaggagctggatgcccctgtgtcacaggtgttggaccaggagagtcatcgcctgaaagccaaagggcatatggcctgggggcagttttgtgttctgagcacaggctgcctggaattcagctagccgctgttagcaaaacactgcgggtgtgagacctgccttgccacgtacctgggagcag

SEQ ID NO: 68331 - DNA, 116 bp, Homo sapiens
  misc_feature 1..116: note = chr1:1982311-1982427
  misc_feature 1..116: note = hyper
  source 1..116: mol_type = genomic DNA
acacgtcgtggacagcgcgggctccttccccgggaccgggtttccctggggtcggccccgcgccgcgagctcctcggcccggtcattgtggtagacgttttcgctggaaagttggg

SEQ ID NO: 68332 - DNA, 157 bp, Homo sapiens
  misc_feature 1..157: note = chr1:1986234-1986391
  misc_feature 1..157: note = hypo
  source 1..157: mol_type = genomic DNA
ttgggtgaacttgaacgagtgcccgaccaggtaacgttgccggacctcccacaagagggcactttcttttctcccattttgtcctcattctttccagccaggtaggtcgcgcttttttctctgtgcaaggaagttgatggtggtcattttttttttt

SEQ ID NO: 68333 - DNA, 16 bp, Homo sapiens
  misc_feature 1..16: note = chr1:198918249-198918265
  misc_feature 1..16: note = hypo
  source 1..16: mol_type = genomic DNA
ggcctgggcggaggcc

SEQ ID NO: 68334 - DNA, 17 bp, Homo sapiens
  misc_feature 1..17: note = chr1:198918546-198918563
  misc_feature 1..17: note = hypo
  source 1..17: mol_type = genomic DNA
tgcgcagaggctactgg

SEQ ID NO: 68335 - DNA, 205 bp, Homo sapiens
  misc_feature 1..205: note = chr1:199249992-199250197
  misc_feature 1..205: note = hypo
  source 1..205: mol_type = genomic DNA
gaaccagtaacagcacgaatagattacaattcattattttctagtcatcaggtttcacatttttgtaggttagattctaagtatatgtgtgctctttttaatttgttgtttcgtctagtattctctctaatcctgacttgttggcagacacatttggggaaaaaaaattgttgatcgtattctgtctcagcgagaccatttggag

SEQ ID NO: 68336 - DNA, 30 bp, Homo sapiens
  misc_feature 1..30: note = chr1:199360890-199360920
  misc_feature 1..30: note = hypo
  source 1..30: mol_type = genomic DNA
aatggaaatgcataacgcagtctccctccc

SEQ ID NO: 68337 - DNA, 36 bp, Homo sapiens
  misc_feature 1..36: note = chr1:199842536-199842572
  misc_feature 1..36: note = hypo
  source 1..36: mol_type = genomic DNA
ccacagggctgggcacggtggctcacgcctatattc

SEQ ID NO: 68338 - DNA, 240 bp, Homo sapiens; identical to SEQ ID NO: 26787
  misc_feature 1..240: note = chr1:199998199-199998439
  misc_feature 1..240: note = hyper
  source 1..240: mol_type = genomic DNA

SEQ ID NO: 68339 - DNA, 56 bp, Homo sapiens
  misc_feature 1..56: note = chr1:199998732-199998788
  misc_feature 1..56: note = hyper
  source 1..56: mol_type = genomic DNA
cctcaagaaaagtaccgaagaaggctctcccctggcctcagcgagactaccccaac

SEQ ID NO: 68340 - DNA, 176 bp, Homo sapiens
  misc_feature 1..176: note = chr1:200008515-200008691
  misc_feature 1..176: note = hyper
  source 1..176: mol_type = genomic DNA
cctcgccaccgccgccgcctgcgcccttgcggagccgaaccagagggccgggacgctgtcttcctcgcctccttttttaaccctgacctcctcctcgcagcttgggggcggctccggagctgcgagaccggacagggctcagaggtcctgcccggcagccccgaggaggcggaggc

SEQ ID NO: 68341 - DNA, 38 bp, Homo sapiens
  misc_feature 1..38: note = chr1:200009412-200009450
  misc_feature 1..38: note = hyper
  source 1..38: mol_type = genomic DNA
caccaaaagcccaggcggacacccgcagccagctcgga

SEQ ID NO: 68342 - DNA, 427 bp, Homo sapiens
  misc_feature 1..427: note = chr1:200009750-200010177
  misc_feature 1..427: note = hyper
  source 1..427: mol_type = genomic DNA
gctaggaaaagtcaccggtgctcttccatcctcgccccttccagggtgcaggatgtgcgggccggcgggcctgtgatcccggaacgcttcctgccatccccttgcgcgaacttgaaaggactgggaggtgttgagagcagagttcagggctggtgcactctgcggtgctgagtgggcggcgcgcccgggcgctcaggccgggggacctgtagtcgccctaccgcggaggggaaaatacgtagctggagggcgtgcgccgtgcgggttgtgatccgttaccccatcggtcatcctggggtctccccaagcctctaggtagggctgtgagagtcccctagagctgaagccccggaggctgacctgtgggtctggctgctatgggaacccggttggtccaaagaagcctttcttccgggcacctggaatt

SEQ ID NO: 68343 - DNA, 427 bp, Homo sapiens
  misc_feature 1..427: note = chr1:200011257-200011684
  misc_feature 1..427: note = hyper
  source 1..427: mol_type = genomic DNA
ccgctgggaggacctcgcctagcatccctttattaatatttcacgaaggcaggctcctgccttctctggagcctcttttctcggaatgttcccaaactctggctaactcactcccctgtgagccatcctagggctctgtggcccgggaagagacgcgtcaactccgcgggtctgcgcgcagtccttagccgcaaagtgctgcaagtgacccccctgacggccctttccgaccgaagagctcgggaaccaaagagaaaaaaaataactttattttcaaaagaacaagtcatcactgcggcgatactgtggcggaggactttggcgatggggtgggggctatttctctttcctttttggtaaacaaatcagaggaaacttctgcccggccgtggctttccatcccccacctgccccaccccctgcaaac

SEQ ID NO: 68344 - DNA, 419 bp, Homo sapiens; identical to SEQ ID NO: 26792
  misc_feature 1..419: note = chr1:200011685-200012104
  misc_feature 1..419: note = hyper
  source 1..419: mol_type = genomic DNA

SEQ ID NO: 68345 - DNA, 30 bp, Homo sapiens
  misc_feature 1..30: note = chr1:200183084-200183114
  misc_feature 1..30: note = hypo
  source 1..30: mol_type = genomic DNA
atgctgagagttctgcgcttccaggtctcc

SEQ ID NO: 68346 - DNA, 160 bp, Homo sapiens; identical to SEQ ID NO: 39187
  misc_feature 1..160: note = chr1:200505065-200505225
  misc_feature 1..160: note = hypo
  source 1..160: mol_type = genomic DNA

SEQ ID NO: 68347 - DNA, 33 bp, Homo sapiens
  misc_feature 1..33: note = chr1:200519383-200519416
  misc_feature 1..33: note = hypo
  source 1..33: mol_type = genomic DNA
tttagaggtctttggcatcgagaaaatataatg

SEQ ID NO: 68348 - DNA, 18 bp, Homo sapiens
  misc_feature 1..18: note = chr1:200588770-200588788
  misc_feature 1..18: note = hypo
  source 1..18: mol_type = genomic DNA
gtccggcccatgtatgtt

SEQ ID NO: 68349 - DNA, 335 bp, Homo sapiens
  misc_feature 1..335: note = chr1:200860242-200860577
  misc_feature 1..335: note = hyper
  source 1..335: mol_type = genomic DNA
cagcgagggggagggcgcctgcggggaggacagggtcgggggagcgcccttccgcaggctcctttcattcttccacttaggggtctccaggaatgaaaactggccccagccaggccagagcgcgcgaatgaaaggcggcactgggaccaagagagaagcttcgtcccgcctgggctgcggaaactggcggcgccaggggtgtcccaccgcgcgggcgtccgaaagcggggcaaaggggacagcctcgcccctcgagcggctgctcccgcagctcgctcacccctgcgggtacgtcgtcactcccgcgtgcggccccgtcccgactcttggatcgg

SEQ ID NO: 68350 - DNA, 77 bp, Homo sapiens
  misc_feature 1..77: note = chr1:200864028-200864105
  misc_feature 1..77: note = hypo
  source 1..77: mol_type = genomic DNA
gcagcctgggagggacggcaaggtaggcaggtgagccgagacggacggacggccagcagctccgtcagctggagaga

SEQ ID NO: 68351 - DNA, 33 bp, Homo sapiens
  misc_feature 1..33: note = chr1:200870109-200870142
  misc_feature 1..33: note = hypo
  source 1..33: mol_type = genomic DNA
atcacagaggcagcccgtcggctgtgcctggag

SEQ ID NO: 68352 - DNA, 49 bp, Homo sapiens; identical to SEQ ID NO: 39190
  misc_feature 1..49: note = chr1:200941620-200941669
  misc_feature 1..49: note = hypo
  source 1..49: mol_type = genomic DNA

SEQ ID NO: 68353 - skipped

SEQ ID NO: 68354 - DNA, 184 bp, Homo sapiens
  misc_feature 1..184: note = chr1:201244242-201244426
  misc_feature 1..184: note = hypo
  source 1..184: mol_type = genomic DNA
gtcagagggagactccgaccctttgggagcagcctgaagcccagggccttactgaacacagatggggcaggtgcccggtcctttgcttgttattggcgatcctaataagaaggcacctggcagaggctttccgcaggaggccccggccatagaaatggggtaatgcagacgggaggctctgcca

SEQ ID NO: 68355 - DNA, 322 bp, Homo sapiens
  misc_feature 1..322: note = chr1:201252494-201252816
  misc_feature 1..322: note = hyper
  source 1..322: mol_type = genomic DNA
ccctgcccccaagagcgctggctccgcagcagcagtgccctgcagctccgcgtctgagcagcagcagcgcgcggcccggtggagtgggtggtgcagggcaggggtggtatatcctgtctgacggagggcgggcctcgccagtgccagagagggacgaaccagggtggaagcgccaggagcagctgcagggagccctcacgcggaccacgcactctatggccgtagggagccgctgagagcgagaagagcacgctcctgcccgcccgctgcaccgcacctcgcctcgcctctctgctctcctaggccccggccgcgcgccacc

SEQ ID NO: 68356 - DNA, 28 bp, Homo sapiens
  misc_feature 1..28: note = chr1:20127443-20127471
  misc_feature 1..28: note = hypo
  source 1..28: mol_type = genomic DNA
gcgtgagccaccgcgcagccccaactag

SEQ ID NO: 68357 - DNA, 177 bp, Homo sapiens; identical to SEQ ID NO: 38728
  misc_feature 1..177: note = chr1:2013405-2013582
  misc_feature 1..177: note = hypo
  source 1..177: mol_type = genomic DNA

SEQ ID NO: 68358 - DNA, 46 bp, Homo sapiens
  misc_feature 1..46: note = chr1:201368848-201368894
  misc_feature 1..46: note = hyper
  source 1..46: mol_type = genomic DNA
cccctgccgggaacccgacttagcccggagacgctcaagagcaaga

SEQ ID NO: 68359 - DNA, 55 bp, Homo sapiens
  misc_feature 1..55: note = chr1:201383691-201383746
  misc_feature 1..55: note = hypo
  source 1..55: mol_type = genomic DNA
cgctctgccaggtagcgcaccttctcagcctcgcgctcctcgtgctcctgctccc

SEQ ID NO: 68360 - DNA, 30 bp, Homo sapiens
  misc_feature 1..30: note = chr1:2013995-2014025
  misc_feature 1..30: note = hypo
  source 1..30: mol_type = genomic DNA
gatttgtcactcagtcgatttccctggtgt

SEQ ID NO: 68361 - DNA, 51 bp, Homo sapiens
  misc_feature 1..51: note = chr1:201437613-201437664
  misc_feature 1..51: note = hyper
  source 1..51: mol_type = genomic DNA
ctagggtgatctgggcgttccagccgggatcttccagggggcagcggaagt

SEQ ID NO: 68362 - DNA, 123 bp, Homo sapiens
  misc_feature 1..123: note = chr1:201437682-201437805
  misc_feature 1..123: note = hyper
  source 1..123: mol_type = genomic DNA
cggtcaccagcgtgaagtagatgtggcgcccggtgctctccacgcactccacggccttgatgcgggcgaagctgagctccttgggccggccgcccgtgcccttggcctcgaagagctgcagcc

SEQ ID NO: 68363 - DNA, 73 bp, Homo sapiens; identical to SEQ ID NO: 26796
  misc_feature 1..73: note = chr1:201438552-201438625
  misc_feature 1..73: note = hyper
  source 1..73: mol_type = genomic DNA

SEQ ID NO: 68364 - DNA, 206 bp, Homo sapiens
  misc_feature 1..206: note = chr1:201445697-201445903
  misc_feature 1..206: note = hypo
  source 1..206: mol_type = genomic DNA
ttctcctgacctgctcgcaccgctttgatgtacagccctttgttccaggactttggggtttcctcggatctctgtttttctaaagggaaacagaaggaaaaaccctaccaaggtttcaagtctctgatgacttgggttttatgggcaccattgcgacagacttcaagtgggcagcaactctgcagccgacccgcccaggcttgctc

SEQ ID NO: 68365 - DNA, 91 bp, Homo sapiens
  misc_feature 1..91: note = chr1:201508375-201508466
  misc_feature 1..91: note = hyper
  source 1..91: mol_type = genomic DNA
gcgagaagcggaccccgcacccgcgctgcccttggggatgcgcgactctgcgcggctgcggcgcggacccggagcccgggcgggcaggcgc

SEQ ID NO: 68366 - DNA, 292 bp, Homo sapiens
  misc_feature 1..292: note = chr1:201508694-201508986
  misc_feature 1..292: note = hyper
  source 1..292: mol_type = genomic DNA
ctatgggactgactgcgcgtttgattctagagttgactctccgggggggctgcctaacttcagtccctctgagcctcagtttccttgttgtgaaatacccacaatttaaagtgcgttgagatcttatcatgagacaccaggtgctgcgttcttatactcgcacccacacggcaagcacacaccctacccgcacctctgcctttcgttgaagcaagagttaactcctcccatcccagcaggagccagaggaacagctggggcaggtgacctcgcgggccgttccagaaaacgt

SEQ ID NO: 68367 - DNA, 30 bp, Homo sapiens
  misc_feature 1..30: note = chr1:201583245-201583275
  misc_feature 1..30: note = hyper
  source 1..30: mol_type = genomic DNA
gtgctgtgcagtgtccgtatctcagtgcgt

SEQ ID NO: 68368 - DNA, 94 bp, Homo sapiens
  misc_feature 1..94: note = chr1:201797447-201797541
  misc_feature 1..94: note = hypo
  source 1..94: mol_type = genomic DNA
cactgcgcctcgccacaccctgcatttttaacacctcactggagcgctcatcctctccacctgctccgctattcaggagcggctctgcaccgta

SEQ ID NO: 68369 - DNA, 30 bp, Homo sapiens; identical to SEQ ID NO: 39194
  misc_feature 1..30: note = chr1:201851118-201851148
  misc_feature 1..30: note = hypo
  source 1..30: mol_type = genomic DNA

SEQ ID NO: 68370 - DNA, 76 bp, Homo sapiens
  misc_feature 1..76: note = chr1:201915663-201915739
  misc_feature 1..76: note = hyper
  source 1..76: mol_type = genomic DNA
agggctagtggaccccggctggtctaatcagcggccaataagacccgacaactgccaggcccggagaggagaagcc

SEQ ID NO: 68371 - DNA, 394 bp, Homo sapiens
  misc_feature 1..394: note = chr1:201977576-201977970
  misc_feature 1..394: note = hypo
  source 1..394: mol_type = genomic DNA
ggcccagtgcgggggcgggggggcggggggatcctggacattaactctctcctaggcacctgggagcttcagagaggaagaaggtaaggtaagaagcagattctctgcgcaggactttcttagtcctcaggctatagagttaaagaaagaagtatctgtagaaggtggagtcaccttttgtttgagtaaccgtttcacccaccctggctgagggtggccaggaactccccaagttgtgcattaatggaggggggtcacacagatcctacatttttttgtttttgtttttttttttttgagacgcagtgattacaggtgtgagccaccggatcctacatttcaaatgcataaaaatctagatatgggctgggcgcagtagctcatgcctgtaatc

SEQ ID NO: 68372 - DNA, 85 bp, Homo sapiens
  misc_feature 1..85: note = chr1:201981114-201981199
  misc_feature 1..85: note = hypo
  source 1..85: mol_type = genomic DNA
agttctggtcgaagacgcaggttctggactggatcagctaccaagtggagaagaacaagtacgacgcaagcgccattgacttctc

SEQ ID NO: 68373 - DNA, 204 bp, Homo sapiens
  misc_feature 1..204: note = chr1:201982388-201982592
  misc_feature 1..204: note = hypo
  source 1..204: mol_type = genomic DNA
gtactgggactgtctcgagggcaagaagagcaagcacggtgagctccgggggcacgtgggtcctccctgcgccgggctgagcggcttcctggggcactgcgggttgttgcaggtatcccttctcccgttttctctggcctccgcatggcctttggtaaggctgtgcacaagctgggggctctatggtatcggtcaccacctaat

SEQ ID NO: 68374 - DNA, 118 bp, Homo sapiens
  misc_feature 1..118: note = chr1:201983113-201983231
  misc_feature 1..118: note = hypo
  source 1..118: mol_type = genomic DNA
cagcaacatgacctacgagaagctgagccgggccatgaggtgagctggcggccaggaccctcacgatacagccggacatggggacaggcgctcacactcccaccgccctctttctggc

SEQ ID NO: 68375 - DNA, 98 bp, Homo sapiens; identical to SEQ ID NO: 39199
  misc_feature 1..98: note = chr1:201984047-201984145
  misc_feature 1..98: note = hypo
  source 1..98: mol_type = genomic DNA

SEQ ID NO: 68376 - DNA, 164 bp, Homo sapiens
  misc_feature 1..164: note = chr1:201986490-201986654
  misc_feature 1..164: note = hypo
  source 1..164: mol_type = genomic DNA
tagacaaaggggatgcgggccagggcgtaggtctagcctcagaagctggggaagctttcacagctacttagtctaaaaatgaccccatttcttggaaattatgcattagactctggtctagtttccctagccacaatatctcggggtccttgcacccttaaaag

SEQ ID NO: 68377 - DNA, 22 bp, Homo sapiens
  misc_feature 1..22: note = chr1:202025754-202025776
  misc_feature 1..22: note = hypo
  source 1..22: mol_type = genomic DNA
ttacaggcgtgagccaccacgc

SEQ ID NO: 68378 - DNA, 123 bp, Homo sapiens
  misc_feature 1..123: note = chr1:202042364-202042487
  misc_feature 1..123: note = hypo
  source 1..123: mol_type = genomic DNA
ttcagatgggttttacgcagtcattcaacaagcatttattgagtacctactgtgtgccaggcagtgaggacacaaagatgaaagagtcccagccctcaaagagctcgccgtctgagtggacat

SEQ ID NO: 68379 - DNA, 30 bp, Homo sapiens
  misc_feature 1..30: note = chr1:20205294-20205324
  misc_feature 1..30: note = hypo
  source 1..30: mol_type = genomic DNA
agtcaagaacctgaacgggccaactgccaa

SEQ ID NO: 68380 - DNA, 15 bp, Homo sapiens
  misc_feature 1..15: note = chr1:202081789-202081804
  misc_feature 1..15: note = hypo
  source 1..15: mol_type = genomic DNA
cgtctcaaaaaaaaa

SEQ ID NO: 68381 - DNA, 88 bp, Homo sapiens
  misc_feature 1..88: note = chr1:202101759-202101847
  misc_feature 1..88: note = hypo
  source 1..88: mol_type = genomic DNA
gggtgaaggagaggccgagggaggtggagcgggaggaggtggggcttactgtgaaactgggtcaagatggcctcggatttgagcaggc

SEQ ID NO: 68382 - DNA, 248 bp, Homo sapiens
  misc_feature 1..248: note = chr1:202183428-202183676
  misc_feature 1..248: note = hyper
  source 1..248: mol_type = genomic DNA
gcaggacccagaaaccgacgcgacgggtggggcgctacccgggccggccctaatccccttccattgttctgggagccgaggccgcctccccacttccggaccctttcagccatggagcgggcggcgcgggcaggggcgggcaggggcacggccaggcgggctggggtgggcaggggcgcgcgcgcgaggctggtccccgcccccggggccgccgcttagctcccgggtacgtgcgtgcagctaggggc

SEQ ID NO: 68383 - DNA, 30 bp, Homo sapiens
  misc_feature 1..30: note = chr1:202208039-202208069
  misc_feature 1..30: note = hypo
  source 1..30: mol_type = genomic DNA
ccccaacagctaacacgaagcggtgcgttt

SEQ ID NO: 68384 - DNA, 139 bp, Homo sapiens; identical to SEQ ID NO: 39203
  misc_feature 1..139: note = chr1:202311995-202312134
  misc_feature 1..139: note = hypo
  source 1..139: mol_type = genomic DNA

SEQ ID NO: 68385 - DNA, 30 bp, Homo sapiens
  misc_feature 1..30: note = chr1:20247063-20247093
  misc_feature 1..30: note = hypo
  source 1..30: mol_type = genomic DNA
tcccgggttgtttcacggatgggtgagaca

SEQ ID NO: 68386 - DNA, 278 bp, Homo sapiens
  misc_feature 1..278: note = chr1:202611761-202612039
  misc_feature 1..278: note = hyper
  source 1..278: mol_type = genomic DNA
catctcaaccctggacggctgcggcaaggcgggggcgctcagaaaggcagccagtcctgcaaaccgcccgtgcctccggcacacccccctctgcgccaggggctccccagtgtcgcgcgagcatggtcttccagctcctcctcagcgaggcaggcgctgcagggtcccatgcgccccgcacccacttctctccgcacgcccacttcatgcacctccccgcgcccttcccacggcttctctgcggcgagtcgccttcgcttcaccgcaggtccctggtc

SEQ ID NO: 68387 - DNA, 127 bp, Homo sapiens; identical to SEQ ID NO: 26799
  misc_feature 1..127: note = chr1:202613418-202613545
  misc_feature 1..127: note = hyper
  source 1..127: mol_type = genomic DNA

SEQ ID NO: 68388 - DNA, 216 bp, Homo sapiens
  misc_feature 1..216: note = chr1:202678665-202678881
  misc_feature 1..216: note = hyper
  source 1..216: mol_type = genomic DNA
cgggctgtcagcacccgccaggctgcgagcctagcccttggggacagagctgaagcagggacggggcgtcctaggtcgtgctgagtcatgagatttggagagaggggaggggcgcctccagccccttcttgggcccctgccccagctcctcgtgcccgttgcttccagatggcccctgcagtctgtctccccaacctctccctgacccagggtctc

SEQ ID NO: 68389 - DNA, 785 bp, Homo sapiens
  misc_feature 1..785: note = chr1:202678923-202679708
  misc_feature 1..785: note = hyper
  source 1..785: mol_type = genomic DNA
cgacggcggtgccaggggtccccgaagcttgagactggggcaaaagaaccttccttggagaccgctagggctggcgggggctgggctagacgcgagtgggttcgtcccagggaaaggagagagggacgggggcgcagagccggccggtgcaggggacgcgtggcccgcccctctctgcagcaacccgcgggaggaaatctgcccccagcccagccccagtccctcagaggagccggctcctcgcccctcgggtccgactccccgagacgaaccttccatccggacgcttccaaactcccccaaaggacggggcagactcccggcccccttggcctcaaacttccccaaccctactcacctctcgggacccagaccaccccgtggcccctcgactcagtagcaggaaaggagaaactttggagagggaggtccgtgcccccaccggcgggggtatggacttaccggagagcgacccgaaggaggcgggagagatccggggtctccaatgtgagggggcgtcggacggcaaggacgcgtggctggcgacggtttcgcaggggcgcccgttcccctgggggcgcgaagtccccgctccaccgctgccccaactcggctccgaagtgcctttgccgcaagacttgctgagcttagcagtctgcgccgaggcggcagagggagggggcctgatcgatgggcgcgcgcggcgagcgctgcagtgaggggaggagaccaagcggcgtgggagggcggggaccgaggcggaggaggcccggaggaggcggagg

SEQ ID NO: 68390 - DNA, 16 bp, Homo sapiens
  misc_feature 1..16: note = chr1:202829801-202829817
  misc_feature 1..16: note = hypo
  source 1..16: mol_type = genomic DNA
gcgcctggccagtcaa

SEQ ID NO: 68391 - DNA, 76 bp, Homo sapiens
  misc_feature 1..76: note = chr1:202840809-202840885
  misc_feature 1..76: note = hypo
  source 1..76: mol_type = genomic DNA
tacctggctttcaaacggcggaatttctttctttctttttaaattttattttgtttcatttttttgagactgagtc

SEQ ID NO: 68392 - DNA, 30 bp, Homo sapiens; identical to SEQ ID NO: 39204
  misc_feature 1..30: note = chr1:202856302-202856332
  misc_feature 1..30: note = hypo
  source 1..30: mol_type = genomic DNA

SEQ ID NO: 68393 - DNA, 97 bp, Homo sapiens
  misc_feature 1..97: note = chr1:202856952-202857049
  misc_feature 1..97: note = hypo
  source 1..97: mol_type = genomic DNA
atgatagtcaggactcaattccatgtatgtttcaattccaagatccatgttctttccactgactccataatgccactaacttcgtaaaattaattga

SEQ ID NO: 68394 - DNA, 30 bp, Homo sapiens
  misc_feature 1..30: note = chr1:202861824-202861854
  misc_feature 1..30: note = hypo
  source 1..30: mol_type = genomic DNA
ctgcgtgcagtggcacgtgcctgtaatccc

SEQ ID NO: 68395 - DNA, 30 bp, Homo sapiens
  misc_feature 1..30: note = chr1:202897655-202897685
  misc_feature 1..30: note = hypo
  source 1..30: mol_type = genomic DNA
cctcaaatttattcacgtccattgtccaca

SEQ ID NO: 68396 - DNA, 83 bp, Homo sapiens
  misc_feature 1..83: note = chr1:202898246-202898329
  misc_feature 1..83: note = hypo
  source 1..83: mol_type = genomic DNA
gcgcctagccctttgattcttaagggtactaaaaccatagccaagtgggtagcattctaaatttacaacgtgtccccatcttc

SEQ ID NO: 68397 - DNA, 155 bp, Homo sapiens
  misc_feature 1..155: note = chr1:202933730-202933885
  misc_feature 1..155: note = hypo
  source 1..155: mol_type = genomic DNA
gtaatgcacctgtcccgccggcaatcattcccagtttcttcgccactcggggttctggtggagatttcttgttgggctgaatgttaaaatgccctgagaggtcaggtgaagagagcagtggaagaataaagtcaatacagcgaacttagaaaaca

SEQ ID NO: 68398 - DNA, 30 bp, Homo sapiens
  misc_feature 1..30: note = chr1:202934371-202934401
  misc_feature 1..30: note = hypo
  source 1..30: mol_type = genomic DNA
gtttagaaggaagggcggccctggccctta

SEQ ID NO: 68399 - DNA, 149 bp, Homo sapiens
  misc_feature 1..149: note = chr1:202936921-202937070
  misc_feature 1..149: note = hyper
  source 1..149: mol_type = genomic DNA
ggcgtgagccatcgcgcccggccccaagatcttttaagaccgcagctccagcctctcctcccagcgaggtggtccctgccacttcgacccgcttatatccgaactggatgggagttctgcctaaggtagaaccacgctaaattggggga

SEQ ID NO: 68400 - DNA, 79 bp, Homo sapiens; identical to SEQ ID NO: 39207
  misc_feature 1..79: note = chr1:202995301-202995380
  misc_feature 1..79: note = hypo
  source 1..79: mol_type = genomic DNA

SEQ ID NO: 68401 - DNA, 394 bp, Homo sapiens
  misc_feature 1..394: note = chr1:202995837-202996231
  misc_feature 1..394: note = hyper
  source 1..394: mol_type = genomic DNA
tcgtctatcgcacctcgggaaacagccctttttgactccgtatgtgctacctccggcaggcgtcggtactgcttaccctgccgcccctcgccctcctttgcggtgccctgtgcccttgggggtgaggataggggcgatgcctgatctgcggggagggcgtggagtgcgccctctgctccatcggcttcaggggagggggccgagttggcgagtctcccggtgggaacggagcagactgcgcccccatttcccctccaggagagtcagaaaaagcgcctctcggctccggggccaaccccactcctttggggacgcgattctgatgggctgaggtcttcgctcttcgcgggggtcttaatctttcccgagttgctcatagcacccctgttcctgt

SEQ ID NO: 68402 - DNA, 15 bp, Homo sapiens
  misc_feature 1..15: note = chr1:202996304-202996319
  misc_feature 1..15: note = hyper
  source 1..15: mol_type = genomic DNA
cggtggggtggaagg

SEQ ID NO: 68403 - DNA, 262 bp, Homo sapiens
  misc_feature 1..262: note = chr1:203086936-203087198
  misc_feature 1..262: note = hyper
  source 1..262: mol_type = genomic DNA
tcagctgaagccttgcgcagtgctccgccaggcgctataatgctgagcccagctatggctcctccttcttctcccttccgcgggaacccagcacctagcgcggcggagcagggaactcaggctgcgggactggggtctggccctgcccagctcctcgcccacgcccaggcttccgttaggccagcagggggaccccgagccccggacaacagccctgagctgggcggctgcttctggctctagatcccgctgctcagccgat

SEQ ID NO: 68404 - DNA, 659 bp, Homo sapiens
  misc_feature 1..659: note = chr1:203096850-203097509
  misc_feature 1..659: note = hyper
  source 1..659: mol_type = genomic DNA
gtcactcagctcctgcgccgggggcgacagagccgcaggcgcccgagtcgagtcccagccagctaccatccctctggagcttaccggccggccttggcttccccaggaatccctggagctagcggctgctgaaggcgtcgaggtgtgggggcacttggacagaacagtcaggcagccgggagctctgccagctttggtgaccttgggtaagtctgagtctcggttcacccctggggctccccaatgggggtgcaggagagggttgaaagaagagaccggaatgcccccttggggcaggccatgggcaaggttccccgacagagctggaacgggaccagaggactgctaagatccaggcaccagacgggtctcaagtgggtgggcgcagggcaggtgcgggcacgctggggaatagggagaaacgccccagccttgtcctgggctccgtccccagacccacgtctgccaccccagtcccaggtgcgaaacaggggcgctacctctttaaaagcgtccggggctgagtctctgccgtaccatgtgattgcttgaaaggccgggctgggagcgctgcggcgggagccggaggactatgagctgccgcgcgttgtccagagcccagcccagccctaccgcgcgcggcccggagctctgttccc

SEQ ID NO: 68405 - DNA, 40 bp, Homo sapiens
  misc_feature 1..40: note = chr1:203236950-203236990
  misc_feature 1..40: note = hyper
  source 1..40: mol_type = genomic DNA
ttccagcccctgagccgtggcctgccgttctcttccccac

SEQ ID NO: 68406 - DNA, 30 bp, Homo sapiens; identical to SEQ ID NO: 39208
  misc_feature 1..30: note = chr1:203257678-203257708
  misc_feature 1..30: note = hypo
  source 1..30: mol_type = genomic DNA

SEQ ID NO: 68407 - DNA, 267 bp, Homo sapiens
  misc_feature 1..267: note = chr1:203298174-203298441
  misc_feature 1..267: note = hypo
  source 1..267: mol_type = genomic DNA
ggggcatttcagtgacgcctgacggcgaggtcagggaagagggtaaggaacacacaaagatgggatacagttcaatggggagccagtaagactggggttctggggttcagtcttgagtctgtgcctttagggagacaagtcaattaaacgtgctaggtcccagttaccctgtcttgtaaagtaggctgtatcatacctgtatccttaccgcatagatgtgtcagggaaagaaatgtcatagaagtgaaagcactttatattttctgg

SEQ ID NO: 68408 - DNA, 85 bp, Homo sapiens; identical to SEQ ID NO: 39210
  misc_feature 1..85: note = chr1:203429564-203429649
  misc_feature 1..85: note = hypo
  source 1..85: mol_type = genomic DNA

SEQ ID NO: 68409 - DNA, 20 bp, Homo sapiens
  misc_feature 1..20: note = chr1:203764131-203764151
  misc_feature 1..20: note = hypo
  source 1..20: mol_type = genomic DNA
gccaccgcaccggccacgtg

SEQ ID NO: 68410 - DNA, 18 bp, Homo sapiens
  misc_feature 1..18: note = chr1:203832761-203832779
  misc_feature 1..18: note = hypo
  source 1..18: mol_type = genomic DNA
taacgtttccacttttat

SEQ ID NO: 68411 - DNA, 38 bp, Homo sapiens
  misc_feature 1..38: note = chr1:203911836-203911874
  misc_feature 1..38: note = hypo
  source 1..38: mol_type = genomic DNA
gattcaggacagggccgggcgtggtggctcacgcctgt

SEQ ID NO: 68412 - DNA, 68 bp, Homo sapiens
  misc_feature 1..68: note = chr1:204042624-204042692
  misc_feature 1..68: note = hyper
  source 1..68: mol_type = genomic DNA
cggacccagggtggccgtgggtccgcagcgactccccggccgacggcggggggcgtgccccctcccag

SEQ ID NO: 68413 - DNA, 30 bp, Homo sapiens
  misc_feature 1..30: note = chr1:204042936-204042966
  misc_feature 1..30: note = hyper
  source 1..30: mol_type = genomic DNA
cggctctcttccctgcgagtttccaccctg

SEQ ID NO: 68414 - DNA, 40 bp, Homo sapiens
  misc_feature 1..40: note = chr1:204044387-204044427
  misc_feature 1..40: note = hyper
  source 1..40: mol_type = genomic DNA
ccgcggttgtgctttcggactcgtccgacgcggcgccagc

SEQ ID NO: 68415 - DNA, 407 bp, Homo sapiens
  misc_feature 1..407: note = chr1:204120648-204121055
  misc_feature 1..407: note = hyper
  source 1..407: mol_type = genomic DNA
cgaggactgggtccccgcatccccctggcagccctggcaggaccccatcctcggccccgcgcccactccgctaccttggtccgaacttgctcgggtttccaatgcggccgcagctcctggatgaggcgcagggccccgggaaggatgtcgtccgggtccacggaaatgccgaagtacgcgacggcggcggccctcggggggcccggcggctcccggcagctggcgctggccgccgccttctcctccatgccccatgagcactgcgggcaaggcgtgtgcctcctcaggtgaaaggacgcgcgcggctgaggggccgaagggggcacagccattcccagcagccccaccccctcggagccgcggcagacgctagccccggcgggggggtccggcgagggagtgggagt

SEQ ID NO: 68416 - DNA, 81 bp, Homo sapiens
  misc_feature 1..81: note = chr1:204159610-204159691
  misc_feature 1..81: note = hyper
  source 1..81: mol_type = genomic DNA
ctcagccccgcccagcgcttctgccgtggttccctggtgccgcctcccgcttgccgaagcgcaggccgaaggagttccagt

SEQ ID NO: 68417 - DNA, 30 bp, Homo sapiens
  misc_feature 1..30: note = chr1:20416390-20416420
  misc_feature 1..30: note = hypo
  source 1..30: mol_type = genomic DNA
aaggctggggcttcccgttcgggccattgg

SEQ ID NO: 68418 - DNA, 38 bp, Homo sapiens
  misc_feature 1..38: note = chr1:204333521-204333559
  misc_feature 1..38: note = hypo
  source 1..38: mol_type = genomic DNA
aggcacacatgaggccgccttcccgcttgctttctatt

SEQ ID NO: 68419 - DNA, 30 bp, Homo sapiens
  misc_feature 1..30: note = chr1:204333856-204333886
  misc_feature 1..30: note = hypo
  source 1..30: mol_type = genomic DNA
taggctactggttctcgaagtgtgggcccc

SEQ ID NO: 68420 - DNA, 30 bp, Homo sapiens; identical to SEQ ID NO: 39213
  misc_feature 1..30: note = chr1:204535867-204535897
  misc_feature 1..30: note = hypo
  source 1..30: mol_type = genomic DNA

SEQ ID NO: 68421 - DNA, 30 bp, Homo sapiens; identical to SEQ ID NO: 39214
  misc_feature 1..30: note = chr1:204536295-204536325
  misc_feature 1..30: note = hypo
  source 1..30: mol_type = genomic DNA

SEQ ID NO: 68422 - DNA, 162 bp, Homo sapiens
  misc_feature 1..162: note = chr1:204586294-204586456
  misc_feature 1..162: note = hypo
  source 1..162: mol_type = genomic DNA
ggattattttcctttcgttcctttcccccgtattattgttattatttatttttattttttacaaaacaggagaaaagagtgaatcgggttgggggaggtgacacatttctccacaaaggtacaaaattgcctatagaaagtcagcttcggaatgccgagccc

SEQ ID NO: 68423 - DNA, 153 bp, Homo sapiens
  misc_feature 1..153: note = chr1:204587558-204587711
  misc_feature 1..153: note = hypo
  source 1..153: mol_type = genomic DNA
ggctggaggagagcacggcccacaaccacactaaccgtcttagtgtcagcccccaccaggttctgggccacacaggtgtatagccctgcctcttctgctgtcaccctccgcagctccagggtcccctcggggtacacccggtacctcctgcct

SEQ ID NO: 68424 - DNA, 30 bp, Homo sapiens
  misc_feature 1..30: note = chr1:204588003-204588033
  misc_feature 1..30: note = hypo
  source 1..30: mol_type = genomic DNA
agcggatggggttgccgtggagacctacct

SEQ ID NO: 68425 - DNA, 112 bp, Homo sapiens; identical to SEQ ID NO: 39216
  misc_feature 1..112: note = chr1:204588271-204588383
  misc_feature 1..112: note = hypo
  source 1..112: mol_type = genomic DNA

SEQ ID NO: 68426 - DNA, 30 bp, Homo sapiens
  misc_feature 1..30: note = chr1:204589092-204589122
  misc_feature 1..30: note = hypo
  source 1..30: mol_type = genomic DNA
gcaagagtggggccacgagaagcctcatgg

SEQ ID NO: 68427 - DNA, 30 bp, Homo sapiens
  misc_feature 1..30: note = chr1:204643879-204643909
  misc_feature 1..30: note = hypo
  source 1..30: mol_type = genomic DNA
ccaggacaaagaacacggacagatctgagc

SEQ ID NO: 68428 - DNA, 130 bp, Homo sapiens; identical to SEQ ID NO: 26808
  misc_feature 1..130: note = chr1:204653466-204653596
  misc_feature 1..130: note = hyper
  source 1..130: mol_type = genomic DNA

SEQ ID NO: 68429 - DNA, 426 bp, Homo sapiens
  misc_feature 1..426: note = chr1:204653792-204654218
  misc_feature 1..426: note = hyper
  source 1..426: mol_type = genomic DNA
cgcttccccctgaccgagtccccaggctgagccccaggccggcccatcccccaccccaaaggtcccatcccaggctgcggtcggaccccagccagccggcccgggaggagcctagctcctggttccagatacttcagacagacccaaggccaccttgtccctccgcacagactcgcgagctccaaggaggagaaagtccccaggctctggagcgcttccagcctgccagtccgcccgtgtcacgccctccctaacctcactgccacctctcggctcctccacatctccagggccccactctacccagcaacagtttgggggaggttctggcctctccaggcgaaggcccaggcgccctctccctggccgcttctgggcattctccagccctccgtccctctgcccctcggccgcctccctctccca

SEQ ID NO: 68430 - DNA, 194 bp, Homo sapiens
  misc_feature 1..194: note = chr1:204654575-204654769
  misc_feature 1..194: note = hyper
  source 1..194: mol_type = genomic DNA
gggaggctcggcgggcgccctccccaacgtggagttatcctgggagcggctccagggcccagccggtgagggcgatggcagaatcccaatccgtccccaccccctctccgcgccctgggcgcgtcgcggccggaggctggcgggcgagagccaggcgctccttgagagcgccgcgcgttcgcaggtgcccggag

SEQ ID NO: 68431 - DNA, 74 bp, Homo sapiens
  misc_feature 1..74: note = chr1:204721208-204721282
  misc_feature 1..74: note = hypo
  source 1..74: mol_type = genomic DNA
gggtgctgctgtagccgcccaacccgcagctacagacccacgcctcctgctgtatggagcgggcaggaacccca

SEQ ID NO: 68432 - DNA, 564 bp, Homo sapiens
  misc_feature 1..564: note = chr1:204797757-204798321
  misc_feature 1..564: note = hyper
  source 1..564: mol_type = genomic DNA
ggcgcgccggccgcccggggacgcgcacgggctggtctctgccctaatgcggcggctggcggcgagaggcgctgcaggggacgcgggggaagtggcggcgccggcagcggacagctcggacagcgcccagggccggagcccgagcccttggaggtaggcgagcgcgaacaccggagagatgggggtagagagtcatggaaacccacctagcgacacccccttgttcccgccctcgtctgtctccatcccctgacctgccccctccccctccgtccacattcccatcccttcccctctccacactgtcacctgccccgaatccatccgattctgttcgtatgcccaccccgtccccgtccagctcccagccccctgcccaccccaacaccctttctatctcgttggccgcgtcccctcccccttcccgcatcctcaaccctttccctttcctctctgtccccgcctcatccgtgagccctgcctgcccttgtacttctgtttacctcgacaccccactttggatgaccccatgcctcctgtatttcctaccgcacacatcagccc

SEQ ID NO: 68433 - DNA, 25 bp, Homo sapiens
  misc_feature 1..25: note = chr1:20492314-20492339
  misc_feature 1..25: note = hypo
  source 1..25: mol_type = genomic DNA
tgtgcgcgcgcgcatgtgtgtttag

SEQ ID NO: 68434 - DNA, 30 bp, Homo sapiens
  misc_feature 1..30: note = chr1:20498645-20498675
  misc_feature 1..30: note = hypo
  source 1..30: mol_type = genomic DNA
gaaagactactgtcccgtgcctccaaatgt

SEQ ID NO: 68435 - DNA, 46 bp, Homo sapiens
  misc_feature 1..46: note = chr1:205043046-205043092
  misc_feature 1..46: note = hypo
  source 1..46: mol_type = genomic DNA
tattttatattctgccgcaggatagaacccacgcaaggattttctt

SEQ ID NO: 68436 - DNA, 205 bp, Homo sapiens
  misc_feature 1..205: note = chr1:20512345-20512550
  misc_feature 1..205: note = hyper
  source 1..205: mol_type = genomic DNA
agagagaaacagaggcggtgacgctaggaagaggaggagagaaggaggccgcgggtccctgtcgcctccaggccaggcaatccactccaggctcgcaatccaccgacctggagttcacggcctccgccctcctggcccagcggcccccacccgaccccacccgaccccacccgacccaggccggttccggtcacgccggaagcac

SEQ ID NO: 68437 - DNA, 248 bp, Homo sapiens
  misc_feature 1..248: note = chr1:20512551-20512799
  misc_feature 1..248: note = hyper
  source 1..248: mol_type = genomic DNA
tggccccccaccctgcggcgttgcccgggagaccagggttgtttaccagcaggacagagcccgggcgcaggcggcggatggagcggaacggctaggtgagagcggctgcccgatcccgcggcctgcccttggcctccgccaggcctggaaggggccgggggaggccagtccccgagaccccagcacatcacccgggagggcctccccagacccagcccgggggacgcaaaccccgggagacaggcgag

SEQ ID NO: 68438 - DNA, 145 bp, Homo sapiens; identical to SEQ ID NO: 39218
  misc_feature 1..145: note = chr1:205310661-205310806
  misc_feature 1..145: note = hypo
  source 1..145: mol_type = genomic DNA

SEQ ID NO: 68439 - DNA, 24 bp, Homo sapiens
  misc_feature 1..24: note = chr1:205311046-205311070
  misc_feature 1..24: note = hypo
  source 1..24: mol_type = genomic DNA
gattacaggcgtgagccaccgcgc

SEQ ID NO: 68440 - DNA, 434 bp, Homo sapiens
  misc_feature 1..434: note = chr1:205312478-205312912
  misc_feature 1..434: note = hyper
  source 1..434: mol_type = genomic DNA
ccaatcaccatgatccgcttccccagggcggtgacggccacccccgcccgggctgtgggcagccggggcaaggcggtccactggtcggcctccggggagtagacctcgaagcagtccatggggacgccgttgtcgtcacatcccccgatggcatagacctggcccccggtctccagcagggagcagtagacccggcggctgggcagtggcgccaggcgcttccactggaagtccttgacgttaggcacctccatggcagccttggggagcgcccgggcgccgggagaggtgcgagcgcgggggtccaccggctacttggcgccggctcccacggcccctatcgccacctccatctggctcccgagcgccggacccagccagaccccggccagtgcttcaccgtgccccgagtctcagcggtccggcggcgtcca

SEQ ID NO: 68441 - DNA, 45 bp, Homo sapiens; identical to SEQ ID NO: 26814
  misc_feature 1..45: note = chr1:205312961-205313006
  misc_feature 1..45: note = hyper
  source 1..45: mol_type = genomic DNA

SEQ ID NO: 68442 - DNA, 29 bp, Homo sapiens
  misc_feature 1..29: note = chr1:20534652-20534681
  misc_feature 1..29: note = hypo
  source 1..29: mol_type = genomic DNA
acagagtgagaccccgcatccaaaagaaa

SEQ ID NO: 68443 - DNA, 482 bp, Homo sapiens
  misc_feature 1..482: note = chr1:205399652-205400134
  misc_feature 1..482: note = hyper
  source 1..482: mol_type = genomic DNA
tcctggaatgggatgcgtggttcccatgagacaggagaaagccgcccatcaccgtggagaaccaggaatggcagaccacgcggacgccaacagtttacgcagctccccagctaggtgcaaagtggccaaaggaagagccggtcttccacacgcacacctccgcgcccacactgccccaggagcttcccactcagccgggggacccccaagcagccggcgaggcgcactgcgcacgcgcactcaggccgcggctccagccgccctccctccgcagtggggcgccccgcccccgcgccgctcagttttaaactcgcagcagacggaactcgacttaaaaataactattttgacagttcagatgtaaatatgtgagtgacgcgtggggctgtttttccttcacacttcccctcacccctcgctccctaccccagctcaattcggctgaggctgagatgatgggagagcgccgtctgcaggatgct

SEQ ID NO: 68444 - DNA, 1182 bp, Homo sapiens
  misc_feature 1..1182: note = chr1:205424654-205425836
  misc_feature 1..1182: note = hyper
  source 1..1182: mol_type = genomic DNA
ggggtataaaggaaacggaggaggcactccaagcgggtttcactcagcggggacaggaggatcggctacctccggagccaaggctccctctcacactccccccaatcccaccagcggcaaaatcctttaaaaggaacaaaggcaatgggggcggggagggggcttcctctttggtcgacctagggcggcggctgacgcagcccgccgccggtcagctttcaggtgagtgcctgaacccgcatcccgcccatgccttagggacccctcttcgcccagccaagcccggggcggggaggaaagtccccctcagccgcactcgggcccccaacccggccaaggggtcgccaactcgcggcactttctgcctgtttgttttcgctcagtactcacagtttagatgctaagccggctcctcttgcactcacttcctttgtgtctctctctctctttctctctctctccccctcaccaatctctttcttccctccttgtccgattctctgctgtagcttccagtggagaaaaataattattcttcaatgggttagcacggggcgcacgcacacacgcgcgcgcacacacaccccgccgaggtacccaatcaatgcacaaatcttcggggtccctttaacctctgcggatgactccgggagttaattatgaagcctatttcggcgcggcataaatatgcattaaggtaggaaataatcgatacgctgaacttctgggaactggcatttagacggactccgtctcgccgccccccactccctccatggccccacgagccacctccacagcctcgcgccttcccggggtcgcaacgcctatcacaagcttctacccgggtttcagggggcccctgtagtggcgtgggcgccgcgccggtgccgggagaccccctcgtgcgccctctgcggtcggggcagaccctcagccggagcttcttcctcccccacccctgcaggccgggcccaagctgcgacacccccagcacgggctcagcctgtgaacaaactccgagctcagtactcggaggaactggcgagagcgggacggctacctgcccgcacgcccgatttccgggcacagctagaaagaccgggacgcgattcaactcccaatccggtgaatccgcctagcgccttcgggtcctgccgcccccggccagtcccgacccgc

SEQ ID NO: 68445 - DNA, 101 bp, Homo sapiens
  misc_feature 1..101: note = chr1:205425896-205425997
  misc_feature 1..101: note = hyper
  source 1..101: mol_type = genomic DNA
atatgcacaccctcgcgcacacagacactcccgcgcgcgctcacgcccgcacacactcagggttataacaaaggaagaggggccagcgctgccttactttt

SEQ ID NO: 68446 - DNA, 30 bp, Homo sapiens; identical to SEQ ID NO: 39220
  misc_feature 1..30: note = chr1:205548923-205548953
  misc_feature 1..30: note = hypo
  source 1..30: mol_type = genomic DNA

SEQ ID NO: 68447 - DNA, 413 bp, Homo sapiens; identical to SEQ ID NO: 26111
  misc_feature 1..413: note = chr1:20618140-20618553
  misc_feature 1..413: note = hyper
  source 1..413: mol_type = genomic DNA

SEQ ID NO: 68448 - DNA, 327 bp, Homo sapiens; identical to SEQ ID NO: 38729
  misc_feature 1..327: note = chr1:2066352-2066679
  misc_feature 1..327: note = hypo
  source 1..327: mol_type = genomic DNA

SEQ ID NO: 68449 - DNA, 150 bp, Homo sapiens; identical to SEQ ID NO: 26112
  misc_feature 1..150: note = chr1:20669698-20669848
  misc_feature 1..150: note = hyper
  source 1..150: mol_type = genomic DNA

SEQ ID NO: 68450 - DNA, 69 bp, Homo sapiens
  misc_feature 1..69: note = chr1:20669896-20669965
  misc_feature 1..69: note = hyper
  source 1..69: mol_type = genomic DNA
cggaactgcgcccctcccgcggacggcctccggaggacagccccgctccacagccgctcccccttcccc

SEQ ID NO: 68451 - DNA, 105 bp, Homo sapiens
  misc_feature 1..105: note = chr1:20692819-20692924
  misc_feature 1..105: note = hyper
  source 1..105: mol_type = genomic DNA
gtcggtccccactcccgacgggcctcgcattcctggtcctccaccttctgccaagaccctgcccacgcttcccgcaccagccttaggtcccgaggtccccaactt

SEQ ID NO: 68452 - DNA, 30 bp, Homo sapiens
  misc_feature 1..30: note = chr1:20693939-20693969
  misc_feature 1..30: note = hyper
  source 1..30: mol_type = genomic DNA
gacctccagccagatcggtctcctctgacc

SEQ ID NO: 68453 - DNA, 361 bp, Homo sapiens
  misc_feature 1..361: note = chr1:207200818-207201179
  misc_feature 1..361: note = hypo
  source 1..361: mol_type = genomic DNA
ggagggagagtattacgtacagatccagagcgggtggaggtgctgctcatcatgctgtcacagctgccgacacgggtcacgggttctgagccagtccccgctggccacagctccctctcgggcatcacccgaaacaaggtgcagggatggcaaagggggcttctagaggggaagcgaggggaagtgaacaatgtcccaagccgggcctgaaaagagaagaatcaaagccacacatgagccgaggcttcggcaaggctctgcccaggccctgggcggcatggcgggaaggacaccaagcaagcagagagctggaaggggggcatgaacagccactgcccgacacccccggcctgcatggaag

SEQ ID NO: 68454 - DNA, 216 bp, Homo sapiens
  misc_feature 1..216: note = chr1:207224789-207225005
  misc_feature 1..216: note = hypo
  source 1..216: mol_type = genomic DNA
acttgtgactagactcgtggctgcattaaacattgactcattggggttccaggggccaaaagactggcctttctgcctccctgggactgtgcttgaaaacgtctatttgccacttcagaaagcacagtatgaggtcagcatctgggcccagggcagctgcctcattcaggtggtggcagtgtaaggaggagtcgtgtaacgcgtgtcatcagattc

SEQ ID NO: 68455 - DNA, 39 bp, Homo sapiens
  misc_feature 1..39: note = chr1:207225631-207225670
  misc_feature 1..39: note = hypo
  source 1..39: mol_type = genomic DNA
cttggttcttcaagacgactgcaacggatgatacagcct

SEQ ID NO: 68456 - DNA, 77 bp, Homo sapiens
  misc_feature 1..77: note = chr1:207227177-207227254
  misc_feature 1..77: note = hypo
  source 1..77: mol_type = genomic DNA
ttcagggaatatgttcgagattttcccacgtccctcacttttttcttttctttctttctttttcatttttcattttt

SEQ ID NO: 68457 - DNA, 44 bp, Homo sapiens
  misc_feature 1..44: note = chr1:207477842-207477886
  misc_feature 1..44: note = hypo
  source 1..44: mol_type = genomic DNA
gatccctccattcggggttcctgacttcccgcaatagctggatt

SEQ ID NO: 68458 - DNA, 87 bp, Homo sapiens
  misc_feature 1..87: note = chr1:207567724-207567811
  misc_feature 1..87: note = hypo
  source 1..87: mol_type = genomic DNA
cgcccggcctaaaacagtttcttttgtcttaagttttcatttctacgttcgtctgtcttcattcagtcttgacggtctcaagtaata

SEQ ID NO: 68459 - DNA, 29 bp, Homo sapiens
  misc_feature 1..29: note = chr1:207590078-207590107
  misc_feature 1..29: note = hypo
  source 1..29: mol_type = genomic DNA
gaggcaggcggatcacgaggtcaggagtt

SEQ ID NO: 68460 - DNA, 25 bp, Homo sapiens
  misc_feature 1..25: note = chr1:207598909-207598934
  misc_feature 1..25: note = hypo
  source 1..25: mol_type = genomic DNA
ccaaactcaccgagtcatgcaggct

SEQ ID NO: 68461 - DNA, 603 bp, Homo sapiens
  misc_feature 1..603: note = chr1:207627530-207628133
  misc_feature 1..603: note = hyper
  source 1..603: mol_type = genomic DNA
ccgcccacctcgtgccgggccgtccctcccgcttgtcccaccctcaccggcgccgcgtcagcccccaggccgcctgcaggtgtgcgctcagaactagcacgtgtgccggacactatttaagggcccgcctctcctggctcacagctgcttgctgctccagccttgccctcccagagctgccggacgctcgcgggtctcggaacgcatcccgccgcgggggcttcggccgtggcatgggcgccgcgggcctgctcggggttttcttggctctcgtcgcaccgggggtcctcggtgagctgggagggggagcacggaggtggggacgcgtcccgggcagggaaagtttctgtgccgcgatgcaaagcagggggccaaaagcgagacggtgggggcagtgctcgacgcgtgtccgcctcccgctagctttgagggaccactgcaataaaccgcctggtcctgattgtccccactggcccctccgggagctgggacctccagaattggaggctgcgccacagaggggcgctgtctggtcggcccggtgtggctggcggcgtgcgggtgctcgcggtctcctgccgggctccccgcccccaggattct

SEQ ID NO: 68462 - DNA, 32 bp, Homo sapiens
  misc_feature 1..32: note = chr1:207648482-207648514
  misc_feature 1..32: note = hypo
  source 1..32: mol_type = genomic DNA
atcatgaatggtagtcgcgtgattaggtgtca

SEQ ID NO: 68463 - DNA, 30 bp, Homo sapiens; identical to SEQ ID NO: 14325
  misc_feature 1..30: note = chr1:207656486-207656516
  misc_feature 1..30: note = hypo
  source 1..30: mol_type = genomic DNA

SEQ ID NO: 68464 - DNA, 15 bp, Homo sapiens
  misc_feature 1..15: note = chr1:207669258-207669273
  misc_feature 1..15: note = hyper
  source 1..15: mol_type = genomic DNA
cagggtgtttggagg

SEQ ID NO: 68465 - DNA, 467 bp, Homo sapiens; identical to SEQ ID NO: 26819
  misc_feature 1..467: note = chr1:207669321-207669788
  misc_feature 1..467: note = hyper
  source 1..467: mol_type = genomic DNA

SEQ ID NO: 68466 - DNA, 288 bp, Homo sapiens
  misc_feature 1..288: note = chr1:207669828-207670116
  misc_feature 1..288: note = hyper
  source 1..288: mol_type = genomic DNA
cgcgcccgggtccgaaggcagcgcgatgggtgggctgagcgcgcgacccggcagggcggcgggtgtaggatccttctgcgcactggagaccctcgctgcttctgggtaagcgtggagttcccaggtgcaggggcttaagtcgtgacgagcgcagtggaaggcgcagatgctgagcgggtgccgcacgaaattccttgcctttgtgtattcacagcctcggctggctatagccaagacgtggcgttgatcctagtgaaagggaacttggggatccgacaaacctgagtt

SEQ ID NO: 68467 - DNA, 30 bp, Homo sapiens
  misc_feature 1..30: note = chr1:207760894-207760924
  misc_feature 1..30: note = hypo
  source 1..30: mol_type = genomic DNA
gaagacaactgtagacgtgagtaacccctc

SEQ ID NO: 68468 - DNA, 29 bp, Homo sapiens
  misc_feature 1..29: note = chr1:207786426-207786455
  misc_feature 1..29: note = hypo
  source 1..29: mol_type = genomic DNA
gcttctttgtacctgcgtttggtgggtcc

SEQ ID NO: 68469 - DNA, 137 bp, Homo sapiens; identical to SEQ ID NO: 39225
  misc_feature 1..137: note = chr1:207787630-207787767
  misc_feature 1..137: note = hypo
  source 1..137: mol_type = genomic DNA

SEQ ID NO: 68470 - DNA, 71 bp, Homo sapiens
  misc_feature 1..71: note = chr1:207818268-207818339
  misc_feature 1..71: note = hyper
  source 1..71: mol_type = genomic DNA
aggggtgctagcccacgataaccccctgccagggctctggacacgccctgtctcctcgaaggccaacgggc

SEQ ID NO: 68471 - DNA, 24 bp, Homo sapiens
  misc_feature 1..24: note = chr1:207829567-207829591
  misc_feature 1..24: note = hypo
  source 1..24: mol_type = genomic DNA
gcgagattccgtctcaaaatcaat

SEQ ID NO: 68472 - DNA, 30 bp, Homo sapiens; identical to SEQ ID NO: 39226
  misc_feature 1..30: note = chr1:207857205-207857235
  misc_feature 1..30: note = hypo
  source 1..30: mol_type = genomic DNA

SEQ ID NO: 68473 - DNA, 171 bp, Homo sapiens
  misc_feature 1..171: note = chr1:207911135-207911306
  misc_feature 1..171: note = hypo
  source 1..171: mol_type = genomic DNA
gaggaatctggtggccgtaataaccggggaacagatgagctggaggcctcatcaggaggggtgtcccttggtggaaggacaccattcccggccttaaaaggagaggctccagcacggctggggaagcatgtggataccttgtaataaatccactgtcgtagctcattcttg

SEQ ID NO: 68474 - DNA, 38 bp, Homo sapiens
  misc_feature 1..38: note = chr1:207921798-207921836
  misc_feature 1..38: note = hypo
  source 1..38: mol_type = genomic DNA
ctccactccttaaaaccactccacgtgtgcccatctcg

SEQ ID NO: 68475 - DNA, 99 bp, Homo sapiens
  misc_feature 1..99: note = chr1:207991495-207991594
  misc_feature 1..99: note = hypo
  source 1..99: mol_type = genomic DNA
tgtccctctgccccacgctccagcagagggggtagagaagagaaaggggaggacggtttgtccgcattcagtggcagtggaggtgcatcttctctctcg

SEQ ID NO: 68476 - DNA, 99 bp, Homo sapiens
  misc_feature 1..99: note = chr1:207991654-207991753
  misc_feature 1..99: note = hypo
  source 1..99: mol_type = genomic DNA
ggcggggcggggcgggacgggacgggacggggcgggacggggcggggcagggcggggggatcacgcgcctatagcgcaaagctgcggtatggagaaaag

SEQ ID NO: 68477 - DNA, 30 bp, Homo sapiens; identical to SEQ ID NO: 39229
  misc_feature 1..30: note = chr1:207992298-207992328
  misc_feature 1..30: note = hypo
  source 1..30: mol_type = genomic DNA

SEQ ID NO: 68478 - DNA, 15 bp, Homo sapiens
  misc_feature 1..15: note = chr1:208083989-208084004
  misc_feature 1..15: note = hyper
  source 1..15: mol_type = genomic DNA
tcctccccagtctcc

SEQ ID NO: 68479 - DNA, 652 bp, Homo sapiens; identical to SEQ ID NO: 26822
  misc_feature 1..652: note = chr1:208084031-208084683
  misc_feature 1..652: note = hyper
  source 1..652: mol_type = genomic DNA

SEQ ID NO: 68480 - DNA, 244 bp, Homo sapiens
  misc_feature 1..244: note = chr1:20810594-20810838
  misc_feature 1..244: note = hyper
  source 1..244: mol_type = genomic DNA
accccaggtaagtcccgagcgcagctccggtgggcaaggctaggtgcggagatgagcggaaccaggaggggacgccaaaaccggttcccacgacgcgcagcgggtgggggttagggcctggcctgggcgggcgccccctcctgcgcgccctctcccagccgctggccgactgactcggccgccccgcgctccccgctgccgcagaggtcagagcctcccttcgctgcctgccagggacacatgc

SEQ ID NO: 68481 - DNA, 66 bp, Homo sapiens
  misc_feature 1..66: note = chr1:20810864-20810930
  misc_feature 1..66: note = hyper
  source 1..66: mol_type = genomic DNA
cgacttagcctcgcctttctcagtccctccatcgtccctcggcgcgacggccggcagccgatcgag

SEQ ID NO: 68482 - DNA, 469 bp, Homo sapiens
  misc_feature 1..469: note = chr1:20811286-20811755
  misc_feature 1..469: note = hyper
  source 1..469: mol_type = genomic DNA
caccctagccttccccgcaggaatgggatcctccccacgcaggtccccacgccgtcccctgggggtccctgggaccccctccccacagggttatggagcgagtgcagctgtgactacactgcgcaaaaggcgggggtggggggcgcaaatcaaaaagcaaactttgccgcgcgggtggagacccccagctgctgctagaagccgccacgcccccagggtgacccagccggggatccggcttagggggacgcgttcctgcgacccgcttcagccggacccgcagtgcgggatcccccaattctgcaagaagggattccgtcaggtctgaacgggctccagcgggtgggagacctccgcaacccttgttcaggccgcggcgcgggaaaaagggggtgtcagacaagggggccgcgaactcaccccgcttgctccggccgatctggcccagcttgggcggccgcttgttctg

SEQ ID NO: 68483 - DNA, 54 bp, Homo sapiens
  misc_feature 1..54: note = chr1:208136458-208136512
  misc_feature 1..54: note = hyper
  source 1..54: mol_type = genomic DNA
tgtttttcttctcatcggtgcctggctgagctctggaatcgtttcctgctctga

SEQ ID NO: 68484 - DNA, 30 bp, Homo sapiens
  misc_feature 1..30: note = chr1:208281203-208281233
  misc_feature 1..30: note = hypo
  source 1..30: mol_type = genomic DNA
cttctccccaggacccgcagtgctgcttca

SEQ ID NO: 68485 - DNA, 35 bp, Homo sapiens
  misc_feature 1..35: note = chr1:208523515-208523550
  misc_feature 1..35: note = hypo
  source 1..35: mol_type = genomic DNA
ggtccttgccatttgcgctgcgccttttagattga

SEQ ID NO: 68486 - DNA, 30 bp, Homo sapiens
  misc_feature 1..30: note = chr1:208677386-208677416
  misc_feature 1..30: note = hypo
  source 1..30: mol_type = genomic DNA
aacagcactttcagccgaggcaacctggga

SEQ ID NO: 68487 - DNA, 175 bp, Homo sapiens
  misc_feature 1..175: note = chr1:20878485-20878660
  misc_feature 1..175: note = hyper
  source 1..175: mol_type = genomic DNA
cagccactgcagcagcggccaggtctctcagctcaggcccagcggtctggcccacgaccttggaagaacctgggagaaagcttcaccaagcgacagtacttttccactgcactgctcggccacctcggctggctttgtgctgtgcagacgaggcaaagtgcgccaggccagcccc

SEQ ID NO: 68488 - DNA, 124 bp, Homo sapiens; identical to SEQ ID NO: 5357
  misc_feature 1..124: note = chr1:20878905-20879029
  misc_feature 1..124: note = hyper
  source 1..124: mol_type = genomic DNA

SEQ ID NO: 68489 - DNA, 199 bp, Homo sapiens; identical to SEQ ID NO: 5358
  misc_feature 1..199: note = chr1:20879030-20879229
  misc_feature 1..199: note = hyper
  source 1..199: mol_type = genomic DNA

SEQ ID NO: 68490 - DNA, 182 bp, Homo sapiens; identical to SEQ ID NO: 5359
  misc_feature 1..182: note = chr1:20879255-20879437
  misc_feature 1..182: note = hyper
  source 1..182: mol_type = genomic DNA

SEQ ID NO: 68491 - DNA, 1175 bp, Homo sapiens
  misc_feature 1..1175: note = chr1:20879462-20880637
  misc_feature 1..1175: note = hyper
  source 1..1175: mol_type = genomic DNA
cgcgatgctgccctggagacgtaacaaattcgtgctggtggaggacgaggccaagtgcaaggcgaagagcctgagtccggggctcgcctacacgtcgctgctctccagcttcctgcgctcctgcccggacctgctgcccgactggccgctggagcgcttgggccgtgtgttccgcagccggcgccagaaagtggagctcaacaaggaggacccgacctacaccgtgtggtacctgggcaacgccgtcaccctgcacgccaagggcgacggctgcaccgacgacgccgtgggcaagatctgggctcgctgcgggcctggcgggggcactaagatgaagctgacgctggggccgcacggcatccgcatgcagccgtgcgagcgcagcgccgccgggggttcggggggccgcaggccggcgcacgcctacctgctgccgcgcatcacctactgcacggcggacgggcgccacccgcgcgtcttcgcctgggtctaccgccaccaggcgcgccacaaggccgtggtgctgcgctgccacgctgtgctgctggcgcgggcgcacaaggcgcgcgccctggcccgcctgctccgccagaccgcgctggcggccttcagcgacttcaagcgcctgcagcgccagagcgacgcgcgccacgtgcgccagcagcatctccgcgctgggggcgccgccgcctcggtgccccgcgccccactgcgccgcctgctcaatgccaagtgcgcctaccggccgccgccgagcgagcgcagccgcggggcgccgcgcctcagcagcatccaggaggaggacgaggaggaggaggaggacgacgcggaggagcaagagggaggagtcccccagcgcgagcggccggaggtgctcagcctggcccgggagctgaggacgtgcagcctgcggggcgccccggcgcccccgccgcccgcgcagccccgccgctggaaggccggccccagggagcgggcgggccaggcgcgctgagagccgaaggacaggactcgcagccccaggcccgacccgccagactcacagcctccaaccccggccctgcccgcttcggctgccccggcccccggcccgtgtctcccccgtggtctccgtgttgtccgccccgccgcctcattttggctcagggtgatgcctgatacgcccttggttattg

SEQ ID NO: 68492 - DNA, 18 bp, Homo sapiens
  misc_feature 1..18: note = chr1:208852030-208852048
  misc_feature 1..18: note = hypo
  source 1..18: mol_type = genomic DNA
aagggggaagctggccgg

SEQ ID NO: 68493 - DNA, 115 bp, Homo sapiens; identical to SEQ ID NO: 39230
  misc_feature 1..115: note = chr1:208951412-208951527
  misc_feature 1..115: note = hypo
  source 1..115: mol_type = genomic DNA

SEQ ID NO: 68494 - DNA, 25 bp, Homo sapiens
  misc_feature 1..25: note = chr1:20897067-20897092
  misc_feature 1..25: note = hypo
  source 1..25: mol_type = genomic DNA
ggattacagacgtgagtcacccatc

SEQ ID NO: 68495 - DNA, 93 bp, Homo sapiens
  misc_feature 1..93: note = chr1:20916163-20916256
  misc_feature 1..93: note = hyper
  source 1..93: mol_type = genomic DNA
ctaagtgttaatgctcgtctttagatgaaactacggaggtctcgagaggtgacatgacttgcccaaggtcacacggggcgctggtggtgaaac

SEQ ID NO: 68496 - DNA, 88 bp, Homo sapiens
  misc_feature 1..88: note = chr1:209306269-209306357
  misc_feature 1..88: note = hypo
  source 1..88: mol_type = genomic DNA
ctctggtgagaacaggctctgtgtgggccccgcagcagcctccgagcccctgccctctcggcacctgagttctcgtccagcatctggg

SEQ ID NO: 68497 - DNA, 30 bp, Homo sapiens
  misc_feature 1..30: note = chr1:209364033-209364063
  misc_feature 1..30: note = hyper
  source 1..30: mol_type = genomic DNA
cagggaggctggtctcgccaggaatggcaa

SEQ ID NO: 68498 - DNA, 544 bp, Homo sapiens
  misc_feature 1..544: note = chr1:209381087-209381631
  misc_feature 1..544: note = hyper
  source 1..544: mol_type = genomic DNA
ttgtttcagcataggcggaagcctccactccagggcttggggtgggctcgggaggccgcccgccgtcggcctgactcacagcgagctcggcgctccctcttgtggcttctgtgttccccgtcagcctcgggaagctgccggccaccacatacaaatggactccgcgtagttaagctgtcaggtctaatgtatttatttgactctctcctgttaaaatgatttctctacagcactgcggttatttacgactattgtcagtacaaggcgatgagaaggcagcagcagaggaaaacaacaacagctgaaggaaaagttctgtctgggagggctgggtggctgggtggctgggtcccgggctttcccgcggctgcagcggctgtgtgtttactttatctgcagcgggggcttcggagctcatccatccataatgcagagcccattgccctcagcccgcagttcacggccagccccagtgagcgcccttgcggaggagctgtggcccggggaggacacccccagctcttttgagcgctaaacattttca

SEQ ID NO: 68499 - DNA, 185 bp, Homo sapiens; identical to SEQ ID NO: 39232
  misc_feature 1..185: note = chr1:209601396-209601581
  misc_feature 1..185: note = hypo
  source 1..185: mol_type = genomic DNA

SEQ ID NO: 68500 - DNA, 237 bp, Homo sapiens
  misc_feature 1..237: note = chr1:209999727-209999964
  misc_feature 1..237: note = hypo
  source 1..237: mol_type = genomic DNA
ccaccccagcctctccgaatctaattaggaatagtagatggtcactagaactgacaagaatcgcattctaatggttttattacaacttctatggtgtgacacagtatcagggaaaacccaaatttcccacagtagcactccaatagcagagctattattttgcttctcatttctctcattttggacgctcctgttttaccgtaaatattcaagtgaattctgcggcttatgatttaa

SEQ ID NO: 68501 - DNA, 30 bp, Homo sapiens
  misc_feature 1..30: note = chr1:210070804-210070834
  misc_feature 1..30: note = hypo
  source 1..30: mol_type = genomic DNA
atgtttctggaagagcgtacaacttagcgg

SEQ ID NO: 68502 - DNA, 229 bp, Homo sapiens
  misc_feature 1..229: note = chr1:210110982-210111211
  misc_feature 1..229: note = hyper
  source 1..229: mol_type = genomic DNA
gctgtttctccacagcggagatctgagacgagtatgtggctgattcgggcaaaacaaaacaaaataaaaccaaacgaaaccaaaacagacttactattaccaaatctgagagtcagtgggtgggaatccttttcaaccaaggagacctgtccatggtcctgaccacatcatttgccactcgcctccttcatggacaccgtttgctccaagtaccggacgggagggcgcc

SEQ ID NO: 68503 - DNA, 139 bp, Homo sapiens; identical to SEQ ID NO: 26824
  misc_feature 1..139: note = chr1:210111283-210111422
  misc_feature 1..139: note = hyper
  source 1..139: mol_type = genomic DNA

SEQ ID NO: 68504 - DNA, 127 bp, Homo sapiens; identical to SEQ ID NO: 26825
  misc_feature 1..127: note = chr1:210111796-210111923
  misc_feature 1..127: note = hyper
  source 1..127: mol_type = genomic DNA

SEQ ID NO: 68505 - DNA, 133 bp, Homo sapiens
  misc_feature 1..133: note = chr1:210112036-210112169
  misc_feature 1..133: note = hyper
  source 1..133: mol_type = genomic DNA
cggcaaaccatccttccgcaatacccaccttcctgccaaactgagagtccagttttttgtcccattcctaacccttccctgtgcccgctcgggctgatgctgggttacactctctgcccgttccccttctgtt

SEQ ID NO: 68506 - DNA, 30 bp, Homo sapiens
  misc_feature 1..30: note = chr1:21024801-21024831
  misc_feature 1..30: note = hypo
  source 1..30: mol_type = genomic DNA
cagccctgcccttcccgctgggccccacct

SEQ ID NO: 68507 - DNA, 30 bp, Homo sapiens
  misc_feature 1..30: note = chr1:21026148-21026178
  misc_feature 1..30: note = hypo
  source 1..30: mol_type = genomic DNA
ttgctagacaggaggcgcttgctagacagg

SEQ ID NO: 68508 - DNA, 30 bp, Homo sapiens
  misc_feature 1..30: note = chr1:21030592-21030622
  misc_feature 1..30: note = hypo
  source 1..30: mol_type = genomic DNA
agcgaacacgcattgcgacaatgccacaga

SEQ ID NO: 68509 - DNA, 58 bp, Homo sapiens
  misc_feature 1..58: note = chr1:210405727-210405785
  misc_feature 1..58: note = hyper
  source 1..58: mol_type = genomic DNA
aaagacaagatatctcggaaggttccagagtgaatacattattcggctggagccaagc

SEQ ID NO: 68510 - DNA, 53 bp, Homo sapiens
  misc_feature 1..53: note = chr1:210406136-210406189
  misc_feature 1..53: note = hyper
  source 1..53: mol_type = genomic DNA
gctcattaccataaccgtctgcagcgacggcggcgcagcgccccagtcgcggc

SEQ ID NO: 68511 - DNA, 49 bp, Homo sapiens
  misc_feature 1..49: note = chr1:210406479-210406528
  misc_feature 1..49: note = hyper
  source 1..49: mol_type = genomic DNA
gcaccagggctgtgccgaggtcaccgagtggactcgcagcggccggagc

SEQ ID NO: 68512 - DNA, 36 bp, Homo sapiens
  misc_feature 1..36: note = chr1:21042027-21042063
  misc_feature 1..36: note = hypo
  source 1..36: mol_type = genomic DNA
gcctctctgggagggcggatccggcaggccctgcat

SEQ ID NO: 68513 - DNA, 337 bp, Homo sapiens
  misc_feature 1..337: note = chr1:21042750-21043087
  misc_feature 1..337: note = hypo
  source 1..337: mol_type = genomic DNA
aaaatcaatatcttaaagggtaagagcagcacctgcggggctctcacagggtgcatacagggcttctttcgtgcatgggcacaggaagcactgccatacacaggtgatggcccaatgtctgcctgcaatgcagggagctggacacgtacaggtgattctcgtggcgggctatggggcggggcacacagcgacaagagtccaggcagccagccggcagggacagggagtacaaagaagcgaaaacaggatggcacaggaagaacgaagcacagctttccaggcggcaaagacagggagaactgggggagctgggagtggggctcgtactttgccaggt

SEQ ID NO: 68514 - DNA, 219 bp, Homo sapiens
  misc_feature 1..219: note = chr1:21044015-21044234
  misc_feature 1..219: note = hyper
  source 1..219: mol_type = genomic DNA
ggtccacgtggtaggcgccgtcgaaggtgaactgcttgggcggctcgtcggcggcgcccgggttctggatgcagcactgggcgcgcgcgcagtccacagtcaccacgggctggcagcgcagctctcgctcccgctggttcatgggacggcagcgcacgacaaccttcaccgcctcggaggccatggcgccgcgcccaggaccaacgggaccagagctga

SEQ ID NO: 68515 - DNA, 69 bp, Homo sapiens
  misc_feature 1..69: note = chr1:210465943-210466012
  misc_feature 1..69: note = hyper
  source 1..69: mol_type = genomic DNA
aagaggctccgggctcggccagtgtctgccccgggactgggccctgggactaggcggggcacaggtgtc

SEQ ID NO: 68516 - DNA, 154 bp, Homo sapiens
  misc_feature 1..154: note = chr1:21058263-21058417
  misc_feature 1..154: note = hyper
  source 1..154: mol_type = genomic DNA
cccgctgcgctacctcgctcggggcgctgcggggaacggccaggggccccggcagagtccccggacccaggagcgtgctgggctccgctgcaggggacggaggaggctacagtggcagggagggcagatgacgacggagcgggtgacgggcgcc

SEQ ID NO: 68517 - DNA, 235 bp, Homo sapiens
  misc_feature 1..235: note = chr1:211306663-211306898
  misc_feature 1..235: note = hyper
  source 1..235: mol_type = genomic DNA
aggccgccgagagcacgtcccgacacctcggacttttcagttgcagggatggaaggtggaggcagccggatcctcccattctgaggcagcggggacctggagttgcccgtctctactgctggctctccctggggagaggcggcgcctctgggagcagcccgggagccccagagccttcgcggaagggtgggcagtgccgatggggcgcgcgctgccgctccggctgcagccagct

SEQ ID NO: 68518 - DNA, 420 bp, Homo sapiens
  misc_feature 1..420: note = chr1:211307119-211307539
  misc_feature 1..420: note = hyper
  source 1..420: mol_type = genomic DNA
tgcatctgctggctccgagcggcgagaggttctgcaataaaggcacggataaaacgcccgggtaatcgaaatccgaatgcacctcttaccattggaccgccgaacaatattctccagaaacgtgttttgaggggccactagtcccctcctgcccccagccatggtcatcctcccagcagctcggggtccggcgggcgtcctggcgcggcttcttacgacagcaggaaactggcctcggggcccgcacgcagtcccggctcgaagcgccccatgcgcccggcggggatccgcaggcagggctggcggctccctctggctgctaccctcgcgccctcttcgcgcctccctccctgcggcccgcctcgcagtgcactcgcgccggcctcggctagcggcagccgcctccgggtgggcggaggg

SEQ ID NO: 68519 - DNA, 33 bp, Homo sapiens; identical to SEQ ID NO: 39234
  misc_feature 1..33: note = chr1:211430421-211430454
  misc_feature 1..33: note = hypo
  source 1..33: mol_type = genomic DNA

SEQ ID NO: 68520 - DNA, 30 bp, Homo sapiens
  misc_feature 1..30: note = chr1:211504088-211504118
  misc_feature 1..30: note = hypo
  source 1..30: mol_type = genomic DNA
tggaggttgctacaccgtccccaccagcat

SEQ ID NO: 68521 - DNA, 30 bp, Homo sapiens
  misc_feature 1..30: note = chr1:211847757-211847787
  misc_feature 1..30: note = hypo
  source 1..30: mol_type = genomic DNA
ggatgtttcagttcacgaagcaaattcact

SEQ ID NO: 68522 - DNA, 32 bp, Homo sapiens
  misc_feature 1..32: note = chr1:211871944-211871976
  misc_feature 1..32: note = hyper
  source 1..32: mol_type = genomic DNA
gagaggatcctgcgccgcgttcagccctggcc

SEQ ID NO: 68523 - DNA, 349 bp, Homo sapiens
  misc_feature 1..349: note = chr1:2125166-2125515
  misc_feature 1..349: note = hypo
  source 1..349: mol_type = genomic DNA
gcagggatcaggtgccgggcgctggggcagggacctggcgggggattccaggtgccctcctgccccgtgaagcagccggtaggaacggcccgggccccacaggtccggcggaaagggtgtccaggaaaaggtcttgggtccgacagtgaagacttcagtgggctccgggccgcacctgggctcctgcaacacagagttgttgggccttgcccagcgatggctcccgccctggaaaccccttcatcgctaagatgggcccagtgggcacacctgtcctgggaaggcgggcagtgaaggcacctcgtgatccaggatcagctccgggctcaccgtgcgcagtagctcggcc

SEQ ID NO: 68524 - DNA, 17 bp, Homo sapiens
  misc_feature 1..17: note = chr1:212614848-212614865
  misc_feature 1..17: note = hypo
  source 1..17: mol_type = genomic DNA
gggcatggtggctcacg

SEQ ID NO: 68525 - DNA, 292 bp, Homo sapiens
  misc_feature 1..292: note = chr1:212873974-212874266
  misc_feature 1..292: note = hyper
  source 1..292: mol_type = genomic DNA
agagcgaatctgccacgtgggacgtcactagtgacaggtttggggatctggacccgccatgccacggttaaacggcccagatcatttttctttttcaagatttatctgctcgtgccaagctggggaccgggttgaggtagggcaagtccctgtccacctgcctgccagtcaaaagatgcgaagccaagacaattacccgtggtcctagcgaaggaaacactagcggccacaggctgtggtctgcatgctgtgagcaccgggaaagataaccgcgattcgggatgggcgggtg

SEQ ID NO: 68526 - DNA, 96 bp, Homo sapiens
  misc_feature 1..96: note = chr1:212963883-212963979
  misc_feature 1..96: note = hypo
  source 1..96: mol_type = genomic DNA
atctacttatattagcggaaaaaatttaaaagctcataataccgcacatttgtgagttatgaatgaccacagtgcaaacagtaaaaataaaggtta

SEQ ID NO: 68527 - DNA, 30 bp, Homo sapiens
  misc_feature 1..30: note = chr1:2129896-2129926
  misc_feature 1..30: note = hypo
  source 1..30: mol_type = genomic DNA
tccaactccttccaccgcggaagaacaagt

SEQ ID NO: 68528 - DNA, 1034 bp, Homo sapiens; identical to SEQ ID NO: 26831
  misc_feature 1..1034: note = chr1:213123589-213124623
  misc_feature 1..1034: note = hyper
  source 1..1034: mol_type = genomic DNA

SEQ ID NO: 68529 - DNA, 380 bp, Homo sapiens
  misc_feature 1..380: note = chr1:213124668-213125048
  misc_feature 1..380: note = hyper
  source 1..380: mol_type = genomic DNA
cgctgatttcaggcaccgccggtaagcagggagcctccgcggagctcccgccgccgctcccccttggtgagtcctgccgcagcgagaggcatggagaaggccgcccccgcggggcgctgatcccctcgccgcgcccgcgcgcacacgccccccgccgccgccgccgctgccgccgccgcgcgcccccagtacctcgctccccgcccaggccccaccatgaccggctccgcggccgacactcaccgctgcccccaccccaaaggcgccaaaggcacccggtcccggagcagccacgcgcggcccgtgagcctcgccaccagcgggggctcagaggaggaggacaaagacggcggggtgctgttccacgtcaacaagagcgg

SEQ ID NO: 68530 - DNA, 180 bp, Homo sapiens; identical to SEQ ID NO: 39236
  misc_feature 1..180: note = chr1:213189664-213189844
  misc_feature 1..180: note = hypo
  source 1..180: mol_type = genomic DNA

SEQ ID NO: 68531 - DNA, 101 bp, Homo sapiens; identical to SEQ ID NO: 39237
  misc_feature 1..101: note = chr1:213190144-213190245
  misc_feature 1..101: note = hypo
  source 1..101: mol_type = genomic DNA

SEQ ID NO: 68532 - DNA, 44 bp, Homo sapiens; identical to SEQ ID NO: 25996
  misc_feature 1..44: note = chr1:2136044-2136088
  misc_feature 1..44: note = hyper
  source 1..44: mol_type = genomic DNA

SEQ ID NO: 68533 - DNA, 183 bp, Homo sapiens
  misc_feature 1..183: note = chr1:2136856-2137039
  misc_feature 1..183: note = hyper
  source 1..183: mol_type = genomic DNA
ctgtcccagccacctcgccgcttcaatttcctccaggtccacaggcccagcccggcgcgcgccgctcgttctgcgacctccagggcgagcgcgcttccggggcggccgtgcaagaggcgtgggaagcgcgcggggggttctgagcgtgcagtcgccgcctgcggacggcgaaggggcgggtga

SEQ ID NO: 68534 - DNA, 80 bp, Homo sapiens
  misc_feature 1..80: note = chr1:214019656-214019736
  misc_feature 1..80: note = hypo
  source 1..80: mol_type = genomic DNA
aaaaagaaaaaagggtagagctcaaccagtgttaaagttagttctgctgaactccatacccaatgcgctccccactaaca

SEQ ID NO: 68535 - DNA, 342 bp, Homo sapiens
  misc_feature 1..342: note = chr1:214155741-214156083
  misc_feature 1..342: note = hyper
  source 1..342: mol_type = genomic DNA
cttctcttttcgctgcgtcaggcaggcacctacttatttctagcccactcctcaccctgaataaaagcttctggtaagatggacaatatggaaaacttcagtcctatcaccaaagcccctgaaaatggagcacccccgaattcacatccttgacgtgaaagaccaaagagagggaagctgggagtaacggccaaacatccttagagtaattgacaaaagaaagggggtgggcagaaagggagatttccatcccttcaaacgtgcacgcccctcccgcggtcccgggagggagtcccccctcccaggtcgagcgcgtccaccggctgtccccacagcaacagg

SEQ ID NO: 68536 - DNA, 121 bp, Homo sapiens
  misc_feature 1..121: note = chr1:214156134-214156255
  misc_feature 1..121: note = hyper
  source 1..121: mol_type = genomic DNA
cgaaatcccccggccaccacgacgttccccggctctgcggcgcgccgggagcaggtggttgccctctgcgtccagggcgtgtactgagcccaggctagctgagcgaggctgcagcccctgc

SEQ ID NO: 68537 - DNA, 23 bp, Homo sapiens
  misc_feature 1..23: note = chr1:214156256-214156279
  misc_feature 1..23: note = hyper
  source 1..23: mol_type = genomic DNA
atggcccgggaagaggcaagtgc

SEQ ID NO: 68538 - DNA, 556 bp, Homo sapiens
  misc_feature 1..556: note = chr1:214156394-214156950
  misc_feature 1..556: note = hyper
  source 1..556: mol_type = genomic DNA
cgctcgctctctctggccggagaggccgcgacacctagcgcggggccgaggctaggaagggcgggccggggagggaggagggcactgggaggaagccgcgggcgaggaagccccgctcctgccgagtgcctggagaggagattcccagccttcctgcccaacccgaaacttttccaacacacgcaggcgtattcctcgcaggattcggcggtcccgagtcgcagtcagggaggaggctcgggaagcacacgtgccctggcacactggaggaggtacacaggcacaccaggagggacagggcctcttgggaggcggctgagggcgtgaaggcagcaggcggccacacatccgaaagggactccctgcgagcgggatcgagcgcttaaaaccctgccacagcttggaagtgtagcggtgcccagaggctttgcgtaactttgcccactgcgcccccgcgtgcaaaggtgtccccttcacactcacaccctcaccccatctcactccccttgagttgcggcccgagactgcctttgtacttaagcgacagcaaaagata

SEQ ID NO: 68539 - DNA, 131 bp, Homo sapiens
  misc_feature 1..131: note = chr1:214158780-214158911
  misc_feature 1..131: note = hyper
  source 1..131: mol_type = genomic DNA
cacggagctgggctgcgaaccgatctcgctcgcctagcgtggcgcgcgctcctatttcaagtcgccgctcctgcgccctaatgcgggctgcgaaccgccgcggcagagcgtcgcgagccgggagcctctgc

SEQ ID NO: 68540 - DNA, 181 bp, Homo sapiens
  misc_feature 1..181: note = chr1:214159036-214159217
  misc_feature 1..181: note = hyper
  source 1..181: mol_type = genomic DNA
cgccagttcccgggcgtggtgtgtgcaaaacgtgcattcaagcgctatgtgcaattgacacaaacttgtgggctaaagtgcaagccatttttttcgcgtttgaatctttttctctgtccctgactcctttcttccccctactcccccctcctccttctctgctctccgcccttttaaatgt

SEQ ID NO: 68541 - DNA, 135 bp, Homo sapiens
  misc_feature 1..135: note = chr1:214159562-214159697
  misc_feature 1..135: note = hyper
  source 1..135: mol_type = genomic DNA
cctctgtgttgcttccgtgatagacgcgtggggggagtgtgtgggggcggcaaaaggggaaagaagaaggctggggatgctcccgcaatctcttttcttatcgccgacacctaacctgaccgacctaattttttt

SEQ ID NO: 68542 - DNA, 88 bp, Homo sapiens; identical to SEQ ID NO: 38731
  misc_feature 1..88: note = chr1:2141596-2141684
  misc_feature 1..88: note = hypo
  source 1..88: mol_type = genomic DNA

SEQ ID NO: 68543 - DNA, 319 bp, Homo sapiens
  misc_feature 1..319: note = chr1:214160107-214160426
  misc_feature 1..319: note = hyper
  source 1..319: mol_type = genomic DNA
tgctttattaaaagccgtttactgtgcccggtgaaagggacgttctagctgcggctgaggctcgcttgcatttgtaacttgcaaagcccaaggagatctttaagagccacattatctaaagaaattttgctggttatttttcaagcaagaaatgtcaaaccaaagtaaattttctagggctttattttagagcctgcgatttatgcgtttgaaatttcttgcctaataaactttaaagtttgttgcccaggcgtcaaaactgtgtaaatcctgtattgaacagctatctttggtctttctggggcgagtgaattagtga

SEQ ID NO: 68544 - DNA, 30 bp, Homo sapiens
  misc_feature 1..30: note = chr1:214162192-214162222
  misc_feature 1..30: note = hyper
  source 1..30: mol_type = genomic DNA
tggggtgtgaggaggcgtttgctccctttc

SEQ ID NO: 68545 - DNA, 393 bp, Homo sapiens
  misc_feature 1..393: note = chr1:214162457-214162850
  misc_feature 1..393: note = hyper
  source 1..393: mol_type = genomic DNA
accccagcagaggaccgggaactgggaggaggagagagggaggtgggggggcgctctgttactttcgtctcaaaacgctgtcgaagccgaattgtggaaatccggcttggaggggagcggtgatgggtcccgggaaacgcgcgcggcgcccctcttccgagctcctggacccagggctgggtcaagttgagtagggtaaggcggcaccgggaggctcggggggtcgcgtggcggtgggattgggacaccagcacgaggaggaccggaggatcgcgggccgggtaagagtagggggttcttgggcagcagaaatgggaggcgatgaatctcccagccatcgctggcagactatggtgttgggcagcttcggtctggtctcgtctgggtggtacc

SEQ ID NO: 68546 - DNA, 44 bp, Homo sapiens
  misc_feature 1..44: note = chr1:214193286-214193330
  misc_feature 1..44: note = hypo
  source 1..44: mol_type = genomic DNA
ttgcccaaatcactccgaagtctacaatgcgaaatgaagtgact

SEQ ID NO: 68547 - DNA, 286 bp, Homo sapiens
  misc_feature 1..286: note = chr1:214360467-214360753
  misc_feature 1..286: note = hyper
  source 1..286: mol_type = genomic DNA
gctgctgtaattctgcgatcccctgacgctggtatttgagaaacacactctggaaacgctgtggttgtttttcacaggaacccagggagctatcaaagtcggagaacgtgcctctgtttgcaggagaggtgggcaggcagcgagatccccgcgcaccgctcgctcgggctgcgggcaggcagcaatcagctaattgcctaatcggagtggggagctggtgcccgctcgccgcggtcgcctcgcgggtcacagacaagagagcggcttgttttctctctgtcacatc

SEQ ID NO: 68548 - DNA, 105 bp, Homo sapiens; identical to SEQ ID NO: 5895
  misc_feature 1..105: note = chr1:214360754-214360859
  misc_feature 1..105: note = hyper
  source 1..105: mol_type = genomic DNA

SEQ ID NO: 68549 - DNA, 114 bp, Homo sapiens; identical to SEQ ID NO: 26844
  misc_feature 1..114: note = chr1:214360926-214361040
  misc_feature 1..114: note = hyper
  source 1..114: mol_type = genomic DNA

SEQ ID NO: 68550 - DNA, 148 bp, Homo sapiens
  misc_feature 1..148: note = chr1:214387629-214387777
  misc_feature 1..148: note = hyper
  source 1..148: mol_type = genomic DNA
tctccttcctcaaagcgagctccagagtagaaactgcaattgtgtatttgaaattctccagtcaccaaatccaagaaaggtgaagaggaactgccccagtggcgtctgcgaggcgtttcctctataaagctgtcgtccctagctctgg

SEQ ID NO: 68551 - DNA, 73 bp, Homo sapiens
  misc_feature 1..73: note = chr1:214638017-214638090
  misc_feature 1..73: note = hypo
  source 1..73: mol_type = genomic DNA
ccctgtgctttccaccgacagcgtgcactcgataacattgctgtccagcaggcgaatccgtgtgacaaagcag

SEQ ID NO: 68552 - DNA, 39 bp, Homo sapiens
  misc_feature 1..39: note = chr1:214724448-214724487
  misc_feature 1..39: note = hyper
  source 1..39: mol_type = genomic DNA
aagtcatctgcagggcgcccggagcgccaaggcggcctc

SEQ ID NO: 68553 - DNA, 43 bp, Homo sapiens
  misc_feature 1..43: note = chr1:214724743-214724786
  misc_feature 1..43: note = hyper
  source 1..43: mol_type = genomic DNA
agcacggggctgtcccgcccgaggaggccggggaggatggctc

SEQ ID NO: 68554 - DNA, 348 bp, Homo sapiens
  misc_feature 1..348: note = chr1:214725213-214725561
  misc_feature 1..348: note = hyper
  source 1..348: mol_type = genomic DNA
ctcccgagctggaggcgcgccgtccttggggacgtcacagcgctggaatccgaggaatgccgggctgcaggagctccttctgcaggcccggagaagtcgcacacttttaatggggtagttttggaaaatgttttaaaaggtgggggccgaggacggaggaccggatgaaactccctggagtaagagacgtggaagtggagagagcaaggcgaccgcagccaccccaaccctgggctgctcccgccgttggggagaaagaggcaaggcaaggaagagcccacctagacttccgaggaccgcagagacggggcggcggcaggaacttgctcaccccgacctacattcaga

SEQ ID NO: 68555 - DNA, 164 bp, Homo sapiens
  misc_feature 1..164: note = chr1:21523130-21523294
  misc_feature 1..164: note = hypo
  source 1..164: mol_type = genomic DNA
aggataaagtccagtcgtcctcttatgacccgtaggatgcagcgaatggcccctgcctctctctctctccatcccccctctctccatcatcttcagctgcactgggccttcttccagttgcttgcatatgtccaagcctcttcctaattcggcgttacaaatgc

SEQ ID NO: 68556 - DNA, 1813 bp, Homo sapiens
  misc_feature 1..1813: note = chr1:215255060-215256873
  misc_feature 1..1813: note = hyper
  source 1..1813: mol_type = genomic DNA
tcatcaggggattcccgctgagaaagtgggaaggaagagagtttagaaacggattgaagttccactacatcacgtgtgttgttagagaattcgcctattacgacgacagcaacgtctgatctcctggctttcttcccctccttggtgggttccgttccgtccccctgtcgctgcgagtttggctgtccctacgccggggtcttggagtttgggcggggtctggtacctgccaaatacggatcctgatggggaggaggtcggggagcgctaagttcaggctggagtctgagttctcccaccctgctgctcccacccaccgcgcttagaaacctatgtttccagcaaaggggtcttgctctgagagaacctaaccgggttttcttccattccctttgcatctctagatgtcttcgccctggctccaggtgcgttccccatccttttcggtcccggacgttctgcagattatagcgcccagctcatgtccagcaccgccggaggtgaagtggggcgagctggtgactccttaacccttcccgaaggtgtagactggaagaagccagggtcttcattacctcccctactccagggctctcaaggcgccaacggggacacttccctgtacaggtctggggggccacgagggcgaggaggacgccctagtgcaggggtccaaggactcgcgtcccagagcttggtcccacacccggtcccacaccccgaacgctggtcgggaaggagataggatgcagcgcagtgtgatgtggatgccagacagcgagagtgaggattttgcggggtggggatgggggttagtggaaggggctgagaggggaggaggcagcaggtgagccaaggggttgtgcccccaggaagagggaagagaggatctttagaagggagcatcttgcaggggcgacgcaggcaagggtagggctaggaggaggtgcggggaagcaagccctggcggtgagacaggagggggaggaggcgaagaggagggagttccgaaaggagggaaacgagccggcaaggggcgacaggagcgagccgggaagggagagcagcggagggctgcagagctgcgggcgcccggaccgtgccacacaccccccgcggggcacggagggcattgcggggggagacacacaaagacatgcgaagaggggctgaacgaggctcgcgcacaaagacgccggggcgcacggcagctggggctgcacccaccgcccccgcgccgcgccgtgccggggccgggccagcgagcagcccggggctgagcgcgtggcggcggcggcggcggcggcggcggcgggcaggcgcgggacccgggtcgcccgcgctctccgggtgacccgggcccggcagcaggcgcgcgcgggggcggcggcgcccaagcccaacttggcctccgcctcgccctctgcccagcccgccggtgtcccctccttcccgcgatttcgtttcttctcacgctcccccccccgccccctcccgcgtccagccccgctctccccaccttgtaaaacaaagccggggaaaatgcctgcccgtgcagctcggagcgcgcagcccgtctctgaataagaagtgagtacaatggcgtgtttgtaaaaaaaagcttcaagtccgtctttttcaaaaaacattttgaatgctgcatgcctcatgcttcccagcgcctcgcgggagagacccggctatagagcaggaggtgagaccccccctccggtacccccacccctctggccgcacgctctcctgccccagccttttctgggaggactgcaaatgccccctctcagcaagcggc

SEQ ID NO: 68557 - DNA, 18 bp, Homo sapiens
  misc_feature 1..18: note = chr1:215256953-215256971
  misc_feature 1..18: note = hyper
  source 1..18: mol_type = genomic DNA
cgccgcttctcccccctc

SEQ ID NO: 68558 - DNA, 51 bp, Homo sapiens
  misc_feature 1..51: note = chr1:21568327-21568378
  misc_feature 1..51: note = hypo
  source 1..51: mol_type = genomic DNA
aatctccaaaaggagcgagggtctgatcgatctgaccggtcaggaagcctg

SEQ ID NO: 68559 - DNA, 83 bp, Homo sapiens
  misc_feature 1..83: note = chr1:21573351-21573434
  misc_feature 1..83: note = hypo
  source 1..83: mol_type = genomic DNA
atgttgcccaggctggtctcaaacgcagggactcaagggatcctcctgcctctgtctcccaaaagtcccgcaattacgggcgt

SEQ ID NO: 68560 - DNA, 294 bp, Homo sapiens
  misc_feature 1..294: note = chr1:21573828-21574122
  misc_feature 1..294: note = hypo
  source 1..294: mol_type = genomic DNA
gcaaccagttgatggcgggtgccaaggtctgcaagggaaaaggacagtgtgaccctgtggggctgctcctcctcacagcccagggctctaggacgggcttctacaggaagcaaaggaaagagcttgggcttggcgccatctgacagcgcaccgggcagagagtcaagcggagcctggcgggcttttgtcagagatgctgtaggtagaattctaaggagtccaacaccaaaatttaacctgaaatggaatgaggatgcaatgagaagatgcagcagctgccgctaccattcagca

SEQ ID NO: 68561 - DNA, 17 bp, Homo sapiens
  misc_feature 1..17: note = chr1:215745270-215745287
  misc_feature 1..17: note = hypo
  source 1..17: mol_type = genomic DNA
gccgagataaactttta

SEQ ID NO: 68562 - DNA, 141 bp, Homo sapiens
  misc_feature 1..141: note = chr1:21586789-21586930
  misc_feature 1..141: note = hypo
  source 1..141: mol_type = genomic DNA
tggccctgagctcctcgatcctggtctcgttcatgcacgcacggtagtatacttgcgcctttctctctgcctcgctcacgctggccgtggagttttctggaacaacagacagtggagtttgcaatgcggccccacttgccc

SEQ ID NO: 68563 - DNA, 30 bp, Homo sapiens
  misc_feature 1..30: note = chr1:21594515-21594545
  misc_feature 1..30: note = hypo
  source 1..30: mol_type = genomic DNA
tgatttttttgtatgcgttcatcttacagt

SEQ ID NO: 68564 - DNA, 40 bp, Homo sapiens
  misc_feature 1..40: note = chr1:21611198-21611238
  misc_feature 1..40: note = hypo
  source 1..40: mol_type = genomic DNA
gctgcctggggcccacgagacaagccgggagcagaaaggg

SEQ ID NO: 68565 - DNA, 30 bp, Homo sapiens
  misc_feature 1..30: note = chr1:216705663-216705693
  misc_feature 1..30: note = hypo
  source 1..30: mol_type = genomic DNA
agcattttgacataacggggatcaagccgc

SEQ ID NO: 68566 - DNA, 32 bp, Homo sapiens
  misc_feature 1..32: note = chr1:216774823-216774855
  misc_feature 1..32: note = hyper
  source 1..32: mol_type = genomic DNA
aagaggattccttgtcgcgagttgtcttggtt

SEQ ID NO: 68567 - DNA, 35 bp, Homo sapiens
  misc_feature 1..35: note = chr1:21682446-21682481
  misc_feature 1..35: note = hypo
  source 1..35: mol_type = genomic DNA
ttcaatcccggtctgcgctccgcaattgcaggata

SEQ ID NO: 68568 - DNA, 113 bp, Homo sapiens
  misc_feature 1..113: note = chr1:216896454-216896567
  misc_feature 1..113: note = hyper
  source 1..113: mol_type = genomic DNA
acacaaacaagcagtcgtgcacacaaaatacccagggcattacctgaatcagtgtgtaaagatatagtctgtccgcccccacccccgcacccccacgacgagtttaaaaagga

SEQ ID NO: 68569 - DNA, 87 bp, Homo sapiens; identical to SEQ ID NO: 5901
  misc_feature 1..87: note = chr1:216896887-216896974
  misc_feature 1..87: note = hyper
  source 1..87: mol_type = genomic DNA

SEQ ID NO: 68570 - DNA, 30 bp, Homo sapiens
  misc_feature 1..30: note = chr1:216897216-216897246
  misc_feature 1..30: note = hyper
  source 1..30: mol_type = genomic DNA
tgggaaaggattctgcggaaggtagagaat

SEQ ID NO: 68571 - DNA, 49 bp, Homo sapiens
  misc_feature 1..49: note = chr1:2170934-2170983
  misc_feature 1..49: note = hypo
  source 1..49: mol_type = genomic DNA
ccatgtgggtgtagccgttggcggcacctttgtacggggacacaccctg

SEQ ID NO: 68572 - DNA, 373 bp, Homo sapiens
  misc_feature 1..373: note = chr1:217262983-217263356
  misc_feature 1..373: note = hyper
  source 1..373: mol_type = genomic DNA
ctttaactgggctcccgcgacctcggcaggcgagggggtgctggccggccctccggtggcaagggcacggccccccgctctgcccccgcgggcgcggggccggcctggcacccggggtccgcgtcccgagcggctgtgcactcaccgagccgggctgcgaggggcagaggggcgcccacggctagccggagcgccaaggcgcctcccttttctcttggtagcgtcggtccgcactccctgtgacccaggacgtcatgatgcctgtctgttttctcaatgataacttggcagaagaagagagaggctgccaggttctcctcgggtggttacgtggtatgtgcacgattctgtttgcatgcgtttctctttttaa

SEQ ID NO: 68573 - DNA, 30 bp, Homo sapiens
  misc_feature 1..30: note = chr1:217307206-217307236
  misc_feature 1..30: note = hyper
  source 1..30: mol_type = genomic DNA
gagatactgagacatcgcacctccagcacc

SEQ ID NO: 68574 - DNA, 1839 bp, Homo sapiens
  misc_feature 1..1839: note = chr1:217307467-217309306
  misc_feature 1..1839: note = hyper
  source 1..1839: mol_type = genomic DNA
gctgcaatgtgagctcgggagggaactggggatgcgagctgggaacagaccgcgctccagcccccatggtttgtgacggggaacttcgggcgcacacaccctggggagtaggtctcctccaaatggcaccgacacagactggcgctggatcttctctccctgctaatctatccgcaaagaccgcctgggcacttttgggggaatgtggccaaaaggggactctaactgcgacatctacagaggaaggagaaactggtggtgcctaagaagttgatctcgatgcgcgcagtgagggcacagggccctgcgcgccagagaagcgaagccagcggtctccacttacttgttcttaattcctccctacccccgctctggcctctcattttcggcctcatggatccaagacccgaggttattttcagtcacaactttctccacaccccgtacccccaaaagtgtacctcagctcaggcgggaaagggcactttgacccgccgtgcgcgagtttccagccagccgctgcgcgcctgagagaaagagcgcctggctgcggctccgagcgcacagctcttccccgcgtgtttggcgcggctacgtttctcttgctccgggctgaggctcgaggaacctcgccagcctgctgtggtcccgtccccttgacgtttgatttctaaaaccgcatagtctgcggctctggcatttagaaaaagaggacaaggtcaaggcctgtggaccgaccgccgcgatccgcttgcacctttgctctcacagcaagcgagtcctggccgcagccgctggaaaaaggtgccgcagcgcccagtttacctggaattcagggacctgaccctgactctatttccggctagtcccagcctctccttcctctcctttccccgctttccgcccagggcggttctgagattttgattaagagagatctgtccccgcaccgcagagggatggtgccaaatggccaggcttcctgggcactgcgtcctcattcccaggtcagagctactgcgaaaggaaaggtctccatctggacgcacctcgtcccctcccccagcgcgcggggcagccctctagggccagctcgggcacgcgcttttccccctcctcaccccctgctccgcccagccccgtacagttttattctttatgaaacacacacgcccaccccgcctcccacgtaaaggccagtcttgactcattttgcgcccagatgcaaactcagctggaagttgagggtagggccaaagaggtgaggggagggtaagagatacagcgaaatagagaatgagaagggagaaatcaaagggggaggagggacaagagaaagcgtgtggagctggaggttgaaggggcagaggcggaggccaaggactgagcaaggggcgcgcgcgcggcggcggcggcggcggtgttggcggcggcggcggcagggcggctgcacctcctcccagccttttcgcccgcgcgcgcgaagcggggtcaggcgcggacccacattcaccgactgcagaactgttttctttgccactaccagagggtgtttcggggctccccacggtcttctccctggctgcttgccgcgtgagagcagaaataaaacaaaacaaatcacgggacacgacggagtcgggccgctgggcgcctccgggatcgctctcactttgcactcggaagcgggcgcggggattcgggctgccgcgtgtagcctataaatagcaaactttttgaccgaagcaactaacaaataagaggagcaggcgtgcattttgctcaagatccccccttttctggggacgaccttactcccacccccgccccctttgcagt

SEQ ID NO: 68575 - DNA, 590 bp, Homo sapiens
  misc_feature 1..590: note = chr1:217309653-217310243
  misc_feature 1..590: note = hyper
  source 1..590: mol_type = genomic DNA
ttttagatggaagtgcgaaaggtgagtgcggaaggcacaaaggagttcctgcagtgcagatttcctttcccagaagcgacaataacccactcagcaactttacttcaaccctaggctctggcctaccgggagggcaaacgcgggcacccgggtcacgtcatcgcttgcttgggggcgccagctctagcgtaagcctgagctgcgagatagctccgtggggttttgccatggggtcttgcttactaatcaccccgcacgccctcacccctgtccctggacgcccttttgctgcacccgctcacatctgcagacccaacggatgggatctacttgactgagattcctgaacacaacttactgcccgcccttcccctttccttttggccaggccggattgtgggtggtgattggctcagtaggattttcattttcattctaggtgcttccttaaaaataaagccccccgaatataacagacactcgctccatacaccaaacttcccagttcctgaggttgctacgctaaatttatcctgaatgtcgcacagaaaccagggtcaataggacgatcagcacggatgggtgtgggg

SEQ ID NO: 68576 - DNA, 1217 bp, Homo sapiens
  misc_feature 1..1217: note = chr1:217310819-217312036
  misc_feature 1..1217: note = hyper
  source 1..1217: mol_type = genomic DNA
accgcgcctggggctcgagagctgacggactgccctttccaggctgccccaagggcctgggaggctgcggtaccgcctgtcggtcccggtcccgagcgcgcttgcttaagagttctcaaagacggggttggaagcagtacagacgtccccggttatcgctgccgggcttgtgcgccccacgccacctacctgtccggccttcccgctccaattgctgacccgtttagggagcccggcctggagcccgccgcctccagaggagcccgccctcgccctcccccgcgcgcctccgctctctgggacgcctggccaaatgcggggcggtctctcgcgggccattggcttgggccaccgttccgagtcagctcctaggatttccccaggctttgcggcccctttgtgggtctaggccagcgcctcaccttgcaccctattccacctccagtccccttaggtgcccccgcatccctcctccagagtccaggctttgaaactgcagcaactccgcaaagaaagcctttgggaaaacctcctagagggccgaatgtggaggtcgggtgggtgggtgggtgggtactcgcggcatttctcaaggttctgggtgttcgtaactaggggaacaggccctatgggggcagaaatgacagacgcacgaacagcgtctctgtggctgtctgcagcgcgaggttcacgtctattgttttatgcctccgggagagctaccccgcgtgatagatcttttcagatccatcactggaagaaaaaccctggtgataacgattatctcccgctcgcgctatctcgccatcgccccaattcatctccctctggctctagccccttggggagacgaggagggcgaggcgctggcaggaggaccggccaagccgctgtcctcggatggagaggagagggagaggcacgaggccacctcattcgtccctttccgcttcgggctggggagacaggacaccgagggtttctttctgtctctgccaagcctcacgcttctttcaaatgattttagcctggtgctacggtctatccatatacatttccaatctcatggctcataaactattagcaaaatggtttcattattcaccttctgtatcctacaaaagggagaaaagaaaggagcgggaggaaggcacagtgggggcgggggacagtcgtcggacactagttaacaatgatgcctccggtgtttaaatcat

SEQ ID NO: 68577 - DNA, 96 bp, Homo sapiens
  misc_feature 1..96: note = chr1:217312947-217313043
  misc_feature 1..96: note = hyper
  source 1..96: mol_type = genomic DNA
tgaaaatataaaggacgctaggcaagtgagcttgcggtaattatccctggatagagaaaccaatctggctgggagaggcccctctgcaattgccgg

SEQ ID NO: 68578 - DNA, 679 bp, Homo sapiens; identical to SEQ ID NO: 5909
  misc_feature 1..679: note = chr1:217313068-217313747
  misc_feature 1..679: note = hyper
  source 1..679: mol_type = genomic DNA

SEQ ID NO: 68579 - DNA, 146 bp, Homo sapiens
  misc_feature 1..146: note = chr1:21754473-21754619
  misc_feature 1..146: note = hyper
  source 1..146: mol_type = genomic DNA
ataagccagggggggcgttctcggcgcggagtggagtggagcggagcgggctggtgctgggggcgcggagagcgcagtgctggccggggccgggagcggggccgagcgggagcggagtcgggcgtcgggcccggggagccggggcc

SEQ ID NO: 68580 - DNA, 197 bp, Homo sapiens
  misc_feature 1..197: note = chr1:217805039-217805236
  misc_feature 1..197: note = hypo
  source 1..197: mol_type = genomic DNA
agtgctttttttcttcgacatcaccactctgcaatttgatgaaacctatgttcaataccctgactgggggtcaccctgactcactagcccaatgaactcagattgtgtcccatctacctagggatttgagcctccgttattttacaaacatcactaaactcaattgttctatgactcattcgcctttttaaaatgaa

SEQ ID NO: 68581 - DNA, 40 bp, Homo sapiens
  misc_feature 1..40: note = chr1:21831562-21831602
  misc_feature 1..40: note = hypo
  source 1..40: mol_type = genomic DNA
gattacaggcgtgtgccactgtgcccggcccctgttatct

SEQ ID NO: 68582 - DNA, 2012 bp, Homo sapiens
  misc_feature 1..2012: note = chr1:218337322-218339334
  misc_feature 1..2012: note = hyper
  source 1..2012: mol_type = genomic DNA
acttctaaaacatttcgtggaagagagtagactgtttaccggatgcccttctatttttgccgtgcaggattagtaccttctacttccttaaatgtaggcaaataaaattacggagaaataaaatgactgcagcctttgagcgctggtttgtcctaggacaatcggatttcaccgggtaacgtatatgcaaacagacacgtcccgtttatttcattgtttgcactgcggagactctccgccgctctccacgcctttgttgacctaccgccagcaaagttgtgtggttataaatagatagaggcagctgattaagaagcggggggagtgactttctctgggctcttacggatcaatcaccgctaaggggatgcaggttgaggggaaggaagaaagtaaatcgcggggcagtttgactaagtgaaacccaattccttcgccccaaagctgtggtggccagacgtgcgcgaccctctagacccaaaacagttttagtcagcaacgggtcatcagcaggaccgagaagactgggtgggaggtctggccggtccgaaatagggaagaggtgcgggctcatcaccgaggcggtagggctcggcttatggtctagagccttgaggcgctcccgcgtgagccccgctgcttccagtccgccctcgcctggcccggcgcgggtcgctccctcctccccgtcctgttccgcactttacccagcaggggtcccaggtcgagcagggccaaccctgctcgcgcagcgccggacccctccccgctgcccggggtgcggcggcttccctccgcccaaacggggggtgtctcctccatcacccctgccgcggcttcccagtcggagtcgcgctgcggggcgagggaggctcgctcctccgcggccggggcctgggggtgccagtgcgcccccgagtgagcgggtagggaagccgaagagccgccgacccgctgcgcgccctccagtcccgggcggcgccgggacccagagcggccccagcccgcgccccagcggggacgcgaacggcgtctcgggacggcacctcgccggggccttgccctgtcccgccgcgtcgcggcctctccgcaccccacgtcccgggagccgaccgggagactctcacggcggagttccacagacctcgttaggttaaaggaacctcgccttgccccccactaatcggctagagagggaggccggcgaaacaaaagccgtagaggaaaattaagcgacttccccctcggcggggaacttggaggtgggggagcggggagcggcgcggggcgcaaggagaaggaagtgctgagctgggttgccgacgaaccccgggcagggggaggtggggggctgcggcagaagaaagacaaacatctggggatcggaccatatgccggagctttgtcttgtccttcaaagttcggctgcccttgaagtgatttgtcaggcggcccacgggtgacagggaggatgtgcagcggggagcgggggcgggacatgccggggggagcggagagggctagaagagaggggaggaaggggggacgccaacaagagggggagcaaagtgaccccgccgcccgaggaacggtagaaaccgggatcgcggaggtgcgagcccgagcccgggagcggagcgcttcccggggagacgccaagacggcgagaaaggaggagcgggaacgcagaggttaagcggagggaaggccgaggagaaacagccagaggacgggaaggaggaaatagacggggagaagaaactgaagattagtcgttgaggtgtattaagaaagaggacatgtcgcctattttaggaaaagtggctttgagctccccccgcacccccaccattttttctttctcttttgcccgccaaccgctgaactgattagactgtaattaaggccataaagccctcagattatacacctgtttattcactgaagtcggggtctcatcaagcaaattagctgcttgcaggctacacattgggcctcgagcttgcctgatt

SEQ ID NO: 68583 - DNA, 254 bp, Homo sapiens
  misc_feature 1..254: note = chr1:21835380-21835634
  misc_feature 1..254: note = hyper
  source 1..254: mol_type = genomic DNA
agagtcagaggtgcacgtggacagagacagagagacagggacacgtgggcagagacggataaagacagagacccagagaaagccagatatgttgacagacacagagacagacgccagagaggaaggcagacaaagagacgggtggagacaaagactcccaccaagagacgcagaaggaagatgccgacggtaaagacaaaacaggagacgcgcgcaaggagcaggtcagagcccaggctcgctgagagaggaag

SEQ ID NO: 68584 - DNA, 505 bp, Homo sapiens
  misc_feature 1..505: note = chr1:21835915-21836420
  misc_feature 1..505: note = hyper
  source 1..505: mol_type = genomic DNA
gccgcgttgcgctcccgccactccgcgcccgctatcctggctccgtgctcccacgcgcttgtgcctggacggaccctcgccagtgctctgcgcaggtaaggattcgacgctgccccgcgccctggttccccagggccccagcggacgtggtccatccccttctgcatcctccgctggccccgtggttgaactttaatggcagggccggggtctccagcgccacgccgcccacagcagcccattcgggacgccctgcaattggtcctgcccctgtcctcccgcgcatcccaagctcccggcgcgcgctctgggcgggacaggagattggacgtggcgcccgcggagccggcgaactcaggggaccgcgctcgggaccgccctgcagtcccagggtctcctacctcccgagccgctgcctgggaccctgcgctctgtctgggcacctgcccttggtgccccgtgactgagcccctcctggtgcctccttagccgtagctctagagac

SEQ ID NO: 68585 - DNA, 30 bp, Homo sapiens
  misc_feature 1..30: note = chr1:218417045-218417075
  misc_feature 1..30: note = hypo
  source 1..30: mol_type = genomic DNA
agatttcccgccaggcgcggtggctcacgc

SEQ ID NO: 68586 - DNA, 42 bp, Homo sapiens
  misc_feature 1..42: note = chr1:21846323-21846365
  misc_feature 1..42: note = hypo
  source 1..42: mol_type = genomic DNA
gagggtggtgggccccggaccacacagcgaataaacggtaaa

SEQ ID NO: 68587 - DNA, 30 bp, Homo sapiens
  misc_feature 1..30: note = chr1:218519769-218519799
  misc_feature 1..30: note = hyper
  source 1..30: mol_type = genomic DNA
ttttttcttcttactcgccaaagtcagggt

SEQ ID NO: 68588 - DNA, 184 bp, Homo sapiens; identical to SEQ ID NO: 26864
  misc_feature 1..184: note = chr1:218520108-218520292
  misc_feature 1..184: note = hyper
  source 1..184: mol_type = genomic DNA

SEQ ID NO: 68589 - DNA, 342 bp, Homo sapiens
  misc_feature 1..342: note = chr1:218520309-218520651
  misc_feature 1..342: note = hyper
  source 1..342: mol_type = genomic DNA
cgagcgcgagaggagcgacgaagagtactacgccaaggaggtttacaaaatagacatgccgcccttcttcccctccgaaagtaagtacttattttgacttccatcccctgaggtttagctctgcccggagctctcaaaaccgcagcagctcccgggatcgcccttccctctcgcggttcccgttcgctcttttcccgttctcctgtccttcaccccaccacctccttttcagttgtatgcttgaggccatcaggctttaaaatgtttactttctactttattttctccatctttcccttccccctaacaattcggtgctttaaaaggcgttattctcttttt

SEQ ID NO: 68590 - DNA, 30 bp, Homo sapiens; identical to SEQ ID NO: 39240
  misc_feature 1..30: note = chr1:219253291-219253321
  misc_feature 1..30: note = hypo
  source 1..30: mol_type = genomic DNA

SEQ ID NO: 68591 - DNA, 30 bp, Homo sapiens
  misc_feature 1..30: note = chr1:21934551-21934581
  misc_feature 1..30: note = hyper
  source 1..30: mol_type = genomic DNA
gtcaatcccccagtccgggactccaccccc

SEQ ID NO: 68592 - DNA, 330 bp, Homo sapiens
  misc_feature 1..330: note = chr1:219347186-219347516
  misc_feature 1..330: note = hyper
  source 1..330: mol_type = genomic DNA
gcggcaacgcaggggcggaaccgcatgactggcagtggcatcagcgatggcggctgcgtcggggtcggttctgcagcgctgtatcgtgtcgccggcagggaggcatagcgcctctctgatcttcctgcatggctcaggtggatttcaattttacgtcctggttttctacagctcgggaaacatcctcccctcggttaccccagtattgcccaagtggaggtgtcgccgggcccaaatagggcccagtgggtggctcccccgtcgccagccccggctgtagatgcacgggcagcgccacctgcccccagcctcccccgttagtcttcctct

SEQ ID NO: 68593 - DNA, 37 bp, Homo sapiens
  misc_feature 1..37: note = chr1:21948897-21948934
  misc_feature 1..37: note = hyper
  source 1..37: mol_type = genomic DNA
ctgtgccatcctgagcgcggcccggcccggcccccgc

SEQ ID NO: 68594 - DNA, 30 bp, Homo sapiens
  misc_feature 1..30: note = chr1:21949180-21949210
  misc_feature 1..30: note = hyper
  source 1..30: mol_type = genomic DNA
ctgcgcgttccggcccgagcgctagaagct

SEQ ID NO: 68595 - DNA, 315 bp, Homo sapiens
  misc_feature 1..315: note = chr1:21996075-21996390
  misc_feature 1..315: note = hyper
  source 1..315: mol_type = genomic DNA
gtggcagaacctgggcgacagcccagctgtccaggcaacagctcatgctccaaggggactgggacaacttctggatcaagtggagacgtcgggataggtggggcccacggcccccatgggctccgcttgtctgcaggcgcgggaggaaggcgcacaggcttcgctgggcgagaaagctgctgtgccctggctgacgccctcctcacccgggcgctcggcgcgcttcctggcagaggccacgcggttgaccctcgccagcccattcgcggctcttggactttgtctctggactgggcagctcgcccccgccccagc

SEQ ID NO: 68596 - DNA, 30 bp, Homo sapiens
  misc_feature 1..30: note = chr1:220012557-220012587
  misc_feature 1..30: note = hypo
  source 1..30: mol_type = genomic DNA
gagctgctgttccttcggcactactgaatg

SEQ ID NO: 68597 - DNA, 162 bp, Homo sapiens; identical to SEQ ID NO: 26867
  misc_feature 1..162: note = chr1:220101049-220101211
  misc_feature 1..162: note = hyper
  source 1..162: mol_type = genomic DNA

SEQ ID NO: 68598 - DNA, 243 bp, Homo sapiens; identical to SEQ ID NO: 26868
  misc_feature 1..243: note = chr1:220101370-220101613
  misc_feature 1..243: note = hyper
  source 1..243: mol_type = genomic DNA

SEQ ID NO: 68599 - DNA, 130 bp, Homo sapiens
  misc_feature 1..130: note = chr1:220101674-220101804
  misc_feature 1..130: note = hyper
  source 1..130: mol_type = genomic DNA
cgcgatggagttgcccaggtagccggagaccagctccgccacgaagaaggcgacggtgagcaccagcatgaagagcagccggcacgtcttgccagagtagcggcccatctcgccaccagccccgggcgcc

SEQ ID NO: 68600 - DNA, 191 bp, Homo sapiens
  misc_feature 1..191: note = chr1:220101864-220102055
  misc_feature 1..191: note = hyper
  source 1..191: mol_type = genomic DNA
cggatccgtgaggcccggtacccgcctcccagattgtctcgccggccctgccccaccgctttttataacgcgaggccgagcgccaccagtccccgcacgtccagagtctaaaggagtggcgggggcagtatctgaacagcccgtgcaccgcctcccgcggcccttttcccctccctcgcggcctgggcctg

SEQ ID NO: 68601 - DNA, 86 bp, Homo sapiens
  misc_feature 1..86: note = chr1:220552703-220552789
  misc_feature 1..86: note = hypo
  source 1..86: mol_type = genomic DNA
tcccctggagttgggcggcaaactcctcagggagtcggaggagactccgactgccctggccaaactcctctttgttccaccagtcg

SEQ ID NO: 68602 - DNA, 136 bp, Homo sapiens
  misc_feature 1..136: note = chr1:220636394-220636530
  misc_feature 1..136: note = hypo
  source 1..136: mol_type = genomic DNA
tgctcttgggggagctgggaacaggtaggatctgccctcccaggtgtcgctgcagctgcagcacctgtggctgcagacttgggcctccggcttcaggaagtcggtagaagcagggaacaagcgggaaacctgtccc

SEQ ID NO: 68603 - DNA, 137 bp, Homo sapiens
  misc_feature 1..137: note = chr1:220700814-220700951
  misc_feature 1..137: note = hyper
  source 1..137: mol_type = genomic DNA
gagggtgctgcagggcgcccagagcgagacgtcttccgccggccccattcccgaagaggccgcgccgtcgggggctgagacccacttgtactgagtctccagccgcctccctaggctgctggcgcttctaggggctt

SEQ ID NO: 68604 - DNA, 370 bp, Homo sapiens
  misc_feature 1..370: note = chr1:220702115-220702485
  misc_feature 1..370: note = hyper
  source 1..370: mol_type = genomic DNA
ccacagcccggccggcgagaccccggccagaccccgctgcccgcacaaaatgtcggcccggacgccattgccgacggtgaacgagcgggacacggaaaatgtgagtaaccggagcctccctcgggagcagtgggggcgagaccctcctctgatccccacttcacccgcgcttgggccgtcccccgtgcctcggcgcggccacccgcggcagggtctccacctggagcccggcgtgaccctcacccactgctcagccctattcttcattccaaccccatttcgcttgtttcccctcaagggtgagggtagggaaccgtaagtggcgccctctcgctcggaggtggtcctccaggggcggatggggtgatgg

SEQ ID NO: 68605 - DNA, 553 bp, Homo sapiens
  misc_feature 1..553: note = chr1:220863640-220864193
  misc_feature 1..553: note = hyper
  source 1..553: mol_type = genomic DNA
gcccccccaatcccccgccccgtccgggctggggcggaggagcgggcggggaccaaaggttggtgtctttgcgctcggaccttcgccagaggggccgggacatcatgacggtgggagccaggctccgaagcaaggcggagagcagcctcctgcgccgcgggccccgagggcgagggcgaaccgagggggacgaggaggcggccgccatcctggagcacctggagtacgcggacgaggcggaggcggcggccgagagcgggacgagcgcggcggacgagcggggcccggggacccggggcgcgcggagggtgcacttcgccctcctgcccgagcgctacgagccactggaggagccggcgccgagcgagcagcccaggaagaggtaccggaggaagctgaagaagtacggcaaggtaggggccctgcgccaccactgcccggggggcgcgggtgtggtgtcccgcgggggagcgggagccgggtccttaccatcgactcacccagtttctccgggctgcacctgcgacccctccgcccccgctcccattccctc

SEQ ID NO: 68606 - DNA, 120 bp, Homo sapiens; identical to SEQ ID NO: 38884
  misc_feature 1..120: note = chr1:22092109-22092229
  misc_feature 1..120: note = hypo
  source 1..120: mol_type = genomic DNA

SEQ ID NO: 68607 - DNA, 494 bp, Homo sapiens
  misc_feature 1..494: note = chr1:220921566-220922060
  misc_feature 1..494: note = hyper
  source 1..494: mol_type = genomic DNA
gaccaccccagaggccgccccattagctcgcttgctttgggcggcgtcgctcccacggcgcccagggtacccccgccgctgtctgcctgtcttcctccattaccgcgcaggcttggtcaccgcattaaggcattcccgctctccgcggaactgctctgccgtctcggcggtgaaagtgtgagagggtccgtagttgggtcaactttgactcctctcgcctgcccggatccttaagggcctcctcgtcctcccggtctccggtcgctgccgggtctgtgcgccggtccgcgcccgccctcgctctgccatgggcgcttccagctcctccgcgctggcccgcctcggcctcccagcccggccctggcccaggtggctcggggtcgccgcgctaggactggccgccgtggccctggggactgtcgcctggcgccgcgcatggcccaggcggcgccggcggctgcagcaggtgggcaccgtggcgaagctctggatct

SEQ ID NO: 68608 - DNA, 602 bp, Homo sapiens
  misc_feature 1..602: note = chr1:220960001-220960603
  misc_feature 1..602: note = hyper
  source 1..602: mol_type = genomic DNA
attggtcacttgcagcgatcgtggggtgggggagggcacagcgccctgcagcgcaggcgacggaaggttgcagaggcagtggggcgccgaccaagtggaagctgagccaccacctcccactccccgcgccgccccccagaaggacgcactgctctgattggcccggaagggttcaggagctgcccagcctttgggctcggggccaaaggccgcaccttcccccagcggccccgggcgaccagcgcgctccggccttgccgccgccacctcgcggagaagccagccatgggcgccgccggctcctccgcgctggcgcgctttgtcctcctcgcgcaatcccggcccgggtggctcggggttgccgcgctgggcctgaccgcggtggcgctgggggctgtcgcctggcgccgcgcatggcccacgcggcgccggcggctgctgcagcaggtgggcacagtggcgcagctctggatctaccctgtgaaatcctgcaagggggtgccggtgagcgaggcggagtgcacggccatggggctgcgcagcggcaacctgcgggacaggtacggccaagcgccggcgcggggcagcgctgatccggctcg

SEQ ID NO: 68609 - DNA, 1237 bp, Homo sapiens
  misc_feature 1..1237: note = chr1:221051973-221053210
  misc_feature 1..1237: note = hyper
  source 1..1237: mol_type = genomic DNA
cgctctcccgggtttcgggaggcagcctgttttgtagcctctgaggctccggggaaaggtttggctgcgtctaagagagacgtttggagccatccgtcttattttgtttgaaaagtcactcgttcaatttgtcactgtgtgacagctcagaataaaaccaatttgcggccgcccctcctcctcgcttcccggaggatctcctgggaggcacgaggcggacgcggtgctgagttgggccgggactcagggcggcaacatttgggcaagggcccaggaaagatgaggggctttgccgaggacacggactcctggaataaaagcagaatgaggtcaagagaagggaagcaaaggggccaaagcgcgctccgctctccaccgggaggcgggctttgcagagccctaaagagtgagattaccgtcccttccccacgcccccaactcgccccgggtgacaagcgcttcaggaaagctcctgtgatcaaccctccttgccccgtggcggttcggagctgcagaagttagaagagagtcagagccctccggagcggctgcctggcccctacgcagagtagcaagaagcactgcgatgtgcgctactaagcccacgcggccgcagcaaaaactttggcgtggccggggcgtggctagggtccggccaggcccccttgttcctaattcccctccactccccgctcccattggtcacgaggatgaccaatgagcgctcggatcgaggtcctaccccgggcctgactcgaaagctcctgccaaaactttgggagtttttagagacgagtttttttttttttctattacttttccccccccctaactaacggactattattgttgttgttttaaatttagctcttagggcttagctatttgggttttcttgcggtgtccggctcccgtctccctggctcccccgcccgccctgcggccccagcgcccctcgctctcatccagcccgcgaggagtgcgggcgccgcgccgcctttaaagcgaggccagggagcgaggcggtgaccggccgagatccggccctcgcctcctccctcggtggcgctagggctcccggcctctcttcctcagtgcgggcggagaagcgaaagcggatcgtcctcggctgccgccgccttctccgggactcgcgcgcccctccccgcgcgcccacccacccagtccggctggactgcggcagccgcgcggctcaccccggcaggatgttcgcagc

SEQ ID NO: 68610 - DNA, 655 bp, Homo sapiens
  misc_feature 1..655: note = chr1:221053255-221053910
  misc_feature 1..655: note = hyper
  source 1..655: mol_type = genomic DNA
cgcttactgctcctcggccggcccaggcggctgctccttccccttggaccccgccgccgtcaaaaagccctccttctgcatcgcagacattctgcacgccggcgtgggggatctgggggcggccccggagggcctggcaggggcctcggccgccgccctcaccgcgcacttgggctcggttcacccgcacgcctctttccaagcggcggccagatccccgcttcgacccaccccagtggtggcgccctccgaagtcccggctggcttcccgcagcggctgtctccgctctcagccgcctaccaccaccatcacccgcaacaacaacagcagcagcaacagccgcagcagcaacagcctccgcctccgccccgggctggcgccctgcagcccccggcctcggggacgcgagtggttccgaacccccaccacagtggctctgccccggccccctccagcaaagacctcaaatttggaattgaccgcattttatctgcagaatttgacccaaaagtcaaagaaggcaacacgctgagaggtaggtcttgggcgggaggctgcaggcctctgaccactgacccactccccggaccccgggctggcttggggtgcctttgagtgtttttacaattaaggacaaatcggtaaaacgggaga

SEQ ID NO: 68611 - DNA, 401 bp, Homo sapiens
  misc_feature 1..401: note = chr1:221067432-221067833
  misc_feature 1..401: note = hyper
  source 1..401: mol_type = genomic DNA
ccctaactcctgcctcgtaggcagcggtggggagccgcaggctgctccccgagtcccaacgctactagggtgctgtaacagtgatgaggcggcgttgcagtctggctaggcgctgcagcgggcaccagctacgttttgctgtcggcggcagttacccggacgcaagttaaggggtaggcgcgcagaggcggttggaggcgggcggccggcccctgacctcggagagctgcgccgagcagggcggaaaatttatggtctgtgtacactttctggctccagagccccgcgcaccagaaggatggggccctgcgagcgcgccccaggccgcgagctggggccgcaggcgccacggccatgtatagtgcccacccgactctgttctgcagcgctgtggtcataaa

SEQ ID NO: 68612 - DNA, 36 bp, Homo sapiens
  misc_feature 1..36: note = chr1:221176286-221176322
  misc_feature 1..36: note = hypo
  source 1..36: mol_type = genomic DNA
tctgcctttcttttgcggttcttctagttcattttc

SEQ ID NO: 68613 - DNA, 90 bp, Homo sapiens
  misc_feature 1..90: note = chr1:221252407-221252497
  misc_feature 1..90: note = hypo
  source 1..90: mol_type = genomic DNA
caggcgaggatagatcggtgtcccatcctgaaggggctgtccttttcacacaggcatttatttatttatttatttatttatttatttatt

SEQ ID NO: 68614 - DNA, 38 bp, Homo sapiens
  misc_feature 1..38: note = chr1:221320657-221320695
  misc_feature 1..38: note = hypo
  source 1..38: mol_type = genomic DNA
ctgggattacaggtgctagccaccgcacccggccccaa

SEQ ID NO: 68615 - DNA, 341 bp, Homo sapiens
  misc_feature 1..341: note = chr1:22140673-22141014
  misc_feature 1..341: note = hyper
  source 1..341: mol_type = genomic DNA
ggtttcgaataagggattgtagatttgaattaaattaaattaaatcatttaatccttacaatcattctgagattgattaatcatccccattttaccgatgaggaaaatgaggctcagagagggcgagtaactcgcttgggatcacacagcgggcaggggacagagtagagttcggggtcgcgccgcgcggctccagtttccgtgccttccgctgcagccgacctggcggaactgtgcgggcagacgtggcagggggacgggctgctgctgcgctcgcacgccgcatcgcgcaggttctacttcgtggctccggacaccgactgcgggctctgggtgcaggc

SEQ ID NO: 68616 - DNA, 293 bp, Homo sapiens; identical to SEQ ID NO: 26129
  misc_feature 1..293: note = chr1:22141015-22141308
  misc_feature 1..293: note = hyper
  source 1..293: mol_type = genomic DNA

SEQ ID NO: 68617 - DNA, 53 bp, Homo sapiens
  misc_feature 1..53: note = chr1:221706685-221706738
  misc_feature 1..53: note = hypo
  source 1..53: mol_type = genomic DNA
ttaaggagcttgctccggatgacaaggcaaatgcctggcggatagggatttgg

SEQ ID NO: 68618 - DNA, 357 bp, Homo sapiens
  misc_feature 1..357: note = chr1:221914136-221914493
  misc_feature 1..357: note = hyper
  source 1..357: mol_type = genomic DNA
tgaattgttgcccaccggatctatctctgatttcagagtgtctgcaaaaagacagctccttcctcctgtaggcacaggggcactctacaactcaggcttgctaactcttcttcttctattagacatgcacatagcaaagacgccaaaccccacgccaagagacgctcacctaaacgaactttaagagctatcaggaaaaatgccatctatcatccgtctacacacgaccgtcaccattctcatccgtctacacacgaccgtcaccattctctgacacagaaccaaagtgtcacaggcggaatccacactcacgcgcgcacacggggcacgcacccatcacgtcggcagatctccaac

SEQ ID NO: 68619 - DNA, 166 bp, Homo sapiens
  misc_feature 1..166: note = chr1:222210334-222210500
  misc_feature 1..166: note = hypo
  source 1..166: mol_type = genomic DNA
gcaaataaagcgaggcgagatgggcattcctgggtggaatgtcatttcacgggaggactcaaaaggccacactgagagcataatggatgagcagagaccttcagggagagtgggaacaagctgtgtgggcgtttgtggaagaagcagtgagcgagaagaccctgag

SEQ ID NO: 68620 - DNA, 167 bp, Homo sapiens
  misc_feature 1..167: note = chr1:222279248-222279415
  misc_feature 1..167: note = hypo
  source 1..167: mol_type = genomic DNA
tccaagccttgatcccggattatctcctgatggtccctgatctccactcctctctgcttccagtcccactgtcctgcaattacacaggaagcactggaccaagaagccagggcagagaatagcggatgagatgaggatggtcagtgtggcatcgggagcgggggaag

SEQ ID NO: 68621 - DNA, 30 bp, Homo sapiens; identical to SEQ ID NO: 39244
  misc_feature 1..30: note = chr1:222391027-222391057
  misc_feature 1..30: note = hypo
  source 1..30: mol_type = genomic DNA

SEQ ID NO: 68622 - DNA, 135 bp, Homo sapiens
  misc_feature 1..135: note = chr1:222794527-222794662
  misc_feature 1..135: note = hypo
  source 1..135: mol_type = genomic DNA
aagatttcacaggcccggattgtcgttttgtgaattttaaaaaaggtgatcctgtatatgtttactataaactggcaagaggatggcctgaagtttgggctggaagtgtaagtaaaatatcgacatactttattt

SEQ ID NO: 68623 - DNA, 187 bp, Homo sapiens
  misc_feature 1..187: note = chr1:222987570-222987757
  misc_feature 1..187: note = hypo
  source 1..187: mol_type = genomic DNA
ctcctggccagctaccggtacaagccaagctctcactccataacgtccttcttctctgcatgcccttctccactgtgcctgtcctttaactcttattcatcatttatttcagtctcaattgaagagtcattatttctagaaagccttctccgcccagctctctacattgcaccgttccctacagcac

SEQ ID NO: 68624 - DNA, 267 bp, Homo sapiens
  misc_feature 1..267: note = chr1:223302777-223303044
  misc_feature 1..267: note = hyper
  source 1..267: mol_type = genomic DNA
ggaaggccctgctcccgaccgacccggagcgcgctgctgccctctaccggtcatccgtgcggccggacaccgtgtcaggcccgcgaggagggctctgccgcagtcccggggaacagcacccagcagcgccactgggagaggaaactggggtcagggaggtgtgactgggccccaggcagtcacactcaggccaacaaggtcagggagggagggcagctcactcgtgcaaacgtgagtgcaaaatgcactccacggccaggaacaggc

SEQ ID NO: 68625 - DNA, 179 bp, Homo sapiens
  misc_feature 1..179: note = chr1:22333829-22334008
  misc_feature 1..179: note = hypo
  source 1..179: mol_type = genomic DNA
cccagacccctgactcggtgctttttatccttgcagccaatgggccactcccagacaagctgcagcaggcccggctgcccgtggtggactataagcactgctccaggtggaactggtggggttccaccgtgaagaaaaccatggtgtgtgctggagggtacatccgctccggctgcaac

SEQ ID NO: 68626 - DNA, 30 bp, Homo sapiens
  misc_feature 1..30: note = chr1:223361283-223361313
  misc_feature 1..30: note = hypo
  source 1..30: mol_type = genomic DNA
actggaaacaacccccgtgtccttcaacaa

SEQ ID NO: 68627 - DNA, 30 bp, Homo sapiens
  misc_feature 1..30: note = chr1:223376610-223376640
  misc_feature 1..30: note = hypo
  source 1..30: mol_type = genomic DNA
ggcaggtgctgctcccggtgagatggtgca

SEQ ID NO: 68628 - DNA, 208 bp, Homo sapiens
  misc_feature 1..208: note = chr1:22349452-22349660
  misc_feature 1..208: note = hypo
  source 1..208: mol_type = genomic DNA
cggcctatgctcagttttaagtactggggtcatggtggtgacagggcagacaaagtccttagctttgtggacactgcctctagtggatgagatagaaaataactaggtaatcacaaaaacaaagtaacaggttataaaggaattggaagggtgcccggggtcgggggatagaggaggtgggcagaaaaggagacgctacagttgaact

SEQ ID NO: 68629 - DNA, 175 bp, Homo sapiens
  misc_feature 1..175: note = chr1:223536480-223536655
  misc_feature 1..175: note = hyper
  source 1..175: mol_type = genomic DNA
ggacgcaggcaccctcgcgttgtcagatcctcctgaagtctgggtgtatgggggaggggtgcagggctgtcctggcagctaggctctttctcccctctgggccatccccaggccctcccaccacagctgggtcactcaccgcccgtgagctgtgcagggccgaagcacagcgcca

SEQ ID NO: 68630 - DNA, 304 bp, Homo sapiens
  misc_feature 1..304: note = chr1:223537183-223537487
  misc_feature 1..304: note = hyper
  source 1..304: mol_type = genomic DNA
ctcacaatgtggcaccgtctcccccagctacttctctggttttcctcgggattgggatcgatcctactgccccagtccccagtgagatttctctgcgctgtcaaaaaaaaaaaaaaaattctcccttggggagctgcaccaggcaccaactccccctccccggcctgcgcgcgcctcctcggaatggaagacccttccgggactgtcggtcttacctgtgggtctcatgcatgcagcttccttccctcctccgcctcctccccccgccagtctaacccgcatctgtgcgcgacctctgctgccg

SEQ ID NO: 68631 - DNA, 33 bp, Homo sapiens
  misc_feature 1..33: note = chr1:223537913-223537946
  misc_feature 1..33: note = hyper
  source 1..33: mol_type = genomic DNA
cggtcgccccttccccggcgctggactgcagcc

SEQ ID NO: 68632 - DNA, 423 bp, Homo sapiens
  misc_feature 1..423: note = chr1:223538158-223538581
  misc_feature 1..423: note = hyper
  source 1..423: mol_type = genomic DNA
agtctcttaatttcccgcgttaacccctccccgctcccatctccgccgaagctctgcgcgtccccagggagcccgaaggaccatctgaggcggctgagagacactctccccctcccccacacccttggtattttccctctgccagccgcaggtgttgcgagtgaggacccctgtccggtcttggagatgcgcggggccctcggagccttggcctgggaggcgctcccgggggcggggaggcgggggtagcgggtgattggtgacacgcagaaggttgggtacctggaggaggggaggcttccggggtcgtagatgggaagccaagggggtcggtggtaattgccctcccagccccaagtggagagagttggcctggtcggtcccctgtctctgcgccgattctggtgtcggagctcagcccgc

SEQ ID NO: 68633 - DNA, 41 bp, Homo sapiens
  misc_feature 1..41: note = chr1:22378609-22378650
  misc_feature 1..41: note = hypo
  source 1..41: mol_type = genomic DNA
gaactggtagtgggccgggcgcggtggttcacgcccgtaat

SEQ ID NO: 68634 - DNA, 30 bp, Homo sapiens; identical to SEQ ID NO: 39246
  misc_feature 1..30: note = chr1:223841897-223841927
  misc_feature 1..30: note = hypo
  source 1..30: mol_type = genomic DNA

SEQ ID NO: 68635 - DNA, 18 bp, Homo sapiens
  misc_feature 1..18: note = chr1:223899327-223899345
  misc_feature 1..18: note = hypo
  source 1..18: mol_type = genomic DNA
tttgatatggagtttcgc

SEQ ID NO: 68636 - DNA, 189 bp, Homo sapiens; identical to SEQ ID NO: 39247
  misc_feature 1..189: note = chr1:223907491-223907680
  misc_feature 1..189: note = hypo
  source 1..189: mol_type = genomic DNA

SEQ ID NO: 68637 - DNA, 176 bp, Homo sapiens
  misc_feature 1..176: note = chr1:223922172-223922348
  misc_feature 1..176: note = hypo
  source 1..176: mol_type = genomic DNA
tatttcttccttattcggacaccccttgcttccaaagaagagtttcggaaggctcaagacggtgagacagacaccttatgcactgcttcactctcccccgcagctcccctccctcctcactgacccccggccacaaccctctctccttgcccctcaccagccggcacccttggcaa

SEQ ID NO: 68638 - DNA, 25 bp, Homo sapiens
  misc_feature 1..25: note = chr1:223927954-223927979
  misc_feature 1..25: note = hypo
  source 1..25: mol_type = genomic DNA
cttgttccctggtgccgtaaagaaa

SEQ ID NO: 68639 - DNA, 173 bp, Homo sapiens
  misc_feature 1..173: note = chr1:223936580-223936753
  misc_feature 1..173: note = hyper
  source 1..173: mol_type = genomic DNA
ccaagtgcaagaaagcgcagccctgagcctcccaccccaggcctcggccgctgcgctagtgcgtccggcggtcccgcccggcagtaggacagagggagcgagggagtccgggaggaagggagagcgggtgcggccagtctgacggttgctgtgtttgcagatcaccagcgccg

SEQ ID NO: 68640 - DNA, 215 bp, Homo sapiens; identical to SEQ ID NO: 26882
  misc_feature 1..215: note = chr1:223936995-223937210
  misc_feature 1..215: note = hyper
  source 1..215: mol_type = genomic DNA

SEQ ID NO: 68641 - DNA, 30 bp, Homo sapiens
  misc_feature 1..30: note = chr1:223990949-223990979
  misc_feature 1..30: note = hypo
  source 1..30: mol_type = genomic DNA
tttggcaaacagctacggtctacctgcagc

SEQ ID NO: 68642 - DNA, 86 bp, Homo sapiens
  misc_feature 1..86: note = chr1:224072197-224072283
  misc_feature 1..86: note = hypo
  source 1..86: mol_type = genomic DNA
catgcatgcacaatgcgttcattagcatatagtgctacagggtgcaggggaaggagctagctctcattagaagggttcagaaggtt

SEQ ID NO: 68643 - DNA, 30 bp, Homo sapiens; identical to SEQ ID NO: 39248
  misc_feature 1..30: note = chr1:224232559-224232589
  misc_feature 1..30: note = hypo
  source 1..30: mol_type = genomic DNA

SEQ ID NO: 68644 - DNA, 24 bp, Homo sapiens
  misc_feature 1..24: note = chr1:224251284-224251308
  misc_feature 1..24: note = hypo
  source 1..24: mol_type = genomic DNA
gattacaggcgtgagccaccacgc

SEQ ID NO: 68645 - DNA, 120 bp, Homo sapiens
  misc_feature 1..120: note = chr1:224267382-224267502
  misc_feature 1..120: note = hypo
  source 1..120: mol_type = genomic DNA
tctaaatgcttctgcctctgagtcttcccttaagttataacagtacctacctcctaaggctattgtaaggattgaatgagtaaacatttataaaacacacagcacaggtgcaagggtttt

SEQ ID NO: 68646 - DNA, 159 bp, Homo sapiens
  misc_feature 1..159: note = chr1:224267802-224267961
  misc_feature 1..159: note = hypo
  source 1..159: mol_type = genomic DNA
gactctgtctcaaaataataataataataataaagtggagagaattagaaggcttcccggagaagagtagattttacttggtccagaaaaatgagtaagatttagatgggatgaggaaatggcatgaggacgaggatgtgacagcgtgactaaggaaca

SEQ ID NO: 68647 - DNA, 29 bp, Homo sapiens
  misc_feature 1..29: note = chr1:224300927-224300956
  misc_feature 1..29: note = hypo
  source 1..29: mol_type = genomic DNA
ggcgtgagtcaacacgcccagccttgtaa

SEQ ID NO: 68648 - DNA, 23 bp, Homo sapiens
  misc_feature 1..23: note = chr1:224361283-224361306
  misc_feature 1..23: note = hypo
  source 1..23: mol_type = genomic DNA
tgagattccgtctcaaaaaaaag

SEQ ID NO: 68649 - DNA, 152 bp, Homo sapiens
  misc_feature 1..152: note = chr1:224386053-224386205
  misc_feature 1..152: note = hypo
  source 1..152: mol_type = genomic DNA
gagggccagcatggccgaggcgcctggcagaggaggctctgagagcagaggggagacagagcagtgacacctggagtggaggcctgaaggctgatcagagcccagcgagggtcatgcctgcagggcgtgctagcaaacgcagggctgggaca

SEQ ID NO: 68650 - DNA, 34 bp, Homo sapiens
  misc_feature 1..34: note = chr1:224400490-224400524
  misc_feature 1..34: note = hypo
  source 1..34: mol_type = genomic DNA
gatcaccagtgtccccgggcgctctgggaggcag

SEQ ID NO: 68651 - DNA, 119 bp, Homo sapiens; identical to SEQ ID NO: 38886
  misc_feature 1..119: note = chr1:22447958-22448077
  misc_feature 1..119: note = hypo
  source 1..119: mol_type = genomic DNA

SEQ ID NO: 68652 - DNA, 277 bp, Homo sapiens
  misc_feature 1..277: note = chr1:224528612-224528889
  misc_feature 1..277: note = hyper
  source 1..277: mol_type = genomic DNA
ggggctccaggtcctcgctgggcacctctctgcccaaccctctgcacccagccggcttctcccccaccgacggggagccccgcctggccccatcgcagagacccccagagcggcgggcttttgttggggggttcccgcttgtccctggctcctgccgtctctgtggagcgcggcaccgccttggatccagctccacctcctccccgtgccctccccacgaggcctgggagcgggtcctgcccggctgcgcaagggtgggggtcgcgcagttagctgc

SEQ ID NO: 68653 - DNA, 37 bp, Homo sapiens
  misc_feature 1..37: note = chr1:22468804-22468841
  misc_feature 1..37: note = hyper
  source 1..37: mol_type = genomic DNA
ccttccttctgtctccggctcccgccccccaagcaga

SEQ ID NO: 68654 - DNA, 135 bp, Homo sapiens
  misc_feature 1..135: note = chr1:224803348-224803483
  misc_feature 1..135: note = hyper
  source 1..135: mol_type = genomic DNA
caacaccaataccaccgagccctcgttgctgcctcttcagcgcagaatagcccaccaagtccacgtttccctagtcccaaggtcggatggctggggagggtagaggatgcaacggaaggacgttaatggagaatt

SEQ ID NO: 68655 - DNA, 549 bp, Homo sapiens
  misc_feature 1..549: note = chr1:224803747-224804296
  misc_feature 1..549: note = hyper
  source 1..549: mol_type = genomic DNA
agtccctgctccaaccggtcccgccccacctccgctcggcctccagccctgcttgtactgctggcttcaagtttcctccgagaggcgggcgtgcacagctgcagtggcggcggcagcggccaccaagcgcccggcggcgcttcgccacccacctttcctcagcccccggcgctgcagtctccgcccgccggggagggcgcgctcagcggaacaggagtcgagggtggggcgccgagaggagggaatcccgggtcgcaccgctacagttctcgcagtggcaaaggcggcggcggcggcggcggcagcggcagcagcaggtggagcgagctacagcgtttggcctgaaacccactgctgcagccacccgggctggagttggcccgttgggtggagccagtgctcgccccggtccgacccccggtttccgggacacttgggttgcggaggccggctggccggagtcacggttggggacgggcgcgcctcggagcgcacggctgcgctggaagccgcgtctggggcgcaggaccaacgggacctacctcctcc

SEQ ID NO: 68656 - DNA, 292 bp, Homo sapiens; identical to SEQ ID NO: 26886
  misc_feature 1..292: note = chr1:224804395-224804687
  misc_feature 1..292: note = hyper
  source 1..292: mol_type = genomic DNA

SEQ ID NO: 68657 - DNA, 270 bp, Homo sapiens; identical to SEQ ID NO: 121
  misc_feature 1..270: note = chr1:224804846-224805116
  misc_feature 1..270: note = hyper
  source 1..270: mol_type = genomic DNA

SEQ ID NO: 68658 - DNA, 555 bp, Homo sapiens; identical to SEQ ID NO: 122
  misc_feature 1..555: note = chr1:224805197-224805752
  misc_feature 1..555: note = hyper
  source 1..555: mol_type = genomic DNA

SEQ ID NO: 68659 - DNA, 18 bp, Homo sapiens
  misc_feature 1..18: note = chr1:224805848-224805866
  misc_feature 1..18: note = hyper
  source 1..18: mol_type = genomic DNA
cgccggtcctctcaaaga

SEQ ID NO: 68660 - DNA, 29 bp, Homo sapiens
  misc_feature 1..29: note = chr1:225113123-225113152
  misc_feature 1..29: note = hypo
  source 1..29: mol_type = genomic DNA
aaatttgtggccaggcgccatggctcacg

SEQ ID NO: 68661 - DNA, 425 bp, Homo sapiens
  misc_feature 1..425: note = chr1:225117226-225117651
  misc_feature 1..425: note = hyper
  source 1..425: mol_type = genomic DNA
tgtcacatcgggggccgccgcgtacccgcggtggaatctcgcaagagccagggcccctcctcacctgcccggcacccaggatcccttgcgccgcgttcgggaccccacccccattgtggcctcttcgccagggcgcaggcgtggctcttggtcaggcggttacggccaggaggcgtcggagcctggcgtggtagggctgtgctgcgcggtccttcccattcaccctagtctggcgctcgccggcgtgggcgggccggaccttcgccgcttccaggaagggccacaacggccgtcggaccacggcgcggcgggtaaggtcgtcagcgtcttcctgtcagcggtcggcagagcctcggcgggcgggcggcgcgtggggcagccggtgtcgcactgggagggctgcgtgggcgcggagggcctgggcg

SEQ ID NO: 68662 - DNA, 120 bp, Homo sapiens
  misc_feature 1..120: note = chr1:225118168-225118288
  misc_feature 1..120: note = hypo
  source 1..120: mol_type = genomic DNA
gcattatgtgtttgtggtgatgctattgtaaactgtgctgccagtcataaaagagtagcacatacaattatgtacagtacatagtacttgataataacagatgagtatgttacttgctta

SEQ ID NO: 68663 - DNA, 35 bp, Homo sapiens
  misc_feature 1..35: note = chr1:2253171-2253206
  misc_feature 1..35: note = hypo
  source 1..35: mol_type = genomic DNA
cacaggactggccaccggaccggtcctggggggct

SEQ ID NO: 68664 - DNA, 148 bp, Homo sapiens
  misc_feature 1..148: note = chr1:225632491-225632639
  misc_feature 1..148: note = hyper
  source 1..148: mol_type = genomic DNA
caacagataacaaatcgacattgtcgtgcataaatgtagagctgatccgtatttcatgtcaaaggcctggactgtgtgaaattggctggtatttgttccagaagcacttgttcatgttgaagatggggcagttctgagtgggttagca

SEQ ID NO: 68665 - DNA, 121 bp, Homo sapiens; identical to SEQ ID NO: 14333
  misc_feature 1..121: note = chr1:226062878-226062999
  misc_feature 1..121: note = hypo
  source 1..121: mol_type = genomic DNA

SEQ ID NO: 68666 - DNA, 36 bp, Homo sapiens
  misc_feature 1..36: note = chr1:226069474-226069510
  misc_feature 1..36: note = hyper
  source 1..36: mol_type = genomic DNA
tcgcctcaccctttccgcccccgcccttccccccag

SEQ ID NO: 68667 - DNA, 30 bp, Homo sapiens
  misc_feature 1..30: note = chr1:226085269-226085299
  misc_feature 1..30: note = hypo
  source 1..30: mol_type = genomic DNA
aatgacaaagaaggccgggtgcggtggctc

SEQ ID NO: 68668 - DNA, 90 bp, Homo sapiens
  misc_feature 1..90: note = chr1:226109616-226109706
  misc_feature 1..90: note = hypo
  source 1..90: mol_type = genomic DNA
cagtgcagaagcccacgctgctcatgagctgctccaggagctgcccatcctccaccagggcatgggtgcccgtggcgtacactgtagcgc

SEQ ID NO: 68669 - DNA, 99 bp, Homo sapiens
  misc_feature 1..99: note = chr1:226150253-226150352
  misc_feature 1..99: note = hyper
  source 1..99: mol_type = genomic DNA
gcagccagcaggggtcgctgcagacatgggaatcacggtgctgaccgtgcctctgcagcgctgtcttcaggtgcttttgctgaacggtcatatcttctc

SEQ ID NO: 68670 - DNA, 86 bp, Homo sapiens; identical to SEQ ID NO: 39254
  misc_feature 1..86: note = chr1:226163129-226163215
  misc_feature 1..86: note = hypo
  source 1..86: mol_type = genomic DNA

SEQ ID NO: 68671 - DNA, 30 bp, Homo sapiens; identical to SEQ ID NO: 39255
  misc_feature 1..30: note = chr1:226284013-226284043
  misc_feature 1..30: note = hypo
  source 1..30: mol_type = genomic DNA

SEQ ID NO: 68672 - DNA, 127 bp, Homo sapiens; identical to SEQ ID NO: 39256
  misc_feature 1..127: note = chr1:226303892-226304019
  misc_feature 1..127: note = hypo
  source 1..127: mol_type = genomic DNA

SEQ ID NO: 68673 - DNA, 370 bp, Homo sapiens
  misc_feature 1..370: note = chr1:2263053-2263423
  misc_feature 1..370: note = hypo
  source 1..370: mol_type = genomic DNA
tgtgcccatgaaacccgggcttcccttggggcacagcttgtgaaggaaccttggctcctctttcctctgcctattttagggaacagtcaaagacgactttgcaggatcctgcctgagagttgtaacaaaggcgcgcgtttctcccgcatgcgccgtccttcttatgtaaccactgccgctcctctcccgcggctgcgcctctcccgccgctgcgcctctccctcgtgcggctctcccgcccctgcgcctctccctcgtgcgcctctcccgcccctgcgcctctccctcgtgcgcctctcccgcccctgcgcctctccctcgtgcgcctctcccgcccctgcgcctctccctcgtgcgcctctcccgcccc

SEQ ID NO: 68674 - DNA, 146 bp, Homo sapiens
  misc_feature 1..146: note = chr1:226314896-226315042
  misc_feature 1..146: note = hypo
  source 1..146: mol_type = genomic DNA
gtgtggggccgcatgcgaagctgcctccgcgccttccccgagcggctggccgcctgcggggccgagtaaggacttctgcgcgcgggagttcgaggccctgcggagctgcttcgccgccgcggccaagaagacgctggagggaggct

SEQ ID NO: 68675 - DNA, 232 bp, Homo sapiens
  misc_feature 1..232: note = chr1:226410992-226411224
  misc_feature 1..232: note = hyper
  source 1..232: mol_type = genomic DNA
caggcaaggtgcttccgccgctcttaacggggatttgacccggagaagagagttctgtcgcctgcggcccgcgcacccgggcccctccgggctgcccctcccaggcaaatagtccttcggggatgtggattgcgccgtccgggcgggtgggcggggaagaacacggagggggccgggacccaagttcacgcctccctcctgcatcccgcagccggcggaagcgattattccc

SEQ ID NO: 68676 - DNA, 758 bp, Homo sapiens; identical to SEQ ID NO: 26895
  misc_feature 1..758: note = chr1:226411246-226412004
  misc_feature 1..758: note = hyper
  source 1..758: mol_type = genomic DNA

SEQ ID NO: 68677 - DNA, 81 bp, Homo sapiens
  misc_feature 1..81: note = chr1:2266113-2266194
  misc_feature 1..81: note = hypo
  source 1..81: mol_type = genomic DNA
aacactccgactccgcggccaggtcgtcctgggattgaaacaatcctagtccaacgacacttaactcgaggacagtgcgag

SEQ ID NO: 68678 - DNA, 43 bp, Homo sapiens; identical to SEQ ID NO: 39258
  misc_feature 1..43: note = chr1:226620644-226620687
  misc_feature 1..43: note = hypo
  source 1..43: mol_type = genomic DNA

SEQ ID NO: 68679 - DNA, 16 bp, Homo sapiens
  misc_feature 1..16: note = chr1:226702271-226702287
  misc_feature 1..16: note = hypo
  source 1..16: mol_type = genomic DNA
ccgataaacacaagag

SEQ ID NO: 68680 - DNA, 597 bp, Homo sapiens
  misc_feature 1..597: note = chr1:2267155-2267752
  misc_feature 1..597: note = hypo
  source 1..597: mol_type = genomic DNA
gtgctggtcactctgcgagcaacccagcagctcctccacagtgtgcggggccaggcgagggctggtgggacgggtccccagggcacatcagcgggggcctcctcgcctccatagcccagcccagcccagcgcgcagctgcccccaatttgtagacagagtcccgatttgaggtggcagctgttgctggactccgagccccgagccccagcttcctcctggtagaaccggccggttacggccctgcatgtgctgtgcccgtagcactgccaggcccaggatggtgagatgtgacggccacaaaccccccacggtgtccccgcctgcacgtgccgcggtgtgcacctggtcccactcctgtcctccagctcacagagtcccctcaagccactgccctgaaccctggccaccagccgtcttcctctgagaggccccgcacccctcctgcctctctgcttctgcatgcccacagcctggtccgcccggcgggtctgggagttgtggtgatcgaagcagatggaccggctccagctccacccacttcatgccagcccaggcaagtcgcagggcagctgttagccccgcgagaccctggctgg

SEQ ID NO: 68681 - DNA, 30 bp, Homo sapiens; identical to SEQ ID NO: 39259
  misc_feature 1..30: note = chr1:226725373-226725403
  misc_feature 1..30: note = hypo
  source 1..30: mol_type = genomic DNA

SEQ ID NO: 68682 - DNA, 249 bp, Homo sapiens
  misc_feature 1..249: note = chr1:226735996-226736245
  misc_feature 1..249: note = hyper
  source 1..249: mol_type = genomic DNA
agacgggagccactgcgctcgccccaaacaaaatcatttaaatcacaatgcactgaaggccgactaggtgtcaggcgccgcgcggtccgtcccttgtccccatgtccctggccaaaggcttgctctagatcaggggactcagcctcgaggctttcccgacggtgtcagccaagcacacactcccagttcgcagggcttcgtggtcaaggttcctagttcacctgtctgggagggcgaggtgtgtccacc

SEQ ID NO: 68683 - DNA, 1021 bp, Homo sapiens
  misc_feature 1..1021: note = chr1:226736532-226737553
  misc_feature 1..1021: note = hyper
  source 1..1021: mol_type = genomic DNA
acagtctcctgctcccgtacgctgggcgccagctccggccgtgctgcccggctgcctgagagcgcgcccggccatggagccctcgcacaaagacgccgagacggcggcggcggcggcggcggtggcggcggcggacccccggggggcgtcctcgtccagcggggtggtggtgcaggtccgcgagaagaagggccccctgcgcgccgccatcccctacatgcccttccccgtggccgtcatctgcctcttcctcaacactttcgtgccgggactgggtaagacacggctgccgcgacccttgcgacccccaccccgccgcgggagggcgtggggggagagaagggcgcggccggagacctcctggcggggccgcgcgctccaagtgctgcgaccacgcgccaccgcccgctcctggcgtccccgggcaggtggcagaagcgcgtggagtgtgcaccccagaggggagaggctgcgctggggtctccgacccgcaggcggggccccaaagagccggaaactttgcggccaatgttggagcccgcagcggcggccggaatggctctgccggcttcggagtagggctcccgtcccggcgccccgatttctgctccttctctccgtcgtgtgcatccgtccgcgagcccacttccccgagaggaatggggtcggatcagaatgagctctagggcctcggcggcgaggatcaaactcccgggcgtcgaagtcagctgagccggggaaagaggacgagccgggctagatatacctgcagccccctttggttcgcggagtgcggaccgcgtggggacgagaactctagccagagtctcctccgcctcattcaggggtacctgcacttccgccagcaccccgcagggcgccagggggatgggggatgattttattagtttggatgcatgtggccagagatgaacccatagctccctcggatcccttctgttcctgagaagtagagagtgcgccgatgtaattctgtgcaggactccggcagccggcaggg

SEQ ID NO: 68684 - DNA, 72 bp, Homo sapiens
  misc_feature 1..72: note = chr1:226737889-226737961
  misc_feature 1..72: note = hyper
  source 1..72: mol_type = genomic DNA
ctttggcctttctcacggtctcctcgctcttcgcctgcttagcaggggcctctgctgcggtgacagccaagg

SEQ ID NO: 68685 - DNA, 139 bp, Homo sapiens
  misc_feature 1..139: note = chr1:226816229-226816368
  misc_feature 1..139: note = hypo
  source 1..139: mol_type = genomic DNA
cctacaaagtggggtcgacgaagctgatcatagacttttttataaagattaagctacttagctttaatcacctggtatggtgcctggcacaaagcaatctttaattgctactggttgccattattctcaggcaggagtt

SEQ ID NO: 68686 - DNA, 18 bp, Homo sapiens
  misc_feature 1..18: note = chr1:226816428-226816446
  misc_feature 1..18: note = hypo
  source 1..18: mol_type = genomic DNA
ctccgtgacaactacaca

SEQ ID NO: 68687 - DNA, 37 bp, Homo sapiens
  misc_feature 1..37: note = chr1:226826631-226826668
  misc_feature 1..37: note = hypo
  source 1..37: mol_type = genomic DNA
gcttccccgcctacccgccgcacgccagggacaagca

SEQ ID NO: 68688 - DNA, 54 bp, Homo sapiens
  misc_feature 1..54: note = chr1:226829338-226829392
  misc_feature 1..54: note = hypo
  source 1..54: mol_type = genomic DNA
ttcggtgccaggcaccgtctgggctaaatggagagtcctcggcagagggctgac

SEQ ID NO: 68689 - DNA, 300 bp, Homo sapiens
  misc_feature 1..300: note = chr1:226846358-226846658
  misc_feature 1..300: note = hypo
  source 1..300: mol_type = genomic DNA
gccgtgtgatgttcccgcaggctggatggcaccgaacatcctccacagcgctgctcaccaggcacgaggttcttctcccccgccctttatggaacccatgagcgtagggtagggattactgagcgctgtcgggttggtgaagtccctccttcagaagcaactgctgggcctggggcaggagaacgaggatgatgggtccttaccagcccctgcagaccgggaccccctgcaggggctacacgaaccagctcagtgaactagctagctaaactagctccaggtgagcgctctgtcccctcc

SEQ ID NO: 68690 - DNA, 30 bp, Homo sapiens; identical to SEQ ID NO: 38735
  misc_feature 1..30: note = chr1:2268713-2268743
  misc_feature 1..30: note = hypo
  source 1..30: mol_type = genomic DNA

SEQ ID NO: 68691 - DNA, 82 bp, Homo sapiens
  misc_feature 1..82: note = chr1:226908374-226908456
  misc_feature 1..82: note = hypo
  source 1..82: mol_type = genomic DNA
agtattttttacagccgtaccacctgttaattcatattgaactggtagtaaaattataactcccagtgaatttcaaaagaaa

SEQ ID NO: 68692 - DNA, 58 bp, Homo sapiens
  misc_feature 1..58: note = chr1:226924772-226924830
  misc_feature 1..58: note = hyper
  source 1..58: mol_type = genomic DNA
cctcttggcctcctccggccctggcggggagagggtaccggctgccaccacctgctgc

SEQ ID NO: 68693 - DNA, 759 bp, Homo sapiens
  misc_feature 1..759: note = chr1:226924900-226925659
  misc_feature 1..759: note = hyper
  source 1..759: mol_type = genomic DNA
cgctgctactattcagcctgcgccggccgctccgccagcccccggggctccggggctcctcgggggacagcgactcggctggggggaagaggaaagaggcgcctctcccggggctgaaaacgctgccggggctcagcactgccctcctcgggggcgggggcgtctcgctgccactgggccccgggccgccgccgctcttcatctcgttggcgctattcatgatcaccaggctattgagcgcatagcagtacacagccatagtactgggtcccgcgctgcccgccgccgcggctcccgctcctgctccgccgccggcgcctcctcctcccggcgctcccggctcagccccggaggcccggcagccgcggctccgcgcgcagatggggcggcatggcctgggcagcgggctgggggcacgaccgcgggctcagcccccgcccaaagctccataaacaaccgtgcggctgtggagatacaaggagaaaagtcaggaccctggagggcgcgcggggggagttgggggtcgcctgcagaacccagagagagccccgggaacacaatctatccgggacccagcgccaccggacatctcacctatggggacggcgaggctcggcgagggcatgccccggctgcctcggtcgccagcgcggtttcgggtgtgcttccccgccccccacctcgccccaggctgcgatgcgctttatgaggtcccttcaaatcccaatcctaatactcgtctcgcggaccggcgagaag

SEQ ID NO: 68694 - DNA, 86 bp, Homo sapiens
  misc_feature 1..86: note = chr1:226926865-226926951
  misc_feature 1..86: note = hyper
  source 1..86: mol_type = genomic DNA
caaaaaagaggagtgcgaaagaggggggaaagctcttcggttcaggggcccggcgatcccggcagtggcgacgccaagccggccct

SEQ ID NO: 68695 - DNA, 38 bp, Homo sapiens; identical to SEQ ID NO: 39263
  misc_feature 1..38: note = chr1:226954853-226954891
  misc_feature 1..38: note = hypo
  source 1..38: mol_type = genomic DNA

SEQ ID NO: 68696 - DNA, 30 bp, Homo sapiens
  misc_feature 1..30: note = chr1:226972978-226973008
  misc_feature 1..30: note = hypo
  source 1..30: mol_type = genomic DNA
aaaaaaatggttttccgtttgagagtctcc

SEQ ID NO: 68697 - DNA, 30 bp, Homo sapiens
  misc_feature 1..30: note = chr1:22710484-22710514
  misc_feature 1..30: note = hypo
  source 1..30: mol_type = genomic DNA
aggattccacaagtacgagagtgtgtgtgg

SEQ ID NO: 68698 - DNA, 52 bp, Homo sapiens
  misc_feature 1..52: note = chr1:2271392-2271444
  misc_feature 1..52: note = hypo
  source 1..52: mol_type = genomic DNA
ctgtgcagacacaggcgcctccgccgcgcggcttctccgtgtttgctgaaga

SEQ ID NO: 68699 - DNA, 30 bp, Homo sapiens
  misc_feature 1..30: note = chr1:227163741-227163771
  misc_feature 1..30: note = hypo
  source 1..30: mol_type = genomic DNA
atgttgcctggctgccgggcagtggggctg

SEQ ID NO: 68700 - DNA, 55 bp, Homo sapiens
  misc_feature 1..55: note = chr1:227174055-227174110
  misc_feature 1..55: note = hypo
  source 1..55: mol_type = genomic DNA
tgaatgagaactcagcgccccgggcactgtgggaggaacccgggctggtggaggg

SEQ ID NO: 68701 - DNA, 42 bp, Homo sapiens
  misc_feature 1..42: note = chr1:2273867-2273909
  misc_feature 1..42: note = hypo
  source 1..42: mol_type = genomic DNA
ttggccctaaggggacgagaacagtctcgtttggaggtgacc

SEQ ID NO: 68702 - DNA, 54 bp, Homo sapiens
  misc_feature 1..54: note = chr1:2274776-2274830
  misc_feature 1..54: note = hypo
  source 1..54: mol_type = genomic DNA
tgtagctgccagagccgctgggccctgtgacagagccgccgggccctggggatg

SEQ ID NO: 68703 - DNA, 343 bp, Homo sapiens
  misc_feature 1..343: note = chr1:227505516-227505859
  misc_feature 1..343: note = hyper
  source 1..343: mol_type = genomic DNA
agtcttgcccggaggcggcttttcgtttctcctcccgaggtccttctttctttaaggctttgcagtcagtcctattttcaacggattccggtgaaaactcttcattttcctcccggcttcaccctagggcctgaccggcggcgcggccgggggtggaaggcgggctgcgggcggcactggcaccgggctccggagaagcggctacttggccgcccgagcccactccatgtcggtggtcgctcgtgggccgagccgcgccgcgccgcgccgggcagagagcccggtctccccgacacccgcaccgggccgccgcgccggaggctcccgacgccccaggcggggg

SEQ ID NO: 68704 - DNA, 196 bp, Homo sapiens
  misc_feature 1..196: note = chr1:2275639-2275835
  misc_feature 1..196: note = hypo
  source 1..196: mol_type = genomic DNA
taggggcccttcttgcgagagcggcatcacctgagggctgggcgtggccaggcacaaggggctggcgggcctgggagggatctgcagggcaggttgagacatggttctgaagccaggcagctgctccccagaagctccggtgagcacactcgacaaggtggtgcggcgagctggctccgagcgtcccccacagggc

SEQ ID NO: 68705 - DNA, 111 bp, Homo sapiens; identical to SEQ ID NO: 38737
  misc_feature 1..111: note = chr1:2276089-2276200
  misc_feature 1..111: note = hypo
  source 1..111: mol_type = genomic DNA

SEQ ID NO: 68706 - DNA, 815 bp, Homo sapiens
  misc_feature 1..815: note = chr1:227729829-227730644
  misc_feature 1..815: note = hyper
  source 1..815: mol_type = genomic DNA
cggggccgggccggcgagagaagggtccggggcacccagtgggctcggatctcgagcggtccccgtgacggccccgcgactgcgcgacttcccgctctagagagtttatggaccctgtcccaggagggctccgcagccgccagggaggtaccggagggaccgcggcgctgggagagggtggcgccaggcggccctggagccctgggcgacgcggccgggccggccagagggcggagaagtccaaagcagcagcccggacagccgcttccgcccctgcgccgccctcccggcccaggtgaccggtcgccctacccggggagcagcgccctcctcctcctgggccggagccgggcgtgggggtcgcaggctggtgccacagcctgaggacaccgcggcctctgccccggggagcacgccaaatgccggacggagcggctgttgcagacggtgaggccgcagccccgcttgagggtagggtcgggcggggtgtcggggtcctggcagaggccgcggcgagggcaggagccggtgcgctggccgctgcacatgcgccgcccggcaccgggaccctgcgggcgcgccccctggtggcagccagcgggaggtggcgtccctgtccccagccaggcggcagcgcgaagctgcctccccgcggggggagcggaagtggcccagctgctcgagtgacttactagttaaaaagctggggttggagctgccacgcggggaagtgtggaggcctgcggggctccgcctagactttctgggtgtcctcctgggacctcaggttcctcacctgtcgcagaggactgatg

SEQ ID NO: 68707 - DNA, 203 bp, Homo sapiens
  misc_feature 1..203: note = chr1:227750829-227751032
  misc_feature 1..203: note = hypo
  source 1..203: mol_type = genomic DNA
ggacagttccacaggcgcaccggaatgcgcctcccctttccacccgccagcattcccaagcacgcctcggcttctgactgttctgtgctttgggaggaaaactcatcttcaggtttttctccaacagaagatgatgatgacgttgtttagacactcaggaacagagattgcagattggcttaagagtgcgccctttattaaag

SEQ ID NO: 68708 - DNA, 184 bp, Homo sapiens; identical to SEQ ID NO: 38887
  misc_feature 1..184: note = chr1:22777513-22777697
  misc_feature 1..184: note = hypo
  source 1..184: mol_type = genomic DNA

SEQ ID NO: 68709 - DNA, 30 bp, Homo sapiens; identical to SEQ ID NO: 14336
  misc_feature 1..30: note = chr1:227921541-227921571
  misc_feature 1..30: note = hypo
  source 1..30: mol_type = genomic DNA

SEQ ID NO: 68710 - DNA, 53 bp, Homo sapiens
  misc_feature 1..53: note = chr1:227921780-227921833
  misc_feature 1..53: note = hypo
  source 1..53: mol_type = genomic DNA
gagactagggcagcacgagtggggcaactgagaccaatcggctccagtggagc

SEQ ID NO: 68711 - DNA, 61 bp, Homo sapiens; identical to SEQ ID NO: 39268
  misc_feature 1..61: note = chr1:227926624-227926685
  misc_feature 1..61: note = hypo
  source 1..61: mol_type = genomic DNA

SEQ ID NO: 68712 - DNA, 151 bp, Homo sapiens
  misc_feature 1..151: note = chr1:227955886-227956037
  misc_feature 1..151: note = hypo
  source 1..151: mol_type = genomic DNA
ccacagggtatgtggcgcacatgcagtctccaggtgcagcttccgtctcgtcttcccctacagttgattcctggaaaaagcaaagctgtctgttgggctgagactgtgcactttggatcttgcagttctgtgtccacgcagggcatgggct

SEQ ID NO: 68713 - DNA, 71 bp, Homo sapiens
  misc_feature 1..71: note = chr1:227975163-227975234
  misc_feature 1..71: note = hyper
  source 1..71: mol_type = genomic DNA
agaaggtaggggtctcggtgtggccggagcgattcactgtctggcacccacgataccggtctcctttgctt

SEQ ID NO: 68714 - DNA, 360 bp, Homo sapiens
  misc_feature 1..360: note = chr1:227976261-227976621
  misc_feature 1..360: note = hyper
  source 1..360: mol_type = genomic DNA
ggctcctccaggtagcgcaggagcccctccggctgccggagccccgcgagggcgcgagtggagggcaggagcccgggcggcggaggagcggaagggatgctgcgttgccttggagtgtcagggtgggggaggaaagaccaagggacccacgtccttcgcccccgccgcggagtcccgggccggcgagacttccgcagcctgcccagcgccggggacctagggctttgcaggagtccgcccgggagctctatcagagcgggcgtcctccccgccgctccaaaggtggcttggggcaggtggggcgtcccggagggaatggagggaccctgcctagggaaggtgagtcgtgtgtggtcgggt

SEQ ID NO: 68715 - DNA, 30 bp, Homo sapiens
  misc_feature 1..30: note = chr1:228071573-228071603
  misc_feature 1..30: note = hypo
  source 1..30: mol_type = genomic DNA
ctagctccctgtgtgcgcatccctagctcc

SEQ ID NO: 68716 - DNA, 43 bp, Homo sapiens
  misc_feature 1..43: note = chr1:228074452-228074495
  misc_feature 1..43: note = hyper
  source 1..43: mol_type = genomic DNA
gtgggtggagagaggcggaacgggagcccgggaagcctggggg

SEQ ID NO: 68717 - DNA, 375 bp, Homo sapiens
  misc_feature 1..375: note = chr1:228074787-228075162
  misc_feature 1..375: note = hyper
  source 1..375: mol_type = genomic DNA
tgagaacattttttccgacgcagcccgcagcgattgtctccctcagaagcagcgctggggacgccctcctgggccgggcagggggcgggggactggggccggggctgcagccagccagccttccttggggcccaaccccttcgccgaccctgcagggtgggaccccacccccgagtggaagaaggaaccggaagccaggcccgcgggcagggagggtgggggcgaatccctaccccacccgaggggaggggcctgagaagggcttttccccccctcttcctccattctgcccccttactcctccctctccaagattccaaatccccttcatcccatagaggggcttcctggcttctggcccgcccgcggtgcaca

SEQ ID NO: 68718 - DNA, 153 bp, Homo sapiens
  misc_feature 1..153: note = chr1:228082129-228082282
  misc_feature 1..153: note = hypo
  source 1..153: mol_type = genomic DNA
gacacagggtgtccacgatgcaagcatccacgcacgtgcccatgccacatgcacacaaccatgaagggtgtccatacacaagccccggacacatggtgcttgcaggcatgcgcctgggacctttggttttcacgaacgcgtccatgctcttca

SEQ ID NO: 68719 - DNA, 221 bp, Homo sapiens; identical to SEQ ID NO: 39270
  misc_feature 1..221: note = chr1:228083399-228083620
  misc_feature 1..221: note = hypo
  source 1..221: mol_type = genomic DNA

SEQ ID NO: 68720 - DNA, 30 bp, Homo sapiens
  misc_feature 1..30: note = chr1:228092133-228092163
  misc_feature 1..30: note = hypo
  source 1..30: mol_type = genomic DNA
atctccatgggatcccgggtggcgggcatg

SEQ ID NO: 68721 - DNA, 47 bp, Homo sapiens
  misc_feature 1..47: note = chr1:228117865-228117912
  misc_feature 1..47: note = hypo
  source 1..47: mol_type = genomic DNA
aacgtcggatccacacgctctgtggcgtgtcacgtggtccatgagca

SEQ ID NO: 68722 - DNA, 30 bp, Homo sapiens
  misc_feature 1..30: note = chr1:228126165-228126195
  misc_feature 1..30: note = hypo
  source 1..30: mol_type = genomic DNA
acacatccacaggaacgaacacacccacac

SEQ ID NO: 68723 - DNA, 200 bp, Homo sapiens
  misc_feature 1..200: note = chr1:228134691-228134891
  misc_feature 1..200: note = hyper
  source 1..200: mol_type = genomic DNA
caccctgcacctcagcgcgcccaaagcgcagcgagggtccctgtaaaggtcgcaggactgggcatcccagacctcagagagggggagggaagaaggaagggaaagaaaggaagagagagacgcgccgacagcccggcaaagcgctgctgcagagacacgtgagcacgggcaatgacaccgcgggacgccccggccgggcc

SEQ ID NO: 68724 - DNA, 197 bp, Homo sapiens
  misc_feature 1..197: note = chr1:228135107-228135304
  misc_feature 1..197: note = hyper
  source 1..197: mol_type = genomic DNA
aagctgctaggtgggcgatggccaggggctgaggactcaggctccagccttttggcaaggacacggcggcccaaggaagtcgggacctgatcccagtccctaagcgcgaggcagtcctgctcacggcggcgactacgacgacgacgactctgcggtcacggaggaccgcggcccggcgcaagccggacgggtccacc

SEQ ID NO: 68725 - DNA, 359 bp, Homo sapiens
  misc_feature 1..359: note = chr1:228135362-228135721
  misc_feature 1..359: note = hyper
  source 1..359: mol_type = genomic DNA
cgccaggcaacccggcggccccgccgcgccccggccccagccaccccgggtgcctcggggactccggacgaccccgccccggccccgccgcccccgcccaccagtgcgcgccggccgccgaaggcacctacccgaagtaggcggccgaagggcgcagcgcggcgagcagcagcgtcagcccgaaggccgcggccagccagcgcgccagcggggacccatccagcatcttgccgcgcctcggcggccgaccatcgcgctcccagctccgcgcagggcgcgccgcggccgccgccctcttatagcgcccggagcgcggccagctgggcccggccccgccccgcgcccgggaggggatcacg

SEQ ID NO: 68726 - DNA, 46 bp, Homo sapiens
  misc_feature 1..46: note = chr1:228136106-228136152
  misc_feature 1..46: note = hyper
  source 1..46: mol_type = genomic DNA
ctgccccgagctgggcgctgcgcggctgctccgggggaagcttggt

SEQ ID NO: 68727 - DNA, 30 bp, Homo sapiens
  misc_feature 1..30: note = chr1:228136517-228136547
  misc_feature 1..30: note = hyper
  source 1..30: mol_type = genomic DNA
tctgcgatacggattcggagctgcttctga

SEQ ID NO: 68728 - DNA, 30 bp, Homo sapiens
  misc_feature 1..30: note = chr1:228193886-228193916
  misc_feature 1..30: note = hyper
  source 1..30: mol_type = genomic DNA
ctgggggcagcactgcgcttccccaccgtc

SEQ ID NO: 68729 - DNA, 285 bp, Homo sapiens
  misc_feature 1..285: note = chr1:228194126-228194411
  misc_feature 1..285: note = hyper
  source 1..285: mol_type = genomic DNA
cagctctggtctcagcggaaggagtccggccgcaggcagacggggccaaaggacgtgcacccgacaaccgtccgctccctccccaaacccccgccccgagaaggttgatggatgaaggggagccctagcccagccacctcgggggcaagagacggagctcgccacagaccaggagcgagagggggactgcgggtcccaccgtgagcgcagggcgcgcggggctggaaacccaggacgcggcccgggagctccaggagggcgcctgcggatcgcgcggccccgggc

SEQ ID NO: 68730 - DNA, 1999 bp, Homo sapiens
  misc_feature 1..1999: note = chr1:228194570-228196569
  misc_feature 1..1999: note = hyper
  source 1..1999: mol_type = genomic DNA
cgcccgggccccggccccggcgggcgccccccgcggcgctgccccgcccccgccgccccgcgccgccccgggcctcggcccgcagcccggccgccggcccacctggcgcagcgccgccctcggagcccgcgcacacccgcgcacccgcggccgcaggagggcccagcgacgccgccgcgccagctcccagggcccggccccccccggcgctcacgctctcggggcggactcccggccctccgcgccctctcgcgcggcgatggccccactcggatacttcttactcctctgcagcctgaagcaggctctgggcagctacccgatctggtggtgagtgagcctcctcgcgttcgcccctgcccctgtgcgccgcgcccgcagcagacggtcccctcgggcagggaccccgcggtggcccgagcccgcgcccttctgctccagccccgcgtgcgggccgcgggcggttggttttccttgacggccactttggacctgttcaggccgctgggacgcgtgggtggcggagtttccggagacattgattcccgagcgggggagtaggggaggttgcggaggtcctagctgcccctggcgtcggacagggcgagcagtgggctggggagaggctgaaagaaggtcggcacgcacggtcaccgaggggacaggcagctcgaggccaggggacaggcgagggaagagggccagcgagagagaattcgccggagactttcctcaaaaaccgtatcttacacacaaacacacacacacgttttaaaacaaagtcgatgagacaagactgaacagctcggagcagcgtggttacgtaaagaaagctgggacccggcggggagtggcgcagagccggcggcggggcgcactgggggccggccctgggccccgcgcgcctccccgccgcagtccgggcacgggggtttccaggggccctctctgcgagccctccgcatgggtccacctggcaatgaggggctgctgtagagagagttaagggtgagttaagcacggggtgtgaggggctccaggaccctcaatcagaaagcgctgtgctgcgccctccacaccagaaaaggcgcgttccgtgagaccctccccagcctggcgatggaagtgcagataaaccaaaggaagggtcccgaaaggtctctctcaggcctcccacctccactgcacatatcctgtgggagggggaacggtggccacactttcgccagggcttgtgatccctcagagccctcaccaagcaaggatcaccccagttccgaattaagggcgctctgagatgcccaagattgaggaacacaagtgggaggaatgtgggcgcgcagggccgggcgcagcgctggtaggacccacagttggagagaagcctccccacaagcatgcacactcccccccatccttctccgacggcagcctggaattataataattacgccgaggggaaggggggagacccagcgagccgaggtacatctaatccgataataatttttctcttcgagatggttcaggagcgggggctcccgcggtaggggcgccgggccaggagcagcggggaggggaaggggcagccctaggcagctgaagggcctggaagaggccacgaggccgcggggacgcgcttcggggacccccgcgcgcccctatttccgcgtgccccatttcccgtgcggcacctgctgcgcccagtggcccacctgagggtcaggctcggggctcgccttggggtgcggggatactgacgcgcgtccagacggccgcagggagccaggggcagcgcgtccgtccgagagagccccgagggctgccggcttacgcaccaggcttctaattagaacccgccgccgcgttcctgagcgcaaaaggaagctccttcgccccgcgcccttcccataaatgtcgccagcctcctggcaaccccgcgccctaggatctttgtcttgtcggccctgagggttcctagcctcggtccccatccacc

SEQ ID NO: 68731 - DNA, 102 bp, Homo sapiens
  misc_feature 1..102: note = chr1:228201221-228201323
  misc_feature 1..102: note = hypo
  source 1..102: mol_type = genomic DNA
taatcccagctgggccggcgggcaggaggaggtgcgggttgggagagctccaggcagggctgggcagcctggactgggaagggttgccgacacccaggaggg

SEQ ID NO: 68732 - DNA, 413 bp, Homo sapiens
  misc_feature 1..413: note = chr1:228225526-228225939
  misc_feature 1..413: note = hyper
  source 1..413: mol_type = genomic DNA
cgcgggcggttcacacgcccttcgcggtgctgaattaaagcgtctgaatggggatttcccctcgcgccggacggcctggcgcgcggcgcatacttccaggttgctatgactggcctgcgctcgcctaatcaccgactagggggaaattcatataaaatatcgccggccattgtgggcctaactcggcgtgacagtggcgcacaaagccggattcaagcgccccagcgggtcagcacggcgcccggccgcgcgggccgcccggcggtgtcaggggccgtggccgcggtggggcgcgggccgcattccgctctcaggtggctccggggccttttgtgcaggccatgattaccaaatgccaccgcgacaccccctcccggccgcctggctcctcctggggccgcaggaatgaggga

SEQ ID NO: 68733 - DNA, 79 bp, Homo sapiens
  misc_feature 1..79: note = chr1:228238495-228238574
  misc_feature 1..79: note = hypo
  source 1..79: mol_type = genomic DNA
gtggggtggctgtagcgaggacatcgagtttggtgggatggtgtctcgggagttcgccgacgcccgggagaaccggcca

SEQ ID NO: 68734 - DNA, 38 bp, Homo sapiens
  misc_feature 1..38: note = chr1:228247050-228247088
  misc_feature 1..38: note = hyper
  source 1..38: mol_type = genomic DNA
gccacaacgcgcgagcggagcggcgccgggagaagtgc

SEQ ID NO: 68735 - DNA, 30 bp, Homo sapiens
  misc_feature 1..30: note = chr1:228247856-228247886
  misc_feature 1..30: note = hyper
  source 1..30: mol_type = genomic DNA
ctcttccctgggaaccgccctcctgattaa

SEQ ID NO: 68736 - DNA, 497 bp, Homo sapiens
  misc_feature 1..497: note = chr1:228248302-228248799
  misc_feature 1..497: note = hyper
  source 1..497: mol_type = genomic DNA
ggaactggcctgctgcgccccaggccccgcccgtctctgctctgctcagctgcgcccccttctttgcagctgcccagcccctcctccctgccctcgggtctccccacctgcactccatccagctacaggagagatagaagcctctcgtcccgtccctccctttcctccgcctgtccacagccccttaagggaaaggtaggaagagaggtccagccccccaggctgcccagagctgctggtctcatttgggggcgttcgggaggtttggggggcatcaaccccccgactgtgctgctcgcgaaggtcccacagccctgagatgggccggcccccttcctggcccctcatggcgggactggagaaatggtccgctttcctggagccaatggcccggcccctcctgactcatccgcctggcccgggaatgaatggggaggccgctgaacccacccggcccatatccctggttgcctcatggccagcgcccctcagcctct

SEQ ID NO: 68737 - DNA, 30 bp, Homo sapiens
  misc_feature 1..30: note = chr1:228264825-228264855
  misc_feature 1..30: note = hypo
  source 1..30: mol_type = genomic DNA
cacccaggaggagcccggcaggcaccttca

SEQ ID NO: 68738 - DNA, 30 bp, Homo sapiens
  misc_feature 1..30: note = chr1:228322401-228322431
  misc_feature 1..30: note = hypo
  source 1..30: mol_type = genomic DNA
taaaataaaggagaacgcagcacaccattc

SEQ ID NO: 68739 - DNA, 78 bp, Homo sapiens
  misc_feature 1..78: note = chr1:228331863-228331941
  misc_feature 1..78: note = hypo
  source 1..78: mol_type = genomic DNA
gtgtgtggtgggtgtcgctgtgcatgatggagttgcagccgtggtgcatttgtgagattacctcggtggcctaaattg

SEQ ID NO: 68740 - DNA, 30 bp, Homo sapiens; identical to SEQ ID NO: 39274
  misc_feature 1..30: note = chr1:228342820-228342850
  misc_feature 1..30: note = hypo
  source 1..30: mol_type = genomic DNA

SEQ ID NO: 68741 - DNA, 30 bp, Homo sapiens
  misc_feature 1..30: note = chr1:228343136-228343166
  misc_feature 1..30: note = hypo
  source 1..30: mol_type = genomic DNA
ttgaggccctgcaggcggggccaggctcag

SEQ ID NO: 68742 - DNA, 163 bp, Homo sapiens
  misc_feature 1..163: note = chr1:228397736-228397899
  misc_feature 1..163: note = hypo
  source 1..163: mol_type = genomic DNA
agaaagggtgaaactcggaccccggtccctgctgtgggcaggcccctgcccaggtcctccccagccccagagccctgctgtgggtggggaggctgggctgcagcataggtgctgcctgcacagtgagtcagcagactggtgcccgctgcgcagtccagccctg

SEQ ID NO: 68743 - DNA, 72 bp, Homo sapiens
  misc_feature 1..72: note = chr1:228398961-228399033
  misc_feature 1..72: note = hypo
  source 1..72: mol_type = genomic DNA
ctgaagttttaggcccgagaggcagcagtgtgtgcggtaggagaaaggataccaccccgcaggtagggagtg

SEQ ID NO: 68744 - DNA, 66 bp, Homo sapiens
  misc_feature 1..66: note = chr1:228400877-228400943
  misc_feature 1..66: note = hyper
  source 1..66: mol_type = genomic DNA
ctgtctcctcccctgcgcccttcccaacccttagcccctctgcctcctgctcgctcctctccccag

SEQ ID NO: 68745 - DNA, 30 bp, Homo sapiens
  misc_feature 1..30: note = chr1:228444438-228444468
  misc_feature 1..30: note = hypo
  source 1..30: mol_type = genomic DNA
tggctcaggcccagacggaggtgatgtggt

SEQ ID NO: 68746 - DNA, 700 bp, Homo sapiens
  misc_feature 1..700: note = chr1:228463170-228463870
  misc_feature 1..700: note = hyper
  source 1..700: mol_type = genomic DNA
ggcacaagggcctggcgtcttgttcagagcaggggagctggaggtgggagcggggcttaaggaagcttcctggtttcctcgcttaaagtcgcacccgggagggtgcgcagctgcggcccgcgtgtggccagggccgcgctgtttggattgggatcccggggcgcggtgccggcagctctgcctgggcccggctcagggcaggcgccggggctgtgcgggccctctgtaccttggcttgtccgtggaggagggcgagggccgccgtgacctcccctctcctgcgaccccagaggcgcctgtgctgttcaaaaagaagctggagccgcagacggtggaggagcggagctcggtgaccctggaggtggagctgacgcggccgtggccggagctgaggtggacacggaacgcgacggccctggcgccgggaaagaacgtggagatccacgccgagggcgcccgccaccgcctggttctgcacaacgtaggttttgccgaccgtggcttctttggctgcgagacgccggatgacaagacacaggccaaactcaccgtggagagtgagccgcgggcgggaagggcggggcatcgaggaggagtgaggagggaggcggggcattgaggattagtgaggacgtaggcggggtgctgaggggaggagggaggaggggcactgaggaagagggagcggaaaagagaggag

SEQ ID NO: 68747 - DNA, 30 bp, Homo sapiens; identical to SEQ ID NO: 39275
  misc_feature 1..30: note = chr1:228466507-228466537
  misc_feature 1..30: note = hypo
  source 1..30: mol_type = genomic DNA

SEQ ID NO: 68748 - DNA, 30 bp, Homo sapiens
  misc_feature 1..30: note = chr1:228473902-228473932
  misc_feature 1..30: note = hypo
  source 1..30: mol_type = genomic DNA
acccctgcatgccaacgagctcaatgagat

SEQ ID NO: 68749 - DNA, 206 bp, Homo sapiens
  misc_feature 1..206: note = chr1:228495816-228496022
  misc_feature 1..206: note = hypo
  source 1..206: mol_type = genomic DNA
gaggtgaccattgtacgggggctggttgatgcggaggtgacggccgatgaggatgttgagttcagctgtgaggtgtccagggctggagccacaggcgtgcagtggtgcctacagggcctgccactgcaaagcaatgaggtgacagaggtggctgtgcgggatggccgcatccacaccctgcggctgaagggcgtgacgcccgagga

SEQ ID NO: 68750 - DNA, 47 bp, Homo sapiens
  misc_feature 1..47: note = chr1:228501386-228501433
  misc_feature 1..47: note = hypo
  source 1..47: mol_type = genomic DNA
gtgaggtgtctcacgcgggtgggccggaggcccgctggtggctggat

SEQ ID NO: 68751 - DNA, 35 bp, Homo sapiens
  misc_feature 1..35: note = chr1:228502582-228502617
  misc_feature 1..35: note = hypo
  source 1..35: mol_type = genomic DNA
ctctgccagtattcacggcccgtgcaggccacgtg

SEQ ID NO: 68752 - DNA, 293 bp, Homo sapiens
  misc_feature 1..293: note = chr1:228504399-228504692
  misc_feature 1..293: note = hypo
  source 1..293: mol_type = genomic DNA
acatctgcaggctggcgcctggagatcctggagcctctgaaaaacgcggcggtccgggccggcgcacaggcatgcttcacctgcacgctcagcgaggcggtgcccgtgggagaggcgtcctggtacatcaatggcgcggcagtgcagccggatgacagcgactggactgtcaccgccgacggcagtcaccacgccctactgctgcgcagcgcccagccccaccacgccggggaggtcaccttcgcttgccgcgacgccgtggcctctgcgcggctcaccgtgctgggtgggtg

SEQ ID NO: 68753 - DNA, 591 bp, Homo sapiens
  misc_feature 1..591: note = chr1:228528791-228529382
  misc_feature 1..591: note = hypo
  source 1..591: mol_type = genomic DNA
ccagggccacttcatcgtgtgggagggtgcaccgggggcccgcatgccctggaagggccacaaccgtcacgtgttcctcttccgcaaccacctggtaatctgcaagccccggcgagactcccgcaccgataccgtcagctacgtgttccggaacatgatgaaggtctgcaggctctgggctgctgggcggggctccctgtccctcagcgccggggtggatgccagtggccacacctgcagccgctggtccagggtggcctgaatgtttcctcgtcgggtcccacatctgttgaggatggtcagcccgtgtccccctccctgtgctgacaccctcccccacccacagctgagcagcatcgacctgaacgaccaggtggagggggatgaccgcgccttcgaggtgtggcaggagcgggaggactcggtgcgcaagtacctgctgcaggcacggacagccattatcaagagctcgtgggtgaaggagatctgtggcatccagcagcgtctggccctgcctgtgtggcgtgagtgtccaccttcccgggggcccaggtggctgagccaggatggggcacccggctgcagccgcac

SEQ ID NO: 68754 - DNA, 30 bp, Homo sapiens
  misc_feature 1..30: note = chr1:228533007-228533037
  misc_feature 1..30: note = hypo
  source 1..30: mol_type = genomic DNA
gcccatgactgaggacggggctggagagga

SEQ ID NO: 68755 - DNA, 94 bp, Homo sapiens
  misc_feature 1..94: note = chr1:228536497-228536591
  misc_feature 1..94: note = hypo
  source 1..94: mol_type = genomic DNA
aatcataagtcggtgctggttgtgacctttgtgatttaagcaatctgtggggcacacccggcactattggaatgtgaatcgatgccgttttatg

SEQ ID NO: 68756 - DNA, 30 bp, Homo sapiens; identical to SEQ ID NO: 14339
  misc_feature 1..30: note = chr1:228552593-228552623
  misc_feature 1..30: note = hypo
  source 1..30: mol_type = genomic DNA

SEQ ID NO: 68757 - DNA, 33 bp, Homo sapiens
  misc_feature 1..33: note = chr1:228554180-228554213
  misc_feature 1..33: note = hypo
  source 1..33: mol_type = genomic DNA
ggcctcgaaggatgccggcgtttacacctgcct

SEQ ID NO: 68758 - DNA, 172 bp, Homo sapiens
  misc_feature 1..172: note = chr1:228554797-228554969
  misc_feature 1..172: note = hypo
  source 1..172: mol_type = genomic DNA
ccgcgctgagccacccgctggtcacggggctgctggaccagtttgagacccgcaagaccctcatcctcatcctggagctgtatcctgccctcagcccctgagacggcttgaggaggggcaggcagggccaggccggggctcagaggagccatgtgcacggtgtcccctgcct

SEQ ID NO: 68759 - DNA, 865 bp, Homo sapiens
  misc_feature 1..865: note = chr1:228558699-228559564
  misc_feature 1..865: note = hypo
  source 1..865: mol_type = genomic DNA
ctgctgccccccatgcggttccagcgttccctgatgagctacaagtccatcctggtgatgcgctccatccctgagctgctgcggggcccacccgacagcccctccctcggcgtagcccggcacctctgcagggacactggtggctcctccagttcctcctcctcctctgacaacgagctcgccccatttgcccgggctaagtcactgccaccctccccggtgacacactcaccactgctgcacccccggggcttcctgcggccctcggccagcctgcctgaggaagccgaggccagtgagcgctccaccgaggccccagctccgcctgcatctcccgagggtgccgggccaccggccgcccagggctgcgtgccccggcacagcgtcatccgcagcctgttctaccaccaggcgggtgagagccctgagcacggggccctggccccggggagcaggcggcacccggcccggcggcggcacctgctgaagggcgggtacattgcgggggcgctgccaggcctgcgcgagccactgatggagcaccgcgtgctggaggaggaggccgccagggaggagcaggccaccctcctggccaaagccccctcattcgagactgccctccggctgcctgcctctggcacccacttggcccctggccacagccactccctggaacatgactctccgagcaccccccgcccctcctcggaggcctgcggtgaggcacagcgactgccttcagccccctccgggggggcccctatcagggacatggggcaccctcagggctccaagcagcttccatccactggtggccacccaggcactgctcagccagagaggccatccccggacagcccttggg

SEQ ID NO: 68760 - DNA, 32 bp, Homo sapiens
  misc_feature 1..32: note = chr1:228560007-228560039
  misc_feature 1..32: note = hypo
  source 1..32: mol_type = genomic DNA
ttctccctgggtggtcgcgggggctacgcagg

SEQ ID NO: 68761 - DNA, 45 bp, Homo sapiens; identical to SEQ ID NO: 26914
  misc_feature 1..45: note = chr1:228566475-228566520
  misc_feature 1..45: note = hyper
  source 1..45: mol_type = genomic DNA

SEQ ID NO: 68762 - DNA, 246 bp, Homo sapiens
  misc_feature 1..246: note = chr1:228566723-228566969
  misc_feature 1..246: note = hyper
  source 1..246: mol_type = genomic DNA
ctcactccgatgctccgcgcgttcagcccctcggggcgtctccgtcctcacacccatgcgcgtttattccacccgccgtgcgccttcctctcttccatcacgctgacctgcagccccgcagcccgctttctccgccgtcgggccagccgcttgtttccacaacttctctgccccgggaagagttcttgggcaaagcgtgcaagcgagggcgagaagccgcgggccacgatccgctggaggagagga

SEQ ID NO: 68763 - DNA, 328 bp, Homo sapiens
  misc_feature 1..328: note = chr1:228603596-228603924
  misc_feature 1..328: note = hyper
  source 1..328: mol_type = genomic DNA
cacagatgcacatatcggtaaacatacatgcatgtacacacaggtacacgcgcgcacacacgcacaggcacacaagcatgcacatagatgccccctgcaatctcaacactcgcgaccccacgcagtggagatctacagactttcgcctacgccacggggttgctatggggaccgagttgcagaaggagttgaaaatcgcgtctacactgcaagcacgattctccccttccgttctgccatcccctaaagcgagggcgtctaggggtctcagacttccccggctctgtcccacgtccagtttctcggagctttctgcacgccaaccacc

SEQ ID NO: 68764 - DNA, 486 bp, Homo sapiens; identical to SEQ ID NO: 26917
  misc_feature 1..486: note = chr1:228604123-228604609
  misc_feature 1..486: note = hyper
  source 1..486: mol_type = genomic DNA

SEQ ID NO: 68765 - DNA, 433 bp, Homo sapiens
  misc_feature 1..433: note = chr1:228633487-228633920
  misc_feature 1..433: note = hyper
  source 1..433: mol_type = genomic DNA
aaggcgcctgtcactcgtcactctccacgcgggctggctctggaaagcccaaaggaaaaaaccctcactttcaggaagaataagcctcagcccatgtatctagggaacacgtgatgctgcaagaaaccagtgacttaacgcgtgtaaaagcaggagagcgtcagaggttctgaccccgggggaggagcagacccgcggcagcgtgcggagacttagcgggcggaatctgccaccaacgcaacctggcccagaggttttgaactgaccaactgggagacgtccccgagcttgaataagggcctcaaaagcttagcgttttatgcagagtcgcaaccacccagcgctgggaacctgagcctgcacaacccactagaaagcacccgtgaccgtcccctgcgcccgttatccctgcgccccgcacccctgtatcccc

SEQ ID NO: 68766 - DNA, 29 bp, Homo sapiens
  misc_feature 1..29: note = chr1:228633921-228633950
  misc_feature 1..29: note = hyper
  source 1..29: mol_type = genomic DNA
gcttctctgcagctgtacaccctgcactg

SEQ ID NO: 68767 - DNA, 278 bp, Homo sapiens
  misc_feature 1..278: note = chr1:228633983-228634261
  misc_feature 1..278: note = hyper
  source 1..278: mol_type = genomic DNA
cgcaggtctccaaaacgaatcccggcttggaggggctcagcggccctgggcctgtgcgccgttgcggccgggagggtcattttcatgcctaaggacccgccccttgcacgcaacctcgggtagccagccggaaacggcgtcccgggctccaaaggacatctctttttacatttcagcaaaacagccgcacaccttctccccagatggcctctgtgcagcctgaaaatgcccgctccctccaagtccctgggcaattgctgggacgcatctcagagact

SEQ ID NO: 68768 - DNA, 343 bp, Homo sapiens
  misc_feature 1..343: note = chr1:228644901-228645244
  misc_feature 1..343: note = hyper
  source 1..343: mol_type = genomic DNA
acacgttgcccacctcgcaagtatgcagcccaatcagtccccagggtctcggttcccgttgcgcccttccccatggccactgcgctcattcatgagcctagggtgatcaggcctccggcctataaagaactgcaggatcagtgcggctcttttctcgagatagtaggtggctctgaaaagagcctttatgtccatcaaaggggccccgggggcggcgggcggcctcacttgcccttggccttgtggtggctctccgtcttcttgggcagcagtacggcctggatgttgggcaggacgccaccctgcgcgatggtcacgcggcccagcagcttgttgagctcct

SEQ ID NO: 68769 - DNA, 586 bp, Homo sapiens
  misc_feature 1..586: note = chr1:228645305-228645891
  misc_feature 1..586: note = hyper
  source 1..586: mol_type = genomic DNA
cgccgcgttgccggcaagctccaggatctcggcagtcaagtactcgagcaccgcggccagatagaccggggcgccggcgcccacgcgctccgaatagttgcccttgcggagcaaccggtgcacgcggcccacggggaactgcagccccgcgcgcgacgagcgcgacttagccttggcgcgcgccttgccaccctgcttaccacgaccggacatttccgagtcaaggaaaaaagacaacggcaaccgaaaagcgagactaaaaacaagagggcagtgaaggccagcgagcccttatgtatggtacagaggtaggctagaccgcggcgttcgattggatggctatggtagccaatcagaaaaagaacctggcactcctaatttgcgtattcctttcccagcgatgacgtagaacaacgtttgatccaatcagaagtgagcaaatcctgagccttcatttgaatacaaaacgtacaaatagagttactccgagcgccgcgcgtttctgtttggagagactcagccatcatgccagacccgtccaaatcggctcctgcgcccaagaagggttctaaaaaggctgtcacca

SEQ ID NO: 68770 - DNA, 360 bp, Homo sapiens
  misc_feature 1..360: note = chr1:228646191-228646551
  misc_feature 1..360: note = hyper
  source 1..360: mol_type = genomic DNA
agtacaccagctccaagtgaggcgttcctcggcgtcctgaacccaaaggctcttttcagagccacccacacgatcaagaaagggtttcgaacacggtgaagggttatgtaacctaatgtgtctccatgcaccctagcggttgccgggtgcggccgaatctgagccgtgtgtgtgtgtgtgtgtgtgtgtgtgtgcgcgcgcgcgccggcacagaacgagaaaaactgctcgttacagaaatcggggtagaaactgctcaggtgatgtagctcagtaatgttgggaggcgatcaaggaccccctctccatcccctccctccgcgcagagctattaactcacgacgagatttcttttttttt

SEQ ID NO: 68771 - DNA, 90 bp, Homo sapiens
  misc_feature 1..90: note = chr1:228646851-228646941
  misc_feature 1..90: note = hyper
  source 1..90: mol_type = genomic DNA
gcacctggccccaaatgtcttttataagcaagtggtgcattcctggatgttgagcgcttgcgcccggttcaggaccgggtccaaatgagg

SEQ ID NO: 68772 - DNA, 123 bp, Homo sapiens
  misc_feature 1..123: note = chr1:228647194-228647317
  misc_feature 1..123: note = hyper
  source 1..123: mol_type = genomic DNA
ttcctggcaggataccgcgatggcaggatgtttgataccgaatcgaagcacggcgtcaaagcagcgtcctgcgcgggggagccggatgtaataagcgaccccagctgccggtaactttaaccc

SEQ ID NO: 68773 - DNA, 648 bp, Homo sapiens; identical to SEQ ID NO: 26927
  misc_feature 1..648: note = chr1:228651254-228651902
  misc_feature 1..648: note = hyper
  source 1..648: mol_type = genomic DNA

SEQ ID NO: 68774 - DNA, 211 bp, Homo sapiens; identical to SEQ ID NO: 26928
  misc_feature 1..211: note = chr1:228652242-228652453
  misc_feature 1..211: note = hyper
  source 1..211: mol_type = genomic DNA

SEQ ID NO: 68775 - DNA, 121 bp, Homo sapiens; identical to SEQ ID NO: 26929
  misc_feature 1..121: note = chr1:228652508-228652629
  misc_feature 1..121: note = hyper
  source 1..121: mol_type = genomic DNA

SEQ ID NO: 68776 - DNA, 30 bp, Homo sapiens
  misc_feature 1..30: note = chr1:228671304-228671334
  misc_feature 1..30: note = hypo
  source 1..30: mol_type = genomic DNA
aggcgtgagccaccgcgaccagccttttgc

SEQ ID NO: 68777 - DNA, 134 bp, Homo sapiens
  misc_feature 1..134: note = chr1:228677767-228677901
  misc_feature 1..134: note = hypo
  source 1..134: mol_type = genomic DNA
gtgccattttctctgcgtttcataaattcctatctccttcttttaacctgaaagacagagtgcttttcacaggtgcagcagctcttgggtaactggctgcatctcgaggctgaggcccacgtttttaccccagc

SEQ ID NO: 68778 - DNA, 94 bp, Homo sapiens
  misc_feature 1..94: note = chr1:228870805-228870899
  misc_feature 1..94: note = hyper
  source 1..94: mol_type = genomic DNA
ggagccgtggccagccgggggctccacggagtgaataggaggcggctcaggcttcctggctcgcgtgggcgccagaaagcggaacctcccgggc

SEQ ID NO: 68779 - DNA, 369 bp, Homo sapiens
  misc_feature 1..369: note = chr1:228871227-228871596
  misc_feature 1..369: note = hyper
  source 1..369: mol_type = genomic DNA
agcgcttgggatccacggcgctcggaccgctgtcctccaacagcgcagggcagagcggctggcgccgccggagcgcggagccacgaccctccctggccgcctttgtctactggccgtgcggcccggaaccgccactctccagggccggggacgcgcccgcagctgtcggtgacagctcctccctaccgcaaccctccggggcggaggggcggtcgggccgggccctgctagcccgcgaccgcaagcccgcgctcgcggatcgatgcccccgcagcagggggaccccgcgttccccgaccgctgcgaggcgcctccggtgccgccgcgtcgggagcgcggtggacgcgggggacgcgggcctggggagcc

SEQ ID NO: 68780 - DNA, 585 bp, Homo sapiens
  misc_feature 1..585: note = chr1:22889595-22890180
  misc_feature 1..585: note = hyper
  source 1..585: mol_type = genomic DNA
cggagtgtgtcaccacgcgaagcactcggtgttggggtcatgcgggcaggagcgagcatgcggtggatgtgcggcccgcgcgtgtgtccacagagggaatccctgggtgggtctggtcctggtgtcgccgggacgtcccgatggtggcttcgcgcactggggccctgagccctgagtccaagtgcgcagcgcggggcgcgcccccgaaggtgcccgccgggggagtgtgggcgtgcgcacgtgcggcggcggtggccgcgggccgggtggccgcggtgcgggctccgtgtcccccacccccccgcctcggtgctgattggctcggcgccgtgacgggccggcccccgcccggggcggcggcggcggcggcgggcgcgggtgcccgcgtgtgcgctgggagccgcgtgtgcgccggggtgtgcgcccggccgggtgtgcggagagcgagggagcgcgctccctcccgacgcgcgggccgcagcggccaagcccgagggtgcgtggcgcccccgcccgcccggcccggcccggccatggcccccgcccggggccgcctgccccctgcgctctgggtcgtcacggccg

SEQ ID NO: 68781 - DNA, 220 bp, Homo sapiens
  misc_feature 1..220: note = chr1:22890189-22890409
  misc_feature 1..220: note = hyper
  source 1..220: mol_type = genomic DNA
cggccacctgcgtgtccgcggcgcgcggcgaaggtgagcggcggcggcggggcggggcaggggcggccgaggggcgcggggcgcggcgcgcgctgcctgcggctcaacttcctttgcatggaccctgagctccaaggcggccgggatccctcggcccggggggcggggtggcaccgcggaagagacccgggattaagggacagagcggtggagatgggaa

SEQ ID NO: 68782 - DNA, 46 bp, Homo sapiens; identical to SEQ ID NO: 39283
  misc_feature 1..46: note = chr1:228919370-228919416
  misc_feature 1..46: note = hypo
  source 1..46: mol_type = genomic DNA

SEQ ID NO: 68783 - DNA, 30 bp, Homo sapiens
  misc_feature 1..30: note = chr1:22893250-22893280
  misc_feature 1..30: note = hypo
  source 1..30: mol_type = genomic DNA
tgggcctaatggtggcgttctcttcagcac

SEQ ID NO: 68784 - DNA, 193 bp, Homo sapiens
  misc_feature 1..193: note = chr1:22896425-22896618
  misc_feature 1..193: note = hypo
  source 1..193: mol_type = genomic DNA
gagtaggagtgagcccgcgagcctggtgagatcccagctctgcccttgacaagcaggtggacttgggtcaccatttcacctctctgagtctcagtttccccatctatagaaagggacaagtctgtgatgacctcccaggtctgcgccagggtgagagcagatgacacagtcttggcaccgagtctggcacagg

SEQ ID NO: 68785 - DNA, 154 bp, Homo sapiens
  misc_feature 1..154: note = chr1:22900779-22900933
  misc_feature 1..154: note = hypo
  source 1..154: mol_type = genomic DNA
ttctttctttcttgtttattctggtgaaatacacataaggtaaagtttaccgtcttaaccctttttaagcgcacaccttggtgacatgtagtgcattcacattgctgtgtggccatcaccaccaccactgccagaactccgttcatcctgcaaa

SEQ ID NO: 68786 - DNA, 107 bp, Homo sapiens
  misc_feature 1..107: note = chr1:22902850-22902957
  misc_feature 1..107: note = hypo
  source 1..107: mol_type = genomic DNA
atcaagtttaccctgcgcgactgcaacagcatgcctggtgtgctgggcacctgcaaggagaccttcaacctctactacctggagtcggaccgcgacctgggggccag

SEQ ID NO: 68787 - DNA, 78 bp, Homo sapiens
  misc_feature 1..78: note = chr1:22903278-22903356
  misc_feature 1..78: note = hypo
  source 1..78: mol_type = genomic DNA
caagatgtactgcagcgcggagggcgagtggctcgtgcccatcggcaaatgcgtgtgcagtgccggctacgaggagcg

SEQ ID NO: 68788 - DNA, 222 bp, Homo sapiens
  misc_feature 1..222: note = chr1:22927359-22927581
  misc_feature 1..222: note = hypo
  source 1..222: mol_type = genomic DNA
gacggctgagcccagcgctgatcccctgcaggtcatcagctctgtggaggaggggtaccgcctgcccgcacccatgggctgcccccacgccctgcaccagctcatgctcgactgttggcacaaggaccgggcgcagcggcctcgcttctcccagattgtcagtgtcctcgatgcgctcatccgcagccctgagagtctcagggccaccgccacagtcagcag

SEQ ID NO: 68789 - DNA, 48 bp, Homo sapiens; identical to SEQ ID NO: 26132
  misc_feature 1..48: note = chr1:22933907-22933955
  misc_feature 1..48: note = hyper
  source 1..48: mol_type = genomic DNA

SEQ ID NO: 68790 - DNA, 30 bp, Homo sapiens
  misc_feature 1..30: note = chr1:229354058-229354088
  misc_feature 1..30: note = hypo
  source 1..30: mol_type = genomic DNA
agtacaaaggactcccgtatccccttcact

SEQ ID NO: 68791 - DNA, 165 bp, Homo sapiens
  misc_feature 1..165: note = chr1:229542788-229542953
  misc_feature 1..165: note = hyper
  source 1..165: mol_type = genomic DNA
cccgccctggtctctcggtttagttcatgctgaggttggtcgcttgtttcattcactgtctcctacgcagtccatgccacgggggataagtttttcacaagtggctttttttccccacagtgaagagacgtggcctgggtctggagttcctcaaccggcaaaata

SEQ ID NO: 68792 - DNA, 316 bp, Homo sapiens
  misc_feature 1..316: note = chr1:229543220-229543536
  misc_feature 1..316: note = hyper
  source 1..316: mol_type = genomic DNA
cgagagggagctctggtccccgaggggctgtcccgggagggagcgaggtggggagggggagcaggccctgccccgagcaccccgcggactgagcgtctggcgtgcacggcggaggggttaccgcggggaggtgacaccccagggtggtgagggcacgcagatgaggctggcctgaggggtgcctgctttggggaaagcagtctgtggagggagggaaggagggcgatcgcggccccacgcgggttgtgctgctgaggctccgcgccgcaggaaaggcaccctagccggattcgccctcggacgccccagctgggca

SEQ ID NO: 68793 - DNA, 257 bp, Homo sapiens; identical to SEQ ID NO: 26933
  misc_feature 1..257: note = chr1:229566603-229566860
  misc_feature 1..257: note = hyper
  source 1..257: mol_type = genomic DNA

SEQ ID NO: 68794 - DNA, 190 bp, Homo sapiens
  misc_feature 1..190: note = chr1:229567087-229567277
  misc_feature 1..190: note = hyper
  source 1..190: mol_type = genomic DNA
gttaatgtatgtacacgttataaacactgtgtcagtttacgatggcagcaacggaagttgttacaaagaaagtgactgcggggtggctggagctcagccgcccccccattgagaagattcgtcgtcctgagaagtcgcgtgctggaggtggagtgtgtctagaagcatttgcggtggacgatggaagggc

SEQ ID NO: 68795 - DNA, 624 bp, Homo sapiens; identical to SEQ ID NO: 134
  misc_feature 1..624: note = chr1:229567369-229567993
  misc_feature 1..624: note = hyper
  source 1..624: mol_type = genomic DNA

SEQ ID NO: 68796 - DNA, 217 bp, Homo sapiens
  misc_feature 1..217: note = chr1:229568157-229568374
  misc_feature 1..217: note = hyper
  source 1..217: mol_type = genomic DNA
cgccggagtccagcacgatgcctgtgcgcgcgcgggagagagtgagtggctgggggcgaggccgaggctaggctctcagcgctagcggcgggggcgggggcgggggcgggggcgggagaggggactgggggcagcgggcactcaccggtggtcctgccggaggcgtagagggacagcacggcctggatggccacgtacatggcgggcacgttgaagg

SEQ ID NO: 68797 - DNA, 1128 bp, Homo sapiens; identical to SEQ ID NO: 26937
  misc_feature 1..1128: note = chr1:229569458-229570586
  misc_feature 1..1128: note = hyper
  source 1..1128: mol_type = genomic DNA

SEQ ID NO: 68798 - DNA, 33 bp, Homo sapiens
  misc_feature 1..33: note = chr1:229706004-229706037
  misc_feature 1..33: note = hypo
  source 1..33: mol_type = genomic DNA
attacaggcgtaaaccaccgcacccagccgtct

SEQ ID NO: 68799 - DNA, 30 bp, Homo sapiens
  misc_feature 1..30: note = chr1:229764690-229764720
  misc_feature 1..30: note = hypo
  source 1..30: mol_type = genomic DNA
gagtcatcttggcagcgtggccatcacctg

SEQ ID NO: 68800 - DNA, 30 bp, Homo sapiens
  misc_feature 1..30: note = chr1:229911522-229911552
  misc_feature 1..30: note = hypo
  source 1..30: mol_type = genomic DNA
gtcgtgccctagcatcgctttaagaattta

SEQ ID NO: 68801 - DNA, 150 bp, Homo sapiens
  misc_feature 1..150: note = chr1:230080008-230080158
  misc_feature 1..150: note = hypo
  source 1..150: mol_type = genomic DNA
gggtggcacctagggcgtatgggaacagcagcagtgggagacaggtgagcatgtcagtgccaggccactggttctctgattgcccgggttctgtgtttctccttctctcactgttccttgcttcacggcttctcacggtgctgccccaga

SEQ ID NO: 68802 - DNA, 64 bp, Homo sapiens; identical to SEQ ID NO: 39285
  misc_feature 1..64: note = chr1:230107209-230107273
  misc_feature 1..64: note = hypo
  source 1..64: mol_type = genomic DNA

SEQ ID NO: 68803 - DNA, 30 bp, Homo sapiens; identical to SEQ ID NO: 26938
  misc_feature 1..30: note = chr1:230240615-230240645
  misc_feature 1..30: note = hyper
  source 1..30: mol_type = genomic DNA

SEQ ID NO: 68804 - DNA, 73 bp, Homo sapiens; identical to SEQ ID NO: 26133
  misc_feature 1..73: note = chr1:23038177-23038250
  misc_feature 1..73: note = hyper
  source 1..73: mol_type = genomic DNA

SEQ ID NO: 68805 - DNA, 132 bp, Homo sapiens
  misc_feature 1..132: note = chr1:230404233-230404365
  misc_feature 1..132: note = hypo
  source 1..132: mol_type = genomic DNA
gcctctgctggaaagcgacacaccttacgctacagcacattaaacagaagcgtgtgctcaggccccggccgagagagttcgtcatcagagtctcgggccccagcttcatcccctgtgcgtcaggctctgtga

SEQ ID NO: 68806 - DNA, 72 bp, Homo sapiens; identical to SEQ ID NO: 39287
  misc_feature 1..72: note = chr1:230423782-230423854
  misc_feature 1..72: note = hypo
  source 1..72: mol_type = genomic DNA

SEQ ID NO: 68807 - DNA, 176 bp, Homo sapiens
  misc_feature 1..176: note = chr1:230424479-230424655
  misc_feature 1..176: note = hypo
  source 1..176: mol_type = genomic DNA
tggacttccggcatccggggctgtgcgttgtgcaagcccccccgagcctgcactgttttgttctggcagctccaagctgactcatacaagcccagagccctcgcaattcccacacgccacatgcatggctcagctgcacctcctgccagctccaaacctcacggcacagggtacac

SEQ ID NO: 68808 - DNA, 154 bp, Homo sapiens
  misc_feature 1..154: note = chr1:2304327-2304481
  misc_feature 1..154: note = hypo
  source 1..154: mol_type = genomic DNA
ttgggttttcctgcccgtggaatgttcccgcacgtcttcccgctggtcgggatttaggccctgcattccctgcatctgagtcagcaccctgaggtgctggacctgggactagggcaaggcctggcaagggtgggtccaccggctggccagtgcc

SEQ ID NO: 68809 - DNA, 65 bp, Homo sapiens
  misc_feature 1..65: note = chr1:230453297-230453362
  misc_feature 1..65: note = hypo
  source 1..65: mol_type = genomic DNA
ccaagaacagaggtgcgctgccgggggctgacccttggggaggggagggccgaggctgatttatc

SEQ ID NO: 68810 - DNA, 73 bp, Homo sapiens
  misc_feature 1..73: note = chr1:230453632-230453705
  misc_feature 1..73: note = hypo
  source 1..73: mol_type = genomic DNA
cacaatcaagtctcccgcaggagtctcctcattacgaccgtgtatacatgggtatacacggaagggtgaaggt

SEQ ID NO: 68811 - DNA, 54 bp, Homo sapiens
  misc_feature 1..54: note = chr1:230458365-230458419
  misc_feature 1..54: note = hypo
  source 1..54: mol_type = genomic DNA
gatcatgcaaagagccgtgactgaggccggggtcagcgtcgggggtggagagga

SEQ ID NO: 68812 - DNA, 796 bp, Homo sapiens
  misc_feature 1..796: note = chr1:230561177-230561973
  misc_feature 1..796: note = hyper
  source 1..796: mol_type = genomic DNA
caggagcagtcagaccgatcaccgctcctgcagcctcatttgtttccggagagacacccacaagccagcccacggagagtctggactcgcccgccccagcacccacgcctcccccgcgcccggttccagcgccgcccccgacatccacccgcgggcagccccttaccgccggtatcctcgaagcgcgggggcgggcggtcccgcagcgctgcgctccagcccgcgccggcctcgtcctcctccggctcctgtgcgtccggggcgcggggcggtggcggggcggcccctgggggtcccgggggctcgcgctcgtcgtccgaggaggcggccgaggaggagcgcgaggcggccgaggtgctgtagaaggggttcccgccgctgtccgggccggactcgccgaacacgtcgtccgagatgtgcaggctctcgtagcgcgcgcgggcagcctcgagcagcgccggcgccctcctccgcgcgcccccgccgccctcggccatggccccggccgccgcccgcgcgcccgcccccacagtgcctcccagccgcacacgccgggccctgggcccgcgccgcggcccgccgccccccaccagcgcagcccgcagcacagcgcccgccgccccgtgcccggccggcccgccgtcttggccgcctcgggcccagcgcccggggaagcgccctcggagctcgggcgccgcaggctgcgggccgcggcgggaggcgagccgcgcgcggggctggcaggggcgacccagagcgggcgggacgcagaggctgcggccgagaccaggcgccg

SEQ ID NO: 68813 - DNA, 268 bp, Homo sapiens
  misc_feature 1..268: note = chr1:2307626-2307894
  misc_feature 1..268: note = hypo
  source 1..268: mol_type = genomic DNA
tcctatgactccagacgttcccaccaaactgggtgagagtccaacgcatttgattggcatctcttgagggtcccttcctgggaccattgtcctcactgtctctcatctcattcacgctggacggggagaggcgcgagtcagcgcacagctgagggctcttcagggcgtccggggcccccgtcaccgtcagtgatgagaatggcgatgtctggtctctgcccccttccacctgctcggcctctggaaggtgccccgggctttcaggagg

SEQ ID NO: 68814 - DNA, 553 bp, Homo sapiens; identical to SEQ ID NO: 38740
  misc_feature 1..553: note = chr1:2308105-2308658
  misc_feature 1..553: note = hypo
  source 1..553: mol_type = genomic DNA

SEQ ID NO: 68815 - DNA, 30 bp, Homo sapiens
  misc_feature 1..30: note = chr1:230841649-230841679
  misc_feature 1..30: note = hypo
  source 1..30: mol_type = genomic DNA
cattccaggggagaccgggaggctcctacc

SEQ ID NO: 68816 - DNA, 48 bp, Homo sapiens
  misc_feature 1..48: note = chr1:2309850-2309898
  misc_feature 1..48: note = hypo
  source 1..48: mol_type = genomic DNA
ggcagtaggcccaaacgtggaggctataggccccgtggaggcccccgg

SEQ ID NO: 68817 - DNA, 128 bp, Homo sapiens; identical to SEQ ID NO: 39292
  misc_feature 1..128: note = chr1:230992827-230992955
  misc_feature 1..128: note = hypo
  source 1..128: mol_type = genomic DNA

SEQ ID NO: 68818 - DNA, 96 bp, Homo sapiens
  misc_feature 1..96: note = chr1:2310148-2310244
  misc_feature 1..96: note = hypo
  source 1..96: mol_type = genomic DNA
ctactctgtctgctccgtctcccaccgaggatgttctggaggacgtgtggggcctgcccaagccctcgggtcctgggaggtcgagcagtaagctgt

SEQ ID NO: 68819 - DNA, 35 bp, Homo sapiens
  misc_feature 1..35: note = chr1:231019380-231019415
  misc_feature 1..35: note = hypo
  source 1..35: mol_type = genomic DNA
aaaaaaaaaaaaaaaaaaagcgaaaccacctcttt

SEQ ID NO: 68820 - DNA, 30 bp, Homo sapiens
  misc_feature 1..30: note = chr1:231037612-231037642
  misc_feature 1..30: note = hypo
  source 1..30: mol_type = genomic DNA
ttaaggctaagaatgcggcagtcaaatccc

SEQ ID NO: 68821 - DNA, 43 bp, Homo sapiens
  misc_feature 1..43: note = chr1:231150213-231150256
  misc_feature 1..43: note = hypo
  source 1..43: mol_type = genomic DNA
tgtattttgtagagaaggggttttaccacgttgcccaggctta

SEQ ID NO: 68822 - DNA, 53 bp, Homo sapiens; identical to SEQ ID NO: 39293
  misc_feature 1..53: note = chr1:231163086-231163139
  misc_feature 1..53: note = hypo
  source 1..53: mol_type = genomic DNA

SEQ ID NO: 68823 - DNA, 28 bp, Homo sapiens
  misc_feature 1..28: note = chr1:231205699-231205727
  misc_feature 1..28: note = hypo
  source 1..28: mol_type = genomic DNA
aaccgcagtgtccatcggtggatgaatg

SEQ ID NO: 68824 - DNA, 30 bp, Homo sapiens
  misc_feature 1..30: note = chr1:231269325-231269355
  misc_feature 1..30: note = hypo
  source 1..30: mol_type = genomic DNA
tgtccgcgaggacagcgtgctcacaccctg

SEQ ID NO: 68825 - DNA, 67 bp, Homo sapiens
  misc_feature 1..67: note = chr1:231296717-231296784
  misc_feature 1..67: note = hyper
  source 1..67: mol_type = genomic DNA
gccccaagccctgggcgcaggctgcagcttccccctgcctgaccccgccagcctgcgcctcctcacc

SEQ ID NO: 68826 - DNA, 286 bp, Homo sapiens; identical to SEQ ID NO: 26941
  misc_feature 1..286: note = chr1:231296817-231297103
  misc_feature 1..286: note = hyper
  source 1..286: mol_type = genomic DNA

SEQ ID NO: 68827 - DNA, 465 bp, Homo sapiens
  misc_feature 1..465: note = chr1:231297104-231297569
  misc_feature 1..465: note = hyper
  source 1..465: mol_type = genomic DNA
cagctcgtggctggcgttggagaatgtggagattttcccattcataaaaggaacgtctccgcttgccgccttcccgtccgccgcacaccgccacatccgcagcggggtagggctgggtctgggggcgctgggttcccaggggtctacccgggcgcgctctcgcctttctcaggaaaccccattttgtgagcggcaccgcgtgtcctctctcagtccgtgcacacagttgacctggagcgcggatgagcacccttggttgaaaggaagagacaaaatggcttgtggttcaattcataaataaaacctcacccttggacttcaggctgcccgacattttgggacttggatttttttgctttatcgtagttttaggaagcgactgtcaggccatgttgcctatccatttctaaacgactggctttttaggatcccgttttcacccttctatggcggtgggttgggggt

SEQ ID NO: 68828 - DNA, 854 bp, Homo sapiens
  misc_feature 1..854: note = chr1:231297797-231298651
  misc_feature 1..854: note = hyper
  source 1..854: mol_type = genomic DNA
gaaattacaactcctcggcgcgccgcgcggggaggcagcggcagcggcgggagggaggcggggaggggattcccgagccagccggacgctcgccctccgcccgccggctgcagcgtcgcgcggcccaaggtcagaggcgccgcaggagcagcagctgggaaccagggaagcgggtcaatcccggccgcagggagaaagccccagggcgcagtcagccggcgtccacagccgcccaggagtagggtgagcggctgtctccgggccggtcgggtcccgccgaggtggccgcggccccagcgacccggcgggtggcggcccaggggtcggcgagcaggcagctggagccccaccttcggctcccgggcgctgtccgccgcctcgtggtgctgatcccagccccacggctgagcggccttcgcacctgcctgtctcacctcgctatcaccccgataaggagttgggccggggcagaaggggggcctcggggtagccgcccaccggagccaggggctgaagcagcgagcgcacagcagcccggccgctggtcctggggtggagaggaggcgcgcgctgcagccggcggcggcgctggtgctgattcatcacctaaagctcctcgcaggccaccgcgagggcagccgaccggctccggaatctggccgcaggttgaagccgctggtgcgggaccctcgggcaggaggtgaggaccccctcccttctctcgcccctcaatcatcttagggcggtggctacaggacagagagaggggcgtgcccctcggctgtgaagtgggcatgcccgtgtgatgcccccgcccgtcgtctcaccggggcgcaccgcgctggtcctcctcc

SEQ ID NO: 68829 - DNA, 56 bp, Homo sapiens
  misc_feature 1..56: note = chr1:231298652-231298708
  misc_feature 1..56: note = hyper
  source 1..56: mol_type = genomic DNA
ccagtctcccgagctccggccattcatccccagcgcagagcagcgctggcagccgg

SEQ ID NO: 68830 - DNA, 295 bp, Homo sapiens
  misc_feature 1..295: note = chr1:231298924-231299219
  misc_feature 1..295: note = hyper
  source 1..295: mol_type = genomic DNA
cgctgcggctggcccggcctgcggcggtgcaggcgggagtgcagctggcggcctcggcggcggtgcgggaggtggcggagaccacgcggacaagctcagcttgtacagcgagacagacagcggctacgggtcctacaccccgagcctcaagtcccccaacggggttcgcgtgctgcccatggtgcccgcaccacccggctcctcggctgcggcggctcggggtgccgcctgctcctcgctgtcctcgtcttcgagctccatcacgtgcccgcagtgccaccgcagcgcatccctg

SEQ ID NO: 68831 - DNA, 36 bp, Homo sapiens
  misc_feature 1..36: note = chr1:231299423-231299459
  misc_feature 1..36: note = hyper
  source 1..36: mol_type = genomic DNA
aagtgccatccatcccggggacccttcgccaagcat

SEQ ID NO: 68832 - DNA, 163 bp, Homo sapiens; identical to SEQ ID NO: 26947
  misc_feature 1..163: note = chr1:231299478-231299641
  misc_feature 1..163: note = hyper
  source 1..163: mol_type = genomic DNA

SEQ ID NO: 68833 - DNA, 145 bp, Homo sapiens
  misc_feature 1..145: note = chr1:231475674-231475819
  misc_feature 1..145: note = hypo
  source 1..145: mol_type = genomic DNA
agactgctgtgaattcgcctgtatgtatcgttaaaaaaagtcactttgccctcagtgaaagcttgaattatggggcaaacaataatgaacaccttatgttttttatagtgcttcatagtaaaaaaaaaaaaaacaaaaaaaaggc

SEQ ID NO: 68834 - DNA, 413 bp, Homo sapiens
  misc_feature 1..413: note = chr1:2316053-2316466
  misc_feature 1..413: note = hypo
  source 1..413: mol_type = genomic DNA
gccccgcctcagctgcgccaccagtcttatccccgtgactggcccccagcacccttcttcctttggtttggctgaagatgggatttaagtcaaaagtgagagccgcctgtgagcttccctgcctctccgcgtacctcctgagtatacacaaggcacacatatgaatacactcctgtttttctcttttcccaacagggaactgtgaggggagagagaaacttatcttcccacacgggatcagggaatcgcagggcctggcacatggagaagctgccagggtgaggctccccatacaccccacgcgccctgcccaccacgaggcctgtaccctctgggcagcaggtgccgcgcgcccccgggtaccttgtaggtggagccgtcggcgcagcgcagcaccccgtgtccctgacgcc

SEQ ID NO: 68835 - DNA, 114 bp, Homo sapiens
  misc_feature 1..114: note = chr1:231663293-231663407
  misc_feature 1..114: note = hypo
  source 1..114: mol_type = genomic DNA
gagtttctctctagacggtgctgaattgccatctagttacctattctgacaccaggaacatgattcttcaacaaacattgacggaagcttacatgggaccggatcacagcgctg

SEQ ID NO: 68836 - DNA, 120 bp, Homo sapiens
  misc_feature 1..120: note = chr1:231738890-231739010
  misc_feature 1..120: note = hypo
  source 1..120: mol_type = genomic DNA
acattttcttcctttgacttgtttgcttgtgtttgttctcagtttttagaatcattaaacattttggccatatagaaaaatatacagaagcctggccgggcgtggtgactcacgcctgta

SEQ ID NO: 68837 - DNA, 30 bp, Homo sapiens
  misc_feature 1..30: note = chr1:232761027-232761057
  misc_feature 1..30: note = hypo
  source 1..30: mol_type = genomic DNA
taacaatttcatcaccggcttaagtaaaga

SEQ ID NO: 68838 - DNA, 30 bp, Homo sapiens; identical to SEQ ID NO: 39296
  misc_feature 1..30: note = chr1:232761388-232761418
  misc_feature 1..30: note = hypo
  source 1..30: mol_type = genomic DNA

SEQ ID NO: 68839 - DNA, 60 bp, Homo sapiens
  misc_feature 1..60: note = chr1:232765315-232765375
  misc_feature 1..60: note = hyper
  source 1..60: mol_type = genomic DNA
cctcagtgcctgtgtcgccgagacgggaataacctttcagccgatcgataacttggagag

SEQ ID NO: 68840 - DNA, 30 bp, Homo sapiens
  misc_feature 1..30: note = chr1:2330625-2330655
  misc_feature 1..30: note = hypo
  source 1..30: mol_type = genomic DNA
gggcccttgcttgtccgctttgtctctgtt

SEQ ID NO: 68841 - DNA, 30 bp, Homo sapiens
  misc_feature 1..30: note = chr1:233116414-233116444
  misc_feature 1..30: note = hypo
  source 1..30: mol_type = genomic DNA
gaactcagggccaaacgcacacagcctgta

SEQ ID NO: 68842 - DNA, 30 bp, Homo sapiens
  misc_feature 1..30: note = chr1:233118122-233118152
  misc_feature 1..30: note = hypo
  source 1..30: mol_type = genomic DNA
cacactcgagatgcccgctctcatagacgg

SEQ ID NO: 68843 - DNA, 33 bp, Homo sapiens; identical to SEQ ID NO: 38743
  misc_feature 1..33: note = chr1:2331363-2331396
  misc_feature 1..33: note = hypo
  source 1..33: mol_type = genomic DNA

SEQ ID NO: 68844 - DNA, 30 bp, Homo sapiens; identical to SEQ ID NO: 38744
  misc_feature 1..30: note = chr1:2336335-2336365
  misc_feature 1..30: note = hypo
  source 1..30: mol_type = genomic DNA

SEQ ID NO: 68845 - DNA, 292 bp, Homo sapiens
  misc_feature 1..292: note = chr1:233750219-233750511
  misc_feature 1..292: note = hyper
  source 1..292: mol_type = genomic DNA
ctgggacttcacctccgcgctcttcttcgccagcaccgtgctctccaccacaggtagggtatcctgcgcgccccctggccgccccggccacctcgcccacaacccacacaccccggccccggcgccccgggcccctctaaccctcccaccccaccccccacctttcgccatcccggctcctccagcccgcctcccctcactgtcctcccgaccctccgaccttccccttactggcgtccccggcctctgcctgggtgactcgggagggcaagccctgcggagccggaagcca

SEQ ID NO: 68846 - DNA, 174 bp, Homo sapiens; identical to SEQ ID NO: 38745
  misc_feature 1..174: note = chr1:2338063-2338237
  misc_feature 1..174: note = hypo
  source 1..174: mol_type = genomic DNA

SEQ ID NO: 68847 - DNA, 234 bp, Homo sapiens; identical to SEQ ID NO: 26950
  misc_feature 1..234: note = chr1:234040247-234040481
  misc_feature 1..234: note = hyper
  source 1..234: mol_type = genomic DNA

SEQ ID NO: 68848 - DNA, 89 bp, Homo sapiens
  misc_feature 1..89: note = chr1:234040885-234040974
  misc_feature 1..89: note = hyper
  source 1..89: mol_type = genomic DNA
gccccgggcgtgggtgagcgagccggcgggcgggaggccggagcgccggggtagccctttgcagctgggacactgggcagtctgaggct

SEQ ID NO: 68849 - DNA, 213 bp, Homo sapiens; identical to SEQ ID NO: 1897
  misc_feature 1..213: note = chr1:234041148-234041361
  misc_feature 1..213: note = hyper
  source 1..213: mol_type = genomic DNA

SEQ ID NO: 68850 - DNA, 209 bp, Homo sapiens
  misc_feature 1..209: note = chr1:234041415-234041624
  misc_feature 1..209: note = hyper
  source 1..209: mol_type = genomic DNA
cgggccggtggggctcacgtccatcgaggagcggatcctgcgcatcactggctactatggctaccagccctgggcagcgagctgcaaaagtaagaccccctcacgtcatgtttcccgttcactggtccatcttcttaccattgtcacagcagcctcggggagcgcacgcagtgaggcgtccagccaccccctcccgccctgcctgctga

SEQ ID NO: 68851 - DNA, 182 bp, Homo sapiens; identical to SEQ ID NO: 26954
  misc_feature 1..182: note = chr1:234349869-234350051
  misc_feature 1..182: note = hyper
  source 1..182: mol_type = genomic DNA

SEQ ID NO: 68852 - DNA, 289 bp, Homo sapiens
  misc_feature 1..289: note = chr1:234350052-234350341
  misc_feature 1..289: note = hyper
  source 1..289: mol_type = genomic DNA
gccgccgcagtgagcaacgcggcaaccggagcccggcgggcagccggggaggccgggactgagaggggcgagccgctggtgctccccggcggcagagggccgcgtcggccacgggcccgggagagacgcgctccagccggccccaggatgtaggcgatcggcggcagcgctcctgcaggcggccggctcatcatgaagaagcactcggcccgggtggccccgctcagcgcctgcaacagtccggtcctgacccttaccaaagtggaaggtaatgcgcggccgcctcgcc

SEQ ID NO: 68853 - DNA, 30 bp, Homo sapiens; identical to SEQ ID NO: 39297
  misc_feature 1..30: note = chr1:234445373-234445403
  misc_feature 1..30: note = hypo
  source 1..30: mol_type = genomic DNA

SEQ ID NO: 68854 - DNA, 278 bp, Homo sapiens; identical to SEQ ID NO: 39298
  misc_feature 1..278: note = chr1:234621065-234621343
  misc_feature 1..278: note = hypo
  source 1..278: mol_type = genomic DNA

SEQ ID NO: 68855 - DNA, 42 bp, Homo sapiens
  misc_feature 1..42: note = chr1:234625024-234625066
  misc_feature 1..42: note = hypo
  source 1..42: mol_type = genomic DNA
gaagtctagagaaagcgcttccaagcacgttttacctgctcc

SEQ ID NO: 68856 - DNA, 30 bp, Homo sapiens; identical to SEQ ID NO: 39300
  misc_feature 1..30: note = chr1:234724806-234724836
  misc_feature 1..30: note = hypo
  source 1..30: mol_type = genomic DNA

SEQ ID NO: 68857 - DNA, 30 bp, Homo sapiens
  misc_feature 1..30: note = chr1:234736426-234736456
  misc_feature 1..30: note = hyper
  source 1..30: mol_type = genomic DNA
aagcactttggacttcggactgtgttccta

SEQ ID NO: 68858 - DNA, 30 bp, Homo sapiens; identical to SEQ ID NO: 39301
  misc_feature 1..30: note = chr1:234795478-234795508
  misc_feature 1..30: note = hypo
  source 1..30: mol_type = genomic DNA

SEQ ID NO: 68859 - DNA, 30 bp, Homo sapiens
  misc_feature 1..30: note = chr1:234812002-234812032
  misc_feature 1..30: note = hyper
  source 1..30: mol_type = genomic DNA
cgtctttttccctgacgtggaaagattaca

SEQ ID NO: 68860 - DNA, 94 bp, Homo sapiens
  misc_feature 1..94: note = chr1:234845049-234845143
  misc_feature 1..94: note = hypo
  source 1..94: mol_type = genomic DNA
acgcagcagcagaaccggtgagttttgcctcagggaaattcacattcaaggggacaatcatctcagtctgaagggtacccgggagtttgacagg

SEQ ID NO: 68861 - DNA, 36 bp, Homo sapiens
  misc_feature 1..36: note = chr1:234881213-234881249
  misc_feature 1..36: note = hypo
  source 1..36: mol_type = genomic DNA
agagaaatggcgtaacgtgctcgtgaagaggcggca

SEQ ID NO: 68862 - DNA, 169 bp, Homo sapiens; identical to SEQ ID NO: 39303
  misc_feature 1..169: note = chr1:234882410-234882579
  misc_feature 1..169: note = hypo
  source 1..169: mol_type = genomic DNA

SEQ ID NO: 68863 - DNA, 242 bp, Homo sapiens
  misc_feature 1..242: note = chr1:234959367-234959609
  misc_feature 1..242: note = hypo
  source 1..242: mol_type = genomic DNA
gtttagaactgtagtcgaatccccttttatcacagaggaaactgagtcactgtgcagcgagggctggagggcatacagggtttgttacaagggaggactctcggagacacccccaatagaagcccttcagggagcgggccagcgggagagcacccccgaccacacctttgttctgcatttatatgtacagattcttatccctacgtataaattctacccacacatcccgagccatgtctgag

SEQ ID NO: 68864 - DNA, 42 bp, Homo sapiens
  misc_feature 1..42: note = chr1:234964788-234964830
  misc_feature 1..42: note = hypo
  source 1..42: mol_type = genomic DNA
tacccggtcagtgtgcggcggagcatacgtgcatgcctgggc

SEQ ID NO: 68865 - DNA, 140 bp, Homo sapiens
  misc_feature 1..140: note = chr1:235003811-235003951
  misc_feature 1..140: note = hypo
  source 1..140: mol_type = genomic DNA
aaaaaaaaaaaaaaaaaatttaattttaatccactcggattttaaaatagcatatcacgatggaaaaagccttgaacttggagtgtaaggggcctgggttgaagttccattctagctgtgtgaatcggtcacatttctgg

SEQ ID NO: 68866 - DNA, 39 bp, Homo sapiens; identical to SEQ ID NO: 39306
  misc_feature 1..39: note = chr1:235005711-235005750
  misc_feature 1..39: note = hypo
  source 1..39: mol_type = genomic DNA

SEQ ID NO: 68867 - DNA, 128 bp, Homo sapiens
  misc_feature 1..128: note = chr1:235034454-235034582
  misc_feature 1..128: note = hypo
  source 1..128: mol_type = genomic DNA
ggcctaacaaaatctcgggttcagagcagatccttaaagccttccagtccagctccctggttaggctcatgagacggccacgatgtgtctgcccagtgacaaccagcacaaaccggaaggtccacccc

SEQ ID NO: 68868 - DNA, 79 bp, Homo sapiens
  misc_feature 1..79: note = chr1:2351881-2351960
  misc_feature 1..79: note = hypo
  source 1..79: mol_type = genomic DNA
atccacagtgggatgcggggctgaacggttatgtcccggtaggtaggggctgcagaaagagccccgagggctggggagt

SEQ ID NO: 68869 - DNA, 30 bp, Homo sapiens
  misc_feature 1..30: note = chr1:235260531-235260561
  misc_feature 1..30: note = hypo
  source 1..30: mol_type = genomic DNA
gattgctgactctgacggcagctgggctgc

SEQ ID NO: 68870 - DNA, 155 bp, Homo sapiens
  misc_feature 1..155: note = chr1:235267075-235267230
  misc_feature 1..155: note = hypo
  source 1..155: mol_type = genomic DNA
aaaaaaaggaaaaaaaaaaaaaaagaagatattctcatgccctttggaaatgaggcacctaagcctcagagaagttaagtgccccagtacgctgcacatttagaactcaaacccaagcccctgcttctaaaaaccgtgttcgttccgccacccca

SEQ ID NO: 68871 - DNA, 76 bp, Homo sapiens; identical to SEQ ID NO: 39308
  misc_feature 1..76: note = chr1:235292638-235292714
  misc_feature 1..76: note = hypo
  source 1..76: mol_type = genomic DNA

SEQ ID NO: 68872 - DNA, 16 bp, Homo sapiens
  misc_feature 1..16: note = chr1:235325301-235325317
  misc_feature 1..16: note = hypo
  source 1..16: mol_type = genomic DNA
ccaggtgcggtggctc

SEQ ID NO: 68873 - DNA, 120 bp, Homo sapiens
  misc_feature 1..120: note = chr1:235325377-235325497
  misc_feature 1..120: note = hypo
  source 1..120: mol_type = genomic DNA
tgaaccagcctggtcgatctagcgagacttattctctacagaaaagaaattagacgggcaccttcgcgctcggcgcctgtagtcccagcactttgagaggctcgggcaagaggatccctt

SEQ ID NO: 68874 - DNA, 15 bp, Homo sapiens
  misc_feature 1..15: note = chr1:235325557-235325572
  misc_feature 1..15: note = hypo
  source 1..15: mol_type = genomic DNA
cggcagaccctggct

SEQ ID NO: 68875 - DNA, 30 bp, Homo sapiens
  misc_feature 1..30: note = chr1:235443853-235443883
  misc_feature 1..30: note = hypo
  source 1..30: mol_type = genomic DNA
tcctcgccacgcaaacggctcctgccagaa

SEQ ID NO: 68876 - DNA, 30 bp, Homo sapiens; identical to SEQ ID NO: 39311
  misc_feature 1..30: note = chr1:235793720-235793750
  misc_feature 1..30: note = hypo
  source 1..30: mol_type = genomic DNA

SEQ ID NO: 68877 - DNA, 1146 bp, Homo sapiens
  misc_feature 1..1146: note = chr1:235812015-235813161
  misc_feature 1..1146: note = hyper
  source 1..1146: mol_type = genomic DNA
tccggctgagaggcacgggcccggtgccagcatttgacagtcctgggaggcgacgggtagaggagagacgcggcagccgcggggccggggagacggtgggaggcccggcgtccatcatccactttattacttgatcaaactttaacattttcgggtttcctaacaccttagccccaaatactcgaaatgaagcaaatcttaaattaaggagtctttccccaccacgctctgtcctcctccccacttcaccctcccgccgtttcgcgttatttccaaggcaatttaaaaaatcaagccaaacaaagctccccggttgctgccgggcgcgcgcggcgaacgaagcacatttcagttcagcaccagcctcggggacagacgccatcaaggaggtgaggaaaaccaccctcagctgcggtggctccagcgtcaccccgagtgctcccgaggcggcgtctgggctgctggggagccaggagggcttcctcaggcactcgccagaaacatttccccaaagaaaacgcccaaccagccacgccatctcctgccactgaggtccttttccacgggggacgtccccgctgggaaaacagcaaacgctctgtgacctacaaatggaagaggggacccccgagcccccgcctgcctcatgccggagggaccgggcgcccccagccccggaagcccctggacgcgctccgagggggctgtccacacccgcgcgcgggcttccccggggcccggcgggaggtcccgggagaggaggccgagggaaccacaggtctttgtgtcgcgtgcagcagcagctggcggcgtgaggaccacaccggcgccagagccgtctccctaggtccggagactttcaccccgagtttcccttccgcgtctggctgcaccgggctgggctctccccgcggacacccggggctccggccgggcgcccacttacccggagcgggatcacgcgcgggcttcgtctgcagcgcggtgctcgcggggggcggccaggccgagcggcatcgctccgcatcggggcgcgggccgggctcgggtgcaaacgcgcgcctcgtgcccctcccgccgcccgcggggtctccgcgtcccgtcaccggccccgccccgcgccgcgcctcccgccctgcagggccc

SEQ ID NO: 68878 - DNA, 176 bp, Homo sapiens
  misc_feature 1..176: note = chr1:235813621-235813797
  misc_feature 1..176: note = hyper
  source 1..176: mol_type = genomic DNA
cgggggggaaatcaccggaggggtctggggcggggccggggttgctggaggggtctggggacggggccgcggtcagcgcgggctccccgaagcctcaggtaccgccctcgctcggggtgagctccagcgcctgggccgttggggcgcgggccgcttcccaccctgcaccaagggac

SEQ ID NO: 68879 - DNA, 193 bp, Homo sapiens
  misc_feature 1..193: note = chr1:235814009-235814202
  misc_feature 1..193: note = hyper
  source 1..193: mol_type = genomic DNA
ggttctaggagcgactgctctccaggcctcgtccctgtggcaccgcaggcttttgcgctggagattttaaaacactttagtgattacagccctcttcctttcagggaaaaaacagtttaagcgccgtccattttccgacttggtaaaataatacgaaaccttgggaatagagaagcaacgaaaacatttcacg

SEQ ID NO: 68880 - DNA, 93 bp, Homo sapiens
  misc_feature 1..93: note = chr1:235872465-235872558
  misc_feature 1..93: note = hypo
  source 1..93: mol_type = genomic DNA
ctgacagatgttctgcgacacgtagtcagactctagagcctgccgatggatgaggataaaaagacgaggatcattacgcgcccaagggggaag

SEQ ID NO: 68881 - DNA, 30 bp, Homo sapiens
  misc_feature 1..30: note = chr1:2358761-2358791
  misc_feature 1..30: note = hypo
  source 1..30: mol_type = genomic DNA
gccgcaggtctgggacgagtcaggtgctgg

SEQ ID NO: 68882 - DNA, 348 bp, Homo sapiens; identical to SEQ ID NO: 14181
  misc_feature 1..348: note = chr1:2359972-2360320
  misc_feature 1..348: note = hypo
  source 1..348: mol_type = genomic DNA

SEQ ID NO: 68883 - DNA, 27 bp, Homo sapiens
  misc_feature 1..27: note = chr1:236044127-236044154
  misc_feature 1..27: note = hypo
  source 1..27: mol_type = genomic DNA
aagaattccatttagcggccgggcacg

SEQ ID NO: 68884 - DNA, 30 bp, Homo sapiens; identical to SEQ ID NO: 39313
  misc_feature 1..30: note = chr1:236081438-236081468
  misc_feature 1..30: note = hypo
  source 1..30: mol_type = genomic DNA

SEQ ID NO: 68885 - DNA, 30 bp, Homo sapiens
  misc_feature 1..30: note = chr1:236087376-236087406
  misc_feature 1..30: note = hypo
  source 1..30: mol_type = genomic DNA
tcaagacagcaacagcggaccattaaacca

SEQ ID NO: 68886 - DNA, 30 bp, Homo sapiens
  misc_feature 1..30: note = chr1:236184191-236184221
  misc_feature 1..30: note = hypo
  source 1..30: mol_type = genomic DNA
tctggacaaggatatcggaggattttctag

SEQ ID NO: 68887 - DNA, 30 bp, Homo sapiens
  misc_feature 1..30: note = chr1:236192796-236192826
  misc_feature 1..30: note = hypo
  source 1..30: mol_type = genomic DNA
cacgaggctagtggccggtctggggctggc

SEQ ID NO: 68888 - DNA, 282 bp, Homo sapiens
  misc_feature 1..282: note = chr1:236227462-236227744
  misc_feature 1..282: note = hyper
  source 1..282: mol_type = genomic DNA
aggcccggccagtcacggggaggatccagggagctgtaggtcatctggtcccgctcctcgtttggggcctccgtggtgacaatgcctggccacaggaaatgggatcactgggagccctgtgtttcccgctctggactctggactctgaaacgagcccaactggaaagcagcatcactgccaagacacatccggagtccacacacaaatacaggaggctgccggcgaaactctcccgcagccacaagagtcccggggcccgcgcgcagactgcgatccagctc

SEQ ID NO: 68889 - DNA, 152 bp, Homo sapiens; identical to SEQ ID NO: 26961
  misc_feature 1..152: note = chr1:236227769-236227921
  misc_feature 1..152: note = hyper
  source 1..152: mol_type = genomic DNA

SEQ ID NO: 68890 - DNA, 603 bp, Homo sapiens
  misc_feature 1..603: note = chr1:236228021-236228624
  misc_feature 1..603: note = hyper
  source 1..603: mol_type = genomic DNA
cgccgtgcccggtgccccggcggccagcgggtccgggtccccgcctgctacgcccaagtccgtccggctccacgggcgcccccggcccgccgcgccctgcagcccctcgcccgccctcccggggctcactcacgtagactgcgtcgatgtcggatctgtcgtagaagcggagcgccccactcagctccagggcaggagagacgaagtcatccccgtcctccagctccaggtccccctgtccggggccgaagggaaagagctcctggcggctcaggcagcccacaggccccgccagcagcagcggcagcagcagcgcccgcgtccacgcagcccggatccggctgctcgaggccaacatgttcccgaactgcggtcccgcaaacccggtcccgcggccaggacagaggaaggcggggatgtaaccggacgcccctggcagccccctctcctcccgcctcccggcgttcccaccccgggaaataggggaggggagcggaggggagagcggagggccccgccccgtccagcgggcgcgccgcggggcagcccaatggccgcgagggggagggcgaggggcgaagccgaacctcccgccttgggcgc

SEQ ID NO: 68891 - DNA, 146 bp, Homo sapiens; identical to SEQ ID NO: 26964
  misc_feature 1..146: note = chr1:236228705-236228851
  misc_feature 1..146: note = hyper
  source 1..146: mol_type = genomic DNA

SEQ ID NO: 68892 - DNA, 29 bp, Homo sapiens
  misc_feature 1..29: note = chr1:236252519-236252548
  misc_feature 1..29: note = hypo
  source 1..29: mol_type = genomic DNA
gcttaccaggccaggcgtggtggctcatg

SEQ ID NO: 68893 - DNA, 55 bp, Homo sapiens
  misc_feature 1..55: note = chr1:236304825-236304880
  misc_feature 1..55: note = hyper
  source 1..55: mol_type = genomic DNA
aaagagaagggctctcgggtggcggggacagaccctccttcggcatgggttggat

SEQ ID NO: 68894 - DNA, 30 bp, Homo sapiens
  misc_feature 1..30: note = chr1:236464650-236464680
  misc_feature 1..30: note = hypo
  source 1..30: mol_type = genomic DNA
gcgtctagctgagggcggccagactctggg

SEQ ID NO: 68895 - DNA, 95 bp, Homo sapiens
  misc_feature 1..95: note = chr1:236558422-236558517
  misc_feature 1..95: note = hyper
  source 1..95: mol_type = genomic DNA
tgtctcagctgagggcgtgagtagggagccaggaaagcgacccgcgactgcagccgtttcttaaggccagtccttcgctcgcagtctgtcccggg

SEQ ID NO: 68896 - DNA, 660 bp, Homo sapiens; identical to SEQ ID NO: 26966
  misc_feature 1..660: note = chr1:236558547-236559207
  misc_feature 1..660: note = hyper
  source 1..660: mol_type = genomic DNA

SEQ ID NO: 68897 - DNA, 229 bp, Homo sapiens
  misc_feature 1..229: note = chr1:236559256-236559485
  misc_feature 1..229: note = hyper
  source 1..229: mol_type = genomic DNA
cgggatgccaggttgagacacgtcctgcaaacctctggcagaaatgggcgcaagggggtggatttcgttttcgcctcccgggctttttctttctccccgctcacatgccttctcattactcctcttcctctctcccattgcactttgatgaaatggttttgtctgtctaaacattggccctcggagctatttcatcagatagtatccgcagaatcgagaggcggatccc

SEQ ID NO: 68898 - DNA, 37 bp, Homo sapiens
  misc_feature 1..37: note = chr1:236607992-236608029
  misc_feature 1..37: note = hypo
  source 1..37: mol_type = genomic DNA
ggattataggcgtgagccaccgcgcctgaccaactct

SEQ ID NO: 68899 - DNA, 84 bp, Homo sapiens
  misc_feature 1..84: note = chr1:236614144-236614228
  misc_feature 1..84: note = hypo
  source 1..84: mol_type = genomic DNA
agcctaactcatatagttttcaaaatgaccttatgcagaatgtaccattattatgctcactttacacatcgagatccagagtgg

SEQ ID NO: 68900 - DNA, 51 bp, Homo sapiens
  misc_feature 1..51: note = chr1:236687037-236687088
  misc_feature 1..51: note = hyper
  source 1..51: mol_type = genomic DNA
ttatccctctgtgctcgtcccacagcaagccagtcgcggtccaaggctcca

SEQ ID NO: 68901 - DNA, 204 bp, Homo sapiens
  misc_feature 1..204: note = chr1:236768620-236768824
  misc_feature 1..204: note = hypo
  source 1..204: mol_type = genomic DNA
tgcagtgggccaagattgcaccactgcactccacagagcgagactgtctcaataaataaattaatcgaatcctgttgaggtataatttacaaacaatggttacacccacgtcagtggaagagtttgatgacttttagcaaatgcatgtataggtgtaatgacctccccagtcaaaatgacagtttccatcgcccctaaaaattg

SEQ ID NO: 68902 - DNA, 83 bp, Homo sapiens
  misc_feature 1..83: note = chr1:236771371-236771454
  misc_feature 1..83: note = hypo
  source 1..83: mol_type = genomic DNA
acaaaaaacaaacaaaaaaacaaattctccctatgctcttaggcagcgtccggaaacagtacaatccacggatattcagtgta

SEQ ID NO: 68903 - DNA, 30 bp, Homo sapiens; identical to SEQ ID NO: 39317
  misc_feature 1..30: note = chr1:236811244-236811274
  misc_feature 1..30: note = hypo
  source 1..30: mol_type = genomic DNA

SEQ ID NO: 68904 - DNA, 49 bp, Homo sapiens; identical to SEQ ID NO: 136
  misc_feature 1..49: note = chr1:236849457-236849506
  misc_feature 1..49: note = hyper
  source 1..49: mol_type = genomic DNA

SEQ ID NO: 68905 - DNA, 15 bp, Homo sapiens
  misc_feature 1..15: note = chr1:236850197-236850212
  misc_feature 1..15: note = hyper
  source 1..15: mol_type = genomic DNA
cgctttgtggaggtg

SEQ ID NO: 68906 - DNA, 113 bp, Homo sapiens
  misc_feature 1..113: note = chr1:236900491-236900604
  misc_feature 1..113: note = hypo
  source 1..113: mol_type = genomic DNA
aatatgagaggctagcgagtgaggtaaaggaaactggtgacctgcagttctgtccatcctcacgcaggggctgaggcacagagggtgaaaaaatactccgtgggggcatatat

SEQ ID NO: 68907 - DNA, 116 bp, Homo sapiens
  misc_feature 1..116: note = chr1:236907863-236907979
  misc_feature 1..116: note = hypo
  source 1..116: mol_type = genomic DNA
ctggcatgaggaagccgctgtgccctcagcatattcatactttcttgctaccacctttgcaggcaaagagcagatcttgctgcagaaggattacgagtcggcgtcgctgacagagg

SEQ ID NO: 68908 - DNA, 29 bp, Homo sapiens
  misc_feature 1..29: note = chr1:236931484-236931513
  misc_feature 1..29: note = hypo
  source 1..29: mol_type = genomic DNA
tgatctgcctgcctcggcctcccaaagtg

SEQ ID NO: 68909 - DNA, 30 bp, Homo sapiens
  misc_feature 1..30: note = chr1:23693485-23693515
  misc_feature 1..30: note = hypo
  source 1..30: mol_type = genomic DNA
acacgatctcaaaaacgtggaggcaaagaa

SEQ ID NO: 68910 - DNA, 33 bp, Homo sapiens; identical to SEQ ID NO: 38890
  misc_feature 1..33: note = chr1:23694078-23694111
  misc_feature 1..33: note = hypo
  source 1..33: mol_type = genomic DNA

SEQ ID NO: 68911 - DNA, 33 bp, Homo sapiens
  misc_feature 1..33: note = chr1:23704242-23704275
  misc_feature 1..33: note = hypo
  source 1..33: mol_type = genomic DNA
tcacccaaggttggccggacgcagtggcttacg

SEQ ID NO: 68912 - DNA, 127 bp, Homo sapiens
  misc_feature 1..127: note = chr1:237056379-237056506
  misc_feature 1..127: note = hypo
  source 1..127: mol_type = genomic DNA
tgattgctgtctcttcgaaggtaccatggggctctgtgatctctctctcctgtggcgcagggaagctttgggtccccctctggcctttgttagcaaagaataattgatgggccgagtatacctggaa

SEQ ID NO: 68913 - DNA, 30 bp, Homo sapiens
  misc_feature 1..30: note = chr1:237204993-237205023
  misc_feature 1..30: note = hyper
  source 1..30: mol_type = genomic DNA
tgcatcgattatctgcgaaaagcatggtac

SEQ ID NO: 68914 - DNA, 165 bp, Homo sapiens; identical to SEQ ID NO: 26970
  misc_feature 1..165: note = chr1:237206101-237206266
  misc_feature 1..165: note = hyper
  source 1..165: mol_type = genomic DNA

SEQ ID NO: 68915 - DNA, 224 bp, Homo sapiens; identical to SEQ ID NO: 137
  misc_feature 1..224: note = chr1:237206511-237206735
  misc_feature 1..224: note = hyper
  source 1..224: mol_type = genomic DNA

SEQ ID NO: 68916 - DNA, 27 bp, Homo sapiens
  misc_feature 1..27: note = chr1:237230203-237230230
  misc_feature 1..27: note = hypo
  source 1..27: mol_type = genomic DNA
tgggattacaggcgtgagccaccgcgc

SEQ ID NO: 68917 - DNA, 299 bp, Homo sapiens
  misc_feature 1..299: note = chr1:23748862-23749161
  misc_feature 1..299: note = hyper
  source 1..299: mol_type = genomic DNA
gtatgtagctgtgaccgtaggcacttggttgcatgtttgaagttgcttctgttagtgcatgctcagaggatgtgacaaagccttaagtggctgagacttcagcaaccggcagtaaaccccgggcctgagctgcaacgtggaggatccgtcttattacaggaagtatgtcctcctctgcctaaccactgctgggcgggtccactttcactcccagagcaggccccacctttctcggccagacgcccagagctccatgcccacccagacactgccgagagcccaggcgcagacgtggctgt

SEQ ID NO: 68918 - DNA, 691 bp, Homo sapiens
  misc_feature 1..691: note = chr1:2374950-2375641
  misc_feature 1..691: note = hyper
  source 1..691: mol_type = genomic DNA
gggaggtgtggggagcggaaggccgcaggagcatctttgcggagaaagtactttggctgcggcgggcgcagggcgggccggctagccccgcgccccacctgttctgtgcgtcgcgctcgcccggttgcgcccgatctgcctccagcccggtgcccgccgcggagcccgcgcccccggccccctcccggcgcggggcgggcagggggtgtggtgcgggcggcacgagtgacagcgcgctcctcgcgcggcgcctccacggggcgcagtgtcaccgcgcacagcccgccgcgggccgcccgagctggcggggcgatgccgcgggagccggagccccagcccgagcccgagcccggccgctgactgcgcctcccggcccgcagcccccgcccccgccgccctcgctgccctcgctgcagccgccacggagacaatggacgcgggagccgccccgcagaagcacagtaggtgccgctcctgccgctgcgccgctgccaaccgggatgcgcgggtggacgcgcgggggcgccgcagccctggtgcgggtcggggctgagccgcctgggcttcagactcgggagcggaggctcggatcgcggtggcacgggcaggggtgcgggcgcgggactgtgggcgggacgggcggagcggtcttgagctctccggatggcctcaggtgcggggtgagggatct

SEQ ID NO: 68919 - DNA, 74 bp, Homo sapiens
  misc_feature 1..74: note = chr1:23750737-23750811
  misc_feature 1..74: note = hyper
  source 1..74: mol_type = genomic DNA
ccagctctcttcgcccgctttcctgggccctgcactagctgcccagggtgaaccctacacgtccaaagggacgt

SEQ ID NO: 68920 - DNA, 30 bp, Homo sapiens
  misc_feature 1..30: note = chr1:237732599-237732629
  misc_feature 1..30: note = hypo
  source 1..30: mol_type = genomic DNA
ggactttgatgttggcgatggtaagtctac

SEQ ID NO: 68921 - DNA, 30 bp, Homo sapiens; identical to SEQ ID NO: 39319
  misc_feature 1..30: note = chr1:237753724-237753754
  misc_feature 1..30: note = hypo
  source 1..30: mol_type = genomic DNA

SEQ ID NO: 68922 - DNA, 30 bp, Homo sapiens
  misc_feature 1..30: note = chr1:237919696-237919726
  misc_feature 1..30: note = hypo
  source 1..30: mol_type = genomic DNA
cttgagttcccctcacgagtgtctgttctt

SEQ ID NO: 68923 - DNA, 71 bp, Homo sapiens
  misc_feature 1..71: note = chr1:237947252-237947323
  misc_feature 1..71: note = hypo
  source 1..71: mol_type = genomic DNA
gaagagttcgtcaaacgcttccacgaacctgcgaaggacatcggcttcaacgtcgccgtccttctgacaaa

SEQ ID NO: 68924 - DNA, 135 bp, Homo sapiens
  misc_feature 1..135: note = chr1:238018308-238018443
  misc_feature 1..135: note = hypo
  source 1..135: mol_type = genomic DNA
cctaagaaagggttgcgccacttgtgaaataatagaaaataaaaagggctcatagtatatgtgtcgattgcatttccagtgccctgttctaatcgctatgcagtcatccataacttaatacgttctgagaaatga

SEQ ID NO: 68925 - DNA, 43 bp, Homo sapiens
  misc_feature 1..43: note = chr1:238027719-238027762
  misc_feature 1..43: note = hyper
  source 1..43: mol_type = genomic DNA
tgctctgcctccaagcgccacgtgggggcgctgcctcaccact

SEQ ID NO: 68926 - DNA, 30 bp, Homo sapiens
  misc_feature 1..30: note = chr1:238081199-238081229
  misc_feature 1..30: note = hypo
  source 1..30: mol_type = genomic DNA
ggtcaggttcagctacgccctgctacttgg

SEQ ID NO: 68927 - DNA, 35 bp, Homo sapiens
  misc_feature 1..35: note = chr1:238235527-238235562
  misc_feature 1..35: note = hypo
  source 1..35: mol_type = genomic DNA
ttagtaaaaatgggccgggcacggtggctcacgcc

SEQ ID NO: 68928 - DNA, 146 bp, Homo sapiens
  misc_feature 1..146: note = chr1:2382686-2382832
  misc_feature 1..146: note = hypo
  source 1..146: mol_type = genomic DNA
gtggtgggcttgcctcgtgtcccgattgtggggtctggggccagagatgtgtgtgcctccccggcccccgaagatcatacgcagtagcgtctccgagggatgccactagcagtgacaggcagagattgtcgcggagaatgtggctg

SEQ ID NO: 68929 - DNA, 88 bp, Homo sapiens
  misc_feature 1..88: note = chr1:23833064-23833152
  misc_feature 1..88: note = hypo
  source 1..88: mol_type = genomic DNA
gttccagctcaccctcgaaaagtgccacaggcaaggttcttcagctcacccaggagccagcaggctggccaggcgtgtggccaccatg

SEQ ID NO: 68930 - DNA, 29 bp, Homo sapiens
  misc_feature 1..29: note = chr1:238508028-238508057
  misc_feature 1..29: note = hypo
  source 1..29: mol_type = genomic DNA
tttgtccttacacgcgtgagccactgcgc

SEQ ID NO: 68931 - DNA, 84 bp, Homo sapiens
  misc_feature 1..84: note = chr1:23859450-23859534
  misc_feature 1..84: note = hypo
  source 1..84: mol_type = genomic DNA
gtgagtcaccgctcccggtcacatctctgaccttatctccagtgcataagacccttttactctagtctacgtatctcattggtc

SEQ ID NO: 68932 - DNA, 72 bp, Homo sapiens
  misc_feature 1..72: note = chr1:23884932-23885004
  misc_feature 1..72: note = hyper
  source 1..72: mol_type = genomic DNA
ggagcagtcagtttccgccgagcgtgccgaggcgggggccgtccgcagactggccggcgccagggaggaaac

SEQ ID NO: 68933 - DNA, 19 bp, Homo sapiens
  misc_feature 1..19: note = chr1:239516662-239516681
  misc_feature 1..19: note = hypo
  source 1..19: mol_type = genomic DNA
agagcgatactctgattaa

SEQ ID NO: 68934 - DNA, 192 bp, Homo sapiens; identical to SEQ ID NO: 39322
  misc_feature 1..192: note = chr1:239523114-239523306
  misc_feature 1..192: note = hypo
  source 1..192: mol_type = genomic DNA

SEQ ID NO: 68935 - DNA, 231 bp, Homo sapiens
  misc_feature 1..231: note = chr1:239549584-239549815
  misc_feature 1..231: note = hyper
  source 1..231: mol_type = genomic DNA
acaaaactaacagaccggcaaaatctatctttgaagcgccgcgggaggcacaatttgggaacaggtgaggccatgctgggtgggtgaggcccccctctctcctgcttggtgttccgctttcagccaacccaccccaggagtaccctgggatctcctcgccccctgccaggcggagaacgcggagcccagcgggcacgcgggaatggagctaggcgccggcagggcaactgg

SEQ ID NO: 68936 - DNA, 1184 bp, Homo sapiens
  misc_feature 1..1184: note = chr1:239550034-239551218
  misc_feature 1..1184: note = hyper
  source 1..1184: mol_type = genomic DNA
gagaaagggaatacacgataaagaaggagacggaaagaagagaaaaagtgaggcgggagacagagggaaaagggcgtgaacagaaagggccggagcgtgcaggggagcacagggcgcgggggcggcactgccgagccgggagcgctgccgcttgggcaggtgccgcggccgctgcccggaggcggcatgtgacgcgcggccgcagctgcccgcgggcggagcgctctcagaccccggagcgcacaccgcggggccatcggtgccatcgcggatctccaggctcctcatcagtccgccggggccgcagcagcgcttctgggaagacgggcgatgaactgaagggcggctccgggcaggggggcacgatcttaaggacagtcgctccctgaacgcggagccggaggagacgaagggaaggtggagcggacgccacccgcgcaccgggcaggcgcggagaccggcgtgggacagccacctggagcgcagctgccaggtagggacggcgcccgccacccaggcgctgggcagagcgggtggcggtagcggctgacctggtttcttgccttatctcgttgcgaaaggaggaaaaagttttcggcgcgggtaggagaggtcttgtgtttggagtccaaagaaggggctgggtagggacgagagaggctgttgatttggggaagatgggggcacttgaattccgacagcgcgatctggtgcggagttggagttctgggactgagggtggggaacgcccgctggcactcaagtgccccgaaagggacgggaatcatgcgagcggtggccgggagagagtcggggacgtcccaccccgctctccctcgcttcgattctctcttcgccactgccggatctgaggctccaaagtgcccgagcatgaggagctactgggctccgggtgtgtttgtgagcgcactcgtgtgttgagcgtttgtctcccatctccccatttggtttcctgtcatttctaagaaggctaaagctggcacccgccaacctcgcagtggggccgcaagttcggattgcatttcagggggcgagaaggcaaatttggcacttcgagtaacacttgggcgaaggtacctagcctagtgcgcatctttactgacccggggagagtctgcactcgcgaggcagcggccgctggactgcaccggttctcctctttg

SEQ ID NO: 68937 - DNA, 195 bp, Homo sapiens; identical to SEQ ID NO: 38748
  misc_feature 1..195: note = chr1:2396998-2397193
  misc_feature 1..195: note = hypo
  source 1..195: mol_type = genomic DNA

SEQ ID NO: 68938 - DNA, 125 bp, Homo sapiens
  misc_feature 1..125: note = chr1:239987328-239987453
  misc_feature 1..125: note = hypo
  source 1..125: mol_type = genomic DNA
actcgggagcatgtgcgtgaccatctgctacgggcacagaatgccaggctgccggcggtgccctctgtctcgttggtgaggccgcatttcactccagctccttgtgccatcgtatcacacatctt

SEQ ID NO: 68939 - DNA, 23 bp, Homo sapiens
  misc_feature 1..23: note = chr1:240102287-240102310
  misc_feature 1..23: note = hypo
  source 1..23: mol_type = genomic DNA
caagactccgtctcaaaaaaaaa

SEQ ID NO: 68940 - DNA, 250 bp, Homo sapiens; identical to SEQ ID NO: 39324
  misc_feature 1..250: note = chr1:240118753-240119003
  misc_feature 1..250: note = hypo
  source 1..250: mol_type = genomic DNA

SEQ ID NO: 68941 - DNA, 157 bp, Homo sapiens
  misc_feature 1..157: note = chr1:240160929-240161086
  misc_feature 1..157: note = hyper
  source 1..157: mol_type = genomic DNA
ggactggggaggctccgagggagcaagacatttaaacccgggcggtgggggggcgggcggtgtcagacgcccaacgaccacctccctcccggcccgcgccgagcccggccacaccctccccgcgacacccgcgatcgccccccaggactggcggccc

SEQ ID NO: 68942 - DNA, 259 bp, Homo sapiens; identical to SEQ ID NO: 5995
  misc_feature 1..259: note = chr1:240161122-240161381
  misc_feature 1..259: note = hyper
  source 1..259: mol_type = genomic DNA

SEQ ID NO: 68943 - DNA, 41 bp, Homo sapiens
  misc_feature 1..41: note = chr1:24017587-24017628
  misc_feature 1..41: note = hypo
  source 1..41: mol_type = genomic DNA
accaccactcctttccgtttgtataaattctatttgtgccc

SEQ ID NO: 68944 - DNA, 667 bp, Homo sapiens; identical to SEQ ID NO: 26977
  misc_feature 1..667: note = chr1:240254819-240255486
  misc_feature 1..667: note = hyper
  source 1..667: mol_type = genomic DNA

SEQ ID NO: 68945 - DNA, 672 bp, Homo sapiens; identical to SEQ ID NO: 139
  misc_feature 1..672: note = chr1:240255487-240256159
  misc_feature 1..672: note = hyper
  source 1..672: mol_type = genomic DNA

SEQ ID NO: 68946 - DNA, 281 bp, Homo sapiens
  misc_feature 1..281: note = chr1:240256624-240256905
  misc_feature 1..281: note = hyper
  source 1..281: mol_type = genomic DNA
cgctgtttcaagccctacccgctcatcaccccctgctacatcaagaccaccacccggcagctcagctcgcccaatcactccccgtctcagtcccctaatcagagccccaggatcaagaggcggccggaaccctccctgagccgagggtccagaactgccctggcctccgtagccgccccggccaagaagcaccgggccgacggcggccttgcggccggcctgagccgctcggctgactggacggaggagctaggcgcccgcacgccccgggtgggaggctc

SEQ ID NO: 68947 - DNA, 38 bp, Homo sapiens
  misc_feature 1..38: note = chr1:240267184-240267222
  misc_feature 1..38: note = hypo
  source 1..38: mol_type = genomic DNA
tatttttttttgtgacggagtcttgctctatccccagg

SEQ ID NO: 68948 - DNA, 30 bp, Homo sapiens; identical to SEQ ID NO: 39325
  misc_feature 1..30: note = chr1:240308662-240308692
  misc_feature 1..30: note = hypo
  source 1..30: mol_type = genomic DNA

SEQ ID NO: 68949 - DNA, 120 bp, Homo sapiens
  misc_feature 1..120: note = chr1:240372826-240372946
  misc_feature 1..120: note = hypo
  source 1..120: mol_type = genomic DNA
gacaggcgtgagccaccgggcacggccgcaaatcaaattcttaggtaaactgactctggagcatgatttagtgcacactttaaaatgcacagccctgtccgggtgcggtggctcacgcct

SEQ ID NO: 68950 - DNA, 169 bp, Homo sapiens; identical to SEQ ID NO: 14351
  misc_feature 1..169: note = chr1:240463082-240463251
  misc_feature 1..169: note = hypo
  source 1..169: mol_type = genomic DNA

SEQ ID NO: 68951 - DNA, 34 bp, Homo sapiens
  misc_feature 1..34: note = chr1:240655738-240655772
  misc_feature 1..34: note = hypo
  source 1..34: mol_type = genomic DNA
tcctcatcacagcagcgaccgagggcagcctgcc

SEQ ID NO: 68952 - DNA, 393 bp, Homo sapiens
  misc_feature 1..393: note = chr1:240774920-240775313
  misc_feature 1..393: note = hyper
  source 1..393: mol_type = genomic DNA
aagagaaagaaagagcgatcacggtcaagtttgaaggtccttatgttacacccacgcataattcaataggtgaataaaccttgtggcccccagacacacgccaacagcttgaattacccggggtgaaaccggcgagacgtccactcagggctttcggtcctgaccagccacggaacaaacaacgtcaattcattctaagtgcctggtgaaggtagaaatcagaaaccgtgtctgtgtcacgttagtcgtgacaagctgcgtacctgcaatgacgtgatggaagcctcctcctcgggtcccttctctctctctctctccctctccctctgccttctctgagttctctagtccacagcggggtctaagtttggtctcccgccgccgctttcagtt

SEQ ID NO: 68953 - DNA, 77 bp, Homo sapiens; identical to SEQ ID NO: 6000
  misc_feature 1..77: note = chr1:240775378-240775455
  misc_feature 1..77: note = hyper
  source 1..77: mol_type = genomic DNA

SEQ ID NO: 68954 - DNA, 40 bp, Homo sapiens
  misc_feature 1..40: note = chr1:240892900-240892940
  misc_feature 1..40: note = hypo
  source 1..40: mol_type = genomic DNA
ccttccggccgggcacggcggctcacgcctgtaatctcag

SEQ ID NO: 68955 - DNA, 40 bp, Homo sapiens
  misc_feature 1..40: note = chr1:240893180-240893220
  misc_feature 1..40: note = hypo
  source 1..40: mol_type = genomic DNA
gtctcaaaaaaaaaaaaaaagaagccgcttcctattggta

SEQ ID NO: 68956 - DNA, 56 bp, Homo sapiens
  misc_feature 1..56: note = chr1:240986717-240986773
  misc_feature 1..56: note = hypo
  source 1..56: mol_type = genomic DNA
agggcagatgcctcacgttatagtccagtccgctcaggacacgggctgcggccggg

SEQ ID NO: 68957 - DNA, 142 bp, Homo sapiens
  misc_feature 1..142: note = chr1:241052144-241052286
  misc_feature 1..142: note = hypo
  source 1..142: mol_type = genomic DNA
ctggaggttagggaacgcggaggcagagagagggaagcagcgggtgcaaagggcagagctacttcggattttatgacggtcaaaggcctcaatgaagaaagaggtaacatttgtttttgttttgtttttgagacggagtccc

SEQ ID NO: 68958 - DNA, 39 bp, Homo sapiens; identical to SEQ ID NO: 39330
  misc_feature 1..39: note = chr1:241096456-241096495
  misc_feature 1..39: note = hypo
  source 1..39: mol_type = genomic DNA

SEQ ID NO: 68959 - DNA, 206 bp, Homo sapiens
  misc_feature 1..206: note = chr1:24119111-24119317
  misc_feature 1..206: note = hypo
  source 1..206: mol_type = genomic DNA
ggttttgctcttgaccgccgccccgatgtatgcaggcccccgccgtggagccgtgtggtgtatgtgtggtaacaccatgtctgtgcccctgctcaccgatgctgccaccgtgtctggagctgagcgggaaacggccgcggtaagggtcccctttcacccacggccagacactgtgggagcagctggaggaccggctggagggggtg

SEQ ID NO: 68960 - DNA, 462 bp, Homo sapiens
  misc_feature 1..462: note = chr1:241520071-241520533
  misc_feature 1..462: note = hyper
  source 1..462: mol_type = genomic DNA
gctcccgggggcggccgccctgcgcccgcggacgctcccgctgcgcagagcgagggctgggtgcgggccgggggccgggagggctctgggtggcgctgcctcctccccgcccgccttccctatttacctcctccgccaaggtcacggccccgcggcgtctcccctcccgggcgggctgggtgcaggcggtgtcagctggcggcaagcggagcagcgaggcagggtagcttcatcacactcgcggcggatgcggattccgcgccgccccggctctagctgctcaggcgaccgccaccctcgcctcgccgccgcccgtgcacaggcggctccggcagccgccactcgcgcccgctcccctgggccgcctcgctggctctctccctcctccgcttcttctcccggggactgggaccagccgagcgcgcgcgggagtcgagacgcccggcccgtgcgcgcgactgg

SEQ ID NO: 68961 - DNA, 30 bp, Homo sapiens
  misc_feature 1..30: note = chr1:241520759-241520789
  misc_feature 1..30: note = hyper
  source 1..30: mol_type = genomic DNA
gagaccggagtttaacgcccagtgtaagcc

SEQ ID NO: 68962 - DNA, 503 bp, Homo sapiens
  misc_feature 1..503: note = chr1:241587106-241587609
  misc_feature 1..503: note = hyper
  source 1..503: mol_type = genomic DNA
gcaggcagtcctgagcggccgctgccatcgcgccggctgcagcggaaaggtacaagcggtggcggcaggagccgctgtgggagcagcagtggcggcagtgggagccctgtgccacgcgtcccctgtgcgccgtgtccccaaggcagctgactacacctcccccaccctcctgcagcagggtggatcccacctagcgggactccccacccacccctccaggccttctccactccggactctggccacttgccaccgttgtcgcccgccgccgctgcagggagggtgcacggagggagcagaccgtctccggagcccgccgccctgggggctgcagtgatggggccgggctgaggcacctgccggcggggtagcagggcagtcgagcacggagggaggggcgggcctccaggggacttcagcgggagccgggcctggggcggtgccgcacttgcacacggagtgtggggggccaggcctgggaccaggagctggggccgggcttc

SEQ ID NO: 68963 - DNA, 268 bp, Homo sapiens; identical to SEQ ID NO: 1911
  misc_feature 1..268: note = chr1:241587610-241587878
  misc_feature 1..268: note = hyper
  source 1..268: mol_type = genomic DNA

SEQ ID NO: 68964 - DNA, 87 bp, Homo sapiens
  misc_feature 1..87: note = chr1:241647308-241647395
  misc_feature 1..87: note = hypo
  source 1..87: mol_type = genomic DNA
gtgctgggattacagccgtgagccactgcgcctggacgtgtctatccttttctatagcacctctaggaaacacgaaccatgtccaag

SEQ ID NO: 68965 - DNA, 123 bp, Homo sapiens
  misc_feature 1..123: note = chr1:241753208-241753331
  misc_feature 1..123: note = hypo
  source 1..123: mol_type = genomic DNA
ttgtgtttggcattgcgatgagtgggaatgaagaataatactaagtcgcagtgagaaatagctgtatttgttcaaaagcgttctttaagactgtcattattgcagatgcgagcacatgtcaac

SEQ ID NO: 68966 - DNA, 30 bp, Homo sapiens
  misc_feature 1..30: note = chr1:241888798-241888828
  misc_feature 1..30: note = hypo
  source 1..30: mol_type = genomic DNA
tctccaaggcccagtcgttccctccatgct

SEQ ID NO: 68967 - DNA, 30 bp, Homo sapiens; identical to SEQ ID NO: 39332
  misc_feature 1..30: note = chr1:241913315-241913345
  misc_feature 1..30: note = hypo
  source 1..30: mol_type = genomic DNA

SEQ ID NO: 68968 - DNA, 30 bp, Homo sapiens
  misc_feature 1..30: note = chr1:241979590-241979620
  misc_feature 1..30: note = hypo
  source 1..30: mol_type = genomic DNA
gagtcaacatgcagacgttctaaaaaacaa

SEQ ID NO: 68969 - DNA, 30 bp, Homo sapiens
  misc_feature 1..30: note = chr1:242012857-242012887
  misc_feature 1..30: note = hypo
  source 1..30: mol_type = genomic DNA
tattaccagaatgttcgtgcttagaataat

SEQ ID NO: 68970 - DNA, 38 bp, Homo sapiens
  misc_feature 1..38: note = chr1:242013289-242013327
  misc_feature 1..38: note = hypo
  source 1..38: mol_type = genomic DNA
tgaacaatttctggccgggcgcggtggctcacgcctgt

SEQ ID NO: 68971 - DNA, 85 bp, Homo sapiens
  misc_feature 1..85: note = chr1:242087513-242087598
  misc_feature 1..85: note = hypo
  source 1..85: mol_type = genomic DNA
tgtgcccggccttacttccttcattcctatagctgggtactattgctttgtctggatgagccacaatttacgtcatccaccttaa

SEQ ID NO: 68972 - DNA, 27 bp, Homo sapiens
  misc_feature 1..27: note = chr1:242122948-242122975
  misc_feature 1..27: note = hypo
  source 1..27: mol_type = genomic DNA
catgagccaccccgcccagcccacttt

SEQ ID NO: 68973 - DNA, 54 bp, Homo sapiens
  misc_feature 1..54: note = chr1:242161776-242161830
  misc_feature 1..54: note = hyper
  source 1..54: mol_type = genomic DNA
cagcgcaccttcctccggggcacgctctgcgccacctaccggatgatgctgagg

SEQ ID NO: 68974 - DNA, 30 bp, Homo sapiens
  misc_feature 1..30: note = chr1:242182244-242182274
  misc_feature 1..30: note = hypo
  source 1..30: mol_type = genomic DNA
atgagccactgtgcccggtctcttacaaat

SEQ ID NO: 68975 - DNA, 20 bp, Homo sapiens
  misc_feature 1..20: note = chr1:242194963-242194983
  misc_feature 1..20: note = hypo
  source 1..20: mol_type = genomic DNA
gccaccgcacccggctgcta

SEQ ID NO: 68976 - DNA, 177 bp, Homo sapiens; identical to SEQ ID NO: 14352
  misc_feature 1..177: note = chr1:242286750-242286927
  misc_feature 1..177: note = hypo
  source 1..177: mol_type = genomic DNA

SEQ ID NO: 68977 - DNA, 17 bp, Homo sapiens
  misc_feature 1..17: note = chr1:24246049-24246066
  misc_feature 1..17: note = hypo
  source 1..17: mol_type = genomic DNA
atttattttttaagacg

SEQ ID NO: 68978 - DNA, 31 bp, Homo sapiens
  misc_feature 1..31: note = chr1:242633349-242633380
  misc_feature 1..31: note = hypo
  source 1..31: mol_type = genomic DNA
attgggaggggctgccgggtgcggtggctca

SEQ ID NO: 68979 - DNA, 1343 bp, Homo sapiens
  misc_feature 1..1343: note = chr1:242686691-242688034
  misc_feature 1..1343: note = hyper
  source 1..1343: mol_type = genomic DNA
agagccaattcacttcgcgtgaagtcggcactccttgggagtagaggtcccctctcaccggctcccaccctccagaggggaggatttctggggagcccgacgatccgctcgcttttagcctttctccttgcaacgcgcaaatctctccctagttgggctcaagtagagaggatcaccaactgctcatcccagcggacactctgcaaaaaactctaatggcttgtgcgcgggtccacgctggtcgctagcggcgccaactttactcattcgttaatttgctagtttttggactgagtaaaacagcccccaaagacgcgggcaaacgccgctctaaagcccactaccatgcaacgccaggttgctcggagccacgctggtggcacttccccttcgtgctcactctgcacaggcacctccagaaccccgtgcaaatgaaccctaccgggagacgcaggtgggcaggtcgggtcggcagggaccaagagcctgaaagggaacctgccctcccctccccgcagcccggtcattaaggcaagaaactgcaggcagagaagcccccgaatccgacctaggacgtcggcgcctgccaggatcccctcgcctgccccccgcgccccgcgcgcgctcatgccaccaccacggggagggtgcatgcggcaggtgcctggccgaggcccccgggagcgagtcgcccttacgtgctccagcttgtctttcctccgaagccagacgctggcgctgtagtcctgctgcttgacgctgctgtagaagttcgcgcccactcgggtcaggcttggggagggctccttggggcggcttttgagcctcatctgctcgaagccctcatggggggaggccgagagccactcgtgctgccggatctccatcctgacatgaccgggcggccgccggcgagcagcggactcgggacgggcgcgcggggagccgggcgcggagggcgagcgggaggcccagcgggagccggaggtggagctggagactgagctggaggagctggaggagcgagcgggcgcggggagcgcggggtgctgagcgccagctgggagcgcggccgggcgggagggggcgatcgcgggaggcgcggggcggaaggagggagggcgaggtgcgggcgggggcgggggcgggggcggagggggacggacggggagaagggggacgagaggggacagggagggaaaggaacctgctccggggagacagaagtgcccggtgcggcggcgacgtcgcccggcggctgcggtcccgagcgggcgctccgctcgccggctccttgcggcacctactgggacccgggccggctcccggggcggcggcggcgg

SEQ ID NO: 68980 - DNA, 164 bp, Homo sapiens; identical to SEQ ID NO: 26989
  misc_feature 1..164: note = chr1:242688080-242688244
  misc_feature 1..164: note = hyper
  source 1..164: mol_type = genomic DNA

SEQ ID NO: 68981 - DNA, 418 bp, Homo sapiens; identical to SEQ ID NO: 26990
  misc_feature 1..418: note = chr1:242688277-242688695
  misc_feature 1..418: note = hyper
  source 1..418: mol_type = genomic DNA

SEQ ID NO: 68982 - DNA, 383 bp, Homo sapiens
  misc_feature 1..383: note = chr1:2428099-2428482
  misc_feature 1..383: note = hypo
  source 1..383: mol_type = genomic DNA
gaagtacaccaagtccgtggccacccacgacatagagatggagggtgagtggctcggggacctggggccacgggcggaggcctccctgtcccccatccctgctatgctgctgggcgccgggcgaggtcgaggactggcagtctgatgcccggtcaccggcgccacagcggcgtccagctggcaggtgtcgtccttcagcgagaccaaggcccaccagattctgcagcagaagccggcgcagtacctacgcttcaaccagcagcagctctcccgcatctacccctcctcctaccgtgtggactccagcaactacaacccgcagcccttctggaacgccggctgccaaatgggtgggtgcgggcatggtgcgctgggtgtggtgg

SEQ ID NO: 68983 - DNA, 30 bp, Homo sapiens
  misc_feature 1..30: note = chr1:242843570-242843600
  misc_feature 1..30: note = hypo
  source 1..30: mol_type = genomic DNA
ctcatctgagatgtgcgtgacagcagtcag

SEQ ID NO: 68984 - DNA, 140 bp, Homo sapiens
  misc_feature 1..140: note = chr1:242973108-242973248
  misc_feature 1..140: note = hypo
  source 1..140: mol_type = genomic DNA
attacaggcgtgagcaaccgcacccggccagataaagaatgttttaacaagaaagatgacctcattcccttagtaccgtattttagttcagtcaaattttgactggtgccattctcctcagctgccgtgatttccaattt

SEQ ID NO: 68985 - DNA, 30 bp, Homo sapiens
  misc_feature 1..30: note = chr1:243002516-243002546
  misc_feature 1..30: note = hypo
  source 1..30: mol_type = genomic DNA
cctgctgtggggcttcggggtcacaggcac

SEQ ID NO: 68986 - DNA, 90 bp, Homo sapiens
  misc_feature 1..90: note = chr1:2430433-2430523
  misc_feature 1..90: note = hypo
  source 1..90: mol_type = genomic DNA
gggagtggtgtgggccgggggctccaggctggagcggtgctgggccgggccctccccatgggacactcctcctggcgctgcttccccagg

SEQ ID NO: 68987 - DNA, 92 bp, Homo sapiens; identical to SEQ ID NO: 26991
  misc_feature 1..92: note = chr1:243053773-243053865
  misc_feature 1..92: note = hyper
  source 1..92: mol_type = genomic DNA

SEQ ID NO: 68988 - DNA, 167 bp, Homo sapiens; identical to SEQ ID NO: 26992
  misc_feature 1..167: note = chr1:243053866-243054033
  misc_feature 1..167: note = hyper
  source 1..167: mol_type = genomic DNA

SEQ ID NO: 68989 - DNA, 17 bp, Homo sapiens
  misc_feature 1..17: note = chr1:243057071-243057088
  misc_feature 1..17: note = hypo
  source 1..17: mol_type = genomic DNA
gccaggtgcggttaccg

SEQ ID NO: 68990 - DNA, 84 bp, Homo sapiens
  misc_feature 1..84: note = chr1:243080471-243080555
  misc_feature 1..84: note = hypo
  source 1..84: mol_type = genomic DNA
tgcacaagtcaactgcggttctacgctcgcacagtattgctcacatggcggcgtacaacagtggacatgcgtattatgcatctg

SEQ ID NO: 68991 - DNA, 16 bp, Homo sapiens
  misc_feature 1..16: note = chr1:243120279-243120295
  misc_feature 1..16: note = hypo
  source 1..16: mol_type = genomic DNA
ccgtctcaaaaaaaac

SEQ ID NO: 68992 - DNA, 29 bp, Homo sapiens
  misc_feature 1..29: note = chr1:243139472-243139501
  misc_feature 1..29: note = hypo
  source 1..29: mol_type = genomic DNA
caggcgtgagccaccgtgcccggcctctc

SEQ ID NO: 68993 - DNA, 82 bp, Homo sapiens
  misc_feature 1..82: note = chr1:243145032-243145114
  misc_feature 1..82: note = hypo
  source 1..82: mol_type = genomic DNA
ttacaggcgtgagccaccgcgcctggccgtgagaatgtaattttttatagttactcttatcgtgagtcgtaagtagctcatt

SEQ ID NO: 68994 - DNA, 30 bp, Homo sapiens
  misc_feature 1..30: note = chr1:2434250-2434280
  misc_feature 1..30: note = hypo
  source 1..30: mol_type = genomic DNA
gtgcctgcaggcaaccgggggccctgcagg

SEQ ID NO: 68995 - DNA, 66 bp, Homo sapiens
  misc_feature 1..66: note = chr1:2435884-2435950
  misc_feature 1..66: note = hypo
  source 1..66: mol_type = genomic DNA
agcctgggcctgggccgcagccgtgagaacctcgctggagcccacatgggacgcctgccccccagg

SEQ ID NO: 68996 - DNA, 385 bp, Homo sapiens
  misc_feature 1..385: note = chr1:243646379-243646764
  misc_feature 1..385: note = hyper
  source 1..385: mol_type = genomic DNA
tgcactctctcaaaacgacagtcgccctgaaacggacgctggaagaggtttccaggcccgtggcgacggtgaggggggtgaaggtcgcaggtggagggcacggggcggcggctgcggagcccggggaggaggcggcgggcgcccgggtcttcctcggagcgcgccccctgggctgggcggcgtgtccctgcctcccgccggcgccctcgtccccgcagcagcgtccccgccgccaccccgctgcctcgtcgcctttctcgcaaacagcggtgccctctacgtgggggatcctggaggctgctgagcacgagcgccctccgcgacccgcccctgctcccgcctccactcttgcctcggggggagggtctcagtcttctgcctaagg

SEQ ID NO: 68997 - DNA, 33 bp, Homo sapiens
  misc_feature 1..33: note = chr1:2437266-2437299
  misc_feature 1..33: note = hypo
  source 1..33: mol_type = genomic DNA
tacttaccaggtgcccgtcggagcctgcgccag

SEQ ID NO: 68998 - DNA, 30 bp, Homo sapiens
  misc_feature 1..30: note = chr1:243844807-243844837
  misc_feature 1..30: note = hypo
  source 1..30: mol_type = genomic DNA
tcagccacccatctacgacatctatatttg

SEQ ID NO: 68999 - DNA, 120 bp, Homo sapiens
  misc_feature 1..120: note = chr1:243982361-243982481
  misc_feature 1..120: note = hypo
  source 1..120: mol_type = genomic DNA
gccttgcgtgccaagcgcagagctgtgcagatgtttggcggtcactcaactggagaatgcctaagactaccgaattcccagggaaaggggccaccgtcatcactgcggctgcctgctgtc

SEQ ID NO: 69000 - DNA, 424 bp, Homo sapiens
  misc_feature 1..424: note = chr1:244014247-244014671
  misc_feature 1..424: note = hyper
  source 1..424: mol_type = genomic DNA
cccacccgccctggccgcggacgcgcgcgccgccaggccccgggcgtctcctccagtccgccgcggccccttggggagatgggcccggcgcgagggctcgcacctggaagcccacgaagtgggcggtgcccaatgaggtagggaccggagagcgcggagcagtccagaagccgaccccaccccctgcacctcggggaagagggaacccgggtcagcccgtagcaagaatcattcctgactatcccaggagaccacggcagaccaaaaacacctctctgaacagccttccgcaccgctcgctgcaagcattcgtccacacacggtacacagattgcgggcggatcgtaattcactcttgaaatcacaccctttttagggatattcgttttcaatgactttgggaaagccacgaggtactacattt

SEQ ID NO: 69001 - DNA, 30 bp, Homo sapiens
  misc_feature 1..30: note = chr1:244019046-244019076
  misc_feature 1..30: note = hypo
  source 1..30: mol_type = genomic DNA
tttttgagagcagagcgttaagccaagtac

SEQ ID NO: 69002 - DNA, 364 bp, Homo sapiens
  misc_feature 1..364: note = chr1:244080431-244080795
  misc_feature 1..364: note = hyper
  source 1..364: mol_type = genomic DNA
ggtagaacagagaagcgagcaagaacaggtgggaagaaaaacagcagcctgatccgtcttgcttttcccttttctccatgcagccagcacttttccttctcactctccccgcacgcccacgcccacccgcttctgcaccgagaacctcgaggcgcgcacgcacgtggaggtgacgccaagcccagcggcgaggtcggggctgggggtggggggagccggcgtcccgcgggcccccgaggccggggagctccgccagcgcattgtgcgagcgagctgaatgcagccgaggggcgagcgcgcgggctcgcacggattagccgtgctttcccatgagccacaaaagaatgcccgaatctgggacatc

SEQ ID NO: 69003 - DNA, 170 bp, Homo sapiens
  misc_feature 1..170: note = chr1:244087001-244087171
  misc_feature 1..170: note = hypo
  source 1..170: mol_type = genomic DNA
agggaggaacacggccggctcattttccctccttgctttccctcatctcacgctcactggctggctgctttggctccccagggtcaggcactgggtggggtgcagggagttagggacaccattgacgtctggcagtggtcccttctgggtgggaccgatgtccaaaatga

SEQ ID NO: 69004 - DNA, 44 bp, Homo sapiens
  misc_feature 1..44: note = chr1:244115675-244115719
  misc_feature 1..44: note = hypo
  source 1..44: mol_type = genomic DNA
agacatggtggatgacgaggacacgctgacgaaagcaatgaaag

SEQ ID NO: 69005 - DNA, 30 bp, Homo sapiens; identical to SEQ ID NO: 39341
  misc_feature 1..30: note = chr1:244139857-244139887
  misc_feature 1..30: note = hypo
  source 1..30: mol_type = genomic DNA

SEQ ID NO: 69006 - DNA, 111 bp, Homo sapiens
  misc_feature 1..111: note = chr1:244142957-244143068
  misc_feature 1..111: note = hypo
  source 1..111: mol_type = genomic DNA
gggggggtggtgggacggaaggtacccacgagggtggcgtgtggggccatcggccaggagtgggggggatgggacggaaggtacccacgagggtggcgggtggggcagatg

SEQ ID NO: 69007 - DNA, 35 bp, Homo sapiens
  misc_feature 1..35: note = chr1:244198767-244198802
  misc_feature 1..35: note = hypo
  source 1..35: mol_type = genomic DNA
tgtgtagtaggttatcgcatctaggtctgtgtgag

SEQ ID NO: 69008 - DNA, 105 bp, Homo sapiens; identical to SEQ ID NO: 39343
  misc_feature 1..105: note = chr1:244200765-244200870
  misc_feature 1..105: note = hypo
  source 1..105: mol_type = genomic DNA

SEQ ID NO: 69009 - DNA, 206 bp, Homo sapiens
  misc_feature 1..206: note = chr1:244243925-244244131
  misc_feature 1..206: note = hypo
  source 1..206: mol_type = genomic DNA
ccggtgagactctgccggatgatgacaaatcgtgttcacattaaccttgtgccctgaaggttgcctttggtgggaagaggcagagaagacgtgagtttcttgccaattccacctggtggagagcctgccaggcctcctgacttgtggtcctgtctctgaccggcacggtggctgcttttcctaggcaagtgcggcataatgtccct

SEQ ID NO: 69010 - DNA, 21 bp, Homo sapiens
  misc_feature 1..21: note = chr1:24426643-24426664
  misc_feature 1..21: note = hypo
  source 1..21: mol_type = genomic DNA
ccaccgcgcctggcctccagt

SEQ ID NO: 69011 - DNA, 55 bp, Homo sapiens
  misc_feature 1..55: note = chr1:244319117-244319172
  misc_feature 1..55: note = hypo
  source 1..55: mol_type = genomic DNA
catcacaggcggctgcgtgcttattaccccctcttcctgccgtgtaggggtggtg

SEQ ID NO: 69012 - DNA, 47 bp, Homo sapiens
  misc_feature 1..47: note = chr1:24435099-24435146
  misc_feature 1..47: note = hypo
  source 1..47: mol_type = genomic DNA
acctcccaagctgtgcggcagagtcatggttacgagagcaacaacct

SEQ ID NO: 69013 - DNA, 30 bp, Homo sapiens
  misc_feature 1..30: note = chr1:244402710-244402740
  misc_feature 1..30: note = hypo
  source 1..30: mol_type = genomic DNA
gctgtgaccctatcccggctgattcaaagg

SEQ ID NO: 69014 - DNA, 21 bp, Homo sapiens
  misc_feature 1..21: note = chr1:244625361-244625382
  misc_feature 1..21: note = hypo
  source 1..21: mol_type = genomic DNA
tcctgccggggcctcccaaag

SEQ ID NO: 69015 - DNA, 30 bp, Homo sapiens
  misc_feature 1..30: note = chr1:244805002-244805032
  misc_feature 1..30: note = hypo
  source 1..30: mol_type = genomic DNA
aataaatctactaagcgcatatcattggta

SEQ ID NO: 69016 - DNA, 16 bp, Homo sapiens
  misc_feature 1..16: note = chr1:244893239-244893255
  misc_feature 1..16: note = hyper
  source 1..16: mol_type = genomic DNA
atttttttgacggggc

SEQ ID NO: 69017 - DNA, 188 bp, Homo sapiens
  misc_feature 1..188: note = chr1:244893315-244893503
  misc_feature 1..188: note = hyper
  source 1..188: mol_type = genomic DNA
gtttgagtccagcccgggcaacatagttggttttttttttttttctcctgtctcaaaaaaaaggcattgcagagattgaaaaccgtttcccaccttctcccctgcagtgtttaggaagagacaatccgcccccgattcagcgcttcccagcccgcagcaactgcgcagcggggggaacccagggctcc

SEQ ID NO: 69018 - DNA, 846 bp, Homo sapiens
  misc_feature 1..846: note = chr1:244893504-244894350
  misc_feature 1..846: note = hyper
  source 1..846: mol_type = genomic DNA
cggcacccgcaggctttagttactgctccgaggccctcggaccaaagagaggctgcgaggaggacgcggctcgtttagctcgctgcgaacctcaagataacccttggtttccatgcacatccccccaacattgcatgtgctttcattcctacggtgctggggttactttcatttattgcttttgttgaccaaaaagaaaaaaacaatcctgagcgtgcacagggggcgcaacgggggaccggctcctcgtggctgaccggcggcggggctggcgcgcgggggcggcctgcgcgggccgcccggggacgctgctctggggtccggccgcggcctcgtggccgccctgcgcgcggtccagcaccagcagcgggatctcctccagccggtccggccgctccttgcgccgcaggtagcgccgcctccacgtcgccagcctctgaagcagcctctgcaggctcgaggggccccacaggccgcgctccggggcctccttgcctgcgcgcgcgtgagcttgcctgagcttcttcctgcgcgggccgcggaacagccgccgccagcaccagcacccagagcaggagccgccgtcgccggccaccgcgcgccgcccgaccgcctccggatccccgcgcggaggggggccccgctccaggcgcgccgccttctccagcagctcgtgctgcgcgccgccgcgccgggggccaccaaaccggggggccgccatggcccgcgcaggcctcttctcggagcgcggggcccacatctcgggaaccgtcgggctggacaacaacgctgccgcctccaggactccaaagggcccctcgcgtcctctcccgggaatgtacccac

SEQ ID NO: 69019 - DNA, 30 bp, Homo sapiens; identical to SEQ ID NO: 39346
  misc_feature 1..30: note = chr1:244914578-244914608
  misc_feature 1..30: note = hypo
  source 1..30: mol_type = genomic DNA

SEQ ID NO: 69020 - DNA, 23 bp, Homo sapiens
  misc_feature 1..23: note = chr1:245032177-245032200
  misc_feature 1..23: note = hypo
  source 1..23: mol_type = genomic DNA
accgtgcccggcctatatgcagt

SEQ ID NO: 69021 - DNA, 180 bp, Homo sapiens; identical to SEQ ID NO: 39347
  misc_feature 1..180: note = chr1:245060866-245061046
  misc_feature 1..180: note = hypo
  source 1..180: mol_type = genomic DNA

SEQ ID NO: 69022 - DNA, 144 bp, Homo sapiens
  misc_feature 1..144: note = chr1:245135719-245135863
  misc_feature 1..144: note = hypo
  source 1..144: mol_type = genomic DNA
tgtatccttgtagtccgtggacagcagcctggacatcactggctgccaccgacctaataatgaatcagtcttcattttaacatgtttgtaggtgatttgtatgtacattaactttcgagaaggccgggcgcggtggctcacgcc

SEQ ID NO: 69023 - DNA, 32 bp, Homo sapiens
  misc_feature 1..32: note = chr1:245254414-245254446
  misc_feature 1..32: note = hypo
  source 1..32: mol_type = genomic DNA
gagatgaggatgaaccgcgtgccttcaggaca

SEQ ID NO: 69024 - DNA, 50 bp, Homo sapiens
  misc_feature 1..50: note = chr1:245305933-245305983
  misc_feature 1..50: note = hypo
  source 1..50: mol_type = genomic DNA
tccttcctgtgggagcgaggaggctgcctccctcacgggtggctgtgagg

SEQ ID NO: 69025 - DNA, 178 bp, Homo sapiens
  misc_feature 1..178: note = chr1:245317376-245317554
  misc_feature 1..178: note = hyper
  source 1..178: mol_type = genomic DNA
cccgcggggcccaggcgcaggaagaaacgggcggcggggggcgaggggcccgatcccacgcaaggagaggccaaggccagctcgcgccacaccccctctccaggccagagtcgtccgcgtgcagcgcggcgaagccctcagtttcccctgcccggcagcggcccgctgggtcaccagg

SEQ ID NO: 69026 - DNA, 82 bp, Homo sapiens
  misc_feature 1..82: note = chr1:245318718-245318800
  misc_feature 1..82: note = hyper
  source 1..82: mol_type = genomic DNA
aagccaccatgaattcggtagctgggaataaagagaggcttgcggtctccaccaggggcaagaaatacggggtaagttgtga

SEQ ID NO: 69027 - DNA, 311 bp, Homo sapiens
  misc_feature 1..311: note = chr1:245319150-245319461
  misc_feature 1..311: note = hyper
  source 1..311: mol_type = genomic DNA
cggagagttggaccccgtatgaataaaaatcctgaaatcacagccctccccctaccccccccatagggtcttccaggattttgttcccgggatcttgctgggataggtgccggcttcaaaagcgtggggcgctgaacctatggatcccccccgccttgcagaagccgtggaaacggccccgagcgagtccccttcctgaccccaggaggaggccaccggggaccagcgcaggggtcacctgggcggtggggactcacttaaggacaattaacgagacagacggagggcaatttggccgcagggcttggaga

SEQ ID NO: 69028 - DNA, 37 bp, Homo sapiens
  misc_feature 1..37: note = chr1:245376976-245377013
  misc_feature 1..37: note = hypo
  source 1..37: mol_type = genomic DNA
atcatcatcagaaggcgttgtgcgtggtgtggatgca

SEQ ID NO: 69029 - DNA, 151 bp, Homo sapiens; identical to SEQ ID NO: 39350
  misc_feature 1..151: note = chr1:245461494-245461645
  misc_feature 1..151: note = hypo
  source 1..151: mol_type = genomic DNA

SEQ ID NO: 69030 - DNA, 30 bp, Homo sapiens
  misc_feature 1..30: note = chr1:245472787-245472817
  misc_feature 1..30: note = hypo
  source 1..30: mol_type = genomic DNA
atggaatgacgccatcgggtctcctggttc

SEQ ID NO: 69031 - DNA, 32 bp, Homo sapiens
  misc_feature 1..32: note = chr1:245494495-245494527
  misc_feature 1..32: note = hypo
  source 1..32: mol_type = genomic DNA
gaccgagacatggatcgcgctcttgccggagg

SEQ ID NO: 69032 - DNA, 32 bp, Homo sapiens
  misc_feature 1..32: note = chr1:245498973-245499005
  misc_feature 1..32: note = hypo
  source 1..32: mol_type = genomic DNA
gaaagaagggtcccacgcggggaaagaagggt

SEQ ID NO: 69033 - DNA, 182 bp, Homo sapiens
  misc_feature 1..182: note = chr1:245499593-245499775
  misc_feature 1..182: note = hypo
  source 1..182: mol_type = genomic DNA
aaggagacaggagtgcgtagagtgagtgggccatcagaaaaaggactgctctggggatgcaggagacccgcttgtaggatttaggggcaccgtgcaagacaggggtcatggtatgcgggtgcctccgactggcggctgcgtggtggatctggccacttggtgaaggtcgcagtgaccttgat

SEQ ID NO: 69034 - DNA, 31 bp, Homo sapiens
  misc_feature 1..31: note = chr1:245522555-245522586
  misc_feature 1..31: note = hypo
  source 1..31: mol_type = genomic DNA
agtgatcctcctgcctcggcctcccaaaggg

SEQ ID NO: 69035 - DNA, 38 bp, Homo sapiens
  misc_feature 1..38: note = chr1:245627605-245627643
  misc_feature 1..38: note = hypo
  source 1..38: mol_type = genomic DNA
aggtaatgtgtgtcccgtcccccgacccagtgagcacg

SEQ ID NO: 69036 - DNA, 120 bp, Homo sapiens
  misc_feature 1..120: note = chr1:245627763-245627883
  misc_feature 1..120: note = hypo
  source 1..120: mol_type = genomic DNA
cgtgcgcgtgtgggggtgtgtgcccgtgggtgtgtgtgggcgtgtgcatgtgtggatgtgtggcaccatgtgtgtgggtgtgcgtgggtgtgttcctgtgtgggtgtgtgggtgtgtgtg

SEQ ID NO: 69037 - DNA, 30 bp, Homo sapiens
  misc_feature 1..30: note = chr1:245633295-245633325
  misc_feature 1..30: note = hypo
  source 1..30: mol_type = genomic DNA
ggttggcgggagtctcgggggagaaatggg

SEQ ID NO: 69038 - DNA, 170 bp, Homo sapiens
  misc_feature 1..170: note = chr1:245725716-245725886
  misc_feature 1..170: note = hypo
  source 1..170: mol_type = genomic DNA
ttggctccgtggtgacggcacatcctcactctgagaaccaggaccggcctcgggagtccaggttctgttcccagtttgtatgcacaccgatttccccactgtctgtcacaaccagtcaacttcccatgtgttaacagttactgaatctacctgtccgcacgtggccaagc

SEQ ID NO: 69039 - DNA, 176 bp, Homo sapiens
  misc_feature 1..176: note = chr1:245750646-245750822
  misc_feature 1..176: note = hypo
  source 1..176: mol_type = genomic DNA
ttgaagacagcaactcgtttttaagctctttataaccccagagcctcgcacagtacctggaccagattaaggggtacttaacagatgcttagtgaaggaaggaatggatttctcacctggttgcttatcttctagactcatttggggagtggccaggagtccgggagagctgccgg

SEQ ID NO: 69040 - DNA, 38 bp, Homo sapiens
  misc_feature 1..38: note = chr1:245753462-245753500
  misc_feature 1..38: note = hypo
  source 1..38: mol_type = genomic DNA
cctgcaaggggaggccgaggcgccggtggaagcacaaa

SEQ ID NO: 69041 - DNA, 95 bp, Homo sapiens
  misc_feature 1..95: note = chr1:245755482-245755577
  misc_feature 1..95: note = hypo
  source 1..95: mol_type = genomic DNA
cctctctgatggcatcgctgctcattatttgctgtctggcaccacgggagctcacccagcggcacctcggagaagccagccgcccagggtgcagg

SEQ ID NO: 69042 - DNA, 30 bp, Homo sapiens
  misc_feature 1..30: note = chr1:245761829-245761859
  misc_feature 1..30: note = hypo
  source 1..30: mol_type = genomic DNA
tgtctgctgtgatcacgtgtagtggtcacg

SEQ ID NO: 69043 - DNA, 297 bp, Homo sapiens
  misc_feature 1..297: note = chr1:245772571-245772868
  misc_feature 1..297: note = hypo
  source 1..297: mol_type = genomic DNA
atcctacaccatgatcggaaaggatgattccatgcagaacctgggcatcattccctgtgccatctcttggctcttcaagctcataaacgaacgcaaggaaaagaccggcgcccgtttctcagtccgggtttccgccgtggaagtgtgggggaaggaggagaacctgcgggacctgctgtcggaggtggccacgggcagcctgcaggacggccagtccccgggcgtgtacctctgtgaggaccccatctgcggcacgcaggtgattgcttctgaagcctggctcgccccaaggtggct

SEQ ID NO: 69044 - DNA, 30 bp, Homo sapiens
  misc_feature 1..30: note = chr1:245786226-245786256
  misc_feature 1..30: note = hypo
  source 1..30: mol_type = genomic DNA
ggagctgatggaggccgcaggatgtagttg

SEQ ID NO: 69045 - DNA, 30 bp, Homo sapiens
  misc_feature 1..30: note = chr1:245835512-245835542
  misc_feature 1..30: note = hypo
  source 1..30: mol_type = genomic DNA
tcctggaaccatattcgggatccccaactg

SEQ ID NO: 69046 - DNA, 32 bp, Homo sapiens
  misc_feature 1..32: note = chr1:245859338-245859370
  misc_feature 1..32: note = hypo
  source 1..32: mol_type = genomic DNA
tgatcatatcccatccgcggtagccaggctcc

SEQ ID NO: 69047 - DNA, 23 bp, Homo sapiens
  misc_feature 1..23: note = chr1:245969918-245969941
  misc_feature 1..23: note = hypo
  source 1..23: mol_type = genomic DNA
aaagagggagaaggccgggcgcg

SEQ ID NO: 69048 - DNA, 141 bp, Homo sapiens
  misc_feature 1..141: note = chr1:245979706-245979847
  misc_feature 1..141: note = hypo
  source 1..141: mol_type = genomic DNA
catttcagaataggacgactggaacaatgcaatactcatctaagcaactgcaaaagccagctacaacccaactcaaggtgccatctattatgagaggtccccttcatctatgtaaaaaaaaaaaaaaaaaaaaaagaggag

SEQ ID NO: 69049 - DNA, 178 bp, Homo sapiens
  misc_feature 1..178: note = chr1:245986618-245986796
  misc_feature 1..178: note = hypo
  source 1..178: mol_type = genomic DNA
gtgtgcacacacacacgcgcgctcgtgcttgctcgctctcgctctctctctctcttttctaaggctccaggcatccgtccctggagaagtgcaccttgggaaggcgatgaaatgaaagaagggcacatcctcctttaaccccaaacatctgaagtcagcgccgcgcactactgcgatt

SEQ ID NO: 69050 - DNA, 92 bp, Homo sapiens
  misc_feature 1..92: note = chr1:2460806-2460898
  misc_feature 1..92: note = hyper
  source 1..92: mol_type = genomic DNA
caagcccggggcggacgacggcgggaaggcgcttccctacaggcgagaggagcaggctcgccctctggtcgtcgggccgcgcgcccgcaggt

SEQ ID NO: 69051 - DNA, 43 bp, Homo sapiens
  misc_feature 1..43: note = chr1:24611924-24611967
  misc_feature 1..43: note = hypo
  source 1..43: mol_type = genomic DNA
cagctgctccccaaacgcagctacaccccgacctccatcttga

SEQ ID NO: 69052 - DNA, 218 bp, Homo sapiens
  misc_feature 1..218: note = chr1:2461311-2461529
  misc_feature 1..218: note = hyper
  source 1..218: mol_type = genomic DNA
ccatctccaggatgtcggccttctccagcttggagttgggctggtgccgcgcgaactcctgctccagcagcagcttcagctgctcgatgctgctgttgatgcggtcgcggcgcatcttctccaccaccggcttccgcagctgcgggaggagggggtgtcaggctggcccggcacggcgcagggacccccgaggaccggaggccgcggggacagcgcgc

SEQ ID NO: 69053 - DNA, 30 bp, Homo sapiens
  misc_feature 1..30: note = chr1:246171927-246171957
  misc_feature 1..30: note = hypo
  source 1..30: mol_type = genomic DNA
tttcctttcctttctcgagcaacgcaggga

SEQ ID NO: 69054 - DNA, 109 bp, Homo sapiens; identical to SEQ ID NO: 39357
  misc_feature 1..109: note = chr1:246172251-246172360
  misc_feature 1..109: note = hypo
  source 1..109: mol_type = genomic DNA

SEQ ID NO: 69055 - DNA, 38 bp, Homo sapiens
  misc_feature 1..38: note = chr1:2461950-2461988
  misc_feature 1..38: note = hyper
  source 1..38: mol_type = genomic DNA
ggggcctgatgccgggagccccgcgcctcaatatgctg

SEQ ID NO: 69056 - DNA, 30 bp, Homo sapiens; identical to SEQ ID NO: 39358
  misc_feature 1..30: note = chr1:246330476-246330506
  misc_feature 1..30: note = hypo
  source 1..30: mol_type = genomic DNA

SEQ ID NO: 69057 - DNA, 30 bp, Homo sapiens
  misc_feature 1..30: note = chr1:246363402-246363432
  misc_feature 1..30: note = hypo
  source 1..30: mol_type = genomic DNA
tagaatgtacacagacgtccactgtaatag

SEQ ID NO: 69058 - DNA, 30 bp, Homo sapiens; identical to SEQ ID NO: 39359
  misc_feature 1..30: note = chr1:246363735-246363765
  misc_feature 1..30: note = hypo
  source 1..30: mol_type = genomic DNA

SEQ ID NO: 69059 - DNA, 112 bp, Homo sapiens
  misc_feature 1..112: note = chr1:24648230-24648342
  misc_feature 1..112: note = hyper
  source 1..112: mol_type = genomic DNA
tgtaaggcggcacttcgaaggctggtctctgagaagcatggaggccccggcggtgtagttagaaaccagctggaggtggctggcgggtgctgagcgccgggcctttcatgtg

SEQ ID NO: 69060 - DNA, 165 bp, Homo sapiens
  misc_feature 1..165: note = chr1:246488142-246488307
  misc_feature 1..165: note = hypo
  source 1..165: mol_type = genomic DNA
tcttcacccagttcccgtgtgcttgatgtgacttgcaccatcacacaccgtcaacattctgggctcagtgactcatccctgaaagctgcaggatctatttaggttaatttaggatctttcatgaacaaggaaggagaaggagtcagggggcgggaaggagggaga

SEQ ID NO: 69061 - DNA, 319 bp, Homo sapiens
  misc_feature 1..319: note = chr1:24648832-24649151
  misc_feature 1..319: note = hyper
  source 1..319: mol_type = genomic DNA
tctgatctccaggagcgccggctccagactgcctggagcgctgaaagagttaatcaggaacgcctccccgctgtggttttgtggtcgaaaccatgattgccaggagcaaatttttgtcgtgcacgaggtgtgttattaaaagtcggagctacgctgctgctgaatgaaaagttaaaagccctctttgagttcgggctgtaaaactggcggactgggccgagaggcttgagccaaccctaacggcggcggcccgggcggcgcgggggtcctgcggctccgccagctgctgggagcgggcaggctgcgcagtcccagcagt

SEQ ID NO: 69062 - DNA, 17 bp, Homo sapiens
  misc_feature 1..17: note = chr1:246666970-246666987
  misc_feature 1..17: note = hypo
  source 1..17: mol_type = genomic DNA
taagtgatttcaggccg

SEQ ID NO: 69063 - DNA, 31 bp, Homo sapiens
  misc_feature 1..31: note = chr1:2468551-2468582
  misc_feature 1..31: note = hypo
  source 1..31: mol_type = genomic DNA
gtgtaccagtgtgtgcgcttgtgtacgtgtg

SEQ ID NO: 69064 - DNA, 150 bp, Homo sapiens
  misc_feature 1..150: note = chr1:2468642-2468792
  misc_feature 1..150: note = hypo
  source 1..150: mol_type = genomic DNA
tgcatgcatctgcgtgcatgtgcccaggaatgctcacgcctgctcagatgtcctcagctgggccacccgtccccaccctgccccgctgccctaactcccagagtacccgcattggccgagcactgctctgtgccacgtgagccctgggcc

SEQ ID NO: 69065 - DNA, 142 bp, Homo sapiens
  misc_feature 1..142: note = chr1:246899152-246899294
  misc_feature 1..142: note = hypo
  source 1..142: mol_type = genomic DNA
aggctattttattaacagttgatttcttgataactaggactgtttacttccaggattagatggcattttattcatttaaacttgtcaagcaagaataacctctttgttctttttgtttccctagtatcggttttatggagaa

SEQ ID NO: 69066 - DNA, 39 bp, Homo sapiens
  misc_feature 1..39: note = chr1:246912280-246912319
  misc_feature 1..39: note = hypo
  source 1..39: mol_type = genomic DNA
aggaatgctaacttttccgtctgccgtgaaaggcacgag

SEQ ID NO: 69067 - DNA, 70 bp, Homo sapiens
  misc_feature 1..70: note = chr1:246959219-246959289
  misc_feature 1..70: note = hypo
  source 1..70: mol_type = genomic DNA
gggggttaggtgctacgcgtaggtccacatctggcatgtccagtttttgatggtacggagatttgtgaca

SEQ ID NO: 69068 - DNA, 120 bp, Homo sapiens
  misc_feature 1..120: note = chr1:246964078-246964198
  misc_feature 1..120: note = hypo
  source 1..120: mol_type = genomic DNA
ggagagcttggctgtcggccttgcaggttctctgttctctttgcttcttgagataatggatgccaccctctgcctctccccagcctgctcctttgttaaagcttgcgggttcctgagatg

SEQ ID NO: 69069 - DNA, 95 bp, Homo sapiens
  misc_feature 1..95: note = chr1:246991090-246991185
  misc_feature 1..95: note = hypo
  source 1..95: mol_type = genomic DNA
cattctcttcagtgtcggctcgagtactattttttggcctgacatggtgtttcacacttaagatcccatcactttgggaggcagaggcagaagga

SEQ ID NO: 69070 - DNA, 83 bp, Homo sapiens
  misc_feature 1..83: note = chr1:24701375-24701458
  misc_feature 1..83: note = hypo
  source 1..83: mol_type = genomic DNA
aaagtgttgggattacaggcgtgagccactgcacctggttttctactatttttactgttttcaggacacgtagtcctacccat

SEQ ID NO: 69071 - DNA, 176 bp, Homo sapiens; identical to SEQ ID NO: 26997
  misc_feature 1..176: note = chr1:247171005-247171181
  misc_feature 1..176: note = hyper
  source 1..176: mol_type = genomic DNA

SEQ ID NO: 69072 - DNA, 315 bp, Homo sapiens
  misc_feature 1..315: note = chr1:247171251-247171566
  misc_feature 1..315: note = hyper
  source 1..315: mol_type = genomic DNA
cgcaatacctgcaggccacagggcgatggagcctgcggcagtcacccgggactctccgagaggcagcagacgggaacccagcaccccgccggccgcaaggagacaaaggccccgccagatccccaaggccgccccttcctctctggctgcacgcctgattggacagttctcacgctagcgccgctgactggatggggctccaggccccaccccctcaggtcttgagtgacaggaggtgcgatcagacactgggccgaatgaaacaagagtgacaggtttttgggtgcagcccttttgaagcgacattcctcacgg

SEQ ID NO: 69073 - DNA, 176 bp, Homo sapiens
  misc_feature 1..176: note = chr1:247185335-247185511
  misc_feature 1..176: note = hypo
  source 1..176: mol_type = genomic DNA
tgacgtgttatcttacgaaaaatgttagcgtattccaccttgctcaaggtcctaggtagcagacggtaatactgtactattgggtaatacatgccaatcatctctagcaatccttattcccagtggcattacactccagagagtgtggagaatattgatcccgtatgttatatttt

SEQ ID NO: 69074 - DNA, 403 bp, Homo sapiens
  misc_feature 1..403: note = chr1:2472147-2472550
  misc_feature 1..403: note = hyper
  source 1..403: mol_type = genomic DNA
gcggggattaggggccgtccgggcccacgtggccgcacgccccgccccgccggtgtccccccaccccccgtgcgccccggggcagggccgggtcgccgtcccaagctggttaaaaaccccgcggtgtcagagagcagctcgttcccaacctctgaaaggcagacaagccctttattgctctattataacgcggagccagatggtcttttgggagttgcccccccgcgccccccgccgccgccctcattcattcagactcagaccccggcactaatgccgcgggggggcccaggcacgcttccctcgccgcccgcccgcgcagtgtgggaaccgccggcgagcgcgaacccacagccgggcggagggaggggcttggaaacccgcgcatcggagagctggggag

SEQ ID NO: 69075 - DNA, 274 bp, Homo sapiens
  misc_feature 1..274: note = chr1:247274326-247274600
  misc_feature 1..274: note = hyper
  source 1..274: mol_type = genomic DNA
aaattgggtggaggccgagagctcggggccgcgagcaagcctccgacgccctggtcccctggacccgccggttaaactgtgattctctttctaaatcctttgtctgcgccggactcggggtacccgccgggtggtgtggggctggtttccccaccagctctcgaactcctgcactgaagcgctcctcccgcttcagtctccccagtggttgggattacaggcgtgagcccccgcgcccggccaaagggccccctaggaccggctgtctcccccg

SEQ ID NO: 69076 - DNA, 204 bp, Homo sapiens
  misc_feature 1..204: note = chr1:247274826-247275030
  misc_feature 1..204: note = hyper
  source 1..204: mol_type = genomic DNA
gctccggaaagtttgcggcggctgccccgggagggacttcggcggggaggaggcggcggcgccaggtggccgaagtcggaggggtccgtccgctcccgcagcctaggagcgcgccctccccgccggtgccggggcccgtggtgggggtcgcacccaccgccgcttggccgggaccgtcttggctggcgccgccttggagctcgt

SEQ ID NO: 69077 - DNA, 121 bp, Homo sapiens
  misc_feature 1..121: note = chr1:247275546-247275667
  misc_feature 1..121: note = hyper
  source 1..121: mol_type = genomic DNA
ccggccttagctgggcggagcaattccggtgccgccgccccttccccgcccggccatgctcgggctccaggcgggctgctgcagggggcctgatccggtggacgatcggctcctcaccccg

SEQ ID NO: 69078 - DNA, 30 bp, Homo sapiens
  misc_feature 1..30: note = chr1:247278844-247278874
  misc_feature 1..30: note = hypo
  source 1..30: mol_type = genomic DNA
gtccctgcttgcccccgcctacctgaccat

SEQ ID NO: 69079 - DNA, 91 bp, Homo sapiens
  misc_feature 1..91: note = chr1:247399809-247399900
  misc_feature 1..91: note = hypo
  source 1..91: mol_type = genomic DNA
acaaacaattagcccagtgtggtggcaggcgcctggtgggaaccagggtggcgggcgcctggtgggaagggcgcctcgtgggaacccgggg

SEQ ID NO: 69080 - DNA, 180 bp, Homo sapiens
  misc_feature 1..180: note = chr1:24740809-24740989
  misc_feature 1..180: note = hypo
  source 1..180: mol_type = genomic DNA
acaggcgtgagccaccacgcccggccccaagccctgtttctaacagaagaaaaaaaaaaaaattgacatgggcgactatacaagggcagccacttagtattccaggagcccctcttcacacgcttcagggcagggcggtctcagcgaccttgtcactcccctgcttaaagtcctccaatg

SEQ ID NO: 69081 - DNA, 30 bp, Homo sapiens
  misc_feature 1..30: note = chr1:247582310-247582340
  misc_feature 1..30: note = hypo
  source 1..30: mol_type = genomic DNA
tgtggatcttcgctgcgatcaacaggagag

SEQ ID NO: 69082 - DNA, 30 bp, Homo sapiens
  misc_feature 1..30: note = chr1:247587392-247587422
  misc_feature 1..30: note = hypo
  source 1..30: mol_type = genomic DNA
tgagcctgtgcacaccgtggtgttccaggg

SEQ ID NO: 69083 - DNA, 261 bp, Homo sapiens
  misc_feature 1..261: note = chr1:247589856-247590117
  misc_feature 1..261: note = hypo
  source 1..261: mol_type = genomic DNA
tcagctttcttgatccgttgacattaccatgaccaggaccaccttcctagtcatggtttggccatgaaggactgactgcccacagggccgcagtggtggtgaagacccaggtcctggtcacagggacttgaggtctggctgtgggacagtccggaaacaagtgcagatgtcggggagggggtcatgggctctgacaaggaaacttgcagagtatccaaagcacaaggggacgaacctgttcaccagcggggcacgggtggg

SEQ ID NO: 69084 - DNA, 224 bp, Homo sapiens
  misc_feature 1..224: note = chr1:247615881-247616105
  misc_feature 1..224: note = hypo
  source 1..224: mol_type = genomic DNA
attcatgctgatctccgctgtcatgaccacacacgcacaggcagccctgtcactcacactggcagtaaaagcagcacaattctaggtcctgtgagtctctggagtggaagagccaaggtatacgttacttcagcccctgaataggtcatggtagttaatgagaccccagaccatggaattttgagcacagggagaaagctcttgattggcgtgagaaaggtagc

SEQ ID NO: 69085 - DNA, 30 bp, Homo sapiens
  misc_feature 1..30: note = chr1:247617725-247617755
  misc_feature 1..30: note = hypo
  source 1..30: mol_type = genomic DNA
cacaaacatcgccatcgcattcagacggaa

SEQ ID NO: 69086 - DNA, 38 bp, Homo sapiens
  misc_feature 1..38: note = chr1:247682027-247682065
  misc_feature 1..38: note = hypo
  source 1..38: mol_type = genomic DNA
cgcctgcagtcccagcgctttggcaggccaaggcgggc

SEQ ID NO: 69087 - DNA, 154 bp, Homo sapiens
  misc_feature 1..154: note = chr1:24768639-24768793
  misc_feature 1..154: note = hypo
  source 1..154: mol_type = genomic DNA
cgagctgggtgtgttcgcctcctacgccttcgcgccgctgtcactcatcgtgcccctcagcgcagtttctgtgataggtaagaccagggctgccccaccctcccctggggtgctcccagctgcgtgaccagagtgccagcgccaggatcaaagg

SEQ ID NO: 69088 - DNA, 195 bp, Homo sapiens
  misc_feature 1..195: note = chr1:247694897-247695092
  misc_feature 1..195: note = hypo
  source 1..195: mol_type = genomic DNA
ccatgtgccggagggcgctcttcacctccgtgttcctcagggtgtaaataagtgggttcagcgcaggagtgactacggtgtagaacagagctatgaacttgccctgctcatgggaggtgctcttggctggctggagatacatgaagatgatgctcccgtaaaacagagacaccacagccacgtgggaagaacagg

SEQ ID NO: 69089 - DNA, 209 bp, Homo sapiens
  misc_feature 1..209: note = chr1:247709336-247709545
  misc_feature 1..209: note = hypo
  source 1..209: mol_type = genomic DNA
ggtagcataaatgtacgcatatgtccaaactcatcaaattatgtacattaattatattcacgttcttttatatcaatatatcaacaaagctaggaaagaaagaaataaatttttgtttgttcgttttgttttgttttgtctaatgatgggacggtttcgctctgttgctcaggctgatgtgcagtagctattcacgggcatgatcattg

SEQ ID NO: 69090 - DNA, 203 bp, Homo sapiens
  misc_feature 1..203: note = chr1:247752018-247752221
  misc_feature 1..203: note = hypo
  source 1..203: mol_type = genomic DNA
gtgatgtcctgtgaccgctatgtggctgtctgccgtcctctccattacactgtcttaatgcatatccatctctgcatggccttggcatctatggcatggctcagtggaatagccaccaccctggtacagtccaccctcaccctgcagctgcccttctgtgggcatcgccaagtggatcatttcatctgcgaggtccctgtgct

SEQ ID NO: 69091 - DNA, 40 bp, Homo sapiens
  misc_feature 1..40: note = chr1:247910639-247910679
  misc_feature 1..40: note = hypo
  source 1..40: mol_type = genomic DNA
catgaactgctaatgcgaagactttttttttttttttttt

SEQ ID NO: 69092 - DNA, 28 bp, Homo sapiens
  misc_feature 1..28: note = chr1:247994928-247994956
  misc_feature 1..28: note = hypo
  source 1..28: mol_type = genomic DNA
tattctggccaggtgcggtggctcatgc

SEQ ID NO: 69093 - DNA, 32 bp, Homo sapiens; identical to SEQ ID NO: 39368
  misc_feature 1..32: note = chr1:248002278-248002310
  misc_feature 1..32: note = hypo
  source 1..32: mol_type = genomic DNA

SEQ ID NO: 69094 - DNA, 134 bp, Homo sapiens
  misc_feature 1..134: note = chr1:248020315-248020449
  misc_feature 1..134: note = hyper
  source 1..134: mol_type = genomic DNA
tgggtgtgtgtgtgacgggggcggggaaccacaacgttaattttatccccgacatagggagcgcctgagtggtggcttttcaccgggtgtggctcgtctgagctcttgaactgaagccagcggacaccacccgt

SEQ ID NO: 69095 - DNA, 116 bp, Homo sapiens; identical to SEQ ID NO: 140
  misc_feature 1..116: note = chr1:248020515-248020631
  misc_feature 1..116: note = hyper
  source 1..116: mol_type = genomic DNA

SEQ ID NO: 69096 - DNA, 393 bp, Homo sapiens
  misc_feature 1..393: note = chr1:248020956-248021349
  misc_feature 1..393: note = hyper
  source 1..393: mol_type = genomic DNA
ggcagctaccaggtgaggcgccccccggcgggggctgcgggcgctgcggtgaccgggaagcgggcgacagtccggagcggagccgccgaggccacccgtctcctgagcggctcccacggccgctccccccaccgcgcgccgtcccccccgcccacgcggctcactcagtgtgggtctctttgccttggctgtggtaaccccctttgcgacacacacccattattttacaccgtccgcccctcccccaagcactctcctgtcgtcgaactcgcgctgggctggtttctcccgatgcggatagtctggtccctcagctgggctctggtcgggagggctgtgtggtccagttcattcttggtaacaattgtacgtctatatcgtaaacttgccata

SEQ ID NO: 69097 - DNA, 22 bp, Homo sapiens
  misc_feature 1..22: note = chr1:248026563-248026585
  misc_feature 1..22: note = hypo
  source 1..22: mol_type = genomic DNA
gggcacagtggctcacgcctgt

SEQ ID NO: 69098 - DNA, 141 bp, Homo sapiens
  misc_feature 1..141: note = chr1:248026825-248026966
  misc_feature 1..141: note = hypo
  source 1..141: mol_type = genomic DNA
cgagactctgtctcaaaaaaaagattaaaaaaaaaaccaggcaaatgacttcacctacaaggccgtataacaatgtaacaaaactgcatttgtaccccatgaatatatacaaaaaataaaataaatcgataaaacaggaca

SEQ ID NO: 69099 - DNA, 294 bp, Homo sapiens; identical to SEQ ID NO: 39370
  misc_feature 1..294: note = chr1:248027965-248028259
  misc_feature 1..294: note = hypo
  source 1..294: mol_type = genomic DNA

SEQ ID NO: 69100 - DNA, 30 bp, Homo sapiens
  misc_feature 1..30: note = chr1:248029451-248029481
  misc_feature 1..30: note = hypo
  source 1..30: mol_type = genomic DNA
atacaagaactttgacggtttcttttcttt

SEQ ID NO: 69101 - DNA, 197 bp, Homo sapiens; identical to SEQ ID NO: 39371
  misc_feature 1..197: note = chr1:248034262-248034459
  misc_feature 1..197: note = hypo
  source 1..197: mol_type = genomic DNA

SEQ ID NO: 69102 - DNA, 113 bp, Homo sapiens
  misc_feature 1..113: note = chr1:248039213-248039326
  misc_feature 1..113: note = hypo
  source 1..113: mol_type = genomic DNA
tggatcccgccacggcgcacccgagtctgctcttgaccgccgacctgcgcagtgtgcaggatggagaaccatggagggatgtccccaacaaccctgagcgatttgacacatgg

SEQ ID NO: 69103 - DNA, 22 bp, Homo sapiens
  misc_feature 1..22: note = chr1:248047093-248047115
  misc_feature 1..22: note = hypo
  source 1..22: mol_type = genomic DNA
taaattatgacaggccgggcgt

SEQ ID NO: 69104 - DNA, 120 bp, Homo sapiens
  misc_feature 1..120: note = chr1:248047790-248047910
  misc_feature 1..120: note = hypo
  source 1..120: mol_type = genomic DNA
gctgggattacaggcgtgagccaccgtgcccgttctaatgagagtcttctttaacctccacttcactttctaaaagtgagtctctttttggcgggggtcggggaggacagggtctcactc

SEQ ID NO: 69105 - DNA, 37 bp, Homo sapiens
  misc_feature 1..37: note = chr1:248048162-248048199
  misc_feature 1..37: note = hypo
  source 1..37: mol_type = genomic DNA
tcatgcgttgcttaacgatggggatgtgttctgagaa

SEQ ID NO: 69106 - DNA, 34 bp, Homo sapiens
  misc_feature 1..34: note = chr1:248074314-248074348
  misc_feature 1..34: note = hypo
  source 1..34: mol_type = genomic DNA
accaccctcttgtatcgttcgtaatatccagcag

SEQ ID NO: 69107 - DNA, 90 bp, Homo sapiens
  misc_feature 1..90: note = chr1:248074687-248074777
  misc_feature 1..90: note = hypo
  source 1..90: mol_type = genomic DNA
tttctaatatccaggcgaaaaaacaataatacttccaatattgcagggggtgtacaccgctcctatgacagtattcctaatatccacggg

SEQ ID NO: 69108 - DNA, 90 bp, Homo sapiens
  misc_feature 1..90: note = chr1:248074837-248074927
  misc_feature 1..90: note = hypo
  source 1..90: mol_type = genomic DNA
tccttataaccgggggggacgggatgatattagtcccaatgtcgcagagggtgtacaccgcctctgtaatatccacgggggaaaaggatg

SEQ ID NO: 69109 - DNA, 32 bp, Homo sapiens
  misc_feature 1..32: note = chr1:248092102-248092134
  misc_feature 1..32: note = hypo
  source 1..32: mol_type = genomic DNA
agaaacaggatgggccgggcgcggtgcctcac

SEQ ID NO: 69110 - DNA, 21 bp, Homo sapiens
  misc_feature 1..21: note = chr1:248098787-248098808
  misc_feature 1..21: note = hypo
  source 1..21: mol_type = genomic DNA
aatgtatgggccaggcgcggt

SEQ ID NO: 69111 - DNA, 30 bp, Homo sapiens; identical to SEQ ID NO: 39377
  misc_feature 1..30: note = chr1:248099290-248099320
  misc_feature 1..30: note = hypo
  source 1..30: mol_type = genomic DNA

SEQ ID NO: 69112 - DNA, 424 bp, Homo sapiens
  misc_feature 1..424: note = chr1:248099705-248100129
  misc_feature 1..424: note = hypo
  source 1..424: mol_type = genomic DNA
tggacatggcaggggcgtgtccagcccagatcaaggatcagttcaggcaggcgacagtgaccgtggtcaccatggcgatgtggtgcccacggtcagaggtggcattggggaagtcagccactcggacgctggtgctcctcactgacttctcatcgctcctgtgctcgctgtagacggtgtttaactcagaatccacatgcaggatgttctcggttttcaggtgtgcgtgggtcagccggttctcgtgcagaaatctaagggtgtggcagagctggtgggccatgtgccagacatgtgggaggggaatggctggatgttattctccttcgggaactcaagggttttcctgcccaggagctcaaaggtgatatgcatggaccgcggagggtgaaccagtcacaccccaagacgcacagcagctggt

SEQ ID NO: 69113 - DNA, 203 bp, Homo sapiens
  misc_feature 1..203: note = chr1:248140923-248141126
  misc_feature 1..203: note = hypo
  source 1..203: mol_type = genomic DNA
aagcatgaaccagctcgcccgatagcctacttccgtatgactgcttactgcttaaaagtcaggtagcccttctcacagggtcctaactaccgttaattgtttctttagatatcatctttaattttaggaaacctcaagttttctatttaaaatgttttccggatcctgaattctagtggatccactgacgcagggggtctgtg

SEQ ID NO: 69114 - DNA, 30 bp, Homo sapiens
  misc_feature 1..30: note = chr1:248244670-248244700
  misc_feature 1..30: note = hypo
  source 1..30: mol_type = genomic DNA
agataaagttcattccgtttttgttgttgt

SEQ ID NO: 69115 - DNA, 30 bp, Homo sapiens
  misc_feature 1..30: note = chr1:248292238-248292268
  misc_feature 1..30: note = hypo
  source 1..30: mol_type = genomic DNA
ctgtggcttagtaggcggttttaccctgct

SEQ ID NO: 69116 - DNA, 203 bp, Homo sapiens; identical to SEQ ID NO: 39379
  misc_feature 1..203: note = chr1:248328673-248328876
  misc_feature 1..203: note = hypo
  source 1..203: mol_type = genomic DNA

SEQ ID NO: 69117 - DNA, 30 bp, Homo sapiens; identical to SEQ ID NO: 39380
  misc_feature 1..30: note = chr1:248329246-248329276
  misc_feature 1..30: note = hypo
  source 1..30: mol_type = genomic DNA

SEQ ID NO: 69118 - DNA, 33 bp, Homo sapiens
  misc_feature 1..33: note = chr1:2483840-2483873
  misc_feature 1..33: note = hypo
  source 1..33: mol_type = genomic DNA
atcctgctgctcctccgccggccgccccgcaca

SEQ ID NO: 69119 - DNA, 30 bp, Homo sapiens
  misc_feature 1..30: note = chr1:248538382-248538412
  misc_feature 1..30: note = hypo
  source 1..30: mol_type = genomic DNA
ccgaggcaggcaggtcgcctgagctcagga

SEQ ID NO: 69120 - DNA, 30 bp, Homo sapiens
  misc_feature 1..30: note = chr1:248685560-248685590
  misc_feature 1..30: note = hypo
  source 1..30: mol_type = genomic DNA
tctttctaattgtcccggtgttactcatct

SEQ ID NO: 69121 - DNA, 126 bp, Homo sapiens
  misc_feature 1..126: note = chr1:248792899-248793025
  misc_feature 1..126: note = hypo
  source 1..126: mol_type = genomic DNA
ccgtgcatcccgccacgccactttctgcttgaaaccctgcagttgtgctttacatcatacattaaggcccatcacgttctgaacattttgtcttctgaaatgatctcccgccgactccagtctgtc

SEQ ID NO: 69122 - DNA, 24 bp, Homo sapiens
  misc_feature 1..24: note = chr1:249121618-249121642
  misc_feature 1..24: note = hypo
  source 1..24: mol_type = genomic DNA
gagccaccacgcccagcctagctt

SEQ ID NO: 69123 - DNA, 30 bp, Homo sapiens
  misc_feature 1..30: note = chr1:249151579-249151609
  misc_feature 1..30: note = hypo
  source 1..30: mol_type = genomic DNA
gccccccatcttggccgccaggcccccgaa

SEQ ID NO: 69124 - DNA, 129 bp, Homo sapiens
  misc_feature 1..129: note = chr1:249212385-249212514
  misc_feature 1..129: note = hypo
  source 1..129: mol_type = genomic DNA
gggaggcgaagcaggcggttggagactgagagccgcttcgatatgattgggcactggattatccatcaggacaagaggacccggtgtgccctctgccactcacagaccaacacccggtgtgagaagtgc

SEQ ID NO: 69125 - DNA, 40 bp, Homo sapiens
  misc_feature 1..40: note = chr1:2500708-2500748
  misc_feature 1..40: note = hypo
  source 1..40: mol_type = genomic DNA
cagcaggatcccaggcgggagggcacggccttctgagagg

SEQ ID NO: 69126 - DNA, 30 bp, Homo sapiens; identical to SEQ ID NO: 14185
  misc_feature 1..30: note = chr1:2507045-2507075
  misc_feature 1..30: note = hypo
  source 1..30: mol_type = genomic DNA

SEQ ID NO: 69127 - DNA, 304 bp, Homo sapiens
  misc_feature 1..304: note = chr1:2519610-2519914
  misc_feature 1..304: note = hypo
  source 1..304: mol_type = genomic DNA
ccctctgtggaccctcggctagcagccactgggctcggtgtccaacctgccggtgggctgggctggctactgatctggtcgcctgtgccatctctgagccctggtgaggcgggtgggtggggtggggcctgacctaggaactggtctcatggacactggagcaggctctggacccaggcttctccggagtttggccaagcgacctggtgtcttcgcaggtacaacagcctgagcatcctcccagcagctctggggaagcccgtgcgtgatgtggctgccaaggtgtgtgcgggtcaagggtgta

SEQ ID NO: 69128 - DNA, 30 bp, Homo sapiens
  misc_feature 1..30: note = chr1:2520957-2520987
  misc_feature 1..30: note = hypo
  source 1..30: mol_type = genomic DNA
gctgggtcgggatgccgaacctctcctgat

SEQ ID NO: 69129 - DNA, 88 bp, Homo sapiens
  misc_feature 1..88: note = chr1:25220516-25220604
  misc_feature 1..88: note = hypo
  source 1..88: mol_type = genomic DNA
tttcctaatttcaggcgtcagtgatttaggacggagttgttttcatggaaaaagaaatagaacctgtttgtggcggggcaagactgat

SEQ ID NO: 69130 - DNA, 43 bp, Homo sapiens
  misc_feature 1..43: note = chr1:25228594-25228637
  misc_feature 1..43: note = hypo
  source 1..43: mol_type = genomic DNA
aggagtccaccagggcggtcagtagggccgccacacggcctca

SEQ ID NO: 69131 - DNA, 884 bp, Homo sapiens
  misc_feature 1..884: note = chr1:25255940-25256824
  misc_feature 1..884: note = hyper
  source 1..884: mol_type = genomic DNA
actgaaccgggtgcccgggtgtcgccgcggcgtctcgggcacctcccatccccactgctcccgaggctctggctcccgcagctcagacgcccggagccccagggccggcgccctcccgccccgggtcccgcactcaccttgaaggcgacgggcagcgtcttgttgcagcgccagtgcgagggcagcacggagcagaggaagttggggctgtcggtgcgcacgagctcgcctgcgtggtccgccagcacgtccaccatcgagcgcacctcgggccgggcgcgccctccgggccccacggccgcctgcgcgctcagcgcgccgctgttctcgcccatcttgccgccgccgccgccgcaggggaaggccggggagggaggtgtgaagcggcggctggtgcttgggtctacgggaatacgcataacagcggccgtcagggcgccgggcaggcggagacggcgcggcttcccccgggggcggccggcgcgggcgcctcctcggccgccgctgccgcgagaagcgggaaagcagaagcggcggggcccgggcctcagggcgcagggggcggcgcccggccactactcgccagggcccgcccgctgcgaggcctcgctggcccgacggccgcccgcagcctgcccggctagtcccgcatcctcggcgcgcggccccgcgtgcggccgcccctcgtggctgtcccggctgcctgggccgcggcggggcccgcgcggggctgtgccgctgccgccgcctcccgccccgaagctcgcccgcggccgccccgactccgcggccgcagccccagaacaaatcctccagaatcaagtggcggggccgcggccgcccgcgcggggttagtacccccggggcccgcggggcggggctgg

SEQ ID NO: 69132 - DNA, 212 bp, Homo sapiens
  misc_feature 1..212: note = chr1:25257156-25257368
  misc_feature 1..212: note = hyper
  source 1..212: mol_type = genomic DNA
gggcctgtgacttctgcaaccccgggctgggggccgcggggtctcagggccggtgacgccgcactgggagccgccccaaagaggttactcacctccctcgtcccgcacattattctgacccaagagcctccaccccacacgggattttgcgcgtcgtccacgcccggccggcggcctttgctgctcccagccctgcgcggctttggtcccag

SEQ ID NO: 69133 - DNA, 117 bp, Homo sapiens; identical to SEQ ID NO: 26139
  misc_feature 1..117: note = chr1:25259018-25259135
  misc_feature 1..117: note = hyper
  source 1..117: mol_type = genomic DNA

SEQ ID NO: 69134 - DNA, 64 bp, Homo sapiens
  misc_feature 1..64: note = chr1:25269281-25269345
  misc_feature 1..64: note = hypo
  source 1..64: mol_type = genomic DNA
gagggtcagcatcagcggtgccctaatgccaggacctgacccgggctcccgcctcccagcctgg

SEQ ID NO: 69135 - DNA, 231 bp, Homo sapiens
  misc_feature 1..231: note = chr1:2527304-2527535
  misc_feature 1..231: note = hypo
  source 1..231: mol_type = genomic DNA
gggctgccttctccccgtggggtcctgtctgcgcctcccggggctgccttctccccgtggggaccgtcaggaggctttgtcggggcggtgctgcccgtgcccagatccagtcggggctgccctgacctctgcgagccacataccttctcctgcgccttcttcttggactcctcgtccatccagcccagctcgtccagcgtctccacaaacactgtccgcaccttgtcaatg

SEQ ID NO: 69136 - DNA, 30 bp, Homo sapiens
  misc_feature 1..30: note = chr1:2527977-2528007
  misc_feature 1..30: note = hypo
  source 1..30: mol_type = genomic DNA
gccatggatgaggggcgcccaccatgctct

SEQ ID NO: 69137 - DNA, 30 bp, Homo sapiens
  misc_feature 1..30: note = chr1:25351684-25351714
  misc_feature 1..30: note = hypo
  source 1..30: mol_type = genomic DNA
ggctgggccgctgcacggggcctgggggga

SEQ ID NO: 69138 - DNA, 66 bp, Homo sapiens; identical to SEQ ID NO: 14186
  misc_feature 1..66: note = chr1:2537084-2537150
  misc_feature 1..66: note = hypo
  source 1..66: mol_type = genomic DNA

SEQ ID NO: 69139 - DNA, 141 bp, Homo sapiens
  misc_feature 1..141: note = chr1:2537758-2537899
  misc_feature 1..141: note = hypo
  source 1..141: mol_type = genomic DNA
ctgtgagttcatcagcgccagctgccgctccagctcccactcgagtcctggggagacagtgccccgcactggagactggcgggccctggggccccagcccggccccttgtcggtgaatctggcctccggagccaggaacta

SEQ ID NO: 69140 - DNA, 164 bp, Homo sapiens
  misc_feature 1..164: note = chr1:2538565-2538729
  misc_feature 1..164: note = hypo
  source 1..164: mol_type = genomic DNA
acagaactgtgggggcgccgttggccggcgtcacaggtccccacagcccctgcagtgctccgcgagaggcggcctcccagcctctgggcctttacacctgcaccctcccgtcacaggtcagcatcttggcagctctgcagcgcaggaggcggaggctgagactg

SEQ ID NO: 69141 - DNA, 64 bp, Homo sapiens
  misc_feature 1..64: note = chr1:2541226-2541290
  misc_feature 1..64: note = hypo
  source 1..64: mol_type = genomic DNA
acacggttccgtggtcgggtccatgttctggaggatcctggcagctgctcgtccccatggcgtg

SEQ ID NO: 69142 - DNA, 30 bp, Homo sapiens
  misc_feature 1..30: note = chr1:25417486-25417516
  misc_feature 1..30: note = hypo
  source 1..30: mol_type = genomic DNA
cagagccacaaagagcgcaggctctgagga

SEQ ID NO: 69143 - DNA, 35 bp, Homo sapiens
  misc_feature 1..35: note = chr1:25425784-25425819
  misc_feature 1..35: note = hyper
  source 1..35: mol_type = genomic DNA
gcagggacaaggcaccgcagcgtgtttttggctgc

SEQ ID NO: 69144 - DNA, 30 bp, Homo sapiens
  misc_feature 1..30: note = chr1:25501519-25501549
  misc_feature 1..30: note = hypo
  source 1..30: mol_type = genomic DNA
gggtccagagcaaggcgccatgcgagagtt

SEQ ID NO: 69145 - DNA, 29 bp, Homo sapiens
  misc_feature 1..29: note = chr1:25601203-25601232
  misc_feature 1..29: note = hypo
  source 1..29: mol_type = genomic DNA
ggggaaacaaagggccgggcgacgtggct

SEQ ID NO: 69146 - DNA, 612 bp, Homo sapiens
  misc_feature 1..612: note = chr1:2560341-2560953
  misc_feature 1..612: note = hyper
  source 1..612: mol_type = genomic DNA
ggtgagcccgggcggcgggagggacacggacgccggtggtccccagccggggctgcgcggccaggcagggagggggtgggcggaggggcgggcgacgggtctgcgccccccaccctccgggagtccggcggaggcggaggcggaggcggaggcgggcgggtgcggagctgcagaagcagcgcgcgggagtcggggccggggcagagctttctggaagggaccgcgggctccctgcaggtcagtgcccctcccgccgcctctgagtccgcagctcggccccgggagcccctgggtgcccagtgcagacccacctgccccatctgacgggcgggctcgggctgggggcaggcggaccctgcagcaggtgcagcggggcgagcgcggagagcgggcacggggacaggcgggggcggggcacccgcactcacctctgcggtcggcgtagaggacacccaaggccaccagggcagcggtcaccagcagcagcagcagcagcagccccccctccaggaaccccgggcgcttctgccctgcacggccggcgctctccaccatccccactgggccttcggacttccccatcagcagggctctggacgggagagcaccgcg

SEQ ID NO: 69147 - DNA, 156 bp, Homo sapiens
  misc_feature 1..156: note = chr1:2571507-2571663
  misc_feature 1..156: note = hypo
  source 1..156: mol_type = genomic DNA
gaccatggaaggaagcggcagagaaggggacagaaatgggacaaatgcaagtgcccaggaggagagagaagccaggagggggggtcgtggccctgtctccccagggtgaagtcaggcagggcttgggggcacgttttgcaccgagtcagctcaccc

SEQ ID NO: 69148 - DNA, 30 bp, Homo sapiens
  misc_feature 1..30: note = chr1:25856663-25856693
  misc_feature 1..30: note = hypo
  source 1..30: mol_type = genomic DNA
atctccaggggcctgcgccatcctgtagcc

SEQ ID NO: 69149 - DNA, 30 bp, Homo sapiens
  misc_feature 1..30: note = chr1:25857535-25857565
  misc_feature 1..30: note = hypo
  source 1..30: mol_type = genomic DNA
ctcctgagtgagggccgggccttgctcggg

SEQ ID NO: 69150 - DNA, 30 bp, Homo sapiens
  misc_feature 1..30: note = chr1:25999651-25999681
  misc_feature 1..30: note = hypo
  source 1..30: mol_type = genomic DNA
gcagcaggatgacagcgctgtctcccgatg

SEQ ID NO: 69151 - DNA, 30 bp, Homo sapiens
  misc_feature 1..30: note = chr1:26222050-26222080
  misc_feature 1..30: note = hyper
  source 1..30: mol_type = genomic DNA
gcagaacacaagtcccgcctcaagggggca

SEQ ID NO: 69152 - DNA, 602 bp, Homo sapiens
  misc_feature 1..602: note = chr1:26249024-26249626
  misc_feature 1..602: note = hyper
  source 1..602: mol_type = genomic DNA
tccagaaaatggcttcgctgcgctccacggatctgctctcccaccccacctgcggcttgcacagcgacacacaagcgttgtgattggctcttccttggctgagacaagggtggggaccgaaatggcgtctctaacagctgatttttcagggcagcagctctgtgctaggagaagagaaggccgggctcactggcggtgcggagcccgccagggccaatccgcatccgggcggaggtgcaagcccgaccgcagtactgacacgtgccgcgacgtcccctcccggcagctcgcggggacctgggagcgggtggggtctctggctggcggggagccagggctgcgggaaaccgcacgaggtcgcgttcgcgagtggcggagaagcccagacccccgggcgcacgcggccgcgcccacccaggtcgctgggaggtgcccgcccgggaggcgccgcggccagtgcctgccgttagcttcaggaagaactaggattgagtaagaaacgactagggatggaagcacttggcactccgggtctcggagcaggctggggacgcccgcggcaggaacctggtcctccactccgggtgcggaccaaagtctgc

SEQ ID NO: 69153 - DNA, 32 bp, Homo sapiens
  misc_feature 1..32: note = chr1:26336891-26336923
  misc_feature 1..32: note = hypo
  source 1..32: mol_type = genomic DNA
ttttattttttgagtcggagtctcgttctgtt

SEQ ID NO: 69154 - DNA, 92 bp, Homo sapiens
  misc_feature 1..92: note = chr1:26337163-26337255
  misc_feature 1..92: note = hypo
  source 1..92: mol_type = genomic DNA
ggcgtgagccaccgtgcccggcagtggcgactttctttgtttggctaaagccttggcgttagcggggatggtgtcagcgaggtaatggtatg

SEQ ID NO: 69155 - DNA, 30 bp, Homo sapiens
  misc_feature 1..30: note = chr1:26372114-26372144
  misc_feature 1..30: note = hyper
  source 1..30: mol_type = genomic DNA
gccccaggccccccgcgggcaggggtcaga

SEQ ID NO: 69156 - DNA, 30 bp, Homo sapiens
  misc_feature 1..30: note = chr1:26372535-26372565
  misc_feature 1..30: note = hyper
  source 1..30: mol_type = genomic DNA
agctcccccggctcccgctgcggctgcagc

SEQ ID NO: 69157 - DNA, 113 bp, Homo sapiens; identical to SEQ ID NO: 26142
  misc_feature 1..113: note = chr1:26372988-26373101
  misc_feature 1..113: note = hyper
  source 1..113: mol_type = genomic DNA

SEQ ID NO: 69158 - DNA, 533 bp, Homo sapiens
  misc_feature 1..533: note = chr1:26551728-26552261
  misc_feature 1..533: note = hyper
  source 1..533: mol_type = genomic DNA
cgcgggcaagacgcccatgccaaccagtgagtgggcagccccgggacctcctgcgcagccgccgcagccttgcctgcaaagcagttcctgccgggcaggctgggtagccggactcccagctgcgccgtcttcacggaagcggtgctgatgcgggacctgggggactgcggtgctggggactggccagtcctaccgggggcggggcttgtggaagactgggcgggattttgaagacctaggtcttgtggatggtgaactcacttggggcggggagggaggtggggctaccctggggtcttgggcaaagtcctcgcctggccggcttcgctacccttgtgcttgcgttgcccacaagcttgtagtcagaagaactcgcctgggagggatcgctcctgggagatccgaacgcgggagggcctggagcgcggcggcagctggatagcattcgggcccatccgaataagcggtaaatggatcatttctggggcctccctgactcctcttccagagcctcctaccgacctgctctgtcc

SEQ ID NO: 69159 - DNA, 36 bp, Homo sapiens
  misc_feature 1..36: note = chr1:26612389-26612425
  misc_feature 1..36: note = hypo
  source 1..36: mol_type = genomic DNA
atgggctcgagggtacgcagccgtgccccgccgggc

SEQ ID NO: 69160 - DNA, 30 bp, Homo sapiens
  misc_feature 1..30: note = chr1:26627535-26627565
  misc_feature 1..30: note = hypo
  source 1..30: mol_type = genomic DNA
gtcaccgctctggggcggagacccagagga

SEQ ID NO: 69161 - DNA, 30 bp, Homo sapiens
  misc_feature 1..30: note = chr1:26648095-26648125
  misc_feature 1..30: note = hyper
  source 1..30: mol_type = genomic DNA
gtttgtgtctgtgcccgcacagcctagggc

SEQ ID NO: 69162 - DNA, 31 bp, Homo sapiens
  misc_feature 1..31: note = chr1:26723047-26723078
  misc_feature 1..31: note = hypo
  source 1..31: mol_type = genomic DNA
atggagacaataggccgggcgcggtggctca

SEQ ID NO: 69163 - DNA, 121 bp, Homo sapiens; identical to SEQ ID NO: 26144
  misc_feature 1..121: note = chr1:26735162-26735283
  misc_feature 1..121: note = hyper
  source 1..121: mol_type = genomic DNA

SEQ ID NO: 69164 - DNA, 342 bp, Homo sapiens
  misc_feature 1..342: note = chr1:26735645-26735987
  misc_feature 1..342: note = hyper
  source 1..342: mol_type = genomic DNA
tcttggagagcaccccgtacgagagaaagggaaataacttctgcagtctcttgctttcctccccatcttccccttccctacccccactcatccggtctctctgaaatacacatgtgcccacatccgcacgtgcacacacacacacacacaaacacacacacagagccacagcgtgagaattccaaaaggttctgcacactcggtggagaagattgaattcagagcaagcggatgcccccgaaagcaggctctgtccctttaaatgggttgtagtggtgggggaggggaactggccggagctggcattgtccagtttgaactgaacaccggaagtgaaggggc

SEQ ID NO: 69165 - DNA, 702 bp, Homo sapiens; identical to SEQ ID NO: 26146
  misc_feature 1..702: note = chr1:26737181-26737883
  misc_feature 1..702: note = hyper
  source 1..702: mol_type = genomic DNA

SEQ ID NO: 69166 - DNA, 417 bp, Homo sapiens; identical to SEQ ID NO: 26147
  misc_feature 1..417: note = chr1:26737907-26738324
  misc_feature 1..417: note = hyper
  source 1..417: mol_type = genomic DNA

SEQ ID NO: 69167 - DNA, 30 bp, Homo sapiens
  misc_feature 1..30: note = chr1:26758265-26758295
  misc_feature 1..30: note = hyper
  source 1..30: mol_type = genomic DNA
atgcgtgccttaagtcggcacaaaatagat

SEQ ID NO: 69168 - DNA, 18 bp, Homo sapiens
  misc_feature 1..18: note = chr1:26879273-26879291
  misc_feature 1..18: note = hypo
  source 1..18: mol_type = genomic DNA
gcccggcttaaattgtga

SEQ ID NO: 69169 - DNA, 43 bp, Homo sapiens; identical to SEQ ID NO: 38900
  misc_feature 1..43: note = chr1:26969603-26969646
  misc_feature 1..43: note = hypo
  source 1..43: mol_type = genomic DNA

SEQ ID NO: 69170 - DNA, 101 bp, Homo sapiens
  misc_feature 1..101: note = chr1:2702371-2702472
  misc_feature 1..101: note = hypo
  source 1..101: mol_type = genomic DNA
ggcagctcctacctgcggcaaagatggccagagacaggtaggcgatggcctccttggtgtgaaccctgccgtcggccccgcctggccgtgcccgcaggatg

SEQ ID NO: 69171 - DNA, 30 bp, Homo sapiens
  misc_feature 1..30: note = chr1:2702696-2702726
  misc_feature 1..30: note = hypo
  source 1..30: mol_type = genomic DNA
tccacctggtgccaacgctcccagtcccac

SEQ ID NO: 69172 - DNA, 28 bp, Homo sapiens
  misc_feature 1..28: note = chr1:2706307-2706335
  misc_feature 1..28: note = hyper
  source 1..28: mol_type = genomic DNA
cgcagcagtccccggccgcacagcgcgc

SEQ ID NO: 69173 - DNA, 159 bp, Homo sapiens
  misc_feature 1..159: note = chr1:2708372-2708531
  misc_feature 1..159: note = hypo
  source 1..159: mol_type = genomic DNA
tctctcctctctttccgagattccagttacacacacgagactttgatattgtccccaggtcacccagcctctgttcatttttcttctgttcttcgtatcgagtaatttctattctgtcttcaagttcaccgacccttctactgtcgctaatattttcat

SEQ ID NO: 69174 - DNA, 90 bp, Homo sapiens
  misc_feature 1..90: note = chr1:27113624-27113714
  misc_feature 1..90: note = hyper
  source 1..90: mol_type = genomic DNA
caagaaatccaccaacggagaaggatttatcatctgtttcctttaaggagggtgcaaagttgttctaacagtttccgttacaagggtaca

SEQ ID NO: 69175 - DNA, 503 bp, Homo sapiens; identical to SEQ ID NO: 38760
  misc_feature 1..503: note = chr1:2716736-2717239
  misc_feature 1..503: note = hypo
  source 1..503: mol_type = genomic DNA

SEQ ID NO: 69176 - DNA, 30 bp, Homo sapiens
  misc_feature 1..30: note = chr1:27183642-27183672
  misc_feature 1..30: note = hypo
  source 1..30: mol_type = genomic DNA
ctgacttccccttcccggatttgtgaggtg

SEQ ID NO: 69177 - DNA, 406 bp, Homo sapiens
  misc_feature 1..406: note = chr1:27189908-27190314
  misc_feature 1..406: note = hypo
  source 1..406: mol_type = genomic DNA
gcaacgaggagggctcggaggagaaggggcccgaggtgcgtgagtaccgggagaaggtggagactgagctccagggcgtgtgcgacaccgtgctgggcctgctggacagccacctcatcaaggaggccggggacgccgagagccgggtcttctacctgaagatgaagggtgactactaccgctacctggccgaggtggccaccggtgacgacaagaagcgcatcattgactcagcccggtcagcctaccaggaggccatggacatcagcaagaaggagatgccgcccaccaaccccatccgcctgggcctggccctgaacttttccgtcttccactacgagatcgccaacagccccgaggaggccatctctctggccaagaccactttcgacgaggccatggctga

SEQ ID NO: 69178 - DNA, 39 bp, Homo sapiens
  misc_feature 1..39: note = chr1:2719879-2719918
  misc_feature 1..39: note = hypo
  source 1..39: mol_type = genomic DNA
acagacaaaagtgggcggctgagccggacagggaggccg

SEQ ID NO: 69179 - DNA, 75 bp, Homo sapiens
  misc_feature 1..75: note = chr1:2725182-2725257
  misc_feature 1..75: note = hypo
  source 1..75: mol_type = genomic DNA
gggacttgtcttcctcggggccacctcctatggcttccctgtcccatcagtaccactgctcgggggactgttctt

SEQ ID NO: 69180 - DNA, 462 bp, Homo sapiens
  misc_feature 1..462: note = chr1:2725529-2725991
  misc_feature 1..462: note = hypo
  source 1..462: mol_type = genomic DNA
aggagctggggctgccggcctcgcaggtgtggttggggtgggtggggctgccgtgggcctggctccatggctctgtgcaggtggcagccggcgccgcgtgtcgccacccacacaggaaaggcgagattggtggcagaggccgtgtccgcgtcatcatgggagctgcagctcttcccttagttccctgcacccacttattgaggggggctggtcctcctgggaaaggacctggcagcatccccgggcgtgggacacatgcctcgcagcagagttgggggacacggggctgtgcccgccctccctgcactagaaccagcagcagcaaacagcccccagctcggccgctgaccatgtcctgctcgggtctcccgggctggccctggcccgcttagcctggactcaggtgcctgtggccggctgctcgtgccttcccatcctggggcaacccggggagtggcagtg

SEQ ID NO: 69181 - DNA, 119 bp, Homo sapiens
  misc_feature 1..119: note = chr1:2726839-2726958
  misc_feature 1..119: note = hypo
  source 1..119: mol_type = genomic DNA
tgctcctggactgaacgctgctaccgtaacttcatcagcaccctccaggcgaggaccacgtgtccagcccctgctgtgcacacgactgagggttgtcggttccccgagctcagctgaac

SEQ ID NO: 69182 - DNA, 70 bp, Homo sapiens
  misc_feature 1..70: note = chr1:27319476-27319546
  misc_feature 1..70: note = hyper
  source 1..70: mol_type = genomic DNA
tgggaggagtaaacacgagccggggcagggaaagaactttgcacaccgtggggtccggggctcctctgtg

SEQ ID NO: 69183 - DNA, 35 bp, Homo sapiens
  misc_feature 1..35: note = chr1:2733564-2733599
  misc_feature 1..35: note = hypo
  source 1..35: mol_type = genomic DNA
caccagcagtgcccacggctgcggcatttactgag

SEQ ID NO: 69184 - DNA, 95 bp, Homo sapiens
  misc_feature 1..95: note = chr1:2733659-2733754
  misc_feature 1..95: note = hypo
  source 1..95: mol_type = genomic DNA
actttggaaacaaaagccatcattctattattttgtttttagtcatggtatttccatttacaaatatagtaactttcgatcgctgcaaaaaacca

SEQ ID NO: 69185 - DNA, 112 bp, Homo sapiens
  misc_feature 1..112: note = chr1:27339342-27339454
  misc_feature 1..112: note = hyper
  source 1..112: mol_type = genomic DNA
cagcccgcggcccagcggactcttataggccgcgggcgacgtgcccattggtccgggccgctgccaacagcgagagccgccccgcctctgaacgctccggacactggtctgt

SEQ ID NO: 69186 - DNA, 30 bp, Homo sapiens
  misc_feature 1..30: note = chr1:27358149-27358179
  misc_feature 1..30: note = hyper
  source 1..30: mol_type = genomic DNA
gggcgcccgctgcagcgacagcagttccca

SEQ ID NO: 69187 - DNA, 18 bp, Homo sapiens
  misc_feature 1..18: note = chr1:27558365-27558383
  misc_feature 1..18: note = hypo
  source 1..18: mol_type = genomic DNA
tgggggttctctggccgg

SEQ ID NO: 69188 - DNA, 187 bp, Homo sapiens
  misc_feature 1..187: note = chr1:27628242-27628429
  misc_feature 1..187: note = hypo
  source 1..187: mol_type = genomic DNA
gctcagtcaggctcccgctaggcattcacacctgcttagacagggccctggtggttccacttgggcatctgagaggcagaagctggtcattgtgtttgttccgagtgtacaagtgcagcagagacaatagcgcagagcagtagaaatgcctcaggcttggaatgtggggcctcggttccaaatgcag

SEQ ID NO: 69189 - DNA, 30 bp, Homo sapiens
  misc_feature 1..30: note = chr1:27675398-27675428
  misc_feature 1..30: note = hypo
  source 1..30: mol_type = genomic DNA
aagcactggtctcaccgctcctgcagctgg

SEQ ID NO: 69190 - skipped

SEQ ID NO: 69191 - DNA, 15 bp, Homo sapiens
  misc_feature 1..15: note = chr1:27684240-27684255
  misc_feature 1..15: note = hyper
  source 1..15: mol_type = genomic DNA
cgctggcagctcctg

SEQ ID NO: 69192 - DNA, 30 bp, Homo sapiens; identical to SEQ ID NO: 38765
  misc_feature 1..30: note = chr1:2770901-2770931
  misc_feature 1..30: note = hypo
  source 1..30: mol_type = genomic DNA

SEQ ID NO: 69193 - DNA, 30 bp, Homo sapiens
  misc_feature 1..30: note = chr1:27710201-27710231
  misc_feature 1..30: note = hypo
  source 1..30: mol_type = genomic DNA
cctgccttcagggctcggtgcaggccccgc

SEQ ID NO: 69194 - DNA, 32 bp, Homo sapiens
  misc_feature 1..32: note = chr1:27719783-27719815
  misc_feature 1..32: note = hypo
  source 1..32: mol_type = genomic DNA
ctggcgggagcttcacgcgcattccctggggg

SEQ ID NO: 69195 - DNA, 30 bp, Homo sapiens
  misc_feature 1..30: note = chr1:2775401-2775431
  misc_feature 1..30: note = hypo
  source 1..30: mol_type = genomic DNA
gaggcccagcggggacgccccagtggccat

SEQ ID NO: 69196 - DNA, 104 bp, Homo sapiens
  misc_feature 1..104: note = chr1:27844518-27844622
  misc_feature 1..104: note = hypo
  source 1..104: mol_type = genomic DNA
ggagagcctggctgtcggggagcagatctgagcacgctcctcaccagccctagctcaggctcggacctctctgacttcctgccttcccacgtgctcttgcctct

SEQ ID NO: 69197 - DNA, 30 bp, Homo sapiens
  misc_feature 1..30: note = chr1:27844988-27845018
  misc_feature 1..30: note = hypo
  source 1..30: mol_type = genomic DNA
acacgatagaattgacgggacccaggaatc

SEQ ID NO: 69198 - DNA, 35 bp, Homo sapiens
  misc_feature 1..35: note = chr1:27868411-27868446
  misc_feature 1..35: note = hypo
  source 1..35: mol_type = genomic DNA
attacaggcgtgagccaccgcgcctggcaaggagg

SEQ ID NO: 69199 - DNA, 244 bp, Homo sapiens
  misc_feature 1..244: note = chr1:27876089-27876333
  misc_feature 1..244: note = hypo
  source 1..244: mol_type = genomic DNA
gaatcgagcagcgagcgaaagtagccggtgaagaggttttggcgctcctggctgagctcggtctggcctgagggtgcacccgtgctgtagtagctgccacggcctgaggctccactctccagcccagtggaggcaaaggcccgggcctcggtcccctgaaacccacagtttcggccagcttgtccgcctgggtgcccatggtgaggggcccagccaccacccttatccccggcccactcagcac

SEQ ID NO: 69200 - DNA, 475 bp, Homo sapiens
  misc_feature 1..475: note = chr1:27960621-27961096
  misc_feature 1..475: note = hyper
  source 1..475: mol_type = genomic DNA
gattccaaaagggggcgaaggcggagagcaaagggggctgcgcccacccggagccccgcggcggcccagcgcggcccgccctctcgttgccttggaggcagcccctgcgggcactcgcggtcaaaggcaggatttccgtcggggcggcagcaattcccggatccagcggggagcgcgggccgagaccgccgcgggcgcggagggggcgcccggagaggcctgtccctgccgagggcggggacttccccaggaagcggggacccacgcctcgcgcgcccggcaggagtcccctgcagcccggaacctaccgcaagggcgggccgagagggtcgcggggccgcggtcgcggccgctaacgttaccctgcgggctgtgggcttcaccccgacttcggccggctcggaagaggggaacttcctggacccgcaattgcaccccaggttctccgtcctccagaagtcgttctcctcaaccc

SEQ ID NO: 69201 - DNA, 30 bp, Homo sapiens
  misc_feature 1..30: note = chr1:28198358-28198388
  misc_feature 1..30: note = hypo
  source 1..30: mol_type = genomic DNA
cctaacgtcatacaacgagcaagaggagac

SEQ ID NO: 69202 - DNA, 688 bp, Homo sapiens
  misc_feature 1..688: note = chr1:28199059-28199747
  misc_feature 1..688: note = hyper
  source 1..688: mol_type = genomic DNA
gagcccagagagccgcggggaccatggagccggtgccgctgcaggacttcgtgcgcgccttggaccccgcctccctcccgcgcgtgctgcgggtctgctcgggggtctacttcgagggtgagcgggggctggaacccctccgagcactcccttggtgtggggcgggggcagagacccggagaagacgttagcaatccggggaaactgcccctgggttcaaatcccgacactgccactggccaagctgtgtgatttggggccgcactcaacctctttggacctcggcttttgctttcgtggaacggggaccgctgacctgccccgcagggtagtgatgaaaagtcagtgggttgaggcgcgggaggtggatgcagccgggccactcctaggtggccccgcggtgcgcatgggacagagctccgaccgcgccgggacgcagcattaggccgctggtggtcgtggctgcgtcttgattctgaagtgcagggtcagtcttcccgtctgtgtcctcccactcctcccccggccctcctctacactgccttccttcagtccctgcgtccaccttggccttctgtttgaccatgggcagtacttgatttgatcagctcttcagttctcagcttaaatggcgcttcctcccggaagccttcctggctctctgctccttgcacgcccccgtacatct

SEQ ID NO: 69203 - DNA, 89 bp, Homo sapiens
  misc_feature 1..89: note = chr1:2823329-2823418
  misc_feature 1..89: note = hypo
  source 1..89: mol_type = genomic DNA
atccacgccatcacacgcctgtccacacccacggaatgcagggtagagagcgagcccggcggtgactctgggcgcggggtaaggcggtg

SEQ ID NO: 69204 - DNA, 52 bp, Homo sapiens
  misc_feature 1..52: note = chr1:2826173-2826225
  misc_feature 1..52: note = hypo
  source 1..52: mol_type = genomic DNA
tgcccacccatggtccgggccctggatcctgcggagccggaagccagctgta

SEQ ID NO: 69205 - DNA, 95 bp, Homo sapiens
  misc_feature 1..95: note = chr1:2827790-2827885
  misc_feature 1..95: note = hypo
  source 1..95: mol_type = genomic DNA
gtctgggcgccaggacgctggaggcgtgggatgatggcgattcgtctcccatcttcaaggccaacacagataggcggtccactgtcccagtggga

SEQ ID NO: 69206 - DNA, 113 bp, Homo sapiens
  misc_feature 1..113: note = chr1:28293291-28293404
  misc_feature 1..113: note = hypo
  source 1..113: mol_type = genomic DNA
tccgagtggctgtaccgggtgacggtggccaccatcctctatttctcctggttcaacgtggctgagggccgcacccgaggccgggccatcatccacttcgccttcctcctgag

SEQ ID NO: 69207 - DNA, 48 bp, Homo sapiens
  misc_feature 1..48: note = chr1:2830003-2830051
  misc_feature 1..48: note = hypo
  source 1..48: mol_type = genomic DNA
ccagcagggacacaacgcagaaaaaatgaccctcggcaatgtcccgtt

SEQ ID NO: 69208 - DNA, 71 bp, Homo sapiens
  misc_feature 1..71: note = chr1:2831835-2831906
  misc_feature 1..71: note = hypo
  source 1..71: mol_type = genomic DNA
aggacagagccttttcgagttcctggcttgacagtgcaggaactgtgccagggtgccggaaggtgatcacc

SEQ ID NO: 69209 - DNA, 161 bp, Homo sapiens; identical to SEQ ID NO: 38769
  misc_feature 1..161: note = chr1:2833818-2833979
  misc_feature 1..161: note = hypo
  source 1..161: mol_type = genomic DNA

SEQ ID NO: 69210 - DNA, 30 bp, Homo sapiens; identical to SEQ ID NO: 38770
  misc_feature 1..30: note = chr1:2836432-2836462
  misc_feature 1..30: note = hypo
  source 1..30: mol_type = genomic DNA

SEQ ID NO: 69211 - DNA, 227 bp, Homo sapiens
  misc_feature 1..227: note = chr1:2840699-2840926
  misc_feature 1..227: note = hypo
  source 1..227: mol_type = genomic DNA
cacaggaggatgagacggacggaagccaccacgcaggaacgaacaagggatgtcccacgatggcggcccctcccccaagcctcccaccagctggcttcgggcggctttgtgagcaggcacccagggccaagacttggggccagatgcagagaacaggccaggcttcccacccagggatgggcccggaggctcaggttctcccctggggtcagcgtcatcctggggca

SEQ ID NO: 69212 - DNA, 30 bp, Homo sapiens; identical to SEQ ID NO: 38772
  misc_feature 1..30: note = chr1:2846793-2846823
  misc_feature 1..30: note = hypo
  source 1..30: mol_type = genomic DNA

SEQ ID NO: 69213 - DNA, 30 bp, Homo sapiens
  misc_feature 1..30: note = chr1:2850995-2851025
  misc_feature 1..30: note = hypo
  source 1..30: mol_type = genomic DNA
acgtggaaggcagggcgccctgtggggtga

SEQ ID NO: 69214 - DNA, 129 bp, Homo sapiens
  misc_feature 1..129: note = chr1:2859680-2859809
  misc_feature 1..129: note = hypo
  source 1..129: mol_type = genomic DNA
cggcttgccagggctcgtggtgtttgccgcatcctctccagcccatctaacccttacgatgcaatgtggcatctcttggctggtgctgggctgggcttctgggcaaagaccacccgctacacaggcacc

SEQ ID NO: 69215 - DNA, 153 bp, Homo sapiens
  misc_feature 1..153: note = chr1:2866038-2866191
  misc_feature 1..153: note = hypo
  source 1..153: mol_type = genomic DNA
ggtgtgacagctgcacgctacatgtttgaaagcagcaacaaggctgtctttgtacggcaggggtggtgctggcagctctgtggcggtgccgggctgcagagtacggcaggggtggtgctggcagctctgtggcggtgccgggctgctgggtac

SEQ ID NO: 69216 - DNA, 89 bp, Homo sapiens
  misc_feature 1..89: note = chr1:28853681-28853770
  misc_feature 1..89: note = hypo
  source 1..89: mol_type = genomic DNA
atggcactcacatgccgggcaactgatgctcagagtaaccttcccacagcagccgcgatcttcagtgcatgtgtgtttttgtttttttg

SEQ ID NO: 69217 - DNA, 74 bp, Homo sapiens
  misc_feature 1..74: note = chr1:28865161-28865235
  misc_feature 1..74: note = hypo
  source 1..74: mol_type = genomic DNA
gttgcttgtgtacatcgtacccatccattcggcttcacctgcagccaacggcctggaatcgcaaagagacacca

SEQ ID NO: 69218 - DNA, 171 bp, Homo sapiens
  misc_feature 1..171: note = chr1:2888921-2889092
  misc_feature 1..171: note = hypo
  source 1..171: mol_type = genomic DNA
tggcccccactgcaccgccacaggctcctgcccacatgggtccccctcagaagtccccgtcagcatcttatcctttggaagcctggaaattaaggctgcccgcaaagccccagggtcccaggctcgctgggccccaagagactcggggtctgggaccgacattcataggaa

SEQ ID NO: 69219 - DNA, 246 bp, Homo sapiens
  misc_feature 1..246: note = chr1:28919075-28919321
  misc_feature 1..246: note = hyper
  source 1..246: mol_type = genomic DNA
cggcggtgggcaagacgtcgctgctgcggagctacgtggcaggcgcgcctggcgccccggagccggagcccgagcccgagcccacggtgggcgccgagtgctaccgccgcgcgctgcagctgcgggccgggccgcgggtcaagctgcaactctgggacaccgcgggccacgagcgcttcaggtgcgggtagccggggcgcgggagggacttctggtggggggctcggtgagcgtgctttaggccac

SEQ ID NO: 69220 - DNA, 23 bp, Homo sapiens
  misc_feature 1..23: note = chr1:28926140-28926163
  misc_feature 1..23: note = hypo
  source 1..23: mol_type = genomic DNA
atggcacgcgcctgtggtgccac

SEQ ID NO: 69221 - DNA, 41 bp, Homo sapiens
  misc_feature 1..41: note = chr1:2896547-2896588
  misc_feature 1..41: note = hypo
  source 1..41: mol_type = genomic DNA
ctgtcccagcctcagcgcgtctttcccgggtggacctggcg

SEQ ID NO: 69222 - DNA, 18 bp, Homo sapiens
  misc_feature 1..18: note = chr1:29047659-29047677
  misc_feature 1..18: note = hypo
  source 1..18: mol_type = genomic DNA
tttttttttgtgaggcgg

SEQ ID NO: 69223 - DNA, 23 bp, Homo sapiens
  misc_feature 1..23: note = chr1:29061371-29061394
  misc_feature 1..23: note = hypo
  source 1..23: mol_type = genomic DNA
accgcacccggcttttttttttt

SEQ ID NO: 69224 - DNA, 39 bp, Homo sapiens
  misc_feature 1..39: note = chr1:29074244-29074283
  misc_feature 1..39: note = hypo
  source 1..39: mol_type = genomic DNA
taagtgagtatcctagttctcagccggtgagcaaaccac

SEQ ID NO: 69225 - DNA, 616 bp, Homo sapiens
  misc_feature 1..616: note = chr1:29138528-29139144
  misc_feature 1..616: note = hyper
  source 1..616: mol_type = genomic DNA
tccctagggagggggcgggaggcctcccctgcccagctccgagccggtggtgcagcgtccgcccccggtcgcgggcgcagactggcggccgcctccgggccacgtggtgcgcgcggcgggcgcgtccgaggagcctgcggctgctcctggctcacagcgctccgggcgaggagagcgggcggacgccgggggctgggccggtgcgggcggcgaggcaggcggacgaggcgcagagacagcggggcggccggggcgcggcagccggcggcgtcggggccgcggcctctgccttgccgctcccctcgcgtcggatccccgcgcccagggcgcacggtggagagggacgcggcggagccggccggcagccatggaaccggccccctccgccggcgccgagctgcagcccccgctcttcgccaacgcctcggacgcctaccctagcgcctgccccagcgctggcgccaatgcgtcggggccgccaggcgcgcggagcgcctcgtccctcgccctggcaatcgccatcaccgcgctctactcggccgtgtgcgccgtggggctgctgggcaacgtgcttgtcatgttcggcatcgtccggtgagtccgctgcgggccggcg

SEQ ID NO: 69226 - DNA, 448 bp, Homo sapiens
  misc_feature 1..448: note = chr1:2918274-2918722
  misc_feature 1..448: note = hypo
  source 1..448: mol_type = genomic DNA
ctagttctgcgaccccggtggaaatgtacccttctggcagccacagagtcacagggtgagggcggcaaacccatgttcccacagtaagccacgtggaacgacgacgaggggaccccctatgtgtccactccgtagctcccagatccatgcattctgcctgtcatggacacggcaccgtgtcatcgtcactggctcaagaaatagcctgcaaactaaaggacagcgcccaccttctcggacgtccacattctcggacgcccacattctcggacgcccacattctcgggggcgcccacattctcggacgcccacactctcggacgcccacactctcgggcgcccacactctcgggcacccacactctcgggcgcccacactcttggacgtccacactcttggatgcccacactctcgggcgcccacactctcgggcgcccacactcttgg

SEQ ID NO: 69227 - DNA, 129 bp, Homo sapiens
  misc_feature 1..129: note = chr1:2919035-2919164
  misc_feature 1..129: note = hypo
  source 1..129: mol_type = genomic DNA
ccctgtcctctccagcgtggagtggttctttgtaaccggcttgccaccaaagggctggttggtgtctttgagggacgatgtcaggacttgagctgcggtcagtttctgatacagcggtgacagtgatca

SEQ ID NO: 69228 - DNA, 30 bp, Homo sapiens
  misc_feature 1..30: note = chr1:29205490-29205520
  misc_feature 1..30: note = hypo
  source 1..30: mol_type = genomic DNA
ttcatattacaggcacgcacatgcatgcac

SEQ ID NO: 69229 - DNA, 30 bp, Homo sapiens; identical to SEQ ID NO: 38775
  misc_feature 1..30: note = chr1:2939161-2939191
  misc_feature 1..30: note = hypo
  source 1..30: mol_type = genomic DNA

SEQ ID NO: 69230 - DNA, 395 bp, Homo sapiens
  misc_feature 1..395: note = chr1:29448515-29448910
  misc_feature 1..395: note = hyper
  source 1..395: mol_type = genomic DNA
aggcggggagccgcccgcgctcgggttttccgcagcggagctccgagccaggcacgcgcggcagaagccggagttggcccggccagcgggcggagaggagggaggggggcgcaggctgttccctggcgcatcccgggctgcaaatctgccgcctgcgtccggtccgcaagcccgcgggtcttgggcctcgggaaacgtgcggcccccagctgccgcgtctccagggtaagtacctcccgggctcgaccccacccccgcacgtggctgcaccgtagcaaatggggcgggggcgctcgggcctcccaggtccgcaggggtcgctcgccgggccccacctcccccctactgtgctttacataccgcagcgcgggaggagggggcgtcaccggctccag

SEQ ID NO: 69231 - DNA, 139 bp, Homo sapiens
  misc_feature 1..139: note = chr1:29449756-29449895
  misc_feature 1..139: note = hyper
  source 1..139: mol_type = genomic DNA
cacagattgcaactacggcccagggaggccggggagactgcccgaccccgcactaggcgggggctctgccaggtccgacgccgggctccggggccccagccctagacccctctcaggacagccacgggagtatccagga

SEQ ID NO: 69232 - DNA, 333 bp, Homo sapiens
  misc_feature 1..333: note = chr1:29450241-29450574
  misc_feature 1..333: note = hyper
  source 1..333: mol_type = genomic DNA
ggggaacgggagggccgcgctcccgcccccaggggccctgaccgagggagggagggagggagggagggaccaaacgaaaagttgggaaaagtggagtgcggacccctggaccccagctcggctcacctggcgccgcagcgccgcgcgggtccgggtcccagtccgcgcgcggaggctccagagccgcccgggtctccacggcccggccccagccccgccccggccccgcctccagcccccgggaccgtccgacccgcgccgggcccggccccaccgccgctgaaaggcggcagctcaggtcaaaggatcgcaggtaggcgccctgtgcgcgcc

SEQ ID NO: 69233 - DNA, 223 bp, Homo sapiens
  misc_feature 1..223: note = chr1:29462383-29462606
  misc_feature 1..223: note = hypo
  source 1..223: mol_type = genomic DNA
ctctgatcactgaggcgaaaccccctgcctgaagtgcttgttcaacatgcttctgcaacatcacttggtcctcgaaaatttctggtttgggagaactgccaacgatgcccctagagacctttcaaacctctttgctaattcctcttgccaagagatgcttgagaggaaaaattaacatgaataaaagatcattgaaagaatctacaggccgggcgcggtggct

SEQ ID NO: 69234 - DNA, 32 bp, Homo sapiens
  misc_feature 1..32: note = chr1:29463290-29463322
  misc_feature 1..32: note = hypo
  source 1..32: mol_type = genomic DNA
ggtgtaacgcgataccgcggggttgtcctaat

SEQ ID NO: 69235 - DNA, 42 bp, Homo sapiens
  misc_feature 1..42: note = chr1:29463615-29463657
  misc_feature 1..42: note = hypo
  source 1..42: mol_type = genomic DNA
ttgaatgttcagggccgggcgtggtggctcacgcctgtaatc

SEQ ID NO: 69236 - DNA, 45 bp, Homo sapiens
  misc_feature 1..45: note = chr1:29516592-29516637
  misc_feature 1..45: note = hypo
  source 1..45: mol_type = genomic DNA
gtacatagtcaaggccgggcgcggtggctcacgcctgtaatccca

SEQ ID NO: 69237 - DNA, 36 bp, Homo sapiens
  misc_feature 1..36: note = chr1:29564766-29564802
  misc_feature 1..36: note = hyper
  source 1..36: mol_type = genomic DNA
tgtcggatgtgtgtgcgtgcgcgtgttccacatccc

SEQ ID NO: 69238 - DNA, 863 bp, Homo sapiens
  misc_feature 1..863: note = chr1:29586000-29586863
  misc_feature 1..863: note = hyper
  source 1..863: mol_type = genomic DNA
caacgcgggccagaacgcgtcgttccagtgcatggccgcgggcagagcggccgaggccgaacgcttcctcttgcaagtgagcgggagcggtgatcttggctgggggcggggtgggagggggttggtggctgcttctggccctgactccccccagattgctgagtccctgcttcatactccagcactgcgcacagcgtcccggccctcccctagctctgctctgcgctttcttgggtcccccattcccccaggttagagcgcggctccaggaacctatgtccgcgcggtgtagtagggacggctaaatggggcccgggtcagagcgagatcgggacccctcgctccgaggcgcccctgaccccctcactctcttccctgcagcggcagagcggggcgctggtgccggcggcgggcgtgcggcacatcagccaccggcgcttcctggccactttcccgctggctgccgtgagccgcgccgagcaggacctgtaccgctgtgtgtcccaggccccgcgcggcgcgggcgtctctaacttcgcggagctcatcgtcaagggtcagctggtggacgccggggagcgccgggacctcaccctcgaggggcggggccggcgacgggggcgggctctgcccgggggcgtggccgtggggggtggggccggcagggtgtcgctggggcgctatctgaagatgggcctgtggaaatggcagtggcccagccgggatgagatctgatctaggggtcggggctggcttcgagggggacggacagggtcaaggtgagagcctaaagaggggtggggttctggctgtgtgacttctgtgttgatcctagctggcctgcggtccgctccaggaggcga

SEQ ID NO: 69239 - DNA, 38 bp, Homo sapiens
  misc_feature 1..38: note = chr1:29785074-29785112
  misc_feature 1..38: note = hypo
  source 1..38: mol_type = genomic DNA
atctaatctttgtgacgtctgtacgagacacctagtat

SEQ ID NO: 69240 - DNA, 616 bp, Homo sapiens
  misc_feature 1..616: note = chr1:29804767-29805383
  misc_feature 1..616: note = hyper
  source 1..616: mol_type = genomic DNA
gtgtccatcgcagtccgccggccccctcccagcgtctctcgaccccttccccccttccctgtactccagccgcggctgattcctgctgtctgggtggggtccctgtaaggctcaggcggctgactggggaggcgatcccaggaggcacagtggggaggggatagcagggcggaaagaggctgaatcacaaggaggcgggggcggcggctcggtcccagggccatctcagggaccgtgtcggggggtgctgactctgcccatcaaggggagccggacatttatccgccaaagcccgtccctcgcggtgagggtcgctcctgggtgtgggacccctggcttcccgcgctgccctgcccggggctggtctcgtcccaggaccctggagagcggccccaggaggcgtggaggaggggagagagccgagggaagtggtcatggagcaggtgaacgcacaggggcttcggctggagcgccctcctgggaagagcccctcctctgcaaggacctgccgcagcttaaccagcctgcgctgctgtcgccagcgccagttttaaatagccaaaccctactcacttcatccagcaacgcacccccaacttcacgctaaatgcataat

SEQ ID NO: 69241 - DNA, 246 bp, Homo sapiens
  misc_feature 1..246: note = chr1:2984623-2984869
  misc_feature 1..246: note = hyper
  source 1..246: mol_type = genomic DNA
gaggaagcgtctggtcggctcccgtccgagctgctccacctgcgccgctggcctttccgcccgctacgcacctgggccccgagaggccagaggggagtgtccccagtggcccgggtccccgaaggtggcccagctcgggcgctcgcgcagccgggtactcaccttgggggcgcggcggcaggagagcgcgggcggagaggtgcgggcgccctgggacgaccagccgaggacgcctggtgtttggac

SEQ ID NO: 69242 - DNA, 582 bp, Homo sapiens
  misc_feature 1..582: note = chr1:2984870-2985452
  misc_feature 1..582: note = hyper
  source 1..582: mol_type = genomic DNA
gctgcccccgcgctgtccccccgtgcgaggcgtgttggcctccgtggcctcgcgagggaccgagggcggcgggtccgagtgccgcccgccggcctgggcagtggcggagcgcggagctggcggcgcctccgctgttgtttttgagccgcgaagcccgaagcagcagccgttgggtgggggcgaaggggaggaggcgggggccgggaggcgcgaggggggcggtggggcccggagggggcttcggaggagccgggttctggcgcgcgagccccgacgccccctccagcgatcgcagggcggggacgggggccgaggggagaatgcaggagaaaagcgggccggggcgacggggaacgcaaagcttttaaattagtaatcaaacgcagtaaaacggagcaaaaccagcccggactcgcgtccgaactatcggcgcgtgtgccccgagatccaaggaagtcgtgtggaaaaccgcagccgccgccccatcttcggccccggctggggcgggagcagcagcgcgacgcgccgcgacgcaggggcagggtggggggatagtcacctcgcctccggggccacctgggt

SEQ ID NO: 69243 - DNA, 43 bp, Homo sapiens
  misc_feature 1..43: note = chr1:2986039-2986082
  misc_feature 1..43: note = hyper
  source 1..43: mol_type = genomic DNA
cgcggaggctcggggcgcccgggccgcgcgctccccgaaggcg

SEQ ID NO: 69244 - DNA, 441 bp, Homo sapiens
  misc_feature 1..441: note = chr1:2986346-2986787
  misc_feature 1..441: note = hyper
  source 1..441: mol_type = genomic DNA
gagcaccgcctttggcgtccgccagccgggcgcagaggagggagaccccgagccggggaggggcggaggagggggcgcgggccggcgcccacccggctccgcgggcgcaggggcaggggtggcgacggcgggacagccgcagccacttggggagcaaaatggagacttttgcccgggctgggaactgtggtcgtgaagtttatccccggctgtgccccgcgtggtggagggcgctcctctgggacgccggcagcctgcgcgggccgccggggcgacagtgcctccgacaggagggacccacccggccacctcccgacccgccgctgccgccctcgggcccgcgtggacccctctgtacccgcttgcctggcacagccgggcccggcggggacagagctgccccggccaggctgcccggtcctcggtcttactttctctttc

SEQ ID NO: 69245 - DNA, 507 bp, Homo sapiens
  misc_feature 1..507: note = chr1:2987055-2987562
  misc_feature 1..507: note = hyper
  source 1..507: mol_type = genomic DNA
cggaatcggcgccgcctgctcccgccgccccctcctctgcaggccgcccgcccgcccacccgcagaagaggcgcccgggccgctcccctcgaggtccccgcccgacccacgccgttccgtccgcgcctccggggccgggtccctccaggccggcctcgcagctcccggggccgagcccccaaacgtgagccgggtgcgcgcgggactcgcggcggttttccgaagctccgctccctcggctcggggcccgcccggctcgtcccaacagctgccccgcggccgtaggccccgcgctctgtgcaccagggaaaagcagctcccgagtttgtgccggacgctcctgcgccccgccatcggccgttcccggcccctgggtgaggcgcccccttcccgccgcgctccgctgccgggtgccctcggcctcggcctcccgtgacctctgacccctcttggtgcgaacaagaccgggcgtttcgccgccgacgcgaaggggctgtctgtgcgcgg

SEQ ID NO: 69246 - DNA, 43 bp, Homo sapiens
  misc_feature 1..43: note = chr1:2999363-2999406
  misc_feature 1..43: note = hypo
  source 1..43: mol_type = genomic DNA
ggcctgggggacaggcgagattggaaagcgatggggccggcgc

SEQ ID NO: 69247 - DNA, 41 bp, Homo sapiens
  misc_feature 1..41: note = chr1:2999823-2999864
  misc_feature 1..41: note = hypo
  source 1..41: mol_type = genomic DNA
caagcagcaacctggcggctgggccccggaactgcacatcc

SEQ ID NO: 69248 - DNA, 30 bp, Homo sapiens
  misc_feature 1..30: note = chr1:3008545-3008575
  misc_feature 1..30: note = hypo
  source 1..30: mol_type = genomic DNA
gcgttagccccaggacggcttcatggggag

SEQ ID NO: 69249 - DNA, 69 bp, Homo sapiens
  misc_feature 1..69: note = chr1:3015467-3015536
  misc_feature 1..69: note = hypo
  source 1..69: mol_type = genomic DNA
tccccaccaaggacccggcaaatgctgcttctcagtgcccgttgagtggctgagcggcctcactgagga

SEQ ID NO: 69250 - DNA, 83 bp, Homo sapiens
  misc_feature 1..83: note = chr1:3032896-3032979
  misc_feature 1..83: note = hypo
  source 1..83: mol_type = genomic DNA
ccacagtgtgagaaccgagagccagggccaatgacgggggggacgcgggttcacgggtggcctggagacgtggcaccgtacct

SEQ ID NO: 69251 - DNA, 141 bp, Homo sapiens; identical to SEQ ID NO: 38777
  misc_feature 1..141: note = chr1:3035035-3035176
  misc_feature 1..141: note = hypo
  source 1..141: mol_type = genomic DNA

SEQ ID NO: 69252 - DNA, 188 bp, Homo sapiens; identical to SEQ ID NO: 38915
  misc_feature 1..188: note = chr1:30351554-30351742
  misc_feature 1..188: note = hypo
  source 1..188: mol_type = genomic DNA

SEQ ID NO: 69253 - DNA, 153 bp, Homo sapiens
  misc_feature 1..153: note = chr1:3051442-3051595
  misc_feature 1..153: note = hypo
  source 1..153: mol_type = genomic DNA
cacctcctgagagcccggcgaggggatcgggccgggtattagccggggattagacggccgagctgctggcctggtaggggagctgccggggagctgccggccacccgcaggctgggcctgggaggccctcctggtccgcgtgctgctgccccc

SEQ ID NO: 69254 - DNA, 30 bp, Homo sapiens
  misc_feature 1..30: note = chr1:3052897-3052927
  misc_feature 1..30: note = hypo
  source 1..30: mol_type = genomic DNA
ggggacctctggtgtcgtccattttacaga

SEQ ID NO: 69255 - DNA, 215 bp, Homo sapiens
  misc_feature 1..215: note = chr1:30558965-30559180
  misc_feature 1..215: note = hyper
  source 1..215: mol_type = genomic DNA
gcgccaccttcaggccgcggccgggagcggtgccggtgcggggcgccccaccaggaggaggtggcggaggtcccgggggccgccccgcctcgcagcctgggctctgcctgctctgcgtccacgccagcataagccccagccggctccgtctcccctaacgactctaattaccagccaagctcggctccccaaggcccaggcgccagaactgatga

SEQ ID NO: 69256 - DNA, 30 bp, Homo sapiens; identical to SEQ ID NO: 38778
  misc_feature 1..30: note = chr1:3063272-3063302
  misc_feature 1..30: note = hypo
  source 1..30: mol_type = genomic DNA

SEQ ID NO: 69257 - DNA, 30 bp, Homo sapiens; identical to SEQ ID NO: 38779
  misc_feature 1..30: note = chr1:3070343-3070373
  misc_feature 1..30: note = hypo
  source 1..30: mol_type = genomic DNA

SEQ ID NO: 69258 - DNA, 45 bp, Homo sapiens
  misc_feature 1..45: note = chr1:30723094-30723139
  misc_feature 1..45: note = hypo
  source 1..45: mol_type = genomic DNA
aatagcaggagccaccgctcattgactggacgccctgtgctggga

SEQ ID NO: 69259 - DNA, 155 bp, Homo sapiens
  misc_feature 1..155: note = chr1:3078686-3078841
  misc_feature 1..155: note = hypo
  source 1..155: mol_type = genomic DNA
gtcattttaaccacccgtgagcgtggcattaggtggcgttcaatatgcccgggccactgcggaaccatcacccctctctgtgcccaggattttcccgtcaccccccaggaaaaccccgtgcccggtaaatagtgactctgcgtccctcctcccga

SEQ ID NO: 69260 - DNA, 34 bp, Homo sapiens
  misc_feature 1..34: note = chr1:3080320-3080354
  misc_feature 1..34: note = hypo
  source 1..34: mol_type = genomic DNA
tgtcatattctaccccgtgcgtgttcacgtccag

SEQ ID NO: 69261 - skipped

SEQ ID NO: 69262 - DNA, 388 bp, Homo sapiens; identical to SEQ ID NO: 26157
  misc_feature 1..388: note = chr1:30815454-30815842
  misc_feature 1..388: note = hyper
  source 1..388: mol_type = genomic DNA

SEQ ID NO: 69263 - DNA, 122 bp, Homo sapiens
  misc_feature 1..122: note = chr1:3087601-3087723
  misc_feature 1..122: note = hyper
  source 1..122: mol_type = genomic DNA
gcacccctgtcccagcgggaccccgcacccctcagcgccccacggagacctgcaccttccagactgacagtgctcggggccctctctccctcttgcgatttttatttcggggccacgtttgt

SEQ ID NO: 69264 - DNA, 54 bp, Homo sapiens
  misc_feature 1..54: note = chr1:3089947-3090001
  misc_feature 1..54: note = hypo
  source 1..54: mol_type = genomic DNA
gctctgaaatgggaacgctgctgtccccggagcattgcacggataaataatcgt

SEQ ID NO: 69265 - DNA, 241 bp, Homo sapiens
  misc_feature 1..241: note = chr1:3102576-3102817
  misc_feature 1..241: note = hypo
  source 1..241: mol_type = genomic DNA
gcccctgagcaccctcggtgcccattgatgcccgagtccccggcgctccctgagctgtacacactgggtggggcacgtgctgcagaggttgacgctgcgttgtctcctttaggtgacggtgacgttgtaaataatatgtatgagcccaaccgggacctgctggccagccacagcgcggaggacgaggccgaggacagtgccatgtcgcccatccccgtggggccaccgtcccccttcccca

SEQ ID NO: 69266 - DNA, 226 bp, Homo sapiens
  misc_feature 1..226: note = chr1:3111237-3111463
  misc_feature 1..226: note = hypo
  source 1..226: mol_type = genomic DNA
cgtctgatcgccacacgccatcgtctccccgccacacgccaccgtctccccgccacacgccaccgtctgatcgccacacattagggcttggtattctcagtcccacgttttatcatctaaacgccaaaactcgttcctggcctgccctttctctccaaggttcccagatgcacgctccactgcccacaccacccccacggttgagtgggctcggccccgggacgtg

SEQ ID NO: 69267 - DNA, 232 bp, Homo sapiens
  misc_feature 1..232: note = chr1:31157994-31158226
  misc_feature 1..232: note = hyper
  source 1..232: mol_type = genomic DNA
cagtgggaacaaggacgaccgtcgaggaacccgacaaatgaattaaaccagcaccagcgtgatgagcaaagcggagaaggaaagagggcgctgtgaggagagcgaggctcctccgggaaagctccttctgctccaggtgacagcggagagagatgccaccgcgcggcgaccggcagggccgcgtcccctctgcgtcctagcacagcgacgccccgcccgccacccgccctac

SEQ ID NO: 69268 - DNA, 181 bp, Homo sapiens
  misc_feature 1..181: note = chr1:31208071-31208252
  misc_feature 1..181: note = hypo
  source 1..181: mol_type = genomic DNA
atcaatctgtagcaccgccacacgcacttgaacatgtagacctggaaaaaggcccaggtcaggctgtgctttgctgagcgtccttctcacgctccagcaggcctaggacatatgccaggcaggagccaccactctctccagaagccagcatccagctgctcctgctcggacctctcattct

SEQ ID NO: 69269 - DNA, 33 bp, Homo sapiens
  misc_feature 1..33: note = chr1:31249862-31249895
  misc_feature 1..33: note = hypo
  source 1..33: mol_type = genomic DNA
aactctgctcttgcccgccgcatgccagcattt

SEQ ID NO: 69270 - DNA, 32 bp, Homo sapiens
  misc_feature 1..32: note = chr1:3128445-3128477
  misc_feature 1..32: note = hypo
  source 1..32: mol_type = genomic DNA
gagcgggtgtgtatccgcggctgctccattct

SEQ ID NO: 69271 - DNA, 157 bp, Homo sapiens
  misc_feature 1..157: note = chr1:3129210-3129367
  misc_feature 1..157: note = hypo
  source 1..157: mol_type = genomic DNA
tcgctgcggtcctcccgctcatcctcccggccccctcgctgcggtcctctctgccactgtggatgggcttcacacaaactgagatggggaggccccatcctcttggttcccaccagcacctgcatttccgccgctacctcggcgtggctctgcctgc

SEQ ID NO: 69272 - DNA, 30 bp, Homo sapiens
  misc_feature 1..30: note = chr1:31439991-31440021
  misc_feature 1..30: note = hypo
  source 1..30: mol_type = genomic DNA
gtccactcagatgtgcgctcacctgcttgt

SEQ ID NO: 69273 - DNA, 35 bp, Homo sapiens
  misc_feature 1..35: note = chr1:3147215-3147250
  misc_feature 1..35: note = hypo
  source 1..35: mol_type = genomic DNA
ctgagaaggcagctccgacgcggccccggttgggg

SEQ ID NO: 69274 - DNA, 52 bp, Homo sapiens
  misc_feature 1..52: note = chr1:31481385-31481437
  misc_feature 1..52: note = hypo
  source 1..52: mol_type = genomic DNA
aatgggaaagagccccgatcgagggtagcattagggtcgggaagcactaaac

SEQ ID NO: 69275 - DNA, 30 bp, Homo sapiens
  misc_feature 1..30: note = chr1:3149618-3149648
  misc_feature 1..30: note = hypo
  source 1..30: mol_type = genomic DNA
atgtttgtatagaaccgatcattgatcctg

SEQ ID NO: 69276 - DNA, 18 bp, Homo sapiens
  misc_feature 1..18: note = chr1:31498805-31498823
  misc_feature 1..18: note = hypo
  source 1..18: mol_type = genomic DNA
aagcttatcttccaccgg

SEQ ID NO: 69277 - DNA, 48 bp, Homo sapiens
  misc_feature 1..48: note = chr1:31712619-31712667
  misc_feature 1..48: note = hyper
  source 1..48: mol_type = genomic DNA
gcctcctttgtctagcgggccgtccgtcaggcgcgcctcctgccccgg

SEQ ID NO: 69278 - DNA, 30 bp, Homo sapiens; identical to SEQ ID NO: 38784
  misc_feature 1..30: note = chr1:3179577-3179607
  misc_feature 1..30: note = hypo
  source 1..30: mol_type = genomic DNA

SEQ ID NO: 69279 - DNA, 30 bp, Homo sapiens
  misc_feature 1..30: note = chr1:3182769-3182799
  misc_feature 1..30: note = hypo
  source 1..30: mol_type = genomic DNA
tgggattttgtgcaacgctggccctctgac

SEQ ID NO: 69280 - DNA, 90 bp, Homo sapiens
  misc_feature 1..90: note = chr1:3183016-3183106
  misc_feature 1..90: note = hypo
  source 1..90: mol_type = genomic DNA
gagactggggaggaccgagcggttcgcatttgcaaagctcttaatcagtgaactgcgttggaggcattgctgctccgctcctccgacgag

SEQ ID NO: 69281 - DNA, 18 bp, Homo sapiens
  misc_feature 1..18: note = chr1:3183533-3183551
  misc_feature 1..18: note = hypo
  source 1..18: mol_type = genomic DNA
gcccggccacgtgcattt

SEQ ID NO: 69282 - DNA, 30 bp, Homo sapiens
  misc_feature 1..30: note = chr1:31846047-31846077
  misc_feature 1..30: note = hyper
  source 1..30: mol_type = genomic DNA
catcccccaacccaccgaggtgggtgggga

SEQ ID NO: 69283 - DNA, 72 bp, Homo sapiens
  misc_feature 1..72: note = chr1:3184625-3184697
  misc_feature 1..72: note = hypo
  source 1..72: mol_type = genomic DNA
tcaaaccatgacccccgaatctaacagggtgcccgtttgcacacacgtgggagcgtacggtgagcaggtcct

SEQ ID NO: 69284 - DNA, 356 bp, Homo sapiens
  misc_feature 1..356: note = chr1:31846296-31846652
  misc_feature 1..356: note = hyper
  source 1..356: mol_type = genomic DNA
actagaaaagcaaaacgcccttgggctggtgcccacgccggggaaagctctggttgacttctggcacgggcatctgtcctcgttttacaagtgaggagtccgaggctcacaggggaactgacaaggtctcaagaaataggagggggtgaatggagctcagattgcaagcttagtctagcgggcttcagagctcgcgctctcccttcactctcactgcctggtggcggagacagtcaccagcggctcggtctgcggctgagctgaccttgtcctctgcctgttttgagcaaaagcctgacccttcgcgccccgcccgcctcacacgtgcttgcccctccctgcggaatgtctcctgc

SEQ ID NO: 69285 - DNA, 30 bp, Homo sapiens
  misc_feature 1..30: note = chr1:31863025-31863055
  misc_feature 1..30: note = hypo
  source 1..30: mol_type = genomic DNA
ggaaacctgctctgccggtgtgtgttctgg

SEQ ID NO: 69286 - DNA, 30 bp, Homo sapiens
  misc_feature 1..30: note = chr1:32098396-32098426
  misc_feature 1..30: note = hypo
  source 1..30: mol_type = genomic DNA
catcaagcgttgcaccgtcctcctactctg

SEQ ID NO: 69287 - DNA, 112 bp, Homo sapiens
  misc_feature 1..112: note = chr1:3213652-3213764
  misc_feature 1..112: note = hypo
  source 1..112: mol_type = genomic DNA
gcagatctcagacctcgtggggtgtaggagccctaaggggagcggtcagcccttgtcctctgtccgctttctgcccagtggcccctccaggtcccggcgtctccttggactc

SEQ ID NO: 69288 - DNA, 178 bp, Homo sapiens
  misc_feature 1..178: note = chr1:3217150-3217328
  misc_feature 1..178: note = hypo
  source 1..178: mol_type = genomic DNA
cgttccctggagcctcggaaccgcggtgcaactggggtgcgtttgtgccagggaaaatggattctgccggtgtctgactctaccaagatccacgcatcattgttagcatttcctttcatttctctttgttattatttgtcttttccaccttgtaccatccccccgaaccccatttatg

SEQ ID NO: 69289 - DNA, 433 bp, Homo sapiens
  misc_feature 1..433: note = chr1:32179994-32180427
  misc_feature 1..433: note = hyper
  source 1..433: mol_type = genomic DNA
tgtttgctccagaaccgctaatatccaggtcgggactttgtgttgctgcgagcccaggtccccaccctgaagtctaggacagacccatgagcttgggtgggagagaagagcaatgcagacgtgactgtcctgccaggcgggggcgccgccgccagacgcacgaaaacaaccaaataaatcaggcccaggaactcctaatccttcccggctgtggctgctaccgcttgccccgccggcaccgccctgccaagggcgcagagtcgggccagcagagccggagtgatgccgggccatcgaggcgtcctcagcccccgaggtgggaggtggtgggggggcggggaggagaagaagaaggctctcccgacacggtgactcaggcctccttgacccgctcctgggtgggcacgttcctgcgccccggtctatttttaga

SEQ ID NO: 69290 - DNA, 133 bp, Homo sapiens; identical to SEQ ID NO: 26162
  misc_feature 1..133: note = chr1:32180688-32180821
  misc_feature 1..133: note = hyper
  source 1..133: mol_type = genomic DNA

SEQ ID NO: 69291 - DNA, 589 bp, Homo sapiens
  misc_feature 1..589: note = chr1:32180905-32181494
  misc_feature 1..589: note = hyper
  source 1..589: mol_type = genomic DNA
cgccctaggccctgcctcctatctggctccgcccagccctggccaaccttagaacctgtcccaaggtccagagaggcctagatgaggggtagcctgcctctgagaggcatggagccctcctcccgcgtggggtcagggaatagaagggcgtcgagggtggcgggtgagggaacgttcctggcgccgcgaacgggaagcctccaggctgcaggacgtagctgcggggacccggcagtctgcgaggctggagtggccgaggccgccccgagcatagaaacagccctgtatacgtgggcacagaaaggcccagggaggcgcctgggcagaagtgtctaggacgatgcctctgccacggagccctggagtgggggcagctgatggctcaagacacatgagctctggtggcgagtacagggacgcggggtttggggaggcccaagtcaaggtccatccttctgggatgaggggcggaggatgggaggcggagcccggtctccagggcaccagccctccacctagcgggaagcttgggaatcgcggagtgcagaggtggggtgcggaaagggttccaccgcgcctgggctccttt

SEQ ID NO: 69292 - DNA, 30 bp, Homo sapiens
  misc_feature 1..30: note = chr1:3222385-3222415
  misc_feature 1..30: note = hypo
  source 1..30: mol_type = genomic DNA
agaagggaacccttccgggtgatgcccgtg

SEQ ID NO: 69293 - DNA, 127 bp, Homo sapiens
  misc_feature 1..127: note = chr1:32226201-32226328
  misc_feature 1..127: note = hyper
  source 1..127: mol_type = genomic DNA
ggccgggggaaggggcgcggcgacgcgcacatccgtcgcgtttatccacctggcagctccaattcgcccgcccgtcactcaccctccgcctccccggcgctcgccgcccgacctgcccaggccgcca

SEQ ID NO: 69294 - DNA, 19 bp, Homo sapiens
  misc_feature 1..19: note = chr1:32226372-32226391
  misc_feature 1..19: note = hyper
  source 1..19: mol_type = genomic DNA
cgctcggacccaaggacag

SEQ ID NO: 69295 - DNA, 25 bp, Homo sapiens
  misc_feature 1..25: note = chr1:32237521-32237546
  misc_feature 1..25: note = hyper
  source 1..25: mol_type = genomic DNA
cacaaagggccccaccgccggaagc

SEQ ID NO: 69296 - DNA, 1078 bp, Homo sapiens
  misc_feature 1..1078: note = chr1:32237638-32238716
  misc_feature 1..1078: note = hyper
  source 1..1078: mol_type = genomic DNA
cggcggcggcggcgcgggtgtggggccgcgcggccgggagcgggcggaagagagcgcgaatttgaatttcaaaggcatctggaacccaagtgcttctgcgttgcccgattgtgtgtgtggcgcttttgtgtgtccgcgaatgcgcgcgtgcgtgtgtggcgtgtgtctgggtgttttatgactgtcctccgtgaggccgtgtgtgagcccttgcgtgggccgtgagtgcggcagggagcgcggtgtccgggggccgcctgtcggtgtgtctgtgcgtgcttgtgcgctagcctttgcctctgcgagtgcgtatttttaggaccgagtctgtctatatgagcctgtgtctgtgtgtgtgcgctcccggccctgcgtgtgtctgtgagcgtctgccggggcgcgtgtgtgctcggaaccccgcggtggtgtgcgggtgtgtccgtgtgtctgtgcacgtgcaggcgagcgttcccatctgtgtgtgtgcatctgagtctgggctatgtgtgactcagggaccagtctatgagcctgcctgtgcctttgagccgatacctgtgtgtgactcagggacgagtctatgagccgatacctgtgtgtgcttgggtgtctgtgtcgtggtgtgtccctgcaagcgtttgtgcctgcaggtgctggagtgtgtagctgtgggaatgagtgcgtgtgagtgtgcggaaggggcaccgcgcgagggagcgccggtgcggaaggctaagcgagcccgcgccctccacggacggtgccgccaccccctccctccgccccgcgctatgtgcccctgtgtgcccgcgccgccggggccgtctctgggctccgggagggggctgagcgagcggccctttcctcccagggaccccgggcccgccgccagccctgggcacacccgccccttcctccagcggccccgctcgctgacccacgggcactcgatgggcactcgggaggcaatggccggagaggatgggcagttagcgggagggactgagtggcgccggcttcacgctcattctgctgagggcttgggggcagctcatcagtcttccgcaatgggcctgct

SEQ ID NO: 69297 - DNA, 130 bp, Homo sapiens; identical to SEQ ID NO: 5388
  misc_feature 1..130: note = chr1:32410234-32410364
  misc_feature 1..130: note = hyper
  source 1..130: mol_type = genomic DNA

SEQ ID NO: 69298 - DNA, 30 bp, Homo sapiens
  misc_feature 1..30: note = chr1:3263565-3263595
  misc_feature 1..30: note = hypo
  source 1..30: mol_type = genomic DNA
gtgcgcagcactcaccggcagcttgggaca

SEQ ID NO: 69299 - DNA, 70 bp, Homo sapiens
  misc_feature 1..70: note = chr1:32705509-32705579
  misc_feature 1..70: note = hypo
  source 1..70: mol_type = genomic DNA
tggtctctgtgcctccgccagtcacgcgggcttgtttcgcggcctgggccgagagcgtgtccatgatgaa

SEQ ID NO: 69300 - DNA, 84 bp, Homo sapiens
  misc_feature 1..84: note = chr1:32741460-32741544
  misc_feature 1..84: note = hypo
  source 1..84: mol_type = genomic DNA
gggccagactcactgcgttctttcgtcgctttgtccatccattcattcattcaggatcgttttcactgtcggtccgggacttcg

SEQ ID NO: 69301 - DNA, 21 bp, Homo sapiens
  misc_feature 1..21: note = chr1:32756498-32756519
  misc_feature 1..21: note = hypo
  source 1..21: mol_type = genomic DNA
cctgccctcctaggccgggcg

SEQ ID NO: 69302 - DNA, 164 bp, Homo sapiens
  misc_feature 1..164: note = chr1:3276914-3277078
  misc_feature 1..164: note = hypo
  source 1..164: mol_type = genomic DNA
ctgtgatgggtgtgccgggccacaggtccccagccagaaacagaggctaagaactatgccagaggttttggttcacctctgtcaccggctgacaccaccgacacgttgtccttaggcaccagacctgccagtgagcccccagcagagcccggtccaagtgcggg

SEQ ID NO: 69303 - DNA, 84 bp, Homo sapiens; identical to SEQ ID NO: 26169
  misc_feature 1..84: note = chr1:32827740-32827824
  misc_feature 1..84: note = hyper
  source 1..84: mol_type = genomic DNA

SEQ ID NO: 69304 - DNA, 30 bp, Homo sapiens
  misc_feature 1..30: note = chr1:32829362-32829392
  misc_feature 1..30: note = hypo
  source 1..30: mol_type = genomic DNA
ccactgcctgaaagccgggccaaggccctc

SEQ ID NO: 69305 - DNA, 18 bp, Homo sapiens
  misc_feature 1..18: note = chr1:32918164-32918182
  misc_feature 1..18: note = hypo
  source 1..18: mol_type = genomic DNA
aaaactatgtctaggcgg

SEQ ID NO: 69306 - DNA, 30 bp, Homo sapiens
  misc_feature 1..30: note = chr1:32930129-32930159
  misc_feature 1..30: note = hyper
  source 1..30: mol_type = genomic DNA
ttttatcttttgtaacgactacccagtgaa

SEQ ID NO: 69307 - DNA, 408 bp, Homo sapiens; identical to SEQ ID NO: 26170
  misc_feature 1..408: note = chr1:32930619-32931027
  misc_feature 1..408: note = hyper
  source 1..408: mol_type = genomic DNA

SEQ ID NO: 69308 - DNA, 82 bp, Homo sapiens
  misc_feature 1..82: note = chr1:3294711-3294793
  misc_feature 1..82: note = hypo
  source 1..82: mol_type = genomic DNA
aggtgcacatggctgcgaccttggacaccacctccctgagtgttcctgttgccagtgtttcttccaccgatccctgatttcc

SEQ ID NO: 69309 - DNA, 66 bp, Homo sapiens
  misc_feature 1..66: note = chr1:3297673-3297739
  misc_feature 1..66: note = hypo
  source 1..66: mol_type = genomic DNA
tcaccaaaggcttctcgccgcgttcccccaggacaagcacacatacatgaacgcacacacatacat

SEQ ID NO: 69310 - DNA, 192 bp, Homo sapiens; identical to SEQ ID NO: 26008
  misc_feature 1..192: note = chr1:3310353-3310545
  misc_feature 1..192: note = hyper
  source 1..192: mol_type = genomic DNA

SEQ ID NO: 69311 - DNA, 136 bp, Homo sapiens
  misc_feature 1..136: note = chr1:3310755-3310891
  misc_feature 1..136: note = hyper
  source 1..136: mol_type = genomic DNA
cggtggggggcatcccaggagatctggctcggtgtgtagagaagggagtccgggcggcgtcctgggagtgtctgtggcctgcagagaggggatggggttggggtgtggatcccgggaggctcggaggcgctcggag

SEQ ID NO: 69312 - DNA, 262 bp, Homo sapiens
  misc_feature 1..262: note = chr1:3321998-3322260
  misc_feature 1..262: note = hypo
  source 1..262: mol_type = genomic DNA
agaaccaggccaaggcgggtgtccaggcagggcacgcgccaacggcatccgtctccccaggtgttcacggaccccagcaaccttcagcggcacatccgctcgcagcacgtgggcgctcgggcccacgcctgccccgactgcgggaagaccttcgccacgtcctccggcctcaagcagcacaagcatatccacagcacggtgaagcctttcatatgtgagtggtcgcccagcctggccgcctgccctccgggtgcgcggatgc

SEQ ID NO: 69313 - DNA, 74 bp, Homo sapiens
  misc_feature 1..74: note = chr1:33220942-33221016
  misc_feature 1..74: note = hypo
  source 1..74: mol_type = genomic DNA
tggtgggagaatctacgggtgtattcccaggatggcccacattcctagagattccgaaccggagcttgatgatc

SEQ ID NO: 69314 - DNA, 560 bp, Homo sapiens
  misc_feature 1..560: note = chr1:3325238-3325798
  misc_feature 1..560: note = hypo
  source 1..560: mol_type = genomic DNA
tgtgagcacgtgagccggtgcatgtgttggcgtgcatgagagtgtgtgagtgtgggcgcgtgagccggtgcatgtgttggcacacgtgagagtgcatgagtgtgggcgcgtgagccggtgcgtgtgtgtgagcgcgtgtgggcgcgtgagctggtgcgtgtgttggaggatgtgagagcacgagggtgggcacgtgagctggtgcgtgtgtgtgtgagagcgcatgagggtgggcgtgtgagccagtgcttgtgttggcacgcatgagagtgaggggcgtgtgagccagtgcatgtgttggcacgtgtgagagcatgtgagggttggcgtgtgagccggggcatgtcagtgtgtgtgagtgtgggcgtgtgggccggtgcgtgtgtcggcgcacgtgacagcgtgagtgtgggcgcgtgtctgtgagtgcgagtgtgggcgtgtgagttgatgcatgtgagtgtgtgagtgtgggtgtgtgtgagtgagtgtgggcacgtgagttggtgcgtgtgtgtgtgagagtgtgggcgcgtgagttggtgcgtgtgggtgtgaga

SEQ ID NO: 69315 - DNA, 155 bp, Homo sapiens
  misc_feature 1..155: note = chr1:3327868-3328023
  misc_feature 1..155: note = hypo
  source 1..155: mol_type = genomic DNA
agtaatttcatgtggcgttttcagcagggtttcccggtcatttcatgcgggtttgtcttggcttctgctgatgttttaggtgaggtctgccacaagtcctacacgcagttctccaacctgtgccggcacaagcggatgcacgccgactgccgcac

SEQ ID NO: 69316 - DNA, 50 bp, Homo sapiens
  misc_feature 1..50: note = chr1:3328269-3328319
  misc_feature 1..50: note = hypo
  source 1..50: mol_type = genomic DNA
gcctcccacgttccccgcactcacccccggcttcccgggcatcttccctc

SEQ ID NO: 69317 - DNA, 92 bp, Homo sapiens
  misc_feature 1..92: note = chr1:3328533-3328625
  misc_feature 1..92: note = hypo
  source 1..92: mol_type = genomic DNA
gaagaccaggagcagcgacatgtcggacggcagtgactttgaggacgtcaacaccaccacggggaccgacctggacacgaccacggggacgg

SEQ ID NO: 69318 - DNA, 30 bp, Homo sapiens
  misc_feature 1..30: note = chr1:3329300-3329330
  misc_feature 1..30: note = hypo
  source 1..30: mol_type = genomic DNA
tgccccagcagcccccgctccactacgcca

SEQ ID NO: 69319 - DNA, 30 bp, Homo sapiens
  misc_feature 1..30: note = chr1:3330244-3330274
  misc_feature 1..30: note = hypo
  source 1..30: mol_type = genomic DNA
gcaggtttaccaaagcgctctcagtgatgg

SEQ ID NO: 69320 - DNA, 130 bp, Homo sapiens
  misc_feature 1..130: note = chr1:33336741-33336871
  misc_feature 1..130: note = hyper
  source 1..130: mol_type = genomic DNA
ggtcactctctctcccgtgcacagccctgacttggctgccgctttctgccctttcccagggtagagagaggacaagtgccaccgagatgcccgtttgtgcccccacccctaagcgcgcctcccttccctg

SEQ ID NO: 69321 - DNA, 121 bp, Homo sapiens
  misc_feature 1..121: note = chr1:33351599-33351720
  misc_feature 1..121: note = hyper
  source 1..121: mol_type = genomic DNA
agctggaggaatgggcgctccacgctcccagctccgttagttgggagttgaggcgcaggagcagggagggtgcccagggtgccaattcggccctcgaagcgacgtgcggctcagagcccag

SEQ ID NO: 69322 - DNA, 131 bp, Homo sapiens
  misc_feature 1..131: note = chr1:33352075-33352206
  misc_feature 1..131: note = hyper
  source 1..131: mol_type = genomic DNA
gcgccgccttccctgcgcagtcggtgtctccgcgtcgctgggtgagtgggggcagctccagccggggccgggggatgagggcagggggttcccggagctgggggcccacgtccagggcttcccaacaccgc

SEQ ID NO: 69323 - DNA, 218 bp, Homo sapiens
  misc_feature 1..218: note = chr1:33352236-33352454
  misc_feature 1..218: note = hyper
  source 1..218: mol_type = genomic DNA
cgggtggcgggggcgctggggactgggaagcgcgcggtgctctccagggtcctgaccgccgagtggccggcccctaggaaccgcgttcgaccgccctggagcgccccctccaggaggggccacgcgccgggcgctgtcctagtgctgagcggatggaggcgggggctgggggacagagctgagggaggtttggagcgggtccccggggctggcttctc

SEQ ID NO: 69324 - DNA, 79 bp, Homo sapiens
  misc_feature 1..79: note = chr1:3335837-3335916
  misc_feature 1..79: note = hypo
  source 1..79: mol_type = genomic DNA
agcctggatgggaagcggtgcgtctgcttccaggatccccccgtgctcctctcatctgaggagccggctggcacctgca

SEQ ID NO: 69325 - DNA, 435 bp, Homo sapiens
  misc_feature 1..435: note = chr1:33358628-33359063
  misc_feature 1..435: note = hyper
  source 1..435: mol_type = genomic DNA
cgccgcgccccctgccggcagcagacggccccgcagcgcagtgccgcccccttggcccggcgccccctttcgaccaccgagcgcgggccgccctgggcccgggtgccagcccggtacttacccccgacgcgcgtgccccggggcacgcgctcctgagcccgccgctccaggccctccactgtcgggccccggtgtcctccaacatctctcctgacccctgcgcccgctcggagcttccacctgcggcgcctttgctcctttcccacccagccctccaagggagcgcggcagggcccgcccgatagccctctcttctgggaggccttcccggacacgccttcccgaagccctcggctccccacgcctccgtgattccccactccaccttgcccaggcgggggcagcaaacgtcagagagcccgggggcgcctctga

SEQ ID NO: 69326 - DNA, 75 bp, Homo sapiens; identical to SEQ ID NO: 26173
  misc_feature 1..75: note = chr1:33390730-33390805
  misc_feature 1..75: note = hyper
  source 1..75: mol_type = genomic DNA

SEQ ID NO: 69327 - DNA, 180 bp, Homo sapiens
  misc_feature 1..180: note = chr1:3342141-3342321
  misc_feature 1..180: note = hypo
  source 1..180: mol_type = genomic DNA
caggtgtaagtactgcgaccgctccttcagcatctcttcgaacctccagcggcacgtccggaacatccacaacaaggagaagcctttcaagtgccacctgtgcaaccgctgcttcgggcagcagaccaacctggaccggcacctcaagaagcacgagcacgagaacgcaccaggtgggcc

SEQ ID NO: 69328 - DNA, 19 bp, Homo sapiens
  misc_feature 1..19: note = chr1:33425641-33425660
  misc_feature 1..19: note = hypo
  source 1..19: mol_type = genomic DNA
actccgtctcaaaaaaaaa

SEQ ID NO: 69329 - DNA, 421 bp, Homo sapiens
  misc_feature 1..421: note = chr1:33438500-33438921
  misc_feature 1..421: note = hyper
  source 1..421: mol_type = genomic DNA
gcgtcttcccttgcccggggcagggccagcgctttccttgggcactcgaacgaggggagggggccgcttagtgcctggaaatccgagcagccttggcttgcttggctgcgcaacccgccaatccggctgcgcccggtggcggtgccatgtgaccagcctccctttccctccctggccttccagggaagaccggcatccccgcagtgccgccaccctcgccatcccgcccccgcccctcgcgtgccgcatccgcgcgggagagcgcccggcgaggggccgggattccgccgcggtccgctacggcgcaggggacgggaagggagcggaggcgagcgagttgctgccgcagctcccgcagtgttttctgtcaaggtcaagcatacccactctttgacaaggctgcctccgaaatccctccctt

SEQ ID NO: 69330 - DNA, 149 bp, Homo sapiens; identical to SEQ ID NO: 38921
  misc_feature 1..149: note = chr1:33441493-33441642
  misc_feature 1..149: note = hypo
  source 1..149: mol_type = genomic DNA

SEQ ID NO: 69331 - DNA, 93 bp, Homo sapiens
  misc_feature 1..93: note = chr1:3347130-3347223
  misc_feature 1..93: note = hypo
  source 1..93: mol_type = genomic DNA
cttccaccccaacaccgccccggccctggtgtcctcccggccatagcagcttgctgctgggccttgccctgcccccaccgccccgagcgcttg

SEQ ID NO: 69332 - DNA, 143 bp, Homo sapiens; identical to SEQ ID NO: 14223
  misc_feature 1..143: note = chr1:33473115-33473258
  misc_feature 1..143: note = hypo
  source 1..143: mol_type = genomic DNA

SEQ ID NO: 69333 - DNA, 69 bp, Homo sapiens
  misc_feature 1..69: note = chr1:3350089-3350158
  misc_feature 1..69: note = hypo
  source 1..69: mol_type = genomic DNA
ctgtctgggatggcccgccctgcccacgcgctcacctgcctgtctgggatggcccgccctgcccacgcg

SEQ ID NO: 69334 - DNA, 55 bp, Homo sapiens
  misc_feature 1..55: note = chr1:3350407-3350462
  misc_feature 1..55: note = hypo
  source 1..55: mol_type = genomic DNA
cgagggcaccagccacgaaggacggaggcgggcggggccccggagaaccctgtcc

SEQ ID NO: 69335 - DNA, 77 bp, Homo sapiens
  misc_feature 1..77: note = chr1:33631065-33631142
  misc_feature 1..77: note = hypo
  source 1..77: mol_type = genomic DNA
gctcaccttggtctccgccagttgtcgcttgagcagctgcagcgcttcggtgtgttcccgctcgctgtcttgaaggg

SEQ ID NO: 69336 - DNA, 33 bp, Homo sapiens; identical to SEQ ID NO: 38794
  misc_feature 1..33: note = chr1:3372809-3372842
  misc_feature 1..33: note = hypo
  source 1..33: mol_type = genomic DNA

SEQ ID NO: 69337 - DNA, 170 bp, Homo sapiens
  misc_feature 1..170: note = chr1:33772445-33772615
  misc_feature 1..170: note = hyper
  source 1..170: mol_type = genomic DNA
gggctccagcagaactcgggcgacagcaccttggcgggcttgtgcagccagaagaacttgttgaggtggctctcgtcgtgccagcgcgcctccaggccgcgcgcgcggtcccagtccaggccccccgcacagtgcgccgtcagcccgcgcagcgccgccacgctgccccc

SEQ ID NO: 69338 - DNA, 38 bp, Homo sapiens
  misc_feature 1..38: note = chr1:33772904-33772942
  misc_feature 1..38: note = hyper
  source 1..38: mol_type = genomic DNA
cgctccacgggcagccggcgtcccgggcccagcgccac

SEQ ID NO: 69339 - DNA, 32 bp, Homo sapiens; identical to SEQ ID NO: 38924
  misc_feature 1..32: note = chr1:33798865-33798897
  misc_feature 1..32: note = hypo
  source 1..32: mol_type = genomic DNA

SEQ ID NO: 69340 - DNA, 118 bp, Homo sapiens
  misc_feature 1..118: note = chr1:33896068-33896186
  misc_feature 1..118: note = hyper
  source 1..118: mol_type = genomic DNA
cgccccggtcaggcccgacgcccgggtctcaccgcactctgcgggacaagcggagcaggcgcaggccgcgcaagaccacgggctgccgcggcgcgggcctctccgcaggaggggggtc

SEQ ID NO: 69341 - DNA, 30 bp, Homo sapiens; identical to SEQ ID NO: 38925
  misc_feature 1..30: note = chr1:33981589-33981619
  misc_feature 1..30: note = hypo
  source 1..30: mol_type = genomic DNA

SEQ ID NO: 69342 - DNA, 48 bp, Homo sapiens
  misc_feature 1..48: note = chr1:33985077-33985125
  misc_feature 1..48: note = hypo
  source 1..48: mol_type = genomic DNA
cggggctctcggtggcggtggtggcggccaggccgggtggctatactg

SEQ ID NO: 69343 - DNA, 45 bp, Homo sapiens
  misc_feature 1..45: note = chr1:3402666-3402711
  misc_feature 1..45: note = hypo
  source 1..45: mol_type = genomic DNA
ggccactgcctgattcgcatttttaacctccgtttacaccagtct

SEQ ID NO: 69344 - DNA, 206 bp, Homo sapiens
  misc_feature 1..206: note = chr1:3408498-3408704
  misc_feature 1..206: note = hypo
  source 1..206: mol_type = genomic DNA
catgcccggcacacacgcctgtgccccctgccgcacatgcatgcactattgcgcagacgcactggctacattcacacactgatgcacacgtaacacacaggcactggcacgcacaggtgcctgctgcctgtgcaggactgcgtgcgtggactggcacgcacaggtgcctgctgcccgtgcaggactgcgtgcgtggactggcacac

SEQ ID NO: 69345 - DNA, 41 bp, Homo sapiens
  misc_feature 1..41: note = chr1:34090896-34090937
  misc_feature 1..41: note = hypo
  source 1..41: mol_type = genomic DNA
aaactggcccagggacggacatacaacgggtctggaacaaa

SEQ ID NO: 69346 - DNA, 34 bp, Homo sapiens
  misc_feature 1..34: note = chr1:34100658-34100692
  misc_feature 1..34: note = hyper
  source 1..34: mol_type = genomic DNA
agaaacgtcagcactcggccgtccttttggggag

SEQ ID NO: 69347 - DNA, 272 bp, Homo sapiens
  misc_feature 1..272: note = chr1:3411032-3411304
  misc_feature 1..272: note = hypo
  source 1..272: mol_type = genomic DNA
caggcggctccgtagcgcccagggggacaggctggggacagggcagggtgggcagtccttcggcaccagccttgcccagccctatggcagcccagggcacctccctgaggggatgctggggtcccgctggccccgcacactcacccagctcgcagtgccgccccgtccagcccaggccacaggagcagctgccgttgctggcgtggcacaggcccccatttctgcaggagcaggtgtgctcgcagcccacgccaaaccggttctgggggcag

SEQ ID NO: 69348 - DNA, 30 bp, Homo sapiens
  misc_feature 1..30: note = chr1:34115492-34115522
  misc_feature 1..30: note = hypo
  source 1..30: mol_type = genomic DNA
ggggactgggaggcacggggcacagagcca

SEQ ID NO: 69349 - DNA, 28 bp, Homo sapiens
  misc_feature 1..28: note = chr1:34130113-34130141
  misc_feature 1..28: note = hypo
  source 1..28: mol_type = genomic DNA
attttaggccaggagcggtggctcatgc

SEQ ID NO: 69350 - DNA, 30 bp, Homo sapiens
  misc_feature 1..30: note = chr1:3416275-3416305
  misc_feature 1..30: note = hypo
  source 1..30: mol_type = genomic DNA
gcaggctgcagacagcgggcagtgatgtgg

SEQ ID NO: 69351 - DNA, 36 bp, Homo sapiens
  misc_feature 1..36: note = chr1:3417132-3417168
  misc_feature 1..36: note = hypo
  source 1..36: mol_type = genomic DNA
gtgtgcatatgtgtgcgtgtgcgcactcaggagggt

SEQ ID NO: 69352 - DNA, 89 bp, Homo sapiens
  misc_feature 1..89: note = chr1:34180223-34180312
  misc_feature 1..89: note = hypo
  source 1..89: mol_type = genomic DNA
tctgccccccaggcacgtgatgcgggcggtgccctccagacggtacccggggaagcaggagaaggtcaaggtgtcgcccacgccaaact

SEQ ID NO: 69353 - DNA, 30 bp, Homo sapiens
  misc_feature 1..30: note = chr1:3418316-3418346
  misc_feature 1..30: note = hypo
  source 1..30: mol_type = genomic DNA
tgcagcctggggaggcggaactggggctgc

SEQ ID NO: 69354 - DNA, 103 bp, Homo sapiens
  misc_feature 1..103: note = chr1:3426374-3426477
  misc_feature 1..103: note = hypo
  source 1..103: mol_type = genomic DNA
cagctggggcaaactcgagaaggcagaggccggtgctccgcggagggcgggagactcacggctgcagcccctacggtcctcgtgcagccggtagccggcctcg

SEQ ID NO: 69355 - DNA, 30 bp, Homo sapiens
  misc_feature 1..30: note = chr1:3431090-3431120
  misc_feature 1..30: note = hypo
  source 1..30: mol_type = genomic DNA
ggagcaggggaggggcgtcctaccttcaca

SEQ ID NO: 69356 - DNA, 30 bp, Homo sapiens
  misc_feature 1..30: note = chr1:3431513-3431543
  misc_feature 1..30: note = hypo
  source 1..30: mol_type = genomic DNA
ctgacaccaaggcggcggccccccagctct

SEQ ID NO: 69357 - DNA, 30 bp, Homo sapiens
  misc_feature 1..30: note = chr1:3450321-3450351
  misc_feature 1..30: note = hypo
  source 1..30: mol_type = genomic DNA
gaatccctgcacctccgactccagtcaccc

SEQ ID NO: 69358 - DNA, 22 bp, Homo sapiens
  misc_feature 1..22: note = chr1:34558017-34558039
  misc_feature 1..22: note = hypo
  source 1..22: mol_type = genomic DNA
aataggaacagctcccgtccac

SEQ ID NO: 69359 - DNA, 1323 bp, Homo sapiens; identical to SEQ ID NO: 26177
  misc_feature 1..1323: note = chr1:34628590-34629913
  misc_feature 1..1323: note = hyper
  source 1..1323: mol_type = genomic DNA

SEQ ID NO: 69360 - DNA, 920 bp, Homo sapiens
  misc_feature 1..920: note = chr1:34630137-34631057
  misc_feature 1..920: note = hyper
  source 1..920: mol_type = genomic DNA
tcccggaaagtttatcgggaaaaagcctagcaccgtgggggctgggaggctggagaaactgaagccacagaccaggtgccccgcaaccccgggcggggatgtctgtctcccaggcccccacaccggccgcatccgtccaagttgcggctggggttggggcagcagtgagggtgagggtggaggtgaggacgtggctgagggtggggtgggagacggaggcagggatgagaatgagagtaggcaactgggagggtgggagattcaggcagggatagaggcggggggagggactgggaccgggtcgaggatgggtgggctcggggctcgggtggggcgcgcggcggccgctggctcctcggcgcggctggactcacccgcggcggccgagacgctgagcaacccacagcccagcaacagcagcagaggcggcggcgttggcggcggcgggcggccccagcggctcccggcgcccggcacaagcgccgaaatcccggtttcgccgcgagccctccccgcggggcagccgcagcgccccagctcccgtccccgcgagcgcggcatggcgcggccggcagcgccgagggagaggctccgctcgccgccgaggagaaaggaggtcaggagagctctggagcttttttctgctcggaaaaaatcccggtacgcgggagccctgagcttctgcggctggaatgaaccaagtgtccgcccggccggggagaggcgcgctgcgctctcggaaatgactcgctccaatcccgcttcgcggggttcgcgccggggggcgggagggggtgaattatccccggattaatcactccggagccgcttctccgccgctccaaatgctgggggtggaggcgcagctaaggataaaatattggggggcgggggttcctcttcagcgccacctccacctc

SEQ ID NO: 69361 - DNA, 375 bp, Homo sapiens
  misc_feature 1..375: note = chr1:34631434-34631809
  misc_feature 1..375: note = hyper
  source 1..375: mol_type = genomic DNA
atcccaggagaggggcgtgtgtgcgtagacagaggcagggttaagaattggagggcggtggaggggggttgtgtgtggggtggggaggggggggaaccggttcatttgacccagtgcggtcccactcctaccctaagacaaaaatctcagggtggcagaggcggtccctgtgtgcacgcgagttgggggtggggagtgaggttggtggaaggacggtgcaagagttactagtacaatttatccccaaatttaaataatcggatcctacttcttcttctccccttcctcctcccagccaaggccccaaaccaagagagttcttcccaaggacgtgagctgctccccacctctccccagtagcggctgcctctaggc

SEQ ID NO: 69362 - DNA, 399 bp, Homo sapiens
  misc_feature 1..399: note = chr1:34632102-34632501
  misc_feature 1..399: note = hyper
  source 1..399: mol_type = genomic DNA
ctgatttggccaaaacggagcgttggcatctgtgtggccaagggggcagtggccggcgggcggtggggcctgagaatttccggggaagggtgtggagagggactgtagggatggcgagccaggctgggggtggctggcgacccaggttggccggctgtcagcgtggccaggaatttccatccaaggaagggtgtgaagaggggctgtggagttgacgatatgaattggggggcgggggcagggctggaggagtggaggcttgtccctactccccatgaaaaacttcctccccagagccacgctttcgcagcctcctagatgccactcttcctccctccccccaccccaagttgttccggtttccctgcatgagctcatcccacagctggggagccagcc

SEQ ID NO: 69363 - DNA, 285 bp, Homo sapiens
  misc_feature 1..285: note = chr1:3463596-3463881
  misc_feature 1..285: note = hypo
  source 1..285: mol_type = genomic DNA
ctgggggggggccagcggcagtagaagccccccacggtgtcccggcaccgacccgcacagcccccgttggcgttggcacactcacccacatctgcgaggggagaagcaggtgaggtgccagccacgcggccacctcctccctccagcctcggcccacccgaggcctcagagggatgaggctcagggctccccacagcacaggggacattgtccaccagaacaggccccgcaggagggaggctgggtgtggaaacccagcagcaggggagccgcactgcagaacgg

SEQ ID NO: 69364 - DNA, 123 bp, Homo sapiens
  misc_feature 1..123: note = chr1:34642367-34642490
  misc_feature 1..123: note = hyper
  source 1..123: mol_type = genomic DNA
gagatttgtgtggagcggcgaagtggggcggcggcgcgtttggctttgacttctgatcccccgaagcgctctggggtcctttgggccccacccccacccaccccaccggcgggtcttgggctc

SEQ ID NO: 69365 - DNA, 276 bp, Homo sapiens; identical to SEQ ID NO: 26182
  misc_feature 1..276: note = chr1:34642862-34643138
  misc_feature 1..276: note = hyper
  source 1..276: mol_type = genomic DNA

SEQ ID NO: 69366 - DNA, 675 bp, Homo sapiens
  misc_feature 1..675: note = chr1:3466869-3467544
  misc_feature 1..675: note = hypo
  source 1..675: mol_type = genomic DNA
catggaggacgacagcgaggaggaacctcaaacctcgtgctgtgtgaaaggagcccatctcgagaggtcacacagtgtaggatagggcgtaccagctggcgggtctggggtctcctgggagggtgaggaaaatgtctcggaatgagataaaggtgatggctgcatagcacgatgaatgcacaaagggtcgctatgtttcaaaggggttattttatgcaatgtgaatttcaccttcatttaagaaaaaagagaaaaacgtcatcccaagactggattctgcacctcacttctccagcagttttgatacagaaagaagcggtcgtgcccaggcctccggggtgctccgtgccggatctggccccatgccaggggcctaactcagcagcagtgactgcaatgtcacaagtgcccagcagccacccaaccggggcagggctccgaagacccagcccttgcagccgatccagcaagcacaggctgcagagtgagaacccgaggggagcaagagggggcccacacccccaccgcccgtgcactcaccctgggggagccagtgtcccccgtgtgctagtccattggcaggagaccctaacgggtgtgacagtggggctctcagatcagccgccaggtgtggacagggccaggatccgaggctccagccggccagggctgggc

SEQ ID NO: 69367 - DNA, 30 bp, Homo sapiens; identical to SEQ ID NO: 38801
  misc_feature 1..30: note = chr1:3470143-3470173
  misc_feature 1..30: note = hypo
  source 1..30: mol_type = genomic DNA

SEQ ID NO: 69368 - DNA, 27 bp, Homo sapiens
  misc_feature 1..27: note = chr1:34979405-34979432
  misc_feature 1..27: note = hypo
  source 1..27: mol_type = genomic DNA
aagaagagggctgggcgcagtggctca

SEQ ID NO: 69369 - DNA, 34 bp, Homo sapiens
  misc_feature 1..34: note = chr1:3511274-3511308
  misc_feature 1..34: note = hypo
  source 1..34: mol_type = genomic DNA
cagaggcttgagagccgcccgctcagctcagacc

SEQ ID NO: 69370 - DNA, 296 bp, Homo sapiens
  misc_feature 1..296: note = chr1:35246877-35247173
  misc_feature 1..296: note = hyper
  source 1..296: mol_type = genomic DNA
ggcctccctggaggccgaggtcgacggcccgtcgcaccgggagggggggctcccaggggtgccccacgcacggtcaaggtcccgcgccaagcggggaccgggctgggccggaagcgggcacggtactcgcggcaaactagcgtgggcgagtcctgattgcagtcggacctgccgccgcggcacttaacagtttgcagagtgcttcccgcccctgatctcattggagccttcggacagcccagcccatggccaccgatgcccccatttcacgcctgaggaagcggaggctcagacgg

SEQ ID NO: 69371 - DNA, 391 bp, Homo sapiens
  misc_feature 1..391: note = chr1:35258480-35258871
  misc_feature 1..391: note = hyper
  source 1..391: mol_type = genomic DNA
gcacctcccagtccccgcccccgccctctctccagcgcccgccgccctccccgtcgcgtttcctgcccccaccccgcccctctgcgctatttaaggcgcccccgccgctcgtgcggtccagcagggctcccgcgggcgtcactccggccatcgtccccacctccacctgggccgcccggcaggcaggcggtgagtcgggggctaggaagggaccaggggcgccacctgctcgcgggaggccgggaggagtcttgggtcctccgatgccgggacgggggttgctgcggaacgcccgccgcgacagagccgcgctcacccaggtggccttggccaggctcccaccctctttccatggaatccttgtaacaacccgaggcgggaggaatactat

SEQ ID NO: 69372 - DNA, 30 bp, Homo sapiens
  misc_feature 1..30: note = chr1:3527351-3527381
  misc_feature 1..30: note = hyper
  source 1..30: mol_type = genomic DNA
ctgccttctcccagccgggctctggggcca

SEQ ID NO: 69373 - DNA, 61 bp, Homo sapiens
  misc_feature 1..61: note = chr1:3527713-3527774
  misc_feature 1..61: note = hyper
  source 1..61: mol_type = genomic DNA
agcgggagcaggggccgcggcggaacgctggcgcccacgggcacggcggggagcagcagca

SEQ ID NO: 69374 - DNA, 35 bp, Homo sapiens
  misc_feature 1..35: note = chr1:3528381-3528416
  misc_feature 1..35: note = hyper
  source 1..35: mol_type = genomic DNA
cctgctcgtctcatgcggaaagtccaagtcctaac

SEQ ID NO: 69375 - DNA, 876 bp, Homo sapiens
  misc_feature 1..876: note = chr1:35350991-35351867
  misc_feature 1..876: note = hyper
  source 1..876: mol_type = genomic DNA
atatatccagaaggccgcttccagcccctcaccccagccccgaccgaccagggtcagagccctcgtgggcgcctccccgttccatacctgcaccccaatggacggccgccacttccgctgccgcgccaggctccgcagctcctccctgccagggatggtcttgatgatgagtgtggggggcttggggctggcccggggcggcaccggcgccaactccagtgtgcgcgcacccatggcggggccgtccagcccgtcggcggagctgcagcgccgggcggggccctcggccgccgtgaagctctcgtgcgcggagtcggtgctgctctgggcggtgatggagatgcggggcggggcctggcttcccggcgggatggggggcggggcctttctgaagttgaaggctgtggccggcgagcgcagagacgcagtgggtgaggctcgcggccctgcctgggtcctgggcccgcgcccgactcccaccctcaagaggccctacgggaccctgcagcggcgcgcactccacatgctgctgcacacacgccaacggacgctctccccgtcatccgaccccgggagcgagcgatctgcgcgggtcacagcacagtcgagggggaggccagaacccggacccagggcgctctcctgcctagggccgggccaggggcaggaaggtgtactcacaggagccgggcctccctgagacagcggcaggggtagcgaggaggggcaggcagtcgtcgtcttgagagcagccggcctggatggcccggaggtagctgtggctccgcatgcggaaacagccgggcaggtccagggcgtccacggcctgggactccagctccccaaacaccgacccgcacacggcctccagctgct

SEQ ID NO: 69376 - DNA, 128 bp, Homo sapiens
  misc_feature 1..128: note = chr1:35369947-35370075
  misc_feature 1..128: note = hypo
  source 1..128: mol_type = genomic DNA
cccgggtatccatcccggccctggctgaccatcatggtatgccaggcacttcgcttgaccgactgtccatccagtgacatggacatgccagtgcaggcaaggcagcggccttccgacccgcccgagcg

SEQ ID NO: 69377 - DNA, 108 bp, Homo sapiens
  misc_feature 1..108: note = chr1:35390565-35390673
  misc_feature 1..108: note = hyper
  source 1..108: mol_type = genomic DNA
gcctcattcagcactcgggacagctccgaaggagcaaatccccgccgaatcccactcagcacccgggacagttcccagcgacattgccggccccggtagccagaaacc

SEQ ID NO: 69378 - DNA, 176 bp, Homo sapiens
  misc_feature 1..176: note = chr1:35394614-35394790
  misc_feature 1..176: note = hyper
  source 1..176: mol_type = genomic DNA
acacagtgacacactcggcacagacacacagcgacacgcactcacattcacacacctgcagaggaaacttctctccggatctccccagcaccacgacttcccccacaaccagctggctactccctcccagacccgagcctccagccgggcgagggctgggccggggctggcctgtc

SEQ ID NO: 69379 - DNA, 499 bp, Homo sapiens
  misc_feature 1..499: note = chr1:35395042-35395541
  misc_feature 1..499: note = hyper
  source 1..499: mol_type = genomic DNA
gcggcttacctggcccggctcgggctccggccgggttacatggtgccggcggcccgggccgggggcgctgcggcgttgggcaggcgggcagggaccggggcccggcactgcggagcccccagctgaggggccgcgccggctgcggagccccaagcgagcgccgagcggcagcgggcgcgggagcgggaggcggccaagccacggaggctggatttcccggggaccgggaaggggaggcggggggatcccgcccgcgcgctccgcccccgcccccgcccccgcgcagggcagccgagcagggagagggagagggagaggaagagggagggggaccgagctccccgcccccgcgcggacccaggagggccgaggtcgccgcccgcgggcggccgccggggtcccggaggagcgcccacctcgctgagcgacggtgctgggggcgcccagcgtaggggcaggaatgagatccccctccccggggacccaggaacaggcaccc

SEQ ID NO: 69380 - DNA, 507 bp, Homo sapiens; identical to SEQ ID NO: 26188
  misc_feature 1..507: note = chr1:35395542-35396049
  misc_feature 1..507: note = hyper
  source 1..507: mol_type = genomic DNA

SEQ ID NO: 69381 - DNA, 24 bp, Homo sapiens
  misc_feature 1..24: note = chr1:35396107-35396131
  misc_feature 1..24: note = hyper
  source 1..24: mol_type = genomic DNA
cgcccagagcgatgctgtaatggg

SEQ ID NO: 69382 - DNA, 30 bp, Homo sapiens
  misc_feature 1..30: note = chr1:3564809-3564839
  misc_feature 1..30: note = hypo
  source 1..30: mol_type = genomic DNA
ttcaagtaaaaataacgcctgagtactcac

SEQ ID NO: 69383 - DNA, 23 bp, Homo sapiens
  misc_feature 1..23: note = chr1:35660562-35660585
  misc_feature 1..23: note = hypo
  source 1..23: mol_type = genomic DNA
aggcgggaccgggtgcggtggct

SEQ ID NO: 69384 - DNA, 136 bp, Homo sapiens; identical to SEQ ID NO: 38930
  misc_feature 1..136: note = chr1:35664720-35664856
  misc_feature 1..136: note = hypo
  source 1..136: mol_type = genomic DNA

SEQ ID NO: 69385 - DNA, 242 bp, Homo sapiens
  misc_feature 1..242: note = chr1:3567103-3567345
  misc_feature 1..242: note = hyper
  source 1..242: mol_type = genomic DNA
taatacggtgtctgtcgcacatatattatatcgtgtatgtaatgtataagtatttatttcgtttgcttggggttttgtttgcttttgctgagtccgacccctctacctgccgcctggcccttgcctcacgctccagtgccactgagatcaaggagagaacgaatttgccgctgactgggcagagcgagcgcgtggatcgcggccaccgcccgttcatcacccgcgcgcatctgggctggcac

SEQ ID NO: 69386 - DNA, 114 bp, Homo sapiens; identical to SEQ ID NO: 2
  misc_feature 1..114: note = chr1:3567737-3567851
  misc_feature 1..114: note = hyper
  source 1..114: mol_type = genomic DNA

SEQ ID NO: 69387 - DNA, 576 bp, Homo sapiens; identical to SEQ ID NO: 26011
  misc_feature 1..576: note = chr1:3567882-3568458
  misc_feature 1..576: note = hyper
  source 1..576: mol_type = genomic DNA

SEQ ID NO: 69388 - DNA, 79 bp, Homo sapiens
  misc_feature 1..79: note = chr1:3597274-3597353
  misc_feature 1..79: note = hypo
  source 1..79: mol_type = genomic DNA
cctcagctggacctgcggttctgcttcctgtcacactctcccattttaaattaacggaatggtgcggtccccatgcaca

SEQ ID NO: 69389 - DNA, 30 bp, Homo sapiens
  misc_feature 1..30: note = chr1:3597733-3597763
  misc_feature 1..30: note = hypo
  source 1..30: mol_type = genomic DNA
ggggaaggacaaaaacgacaggttccaggc

SEQ ID NO: 69390 - DNA, 132 bp, Homo sapiens
  misc_feature 1..132: note = chr1:3601814-3601946
  misc_feature 1..132: note = hypo
  source 1..132: mol_type = genomic DNA
tgtcctccccagccccggagggttccctgagctccatatcggggtctggtccgagcccccgcctgctggaacgtgccactccccagccacagggtgacagtgggagcctcgaacctccgcaaacagcaaggt

SEQ ID NO: 69391 - DNA, 30 bp, Homo sapiens
  misc_feature 1..30: note = chr1:3602547-3602577
  misc_feature 1..30: note = hypo
  source 1..30: mol_type = genomic DNA
tgtttccggggctaccgatagtcctgagtt

SEQ ID NO: 69392 - DNA, 1240 bp, Homo sapiens
  misc_feature 1..1240: note = chr1:36042478-36043718
  misc_feature 1..1240: note = hyper
  source 1..1240: mol_type = genomic DNA
tcacgtgcacaaccgcgcgggacggggccacgcggactcacgtgcacaaccgcgggaccccagcgccagcgggaccccagcgccagcgggaccccagcgccagcgggaccccagcgccagcgggaccccagcgccagcgggaccccagcgccagcgggaccccagcgccagcgggtctgtggcccagtggagcgagtggagcgctggcgacctgagcggagactgcgccctggacgccccagcctagacgtcaagttacagcccgcgcagcagcagcaaaggggaaggggcaggagccgggcacagttggatccggaggtcgtgacccaggggaaagcgtgggcggtcgacccagggcagctgcggcggcgaggcaggtgggctccttgctccctggagccgcccctccccacacctgccctcggcgcccccagcagttttcaccttggccctccgcggtcactgcgggattcggcgttgccgccagcccagtggggagtgaattagcgccctccttcgtcctcggcccttccgacggcacgaggaactcctgtcctgccccacagaccttcggcctccgccgagtgcggtactggagcctgccccgccagggccctggaatcagagaaagtcgctctttggccacctgaagcgtcggatccctacagtgcctcccagcctgggcgggagcggcggctgcgtcgctgaaggttggggtccttggtgcgaaagggaggcagctgcagcctcagccccaccccagaagcggccttcgcatcgctgcggtgggcgttctcgggcttcgacttcgccagcgccgcggggcagaggcacctggagctcgcagggcccagacctgggttggaaaagcttcgctgactgcaggcaagcgtccgggaggggcggccaggcgaagccccggcgctttaccacacacttccgggtcccatgccagttgcatccgcggtattgggcaggaaatggcagggctgaggccgaccctaggagtataagggagccctccatttcctgcccacatttgtcacctccagttttgcaacctatcccagacacacagaaagcaagcaggactggtggggagacggagcttaacaggaatattttccagcagtgagcaggggctgtatgggacgcgggaggagctcagaggaggcgcggagagtgcccgaggttgggtgagtgcctagaggggagatagttgaaccgggttcaagaggtg

SEQ ID NO: 69393 - DNA, 139 bp, Homo sapiens
  misc_feature 1..139: note = chr1:36056226-36056365
  misc_feature 1..139: note = hypo
  source 1..139: mol_type = genomic DNA
ccccccaggagaggccgtgcacctggcccgagacttcggttacgtctgtgagacggagttcccagccaaggcagctgccgagtacctgtgccgacagcacgctgacccgggggagctgcacagccgcaagagcatgctg

SEQ ID NO: 69394 - DNA, 94 bp, Homo sapiens; identical to SEQ ID NO: 38803
  misc_feature 1..94: note = chr1:3607472-3607566
  misc_feature 1..94: note = hypo
  source 1..94: mol_type = genomic DNA

SEQ ID NO: 69395 - DNA, 66 bp, Homo sapiens
  misc_feature 1..66: note = chr1:3614470-3614536
  misc_feature 1..66: note = hypo
  source 1..66: mol_type = genomic DNA
tcctgctccaatgtccgcttatcaccgagggccatcggaggtggcacgccccgtgactgcctcccc

SEQ ID NO: 69396 - DNA, 41 bp, Homo sapiens
  misc_feature 1..41: note = chr1:36173241-36173282
  misc_feature 1..41: note = hyper
  source 1..41: mol_type = genomic DNA
ctgaatgttgggggccggtgctaattcgcaccactcaagaa

SEQ ID NO: 69397 - DNA, 237 bp, Homo sapiens
  misc_feature 1..237: note = chr1:36173696-36173933
  misc_feature 1..237: note = hyper
  source 1..237: mol_type = genomic DNA
ccggcccgcgccactcgaggcgccgcggggctccggggaggccgcccctttgtctgcgcctttcggggacgagccccgcccggggagcgccgagcaccagctgagcgccgcgctcccgccggctacctcttccccggcgcggaggcctggaggcccctcctggggcgaggtcgcggccccccgccacgcccgagcccctcggacggctcccatcccacagcccgagccccctttcat

SEQ ID NO: 69398 - DNA, 120 bp, Homo sapiens
  misc_feature 1..120: note = chr1:36271443-36271563
  misc_feature 1..120: note = hypo
  source 1..120: mol_type = genomic DNA
cacccaagcctgggcgacagagcgagactccgggtcaaaaaaaataaaagaatatagggtatggtatcagtagacaagaatgtaggcactagattaaaagtcccagttccggccgggcgc

SEQ ID NO: 69399 - DNA, 105 bp, Homo sapiens
  misc_feature 1..105: note = chr1:36334781-36334886
  misc_feature 1..105: note = hypo
  source 1..105: mol_type = genomic DNA
gggaatgaatagggtcgttatattgattgttgtgaaggtttcatgtgtgtatatttgtttcaaaactcatcagaccgcacactttaaacgtgtgtagtttttttt

SEQ ID NO: 69400 - DNA, 75 bp, Homo sapiens
  misc_feature 1..75: note = chr1:3644699-3644774
  misc_feature 1..75: note = hypo
  source 1..75: mol_type = genomic DNA
gcagagcccccctgccgtccccgcccttggtgccggtgtgaagaagcggcggcatggagacgaggacacgtacta

SEQ ID NO: 69401 - DNA, 167 bp, Homo sapiens
  misc_feature 1..167: note = chr1:36549703-36549870
  misc_feature 1..167: note = hyper
  source 1..167: mol_type = genomic DNA
cactggagctcagagcggggggcgcggagagcgaagcgggaaaggaggtaagggagctagggaagcgggggcgcccccttcctccgcgctggaccggggtactgatctaaaccaaaggcgatcatcctgcggaggggaagaaaggggtttgacggggaaccggactg

SEQ ID NO: 69402 - DNA, 252 bp, Homo sapiens; identical to SEQ ID NO: 38933
  misc_feature 1..252: note = chr1:36563342-36563594
  misc_feature 1..252: note = hypo
  source 1..252: mol_type = genomic DNA

SEQ ID NO: 69403 - DNA, 47 bp, Homo sapiens
  misc_feature 1..47: note = chr1:36591033-36591080
  misc_feature 1..47: note = hyper
  source 1..47: mol_type = genomic DNA
ggccgccggggagtccgcgcagcccctgccctcgaggggccacctgc

SEQ ID NO: 69404 - DNA, 15 bp, Homo sapiens
  misc_feature 1..15: note = chr1:3659628-3659643
  misc_feature 1..15: note = hypo
  source 1..15: mol_type = genomic DNA
tctctttagggaagc

SEQ ID NO: 69405 - DNA, 30 bp, Homo sapiens; identical to SEQ ID NO: 38806
  misc_feature 1..30: note = chr1:3661766-3661796
  misc_feature 1..30: note = hypo
  source 1..30: mol_type = genomic DNA

SEQ ID NO: 69406 - DNA, 30 bp, Homo sapiens
  misc_feature 1..30: note = chr1:3662534-3662564
  misc_feature 1..30: note = hypo
  source 1..30: mol_type = genomic DNA
ggtgttgcatcctcccgggcagacaagtcg

SEQ ID NO: 69407 - DNA, 98 bp, Homo sapiens
  misc_feature 1..98: note = chr1:3663195-3663293
  misc_feature 1..98: note = hyper
  source 1..98: mol_type = genomic DNA
ggtctccaccacagacgtgtccccagagtcactgtgctcaatcaggtgcttcaccaccaggtcggtgaactccgccgcgtagtcgtgtaaagccttct

SEQ ID NO: 69408 - DNA, 444 bp, Homo sapiens
  misc_feature 1..444: note = chr1:3663539-3663983
  misc_feature 1..444: note = hyper
  source 1..444: mol_type = genomic DNA
gtggtctccgaggggcggcggatgctcggagggggcggatcccttagggctgggggccaggacgatcccacccggagaagcctcgcgggcgagaagagggtcccttcctgcgggggcagatggaggcgcgggagccttccccgggaggtgaccgaggccagtcagcggccccggggacccaaggccggggactctcggcggccggtggacgggcagggccggcccgcctgggcaggcggcggggtgaaggtgtccagggcctgaggcggcaaagtgccgccgccgtcagccccgactgccacccaccaggcacccggcccatccccggctcccatctagggatccacacccgggcgccgcggcgccgcggtttaaagcctgtgagatcccgcaacaacccggatccggaagcgcggggtcgcggctgggcgagggcaggggtgg

SEQ ID NO: 69409 - DNA, 32 bp, Homo sapiens
  misc_feature 1..32: note = chr1:3664709-3664741
  misc_feature 1..32: note = hypo
  source 1..32: mol_type = genomic DNA
acacaccttgccccccgcgatggccagacttc

SEQ ID NO: 69410 - DNA, 30 bp, Homo sapiens
  misc_feature 1..30: note = chr1:36666375-36666405
  misc_feature 1..30: note = hypo
  source 1..30: mol_type = genomic DNA
gaactgggggctgagcgcagtggctcacac

SEQ ID NO: 69411 - DNA, 30 bp, Homo sapiens
  misc_feature 1..30: note = chr1:3673312-3673342
  misc_feature 1..30: note = hypo
  source 1..30: mol_type = genomic DNA
cagtaagagcatctgcgagttcgattactt

SEQ ID NO: 69412 - DNA, 22 bp, Homo sapiens
  misc_feature 1..22: note = chr1:36736011-36736033
  misc_feature 1..22: note = hypo
  source 1..22: mol_type = genomic DNA
aggcacacgcacacgcacgcat

SEQ ID NO: 69413 - DNA, 88 bp, Homo sapiens
  misc_feature 1..88: note = chr1:36762204-36762292
  misc_feature 1..88: note = hypo
  source 1..88: mol_type = genomic DNA
gatcctgttgatctccgccttgatattgaacgtcgtaaaaaacataaggagagagatcttaaacgaggtaaatcgagagaatcagtgg

SEQ ID NO: 69414 - DNA, 114 bp, Homo sapiens
  misc_feature 1..114: note = chr1:3678034-3678148
  misc_feature 1..114: note = hypo
  source 1..114: mol_type = genomic DNA
cggttgttttcaaagcgtccaaagctgctagtgacacacaggcccctggcaaacccccaggccccctggatcctatcaggtcctcactggaacgtggaccggttctcagggttc

SEQ ID NO: 69415 - DNA, 94 bp, Homo sapiens
  misc_feature 1..94: note = chr1:36789434-36789528
  misc_feature 1..94: note = hyper
  source 1..94: mol_type = genomic DNA
ctggagctctgcctgcgtgcgggccaagggctaaaccttggacaggttctttcacttactccgcctgacaaccctgcgacgtgataccattatc

SEQ ID NO: 69416 - DNA, 68 bp, Homo sapiens; identical to SEQ ID NO: 38808
  misc_feature 1..68: note = chr1:3680032-3680100
  misc_feature 1..68: note = hypo
  source 1..68: mol_type = genomic DNA

SEQ ID NO: 69417 - DNA, 55 bp, Homo sapiens
  misc_feature 1..55: note = chr1:3680304-3680359
  misc_feature 1..55: note = hypo
  source 1..55: mol_type = genomic DNA
caagaaacccagctgcgaaagatcaatacggaaaatgagacgctgcagaaggagc

SEQ ID NO: 69418 - DNA, 680 bp, Homo sapiens
  misc_feature 1..680: note = chr1:3683703-3684383
  misc_feature 1..680: note = hypo
  source 1..680: mol_type = genomic DNA
ccggccatcttttaggaaaaagtggatgggtgccacacatactcaggttgggcgaaatgaccccacctcttttttctccccggctgtccccagcaagtgtcggaactggagagaaagctcaccaagcgggactgtgtcatctcagagttggacaccaaggtcagccagctgcaggagcaggtggaactggaccagaaccacctgcagaggtggaagcagctgcaggaggatttgcagagcaagaaggagatgattcagcaggcagagcagcacacccgcgtggccctggagagctcccagtccagggtatgcccagcccttcctcctgagggtctgtcccagcagctggcggccgagcacccaggcctctgcccaccgcccaccgaggtagaaccggggtctgtgtacgctggggctcgggctggttctgccgtgtacaccagcatccacacagagttgacactcaagaaatgtgggtagaggacggagtgagagtgcaacagagtagcccggaaatgttcgtcaatggcagtggtgggcggagccccatgggcagggctgcgggtcttgggttgcattgtgaaggggttggatcactggctggaaaggaggagggcacctggatagggaggcatggtgttgcccccctcatctctgagtcatagcgtgcttgctggacc

SEQ ID NO: 69419 - DNA, 30 bp, Homo sapiens
  misc_feature 1..30: note = chr1:3693714-3693744
  misc_feature 1..30: note = hypo
  source 1..30: mol_type = genomic DNA
ggagggctgaggctgcgcctgccccaggcc

SEQ ID NO: 69420 - DNA, 20 bp, Homo sapiens
  misc_feature 1..20: note = chr1:36966967-36966987
  misc_feature 1..20: note = hypo
  source 1..20: mol_type = genomic DNA
ctggccgattagcactgttt

SEQ ID NO: 69421 - DNA, 30 bp, Homo sapiens
  misc_feature 1..30: note = chr1:3701022-3701052
  misc_feature 1..30: note = hypo
  source 1..30: mol_type = genomic DNA
cagcccaggacagcacgacacagcaactca

SEQ ID NO: 69422 - DNA, 35 bp, Homo sapiens
  misc_feature 1..35: note = chr1:3706065-3706100
  misc_feature 1..35: note = hypo
  source 1..35: mol_type = genomic DNA
cgggcggggccccaccggggcgcccagagcagcca

SEQ ID NO: 69423 - DNA, 30 bp, Homo sapiens
  misc_feature 1..30: note = chr1:3714226-3714256
  misc_feature 1..30: note = hypo
  source 1..30: mol_type = genomic DNA
gcatgccaccgtggccggttaatttttata

SEQ ID NO: 69424 - DNA, 180 bp, Homo sapiens; identical to SEQ ID NO: 38934
  misc_feature 1..180: note = chr1:37148125-37148305
  misc_feature 1..180: note = hypo
  source 1..180: mol_type = genomic DNA

SEQ ID NO: 69425 - DNA, 30 bp, Homo sapiens; identical to SEQ ID NO: 38935
  misc_feature 1..30: note = chr1:37227648-37227678
  misc_feature 1..30: note = hypo
  source 1..30: mol_type = genomic DNA

SEQ ID NO: 69426 - DNA, 206 bp, Homo sapiens
  misc_feature 1..206: note = chr1:37498362-37498568
  misc_feature 1..206: note = hyper
  source 1..206: mol_type = genomic DNA
gtgttcaagagggtccggctcccgggcggccgcccaggaggagacccacccgctgggtttctgaccgcctcctaggaaaatctcaagtacggaaaccaagcccgacaccggttccggcacctctttcacgccgctggcagcccaaggtccgccctgaagaagagctgtagaggaggaaggtggccctggctcggcggagtccggct

SEQ ID NO: 69427 - DNA, 248 bp, Homo sapiens
  misc_feature 1..248: note = chr1:37498597-37498845
  misc_feature 1..248: note = hyper
  source 1..248: mol_type = genomic DNA
cgagtgaacccaggcggcccaggtgtccggcctggtggcgggcgcagggcctgcggtgatggaggctccgtcttagcccggccaggcccagccctgccggtcgtcggcccgggacatgcgcggcgctcaggcctgcagggtgccttgggcggccacaacaaagttaaagaccggagtaagagtctccggcgagaagagacgcggagaagccggagccccggaaagccgcgcgcagccccgccagccgc

SEQ ID NO: 69428 - DNA, 795 bp, Homo sapiens; identical to SEQ ID NO: 26194
  misc_feature 1..795: note = chr1:37498888-37499683
  misc_feature 1..795: note = hyper
  source 1..795: mol_type = genomic DNA

SEQ ID NO: 69429 - DNA, 428 bp, Homo sapiens; identical to SEQ ID NO: 26195
  misc_feature 1..428: note = chr1:37500013-37500441
  misc_feature 1..428: note = hyper
  source 1..428: mol_type = genomic DNA

SEQ ID NO: 69430 - DNA, 133 bp, Homo sapiens; identical to SEQ ID NO: 26196
  misc_feature 1..133: note = chr1:37500442-37500575
  misc_feature 1..133: note = hyper
  source 1..133: mol_type = genomic DNA

SEQ ID NO: 69431 - DNA, 430 bp, Homo sapiens
  misc_feature 1..430: note = chr1:37500602-37501032
  misc_feature 1..430: note = hyper
  source 1..430: mol_type = genomic DNA
cgggagactgacccgggaaccggcttccctccccaaccccattcctcctggcagcagagttggggctgggggttcggagaggcagaattcaaagcgaattgtctacgctgggccaggggagctgagggagttggtagaggtgggagagcccaagtcagaccccctgctgtgggaagctggacttgaccgcgcacaggtcctggggctgcggaggaggaagaccgctcacgccttagatgtaggggggcgtgggcgccgggcccgctccctctcagccctctcccgtaactgtgcaggaagggctggtgccccctccctcattctcctgagaaagaataaagagaaactgtaatttgtcgtgggatggagtaggatccgtgggggagcaagctaaaggggttaaaaagaaaaacaacgttgtttattagca

SEQ ID NO: 69432 - DNA, 30 bp, Homo sapiens
  misc_feature 1..30: note = chr1:37501855-37501885
  misc_feature 1..30: note = hyper
  source 1..30: mol_type = genomic DNA
ccccttccttggggacgcacacccctcccc

SEQ ID NO: 69433 - DNA, 192 bp, Homo sapiens
  misc_feature 1..192: note = chr1:37549296-37549488
  misc_feature 1..192: note = hypo
  source 1..192: mol_type = genomic DNA
gttaggttaaggcagcgtcaacaaccaactgtgtgggaagcaaagaagaaaagagagaaaaaaaccaagtacaaccgaagctttattcattgtccgggctatttagcaggaggagttgaaaagaaagtagttagctgttagaggaaaaaatggaaaactctggtccctcattaatctcgctgccctccatgt

SEQ ID NO: 69434 - DNA, 107 bp, Homo sapiens
  misc_feature 1..107: note = chr1:37721088-37721195
  misc_feature 1..107: note = hyper
  source 1..107: mol_type = genomic DNA
ggcctgcattccagccgcccaaaggagccattttcgggcgaagccaggggcccacgtgggagggagctccaggagagatcagtctctgctggcgtggagggggcggg

SEQ ID NO: 69435 - DNA, 192 bp, Homo sapiens
  misc_feature 1..192: note = chr1:3786388-3786580
  misc_feature 1..192: note = hypo
  source 1..192: mol_type = genomic DNA
acagcccgcctggggcgaggcgggtggggaccttcagcccttgccctgcctgggcaaagccttgtgaagaggtacagccctcacattcccagggagggcggcagtgtctcagccagtgcctctcaagctgcagtgcacacaggaatccctggggagcttgcagagggctgcagggcccgccccagggcttgt

SEQ ID NO: 69436 - DNA, 26 bp, Homo sapiens
  misc_feature 1..26: note = chr1:37899676-37899702
  misc_feature 1..26: note = hypo
  source 1..26: mol_type = genomic DNA
gcgtgagacaccgcacctggccaggg

SEQ ID NO: 69437 - DNA, 30 bp, Homo sapiens
  misc_feature 1..30: note = chr1:38099986-38100016
  misc_feature 1..30: note = hyper
  source 1..30: mol_type = genomic DNA
ggatggaggggagttcgaggggaagaggct

SEQ ID NO: 69438 - DNA, 30 bp, Homo sapiens
  misc_feature 1..30: note = chr1:38100242-38100272
  misc_feature 1..30: note = hyper
  source 1..30: mol_type = genomic DNA
tgctgccagtcgcgacgggggcaggcccgg

SEQ ID NO: 69439 - DNA, 33 bp, Homo sapiens; identical to SEQ ID NO: 26198
  misc_feature 1..33: note = chr1:38100650-38100683
  misc_feature 1..33: note = hyper
  source 1..33: mol_type = genomic DNA

SEQ ID NO: 69440 - DNA, 30 bp, Homo sapiens; identical to SEQ ID NO: 38936
  misc_feature 1..30: note = chr1:38207058-38207088
  misc_feature 1..30: note = hypo
  source 1..30: mol_type = genomic DNA

SEQ ID NO: 69441 - DNA, 481 bp, Homo sapiens
  misc_feature 1..481: note = chr1:38219523-38220004
  misc_feature 1..481: note = hyper
  source 1..481: mol_type = genomic DNA
tggcagcatggggaccgaaccgatggtgcgaaggtcgggagcccccctttcggctggagggtaggcagggtgaggagagggcagcggaggggcgctctcctcagtgatctgccaggcatcctaaccccatcctccgtctggactctcgcagttgtcctggttcttctcatcaaaggccccggcccccagggcgcgtccaggctccgctcccccgtacgccgccttccggggcgctggcccccatatccgcccacgtgcgccccagtgcggagaccctgccctcaccaccacctggatcaggccttccttcttggccactcccaccccccaccctccgcagtgcagcctggaggggggactcacgggtgcaggaagccgagggcgggtcggtgggtgagcgcgcatagctgtcctggcacacgcagaaggtggaggcgttttccagggcccggctgtgctctgggcacggtgagcagagggg

SEQ ID NO: 69442 - DNA, 358 bp, Homo sapiens
  misc_feature 1..358: note = chr1:38229885-38230243
  misc_feature 1..358: note = hyper
  source 1..358: mol_type = genomic DNA
caactgacagcacatcggaatcgcgaactggaaggcatcagccatccagggcccagaccaaccccgcggtcaacgcctcagattccagctcctccggattctgcacctagatatgacgcctctggattcaactgagcgtatagctcccctaaatgcacaatcagaggcaagacgcgggctccagtatcgccgacagcctcaaacccggcaacgcggagcgcgcccggcagactacgctcagaattcagcactgcggacagttccatgatcagcacgtcgggcagcgcccggatccagccccctcgaccagcattccaccttctgttggccacactgtggtctcctagcccctgtagtc

SEQ ID NO: 69443 - DNA, 566 bp, Homo sapiens
  misc_feature 1..566: note = chr1:38230282-38230848
  misc_feature 1..566: note = hyper
  source 1..566: mol_type = genomic DNA
cgcatctccctgtctccactcttcatctccccgcccccgcacctcccacctccaatcactcagcttgtccgtctcaccggccgctggaccgccgcctctggctcccgcggttcctggcctctttctttcccaacctcccgggtctccagcccccaagctcctcagcgcccctctcttcgctactgcttgatcacatttttctctgtctctccagttctttgctgcctgcttgcttcaagccccaatacagactctagtctctccaatgactccttcccccagaacccccatcgccagccccctatcttttggtatgccacgctccgagcagagctcaccagtcttctcaccttcctcggcggtcccaggccgccagggtcccaaaagcagcgcgagacagagctgcatccggcagaggaagaggcgcagcgggtgtggaccggcgcaggtctccatggtccgcagaccgagctgtcagtccggcggcggctcaagccgcgccagcctagcaccgctgagcaatgcccccagaccccagagccagcggggggcggagtctcaccgct

SEQ ID NO: 69444 - DNA, 99 bp, Homo sapiens
  misc_feature 1..99: note = chr1:38342587-38342686
  misc_feature 1..99: note = hypo
  source 1..99: mol_type = genomic DNA
acaggcatgcctgtaatcctacctactgaggaggctgatgtatgtgggaggattgcttaagcccagcagattgaggccgcagttcgctgtgactgtgcc

SEQ ID NO: 69445 - DNA, 87 bp, Homo sapiens; identical to SEQ ID NO: 38937
  misc_feature 1..87: note = chr1:38398355-38398442
  misc_feature 1..87: note = hypo
  source 1..87: mol_type = genomic DNA

SEQ ID NO: 69446 - DNA, 85 bp, Homo sapiens
  misc_feature 1..85: note = chr1:38456465-38456550
  misc_feature 1..85: note = hypo
  source 1..85: mol_type = genomic DNA
attcacgtgtagaaacgacttgtctatcggcagcgaatatgttaaataaaatactgtgcatccaacgagatcaggagattgagac

SEQ ID NO: 69447 - DNA, 36 bp, Homo sapiens
  misc_feature 1..36: note = chr1:38493396-38493432
  misc_feature 1..36: note = hypo
  source 1..36: mol_type = genomic DNA
ggccagagggaagaacgtctccgctgcttctcaggc

SEQ ID NO: 69448 - DNA, 676 bp, Homo sapiens
  misc_feature 1..676: note = chr1:38510058-38510734
  misc_feature 1..676: note = hyper
  source 1..676: mol_type = genomic DNA
aacttttccaagtttcgtttggtgtggccaggagggcagggccccgcggggagcaggggccgcgctatgcggcggtcggtctgcagcagggcagaagccccttcccgtctgggtgtgtgggagcgcagacccctccggcgtggccgggaaccaagccggggctcggatgaaacgaaacgaaaaatgaacactcgaattttttttgttagttttttttttttttttttgcttttttttggggggagggtagggtagggaaatataaggggaaaaataaattaggctagattaaagctttggctatttcctgcttttatacacagacgcggctctcgcgacctcccctccggggccccgataaatacagtatactgcgatttaaattaagggcgcgggcggagttagaaggaccccaggagccgagaggctccacgaataaataaaaaccgtaaaaaaccaagcccggagaaaggggaaagcggggtggggcgcatccttataggagagaagaggcgtgtagcgaataaagtgacagccccccaccctggacccgcaggctcaggagtccacgcggggagaggggatggagaactctcctcgcttcgtcctctctcccggggaatccctaaccccgcactgcgttacctgtcgctttggggaggccgctgccgggatc

SEQ ID NO: 69449 - DNA, 160 bp, Homo sapiens; identical to SEQ ID NO: 24
  misc_feature 1..160: note = chr1:38510773-38510933
  misc_feature 1..160: note = hyper
  source 1..160: mol_type = genomic DNA

SEQ ID NO: 69450 - DNA, 866 bp, Homo sapiens; identical to SEQ ID NO: 25
  misc_feature 1..866: note = chr1:38510934-38511800
  misc_feature 1..866: note = hyper
  source 1..866: mol_type = genomic DNA

SEQ ID NO: 69451 - DNA, 293 bp, Homo sapiens; identical to SEQ ID NO: 26207
  misc_feature 1..293: note = chr1:38511821-38512114
  misc_feature 1..293: note = hyper
  source 1..293: mol_type = genomic DNA

SEQ ID NO: 69452 - DNA, 353 bp, Homo sapiens
  misc_feature 1..353: note = chr1:38512126-38512479
  misc_feature 1..353: note = hyper
  source 1..353: mol_type = genomic DNA
cgcctgccttgccgtgttctaggtgcgggccgccggcccaatcgccgccgccgcctcctcccgtgggtagccactgggggtgcgctaggcccacggggtggcccgcgcccgcgcccagccactcgtggtgcatcagcttctgcacttcgcggtacgcggcccctgcatgcaatcgctccgcggccgccgccgccgccgccgccgccgcggcgtccgggtgcataagcggcccggtgcccccggctccgccaccggggccccgcggcaggtactgcgcggtggtggccatgccgccccgcgccctgcgccgcgccgccgccgccgctccgctccgtctgcgggccccgccgcct

SEQ ID NO: 69453 - DNA, 90 bp, Homo sapiens
  misc_feature 1..90: note = chr1:38513064-38513154
  misc_feature 1..90: note = hyper
  source 1..90: mol_type = genomic DNA
tcaccgcgcccgcctcgcctcccgcggctgccagcgtgcactgggcgctcctcggcgcgtctgcccggcccgtctcggctttccttctcc

SEQ ID NO: 69454 - DNA, 111 bp, Homo sapiens
  misc_feature 1..111: note = chr1:38599710-38599821
  misc_feature 1..111: note = hyper
  source 1..111: mol_type = genomic DNA
cggagggcccagggccggggtgggggcctcgcggggttggggggactgcctatcttctcccggagcagctggggccggccacacagaaccccctctcggctcccctgcccc

SEQ ID NO: 69455 - DNA, 30 bp, Homo sapiens
  misc_feature 1..30: note = chr1:38673189-38673219
  misc_feature 1..30: note = hypo
  source 1..30: mol_type = genomic DNA
ggagggagacaggctcgggcccattcgctg

SEQ ID NO: 69456 - DNA, 88 bp, Homo sapiens
  misc_feature 1..88: note = chr1:38953066-38953154
  misc_feature 1..88: note = hypo
  source 1..88: mol_type = genomic DNA
tacaacttacagttgcgtcaatacaggatggagctccccagacggtgctggctgttgagtgctgcagcgagtgcgatattggcccttt

SEQ ID NO: 69457 - DNA, 20 bp, Homo sapiens
  misc_feature 1..20: note = chr1:39025499-39025519
  misc_feature 1..20: note = hyper
  source 1..20: mol_type = genomic DNA
cggggcggggcggggggcga

SEQ ID NO: 69458 - DNA, 15 bp, Homo sapiens
  misc_feature 1..15: note = chr1:39044044-39044059
  misc_feature 1..15: note = hyper
  source 1..15: mol_type = genomic DNA
aacttaagaggggag

SEQ ID NO: 69459 - DNA, 101 bp, Homo sapiens
  misc_feature 1..101: note = chr1:39044095-39044196
  misc_feature 1..101: note = hyper
  source 1..101: mol_type = genomic DNA
cggcggcggcgagagcgggcgggggacacggggaccgggagacgcgatccggagagcggtgggaagtattcgcctccgttcctcaaacacaggatgcgagc

SEQ ID NO: 69460 - DNA, 269 bp, Homo sapiens
  misc_feature 1..269: note = chr1:39044197-39044466
  misc_feature 1..269: note = hyper
  source 1..269: mol_type = genomic DNA
ccctttggagaagtcgcgctcggcggaaacgctaactccccggccaagtgcaaatgtaaagaggccctgagagcactttgtgcaaatatcaggccgggaagtgctgcgcccgcggagctgccgggcacctcggcgcccccgcgccctcggctgcgcgctaattcactttgccgtcacctctcgggcggggtcgggcgggcgcgggcagccggagcgcgcagagggcgcagagcgcctcgcagggccaggggccgcggccctgcctaatg

SEQ ID NO: 69461 - DNA, 30 bp, Homo sapiens
  misc_feature 1..30: note = chr1:39061965-39061995
  misc_feature 1..30: note = hypo
  source 1..30: mol_type = genomic DNA
gaaagaggacaagtacggggtcagaaagac

SEQ ID NO: 69462 - DNA, 151 bp, Homo sapiens
  misc_feature 1..151: note = chr1:39075192-39075343
  misc_feature 1..151: note = hypo
  source 1..151: mol_type = genomic DNA
gtgggtggctctcagcggaaagggaagctggaaaggggataggaaagtgatctttccctgaagccacaccatctgaagtcatcagcatctatccatagtctccgatgctcagttgcttttatgctcaccgctcagccgcttgtatcctcaa

SEQ ID NO: 69463 - DNA, 550 bp, Homo sapiens
  misc_feature 1..550: note = chr1:39269643-39270193
  misc_feature 1..550: note = hyper
  source 1..550: mol_type = genomic DNA
ccgactagcattgatcgctttttgatcttaaaagaaatactttttaattcgaaagttaatagaaatgcggagtcaggggcaggcctcggcggcgtccgggctgggggcgaggcgcccacgccccaccctcccgctgtggccgctggcgccggcccgagcgcgcgcagcccggtgcgcttcggcgcccgctgagcccgcgaacctctccgccgcgccatcagcgcagccatcagccgcgccgcgtgctgtcccgcgccccgctgctcgcggccgcgggccaccggcggtaataatgaggcacagcgccatgaccgcggccctcggctgcgccgccggcagcagcgcgggcgccgcattagcatctccgaagccttcctgtgtgttcttttgtgctcattttccagcccgaatgctcggcacatcccggaccgcggacggagccgcaggagccaccgcggccgaacgtagctgccctggttttagaaagagctgcgggctgcgggcccggctgtccccgagacctctgcctcccgcacggcccagccagatc

SEQ ID NO: 69464 - DNA, 156 bp, Homo sapiens
  misc_feature 1..156: note = chr1:39284433-39284589
  misc_feature 1..156: note = hyper
  source 1..156: mol_type = genomic DNA
tgctaatgatttattcgtgctcaaacgccgggggctgcgtcgccgcttttgaagacagctccaagcgtggctttccaggaaggcaggcctccccgcggcgccttccagggctccccggggcctcctccctggccgcgggtccgggctgggggacag

SEQ ID NO: 69465 - DNA, 31 bp, Homo sapiens
  misc_feature 1..31: note = chr1:39345389-39345420
  misc_feature 1..31: note = hypo
  source 1..31: mol_type = genomic DNA
tctgttttttttgttcgtttgttttctgaga

SEQ ID NO: 69466 - DNA, 142 bp, Homo sapiens
  misc_feature 1..142: note = chr1:39416821-39416963
  misc_feature 1..142: note = hypo
  source 1..142: mol_type = genomic DNA
tgctgtatatcataacgctgccttataaaatcacagcacatgtcagcgtcatgaagtctctaaccttctaagaagtccttcaacaaacaagtctgttcaatgttgcttcacctagcacttcccaaacttgtctgacttcttt

SEQ ID NO: 69467 - DNA, 32 bp, Homo sapiens
  misc_feature 1..32: note = chr1:39547658-39547690
  misc_feature 1..32: note = hyper
  source 1..32: mol_type = genomic DNA
gcgcgcggacccacccgcgccgccccaggctc

SEQ ID NO: 69468 - DNA, 34 bp, Homo sapiens
  misc_feature 1..34: note = chr1:40025741-40025775
  misc_feature 1..34: note = hypo
  source 1..34: mol_type = genomic DNA
gttagccactgtgcccagccgaggtgacaccaga

SEQ ID NO: 69469 - DNA, 696 bp, Homo sapiens
  misc_feature 1..696: note = chr1:40105024-40105720
  misc_feature 1..696: note = hyper
  source 1..696: mol_type = genomic DNA
caggatccaggcactcgtgcgtgtaacggcacggcccgcacacgccccctacgccgacacctgtggcccccgcgctcacctgcctctgcccaggcggtgctggagggctggcccgcctgctcggcgagcccgtcgggccgacccccaccccgctcgccctccgcctgctcggtccccgcatcccggcccttacctcagctggccctcttggcccacgtcgatgggtccgtcggactccccgtcggagccgctcggctccttgggtcgcttcatggcgaacgcaggctgcctggtctcagccccgcggctaaggctcccagtcgggaagtcaggccccgccccggccccgccccggccccgcctcgggggcgccgccaccgccctttcccagggccctttcctgcgccgcagctccgggcgcccaggcgccccctcgcccccgcggtgacgcgccgccgagccgtgggaaggccctaggcggtcgccgccttcatcgacggctgggaggtccggctctgctccgctgtctcggctgccgcgcgctgggtggccttgggcaggtgccctgggaggccccgcggggaagccaggagtccccgtctgtccctgggtcgcctgggcgctgctggcctgtagaggcgccgcttcgatgcccgggattccgcaagggtcaaccctgcgcgctcctgcctcctg

SEQ ID NO: 69470 - DNA, 47 bp, Homo sapiens
  misc_feature 1..47: note = chr1:40136996-40137043
  misc_feature 1..47: note = hyper
  source 1..47: mol_type = genomic DNA
gcctgcggccaggggcgccgatcgccccccagcgcagagtgtggatc

SEQ ID NO: 69471 - DNA, 47 bp, Homo sapiens
  misc_feature 1..47: note = chr1:40137560-40137607
  misc_feature 1..47: note = hyper
  source 1..47: mol_type = genomic DNA
gtgcattgcttttaccgatttgggtttcttcttgggcgcgaggttgt

SEQ ID NO: 69472 - DNA, 355 bp, Homo sapiens
  misc_feature 1..355: note = chr1:40137646-40138001
  misc_feature 1..355: note = hyper
  source 1..355: mol_type = genomic DNA
cggtctccgctcctggcccgggctcgcggggctcctggggctcccggggctgcccaggttccatgctccggctctgacccggcccggccagagcaggcggcggcgtagacgcggaggtggctggggctgggctgcaggagggaggcgagtcccggcgagggaagggggcgggcagcggcgaggaggctgtgcgtgtgagctgggctccccgcccgccgggcggggggaggtcacactggccctctcggtcgcccgtgtgtcgctgccgctgctgctgctactgctgtacggtatgagggatagctgggctctccttccccgaccgacccacgccagcagccggttgggtggtgag

SEQ ID NO: 69473 - DNA, 581 bp, Homo sapiens
  misc_feature 1..581: note = chr1:40157602-40158183
  misc_feature 1..581: note = hyper
  source 1..581: mol_type = genomic DNA
cagtccacatctctgcgtcccccctccccacgcatccactcccctcacgccgtggggcagagaggagggtgctggttgcgcgcggagagcgcggtatgggtggcgaagtcccagcctctacctagccccgcgctagtcgtgggttccctccagccacccctctggcccttcattccggtccctccccagacgggccctcctcctttctcatggacccccaagaggcctctcgcgttctcccccgaaggacccctatgcctagccatggatcctccattccccaccctcccgttttcccgtcccgcagacggagccggtccccagccgccgccagtctccggcctcggatgttgacacaaacccgaggcggtttacactgagcgggtctggaagctttcagggccccggcaacacctcctccccgcacttgggggtctccccacagcccgggccggccgcctgggctgcactggcgtctgagagctcctgacacaaggctgtgggaaggaacccttttaagccaaactgggggcaaaaggggagccagacatccccgggctgggccacgtgcggggcaggga

SEQ ID NO: 69474 - DNA, 140 bp, Homo sapiens
  misc_feature 1..140: note = chr1:40204314-40204454
  misc_feature 1..140: note = hyper
  source 1..140: mol_type = genomic DNA
tttgcccataataatcgggttgattcggccaaggtttccctcccccaacacggtgcgcactgggaagcgcgaggaccacgtcccttggtttaccactgcgcacctcacaaggcgcccagtgcatccgggtagcgggatgc

SEQ ID NO: 69475 - DNA, 181 bp, Homo sapiens
  misc_feature 1..181: note = chr1:40236124-40236305
  misc_feature 1..181: note = hyper
  source 1..181: mol_type = genomic DNA
cgatctacataaatgttaggaacgtggatgtcttctggggggaaagcccccacctccacgatctcttccacctccaccgccgtgacgtctgcagctttgcacatgggcacgttgaaattgcgggcgcttctcctgaagaccacgtttcctgcccggtcggccttccaccctttcaccaggg

SEQ ID NO: 69476 - DNA, 144 bp, Homo sapiens; identical to SEQ ID NO: 26221
  misc_feature 1..144: note = chr1:40237059-40237203
  misc_feature 1..144: note = hyper
  source 1..144: mol_type = genomic DNA

SEQ ID NO: 69477 - DNA, 140 bp, Homo sapiens
  misc_feature 1..140: note = chr1:40254091-40254231
  misc_feature 1..140: note = hyper
  source 1..140: mol_type = genomic DNA
gccgcccccgcccagcgcgcatagcgccaggcccaggagccagagcgggccggggagcgcggtcatggcaggccgggggcgctcagctggggcgctcagcgggcgcgcatcggctccgcggccgacccagggcctgggga

SEQ ID NO: 69478 - DNA, 70 bp, Homo sapiens
  misc_feature 1..70: note = chr1:40254279-40254349
  misc_feature 1..70: note = hyper
  source 1..70: mol_type = genomic DNA
cggggcgggacgggcggcgaccgcggcctcagcgcggtccctggagcgcccgccgcgcgacacctgtcct

SEQ ID NO: 69479 - DNA, 85 bp, Homo sapiens
  misc_feature 1..85: note = chr1:40349616-40349701
  misc_feature 1..85: note = hypo
  source 1..85: mol_type = genomic DNA
caggcatgcgccactgcgccagaccacctgccgtcttaaatggtagatggcaaccctatctaaatagatccgtccctattattct

SEQ ID NO: 69480 - DNA, 23 bp, Homo sapiens
  misc_feature 1..23: note = chr1:40350021-40350044
  misc_feature 1..23: note = hypo
  source 1..23: mol_type = genomic DNA
agcaaacctttggcccggcacag

SEQ ID NO: 69481 - DNA, 24 bp, Homo sapiens
  misc_feature 1..24: note = chr1:40409694-40409718
  misc_feature 1..24: note = hypo
  source 1..24: mol_type = genomic DNA
accaggcaatataggcgtattcat

SEQ ID NO: 69482 - DNA, 27 bp, Homo sapiens
  misc_feature 1..27: note = chr1:40573661-40573688
  misc_feature 1..27: note = hypo
  source 1..27: mol_type = genomic DNA
agactttttttttttcgagacggaatt

SEQ ID NO: 69483 - DNA, 37 bp, Homo sapiens
  misc_feature 1..37: note = chr1:4066154-4066191
  misc_feature 1..37: note = hypo
  source 1..37: mol_type = genomic DNA
tgggattacaggagtgagccaccgctcctggcctgcc

SEQ ID NO: 69484 - DNA, 30 bp, Homo sapiens
  misc_feature 1..30: note = chr1:40722325-40722355
  misc_feature 1..30: note = hypo
  source 1..30: mol_type = genomic DNA
tggatcaaaatgacacgattgcaaatattg

SEQ ID NO: 69485 - DNA, 1008 bp, Homo sapiens
  misc_feature 1..1008: note = chr1:40781208-40782216
  misc_feature 1..1008: note = hyper
  source 1..1008: mol_type = genomic DNA
ttctcctttgtctgccgcctccctcccgccctggtctcaggttagagacttacgtcgatgccgtcggatccaggcactcccggcggtcccgggggacccggggggccccgctctcccggtggacctctctgaaaaacacacacggggtggggcagtcctcagacagtgcaggaagctgggcgtccccggggctgcaagcgaccctgggagcggggtcctaggggcgcagctcttccgcgaactcccacgtattgagaatcttctgtatagcaggcactgtgtgccattacatgcattcattatcttacagaatactcagaaccgggaggcgggcgctattacgggccccagtttgcagtcgaagaaactggctcagaacgtgaagggtccatggtcactgagagtgggcggcggcgccaggagtccgccctggatctgcccgactccttccactgtgccagtttgcccttgcgcggtcgcggtggggaatagatggagacgtggacagctcaaataaatcacagatggaatgtaaggttgtgcctagcaggctgccggccctcagtgagcggtggctcgggttgttgttcttacgtgaacgacaggcagagacagcgcctcctcctctccccatggtgcgggaaaacccgacgggaaagtgggggaggcgcagagaaaggaggtgtagggaggtgaagcgggtactatcttcccactcggagcgccccttcggcagcacagctgcccggtcctccctctgctaagccctgactgctgcaggggagcaggaggagccggcacctcccagaaagcagaccctctctctggatcccgtttgcctgcaattcaatgcccctgggtgggtgtgaggtttcagggaggtcacaagtcatatcaagatgaggcgagctcacagctggagagtctccatcctgctgcccatctctgaacagatcagagatcttaaaaggcggcccttttaagaggccagctcggacccaggcaggg

SEQ ID NO: 69486 - DNA, 234 bp, Homo sapiens
  misc_feature 1..234: note = chr1:40782674-40782908
  misc_feature 1..234: note = hyper
  source 1..234: mol_type = genomic DNA
cctcaggtggcctctcgggctaggggtgtcagtaggcgcgggacacaggcagagctcctccatcccggactccagaccccgcaccctggaccctggcagcggaggggctgcgaaacttacaatctgcgccagagcgagcactaccacctggaggagaacaaggaggctgcggggggaggccgtagcggcggccatggctggcggcgagaccaagggggacgggtgcgtgtccgc

SEQ ID NO: 69487 - DNA, 193 bp, Homo sapiens; identical to SEQ ID NO: 38813
  misc_feature 1..193: note = chr1:4082814-4083007
  misc_feature 1..193: note = hypo
  source 1..193: mol_type = genomic DNA

SEQ ID NO: 69488 - DNA, 138 bp, Homo sapiens; identical to SEQ ID NO: 38945
  misc_feature 1..138: note = chr1:40905029-40905167
  misc_feature 1..138: note = hypo
  source 1..138: mol_type = genomic DNA

SEQ ID NO: 69489 - DNA, 32 bp, Homo sapiens
  misc_feature 1..32: note = chr1:40974460-40974492
  misc_feature 1..32: note = hyper
  source 1..32: mol_type = genomic DNA
agtccgctccggcagcgcgctctgcccggctt

SEQ ID NO: 69490 - DNA, 151 bp, Homo sapiens; identical to SEQ ID NO: 14198
  misc_feature 1..151: note = chr1:4111083-4111234
  misc_feature 1..151: note = hypo
  source 1..151: mol_type = genomic DNA

SEQ ID NO: 69491 - DNA, 30 bp, Homo sapiens
  misc_feature 1..30: note = chr1:4111541-4111571
  misc_feature 1..30: note = hypo
  source 1..30: mol_type = genomic DNA
gggagcagggagttccgcagacggcaggtg

SEQ ID NO: 69492 - DNA, 17 bp, Homo sapiens
  misc_feature 1..17: note = chr1:41117054-41117071
  misc_feature 1..17: note = hypo
  source 1..17: mol_type = genomic DNA
gccaggggaggggcacg

SEQ ID NO: 69493 - DNA, 17 bp, Homo sapiens
  misc_feature 1..17: note = chr1:41117191-41117208
  misc_feature 1..17: note = hypo
  source 1..17: mol_type = genomic DNA
ggcgctttattgcagct

SEQ ID NO: 69494 - DNA, 196 bp, Homo sapiens
  misc_feature 1..196: note = chr1:41267850-41268046
  misc_feature 1..196: note = hyper
  source 1..196: mol_type = genomic DNA
ttacttgaggtcacacgtgaaactacctactccaagagccctttaggatggtgctgtgaggtggaagggcgaggccgaggcggcggtggcgtcgcgtcccccctctccgcccctggcctcggggacgcggcggcaccttcacactttccgcttggcccgctgctcgcctttcaggccgccgcgttttcaattgtta

SEQ ID NO: 69495 - DNA, 611 bp, Homo sapiens
  misc_feature 1..611: note = chr1:41284141-41284752
  misc_feature 1..611: note = hyper
  source 1..611: mol_type = genomic DNA
ggctggctgtgatctcgccgcccccgcccctgcagacttcatcgtgttcgtggcctcggtggccgtcatcgccgcgggtacccagggcaacatcttcgccacgtccgcgctgcgcagcatgcgcttcctgcagatcctgcgcatggtgcgcatggaccgccgcggcggcacctggaagctgctgggctcagtggtctacgcgcatagcaaggtgaggcctgcaagccgcgcgcggagacccgagggcgtgtctggggcacgaccagagcgggcagggcggagagggcgaggtcagaggggctgtctccgtgctgggaaggggtgtggcctgcgggggttggagccctagcaggaggcgaggtctaagcgggtggggcgaagtggattctgaattaggtaggggcgggcctaggagtccggaccggatcagggggcggggccggagaggcggggcttgagggtttcccctggatgcttctgggtttgaagggaccactcgtaccacaaagtgggcagctgaggtgggacttgagggtggggctggagcggggctagggtgggccccaggtggaagcctgaaagtgggacttgggggacggggcaaggtaggc

SEQ ID NO: 69496 - DNA, 95 bp, Homo sapiens
  misc_feature 1..95: note = chr1:41288701-41288796
  misc_feature 1..95: note = hypo
  source 1..95: mol_type = genomic DNA
ccatggagcccagctcggtcccacgggcaggcgggcatcaagcttgtggctggggcaggatgctgtgctcagcgcttctgcgggtgccttttttg

SEQ ID NO: 69497 - DNA, 90 bp, Homo sapiens
  misc_feature 1..90: note = chr1:41326990-41327080
  misc_feature 1..90: note = hyper
  source 1..90: mol_type = genomic DNA
aagctgaagctggtccggtctctttcactttacggccgaggctggggtcagagaagtgaagccaaactgtcctcccgcaggaggcaaggc

SEQ ID NO: 69498 - DNA, 211 bp, Homo sapiens
  misc_feature 1..211: note = chr1:41327843-41328054
  misc_feature 1..211: note = hyper
  source 1..211: mol_type = genomic DNA
gccggctcccccggcccgggccagcggctgctctgcggcgggagacccgggcaccgtgcggtccctgcagctcggccgggcggagcaaaaccaaacccgactggtgccccggcccagcccactactgcgcaccttgcggccgcagcctggggtcacaaaggcccgcaacctgtagtgctccgaaacctccgcgtcgcgtagctgggctcgg

SEQ ID NO: 69499 - DNA, 61 bp, Homo sapiens
  misc_feature 1..61: note = chr1:41350136-41350197
  misc_feature 1..61: note = hyper
  source 1..61: mol_type = genomic DNA
cgcgctcaccaccaccgcggaggccgggctgtaattaggataattgcgctgctcccagcct

SEQ ID NO: 69500 - DNA, 136 bp, Homo sapiens
  misc_feature 1..136: note = chr1:41444838-41444974
  misc_feature 1..136: note = hyper
  source 1..136: mol_type = genomic DNA
tcggtgctcagggagcgatagctagatgaaaccgtacttttcgggatcctagtccatccaaagcagccgccttcggggcaggtgtggggaggagggaggccgacgaggagccaacgccgcgcgaccctccgcactt

SEQ ID NO: 69501 - DNA, 36 bp, Homo sapiens
  misc_feature 1..36: note = chr1:41451976-41452012
  misc_feature 1..36: note = hypo
  source 1..36: mol_type = genomic DNA
ggaggcgcagggctacgaaggcgtggttggtccggg

SEQ ID NO: 69502 - DNA, 116 bp, Homo sapiens
  misc_feature 1..116: note = chr1:41486048-41486164
  misc_feature 1..116: note = hypo
  source 1..116: mol_type = genomic DNA
agtgcataggccttccgcggccgcctcaccacttcaatgtgctcccgcgccaccggcatctccagccgctccagggtgtctcgcagcaggcaggcaagcaccggcactgagaactg

SEQ ID NO: 69503 - DNA, 33 bp, Homo sapiens
  misc_feature 1..33: note = chr1:41602320-41602353
  misc_feature 1..33: note = hypo
  source 1..33: mol_type = genomic DNA
ggtgtgagccattgtgcccggccatttcttatt

SEQ ID NO: 69504 - DNA, 30 bp, Homo sapiens
  misc_feature 1..30: note = chr1:4182092-4182122
  misc_feature 1..30: note = hypo
  source 1..30: mol_type = genomic DNA
cgctggaggaaacatcgattcttctgtgat

SEQ ID NO: 69505 - DNA, 1022 bp, Homo sapiens
  misc_feature 1..1022: note = chr1:41847296-41848318
  misc_feature 1..1022: note = hyper
  source 1..1022: mol_type = genomic DNA
cggcacaacctgtcgctgcacacccgtttcatccgcgtgcagaacgagggcaccggcaagagttcgtggtggatgctgaaccccgagggcggaaagacagggaagaccccgcggcgcagggccgtgtccatggacaacggggccaagttcctgcgcatcaagggcaaggcgagcaagaagaagcagctgcaggcgcccgagcgaagcccggacgacagctccccgagtgcgcccgccccggggccggtgcctgccgcagccaagtgggccgccagccccgcctcgcacgccagcgacgactacgaggcttgggccgacttccgcggcggcgggagacccctgctcggggaggcggccgagctggaggacgacgaggccctggaggccctggcgccatcatcgccgctcatgtacccaagccccgccagcgcgctgtcgccggcgctgggctcgcgctgtccgggtgagctgccccgcctggccgagctgggaggcccgctgggcctgcacggcggcggcggcgcggggctgcccgagggcctgctggacggcgcgcaggacgcgtacgggccgcgggcccgcgcccaggcccggcccggtgctgggtgcgccgggggagctggcgctggcgggcgcagccgccgcctaccccggcaaaggggcggccccgtacgcgccgcccgcgccctcgcgcagtgccttagcccaccccatcagccttatgacgctgcccggcgaggcgggcgccgcgggcctggcaccgccgggccacgccgccgccttcgggggcccgcccggcggcctcctgctggacgctctgccggggccctacgctgccgccgccgccgggccgctgggcgccgcgcccgaccgcttcccggccgacctggacctcgacatgttcagcgggagcctcgagtgcgacgtggagtccatcatcctcaacgacttcatggacagcgacgaaatggacttcaacttcgattcggccctgcctccgccgccgccgggcctggccgggg

SEQ ID NO: 69506 - DNA, 30 bp, Homo sapiens
  misc_feature 1..30: note = chr1:41848613-41848643
  misc_feature 1..30: note = hyper
  source 1..30: mol_type = genomic DNA
gggagtagggaggagcggggtgggccgcct

SEQ ID NO: 69507 - DNA, 12 bp, Homo sapiens
  misc_feature 1..12: note = chr1:41848877-41848889
  misc_feature 1..12: note = hyper
  source 1..12: mol_type = genomic DNA
caaatcgccctc

SEQ ID NO: 69508 - DNA, 34 bp, Homo sapiens
  misc_feature 1..34: note = chr1:41848942-41848976
  misc_feature 1..34: note = hyper
  source 1..34: mol_type = genomic DNA
cgcttctcccctcccccgtcggagtcagtccctc

SEQ ID NO: 69509 - DNA, 66 bp, Homo sapiens
  misc_feature 1..66: note = chr1:41967207-41967273
  misc_feature 1..66: note = hypo
  source 1..66: mol_type = genomic DNA
caagagatgatgcagcgtggaccaggcctaggtgtcatcaccctggaccctcgccaggatcaccat

SEQ ID NO: 69510 - DNA, 195 bp, Homo sapiens
  misc_feature 1..195: note = chr1:41991590-41991785
  misc_feature 1..195: note = hypo
  source 1..195: mol_type = genomic DNA
gagaggccactggcacggcacgtggaggaggcgtggcttctcaacctgtggggcgcaccttccaacgccagccagagttgccctcacatactcacgccgcaccacctgcccctgcctggttccagcacagaggggcaggaggtggctgggaggaggtgagcaagggacagcgtgtcggggcgggggggctccacc

SEQ ID NO: 69511 - DNA, 191 bp, Homo sapiens
  misc_feature 1..191: note = chr1:4212772-4212963
  misc_feature 1..191: note = hypo
  source 1..191: mol_type = genomic DNA
gtgtttcagaatggacgcagaaccagagacagaaaatctctcctctgagctgcttggtgtcattcccccaggatgccaggaaagcctgagcccagtgctccagtgacaggccccctccccaatccaggagcgatagcagacacgaggggtgatggggatgcgacagcccgtggcagcggggccctgagtca

SEQ ID NO: 69512 - DNA, 115 bp, Homo sapiens
  misc_feature 1..115: note = chr1:42128232-42128347
  misc_feature 1..115: note = hyper
  source 1..115: mol_type = genomic DNA
ggtcgcagatgggcccgggcgcggctggcggctgccaggggagggtctcctcgcccggggaatccctggctgccggcggccgcggggagggtctgcgcgccggcctcctcggtga

SEQ ID NO: 69513 - DNA, 30 bp, Homo sapiens
  misc_feature 1..30: note = chr1:42610107-42610137
  misc_feature 1..30: note = hypo
  source 1..30: mol_type = genomic DNA
cacaaatggcagctgcgtcttggacatcaa

SEQ ID NO: 69514 - DNA, 23 bp, Homo sapiens
  misc_feature 1..23: note = chr1:42633276-42633299
  misc_feature 1..23: note = hypo
  source 1..23: mol_type = genomic DNA
tgtgctgacgtgtgtgtatacac

SEQ ID NO: 69515 - DNA, 82 bp, Homo sapiens
  misc_feature 1..82: note = chr1:4279385-4279467
  misc_feature 1..82: note = hypo
  source 1..82: mol_type = genomic DNA
ggaggcagggtggatcgtgccttcctgtgtaggtatgagcctcttccccaagatggcctgtgaccttcagagcagttaagaa

SEQ ID NO: 69516 - DNA, 78 bp, Homo sapiens
  misc_feature 1..78: note = chr1:42802583-42802661
  misc_feature 1..78: note = hypo
  source 1..78: mol_type = genomic DNA
gcctggcctgcaattttaaatagagccgtcagcatgggcctcatttataaaatgactttaaatcggagacctgaaaga

SEQ ID NO: 69517 - DNA, 30 bp, Homo sapiens
  misc_feature 1..30: note = chr1:42803057-42803087
  misc_feature 1..30: note = hypo
  source 1..30: mol_type = genomic DNA
agatgcagtctcagccgggcacagtggcgc

SEQ ID NO: 69518 - DNA, 99 bp, Homo sapiens
  misc_feature 1..99: note = chr1:4285363-4285462
  misc_feature 1..99: note = hypo
  source 1..99: mol_type = genomic DNA
aaaacagtggacatgcggctgcactcacgtatccgattccagctggcttgactccagtggctaatgacaccacaatggtgagcacctctgtcacgctag

SEQ ID NO: 69519 - DNA, 75 bp, Homo sapiens
  misc_feature 1..75: note = chr1:43209082-43209157
  misc_feature 1..75: note = hypo
  source 1..75: mol_type = genomic DNA
ctacttgcctcagggcgcacagctagaaagcaatacagccagctgtgtggccacccccaacgattctgcctgccc

SEQ ID NO: 69520 - skipped

SEQ ID NO: 69521 - DNA, 30 bp, Homo sapiens
  misc_feature 1..30: note = chr1:43393760-43393790
  misc_feature 1..30: note = hypo
  source 1..30: mol_type = genomic DNA
gcctgcagcacagtccgcctgtggcaggat

SEQ ID NO: 69522 - DNA, 30 bp, Homo sapiens
  misc_feature 1..30: note = chr1:43414183-43414213
  misc_feature 1..30: note = hypo
  source 1..30: mol_type = genomic DNA
caactgcttagtccacggctcaaaggagtg

SEQ ID NO: 69523 - DNA, 57 bp, Homo sapiens
  misc_feature 1..57: note = chr1:43446019-43446076
  misc_feature 1..57: note = hypo
  source 1..57: mol_type = genomic DNA
tcctcatacctgccccgctccgatgaggctccctccaggctccgcatcttgacttag

SEQ ID NO: 69524 - DNA, 16 bp, Homo sapiens
  misc_feature 1..16: note = chr1:43531822-43531838
  misc_feature 1..16: note = hypo
  source 1..16: mol_type = genomic DNA
gcgcccagccaagatg

SEQ ID NO: 69525 - DNA, 20 bp, Homo sapiens
  misc_feature 1..20: note = chr1:43533892-43533912
  misc_feature 1..20: note = hyper
  source 1..20: mol_type = genomic DNA
ggcaggcggggtgtgcgccc

SEQ ID NO: 69526 - DNA, 131 bp, Homo sapiens; identical to SEQ ID NO: 26234
  misc_feature 1..131: note = chr1:43534114-43534245
  misc_feature 1..131: note = hyper
  source 1..131: mol_type = genomic DNA

SEQ ID NO: 69527 - DNA, 369 bp, Homo sapiens
  misc_feature 1..369: note = chr1:43613473-43613842
  misc_feature 1..369: note = hyper
  source 1..369: mol_type = genomic DNA
tggcagagtgagacccgccccgaccgggcagcactacccgagcgctgttgcctggagaccacgggacgccgttgcctggagacagcggggacgcgttgcctggagactgtggaaggcccaggcaagagggcgcgtggcagcccaaggccatggcgggacacccaaaagagaaggtgattccagatgaggtccatcagaaccagatcttgcgggaactgtacctcaaggagctacgaacccagaaactctacacgcagtatcacgtgaatcccctccgcaagagtgagaggcacggcggggtgggggaagggcgagagcgggagggcgccggggaaggaggagccctccgggttgcggggtgggaacgcg

SEQ ID NO: 69528 - DNA, 30 bp, Homo sapiens
  misc_feature 1..30: note = chr1:43750677-43750707
  misc_feature 1..30: note = hypo
  source 1..30: mol_type = genomic DNA
ctgcagggagctgggcgttcagcccctcag

SEQ ID NO: 69529 - DNA, 30 bp, Homo sapiens
  misc_feature 1..30: note = chr1:43752107-43752137
  misc_feature 1..30: note = hypo
  source 1..30: mol_type = genomic DNA
tggaggccccgaattcgcaaggataggccg

SEQ ID NO: 69530 - DNA, 30 bp, Homo sapiens
  misc_feature 1..30: note = chr1:43787010-43787040
  misc_feature 1..30: note = hypo
  source 1..30: mol_type = genomic DNA
ccccaccttaccccacgtggagccctggac

SEQ ID NO: 69531 - DNA, 92 bp, Homo sapiens; identical to SEQ ID NO: 38953
  misc_feature 1..92: note = chr1:43826882-43826974
  misc_feature 1..92: note = hypo
  source 1..92: mol_type = genomic DNA

SEQ ID NO: 69532 - DNA, 91 bp, Homo sapiens; identical to SEQ ID NO: 38954
  misc_feature 1..91: note = chr1:43834716-43834807
  misc_feature 1..91: note = hypo
  source 1..91: mol_type = genomic DNA

SEQ ID NO: 69533 - DNA, 177 bp, Homo sapiens
  misc_feature 1..177: note = chr1:4385832-4386009
  misc_feature 1..177: note = hypo
  source 1..177: mol_type = genomic DNA
ccctgcagggagctccggggtgtaggttgtccctctgcatttatccctattagaagcgagagagctgtgctgttctattcctgcaccggccagcccttgacctaggcaattgtggggttgaagtggaggttgagggggaagaaagtaaatttctggacattccggctcactgatttg

SEQ ID NO: 69534 - DNA, 89 bp, Homo sapiens
  misc_feature 1..89: note = chr1:43893329-43893418
  misc_feature 1..89: note = hypo
  source 1..89: mol_type = genomic DNA
gctgttcactggaagcgctgagggaacaaatggttggcatgcagccccctcaggcgccccgagacctcatcttccggtgagtgccttca

SEQ ID NO: 69535 - DNA, 49 bp, Homo sapiens
  misc_feature 1..49: note = chr1:43919778-43919827
  misc_feature 1..49: note = hyper
  source 1..49: mol_type = genomic DNA
ggctgcccgagggcccggttgcaatgatgggacgcgcactttaatactg

SEQ ID NO: 69536 - DNA, 57 bp, Homo sapiens; identical to SEQ ID NO: 38955
  misc_feature 1..57: note = chr1:43991727-43991784
  misc_feature 1..57: note = hypo
  source 1..57: mol_type = genomic DNA

SEQ ID NO: 69537 - DNA, 30 bp, Homo sapiens; identical to SEQ ID NO: 38956
  misc_feature 1..30: note = chr1:44000506-44000536
  misc_feature 1..30: note = hypo
  source 1..30: mol_type = genomic DNA

SEQ ID NO: 69538 - DNA, 30 bp, Homo sapiens; identical to SEQ ID NO: 38957
  misc_feature 1..30: note = chr1:44016696-44016726
  misc_feature 1..30: note = hypo
  source 1..30: mol_type = genomic DNA

SEQ ID NO: 69539 - DNA, 152 bp, Homo sapiens; identical to SEQ ID NO: 38817
  misc_feature 1..152: note = chr1:4402113-4402265
  misc_feature 1..152: note = hypo
  source 1..152: mol_type = genomic DNA

SEQ ID NO: 69540 - DNA, 57 bp, Homo sapiens
  misc_feature 1..57: note = chr1:44043730-44043787
  misc_feature 1..57: note = hypo
  source 1..57: mol_type = genomic DNA
ttttgctacccaccccgatcctggctcctgtctgtccgtctgcggccagagcagccc

SEQ ID NO: 69541 - DNA, 115 bp, Homo sapiens
  misc_feature 1..115: note = chr1:44068774-44068889
  misc_feature 1..115: note = hypo
  source 1..115: mol_type = genomic DNA
gatatcctcagtctccgttcacagcacagtggagtgagggaaacagtctggccctttgttcttgtctgaaaagaataatgagctgtctgccccaggcgtgcggctcctgggatgg

SEQ ID NO: 69542 - DNA, 214 bp, Homo sapiens
  misc_feature 1..214: note = chr1:4426176-4426390
  misc_feature 1..214: note = hypo
  source 1..214: mol_type = genomic DNA
ccagatgccacacatcggcctgcaccttgacgttggatttccagactgcacagctgtgagaaggtgcatttctgttatgtaagccccacagtctacggtgttttgttgtgggagcccgagtggactaacacagtggaggacccagagacagcagtgggtggagagtatccaggcagagccacccccgctgcagagggcccggggcagggaccca

SEQ ID NO: 69543 - DNA, 30 bp, Homo sapiens
  misc_feature 1..30: note = chr1:44304865-44304895
  misc_feature 1..30: note = hypo
  source 1..30: mol_type = genomic DNA
ccctttcttttctaacgtgagcagtctcag

SEQ ID NO: 69544 - DNA, 142 bp, Homo sapiens
  misc_feature 1..142: note = chr1:44351091-44351233
  misc_feature 1..142: note = hypo
  source 1..142: mol_type = genomic DNA
cctgaggctgcctcgcgtgccggggtgctggcggggctggcgggctggggcctgtcttttggagcctgccccaccctcccctgctaccccctaggccagggcaagcaggtcaggcgtcccacacccccgctagtctgaccag

SEQ ID NO: 69545 - DNA, 30 bp, Homo sapiens
  misc_feature 1..30: note = chr1:44396459-44396489
  misc_feature 1..30: note = hypo
  source 1..30: mol_type = genomic DNA
ttcttggggagaaggcggggtattcccact

SEQ ID NO: 69546 - DNA, 351 bp, Homo sapiens
  misc_feature 1..351: note = chr1:44401909-44402260
  misc_feature 1..351: note = hyper
  source 1..351: mol_type = genomic DNA
gagagggcgagggggcggggcggggctggcccgggacaccgcgcgtgactgggtctcattccagggggacgcacggcccgctggtgcagtggaagagcccggcggccgccgccgcagccttctcggcccgcgcccccgccgcctgcacccccatctgctcttccccgcgggggccgcgcggcgcgggctgggggcccgggcagccgcgctcgggcagcgggggcgcggggctgccgcctgcgctcgcagctggtgccggtgcgcgcgctcggcctgggccaccgctccgacgagctggtgcgtttccgcttctgcagcggctcctgccgccgcgcgcgctctccacacgac

SEQ ID NO: 69547 - DNA, 45 bp, Homo sapiens; identical to SEQ ID NO: 38961
  misc_feature 1..45: note = chr1:44463208-44463253
  misc_feature 1..45: note = hypo
  source 1..45: mol_type = genomic DNA

SEQ ID NO: 69548 - DNA, 173 bp, Homo sapiens
  misc_feature 1..173: note = chr1:44463830-44464003
  misc_feature 1..173: note = hypo
  source 1..173: mol_type = genomic DNA
tgtcaacatctgggccgtggaagaagcaggcagggccgggggccggagcgcggtgagtgggaaggctctgcggaagggagaagtctgtctttgccacagtcctgaactggccaagcacagtagagctgctgccgcctttggaatcagtcagttctgctcgctatggctcccca

SEQ ID NO: 69549 - DNA, 150 bp, Homo sapiens; identical to SEQ ID NO: 38963
  misc_feature 1..150: note = chr1:44497521-44497671
  misc_feature 1..150: note = hypo
  source 1..150: mol_type = genomic DNA

SEQ ID NO: 69550 - DNA, 146 bp, Homo sapiens
  misc_feature 1..146: note = chr1:44584392-44584538
  misc_feature 1..146: note = hypo
  source 1..146: mol_type = genomic DNA
cctggggcagggctgcgagggcggcgcagggcgggacgggtggggcctgaccccgccccttggcgcagctgtaaataggtaaatagaaggtgattgtggcgtggcgatgtaccgatacccgcctgcgacgccgtggtggctggttc

SEQ ID NO: 69551 - DNA, 92 bp, Homo sapiens
  misc_feature 1..92: note = chr1:44718072-44718164
  misc_feature 1..92: note = hypo
  source 1..92: mol_type = genomic DNA
ctgcgacgggcctgccgcatagccctgctgtaggtgcggcgggtggccccctgtgtaacagggagctttgccattagcgcctttaatattct

SEQ ID NO: 69552 - DNA, 423 bp, Homo sapiens
  misc_feature 1..423: note = chr1:44726893-44727316
  misc_feature 1..423: note = hypo
  source 1..423: mol_type = genomic DNA
aggagcggggtgggccggctggcagatctgagagcgtggcacgccccagcgggcagggcgcacagcgcggaggaaggcgcgagtcagtctggagtgctccccatttatcaagctcacgcaggccgccagccgagcgagtctttctatcattacacctctcaaaatccgattcataccactaatcctgccttcattctcccagattaataacatctctttcaaccttcacagtgtgataaatagacaaagagagaacaaaaggagagacagaagagagagaaagagctggagcaagtccccataatagagagagctgagaaagaggagagggaaaaaaggagagcgaacgagagcaggcagcggccagagactgcagctaccttagagagccgctctgaggagagctggcggctgcgccccgct

SEQ ID NO: 69553 - DNA, 30 bp, Homo sapiens; identical to SEQ ID NO: 38967
  misc_feature 1..30: note = chr1:44794138-44794168
  misc_feature 1..30: note = hypo
  source 1..30: mol_type = genomic DNA

SEQ ID NO: 69554 - DNA, 71 bp, Homo sapiens
  misc_feature 1..71: note = chr1:4486495-4486566
  misc_feature 1..71: note = hypo
  source 1..71: mol_type = genomic DNA
aggcagctcactgcacggttgtttgcggaatgaaacgactttgccaaagccatggccgcagacatacgatg

SEQ ID NO: 69555 - DNA, 26 bp, Homo sapiens
  misc_feature 1..26: note = chr1:44871018-44871044
  misc_feature 1..26: note = hyper
  source 1..26: mol_type = genomic DNA
tcgcgaacacaaacccggggccagcc

SEQ ID NO: 69556 - DNA, 86 bp, Homo sapiens
  misc_feature 1..86: note = chr1:44871104-44871190
  misc_feature 1..86: note = hyper
  source 1..86: mol_type = genomic DNA
ctctgcgaacccgggacttttcatgcaccacactctccgcctgcttccctccgtgtcctgaaaagtgcgaccgttctcccaaggaa

SEQ ID NO: 69557 - DNA, 430 bp, Homo sapiens
  misc_feature 1..430: note = chr1:44872293-44872723
  misc_feature 1..430: note = hyper
  source 1..430: mol_type = genomic DNA
gcgaccttctctgcccggaacccagccccgccaccgcactccggagcctccggcctcccccaccccacccccgccccccaacccggggcttttcagggctcggcctgggcgtttcgcctttgtgctttgtaagagaaagccttttcttccagggcacaacaaacttgggcggagagcttccgtgtggccccccgggcgaggccgcccacggtggtgaggccatccgaggggatgcccggttcatcccccagtccaggagcctctccgagagctcgcggcccaggtcgaccccagctggcgagggcgcgcaggagtcccgaagtagcggggactagggcagccaggaggcagggggaaagctctcgcttcccgttaagcacaccctgcattctcgggtcgtggatgcagctccagcggagagcccgtgttc

SEQ ID NO: 69558 - DNA, 141 bp, Homo sapiens; identical to SEQ ID NO: 28
  misc_feature 1..141: note = chr1:44872923-44873064
  misc_feature 1..141: note = hyper
  source 1..141: mol_type = genomic DNA

SEQ ID NO: 69559 - DNA, 108 bp, Homo sapiens; identical to SEQ ID NO: 29
  misc_feature 1..108: note = chr1:44873065-44873173
  misc_feature 1..108: note = hyper
  source 1..108: mol_type = genomic DNA

SEQ ID NO: 69560 - DNA, 336 bp, Homo sapiens
  misc_feature 1..336: note = chr1:44873509-44873845
  misc_feature 1..336: note = hyper
  source 1..336: mol_type = genomic DNA
gggtgacccccggggcggggctgctcgggggctggaggtccttggactttggtcgaaggctggcagctctgagcccctgccccgcgggccccgcgcggctgcggaccaggggcccttgcacgtgtcggttcttcctggactggcgctttggttgcccaaagttgggcgcagattgtttcgtgcggaggttgttgggacccagagtattctatatacaaaggcaaccgagagccggagggagaggtcgggccaaagagtagtgggctcggctccgcgttgggcccaagtttatgtaggtttcgccttcacctcttcttcccccgttttccctaaaag

SEQ ID NO: 69561 - DNA, 146 bp, Homo sapiens; identical to SEQ ID NO: 26241
  misc_feature 1..146: note = chr1:44883069-44883215
  misc_feature 1..146: note = hyper
  source 1..146: mol_type = genomic DNA

SEQ ID NO: 69562 - DNA, 372 bp, Homo sapiens; identical to SEQ ID NO: 26242
  misc_feature 1..372: note = chr1:44883751-44884123
  misc_feature 1..372: note = hyper
  source 1..372: mol_type = genomic DNA

SEQ ID NO: 69563 - DNA, 82 bp, Homo sapiens
  misc_feature 1..82: note = chr1:44884203-44884285
  misc_feature 1..82: note = hyper
  source 1..82: mol_type = genomic DNA
cgttaaagtctgggcaatttctggaactcttcccacgggaagttttccggggctgccttccggtcagcggccccaggttgat

SEQ ID NO: 69564 - DNA, 30 bp, Homo sapiens
  misc_feature 1..30: note = chr1:45063652-45063682
  misc_feature 1..30: note = hypo
  source 1..30: mol_type = genomic DNA
tctctcgttctctctcgaacacaggtgtac

SEQ ID NO: 69565 - DNA, 62 bp, Homo sapiens; identical to SEQ ID NO: 38968
  misc_feature 1..62: note = chr1:45103094-45103156
  misc_feature 1..62: note = hypo
  source 1..62: mol_type = genomic DNA

SEQ ID NO: 69566 - DNA, 49 bp, Homo sapiens
  misc_feature 1..49: note = chr1:45106627-45106676
  misc_feature 1..49: note = hypo
  source 1..49: mol_type = genomic DNA
tttcaggttccaggacgatactgcccccagtaaacgggcatctccagtt

SEQ ID NO: 69567 - DNA, 38 bp, Homo sapiens
  misc_feature 1..38: note = chr1:45156636-45156674
  misc_feature 1..38: note = hypo
  source 1..38: mol_type = genomic DNA
aaggttgttgaggggcggggcgcggtgactcacgcctg

SEQ ID NO: 69568 - DNA, 30 bp, Homo sapiens
  misc_feature 1..30: note = chr1:45194741-45194771
  misc_feature 1..30: note = hypo
  source 1..30: mol_type = genomic DNA
aagctcttgtctcaacgctattgtactgac

SEQ ID NO: 69569 - DNA, 18 bp, Homo sapiens
  misc_feature 1..18: note = chr1:45197991-45198009
  misc_feature 1..18: note = hypo
  source 1..18: mol_type = genomic DNA
ttttttaaagagtctcgc

SEQ ID NO: 69570 - DNA, 20 bp, Homo sapiens
  misc_feature 1..20: note = chr1:45240494-45240514
  misc_feature 1..20: note = hypo
  source 1..20: mol_type = genomic DNA
caccgcgccaggcctaaaaa

SEQ ID NO: 69571 - DNA, 154 bp, Homo sapiens; identical to SEQ ID NO: 26243
  misc_feature 1..154: note = chr1:45250008-45250162
  misc_feature 1..154: note = hyper
  source 1..154: mol_type = genomic DNA

SEQ ID NO: 69572 - DNA, 197 bp, Homo sapiens
  misc_feature 1..197: note = chr1:45250192-45250389
  misc_feature 1..197: note = hyper
  source 1..197: mol_type = genomic DNA
cgggagcggggacgcgggatcggctctcggggaaggaccgaggcatcggtgccccagaggctgagcgaggacccgcgtgccgggtcaggcccagtgcaagccactcaccgcaggttgaaggtggagcccaggaatgagggccgcagagactcggccgccgtggccacagtgtagggtggctgcggctggtcctcatc

SEQ ID NO: 69573 - DNA, 434 bp, Homo sapiens
  misc_feature 1..434: note = chr1:45251837-45252271
  misc_feature 1..434: note = hyper
  source 1..434: mol_type = genomic DNA
agtacttgttgaagtcggatttcaggctctcaaactttttcctctcttcctgggacatgaaacctgagggggtaaagcaggtggggtgcagttgcaccctctgccgccaggggaggctgctgttccgccgtctggctcccctccctcgcgtccaccggctgtcccaggactcgcggttccgcgttcctgtcgcagtccagacccttccctggaggcccctgctcccaggactctcccaggcgccacctgcatccggctgtgggccggacccccagaggctcccggcgggcggcgcacctgcgtccaccacgtgctccatggtggggaagcgcttaagcacgcgggtgctgaccgagcgcagcaccagcacggacgccaggttcgcgtagcggatgagggtgcggcgcagcaggcggccccgctggtccacgccg

SEQ ID NO: 69574 - DNA, 24 bp, Homo sapiens
  misc_feature 1..24: note = chr1:45264938-45264962
  misc_feature 1..24: note = hypo
  source 1..24: mol_type = genomic DNA
aggcaaggtggctcacgcctgtaa

SEQ ID NO: 69575 - DNA, 100 bp, Homo sapiens; identical to SEQ ID NO: 38971
  misc_feature 1..100: note = chr1:45280516-45280616
  misc_feature 1..100: note = hypo
  source 1..100: mol_type = genomic DNA

SEQ ID NO: 69576 - DNA, 100 bp, Homo sapiens
  misc_feature 1..100: note = chr1:45293217-45293317
  misc_feature 1..100: note = hypo
  source 1..100: mol_type = genomic DNA
tcaccagggccacctcgtacagggagaagtacctgagctgggcgctcaggaaggcatgctccttggtgccccgaggcaccacatccgtcagggccaggcc

SEQ ID NO: 69577 - DNA, 80 bp, Homo sapiens
  misc_feature 1..80: note = chr1:45308235-45308315
  misc_feature 1..80: note = hypo
  source 1..80: mol_type = genomic DNA
accgcgcccggccggcataggcccattttctgagagcaggatacatatgtacacacacctgtcgtcgggtggacacagag

SEQ ID NO: 69578 - DNA, 113 bp, Homo sapiens
  misc_feature 1..113: note = chr1:45308747-45308860
  misc_feature 1..113: note = hyper
  source 1..113: mol_type = genomic DNA
gtgtgggtgttaaagcggctgggagggaggagtgcagggagctgcgggtccggggcgcggcgccgggattcacccgctccgtgggccgtgggccgcggcggctggaggaggaa

SEQ ID NO: 69579 - DNA, 75 bp, Homo sapiens
  misc_feature 1..75: note = chr1:4542688-4542763
  misc_feature 1..75: note = hypo
  source 1..75: mol_type = genomic DNA
ccgaacgctgtcctgcgtggccaccacgtgctcctccctgctgcagccctgccctcccgccgggcctgcatgtcc

SEQ ID NO: 69580 - DNA, 104 bp, Homo sapiens
  misc_feature 1..104: note = chr1:45466045-45466149
  misc_feature 1..104: note = hypo
  source 1..104: mol_type = genomic DNA
cacgccactgcactccaacctgggcgacagacacgctgtataaataataataataataatggttaaaatgagtgcccccttggcccagtcgtcatcatttcctg

SEQ ID NO: 69581 - DNA, 30 bp, Homo sapiens
  misc_feature 1..30: note = chr1:45468126-45468156
  misc_feature 1..30: note = hypo
  source 1..30: mol_type = genomic DNA
ccatcttcttggctccgagtaggacactaa

SEQ ID NO: 69582 - DNA, 16 bp, Homo sapiens
  misc_feature 1..16: note = chr1:45645619-45645635
  misc_feature 1..16: note = hypo
  source 1..16: mol_type = genomic DNA
aggagccaagatggcc

SEQ ID NO: 69583 - DNA, 23 bp, Homo sapiens
  misc_feature 1..23: note = chr1:45936888-45936911
  misc_feature 1..23: note = hypo
  source 1..23: mol_type = genomic DNA
caagactccgtctcaaaaaaaag

SEQ ID NO: 69584 - DNA, 38 bp, Homo sapiens; identical to SEQ ID NO: 14239
  misc_feature 1..38: note = chr1:46079131-46079169
  misc_feature 1..38: note = hypo
  source 1..38: mol_type = genomic DNA

SEQ ID NO: 69585 - DNA, 68 bp, Homo sapiens; identical to SEQ ID NO: 38821
  misc_feature 1..68: note = chr1:4652230-4652298
  misc_feature 1..68: note = hypo
  source 1..68: mol_type = genomic DNA

SEQ ID NO: 69586 - DNA, 94 bp, Homo sapiens
  misc_feature 1..94: note = chr1:4659147-4659241
  misc_feature 1..94: note = hypo
  source 1..94: mol_type = genomic DNA
gaacgcaaggccctccgggtggctgagtcagtatgctctgtgagaattgcagagggacagagaaagtttgagcccggccgggtgcggtggctca

SEQ ID NO: 69587 - DNA, 93 bp, Homo sapiens
  misc_feature 1..93: note = chr1:4659541-4659634
  misc_feature 1..93: note = hypo
  source 1..93: mol_type = genomic DNA
tcctccattccctattatgaaaggctctgaaggtagatagtttagaaagggctgcctcgggcagggggctgcatagagcgatgagtctatggt

SEQ ID NO: 69588 - DNA, 76 bp, Homo sapiens
  misc_feature 1..76: note = chr1:46632620-46632696
  misc_feature 1..76: note = hyper
  source 1..76: mol_type = genomic DNA
ccgcacttctagctgcgttcaaccaggctcaggaggtccttcaagatcttggcttccttttcctgactccgcgccc

SEQ ID NO: 69589 - DNA, 275 bp, Homo sapiens
  misc_feature 1..275: note = chr1:46632697-46632972
  misc_feature 1..275: note = hyper
  source 1..275: mol_type = genomic DNA
gcgcggttaattatagccccaccccgcgactacctgcttcgctcccacccgcgcgcccaggaccctagctgcgggactctagcggggaaggcacccccaattctgggccctggcgaccttgggtcagggccaggaaaggcacttccagccaagcgctggcgccgggtgcgcctcgctttacggaaagaacgccccgcgaataaatccggagcggatttgcatcacagcagccgcgagaaggctagctgctgccaaagctccgaagctctggatgt

SEQ ID NO: 69590 - DNA, 41 bp, Homo sapiens
  misc_feature 1..41: note = chr1:46653449-46653490
  misc_feature 1..41: note = hypo
  source 1..41: mol_type = genomic DNA
aacaaacactgaaggcgtcagggtggcgagatatgtccaag

SEQ ID NO: 69591 - DNA, 40 bp, Homo sapiens
  misc_feature 1..40: note = chr1:46668917-46668957
  misc_feature 1..40: note = hyper
  source 1..40: mol_type = genomic DNA
gaatacatccacagacggtgctgcgcggcttttctgagtg

SEQ ID NO: 69592 - DNA, 44 bp, Homo sapiens
  misc_feature 1..44: note = chr1:4673712-4673756
  misc_feature 1..44: note = hypo
  source 1..44: mol_type = genomic DNA
caggccatgtgcacacgggggcaggtgcccgcaatcacttaaca

SEQ ID NO: 69593 - DNA, 124 bp, Homo sapiens; identical to SEQ ID NO: 38823
  misc_feature 1..124: note = chr1:4677050-4677174
  misc_feature 1..124: note = hypo
  source 1..124: mol_type = genomic DNA

SEQ ID NO: 69594 - DNA, 51 bp, Homo sapiens
  misc_feature 1..51: note = chr1:46859925-46859976
  misc_feature 1..51: note = hyper
  source 1..51: mol_type = genomic DNA
ccggctgatccagtccgggttttgcggcggagcgggcgggctgcgcgtgcg

SEQ ID NO: 69595 - DNA, 30 bp, Homo sapiens
  misc_feature 1..30: note = chr1:4691300-4691330
  misc_feature 1..30: note = hypo
  source 1..30: mol_type = genomic DNA
ttgatgattgagccacggggctggtctttc

SEQ ID NO: 69596 - DNA, 218 bp, Homo sapiens
  misc_feature 1..218: note = chr1:46913659-46913877
  misc_feature 1..218: note = hyper
  source 1..218: mol_type = genomic DNA
gggccctgactaggacgttacgggaagggggtcttgaattctgatctcgtttctgcctaagacctatcgcctttttgaacctcagtttcccctttggctgcatagggaaggggtgcccacatgcccccgcccgcattcagttcgaaggaccagccagtaggccctgcgccgcccagggaccgcccggcctttgcgtccggcccagctcaagccccttc

SEQ ID NO: 69597 - DNA, 360 bp, Homo sapiens; identical to SEQ ID NO: 1693
  misc_feature 1..360: note = chr1:46913886-46914246
  misc_feature 1..360: note = hyper
  source 1..360: mol_type = genomic DNA

SEQ ID NO: 69598 - DNA, 257 bp, Homo sapiens
  misc_feature 1..257: note = chr1:46914285-46914542
  misc_feature 1..257: note = hyper
  source 1..257: mol_type = genomic DNA
cgcggagggccggacgggagccaaggcggctcagttcctcttctcccccgagcaggcgaggagaggtggggtctcaggacctccaaggccctgttccccttccattggcatttgtgtaaggacgcaggccctccgcactgctgactgtggcactgggcagggagtcccctagactaggggtttggggttagatctggggctcaggcagcgctgggctgggcgtagtttgcagagggaccggccgtcctggcaggaaa

SEQ ID NO: 69599 - DNA, 111 bp, Homo sapiens
  misc_feature 1..111: note = chr1:46921772-46921883
  misc_feature 1..111: note = hypo
  source 1..111: mol_type = genomic DNA
tattcatcaccagctcgtggcgccggcgccgacgctgatacaatattagtgttgccccccctttcggagcccgctccgcccggctccccgatggcacgaatccatcacctg

SEQ ID NO: 69600 - DNA, 249 bp, Homo sapiens
  misc_feature 1..249: note = chr1:46932507-46932756
  misc_feature 1..249: note = hyper
  source 1..249: mol_type = genomic DNA
tgggaaaagtttactcgggcggagggggcggagactcccccgggcgggcggccgggacttctcccagccgggtgaatggaggacccgcctgcaggagcagccgcgaaagagtggagcgggcgcgcctgctgagccacagccacagcaacactttgcaggcgtgcacactcacacgcacacccaggccacaacagccgtgtctgcaccagcccacgggcgcacgcgcgctgcccacgatcaccctcccaa

SEQ ID NO: 69601 - DNA, 149 bp, Homo sapiens
  misc_feature 1..149: note = chr1:46951169-46951318
  misc_feature 1..149: note = hyper
  source 1..149: mol_type = genomic DNA
gggggtatctctgagcggtgaaggggagtagccgtcggagggcggggacagagcggtagctgccttgcgctgggattgggggtgggggtgggagtggggagggctctttaagcggcggccgcgctaataacctgtccaggagatggctc

SEQ ID NO: 69602 - DNA, 118 bp, Homo sapiens; identical to SEQ ID NO: 26252
  misc_feature 1..118: note = chr1:46951644-46951762
  misc_feature 1..118: note = hyper
  source 1..118: mol_type = genomic DNA

SEQ ID NO: 69603 - DNA, 40 bp, Homo sapiens
  misc_feature 1..40: note = chr1:46954864-46954904
  misc_feature 1..40: note = hyper
  source 1..40: mol_type = genomic DNA
ccgcgagttccagcccgcggcctcccggcccagaggccaa

SEQ ID NO: 69604 - DNA, 375 bp, Homo sapiens
  misc_feature 1..375: note = chr1:46956241-46956616
  misc_feature 1..375: note = hyper
  source 1..375: mol_type = genomic DNA
cagcttcctggtccacgcgaaccccgcagtgctccgggcattgcccgggtctggctttggtctcgcccgcgcagatcccgttcaaactcagctgccaccaagtgcgccttttctctctggattgcgattctgcacgaattttccagttgagggtggttcggcgctcagccagcctctgccctcgaagacgcggccttggtctaggaaccttcaggtgggtgtttggggcgcagtggccctagttccctagaattcgttttgcctcccgcggcctcagccggcgtgggtcaggcgagctccggcgaggaacggcaggctggggccagtccccggagcggctctcggggcgcttctaggggagcagtcaaagggttg

SEQ ID NO: 69605 - DNA, 155 bp, Homo sapiens; identical to SEQ ID NO: 34
  misc_feature 1..155: note = chr1:46956684-46956839
  misc_feature 1..155: note = hyper
  source 1..155: mol_type = genomic DNA

SEQ ID NO: 69606 - DNA, 331 bp, Homo sapiens
  misc_feature 1..331: note = chr1:46956840-46957171
  misc_feature 1..331: note = hyper
  source 1..331: mol_type = genomic DNA
caccaaatctggggccccgacttttcctggattccagccacactcggtttgggaggcagtgggctcctcaggcttgtgatttgcggcaggaaggagtcccggaatggaagaacggggaggacgagatccgaggccttttcaccctctttgcaagcatgcagttcaccaaagccgagaacccaccgggcctggagcgcagcctcagcgctggttccgacccgggccccagaaggtctttttcgtttgagaaaagtcctcggaggccggggcagggtgcgccgatattggtttactaagggcgcctccagtttgagggcgttggggaaagagg

SEQ ID NO: 69607 - DNA, 30 bp, Homo sapiens
  misc_feature 1..30: note = chr1:46958750-46958780
  misc_feature 1..30: note = hyper
  source 1..30: mol_type = genomic DNA
cctgccttcccatttcgccccccaccccac

SEQ ID NO: 69608 - DNA, 101 bp, Homo sapiens
  misc_feature 1..101: note = chr1:4696797-4696898
  misc_feature 1..101: note = hypo
  source 1..101: mol_type = genomic DNA
agaggacttcggggacgagcacacgaggcaatggcagcgctgaggaaggagcgggcgatgtaatggtgagtaccaaggagcacgcccggaggaaagaggag

SEQ ID NO: 69609 - DNA, 350 bp, Homo sapiens
  misc_feature 1..350: note = chr1:46998912-46999262
  misc_feature 1..350: note = hyper
  source 1..350: mol_type = genomic DNA
gccgccgagcgcccacggggcgcgaggccccggcggctacacacgcagcaggccgcgaagaagccgagcgccagcaccagcagcgccagccccacgacgagcagcgcgttgtgctcgggcaagaaggaggcgaaggcgcctgccagcgtcacgttcacgcccgccagcagcgcgcacagaccgcaggcgcagcacagcgccggcgacggcaggccgggcacccggccccgggcgcgttccgcgggcgccgggaccggtggcccctcgctcttttctgccggcggcatcggcctgcgcacgccaggcacgcatcaagctccctcctgccgccggcccggaacagcccaact

SEQ ID NO: 69610 - DNA, 437 bp, Homo sapiens; identical to SEQ ID NO: 26256
  misc_feature 1..437: note = chr1:47009449-47009886
  misc_feature 1..437: note = hyper
  source 1..437: mol_type = genomic DNA

SEQ ID NO: 69611 - DNA, 126 bp, Homo sapiens; identical to SEQ ID NO: 37
  misc_feature 1..126: note = chr1:47009910-47010036
  misc_feature 1..126: note = hyper
  source 1..126: mol_type = genomic DNA

SEQ ID NO: 69612 - DNA, 28 bp, Homo sapiens
  misc_feature 1..28: note = chr1:47010104-47010132
  misc_feature 1..28: note = hyper
  source 1..28: mol_type = genomic DNA
cgtccgcactttccgagagccaggcacg

SEQ ID NO: 69613 - DNA, 30 bp, Homo sapiens
  misc_feature 1..30: note = chr1:47041243-47041273
  misc_feature 1..30: note = hypo
  source 1..30: mol_type = genomic DNA
acttgtggccttccccggtgagcactctct

SEQ ID NO: 69614 - DNA, 23 bp, Homo sapiens
  misc_feature 1..23: note = chr1:4711648-4711671
  misc_feature 1..23: note = hypo
  source 1..23: mol_type = genomic DNA
taataataagctgggcgcggtgg

SEQ ID NO: 69615 - DNA, 355 bp, Homo sapiens
  misc_feature 1..355: note = chr1:4712671-4713026
  misc_feature 1..355: note = hyper
  source 1..355: mol_type = genomic DNA
aggggttcctggagccgacacggtccggtccggagcccctccctgccctgctggctcctagtgtgcgaagccggccccttccaggcccactccggttgcaggaagggcctccctggtgcagcaccgcctcctcacaccgctaggtggcagcactgccggcgcctccttccccgccggccgccataggccccgctggttccaggacctccctgcctccttcgcctcttaatgggatccgctccctcacacccctcagggagaggctctaggggacgatgacccaggggcggcccggcagggaaactgctgagtcaccctgctgcctctcgggtcctctgaccggctcacagatcac

SEQ ID NO: 69616 - DNA, 131 bp, Homo sapiens
  misc_feature 1..131: note = chr1:4713944-4714075
  misc_feature 1..131: note = hyper
  source 1..131: mol_type = genomic DNA
ttccagtgactcctccggagcaagggcctggccaggcagcagctgcgctgggcgatgagggaccgttgggtaattgggggcataggaccgggcttcgctgggttcggggcagaagcgccgaagctccgacc

SEQ ID NO: 69617 - DNA, 199 bp, Homo sapiens
  misc_feature 1..199: note = chr1:4714163-4714362
  misc_feature 1..199: note = hyper
  source 1..199: mol_type = genomic DNA
cggcccgcgtggctcagctccgccccaggaaacttttcgcgcagcccccgctccatgcgcccccacccagtccttcttcggggccgccccctccccaaagtagctctccgggtccactgggcgcccccgtaaccgggtcggaacctcgaacggcttcgcgtgccatccggttaccctggcaacaccatccggcggcgcc

SEQ ID NO: 69618 - DNA, 113 bp, Homo sapiens; identical to SEQ ID NO: 4
  misc_feature 1..113: note = chr1:4715427-4715540
  misc_feature 1..113: note = hyper
  source 1..113: mol_type = genomic DNA

SEQ ID NO: 69619 - DNA, 963 bp, Homo sapiens; identical to SEQ ID NO: 26018
  misc_feature 1..963: note = chr1:4715574-4716537
  misc_feature 1..963: note = hyper
  source 1..963: mol_type = genomic DNA

SEQ ID NO: 69620 - DNA, 126 bp, Homo sapiens; identical to SEQ ID NO: 5294
  misc_feature 1..126: note = chr1:4716538-4716664
  misc_feature 1..126: note = hyper
  source 1..126: mol_type = genomic DNA

SEQ ID NO: 69621 - DNA, 235 bp, Homo sapiens; identical to SEQ ID NO: 38825
  misc_feature 1..235: note = chr1:4726593-4726828
  misc_feature 1..235: note = hypo
  source 1..235: mol_type = genomic DNA

SEQ ID NO: 69622 - DNA, 137 bp, Homo sapiens
  misc_feature 1..137: note = chr1:47691603-47691740
  misc_feature 1..137: note = hyper
  source 1..137: mol_type = genomic DNA
ccgcccctgacccaccgacgtgggctggggtaaaggggagaagggcagagagaggaactcacgcaccgagacgtgagaagaggcagacaaagttagcgccacgtggggctagggcgggaggccggttggggctaggg

SEQ ID NO: 69623 - DNA, 135 bp, Homo sapiens
  misc_feature 1..135: note = chr1:47694793-47694928
  misc_feature 1..135: note = hyper
  source 1..135: mol_type = genomic DNA
ttcctcaccccaggccggaacacaaggccttcctagacaccgtttccaccggcaccattcccctgaaaactcacctggggcatatttagagagaccggcccctctgaataggatctccactccgccggaaagggg

SEQ ID NO: 69624 - DNA, 607 bp, Homo sapiens; identical to SEQ ID NO: 26261
  misc_feature 1..607: note = chr1:47694979-47695586
  misc_feature 1..607: note = hyper
  source 1..607: mol_type = genomic DNA

SEQ ID NO: 69625 - DNA, 625 bp, Homo sapiens; identical to SEQ ID NO: 26262
  misc_feature 1..625: note = chr1:47695896-47696521
  misc_feature 1..625: note = hyper
  source 1..625: mol_type = genomic DNA

SEQ ID NO: 69626 - DNA, 345 bp, Homo sapiens; identical to SEQ ID NO: 40
  misc_feature 1..345: note = chr1:47696620-47696965
  misc_feature 1..345: note = hyper
  source 1..345: mol_type = genomic DNA

SEQ ID NO: 69627 - DNA, 269 bp, Homo sapiens
  misc_feature 1..269: note = chr1:47696986-47697255
  misc_feature 1..269: note = hyper
  source 1..269: mol_type = genomic DNA
cgcccccaccagcgcctcgatctctcgctcgccctccccccactcccgcccccagcgatttgcaaacgcacctctaaaggacacaggcacacaggcatacaactcagtgcggacaggaccacacagggtccagccccacagaagggcagcaaacaaacaccacctagcactgccccagaagccgacttggtcagccccgcacactgcccaacaggacacaacgaaatcagtcaaacgcagcggctcacggacacacaatccagcacagt

SEQ ID NO: 69628 - DNA, 668 bp, Homo sapiens
  misc_feature 1..668: note = chr1:47697279-47697947
  misc_feature 1..668: note = hyper
  source 1..668: mol_type = genomic DNA
cgacgacaccacccaaacacagtcgcaggggccacacacccccacacacagaatcagatccctgctgagaacaccaacggagcacaatcgtacgcaacgaagaaaacgcagaagggcctcgaagggtccacatctacacaccccaaccgcgcaggcacaccacactcggacacagagcctgtcgccaagaagaccacacttagaagcagccaacgccgcccacagttctcatgaacgcactctcacaatcccaccgcatgcacacaaccacgaagaagaaatgaaaaccaaccacagcctcgcgcatttctgtatattgcgtaaggaaaagggggaaggaaggaagagagtctccgaggcgggaggggcggcggcagccggggcgggggcgtccgtggaaaatgcccccccaccgccccccccggccatcgaaaggaaccgagggaaagggagcgaagacctcttttgcggacgtggggaaaaagaggaggaaattgatgaagaattcggtgggaggccgcgggttgcttttcccctagaaaaaggccagaatgctcacgtttttccgctacgggggtacgcgtgtggccattttgaggcccggtcctgagcggcggcggcccggcccctcccgcggcccccgctcccccgcccgccccgcgcccgcc

SEQ ID NO: 69629 - DNA, 204 bp, Homo sapiens
  misc_feature 1..204: note = chr1:47698006-47698210
  misc_feature 1..204: note = hyper
  source 1..204: mol_type = genomic DNA
cgaggcgcgccggggccgtgtgcgccgcagagataaggcactgccgcgggtccgcccgcccccgataagcgcctcggccattatgggccaaatgattcattttaatttggcaatttcaccggagggagtggggactggttgagcggcgctaggaccggctccggaacgcgctgcggggagcgttggacgcgctgtctaggaccc

SEQ ID NO: 69630 - DNA, 30 bp, Homo sapiens
  misc_feature 1..30: note = chr1:47701225-47701255
  misc_feature 1..30: note = hyper
  source 1..30: mol_type = genomic DNA
cacccctcctccacccgccccaaacggagg

SEQ ID NO: 69631 - DNA, 120 bp, Homo sapiens
  misc_feature 1..120: note = chr1:4771547-4771667
  misc_feature 1..120: note = hyper
  source 1..120: mol_type = genomic DNA
cttacgtcctctcgtcgtgtgatgggcaaaaggaaggagggactcacaggtcttttcaggttatcttgtcgaggctgccctgaaaggctgggggtttctgaggctcggttttcgctcgcg

SEQ ID NO: 69632 - DNA, 224 bp, Homo sapiens
  misc_feature 1..224: note = chr1:4772478-4772702
  misc_feature 1..224: note = hypo
  source 1..224: mol_type = genomic DNA
ggggcccacgggggacgaggaggccctggagtccaacacatttccgggcgtttacggccccaccacggtctccatcctacaaacacggaagacaactgtggccgccaccaccaccaccaccaccacggccacccccatgacgctgcagactaaggggttcaccgagtccttggatccccggagaaggatcccaggtggggttagcacaacggagccttccacca

SEQ ID NO: 69633 - DNA, 84 bp, Homo sapiens
  misc_feature 1..84: note = chr1:47749513-47749597
  misc_feature 1..84: note = hypo
  source 1..84: mol_type = genomic DNA
atatacacacaaaaccgttgacactgagcaataaaacccatttcttagcttttttttttgcgggggggtggggggtggatagag

SEQ ID NO: 69634 - DNA, 177 bp, Homo sapiens
  misc_feature 1..177: note = chr1:4782333-4782510
  misc_feature 1..177: note = hypo
  source 1..177: mol_type = genomic DNA
ttagcagcaccgagccgcggggcaggtgcaagttcacagcgcagaggcgatccgtggtttgcacacttgtcctgtgcacggcaggacctgtggcgtccatacctgcctcattctgtgactgttatgaatctctgctctagtcctagacattccgaaagcagccgttcacccagctgg

SEQ ID NO: 69635 - DNA, 268 bp, Homo sapiens
  misc_feature 1..268: note = chr1:47881997-47882265
  misc_feature 1..268: note = hyper
  source 1..268: mol_type = genomic DNA
gcagcgacatggatccgcccgccgcgttctctggcttccctgccctgccagcggtcgcgccgtcggggccgccgccgtcgccgctcgcaggagccgagccagggcgggagccagaggaggcggcggctggccgcggagaggcggcccccacgcccgcgcccggcccggggcggcggcggcggcggcccctgcagcgcgggaagccgccctactcgtacatcgcgctcatcgccatggctctggcgcacgccccgggccgccgcctcac

SEQ ID NO: 69636 - DNA, 122 bp, Homo sapiens
  misc_feature 1..122: note = chr1:47882266-47882388
  misc_feature 1..122: note = hyper
  source 1..122: mol_type = genomic DNA
ctggccgccatctaccgcttcatcaccgaacgctttgccttctaccgcgacagcccgcgcaagtggcagaacagcatccgccacaatctcacgctcaacgactgcttcgtcaaggtgccccg

SEQ ID NO: 69637 - DNA, 100 bp, Homo sapiens
  misc_feature 1..100: note = chr1:47882747-47882847
  misc_feature 1..100: note = hyper
  source 1..100: mol_type = genomic DNA
ctgccgccgcctccccgccactctactcgcaggtccccgaccgcctggtactgcccgcgacgcgccccggccccggcccgctgcccgctgagcccctcct

SEQ ID NO: 69638 - DNA, 83 bp, Homo sapiens
  misc_feature 1..83: note = chr1:47904375-47904458
  misc_feature 1..83: note = hyper
  source 1..83: mol_type = genomic DNA
gcgagccgggcaacccgggcaagggcaactactggacgctggacccggagtcggccgacatgttcgacaacggcagcttcctg

SEQ ID NO: 69639 - DNA, 113 bp, Homo sapiens
  misc_feature 1..113: note = chr1:47904617-47904730
  misc_feature 1..113: note = hyper
  source 1..113: mol_type = genomic DNA
gggctggctctcccggcctacggcgcacccccgccggggccggccccgcatccgcacccgcacccgcacgccttcgctttcgccgcggcagccgccgccgctccttgccagct

SEQ ID NO: 69640 - DNA, 718 bp, Homo sapiens
  misc_feature 1..718: note = chr1:47909442-47910160
  misc_feature 1..718: note = hyper
  source 1..718: mol_type = genomic DNA
gcagcccaattaaagcggttaattcttttcaccgcttattcctccccatctttctttctttctcctggggctcctcggaccacccaggagccggagttgaggtgggggcggacacttcccctccatatccaatttgctcttgccacagcgggcgcgtcttcgtggttacaaagcgctttttccctgatgacttttttccccttttcaaaaacacttctttctccccccttcaactagcaaccctccccaggcccacccctcctccctctccgctccggtttatttaaacttcgcctcctccagcgccgccgcagcgcgcacttaatgaagttgaaggctcggtgagcccgggtgaagagggtttggaatctgttgaaaggggcgttttgtgacactgattggggcgggggcgggggcagtcgcggaccagacaatgaccgaccaggcgggttttcctgcgcacagggtcaggcgaataaaggcgccgacgctgtttaaacgaaggaccttgtaagagaaagggagaaaagattttgtgtgtggagcgtgcctcgtaaggtttcgtgcttaggagaagttgggaggaggcagctcgcctagagtctttacggaccgaattcggagtttatttcgaacactatgcatcaagccaaagaaaagcggggccagtttgggtttgcgcctaacttaattccgatacgcgcgtcaaaatgttgtg

SEQ ID NO: 69641 - DNA, 191 bp, Homo sapiens
  misc_feature 1..191: note = chr1:47910434-47910625
  misc_feature 1..191: note = hyper
  source 1..191: mol_type = genomic DNA
ttccagctctagtttcgggaacggatttttccgcgggctagtgggcgcggcgcggcgcagggcggagcgggcaccgcctccttccgtagcggagcgagagctgccgctcgaggctgaggccgctccggaggcctggaggcttcggactgctggactagtggggaaggaaggcggtttcctccgcagcgccc

SEQ ID NO: 69642 - DNA, 285 bp, Homo sapiens
  misc_feature 1..285: note = chr1:47910748-47911033
  misc_feature 1..285: note = hyper
  source 1..285: mol_type = genomic DNA
cgctcgctgtccgcgactttgcatttctcctgcagcaggggtctctacccggtgccttcctcccggcacgctagcctcctcgccgaaatttcgtcgtcccggagtcggtaaccgagtcccaggctttactgccactccactccctgctgggttatttaagagatacgcggcttccgaggggttttcatcagaccccgcaagtgcgctcggctgggaaggatgcgctccgatgccgctacaggggttccgcgcgtttcaccgcgggaagcccgggcattggagatc

SEQ ID NO: 69643 - DNA, 30 bp, Homo sapiens
  misc_feature 1..30: note = chr1:47911260-47911290
  misc_feature 1..30: note = hyper
  source 1..30: mol_type = genomic DNA
gtgtgtgtgtggtggcggagggtggggtaa

SEQ ID NO: 69644 - DNA, 15 bp, Homo sapiens
  misc_feature 1..15: note = chr1:47911816-47911831
  misc_feature 1..15: note = hyper
  source 1..15: mol_type = genomic DNA
cagttcactgggtgc

SEQ ID NO: 69645 - DNA, 30 bp, Homo sapiens
  misc_feature 1..30: note = chr1:47944568-47944598
  misc_feature 1..30: note = hypo
  source 1..30: mol_type = genomic DNA
ctgaaaaactttgcacgaaactgttctctc

SEQ ID NO: 69646 - DNA, 360 bp, Homo sapiens; identical to SEQ ID NO: 26274
  misc_feature 1..360: note = chr1:48058946-48059306
  misc_feature 1..360: note = hyper
  source 1..360: mol_type = genomic DNA

SEQ ID NO: 69647 - DNA, 51 bp, Homo sapiens
  misc_feature 1..51: note = chr1:48175121-48175172
  misc_feature 1..51: note = hyper
  source 1..51: mol_type = genomic DNA
aaggtcccggggactcggatggagccgcagtgtccccggcccgggcggaga

SEQ ID NO: 69648 - DNA, 304 bp, Homo sapiens
  misc_feature 1..304: note = chr1:48190874-48191178
  misc_feature 1..304: note = hyper
  source 1..304: mol_type = genomic DNA
gcccagcggccggagcgcgcggcgcagccatcgatcgcggctaatggcctcgtctaaatgcggagccgctgcctccgccccccgggtcagggcgcccccgccctcgccccccgctccgtgcaaaatggtgtttaccaaagtcaatattggccgcggcgcccgcccggggcacccgggagcccctctggcctcccccagcccaaggctggatctgggccaccagagcctcatcttggtgtcccaactagccccggccctgacaaggagtcttttgagggctagacacaggcgggtctcgcccagg

SEQ ID NO: 69649 - DNA, 154 bp, Homo sapiens
  misc_feature 1..154: note = chr1:48247049-48247203
  misc_feature 1..154: note = hypo
  source 1..154: mol_type = genomic DNA
ctgctccaagaggagcgtttctgggactgagtagaggagacacttagagggcccaggcctcagcccggccgatggtgcaggcctcaccggatgcccactggatcctgagcactgcgcggcaatggtccacgtgtctggccggcgttcctatcca

SEQ ID NO: 69650 - DNA, 338 bp, Homo sapiens
  misc_feature 1..338: note = chr1:48462159-48462497
  misc_feature 1..338: note = hyper
  source 1..338: mol_type = genomic DNA
gggagcgccccttctcgctcctggctgggagctggagccgggacaggcaggagcgaaggaagggcgcccgaggctgcgcccggggggtggaggtggagcgggcgggctaaggtgggtgcggaagcaggacccaaaccatggtcccacgggactagaatacccaggcaggcgggagagtggccgggcaggcgctcgctcaccgatccgggcggccggcactgtcctccgtccgggggctgcgggcgggcgcgagcggtggcgaggagggcggcgagcagcggccccgccagggcggcgtgcatcctgccagggcccgcggggcgcgggggaccctcctg

SEQ ID NO: 69651 - DNA, 60 bp, Homo sapiens
  misc_feature 1..60: note = chr1:49242299-49242359
  misc_feature 1..60: note = hyper
  source 1..60: mol_type = genomic DNA
cttgtggagcaacagcgcgccccagtcgcggggggcgcgcggggggctctcgggcccggc

SEQ ID NO: 69652 - DNA, 153 bp, Homo sapiens; identical to SEQ ID NO: 26278
  misc_feature 1..153: note = chr1:49242360-49242513
  misc_feature 1..153: note = hyper
  source 1..153: mol_type = genomic DNA

SEQ ID NO: 69653 - DNA, 499 bp, Homo sapiens
  misc_feature 1..499: note = chr1:49242514-49243013
  misc_feature 1..499: note = hyper
  source 1..499: mol_type = genomic DNA
ggggcgggccccggtcgggcagctcagcccgcggggcgggcgcggaggtggggatccggcggggggcgcgagtctcgctacggtgctggggggggcgggggcggctccccaggacccaggctccccccactgttattgttcctgaaagcaccgttctgccaatcggctgctttcgcctgggcgcggaaaagggagggagggggggaaagggggacgaggggcggatgaggggggtttggaagcgcactgccacttgcaaagtcagacccgagcaatcacagccggagcgcgattcgaatggggagggaaaagggttcagagattcagttgcaataaaaataataacaagagcattgcaggaaaaaaatgcattgattaaaaggtgcgctgcgtgcaggattatattgcttcaacaatcgcgctgccaaattgcattgcaacaaaactgcattgccaagtagagaagtgtatgagtgagtgaatgcgggataggggtggg

SEQ ID NO: 69654 - DNA, 225 bp, Homo sapiens
  misc_feature 1..225: note = chr1:50489447-50489672
  misc_feature 1..225: note = hyper
  source 1..225: mol_type = genomic DNA
cgactggctcccctccgccatttttgttgtccctcagtctccgagctcacgcgaagaccgcggggcagtagggagcgggtggtgggatcagtgggctgacaggagctacctcaggaagacgcggcacgacggttgcctgggcaacgggcggcaggcgcgcgggtggccggcgcgcggctgagggcgggagggacgcctgggaggagcgtgcgtccaaggccccgc

SEQ ID NO: 69655 - DNA, 601 bp, Homo sapiens
  misc_feature 1..601: note = chr1:50513629-50514230
  misc_feature 1..601: note = hyper
  source 1..601: mol_type = genomic DNA
cacaggaacctgactcgcaggagtcgtcctccgtctctacgcgaagcgccccctcgaggtgggcagggggtggcggcggcgacggtggcggagccgcagagcgagctagagagcgagagcggtgagactctgcggacgtcttcccgcccgccgcgctccgccccacccagcctccgcagcctcgggccggatcgcccggcggggaagatgcgcctcaagaaccaggtagaagcgcctcggcgcaggccccgcacccccgactctgcccgccctctgttacggacacccgctgggccacgtggtcgcgactggcttctcccagcggccagcctggccaccccgactcccagggagggggagagggcccttgcaagaggatcctgcccccgcgctgcccagacctgagggctcctggcgaccccacccgcagcccatctggcggctctggccccgcaggtcagggtcacacccctgccggcctcctgagacttcccggccccaggggagagagctgaaacttgggttgacgcgcgccccctccccagcgacaggcgaccccgcagcagccccgcgccactcctctctgcgcctttccgtagtt

SEQ ID NO: 69656 - DNA, 665 bp, Homo sapiens; identical to SEQ ID NO: 1710
  misc_feature 1..665: note = chr1:50798652-50799317
  misc_feature 1..665: note = hyper
  source 1..665: mol_type = genomic DNA

SEQ ID NO: 69657 - DNA, 243 bp, Homo sapiens
  misc_feature 1..243: note = chr1:50799393-50799636
  misc_feature 1..243: note = hyper
  source 1..243: mol_type = genomic DNA
cggcggcagccgcggctgccccctactggcggaaggaagagtcgccgctccggggcccttggcggccgccgctcttcgcgcctccttggcctggctgccacccttccaccctcgggggagaccccgcgctctgtgctcactcggggaagagaggctcaatcacggcctggaccagcactagggacctaaacgctcttctcagtgtgcgtgaagccaggtcctcaaatccgccttcagtaagag

SEQ ID NO: 69658 - DNA, 386 bp, Homo sapiens; identical to SEQ ID NO: 26285
  misc_feature 1..386: note = chr1:50880931-50881317
  misc_feature 1..386: note = hyper
  source 1..386: mol_type = genomic DNA

SEQ ID NO: 69659 - DNA, 531 bp, Homo sapiens; identical to SEQ ID NO: 26286
  misc_feature 1..531: note = chr1:50881426-50881957
  misc_feature 1..531: note = hyper
  source 1..531: mol_type = genomic DNA

SEQ ID NO: 69660 - DNA, 1834 bp, Homo sapiens
  misc_feature 1..1834: note = chr1:50882143-50883977
  misc_feature 1..1834: note = hyper
  source 1..1834: mol_type = genomic DNA
cgctttctcccgcctgcctcttttctttctaactcttccctctcctgtctcctctcgccctcttttttctccttttttatccccttttcgtccatcgctcttgccggcatctttcttctctgggtccttctcccccactttcatctcatcgcgctcgcacttcatcaccagacagccaaaccccctttccaattaaagtggaattaggcaactcaatcaaattagttccccattaaagcccttctttattaaaccgttttcttgtcctgctattaagtttcactgcctggcggaactcgagccggccccagaagtttaccttgggatgtcgccggacccagccgaggggaggagtcattcttttcctggagcgggggagtcaccctgcggggagcgggagggactggaggttgaaggagagggtcggcccaggagcggctaatttgctcagctcggcgtgaggagggaaggtgaaaagggtgagagacgaggtctggctcgaagtcgcgtgctcacggcccctctcccaaattacactttttcaaggaaggcagcatgccacccccaactccccagaaccccataactcccaggctgtagcccttgtcagaagaatggtagcagccaccctgcccagccgtcgccttcgttgcctgtggttccaaatctgagatggggagcgcgcagtgtgtacatccaaatctacacctcggaaagagcagggactgggcccccagccttgcaagatccctgtgaagactggggccgacgatccaaaaactaagagccggggcaaggtgacccctccgcaagggtgcccaagctggggtacacactgtgttccctctgctcagcggtcgcgggtccttcgggagttgtgagccccgcgccactctggtgggataggtcttccgagtaccacaggaagtctcctctcccagtagccccgagggtcggagatcccacgggacctcggacaagcgtctccttagcgccgcggcctgagtgggaaatcacgaccttccccagcgccccacccccaccccctatttctcgaggagcgggacgggattcggcattgttttcttagaaaataacatttatttctagctcatatctatgcaaaggaaagcacaaagtgctgctctgcagcagcgttttccgctgcgggcccttcagtcagggcgtttggcgagtcccgggaggcgaggatgggcccgcgagcgggcggttctggctcagtcacacgtcgctctgttcctgcttcagtgcgcaccttgacggctccttagggacagaccagccgcaggcaagaggggcaggtgggcaggattcatcccgagtttccaatatatttaatctctaaacctgataagtacaatgcgcgcatagtctaatttttttccattttgtccctttttttgcttgttttgaatgtttttcacgttaataccgaggtcacctacagattacaattaataacttagaattccattttataacattatacactggcttgtatatatatatgtatagattatatatagatttatacatatataaaaacacactgcaccaaggaaacccatgcttatcggcataagcaacaaagagagcgacaaataccgcaacgaggaaagtgcaccttaaaacttgtttcctttttttttttttacaattgtatcgatatatatgtgtgtcccaaagactcagtgccaagagatttatacatcctaaatttatatttgttagagcgaatatttaaattttttaaaagtgagggctggggagacacagaaaagactctcggattatcctgccatccactgagagc

SEQ ID NO: 69661 - DNA, 333 bp, Homo sapiens; identical to SEQ ID NO: 46
  misc_feature 1..333: note = chr1:50884020-50884353
  misc_feature 1..333: note = hyper
  source 1..333: mol_type = genomic DNA

SEQ ID NO: 69662 - DNA, 198 bp, Homo sapiens; identical to SEQ ID NO: 47
  misc_feature 1..198: note = chr1:50884690-50884888
  misc_feature 1..198: note = hyper
  source 1..198: mol_type = genomic DNA

SEQ ID NO: 69663 - DNA, 330 bp, Homo sapiens
  misc_feature 1..330: note = chr1:50885248-50885578
  misc_feature 1..330: note = hyper
  source 1..330: mol_type = genomic DNA
cgagcctgagccgggccgcacctctggggacgacgtcccgggccccgagtctgcgccgtcgggtgataagggcttcaccggcggcggcagcgggctgcccgggcggcctgcctgcagcagcgtcttaggaaacaggtcaaacttctgcaacttggcctctgggaggggagaaaacgtgtcgtgaggagcggttagctagaagacagcagtcacagcacctcggccctttggatctcagtttcctctccctcagccccacagcccttattcactaggctccagtgcccctctttctttttgctctagcattccttccgctctgagccccta

SEQ ID NO: 69664 - DNA, 1135 bp, Homo sapiens
  misc_feature 1..1135: note = chr1:50885950-50887085
  misc_feature 1..1135: note = hyper
  source 1..1135: mol_type = genomic DNA
ctcccaagtttagagcggatccctcctttccctcaacggctctggcctaatttcttccctccccacaaaaagccacgggggtccagaaaaagagggtggtgctaggcaggcagtaggaagcgaagaggaaaagacataggaaagcagacctgagaaaccagggagggtgcggaagaaactagaaggagggagggcgcagcaagcggttgtccagagggcgttaggaacgcgagaaggggaaaagaaactagggcgtctcagaacctagggcgtctcaaaacctagggtgtcagttaaagggggggggattccttaagggagttgggaaggagcagagggaaagggcctgtggagaagcgcagagcgaacgaagatgcgcaggtttccacctggggagaagacgaagcaaagaagcagggacctgcctgcgtttgggtagaggcgagtaaaaaaattaaagcgtgtacatttcggcccgatgcaggagaaaggggtaaagtgcaaatgctccagaagcgggagaaaggagagtttctgtacccacgctccatacccgaggctgggcgagcggtgaaccctagcagtcgcggcgactggacacgggggttctactctttctgaaccgagacaagcccctgggccccgtgccccagagctacgatcctgctgcccctacctgcggcctggccgcgctctcacctgagccccctgcgccagctgctccgcctccggtccccgcgggcgctcccgctccaggtcccccgccgtcggcggcgcacactgaaccgaagacctcgtaggcgggcctcggggggatgatgccgttggcggcggccagcgccagcccctcggcagtgccgtagagcagctgcagctcgcgcgcctcgttctcctcctgcgcctgctgcctgcgcagcgccacctgcgccgccatgacacgctggcgctccgcgatgagcgtgcacttggcgcacaggcagtccttccagcgacagtagcgtttgtggcccttgagggccgacaccacgccatggttgcgacagcgcgcgcacttgggggtccgcgggtacttctcggctgcccgcagcaacagtggcggcccccgcagcaagccgcctgccacgctcaccggtag

SEQ ID NO: 69665 - DNA, 125 bp, Homo sapiens
  misc_feature 1..125: note = chr1:50887175-50887300
  misc_feature 1..125: note = hyper
  source 1..125: mol_type = genomic DNA
gggcacgctgggcagctccgagcgcagctccatgacaggacctgacgggaaagaaggtgggagaggggagagacctggtgaggagcacaccgcgcgctaggccaaagcgccgccttgaggaaccc

SEQ ID NO: 69666 - DNA, 30 bp, Homo sapiens; identical to SEQ ID NO: 26294
  misc_feature 1..30: note = chr1:50887723-50887753
  misc_feature 1..30: note = hyper
  source 1..30: mol_type = genomic DNA

SEQ ID NO: 69667 - DNA, 570 bp, Homo sapiens
  misc_feature 1..570: note = chr1:50888226-50888796
  misc_feature 1..570: note = hyper
  source 1..570: mol_type = genomic DNA
gtctggagtagtagtcggggcggaagacgtatcctgcgaaaagttaggcatttcgggagggggatctttctcgaagaccacctcacactgccctcccctcccctccgggtttagggacagagtcgtcagacacgccctccccgtcttggggtcccaggggacccctctcgagcgcaggctcctgcgttctgatctcagagttggggtcctaggacacggatggcccagcaggccgcaccaagccaggggagtcgccttcgcaactggccataaacggacaccagagtccctcccacgccgcagccccataaggcccaagcaggcccagctccccgcttctgccgcggtctcctctgcttcccgcgttccccgtccctgccagagcccgcgacagagtccttgtgtctccgtccgagagtcccagacctcctctctatgagcgttgcctcctctcccagacccttcgggcgtccctaaggcccacggggcccaggcctcctcaacaggggccgcagaccaggtctccacccactgctctccctgcggccctcaactacctgccttgggctc

SEQ ID NO: 69668 - DNA, 1526 bp, Homo sapiens
  misc_feature 1..1526: note = chr1:50889123-50890649
  misc_feature 1..1526: note = hyper
  source 1..1526: mol_type = genomic DNA
cgcccgctctattgttggtccttagggctccattagacagaattggacaacaatgtggcgcctgccattggccaggggaggcagacggcgctctgattggccgggcccgcgcccggggagccccgcattctgcagtgtccgaaagattcgaaactccaaaagctccactgcgtgcctctgggaggggagggggcgcgccaggaaaggagtggaaaaaagtgggcgaggaggagcgttgaaaatttcctgacaagtagtttccgtgcgcccgagagcgtgtgaattgctcctaattaccgtgtccggtgcgcctctctgcgtagacttgtgtaacctctcggcttctggggcgccggctcggctgcaccgctcttactggcctggggcgcttggcaaagccgagcttcccaagtggctctggagccctgaggcgggatggggggcaggtgacaattcaattactgcggtcggggtaggggcgggacaagggtgcgggggtggggaagggagggtgttcaaggcataaatgccaggacgatttttcctgccttcttcctgctatgtttcggcgcgctcccaaatccgacgagtttggggtagttgggggctgctttggttttttcctcctgtctccttaaagctcagttactttattttaaaagtcctgatacgatagtcatcctggagggtaagtgtggtttatgaagattttcgtgtttaaagagaagctcagcgaagagaaatgagattgcacttcctgtcggtgcccgccacgtccctcgcgccctgagcctttcctctccccgcccctcttttcgcgtccctcagccccttttgagctctcttttcctcacttttcagcatctcgatttcttttccgtggtggtgggattctttttgtcgttattgcaaatgaacaaatagcccccccccctttttttttcttttctaaacgaaagtaaaaagtggcctctgtgtctccgcagattctcttaaactcaggacgcgcatcggtctgtccgaccttcccggcaagagacaaagtcactgctgggaggccccctcggacagttttcagttttaactttcgccttattctcgtcttgtcttgatgtcacggccctgaggaacagctcgttctgcagaagaggtaacaggtttcagattttgtttcctttttgaaaggctgttgcctttcaaacatctggaattaatgccgcggccctcgggcgagtcgccctcggtttctgtagctctgattttatctctgtgtcttttcccctctaatttctaaagttctgtttttccctctaattctgtttttccctctaatttctaatgttctgtcactctcgtttttgttctctacttttctctctctccttcagaataaagaaaattcgtttaaataatgaggaaaatgagcgttcctgtcgttctccctccactcttgaccgtgcgtctctgcgttgctctttcgaacctccaggccggcgggaatctgggcgcgcagactcggcccgggt

SEQ ID NO: 69669 - DNA, 689 bp, Homo sapiens; identical to SEQ ID NO: 26299
  misc_feature 1..689: note = chr1:50890795-50891484
  misc_feature 1..689: note = hyper
  source 1..689: mol_type = genomic DNA

SEQ ID NO: 69670 - DNA, 131 bp, Homo sapiens; identical to SEQ ID NO: 1725
  misc_feature 1..131: note = chr1:50892153-50892284
  misc_feature 1..131: note = hyper
  source 1..131: mol_type = genomic DNA

SEQ ID NO: 69671 - DNA, 813 bp, Homo sapiens; identical to SEQ ID NO: 26301
  misc_feature 1..813: note = chr1:50892336-50893149
  misc_feature 1..813: note = hyper
  source 1..813: mol_type = genomic DNA

SEQ ID NO: 69672 - DNA, 273 bp, Homo sapiens; identical to SEQ ID NO: 5498
  misc_feature 1..273: note = chr1:50893150-50893423
  misc_feature 1..273: note = hyper
  source 1..273: mol_type = genomic DNA

SEQ ID NO: 69673 - DNA, 359 bp, Homo sapiens; identical to SEQ ID NO: 26303
  misc_feature 1..359: note = chr1:50893518-50893877
  misc_feature 1..359: note = hyper
  source 1..359: mol_type = genomic DNA

SEQ ID NO: 69674 - DNA, 379 bp, Homo sapiens
  misc_feature 1..379: note = chr1:50896073-50896452
  misc_feature 1..379: note = hyper
  source 1..379: mol_type = genomic DNA
cttcctggggcattgcggatggtgtgcaccggctacgtggtcttctttgggccatccttctcctggtttccatctcccaagaggaccccttgaaatagcgattccgagaatcggctccggggctgatgagccatccagatacggagcttccgccgcactgtgtgaccgtgagcgagtcgccagccctctctgggctcgcctcccggctaccccggagtcagactgcctggaggataggcagccaggccactacttgtggagaaaggagactgtagagaggaggggcattcgggctggttcctgggccgggtcagcctgggtttgagtccagactccctccctccgtagtgcggcgagtgaccttcggcagccaagtagt

SEQ ID NO: 69675 - DNA, 30 bp, Homo sapiens; identical to SEQ ID NO: 38979
  misc_feature 1..30: note = chr1:50918985-50919015
  misc_feature 1..30: note = hypo
  source 1..30: mol_type = genomic DNA

SEQ ID NO: 69676 - DNA, 225 bp, Homo sapiens
  misc_feature 1..225: note = chr1:51099269-51099494
  misc_feature 1..225: note = hypo
  source 1..225: mol_type = genomic DNA
tgagctctgtcactacggcaaccagcagggaataagtatctgtgggtctatgaatttcagaatcccataaaagccagggctaaaaaggcatgtgcagcctctcagagattgactgcattaatacattagcaaatactgtgaaacactggataaatgtcagcaattatggaaaaagcgtctaataacgatattcgttgcctgtcaaacccccgtgaggtttgatat

SEQ ID NO: 69677 - DNA, 20 bp, Homo sapiens
  misc_feature 1..20: note = chr1:51176289-51176309
  misc_feature 1..20: note = hypo
  source 1..20: mol_type = genomic DNA
ttcgagacagagtctcgctc

SEQ ID NO: 69678 - DNA, 30 bp, Homo sapiens
  misc_feature 1..30: note = chr1:51439947-51439977
  misc_feature 1..30: note = hypo
  source 1..30: mol_type = genomic DNA
gggagggctcccccacgttgcctctacttt

SEQ ID NO: 69679 - DNA, 481 bp, Homo sapiens
  misc_feature 1..481: note = chr1:51442325-51442806
  misc_feature 1..481: note = hyper
  source 1..481: mol_type = genomic DNA
aattcagttcttcaccgctgcgtccacattcacgtcgggaaacttggtctcagcctttgcccaggaagctgaagccaggcttacacctgggggtggagggcactaacatgacctcggttcaagttctggtccccgaactgctaaacaaagtgtcttttatcacattttggtagtgaattaagttttctgataaacattatgcatcttgcaacggtgtgatgagttcatgtacacacacaccacaatgggcgactgatcaataagtaggttaagtattctgtcccgagaaagcaatatgatgtatttcccttatcgtattgatcaaaagaacgttgtggatggagtccgtggcccaggactggtttcgaaatctcagttcccaaaaaggtgctttcggcttttgccgggggtagaagtaaatagtccataggcgccgggcagtcacagtgctggagcaagaaaaggtcgtgctcacagcctt

SEQ ID NO: 69680 - DNA, 35 bp, Homo sapiens
  misc_feature 1..35: note = chr1:51727596-51727631
  misc_feature 1..35: note = hypo
  source 1..35: mol_type = genomic DNA
gctcactgcaacctccgtctctccggttcaagcga

SEQ ID NO: 69681 - DNA, 159 bp, Homo sapiens
  misc_feature 1..159: note = chr1:51761751-51761910
  misc_feature 1..159: note = hypo
  source 1..159: mol_type = genomic DNA
gaaataattccacttcgtcgtccccgaacggcttgtggtcctccttcccaaacatgctgaggtaggcggccttcatgtaaatgtaggtggcctgtgcgagacagagcaacagccaggtgtgagcagccctcctccagccccagccgggctggaatctgc

SEQ ID NO: 69682 - DNA, 209 bp, Homo sapiens
  misc_feature 1..209: note = chr1:51763180-51763389
  misc_feature 1..209: note = hypo
  source 1..209: mol_type = genomic DNA
gcgtctggccccggtcccatctttaacctcccgggtcacccttgtcctctccctttcccctgcccctgacgtggagacaccaagtcccggtgactttacctcccgtctcactctaggatcctgctggccttgccctacggctctcattatcggactgccaccatctccacaccgtctccctgttccaggctacccgggatgtctttctg

SEQ ID NO: 69683 - DNA, 213 bp, Homo sapiens; identical to SEQ ID NO: 38985
  misc_feature 1..213: note = chr1:51795524-51795737
  misc_feature 1..213: note = hypo
  source 1..213: mol_type = genomic DNA

SEQ ID NO: 69684 - DNA, 17 bp, Homo sapiens
  misc_feature 1..17: note = chr1:51810611-51810628
  misc_feature 1..17: note = hyper
  source 1..17: mol_type = genomic DNA
ccccttggtcccgtccg

SEQ ID NO: 69685 - DNA, 30 bp, Homo sapiens
  misc_feature 1..30: note = chr1:52068030-52068060
  misc_feature 1..30: note = hypo
  source 1..30: mol_type = genomic DNA
gtatggtaatttattcgtatactttcataa

SEQ ID NO: 69686 - DNA, 37 bp, Homo sapiens
  misc_feature 1..37: note = chr1:52084092-52084129
  misc_feature 1..37: note = hypo
  source 1..37: mol_type = genomic DNA
atggtgtatagttgacgatagccgatatgagggaaga

SEQ ID NO: 69687 - DNA, 37 bp, Homo sapiens
  misc_feature 1..37: note = chr1:52094622-52094659
  misc_feature 1..37: note = hypo
  source 1..37: mol_type = genomic DNA
tacaggcctgagctaccatgcccggccttagcttaac

SEQ ID NO: 69688 - DNA, 28 bp, Homo sapiens
  misc_feature 1..28: note = chr1:52194940-52194968
  misc_feature 1..28: note = hyper
  source 1..28: mol_type = genomic DNA
cgacacaactttccggaagtaagcaaaa

SEQ ID NO: 69689 - DNA, 30 bp, Homo sapiens
  misc_feature 1..30: note = chr1:5220720-5220750
  misc_feature 1..30: note = hypo
  source 1..30: mol_type = genomic DNA
accgtggcgatgcctcggtgtgttgcaatg

SEQ ID NO: 69690 - DNA, 128 bp, Homo sapiens; identical to SEQ ID NO: 38986
  misc_feature 1..128: note = chr1:52455042-52455170
  misc_feature 1..128: note = hypo
  source 1..128: mol_type = genomic DNA

SEQ ID NO: 69691 - DNA, 117 bp, Homo sapiens
  misc_feature 1..117: note = chr1:52456223-52456340
  misc_feature 1..117: note = hyper
  source 1..117: mol_type = genomic DNA
cgcggactccgagtgcgggacgacgggttcgctcccggacggtcggcgggacggcaggacctggcgtcgggagggcgcggagggggccggggcggggcgctgcgggatggtctggtc

SEQ ID NO: 69692 - DNA, 39 bp, Homo sapiens
  misc_feature 1..39: note = chr1:52524541-52524580
  misc_feature 1..39: note = hypo
  source 1..39: mol_type = genomic DNA
gattacaggcgtgagccaccgtgccgggcctgaatttgg

SEQ ID NO: 69693 - DNA, 80 bp, Homo sapiens
  misc_feature 1..80: note = chr1:52832632-52832712
  misc_feature 1..80: note = hypo
  source 1..80: mol_type = genomic DNA
tttctaaggaaagcacgtttctccctgcggcttgcagagtccagttaacaagagattgagctcaggagtccgagaccagc

SEQ ID NO: 69694 - DNA, 316 bp, Homo sapiens
  misc_feature 1..316: note = chr1:53067865-53068181
  misc_feature 1..316: note = hyper
  source 1..316: mol_type = genomic DNA
cctggctctggggtccggggcaggggtgcgctgcctcaggacagacggtgaaactgaggtccagagccggacatccaccgcctgcggagggaacgagaacgcggcgcgtcctgccttgcgggccgagcggcgccagagccgcctcctcccgccccccgcgctagatccccccgccccgtctttgccctcgcgacgccgccacctccggaacaagccatggtggcggcgacggtggcagcggcgtggctgctcctgtgggctgcggcctgcgcgcagcaggagcaggacttctacgacttcaaggcggtcaacatcc

SEQ ID NO: 69695 - DNA, 479 bp, Homo sapiens
  misc_feature 1..479: note = chr1:53068182-53068661
  misc_feature 1..479: note = hyper
  source 1..479: mol_type = genomic DNA
gggcaaactggtgtcgctggagaagtaccgcggatcggtgagtgcgcggggtctggcggcgccgctgggcccggcctcgccctggcggggcctgctggggacgccccgcagcccggtcccccgcgcggtgtggctccgaggacgctccagccgcgcggccgccaaaccccggcccccgccccgctcggccgtgacctctggcgcggcgcccccatcccgcgcccggcccggcccggcccgcggctacgtggcacggccttggcgcggaggaacccgaagcgctcgcagtcggcgcccacttcgctaccggcacctttgggcagcggggtccagaccttcgccgggaggccgggcaccactgcccagcctttgccattcacgggtgaaaaaagtaaccgtagcatcgtgcggcctttccctctcccgtcctcattttctgcatctggaacggggagtggctgattcggagtccagtgaag

SEQ ID NO: 69696 - DNA, 394 bp, Homo sapiens
  misc_feature 1..394: note = chr1:53098659-53099053
  misc_feature 1..394: note = hyper
  source 1..394: mol_type = genomic DNA
tgtctgccccagccccgaatgccccgagactcccggcgccggctcggtgcaggtaaggcgcccgcgccctggcctcgaattcccgccccgccactctggccgcgtcgtgctgtcgttgcgcacccagcgccctcgtgcaggcagggggagcgcagtggggagggggcaggaagcgcaggcagagccaggcgagcacgcggctcccggcccagctccccgcgtccgctccggctcctgccgcgttccagcagccgtcactcccgccgccggcccccgccgcccgccccgcctgcccctacccctccgcgcgggccgggcacctggccgccgctcggtcctcggggccccgcgctgctgtctctgtctcggcttctctcggcccctgggtctcttc

SEQ ID NO: 69697 - DNA, 312 bp, Homo sapiens; identical to SEQ ID NO: 5502
  misc_feature 1..312: note = chr1:53099054-53099366
  misc_feature 1..312: note = hyper
  source 1..312: mol_type = genomic DNA

SEQ ID NO: 69698 - DNA, 32 bp, Homo sapiens
  misc_feature 1..32: note = chr1:53129138-53129170
  misc_feature 1..32: note = hypo
  source 1..32: mol_type = genomic DNA
atcagaacatgtggccgggcgcggtggctcac

SEQ ID NO: 69699 - DNA, 368 bp, Homo sapiens
  misc_feature 1..368: note = chr1:53168827-53169195
  misc_feature 1..368: note = hyper
  source 1..368: mol_type = genomic DNA
tccaggtggcttgctcgggggctgcccagctcgccgtcctctgcagatcccctcgggactctcagcattttgtgggttagccgtggagacgccctgcccttcctgctttggccagtcaaccccctcaagcccgtgcccgtagagcctgcagcccttcctcacctcatcactccccatccccccaagatatagaaaggccgtgacagctgccagccctgcacatgctcttgtttcaacagcggcgattgcacatcacgtagtccccacgtgacctgtcgggcctagggcaagcgcaaagctttcggaaacccgaattattgcaaccttgacttcctgcctgtctctgaggctcccgggctgtgctttaa

SEQ ID NO: 69700 - DNA, 340 bp, Homo sapiens
  misc_feature 1..340: note = chr1:53308268-53308608
  misc_feature 1..340: note = hyper
  source 1..340: mol_type = genomic DNA
gggaggctggggaggcgggaggagaacggttggccccggcagcggcgtgtcggagggcggatggggctaggaggccgcccggggggtggggtctgcggcgggccggcccccgcgtgcgcgtcgcctcgccgggcatttcaaaagctcgccggcagggcgcggcgctagctccgtgtgcctcgcaggcgtggtgggcgcgtcctggcagccgcccgcttggttctcgcgggatccgggctccggctcgacgccggctctctttttgacgccccgccgccggggttgccatggttcatttcttgcacccgggccacacgccccggaacatcgtccctcctga

SEQ ID NO: 69701 - DNA, 368 bp, Homo sapiens; identical to SEQ ID NO: 1728
  misc_feature 1..368: note = chr1:53308907-53309275
  misc_feature 1..368: note = hyper
  source 1..368: mol_type = genomic DNA

SEQ ID NO: 69702 - DNA, 30 bp, Homo sapiens
  misc_feature 1..30: note = chr1:53392828-53392858
  misc_feature 1..30: note = hyper
  source 1..30: mol_type = genomic DNA
tcccatgcccaagtccgcaaattagggatt

SEQ ID NO: 69703 - DNA, 39 bp, Homo sapiens
  misc_feature 1..39: note = chr1:53479895-53479934
  misc_feature 1..39: note = hypo
  source 1..39: mol_type = genomic DNA
ccagctctccttcaatagctggtccgatagaaaggcaaa

SEQ ID NO: 69704 - DNA, 136 bp, Homo sapiens
  misc_feature 1..136: note = chr1:53527470-53527606
  misc_feature 1..136: note = hyper
  source 1..136: mol_type = genomic DNA
tcagaggcactgggtcgaaggacccctctccccagccctcctttcaggtgtcggggcctaaagggggtccagttccagtgcggaaggctgggaactaggaagcgtcgcggaccagacagcccgccttcccggtctc

SEQ ID NO: 69705 - DNA, 317 bp, Homo sapiens
  misc_feature 1..317: note = chr1:53527817-53528134
  misc_feature 1..317: note = hyper
  source 1..317: mol_type = genomic DNA
ggggcgggagagaggcggggaggagaaaacccacaacaaaacttgcgtcgcggagagcgcccagcttgacttgaatggaaggagcccgagcccgcggagcgcagctgagactgggggagcgcgttcggcctgtggggcgccgctcggcgccggggcgcagcaggtacagggcgctggcagccggggtgggccgaggggccgggggctgagcccgggcagcgcactcagacgtccccgcctctccggatggctccagcagctgcctggggcgggcccgccgcatctcaccccctctgtaggaccctgcacccagggca

SEQ ID NO: 69706 - DNA, 617 bp, Homo sapiens
  misc_feature 1..617: note = chr1:53528170-53528787
  misc_feature 1..617: note = hyper
  source 1..617: mol_type = genomic DNA
cgcagtcaggacccaggcaggggccttctcctctctgagcagaggctggtccccgtccccaggcccctcccgctgcgcacatctggaaagaatctgagggcggttgggggcgggggctggagtgggaggacgccggcgggcgacagggaatgtggggggcaggtggaactgcgtaggggcggggacccctgtcatgagagcctgggcccgaagtatccccgcgtctttccacgtcaactcatcaggccccctagcgactccaacctccacctctttatagatagagaaactgaggcccagagaggggcagaggtctggccccagggcgcgtcggacgccgggtgggtcccctccggggctcggcttccccggccactgtgccgccccagcttagtgccaaccactagttgagctaaaggtctcagctggcggtctggagtccgtctatctgtctacgcggctgcttcccagccgggacagctggagggaggaaggggtgggggtccgcgaagcgcgaggagcgagatccgcgccttcctgcgaatgaggcagaagccccaggttccaggtccccgagccacagcccggcctggggcgggggacgagatcttggcgtt

SEQ ID NO: 69707 - DNA, 30 bp, Homo sapiens
  misc_feature 1..30: note = chr1:53561195-53561225
  misc_feature 1..30: note = hypo
  source 1..30: mol_type = genomic DNA
acactcacaccgcctcggtacactcaactc

SEQ ID NO: 69708 - DNA, 30 bp, Homo sapiens
  misc_feature 1..30: note = chr1:53573022-53573052
  misc_feature 1..30: note = hypo
  source 1..30: mol_type = genomic DNA
gagaaaaaggacattcgtggaaaaactgat

SEQ ID NO: 69709 - DNA, 24 bp, Homo sapiens
  misc_feature 1..24: note = chr1:53703048-53703072
  misc_feature 1..24: note = hypo
  source 1..24: mol_type = genomic DNA
aaaaccttccaagcccggccgggc

SEQ ID NO: 69710 - DNA, 27 bp, Homo sapiens
  misc_feature 1..27: note = chr1:53705674-53705701
  misc_feature 1..27: note = hypo
  source 1..27: mol_type = genomic DNA
tcagtcttaacacggagtccttttctc

SEQ ID NO: 69711 - DNA, 102 bp, Homo sapiens
  misc_feature 1..102: note = chr1:53990535-53990637
  misc_feature 1..102: note = hypo
  source 1..102: mol_type = genomic DNA
cagggatctgacaggcgtacggcttctgtaacatggggggcacgggtggggtgagtgaggcccatccctacgggacacgcgcctccgcgtgacctgctgtgg

SEQ ID NO: 69712 - DNA, 38 bp, Homo sapiens
  misc_feature 1..38: note = chr1:54142594-54142632
  misc_feature 1..38: note = hypo
  source 1..38: mol_type = genomic DNA
tcaaatcccacttaccggtcctgcgggccctctggcct

SEQ ID NO: 69713 - DNA, 876 bp, Homo sapiens
  misc_feature 1..876: note = chr1:54203828-54204704
  misc_feature 1..876: note = hyper
  source 1..876: mol_type = genomic DNA
gtattgtcccggggccgagtttgagcaggtcactgccccttcggtggattgcgcgtctttaacataggttagcaccacgacacctagcccaatcagaggtcaaacccacctgattccacgcaaaagccccctcgctcaggagcggttcgcccttccctggtgtggggaggaccccaggcccccgcgccgcggcgcattaccgcgaagtcccacccaaatcctcctccaccgaaaccagcctcctttgcacgaatggtgaaactgaggcctggagcgggtaaggcgcctgttccgcgtcccccagtggaacacggagccggcggcaacgaggattcccagagcagggctcgggcgaagccccggagacggctccgggtaggtcacgggctgcgcgcttcgtcgactctccggggccgagctgcgcgcagaagctggggacccgaacccaaaggcccgagggaaacccccagagactcacccgcgaccacccgaacctggaaaacaggagtcccaagctgggcgctgaatcctgcgacgcgaacccatcacgcgcagccgggacacccacattcctatgcgcagcggaggaatcgagcccgtcgcgcgcgcaaaccggcacagtgggcaatgcccacgcggccgccgccacacacccgcacacccgccgaggcacgcccggggacggacacgccacccacactgccgctggtcagacgctcagcagcgcacaaccacacagtcccacgctctcgccacacgcgcgtgcgatgggggccgcgacagagcctccctcagcccttccatcaggggcccccaaactctccgttcccctccgcgctccctgcgccatccccaagctgccggggttcgagcgtc

SEQ ID NO: 69714 - DNA, 43 bp, Homo sapiens
  misc_feature 1..43: note = chr1:54530324-54530367
  misc_feature 1..43: note = hypo
  source 1..43: mol_type = genomic DNA
gactaggcaagcgaccggttttgttggttgtgcatttttcctt

SEQ ID NO: 69715 - DNA, 407 bp, Homo sapiens; identical to SEQ ID NO: 14242
  misc_feature 1..407: note = chr1:54586590-54586997
  misc_feature 1..407: note = hypo
  source 1..407: mol_type = genomic DNA

SEQ ID NO: 69716 - skipped

SEQ ID NO: 69717 - DNA, 95 bp, Homo sapiens
  misc_feature 1..95: note = chr1:54587534-54587629
  misc_feature 1..95: note = hyper
  source 1..95: mol_type = genomic DNA
cgcctctttctccaggcatagtcgtactcacacgcactctcccgcccacccagaccccagatcccccgacactcacagcacggcaggagcatagg

SEQ ID NO: 69718 - DNA, 30 bp, Homo sapiens
  misc_feature 1..30: note = chr1:5463052-5463082
  misc_feature 1..30: note = hypo
  source 1..30: mol_type = genomic DNA
aaatgccagactgagcggctaaatacaggc

SEQ ID NO: 69719 - DNA, 30 bp, Homo sapiens
  misc_feature 1..30: note = chr1:54683784-54683814
  misc_feature 1..30: note = hypo
  source 1..30: mol_type = genomic DNA
tgttttaattgctgccgttaaacctagtag

SEQ ID NO: 69720 - DNA, 30 bp, Homo sapiens
  misc_feature 1..30: note = chr1:54712302-54712332
  misc_feature 1..30: note = hypo
  source 1..30: mol_type = genomic DNA
agcctctccaagaaccggcatggcagcttc

SEQ ID NO: 69721 - DNA, 186 bp, Homo sapiens
  misc_feature 1..186: note = chr1:54722666-54722852
  misc_feature 1..186: note = hypo
  source 1..186: mol_type = genomic DNA
gtaagctaccagccacgttaaacctgcccctccacccctcaatcctttccctcaactttcattttgtgtcaaagtccacctagggccaaggatggctgagggaggggagagagaacatgaaaaggtacagtacctggtttcccattctgatcgggggcctggggccgcctgcgtatcgcggtgaca

SEQ ID NO: 69722 - DNA, 30 bp, Homo sapiens
  misc_feature 1..30: note = chr1:54757013-54757043
  misc_feature 1..30: note = hypo
  source 1..30: mol_type = genomic DNA
atgccagggaaggggcgcataattcaaacc

SEQ ID NO: 69723 - DNA, 35 bp, Homo sapiens
  misc_feature 1..35: note = chr1:54757429-54757464
  misc_feature 1..35: note = hypo
  source 1..35: mol_type = genomic DNA
gacccaacaacactacgaagcgctgggcacttatt

SEQ ID NO: 69724 - DNA, 52 bp, Homo sapiens
  misc_feature 1..52: note = chr1:54766254-54766306
  misc_feature 1..52: note = hypo
  source 1..52: mol_type = genomic DNA
aaggattatttctgccggagggtggggcttcacagagcggtgacatctgatc

SEQ ID NO: 69725 - DNA, 30 bp, Homo sapiens
  misc_feature 1..30: note = chr1:54808954-54808984
  misc_feature 1..30: note = hypo
  source 1..30: mol_type = genomic DNA
ctggatctaactgtacggccctggacaagt

SEQ ID NO: 69726 - DNA, 30 bp, Homo sapiens
  misc_feature 1..30: note = chr1:54814665-54814695
  misc_feature 1..30: note = hypo
  source 1..30: mol_type = genomic DNA
tgctcttcacccattcgacaagaaacaggt

SEQ ID NO: 69727 - DNA, 33 bp, Homo sapiens; identical to SEQ ID NO: 38995
  misc_feature 1..33: note = chr1:54839900-54839933
  misc_feature 1..33: note = hypo
  source 1..33: mol_type = genomic DNA

SEQ ID NO: 69728 - DNA, 20 bp, Homo sapiens
  misc_feature 1..20: note = chr1:54849481-54849501
  misc_feature 1..20: note = hypo
  source 1..20: mol_type = genomic DNA
ataaaaagcaagaaccggcc

SEQ ID NO: 69729 - DNA, 17 bp, Homo sapiens
  misc_feature 1..17: note = chr1:54880702-54880719
  misc_feature 1..17: note = hypo
  source 1..17: mol_type = genomic DNA
cccggccacgtagagca

SEQ ID NO: 69730 - DNA, 373 bp, Homo sapiens
  misc_feature 1..373: note = chr1:54940331-54940704
  misc_feature 1..373: note = hyper
  source 1..373: mol_type = genomic DNA
gctagaatgtgagatcgcggagggttgagtggcttttgccccacatcctgcggccagcagccggccatggctaggagaggcgcccgacgcctggcgctccccgtccgggtctccggccgctgcggggctgtgagggcccccggcggtaccggccgggggtggcccagctggggtgggcttggggccagatgggctgcgcagcggcggggaggcagggccggcaggcaggggccgcgcgttgccatggggacgggggtgggggcggcagccccgcccgggcgcagggggagcaggtggcgggtcggtgagcaggctgggggaggggccggaaggggcccgcggggtcggggcgcgcccccggctcctccgccgc

SEQ ID NO: 69731 - DNA, 23 bp, Homo sapiens
  misc_feature 1..23: note = chr1:55231044-55231067
  misc_feature 1..23: note = hypo
  source 1..23: mol_type = genomic DNA
tttgtttttttgagacggagttt

SEQ ID NO: 69732 - DNA, 65 bp, Homo sapiens
  misc_feature 1..65: note = chr1:55446357-55446422
  misc_feature 1..65: note = hyper
  source 1..65: mol_type = genomic DNA
caccggagtggagggcgaggcccgggtcccgcgctcccctgggcgccccacggcagcctcagagc

SEQ ID NO: 69733 - DNA, 30 bp, Homo sapiens
  misc_feature 1..30: note = chr1:5544893-5544923
  misc_feature 1..30: note = hypo
  source 1..30: mol_type = genomic DNA
gatagaaggatgagtcggctgcctggtgag

SEQ ID NO: 69734 - DNA, 63 bp, Homo sapiens
  misc_feature 1..63: note = chr1:55462125-55462188
  misc_feature 1..63: note = hyper
  source 1..63: mol_type = genomic DNA
cgctcgccttgcctgcgtggacctcgatgcttacctctgtcaaatgggcgtgctctttccctc

SEQ ID NO: 69735 - DNA, 261 bp, Homo sapiens
  misc_feature 1..261: note = chr1:55462673-55462934
  misc_feature 1..261: note = hyper
  source 1..261: mol_type = genomic DNA
ctgggaggggaggtgcggtcaccgctcagccgccgactcagccgagggagaccttggccagcccctgccactccgcaggctcggtttcctcgcctgtgaaatgcgggcgatgactcccctccccgccgcgactgctcatcaccgggtccgagcccagccgctgaccccgggggaagcgccttgctcagcgccgggcggcccacgaggccctgcaggaccgcggctgcggagaccgttcccgccacccgcctgggctccagg

SEQ ID NO: 69736 - DNA, 117 bp, Homo sapiens
  misc_feature 1..117: note = chr1:55505045-55505162
  misc_feature 1..117: note = hyper
  source 1..117: mol_type = genomic DNA
tttttcttccctctgcgcgtaatctgacgctgtttggggagggcgaggccgaaacctgatcctccagtccgggggttccgttaatgtttaatcagataggatcgtccgatggggctc

SEQ ID NO: 69737 - DNA, 43 bp, Homo sapiens
  misc_feature 1..43: note = chr1:55505516-55505559
  misc_feature 1..43: note = hyper
  source 1..43: mol_type = genomic DNA
accgtcagctccaggcggtcctggtggccgctgccactgctgc

SEQ ID NO: 69738 - DNA, 155 bp, Homo sapiens
  misc_feature 1..155: note = chr1:55529091-55529246
  misc_feature 1..155: note = hypo
  source 1..155: mol_type = genomic DNA
ccctgggacctcccacgtcctgggggcctacgccgtagacaacacgtgtgtagtcaggagccgggacgtcagcactacaggcagcaccagcgaaggggccgtgacagccgttgccatctgctgccggagccggcacctggcgcaggcctcccagg

SEQ ID NO: 69739 - DNA, 32 bp, Homo sapiens
  misc_feature 1..32: note = chr1:55731721-55731753
  misc_feature 1..32: note = hypo
  source 1..32: mol_type = genomic DNA
ttctgatcagcaatacgtgagtgactcggttt

SEQ ID NO: 69740 - DNA, 52 bp, Homo sapiens
  misc_feature 1..52: note = chr1:5661868-5661920
  misc_feature 1..52: note = hypo
  source 1..52: mol_type = genomic DNA
atggggtgtgggagacgcggcatggggtgtggggacgcggcatggggtgtgg

SEQ ID NO: 69741 - DNA, 184 bp, Homo sapiens
  misc_feature 1..184: note = chr1:56943121-56943305
  misc_feature 1..184: note = hyper
  source 1..184: mol_type = genomic DNA
ccgggaggtcttctgcgcccagcgctcctccagcttcttttgctctccccagaagaatttaaaaagccaaacaaaacccttttgctgtgatctcaccccagacaaacgcacggctcccagacaaacgcacagctacaaaagcagcccgcatttgcattctaaaccgtcccggcctgggatgaaa

SEQ ID NO: 69742 - DNA, 15 bp, Homo sapiens
  misc_feature 1..15: note = chr1:57110648-57110663
  misc_feature 1..15: note = hyper
  source 1..15: mol_type = genomic DNA
gcctcctgcctccct

SEQ ID NO: 69743 - DNA, 616 bp, Homo sapiens
  misc_feature 1..616: note = chr1:57110882-57111498
  misc_feature 1..616: note = hyper
  source 1..616: mol_type = genomic DNA
cttcccacctgggcccgaagcgcccagcgccctctcccgggaccccgcgcccgccccgcgcccctcgcggctcggggtccgccccctcgcccgcagggcccgctgcactgtgggtaggcggcggcggcggcggctacgcggagcggcaggcggtggagcgaggccgcgcgcgccgaagatggctgagaagcagaagcacgacgggcgggtgaagatcggacactacgtgctgggcgacacgctgggcgtcggcaccttcggcaaagtgaagagttgagtacgcgctccggaccgctgtgcggggctgcctgacttgcgggaggccgaggggagaggcgggagccccgggcctccggcgggcgcggggctcggcggcaggtggagcggtcccgggtcgcgcggagctggggccccgggagggtggcgcgcaccgcctcgcctggcaccggcgcccgggccccacagggtccagggaagagggcgggggtgtgagctgaggatgggcgtcctgggttccaggttccgcgcccatctgcctttctggaggtcggagcaaggcacttctgtgttctctggacctcagtgtcctcctctgcaaaatcgggagaactggact

SEQ ID NO: 69744 - DNA, 221 bp, Homo sapiens
  misc_feature 1..221: note = chr1:57224849-57225070
  misc_feature 1..221: note = hypo
  source 1..221: mol_type = genomic DNA
tacagtttgaaaacacgagcacaccaactaaggctgacccaccttttgacttttccaatagttctgtggattttatttaatgacatgatgccaatcttaattacagtcatgcatcgcttaacaatggggatctgttctgagaaatgcatccttaggtgatttcatcatcacgtgaataccatagaacatacttatacaaacctagacggtatagcctacta

SEQ ID NO: 69745 - DNA, 30 bp, Homo sapiens
  misc_feature 1..30: note = chr1:57687138-57687168
  misc_feature 1..30: note = hypo
  source 1..30: mol_type = genomic DNA
aaggtcacctgatagcgacatttcttttac

SEQ ID NO: 69746 - DNA, 30 bp, Homo sapiens
  misc_feature 1..30: note = chr1:5777938-5777968
  misc_feature 1..30: note = hyper
  source 1..30: mol_type = genomic DNA
tgggcaatttcaaagcggaaaggtcagcta

SEQ ID NO: 69747 - DNA, 303 bp, Homo sapiens
  misc_feature 1..303: note = chr1:57887764-57888067
  misc_feature 1..303: note = hyper
  source 1..303: mol_type = genomic DNA
acataaatgtaccaacgtgaactggataattaggcggttctgaacgtaagccacctttaatttaattgatatgattacttgaaaacgttaagtgttgtaaagtgtagtggaacccccacacagcctttattcaaaactatcaacactgttaaagtgtatttaaccggccagcaggaagggagcaggaaggaggaagaaacgacggcgcggattctcgccccggtccccgccggctggctaggagctgcactggagcatccagctcgcaggagggctcgcccccgggctcgcccccgtccagct

SEQ ID NO: 69748 - DNA, 738 bp, Homo sapiens
  misc_feature 1..738: note = chr1:57888297-57889035
  misc_feature 1..738: note = hyper
  source 1..738: mol_type = genomic DNA
gcctccccacccccacgccattccttcagactctcccagcctaagcggaagtgccccagcagacccccaacaatgaggatttgtgcgatgcagttgggggttgggggtagttcacacggagtgaaacgtacacagtctggcgggtctgggagcagccaagtggcgtccgcctctccaggcagcgatcccttgtgcccactgccccccatcaggcccaccagcaccaccaaaaaacaaaaacagagaaaagaaaaagcgccttaaaaagtgcagagaaaagatgcgccctcccaccaggggtcacaataatactcctcgggacgcagccagcggaggcagggtcctggctgcagcagccaccctggttttgaaatttactttgtacactcacccagtggcccctttcagacgccgcgacacgacctccccccatctcggactccctgcctctgggttctctcggcggttgacaccctcttgtgtgcctgctttatgagccgaaccacagagatttaaagtttccttggtagaaaaaaaaactgagctctctgcatccaagtcagagcgtcgagtctggagcagagagaaggaagaggggcgggctggggaggcgactagctgggcgtggggggagggggtgctggggagtggatggagggggacgagcggcagagaacagagtccacagaggatccgaagaaaggccggggtccgaggaacgcgggatccagttctcac

SEQ ID NO: 69749 - DNA, 568 bp, Homo sapiens; identical to SEQ ID NO: 26327
  misc_feature 1..568: note = chr1:57889036-57889604
  misc_feature 1..568: note = hyper
  source 1..568: mol_type = genomic DNA

SEQ ID NO: 69750 - DNA, 980 bp, Homo sapiens
  misc_feature 1..980: note = chr1:57889605-57890585
  misc_feature 1..980: note = hyper
  source 1..980: mol_type = genomic DNA
cctagcccagagcatcctcctccgctgccgcagccgcccaggaagcggctccccatgcccggcgggcggcggcactcaggcgcgctctgcagcccggggaagcccgggcgagcgccgagctgggtccatcctccccgggagccaccggccccgcgtcagagtagggggaggagaccgccacccgcgcggacccgcctcctcccgcggccccccgccccgccgccccccgcgcccgcccggcgccccgcggcaccgctcacctgctagctccccggccgccgccgccgggccgtgagcccctcgccccggcctcgcggctccctccggggcgctctctgcgcagccggagcgcgctccgagagcttagccgagtggcggtggcgacgaggaggtggaagaacgagcgagcgagcgagcgagcgagcgggggcgccgcggcttgcagtcgcgcctctggagcccctgcactctctctccatcccagcgtggaagggggagagacgagccgagagcgaggggtccccgccccagccgcgccagcgtggagagggtaagggaggggggttgtcacaaagtatccagtgttttctcccccatcaccaccactggacgcagctccgcctggcctctctcatttttctctaagatctacccttttatccaagcctcgaaaacatatgcatacccaaatatatggagtgccaggaagggcgaaaccacgaggggagtctccgcgagggcatgttgcccccacgccccttggcaggagggggcgctcgctcccagccgccagtgcaggttcggcggctcctgttttgactgaggtttcccaggcaaagttcggcaagttgggagggagaaggctggcacgtgtcaagtttccgtcagtcctcaggagagacccgtgcccctgagagcacgcagaccacggttaactccggcttactccccgcgactcccctactcggctcttagaatga

SEQ ID NO: 69751 - DNA, 30 bp, Homo sapiens
  misc_feature 1..30: note = chr1:5816415-5816445
  misc_feature 1..30: note = hypo
  source 1..30: mol_type = genomic DNA
gacacccagagagtccgtgctcacatccct

SEQ ID NO: 69752 - DNA, 174 bp, Homo sapiens; identical to SEQ ID NO: 26330
  misc_feature 1..174: note = chr1:58715153-58715327
  misc_feature 1..174: note = hyper
  source 1..174: mol_type = genomic DNA

SEQ ID NO: 69753 - DNA, 173 bp, Homo sapiens; identical to SEQ ID NO: 26331
  misc_feature 1..173: note = chr1:58715359-58715532
  misc_feature 1..173: note = hyper
  source 1..173: mol_type = genomic DNA

SEQ ID NO: 69754 - DNA, 322 bp, Homo sapiens; identical to SEQ ID NO: 53
  misc_feature 1..322: note = chr1:58715533-58715855
  misc_feature 1..322: note = hyper
  source 1..322: mol_type = genomic DNA

SEQ ID NO: 69755 - DNA, 293 bp, Homo sapiens
  misc_feature 1..293: note = chr1:58715978-58716271
  misc_feature 1..293: note = hyper
  source 1..293: mol_type = genomic DNA
cgagcgggctccgcttttgttccctggggctggcaggtccgtgtggggccagggcgcgcgggagacgccgcggagctgggtatcccggagaggggatgctcactcctagcggctccgctggcagcagtagtggcggtggcagcagaggcagcggtagcaacagcagcagtagcagcagcagcagcagtagagatagtgccggctctctgcaggccacatctttcataccttatacatcactaccgcattcccccgaataggggagcccctcagcatttcgccacctagcgcgg

SEQ ID NO: 69756 - DNA, 30 bp, Homo sapiens
  misc_feature 1..30: note = chr1:58721839-58721869
  misc_feature 1..30: note = hypo
  source 1..30: mol_type = genomic DNA
gcaagtttaagagaacgctcttcactatca

SEQ ID NO: 69757 - DNA, 93 bp, Homo sapiens
  misc_feature 1..93: note = chr1:5890942-5891035
  misc_feature 1..93: note = hyper
  source 1..93: mol_type = genomic DNA
cgctggcccaggaggcggcagagcctgtgcttgcctgggccctggcgtgagccaacagcgccaccatcagctgccagccgggaagtcctccca

SEQ ID NO: 69758 - DNA, 43 bp, Homo sapiens; identical to SEQ ID NO: 38828
  misc_feature 1..43: note = chr1:5893925-5893968
  misc_feature 1..43: note = hypo
  source 1..43: mol_type = genomic DNA

SEQ ID NO: 69759 - DNA, 49 bp, Homo sapiens
  misc_feature 1..49: note = chr1:5894998-5895047
  misc_feature 1..49: note = hypo
  source 1..49: mol_type = genomic DNA
cagatgatgagtgcacgtgggtgcgatgctgctgcgggagcagcgaggg

SEQ ID NO: 69760 - DNA, 492 bp, Homo sapiens
  misc_feature 1..492: note = chr1:59042065-59042557
  misc_feature 1..492: note = hyper
  source 1..492: mol_type = genomic DNA
gctccacctgcaggggttctccgcgcacgcgcaagtccaggccgccgcggccctggaatagagactcgcccttgatgtccctctcgaagtagtaggcggcatcgccgatatccacgtcaccggcggccttctgagacgtgttctgccgcagctcgatctggatggtgggctgctcgtagtgcacggccgccacgaacttggggtgcagccgatagcgctcgcggaagagccgcctcagctcggcgtccaggtctgagtggttgaaggcgccggcggtggggcggtggcgcaggtcaatgaggatgtggtgggtgcgcaccagctcatcgcagcgtaggctcaggtcgcccttgtccgtgcggcgcacgcccaccgagttcacgcaccagcacaccgacgtctggttgcactggcgcgccttgaagcggccctcggggtcgcagtcggggtcgtagaggccatcgttgtccacgagcgcgtgctcactcggcc

SEQ ID NO: 69761 - DNA, 51 bp, Homo sapiens
  misc_feature 1..51: note = chr1:59348317-59348368
  misc_feature 1..51: note = hypo
  source 1..51: mol_type = genomic DNA
gggtgggagctcagccgtccaaatgcagagccagaacgagtctcctgtaaa

SEQ ID NO: 69762 - DNA, 455 bp, Homo sapiens
  misc_feature 1..455: note = chr1:59612368-59612823
  misc_feature 1..455: note = hyper
  source 1..455: mol_type = genomic DNA
agggcacacagtgggcgcttagtaactgtagaaagaagtcgaacgaaatcggaagggggagaggcagaggccacaatcaagacacggaaacgacagtcagtcgaggcagcagagagggtttcacgcgggccagcggaggcgcagggcagttgagaagggaacttgccacggggcggaggggccgcgctccccaccagcgcggcgcgggggcgctaggccagggaccgccgggccagggaccgccggctgcgagcagcgggaacggacctgccccgggtcgcagcggtttttcccgggcggggctgaggctgcagggaggcgggcgttccggcggagggtcacggcctcgccgccgggactttcctggggtggaggtgtgagcacgtaggagccctggcctttccaacttcccaggtcagactggggctgggaccaccctgcgcggccttggatgc

SEQ ID NO: 69763 - DNA, 66 bp, Homo sapiens
  misc_feature 1..66: note = chr1:6046211-6046277
  misc_feature 1..66: note = hypo
  source 1..66: mol_type = genomic DNA
tacctgcctaattaccggtccgtccagccacttgaggacacactggaatgccgtggattccttcca

SEQ ID NO: 69764 - DNA, 90 bp, Homo sapiens
  misc_feature 1..90: note = chr1:6053472-6053562
  misc_feature 1..90: note = hyper
  source 1..90: mol_type = genomic DNA
ttacagcacacacaccgccacttctgaccctgagcccctactcctatcttaagcttctccctcctgccaggccttggcacaaagcacttc

SEQ ID NO: 69765 - DNA, 31 bp, Homo sapiens
  misc_feature 1..31: note = chr1:6053624-6053655
  misc_feature 1..31: note = hyper
  source 1..31: mol_type = genomic DNA
cggcattagcagcagccggggtacctgccca

SEQ ID NO: 69766 - DNA, 209 bp, Homo sapiens
  misc_feature 1..209: note = chr1:60662398-60662607
  misc_feature 1..209: note = hypo
  source 1..209: mol_type = genomic DNA
agcaccagaggcaagcgttggatatattactgaatatgaatcatctgccttaaaaaaatagactaattagttgttcactgccgtataaaccttaggtaattataggacccagagttctgagaaattaaaataaacatcattttaaaacggagaaaagtaatgagagctatttgtagggctcctgaagtgcttttcggcagagcggtcta

SEQ ID NO: 69767 - DNA, 188 bp, Homo sapiens
  misc_feature 1..188: note = chr1:6071300-6071488
  misc_feature 1..188: note = hypo
  source 1..188: mol_type = genomic DNA
caagtgtgcaggaggcgaggcaggcagctgtgcccagggccaggtgtgcgggagacaggcaggcggctgtgcccagggccaagtgtgcgggagacaggcaggcggctgtgcccagggccaggtgtgcgggaggcgaggcaggcagctgtgcccagggccaggtgtgcgggaggcgaggcaggcagctg

SEQ ID NO: 69768 - DNA, 32 bp, Homo sapiens
  misc_feature 1..32: note = chr1:6086259-6086291
  misc_feature 1..32: note = hyper
  source 1..32: mol_type = genomic DNA
ctcccacctgggtcacgcgctaggcatgcctg

SEQ ID NO: 69769 - DNA, 171 bp, Homo sapiens
  misc_feature 1..171: note = chr1:6131714-6131885
  misc_feature 1..171: note = hypo
  source 1..171: mol_type = genomic DNA
taggactcctgccaccgcgtagggctctgctgcgtaggactcctgccgccgcatagggctctgctgcgtaggactcctgcggcgagggctccctcctgccgcgtgggctcctcctgccgcgtgggctcctcctgccacatagggcacctcctgccgcgagggcacctcctg

SEQ ID NO: 69770 - DNA, 37 bp, Homo sapiens
  misc_feature 1..37: note = chr1:61339518-61339555
  misc_feature 1..37: note = hypo
  source 1..37: mol_type = genomic DNA
gaaaaatggcaacttcagttctcgtttttgtaagtat

SEQ ID NO: 69771 - DNA, 30 bp, Homo sapiens
  misc_feature 1..30: note = chr1:6149015-6149045
  misc_feature 1..30: note = hypo
  source 1..30: mol_type = genomic DNA
ccagggtgccaaaaccgctggtgacatcac

SEQ ID NO: 69772 - DNA, 267 bp, Homo sapiens
  misc_feature 1..267: note = chr1:61508687-61508954
  misc_feature 1..267: note = hyper
  source 1..267: mol_type = genomic DNA
ccctaggggagagggcgccgcagcgagtcccgagatccgagcccggcctcgacgccggagcgctcccggagctggtccttgcccgaagcgcattaaaacggcgccctctggtgtcagctcgcggcggccgggtaaaagcagtggcgctgggggtagagttctactcgccaccctgttcgcaaactgaaagatccccgagtttagaaagtgtcttgccgctctgcggacgctgtgtccgcggccccgctgtcgcgcagagctgggctg

SEQ ID NO: 69773 - DNA, 41 bp, Homo sapiens
  misc_feature 1..41: note = chr1:61519364-61519405
  misc_feature 1..41: note = hyper
  source 1..41: mol_type = genomic DNA
gagaacgaggccgtccgggctaggttcccggggctcaaaga

SEQ ID NO: 69774 - DNA, 232 bp, Homo sapiens
  misc_feature 1..232: note = chr1:61519472-61519704
  misc_feature 1..232: note = hyper
  source 1..232: mol_type = genomic DNA
cgtttatttaaagttcagttgtgttgggcatctgatccaggacaactcgcccaggagcccggcgggtttcagctgccaccacgaaagtaaggatcggttctgccgcgtcgccccctccttccccttgggatgtgccaggcgggcgacagataagggggcgcggcgcggggtcagccaccgagccagagggcggcgcccggttgcagcgctccacagccgcctcctgcagcct

SEQ ID NO: 69775 - DNA, 77 bp, Homo sapiens
  misc_feature 1..77: note = chr1:61541784-61541861
  misc_feature 1..77: note = hypo
  source 1..77: mol_type = genomic DNA
attacaggcgtgagcgaccgtgcccagccagcaatcacatttttaaaaacaacaacgaaaaccgcagtagcctggtt

SEQ ID NO: 69776 - DNA, 102 bp, Homo sapiens; identical to SEQ ID NO: 26338
  misc_feature 1..102: note = chr1:61549208-61549310
  misc_feature 1..102: note = hyper
  source 1..102: mol_type = genomic DNA

SEQ ID NO: 69777 - DNA, 48 bp, Homo sapiens
  misc_feature 1..48: note = chr1:61555978-61556026
  misc_feature 1..48: note = hypo
  source 1..48: mol_type = genomic DNA
acctataaattatcccgaatagatgaccaacatcgaaacttgaaagtg

SEQ ID NO: 69778 - DNA, 16 bp, Homo sapiens
  misc_feature 1..16: note = chr1:61653734-61653750
  misc_feature 1..16: note = hypo
  source 1..16: mol_type = genomic DNA
gttgagacagagtctc

SEQ ID NO: 69779 - DNA, 203 bp, Homo sapiens
  misc_feature 1..203: note = chr1:6166315-6166518
  misc_feature 1..203: note = hypo
  source 1..203: mol_type = genomic DNA
aacacagggaagtctcgaggacggctagatatctgtcaaaaaaagaggagagccgggcttgcctgacgttggcagcagcaggcaggccgggcccggcgggcacccgtgtgcatgctgcccggagcggacgggcacctaccggtcacatagggccccaggggcatctggttgtagttgacaatccctcccggtccagggccccg

SEQ ID NO: 69780 - DNA, 317 bp, Homo sapiens
  misc_feature 1..317: note = chr1:6171630-6171947
  misc_feature 1..317: note = hypo
  source 1..317: mol_type = genomic DNA
gacagagacacataaggaagaagccgggatgacagcggcggggagcgggcgacacagcaatgccgaggatttctagccaccgccagaagtgaggaagattgaggaagaacgaggaaggcttcccccggagctctcagagggctctccccgaggtccacggaggaacgggcaagtccctgcccagcccggcctggccaaggatacgtcacgatgcccgccagcagccagtagtcatggcgccggtgccagatgtcgtagattttcccagaggatacagcagcccgctcctcgttctgccacagcgtgtgcaactctgg

SEQ ID NO: 69781 - DNA, 269 bp, Homo sapiens
  misc_feature 1..269: note = chr1:6186398-6186667
  misc_feature 1..269: note = hypo
  source 1..269: mol_type = genomic DNA
ctcgcccagctctcccggcccgcacctcccgggggttctgcacagggatgccctgacagaatcctgccccaccctccgcctctgggtatgggacacccatccctcctggcacactcgcccagctctcccggcccgcacctcccgggggttctgcacagggatgccctgacagaatcctgccccaccctccgcctctgggtgaggggcaccagtccctccctcccggcacgcaccctggtcctcctgggaggcatcgttgtagttgacct

SEQ ID NO: 69782 - DNA, 30 bp, Homo sapiens
  misc_feature 1..30: note = chr1:6189031-6189061
  misc_feature 1..30: note = hypo
  source 1..30: mol_type = genomic DNA
gccacctgcgtgatgcgctcctccaccgag

SEQ ID NO: 69783 - DNA, 311 bp, Homo sapiens
  misc_feature 1..311: note = chr1:6208626-6208937
  misc_feature 1..311: note = hyper
  source 1..311: mol_type = genomic DNA
tcactgaacagtggtcgcggtgttggcatgatcaccacacctgtctgcctttccctaacactcatgcctcccgtctctaggggagtcagacgcggagaagggcgcgaggaagctattgtggacggggtctcgagcagcgcgggcgaagctttgcgggatcggctaccgaggcggggcaggagccggcaggggcggggccttttgaggagggcaggccttcccctgggggcggggcctgttcctggggtggggcggggcgtccggcgcggggcgggcggaacactcacagtacagcgcgggcagagccattc

SEQ ID NO: 69784 - DNA, 147 bp, Homo sapiens
  misc_feature 1..147: note = chr1:62189753-62189900
  misc_feature 1..147: note = hypo
  source 1..147: mol_type = genomic DNA
ccccataattatccacgtttttactcatgagaaaacagagttcaaataggtcacccaaggttgcaaagtgcaacagaaatttatccactgagtccccacgcggtggttcatggtgagggggatgcggatcgcttgagaccaggagtt

SEQ ID NO: 69785 - DNA, 73 bp, Homo sapiens
  misc_feature 1..73: note = chr1:62207769-62207842
  misc_feature 1..73: note = hyper
  source 1..73: mol_type = genomic DNA
agcggattgacccaacgctttcatcgatatcctcctcaatttccttgatcttgggtctcgctctacacgcagg

SEQ ID NO: 69786 - DNA, 30 bp, Homo sapiens; identical to SEQ ID NO: 26021
  misc_feature 1..30: note = chr1:6221982-6222012
  misc_feature 1..30: note = hyper
  source 1..30: mol_type = genomic DNA

SEQ ID NO: 69787 - DNA, 921 bp, Homo sapiens
  misc_feature 1..921: note = chr1:6239141-6240062
  misc_feature 1..921: note = hyper
  source 1..921: mol_type = genomic DNA
actaaagaactgtcccgcaaggcaacccctggcgcacagccctgtgtatactaaattctgagagagataaaaggagagagatggtaggggcaggggcggtggccctggggcgtcaggcccgtagccaaggcagggtgggctgggaacggccaccaccctgggcgatggtgaggctggagacagcggcgggcgctaggtcgcgccagaaggacgccggcggcccgggtaaagtgcttgggagcggcggtcacagcgcacagaggccaggaaagaggagcaggggtccgagcccgtgcgtcccagagcggagtcctcctgggccgggagggaagccgccccatcctgggcgctcaacgcgtccccaagcaccgccggtcctcgcccctctctgggccccacccagcccgccccgcggccgacatgggccaggggccgggtcccgcctgcccgcagcgaggccagaggcgcacggcggcgggacgcgagcgcggggtgcgccgctccgggagctagcgcgattcccgcccccttcaagggcacgcgggctgaccctgacagcgccgcgccccccagcgcaggccccggcccgcggtcctctggcccgcctggcccgcgtcgccgcccggggggcccggatcgcaccccgcccttagccgccctcacgccggcccgggcgctcacccagccttcgcccttggccgcgcggcgccagcagggcgggagcgcagccccgcaacccgggtgcccctcctgcgaggcgccagcccggccgcgccgcccccgccgcccgcgctccgccctgggcccggcccgtctcggcgcccccgccgctctggccccaggcgcacccgcgccccgctcacctgacatctcgtcctcattctccatctcctcggcgaacagccgcggcagctcctcctc

SEQ ID NO: 69788 - DNA, 436 bp, Homo sapiens
  misc_feature 1..436: note = chr1:6240272-6240708
  misc_feature 1..436: note = hyper
  source 1..436: mol_type = genomic DNA
ccttagcctgctccccgcaaagcccgggcgctcctcccaccgcgccccgcagcccgagtcccgcagccggccgagggtggcggcggcagcgccagaggcacggcggcacggcgggggggcggcacacatgcccggattgtgacgtccagtctggttgctgtggcaaccccatcccatcgttccggcagcgcgactagttaacagcagagaacaagttgggggactagtcctgagccgccgggtgagggtggggaccggggggcgccccggcagggggagccgtcgaggcgtccgcgcgcccgcggacccgacggccgagcgggcagtcggggcttggcgagcccgggcgcagggggaggcgaggaaacaccgcccccgcgcaccccgggcagagccagccgccgccgctcgcctgcgaaggcgctgggccccgagc

SEQ ID NO: 69789 - DNA, 333 bp, Homo sapiens
  misc_feature 1..333: note = chr1:6240931-6241264
  misc_feature 1..333: note = hyper
  source 1..333: mol_type = genomic DNA
cctcacctgcttccccgctcccaccgcccacgtgcccccttccaaaaagcccctccaggctgggtgcagctgaaacccatgcagacccctaggggtggtgcggatctgcgatgtctgtgcccaaaactcccgctcagaagcgacacctgtcgcagagcaggaaggagccgccgccaccagccctcggtcgttaaaggtgaagatggaggccaaagccctcgggagcaagactggaattttaaatgagcgcctccagtctccgcggcggcaagtcttaaagctaccttaagaacgcaaaagttccaggggctggccgaccgccagctctctaac

SEQ ID NO: 69790 - DNA, 22 bp, Homo sapiens
  misc_feature 1..22: note = chr1:62657668-62657690
  misc_feature 1..22: note = hypo
  source 1..22: mol_type = genomic DNA
attctttttctttttcgagacg

SEQ ID NO: 69791 - DNA, 229 bp, Homo sapiens
  misc_feature 1..229: note = chr1:6266484-6266713
  misc_feature 1..229: note = hyper
  source 1..229: mol_type = genomic DNA
agtcgggtccaggcgcgatagggagggcgcgggcgcccgggcagaggggccgcgggagctcaagcggggctccgtgcgtgccccagccgcccgcttgcgctgtcgctgcagatgtcgggagctatcttcgggcccctggagggcccgagctccctggatgccccgagcatccacccgctggtgtgcccgctgtgccacgtgcagtacgagcgcccgtgtcttctggact

SEQ ID NO: 69792 - DNA, 291 bp, Homo sapiens
  misc_feature 1..291: note = chr1:62784355-62784646
  misc_feature 1..291: note = hyper
  source 1..291: mol_type = genomic DNA
ggctgcatcccagaccgcagcgcctagctcggaaaagctgggcgggggctgcaccacctgagtcgcaaggacagcacggcctccccctcctcaccagtgttctccacccccagaattggggcgcggagagccaatctgggctggaaagggagcggcgcccacctttgggcagcccgagcagccccgctccttttctgtcgcagaccccaggctgggaggcgggggcgccaggtcggcccaagctgccgcagccactgctttaaagggagccggggacgcggcgctggggac

SEQ ID NO: 69793 - DNA, 308 bp, Homo sapiens
  misc_feature 1..308: note = chr1:62784870-62785178
  misc_feature 1..308: note = hyper
  source 1..308: mol_type = genomic DNA
tccgggtgcactgtccgcgtcccaggcgcgcaccccggggctggcgcaccctggtcgtccgcggcgcgcacaccctccaggcgccctctggccgacggtctcggccctggccccggcgcacccctgcgggcacacccaccgcggcggatgcgggactggccaggcgccgccagccgcggcttcgccccgcgtcgccagctgccaacagcgcccgagtccccgccttcgctaggggagaaaaaaaagactcctgacgcggcgcggactttggtgtgtaggaaggggcagaattgcgaaaccgaggggag

SEQ ID NO: 69794 - DNA, 30 bp, Homo sapiens
  misc_feature 1..30: note = chr1:62793243-62793273
  misc_feature 1..30: note = hypo
  source 1..30: mol_type = genomic DNA
tgccattcacggactcgaggctcagcccca

SEQ ID NO: 69795 - DNA, 502 bp, Homo sapiens
  misc_feature 1..502: note = chr1:6280243-6280745
  misc_feature 1..502: note = hypo
  source 1..502: mol_type = genomic DNA
agttttgattttccccgtgtttgcatggcatgaagtcttcgtccttgtcacagtagcttgggatgactcccagtccacatggaaaacatcagggagtgacaatccagcaagaaatccctcgctagttccacacctacgcaccgagcgtcggtgtgccaggccctgtgctgggcagagtgtggtatgtcagggtgtgccggttttaggtaacaagactccaccactgagtggcacctgccctattgcaaaggaatccagttcctccggaataacagtcccactgttaacctggtgctactgggaagttccacacagtaatctgagcagtgactcatggaaggatgaggaacgtttgctccagcttctctccctttccagcaagggcagagctcctaaagccaggggttagcacctggccagcttatgtggcagatggtctcagttacaacttcgctgctttcccaaactcctgcagccctcctgagtccgacttccgttgata

SEQ ID NO: 69796 - DNA, 49 bp, Homo sapiens
  misc_feature 1..49: note = chr1:6281776-6281825
  misc_feature 1..49: note = hypo
  source 1..49: mol_type = genomic DNA
gctcaaggagcagctcgtgaaggggtggcaggtgcgctgctgccttgtt

SEQ ID NO: 69797 - DNA, 45 bp, Homo sapiens
  misc_feature 1..45: note = chr1:6294199-6294244
  misc_feature 1..45: note = hypo
  source 1..45: mol_type = genomic DNA
gctgggattacaggcgtgagccaccgcgcccggcaagggactgtt

SEQ ID NO: 69798 - DNA, 321 bp, Homo sapiens
  misc_feature 1..321: note = chr1:6301689-6302010
  misc_feature 1..321: note = hyper
  source 1..321: mol_type = genomic DNA
atcctgcgcgaccctcggccagtgtaaggcgagtagcgggccaaggaggctgtttgtgatggaggagccacgggtgggggcgtcagaaagtagggggatcattccaggtggggagaccactgaccgaaaacgggccacaggacagggggcgcggcgggcagtgtcggggttggggtcggggggcaacggaggcggaagtccattcagtggaccagggcggagcgacgcctgagaattccgcccaggccttgaggcgggcctcgcctcccgcagccaaagcagaacattgcgaattagagcattttgcggtcaattttccac

SEQ ID NO: 69799 - DNA, 548 bp, Homo sapiens
  misc_feature 1..548: note = chr1:6304118-6304666
  misc_feature 1..548: note = hyper
  source 1..548: mol_type = genomic DNA
gggagcttcccagtgcgtcctccctcggtcccctcctcctcaaggtttctagagtccagagggcctcattgacatgtaaacgagggtccctataaaggcggcgctgcctcgcactggtgcatggactgcaacatgggcacggagcctgctgcccggggcagcctccccggcaacttccgaaaggtctggggtcttgagggactaggggcaggcacccttccccgggaggtgtgggggggtgccgagggcaggagggtggcagtcctgcactctaaaggctgttcatctgcagatttccaagccgctgatggagaaaaagcgccgggcacgcatcaatgtgtcactggagcagctcaagtcgctgctggagaaacactactcgcaccaggtgagactcaggcggggtgggggtgggtgggtgatacgatcccaacctccctctctccacctcgggaggccggtctaatagacctttccatggtcgggtagatccggaagcgcaaattggagaaggccgacatcctggagttgagcgtgaagtacatgag

SEQ ID NO: 69800 - DNA, 907 bp, Homo sapiens
  misc_feature 1..907: note = chr1:6309182-6310089
  misc_feature 1..907: note = hyper
  source 1..907: mol_type = genomic DNA
acatgcggtgcccagcgcagtcgtccggggcagccgtcgcccctgggacaaggccagctgggaggagccggaagacaaacgctgaggccaacgccccctcacccctgggaggggtggcgcatgtctgcgcgcggggcggaggcgggcgtctttggtgctgcggccccggagagcggcctggcctgcctggcgtccgtggggaggcgccggcggtcctaggacgcggagcccagcgagtccgagtgcagcgtggcgtagcccgaggactcggagggggaactcaggaagctgctggtgctgccgccgccgcccgccgcgcgcagccccccgggctcgccccacgacgcgctcaggccggggcgcagagagccggcgtgcgagtgcgcagaggggcgtggccctgggctccgctgggcgctgcttgggggcgtcggggcctctccgggatctgcgccgtcgggggcggcgggcgcagcggggaagggcccgggcgggcggcgcagggcctgtggctcgcactcgaaggcggtcagggcgaaggcgtcgggcagcagcgaggccgaggcggagcgggggccgggcccggggcggcggcgcgggctgccggggggcgagtcgcgggctccccgcgggccgctatccagggccgagggccgcagcgacagcaggctctcggccgagcggcggcgcgcgcgggacggtggtgcgtcctccgcgaaggccaggaggctggcgcggcgccgctcgggcccggcaggcagcaccaggtgcgccagggcggccaggtcctcgccggagccccagcgcggcaggaaggcgggcagcgggacggcggcccacacgtccgcatcgtcgtgggagaagcgccgcgtgggcgggacctgtcaggacgcggctggcttttacc

SEQ ID NO: 69801 - DNA, 32 bp, Homo sapiens
  misc_feature 1..32: note = chr1:6332155-6332187
  misc_feature 1..32: note = hypo
  source 1..32: mol_type = genomic DNA
gcctgggccagaagccgcgtgctcatggcaca

SEQ ID NO: 69802 - DNA, 553 bp, Homo sapiens
  misc_feature 1..553: note = chr1:63539428-63539981
  misc_feature 1..553: note = hyper
  source 1..553: mol_type = genomic DNA
tctaaagggggataacgcggaagagtgggggagggggtagatttgaggtgtgcaattcttaccacatctggggaaaaaaacaaaaacaaagccaagcgaagtgggcctgccagagttaactatgttcacagagtgcaattaagtgtttggaaggttctgtgccgtgtgctctgatttacggccgcgttcctgggacgcccctttagccgggcgaacgtggagggggccaggcccggccgtgcgcaccctgggagcggagccgggccgctggcgctccgggtcttgggcttggcaccgcggcgcaccgggtggcaagcacagcgcttagcggaggccacacctgcacctcatttgcttctgagcagtgccatgacccgcctgctgatggggcgccttccctttcatcctcgggattatgacaagttattaattgccaccattagccgcagcagcctgcccgagatctctgctgctctctggaggtgagaaaccgcgcatctgaatgccgagggaagaggcgctgagcagccagggcaaacggagcaacaatctg

SEQ ID NO: 69803 - DNA, 30 bp, Homo sapiens; identical to SEQ ID NO: 14204
  misc_feature 1..30: note = chr1:6360980-6361010
  misc_feature 1..30: note = hypo
  source 1..30: mol_type = genomic DNA

SEQ ID NO: 69804 - DNA, 30 bp, Homo sapiens
  misc_feature 1..30: note = chr1:63783677-63783707
  misc_feature 1..30: note = hyper
  source 1..30: mol_type = genomic DNA
ttcgagagaaaggctcgtttttattaaatc

SEQ ID NO: 69805 - DNA, 325 bp, Homo sapiens
  misc_feature 1..325: note = chr1:63784115-63784440
  misc_feature 1..325: note = hyper
  source 1..325: mol_type = genomic DNA
gagttgaaaatcccccgctttgggaaatggaagtaatctgggtgggttggggccttgggtaccacctctgccctttcccaccttccttggtggcggccatccagacaaagaggccggtaatagtttaacaaatctatgaagattttcaagaagcagcagactttgattgttgcgggcgcgggggtgttggggagaaaggaggggaatttttctaatagtcccacccacgttttgctccctcttggacaaagagtaactactcttggtgggggacgcgcccttcactccgcggaacctggtcccaactccccgtattgtaagaaaa

SEQ ID NO: 69806 - DNA, 86 bp, Homo sapiens
  misc_feature 1..86: note = chr1:63784701-63784787
  misc_feature 1..86: note = hyper
  source 1..86: mol_type = genomic DNA
catccccccactggacgcacacactaaatctcccctcccctggagacgtctcaatttccttcctatcgatccggactccattcttc

SEQ ID NO: 69807 - DNA, 306 bp, Homo sapiens; identical to SEQ ID NO: 56
  misc_feature 1..306: note = chr1:63784987-63785293
  misc_feature 1..306: note = hyper
  source 1..306: mol_type = genomic DNA

SEQ ID NO: 69808 - DNA, 149 bp, Homo sapiens; identical to SEQ ID NO: 57
  misc_feature 1..149: note = chr1:63785618-63785767
  misc_feature 1..149: note = hyper
  source 1..149: mol_type = genomic DNA

SEQ ID NO: 69809 - DNA, 317 bp, Homo sapiens
  misc_feature 1..317: note = chr1:63786078-63786395
  misc_feature 1..317: note = hyper
  source 1..317: mol_type = genomic DNA
gccccgggcccctgcctttagggctgggcaacccaagcagagcaaaggaggttcctgaatgtgtaaatttccgctttttagctttttttttttttttttttggaccttccgacacttcggttgctgaggcagttgcagacgcgacctctgcagtcctgggcgatggccagccagctcagctcgggtcggtttcgcggaaagctgtctagacggcattgtaaacggttcggagcctgcgggccacaaagctgtggagctacggaaatcaactctgagatgcgttttagggccgtgtgcaacctcgggatcatttagat

SEQ ID NO: 69810 - DNA, 593 bp, Homo sapiens; identical to SEQ ID NO: 26347
  misc_feature 1..593: note = chr1:63786656-63787249
  misc_feature 1..593: note = hyper
  source 1..593: mol_type = genomic DNA

SEQ ID NO: 69811 - DNA, 1485 bp, Homo sapiens
  misc_feature 1..1485: note = chr1:63787282-63788767
  misc_feature 1..1485: note = hyper
  source 1..1485: mol_type = genomic DNA
cgctgcgtctaacctgaagacaccaggcctcttcccggatccactcgacttacccaggccgctgccaatcccagctccttccccagcgcctcatttccgattttttcatatgctaagtcgtttaacaactccaagtagccagttatggcttctttatttataggttccctgctattttacgtcgtttttatttctctcggcaactattctagtagattaatcaatagccattttctgaccttcgggaaccccagctgatgctttttgtggccgcacgaaaaaatacatacaggaaaacacgcccgcatcaagccgggaaagagcaggtaggacctgagtggtttggttgggggagggggaaaaagacatctcagcaggtgtcttccccggaatgagcactgaggccagaggggaatctgaaatctaattagcaggagggagccgggtgcgctgctcttactctttaaagctaaaaacaatgaaacaaaaagcaaaacagagactaagttttgctttttaaaacacgatatgggaacctcgttctaggtcgcccagtccctgtctaaggagtgtgacaaagtgggggggagaagggcggaagggagagggggcggggaaggcagggcagcgacagtcgcacagtcccgcggacgctcccaggcccacgccctgactcgctcacacccacccacactcacacccacccgctccctgggccccagggcccggatccagcctgggtgggggggtctccgggcgggccgcagcgccctccgtgccccggggatgctggcgcacagtgcggagcggagttgcgcgtctctcgtccctttgttgacaattccctgaaccaacttgagtttggccggctcggccgcggccctgacgtcacgcacggtcacgtggccccgcctcccgctggatctttaagtagaaagtaatctatcaggccagtccttaaaacgggactttcgactaccggggcttcggcgtccctgacacccagccccctgcccccccgctactgtccctgcccgcgccctcccgagctgctcggcgcccggcgtcccgcgcccgcctggaccgctcctgcgccccacgccagggccagaggccgaggaaggcgggctaagtgagggggcgcggcgtggagaaccgccggggccgggagcggtagcgagcgcctagtaccgagcgccagggacggcaggagttcgcggagcgcggccgctgggggcggacggcagagcccgcgccacgcgatgcggggccgccgagtgtgagctgagcccagcgggccccaagccacctgcggccccctcccctctccctgccccccatctttcgggggcactcaaaccctcttcccctgagctccgtggcagcccccgaacaccctcatcgcccgctgccccctccccgccgccgctaccaaccccgaggagggatgaccctctccggcggcggcagcgccagcgacatgtc

SEQ ID NO: 69812 - DNA, 578 bp, Homo sapiens; identical to SEQ ID NO: 26350
  misc_feature 1..578: note = chr1:63788919-63789497
  misc_feature 1..578: note = hyper
  source 1..578: mol_type = genomic DNA

SEQ ID NO: 69813 - DNA, 64 bp, Homo sapiens; identical to SEQ ID NO: 26351
  misc_feature 1..64: note = chr1:63789728-63789792
  misc_feature 1..64: note = hyper
  source 1..64: mol_type = genomic DNA

SEQ ID NO: 69814 - DNA, 64 bp, Homo sapiens; identical to SEQ ID NO: 26352
  misc_feature 1..64: note = chr1:63789849-63789913
  misc_feature 1..64: note = hyper
  source 1..64: mol_type = genomic DNA

SEQ ID NO: 69815 - DNA, 216 bp, Homo sapiens
  misc_feature 1..216: note = chr1:63790252-63790468
  misc_feature 1..216: note = hyper
  source 1..216: mol_type = genomic DNA
ggtcccggtcccgctgcccaatcctggactctgcctctccccaatttcctttcccctgagcccccaacgcctaccttccgcggcctccatcccctcgcgcacacctaagctggtcgagcaaactcaccgcgcgcccgccggggatagctttccatacaggtaaaaccgaaaaccgaattttccaaaaatgcaccccgacggcgcctgctcttagta

SEQ ID NO: 69816 - DNA, 39 bp, Homo sapiens
  misc_feature 1..39: note = chr1:63791977-63792016
  misc_feature 1..39: note = hyper
  source 1..39: mol_type = genomic DNA
cccacctcatttctccgctgtcgacgtgggctgggggtc

SEQ ID NO: 69817 - DNA, 100 bp, Homo sapiens; identical to SEQ ID NO: 26354
  misc_feature 1..100: note = chr1:63792549-63792649
  misc_feature 1..100: note = hyper
  source 1..100: mol_type = genomic DNA

SEQ ID NO: 69818 - DNA, 275 bp, Homo sapiens
  misc_feature 1..275: note = chr1:63792797-63793072
  misc_feature 1..275: note = hyper
  source 1..275: mol_type = genomic DNA
cggacccagaccctcaagctgccagcggttgtttaaagtcctggcagatgtcaggaagatgggcccggccgtcgcaccctcaaaagctctttttcgtttaagctttttaaacctcgaagatttagcacaaaatgggaaatgcaaatatcatagacaatgatcgcaagcacttagtggtggggctgggggaagcctgaaacccttgtttgatgttatggaacgcaggcacctgcgacaaacggcactggaaacagctctctcgttgagatttaaag

SEQ ID NO: 69819 - DNA, 26 bp, Homo sapiens
  misc_feature 1..26: note = chr1:63793338-63793364
  misc_feature 1..26: note = hyper
  source 1..26: mol_type = genomic DNA
gtggatctggatgtccggggaaaggc

SEQ ID NO: 69820 - DNA, 280 bp, Homo sapiens
  misc_feature 1..280: note = chr1:63793365-63793645
  misc_feature 1..280: note = hyper
  source 1..280: mol_type = genomic DNA
aatgaagagtagagcaaaacatgtgccggctgttgagggctgtcgatgcgatggcagatgtggcctgtagggggcgacgagcagacggaaaacttcgcggtttgtctggaatggtccagccccagccccggacgcctctccttccctcccaggctctgagcctcctgacatccttgcttattctcaggccccggaagcctaggtcgaatctcgagaagctgatttcctcctttcccccgcctgtgtcctgggaggaacagagtcccgaggggagtttgtc

SEQ ID NO: 69821 - DNA, 586 bp, Homo sapiens; identical to SEQ ID NO: 26357
  misc_feature 1..586: note = chr1:63795348-63795934
  misc_feature 1..586: note = hyper
  source 1..586: mol_type = genomic DNA

SEQ ID NO: 69822 - DNA, 565 bp, Homo sapiens; identical to SEQ ID NO: 26358
  misc_feature 1..565: note = chr1:63795935-63796500
  misc_feature 1..565: note = hyper
  source 1..565: mol_type = genomic DNA

SEQ ID NO: 69823 - DNA, 111 bp, Homo sapiens; identical to SEQ ID NO: 38837
  misc_feature 1..111: note = chr1:6391430-6391541
  misc_feature 1..111: note = hypo
  source 1..111: mol_type = genomic DNA

SEQ ID NO: 69824 - DNA, 29 bp, Homo sapiens
  misc_feature 1..29: note = chr1:6422825-6422854
  misc_feature 1..29: note = hypo
  source 1..29: mol_type = genomic DNA
ttggctaggcgcggtcgtgcacgcctgta

SEQ ID NO: 69825 - DNA, 336 bp, Homo sapiens
  misc_feature 1..336: note = chr1:64240116-64240452
  misc_feature 1..336: note = hyper
  source 1..336: mol_type = genomic DNA
gcccgccgctcctggcgctgctggccgcgctgctgctggccgcacgcggggctgctgcccaaggtaagaggcgcccgccggcccccgcccgcccagaccccctgacccgtggccacccttccgccgtccagccgggcgcgggacacgcaggaagcgccgcgctggctccggggcgcgtccggccacccgccacggggctcgccggcgccgccaggccagggtttgccccggagccccgccaggccagggtttgccccggagccccgcggcgggccggggcgcgcccagggactcgttcctcggtgcgcagcagcgattgtcagcgctgacaggaag

SEQ ID NO: 69826 - DNA, 251 bp, Homo sapiens
  misc_feature 1..251: note = chr1:64240532-64240783
  misc_feature 1..251: note = hyper
  source 1..251: mol_type = genomic DNA
cgcgccccagccggtgttcaggcaagtctatcctgcccccaagttgcgagccggcccggaaggcgcggtccaggagggagtttggattttcagtggtgctcgccagagcccaggcggctcgcggatcgacgcaaacaaaagccctgtcctcctggggctccggcggcctcgcatcgccaccgcccccggccctccggccctcccgagagtcatcatagaggccaaaacttgtgcgccgctgcagccgctgc

SEQ ID NO: 69827 - DNA, 39 bp, Homo sapiens
  misc_feature 1..39: note = chr1:64240997-64241036
  misc_feature 1..39: note = hyper
  source 1..39: mol_type = genomic DNA
ctggggtccttgctgcgtctgagccggtacacaatgaga

SEQ ID NO: 69828 - DNA, 274 bp, Homo sapiens
  misc_feature 1..274: note = chr1:6446079-6446353
  misc_feature 1..274: note = hypo
  source 1..274: mol_type = genomic DNA
caggaccttaaacctcgcaccactcaggctggccctcaggcaagtagaagaatgagttccacctgggcggagttccacctgggcagagaggtcttggctcacaggcaccgggagagctggaaggctgcggggaagccgaggaaggccaacacaccgcacaacacggcaggtgcctggccctcctctgacagtggccctcaagctccaggagggccgaggaaaatgcagattcctgggcctacccctccctgaccttccccgcccctggagttag

SEQ ID NO: 69829 - DNA, 30 bp, Homo sapiens
  misc_feature 1..30: note = chr1:6446992-6447022
  misc_feature 1..30: note = hypo
  source 1..30: mol_type = genomic DNA
tagcaagtgacttcacgtttctgtcctaaa

SEQ ID NO: 69830 - DNA, 17 bp, Homo sapiens
  misc_feature 1..17: note = chr1:64734652-64734669
  misc_feature 1..17: note = hypo
  source 1..17: mol_type = genomic DNA
atgttctgaattagccg

SEQ ID NO: 69831 - DNA, 16 bp, Homo sapiens
  misc_feature 1..16: note = chr1:64734789-64734805
  misc_feature 1..16: note = hypo
  source 1..16: mol_type = genomic DNA
gcgacaaagcaggact

SEQ ID NO: 69832 - DNA, 59 bp, Homo sapiens
  misc_feature 1..59: note = chr1:6479255-6479314
  misc_feature 1..59: note = hyper
  source 1..59: mol_type = genomic DNA
gtgcggggtgcagagcgcgcggcagggcagggagggctcactcacggggcgctgccgtg

SEQ ID NO: 69833 - DNA, 735 bp, Homo sapiens
  misc_feature 1..735: note = chr1:6480216-6480951
  misc_feature 1..735: note = hyper
  source 1..735: mol_type = genomic DNA
cgggggccttcgctgcgtgaccccgagggcaggagggccaggtggggccaggccttgcctgactggagctacggtccctcctctccaatgctgcccttcattcattccccaggctcgggttcagcgtcttctctgagccccgccctgggccgcagcaggggacccagcggttacgggagctcccatgagggacagcagcgggagggacttgcacccccagctgctttatcgggtgaagggctgagctggacgggaaatccgagttccggagaaaggtcgtgacttgctccagtcctcgacgctgggaacaggccgagcctggacaagggccccagtcgctggacgcccggctctaaggagcccgtagaacccttcggcggcttgcctagttaagagtcttttggttaccccactccaggctttgggtggggaaacggaatcctagagaagcagaggcagccctggagccctcggagctcgttttcattcccaccggctaggggtccgggttctcgcccgcaagacagtcagggctcatgtgacgcgcgggcaggacagttttgggtgcgggccccagtggcccgcccaggaccgccttcgcgccgcgtggccgttgctgcggcaaactggctggcgtcccccgcccatctgctccgggctcccctcccccgaccggctggcggggcaacggccacgcccgcgaaccacactgcgaactgccgggcagagagatga

SEQ ID NO: 69834 - DNA, 49 bp, Homo sapiens
  misc_feature 1..49: note = chr1:6484931-6484980
  misc_feature 1..49: note = hyper
  source 1..49: mol_type = genomic DNA
cgggctcctctggcccgcaagaacacgtgcatggcgtcctggggaaggc

SEQ ID NO: 69835 - DNA, 359 bp, Homo sapiens
  misc_feature 1..359: note = chr1:6484981-6485340
  misc_feature 1..359: note = hyper
  source 1..359: mol_type = genomic DNA
ctgagtgcggagtcgcggcgccgcacgcggcaccatggccctggagcaggcgctgcaggcggcgcggcagggcgagctggacgtgctgaggtcgctgcacgccgcaggcctcctggggccctcgctgcgcgacccgctggacgcgctgcccgtgcaccacgcggcccgcgctgggaagctgcactgtctgcgcttcctggtggaggaagccgccctccccgccgcggcccgcgcccgcaacggcgccacaccggcccacgacgcctccgccaccggccacctcgcctgcctgcagtggctgctgtcgcagggcggctgcagagtgcaggtgggtccgcgcggttcgccaggggcactga

SEQ ID NO: 69836 - DNA, 89 bp, Homo sapiens
  misc_feature 1..89: note = chr1:6488312-6488401
  misc_feature 1..89: note = hypo
  source 1..89: mol_type = genomic DNA
ttgcatctggctgcccgcttcggccaccccgaggtggtgaactggctcttgcatcatggcggtggggaccccaccgcggccacagacat

SEQ ID NO: 69837 - DNA, 96 bp, Homo sapiens
  misc_feature 1..96: note = chr1:64937203-64937299
  misc_feature 1..96: note = hyper
  source 1..96: mol_type = genomic DNA
cctccgagtgggctccgcgctcctttcccctcccgggagcatggggggaggggctggcctggtagattctgggtagactcccgactctaatcctgc

SEQ ID NO: 69838 - DNA, 244 bp, Homo sapiens
  misc_feature 1..244: note = chr1:6500744-6500988
  misc_feature 1..244: note = hyper
  source 1..244: mol_type = genomic DNA
cttcgcggcgagccgcggccacaccaaggtgctcagctggctgctgctgcacggcggggagatctcggctgacctgtggggcgggaccccgctgcacgacgccgccgagaacggggagctagaggtcagcgcgggcccggggtgggggcgcgcgccctctgctggcaccgcgctttcagcacggccctgcccgggcgcgggggtcccagctcgcggccgcggccgggtcctcactgcgtgcccc

SEQ ID NO: 69839 - DNA, 125 bp, Homo sapiens; identical to SEQ ID NO: 8
  misc_feature 1..125: note = chr1:6501054-6501179
  misc_feature 1..125: note = hyper
  source 1..125: mol_type = genomic DNA

SEQ ID NO: 69840 - DNA, 130 bp, Homo sapiens
  misc_feature 1..130: note = chr1:6507126-6507256
  misc_feature 1..130: note = hyper
  source 1..130: mol_type = genomic DNA
gcccagccagtgccccgtctccaccgttgagcccaagtgccaggtctgcgtggtcccctcctggctgtgtgagccccctcccggctgtgtgcgtccctccgggctgtgtgcgcccctcccggctgtgtgc

SEQ ID NO: 69841 - DNA, 1654 bp, Homo sapiens
  misc_feature 1..1654: note = chr1:6507490-6509144
  misc_feature 1..1654: note = hyper
  source 1..1654: mol_type = genomic DNA
ggtgtcgcatttcctgcaacgtgagccaggtcgggcggggtgaagggtctgaggccaccgcagggacgcatgggctggagagtggggcagaggacagcccccacccggtcactcagtctttggcccggccgcctcactctccctcactgagctgggcctagttgggggcagctgcgatggggtgggaagccacgctgtcacccgaccccgccttacggcccctgaaatccgaggcttgagcgcgggtgtcggtgtcgctttcgtggatggcgatggtttccagatgcaggaggggaagggtggggacgcgacccggagccgggggccaaatatgagaggcctcctctgcccacagtcagccctctcccctctcgggcggggatgaaggtgggggctcagctcccagcttagggagaggcgcagggggcggggtcacatctggccggggacgggtgcagagccgcggccaggtgtggcaaagtagttggcgccccctgtggcatccgcgacggctgggggggttcagcctgggattggcgggccccgggtgatgtcaggccgtcggagcccataggctggctgtgcgcgggtggctgtaacctgagaggaagtatcaggtaacgcaggtgtcgggtcctgccgcccccacagccaggtgcacagcgggggccaccagcaccgtggcaggtaggagcagcccccggacgggcaaccggggtccgtggcaagccggagcctccgagagcacaggctctggagggggctccctccggccccggacccccgaaagacagggctccgcggagccctggggacccgcagtccttctgacagccgagagcggagtgcggccgagggcctagtgagggctaagctgggaggtgccccttcgccagctccccctggcgtcggggctgggccaccccgcccctgggcccgcctcttctggcctcagtgggggcccctgtgccccttggccggtgcccagaacccctccctgtaaggcgggcggagcctgcccttccaccgaggcccccatgaccctcgcccgctgcccactgtgagaaccagggggtctaggaagtcagctgctgcacccctcgacggccgctggccgcgagtccccaggaggtgaagagctgggtggggaggcgtggggggcgcctaccgggcaggtgcccgagccccaccggtcactgtcttcccgcagctgagctcctgtgacggccacgacgggctgcggaggcaggactccagccgcaagccccgcgccttcagcaagcagcccagcacgggggactactaccggcagctgggccgctgccccggcgagacgctggccgcacgcccgggcatggcgcacagcgaggaggtgcgtgcccgccagcccgcgcgcgccggctgcccgcgcctcggccctgccgcccgcggctcactcgaaggcccctccgctcccccgcaggcggcgctgcttcctgggaaccatgttcctaacggctgcgccgcggaccccaaggcgtccagggagctgccaccgccgcccccaccgccgccgccgcccctgccggaggccgcgagttcgccaccgccggccccgcctctgcccctcgagagcgctggccctggctgcgggcagcgccgctcctcctcgtcc

SEQ ID NO: 69842 - DNA, 34 bp, Homo sapiens
  misc_feature 1..34: note = chr1:6533352-6533386
  misc_feature 1..34: note = hypo
  source 1..34: mol_type = genomic DNA
gctgaagcgactggccgcccggttcttccagctg

SEQ ID NO: 69843 - DNA, 36 bp, Homo sapiens
  misc_feature 1..36: note = chr1:6537501-6537537
  misc_feature 1..36: note = hypo
  source 1..36: mol_type = genomic DNA
tatgacgccctagcacgtttccgacagttactgaaa

SEQ ID NO: 69844 - DNA, 30 bp, Homo sapiens
  misc_feature 1..30: note = chr1:6542460-6542490
  misc_feature 1..30: note = hypo
  source 1..30: mol_type = genomic DNA
ccgatgagagatttccgagataggcgtggt

SEQ ID NO: 69845 - DNA, 260 bp, Homo sapiens
  misc_feature 1..260: note = chr1:6545379-6545639
  misc_feature 1..260: note = hyper
  source 1..260: mol_type = genomic DNA
gtacctggctatcaccgtcgcgggcacgacccccggcccaggagggctccgagtcccggaggggcagccccgggcccggcctggaggctgctaggcgtccggagacaccgggtcctgtccccatggcggccggaggaagccgcggtctgcgccgcccgccggacaaagcgcggagccccgcttcctgccattgtgcggccgcgcccgcccccgccgagcgcggggaccccggggagggccgggcccggaacagcccccag

SEQ ID NO: 69846 - DNA, 46 bp, Homo sapiens
  misc_feature 1..46: note = chr1:6545885-6545931
  misc_feature 1..46: note = hyper
  source 1..46: mol_type = genomic DNA
gtacccccacctctgcgcctctgcgcggccccgggcccctctcttc

SEQ ID NO: 69847 - DNA, 358 bp, Homo sapiens
  misc_feature 1..358: note = chr1:65468302-65468660
  misc_feature 1..358: note = hyper
  source 1..358: mol_type = genomic DNA
ggctccaggtttcagcgcaggcttccgcggagccagctggatgcgtcaccatccgaaagtgcgagcctggccggcggcggcggaggcgggggcaccgcgcagttggaagcccgggcgctcttaccgaaagcgcgagcccggacttccccgccacgatcgatgtggccagtctgcgcctgccgcagttcccgctcgcaccccggcccctcgcagagtcccaggaaagcgctgtggcgggcgggcagtctctgcccccgggaggggacgcacgcacgcgctgctccttccaggtcccggcggggaagcgatgctttcttggcccgggcttggggccagcgggaaccgggctgtccggccg

SEQ ID NO: 69848 - DNA, 275 bp, Homo sapiens; identical to SEQ ID NO: 5540
  misc_feature 1..275: note = chr1:65731231-65731506
  misc_feature 1..275: note = hyper
  source 1..275: mol_type = genomic DNA

SEQ ID NO: 69849 - DNA, 69 bp, Homo sapiens
  misc_feature 1..69: note = chr1:65731781-65731850
  misc_feature 1..69: note = hyper
  source 1..69: mol_type = genomic DNA
ggagctaagttctttgggtgagacgtgcaacaacgcaggccccaaagctctctgcgcgcagcgccgcgg

SEQ ID NO: 69850 - DNA, 69 bp, Homo sapiens
  misc_feature 1..69: note = chr1:65774834-65774903
  misc_feature 1..69: note = hyper
  source 1..69: mol_type = genomic DNA
tggtcctcaaagcttcgcaggccgagatacctcgcccctttcttctctgtcacacgcgtgcgaacacac

SEQ ID NO: 69851 - DNA, 30 bp, Homo sapiens
  misc_feature 1..30: note = chr1:65775296-65775326
  misc_feature 1..30: note = hyper
  source 1..30: mol_type = genomic DNA
tttccctcctctttgcgtcatgtcgggcac

SEQ ID NO: 69852 - DNA, 30 bp, Homo sapiens
  misc_feature 1..30: note = chr1:65775826-65775856
  misc_feature 1..30: note = hyper
  source 1..30: mol_type = genomic DNA
gcccagagactgtagcgagctcctcctaat

SEQ ID NO: 69853 - DNA, 21 bp, Homo sapiens
  misc_feature 1..21: note = chr1:65940402-65940423
  misc_feature 1..21: note = hypo
  source 1..21: mol_type = genomic DNA
agaaaaggccaggtgcggtgg

SEQ ID NO: 69854 - DNA, 64 bp, Homo sapiens; identical to SEQ ID NO: 26365
  misc_feature 1..64: note = chr1:65990955-65991019
  misc_feature 1..64: note = hyper
  source 1..64: mol_type = genomic DNA

SEQ ID NO: 69855 - DNA, 442 bp, Homo sapiens; identical to SEQ ID NO: 26366
  misc_feature 1..442: note = chr1:65991119-65991561
  misc_feature 1..442: note = hyper
  source 1..442: mol_type = genomic DNA

SEQ ID NO: 69856 - DNA, 153 bp, Homo sapiens
  misc_feature 1..153: note = chr1:65991605-65991758
  misc_feature 1..153: note = hyper
  source 1..153: mol_type = genomic DNA
cgggccgcttagggactgggagtccggggcagcttagcgggaccaccagaggggccagcgcccggcgggcggcgggggtggggtgggtgcgacgccgggcgactctcggctcccgtggggcgaggaagatctggacacacggctgacagcagc

SEQ ID NO: 69857 - DNA, 64 bp, Homo sapiens
  misc_feature 1..64: note = chr1:65991783-65991847
  misc_feature 1..64: note = hyper
  source 1..64: mol_type = genomic DNA
cgggaccaccgagagagcatgccacccggccaacttcttttccaggcttcgtgcctactttgga

SEQ ID NO: 69858 - DNA, 23 bp, Homo sapiens
  misc_feature 1..23: note = chr1:66030258-66030281
  misc_feature 1..23: note = hypo
  source 1..23: mol_type = genomic DNA
cgtgaatccgtttcttaatgttt

SEQ ID NO: 69859 - DNA, 20 bp, Homo sapiens
  misc_feature 1..20: note = chr1:6621025-6621045
  misc_feature 1..20: note = hypo
  source 1..20: mol_type = genomic DNA
agagtcggaagactctgtct

SEQ ID NO: 69860 - DNA, 506 bp, Homo sapiens
  misc_feature 1..506: note = chr1:66258145-66258651
  misc_feature 1..506: note = hyper
  source 1..506: mol_type = genomic DNA
tcaaaccaggattttcggtctctggctttggataggcacgcagggctgtgcgtaatccttcagctctggtggtaagggagatgcagtgagctcccggctgggagagagggttattttgcaaaactcccctggtaccgtgcccgcggaatattgcaggaggtctgtgaggtaggtgggggaaaaaataacctgggagggcaatcagggagaggccagacgactggggacggcgtgctttgcaccctagaattgacaggtggtggcctcagcagttacaacctactacacagcatctcgtccgtgcgatacggtcacattgttattccccgcacccggctgaggagcgcagcgcggcagaccaagtggcaccggcgagctgtctctcttccggggggcgggggtggacagtagggagagggggtttaaagggccagaggacgagagaagagctgaggggcgcgtcgccagcgcctgtgtctccctggcgcgggttccccaggctagcc

SEQ ID NO: 69861 - DNA, 89 bp, Homo sapiens; identical to SEQ ID NO: 26369
  misc_feature 1..89: note = chr1:66258671-66258760
  misc_feature 1..89: note = hyper
  source 1..89: mol_type = genomic DNA

SEQ ID NO: 69862 - DNA, 86 bp, Homo sapiens
  misc_feature 1..86: note = chr1:66258761-66258847
  misc_feature 1..86: note = hyper
  source 1..86: mol_type = genomic DNA
ccctccgggcagactttcgtcccccacccccgggagcgcggaaggctcactcgcagcgcatggtctacccgcgccgggcggagccc

SEQ ID NO: 69863 - DNA, 354 bp, Homo sapiens
  misc_feature 1..354: note = chr1:66259077-66259431
  misc_feature 1..354: note = hyper
  source 1..354: mol_type = genomic DNA
tgacggcgtcattgtcgccccttgtaggaaatccgccaaccggcccctagcctttcgccctcatcttctctgcttcggcttccgcccttggacctcttgacaagtcactggggaggagaggatggagagaggctaagggagaatggagagaggcagaaggattcagggcttggaagccctggagtaggtgacggatgggcgcgcggtgcccagtgattgactgcaggcagcgggcgcggaagggaacctgaactacccaagagtttgctgggctgaggctccaggatgctcctgcgtgccctggtggctggggcaccaaggaggggcgcactcaagcctcggcatcaccaaggc

SEQ ID NO: 69864 - DNA, 139 bp, Homo sapiens
  misc_feature 1..139: note = chr1:6627618-6627757
  misc_feature 1..139: note = hypo
  source 1..139: mol_type = genomic DNA
caaagaaaaaaaaaaaaaagaggagatcggcttacctgatactagcagagttaccctgggctctgctgcattgatggcagtttggcagttggggcctggggccctgggcctcgttcatcttcagcggctaggtcaagga

SEQ ID NO: 69865 - DNA, 30 bp, Homo sapiens; identical to SEQ ID NO: 38839
  misc_feature 1..30: note = chr1:6635034-6635064
  misc_feature 1..30: note = hypo
  source 1..30: mol_type = genomic DNA

SEQ ID NO: 69866 - DNA, 171 bp, Homo sapiens; identical to SEQ ID NO: 26038
  misc_feature 1..171: note = chr1:6663729-6663900
  misc_feature 1..171: note = hyper
  source 1..171: mol_type = genomic DNA

SEQ ID NO: 69867 - DNA, 622 bp, Homo sapiens
  misc_feature 1..622: note = chr1:66998790-66999412
  misc_feature 1..622: note = hyper
  source 1..622: mol_type = genomic DNA
agctgcagccccagtcggttgcgagaaaagctccccacctggggaagcgaggccgctcccgtgtgcgctcggcggggaggacgcggtggcggcgggactcgaactcggtcgtcgaagggcgccccgcagggtcccgtctgtagcccggacggcgagcccaggttggagtgggagggagccggcgtgcacagctgtctttggtcgggctcaggcttccgctccctgcctgctcccctttccagcctcccgccccagaaacgatctcgagcgttgccagtttgattccagagccccactcgggtgggttcttttgtttctttgttttaatgacagttcccagcccttcagcatgtcatgcgcaattaattccctggctctcacgaaggcagctggggtgaaatttcttctgcatcatccttttggggatgtttatgatgtgacgtcagtcggattgatttttctctcttgaatgaaggatgggaggggagaaagagagacggagagagagagagacgcacagatgtgcacggaggccacagacactgacatttggaattccttcagggtaaaaggacaccggaatgggagcttagaagtgtgttgctaagatttccggctgcac

SEQ ID NO: 69868 - DNA, 201 bp, Homo sapiens
  misc_feature 1..201: note = chr1:66999472-66999673
  misc_feature 1..201: note = hyper
  source 1..201: mol_type = genomic DNA
accccctccgcagcgagccacttaggtgctgctttcacgccagagtcccctgttaaggtggcagcccttgataactaatctcgggcacccagccgcttctgtaagcttaaggagacgacgaggaggggcgggggaagtgcgtcaccaggtggggaaggggctgtgtatttggtgacaagcgggaggcgatgggggtggagg

SEQ ID NO: 69869 - DNA, 378 bp, Homo sapiens; identical to SEQ ID NO: 64
  misc_feature 1..378: note = chr1:67217965-67218343
  misc_feature 1..378: note = hyper
  source 1..378: mol_type = genomic DNA

SEQ ID NO: 69870 - DNA, 30 bp, Homo sapiens
  misc_feature 1..30: note = chr1:6765811-6765841
  misc_feature 1..30: note = hypo
  source 1..30: mol_type = genomic DNA
ttgagctagcatacccggccccatctttaa

SEQ ID NO: 69871 - DNA, 23 bp, Homo sapiens
  misc_feature 1..23: note = chr1:6776365-6776388
  misc_feature 1..23: note = hypo
  source 1..23: mol_type = genomic DNA
agggagaccgtggggagagggag

SEQ ID NO: 69872 - DNA, 648 bp, Homo sapiens
  misc_feature 1..648: note = chr1:67773132-67773780
  misc_feature 1..648: note = hyper
  source 1..648: mol_type = genomic DNA
agcacacgattttatcgcgcctatcatatcttggtgcataaacgcacctcacctcggtcaacccttgctccgtcttatgagacaggctttattatccgcattttatatgaggggaaactgacggtggagagagaattatcttgctcaaggcgacacagcagagcccacaggtggcagaatcccacccgagcccgcttcgacccgcggggtggaaaccacgggcgcccgcccggctgcgcttccagagctgaactgagaagcgagtcctctccgccctgcggccaccgcccagccccgacccccgccccggcccgatcctcactcgccgccagctccccgcgcccaccccggagttggtggcgcagaggcgggaggcggaggcgggagggcgggcgctggcaccgggaacgcccgagcgccggcagagagcgcggagagcgcgacacgtgcggcccagagcaccggggccacccggtccccgcaggcccgggaccgcgcccgctggcaggcgacacgtggtgagtgaccagtgactcggggtcggggacagagagagccccaggatcccggaccagcggggtgtctgcgtgcccgggattccgtgtctcgcgtctcccgagggggcttcggcgacggcttctctcttta

SEQ ID NO: 69873 - DNA, 183 bp, Homo sapiens
  misc_feature 1..183: note = chr1:6801549-6801732
  misc_feature 1..183: note = hypo
  source 1..183: mol_type = genomic DNA
aatgaaggcattggccgagctgtgttcctgctctaggctctgcaggagaatccctttccttgccttttccagctccctcaggctgcccacatcccttggtttgtggtcccctcctcctcctcttcaaagccagcagtgctgcctcttcacatctcgctctgaccttggcggttgtgatcccat

SEQ ID NO: 69874 - DNA, 17 bp, Homo sapiens
  misc_feature 1..17: note = chr1:6811500-6811517
  misc_feature 1..17: note = hypo
  source 1..17: mol_type = genomic DNA
cgcgcctggcctataat

SEQ ID NO: 69875 - DNA, 86 bp, Homo sapiens
  misc_feature 1..86: note = chr1:68297687-68297773
  misc_feature 1..86: note = hyper
  source 1..86: mol_type = genomic DNA
tagagaaggcacagacgcagaccctgcctctgacgacatccaaaagattcattatacacagcctattcaggcgaagctacaaccgc

SEQ ID NO: 69876 - skipped

SEQ ID NO: 69877 - DNA, 198 bp, Homo sapiens
  misc_feature 1..198: note = chr1:68298403-68298601
  misc_feature 1..198: note = hyper
  source 1..198: mol_type = genomic DNA
cgtcatatgggctctcccctctgcgacccgctatttccctgctagacccccagcgcccagcggattccaaggctgcgctcccgccggctggtcccgggaggtagaaagtaggcagaggggcgtggcgtccctgtcgcccccacatgccagccctcctccaacgcctgacaccaccacaagccacggctgggaacactg

SEQ ID NO: 69878 - DNA, 262 bp, Homo sapiens
  misc_feature 1..262: note = chr1:68696775-68697037
  misc_feature 1..262: note = hyper
  source 1..262: mol_type = genomic DNA
cattgaagtttgtgccgggatgtcccaaatcttgagggggcggggggcgcgagtgtgcagagaggcgggaggatggatgcagatggggagacagtgaggggaagggagtttttccgagtggacggtccgtgaggcggttttcttcacccggaagcctgtttgactcagagaggtccgggaggtgcacgccaggggaggtctcccggggcgggcgctgtcgccgaggaggccggcgagctgtcacctgcggggggctgtggtg

SEQ ID NO: 69879 - DNA, 30 bp, Homo sapiens
  misc_feature 1..30: note = chr1:68698056-68698086
  misc_feature 1..30: note = hyper
  source 1..30: mol_type = genomic DNA
cactccctccttcctcgcctcctttctggg

SEQ ID NO: 69880 - DNA, 30 bp, Homo sapiens
  misc_feature 1..30: note = chr1:68698513-68698543
  misc_feature 1..30: note = hyper
  source 1..30: mol_type = genomic DNA
aaatcaccggtggaccgccttgcagacctt

SEQ ID NO: 69881 - DNA, 123 bp, Homo sapiens
  misc_feature 1..123: note = chr1:68703942-68704065
  misc_feature 1..123: note = hypo
  source 1..123: mol_type = genomic DNA
atatctgcttctctccgcgcagagtggcaataggtggaaaacccgggaaggcccagaaacacctgccccggacagtgattcctgtgatatgcagacaacacccagtaccgtggcagacttggc

SEQ ID NO: 69882 - DNA, 30 bp, Homo sapiens
  misc_feature 1..30: note = chr1:68761411-68761441
  misc_feature 1..30: note = hypo
  source 1..30: mol_type = genomic DNA
gcgtgctcgcctcgacgtccgctcaaagtc

SEQ ID NO: 69883 - DNA, 30 bp, Homo sapiens
  misc_feature 1..30: note = chr1:6964959-6964989
  misc_feature 1..30: note = hypo
  source 1..30: mol_type = genomic DNA
ttgtttcgtattgcacgctgaacactccga

SEQ ID NO: 69884 - DNA, 195 bp, Homo sapiens; identical to SEQ ID NO: 38841
  misc_feature 1..195: note = chr1:6984148-6984343
  misc_feature 1..195: note = hypo
  source 1..195: mol_type = genomic DNA

SEQ ID NO: 69885 - DNA, 301 bp, Homo sapiens
  misc_feature 1..301: note = chr1:70032971-70033272
  misc_feature 1..301: note = hyper
  source 1..301: mol_type = genomic DNA
cgggggaggaaaccccgaggaggcgctcccggccgcctctttgctgagatagcaggagcagcagcctgaggagccacgagctcagcgtcactgagctagtgcgggtgcaggggcgctcaggcaggcgcacaggccgggagccgcttctgccgctcaggcggccgcgctgcagaaagccgcgccgcgctgcccgagcgcccggggctggcccgcgagcgggaggagccggcagccgcgctccgccccgcgctgagattcgtgccacctgcctcgaacaccacggaggcgagaggaacccaga

SEQ ID NO: 69886 - DNA, 111 bp, Homo sapiens; identical to SEQ ID NO: 26378
  misc_feature 1..111: note = chr1:70033503-70033614
  misc_feature 1..111: note = hyper
  source 1..111: mol_type = genomic DNA

SEQ ID NO: 69887 - DNA, 569 bp, Homo sapiens
  misc_feature 1..569: note = chr1:70033922-70034491
  misc_feature 1..569: note = hyper
  source 1..569: mol_type = genomic DNA
ggagccttctgggggcggggagggagctgcgcctccgccaccgccgccgccgccgccgctgctgctgcggtcgctagcgcggcgcgctgggcaggctgaggctggggagtggacgcgctcctgcctcccccgccggcgcttcgggcttcccctcagccgcttcccgcgggaacctctccagccgtccacctgaagggcactggcatcatggtctaacgtggcaccttcctggattcccctctatctcctgttcttcctaccttctactccttccctcctcttctcctccgaagaccctggcgcccactccactgcggacccctgaacacttaaggaataacccttggcagctgcacgactacgctctccgaaacctcatgggcagtttctcccgccggcgatgtgagtaaggcacgctcgctccgtggcggagggtgctgcgggggcccggccgcggcgaccgtaggcgcgcgaggtgtgggaccccagaggccggccgggggcgggggtggcagggcgggaggcttcggcgctcgcggggagctgcttgtgcggtggccgagggaggc

SEQ ID NO: 69888 - DNA, 82 bp, Homo sapiens; identical to SEQ ID NO: 26380
  misc_feature 1..82: note = chr1:70034492-70034574
  misc_feature 1..82: note = hyper
  source 1..82: mol_type = genomic DNA

SEQ ID NO: 69889 - DNA, 120 bp, Homo sapiens
  misc_feature 1..120: note = chr1:70035088-70035208
  misc_feature 1..120: note = hyper
  source 1..120: mol_type = genomic DNA
cccttgaggatcttgcgtcctcctctccgagttattaaggatgcaggacgtgtttcggattcgacgtggaaagagggagggaagcacattagcattaaggtaatcatggcaccctggctc

SEQ ID NO: 69890 - DNA, 215 bp, Homo sapiens
  misc_feature 1..215: note = chr1:70035209-70035424
  misc_feature 1..215: note = hyper
  source 1..215: mol_type = genomic DNA
tggactattagattggctaccagtggtctctaatcttactgtttgcagagtcaagaatgggggcgggggttgggggactgtatagattgccttttaaaatagtgtgacttcataataacggagatggctgaaagattgcttccttacactacttctcggccatcagggctgaataaaggacccgcctccgccctctactccggctcttctctggc

SEQ ID NO: 69891 - DNA, 112 bp, Homo sapiens
  misc_feature 1..112: note = chr1:7023766-7023878
  misc_feature 1..112: note = hyper
  source 1..112: mol_type = genomic DNA
acctggctgggggggcgcgctcccggggcctgggggctgggcgcggctcggggagctgcgctttgcggactggaggtggcgaccgtgcgagcagagacgcccctcaccatgg

SEQ ID NO: 69892 - DNA, 29 bp, Homo sapiens
  misc_feature 1..29: note = chr1:70599140-70599169
  misc_feature 1..29: note = hypo
  source 1..29: mol_type = genomic DNA
cgatccgaccgcctcggcctcccaaagtg

SEQ ID NO: 69893 - DNA, 75 bp, Homo sapiens
  misc_feature 1..75: note = chr1:70672852-70672927
  misc_feature 1..75: note = hypo
  source 1..75: mol_type = genomic DNA
gtgtcagtcgccgtgcccagcctgagttttaaaggaaaacgaccgtagcagcttttgcaacgttattaatgaggt

SEQ ID NO: 69894 - DNA, 35 bp, Homo sapiens
  misc_feature 1..35: note = chr1:7067754-7067789
  misc_feature 1..35: note = hypo
  source 1..35: mol_type = genomic DNA
cccctgtggggctcccggggcgtcgcttctgcctc

SEQ ID NO: 69895 - DNA, 38 bp, Homo sapiens
  misc_feature 1..38: note = chr1:70710368-70710406
  misc_feature 1..38: note = hypo
  source 1..38: mol_type = genomic DNA
ggtcaagaagcagatcgagacggcggtcacattctaag

SEQ ID NO: 69896 - DNA, 32 bp, Homo sapiens
  misc_feature 1..32: note = chr1:70793696-70793728
  misc_feature 1..32: note = hypo
  source 1..32: mol_type = genomic DNA
gagactgtaccactgagcgagactccgactca

SEQ ID NO: 69897 - DNA, 30 bp, Homo sapiens
  misc_feature 1..30: note = chr1:70859409-70859439
  misc_feature 1..30: note = hypo
  source 1..30: mol_type = genomic DNA
cagcagagagaatatcgtagggcaattaaa

SEQ ID NO: 69898 - DNA, 30 bp, Homo sapiens; identical to SEQ ID NO: 26040
  misc_feature 1..30: note = chr1:7130249-7130279
  misc_feature 1..30: note = hyper
  source 1..30: mol_type = genomic DNA

SEQ ID NO: 69899 - DNA, 54 bp, Homo sapiens
  misc_feature 1..54: note = chr1:713277-713331
  misc_feature 1..54: note = hypo
  source 1..54: mol_type = genomic DNA
ctaacccaggtgggtcgctgtccctcacgcctgtaatcccgacaactctgatgg

SEQ ID NO: 69900 - DNA, 885 bp, Homo sapiens
  misc_feature 1..885: note = chr1:71512862-71513747
  misc_feature 1..885: note = hyper
  source 1..885: mol_type = genomic DNA
aaaaaggtgcagagccgccccgacgggtcgatgtgctcccaacgctgcttggacaggtacacgacgatgacgaccggggtggtgagaagctgcccgaccaggtcggtgagcgccagccagccgatgcacagcaggaaggacttcttgcgcttgctctcccggcgccggtagctgcgcgacacgagcagcatggccagtgcgttgcccacgaaaccagtgagcagcatggtgatcgggaaggccacggacaccgatccgcaatcctcgccagaccctggagggcgcgtgaggttgccccgcgcctcggcggaacgctcgggcgcccacatgcctgtgtaggagtggttgaggcgggtgcagaagggggcatcccctccgtagccccgggtctccttcatgttggcttcgaggtgaggaggggatggcgtccagagagccgcagcgggagggggcagacgcggcgcgggcggcggcggaggtcggcgtttaccgcggctggggctgggctgccccccatggtgcggggcgcagccgccgccctactccgctgctgggaccgcggccgcggcggcgccagggctcactggcccgggagggagccacgccttcctctctgggaaacctctggtggcgaggcgcgcggaggtgccgagtcccctttataaggccgagggggcggggcgcccgtgggtgtggacagaaccgaggtgggaggagggtgcaaagcaactgagcgcctctcttggctgttgcctatcctgatcgcctgggttgggaagccccagacggtctcctctgaaacgccctgctcctggccggaccgggagcccactggggtctcctccagttctccgctaaagtgtcggtggacggcaagcagctaat

SEQ ID NO: 69901 - DNA, 30 bp, Homo sapiens
  misc_feature 1..30: note = chr1:71520000-71520030
  misc_feature 1..30: note = hypo
  source 1..30: mol_type = genomic DNA
gtggcagctgggttccgggcaggtggagcc

SEQ ID NO: 69902 - DNA, 30 bp, Homo sapiens
  misc_feature 1..30: note = chr1:71532563-71532593
  misc_feature 1..30: note = hypo
  source 1..30: mol_type = genomic DNA
gaataagatctttttcgtggggaagaagag

SEQ ID NO: 69903 - DNA, 30 bp, Homo sapiens; identical to SEQ ID NO: 38843
  misc_feature 1..30: note = chr1:7162881-7162911
  misc_feature 1..30: note = hypo
  source 1..30: mol_type = genomic DNA

SEQ ID NO: 69904 - DNA, 194 bp, Homo sapiens
  misc_feature 1..194: note = chr1:72118097-72118291
  misc_feature 1..194: note = hypo
  source 1..194: mol_type = genomic DNA
aaatctagccatctacgtttataaataaagttatatggaaacgcagcacagccattttttatagacatatatggctacttatatactacaatattagcattgagtagttactacagacaccatagggccaacaaagcctaaaatatttactattttgcccattatagaaaaagctggcccggtgtggtggctca

SEQ ID NO: 69905 - DNA, 153 bp, Homo sapiens
  misc_feature 1..153: note = chr1:72383459-72383612
  misc_feature 1..153: note = hypo
  source 1..153: mol_type = genomic DNA
cttaaaaaaaaaaaaaaaaaaagtaagtcatatatattttggaagcggccaaattgaacagcaaaccactcttcaaaaagcacaaattgagttaggttgcctttaagaacgacctcactgctgtgtgctctactgcaacgttaaaagaagaac

SEQ ID NO: 69906 - DNA, 436 bp, Homo sapiens
  misc_feature 1..436: note = chr1:72747831-72748267
  misc_feature 1..436: note = hyper
  source 1..436: mol_type = genomic DNA
aacgggccggggctccgggaagaatctgcacctggaattcttgggatgtggtctttccatgatgagcaccaccagcattattgcttgtgttataaagaaggcaaagagggttcaaagagagacagaaagatagaccgaaacaagtacgaaaagcacgccgttcttcctacctaagcaccgccgtgtccccttttctgaccatcatgttgtccacggccgcccaggggaagtccacactctgtccagccgggaggcaggagggtagcaggcagcacaggctgaggagcaccgccgccagccactggttcgagcaacaagcaccctgcaccaacagcatcatgtccatccctgctagggctgctcactctccagcagctttcagctcgcactcccccaccccctggtgctggcgagtcttcccgggaaccaggcggcg

SEQ ID NO: 69907 - DNA, 379 bp, Homo sapiens
  misc_feature 1..379: note = chr1:72748650-72749029
  misc_feature 1..379: note = hyper
  source 1..379: mol_type = genomic DNA
gcagcagaagcagcgcggagcgctgcgccggccgccggctcccgggctcgcgcgcgttgccaagcggccgtttccttagcaaccccgccaggggactggggatggagaagggagggggattaaaaaaataataaaaaaagaaagaaaaaagatagcaagaaaaaaaaaagaaaagcaagacaacgaaaaaaaaaataggaggaactgtatcacaattatgcaaactaagggggaaagagaggcaccttagaatgaaggctctccttactgtcgtaagcgctagagggattctttgctagaaaagtctccgtgtcagggctggggtgaagagagctgaggggcgctttgccttccctcaccggtgcgttttacctctcga

SEQ ID NO: 69908 - DNA, 847 bp, Homo sapiens
  misc_feature 1..847: note = chr1:72749731-72750578
  misc_feature 1..847: note = hyper
  source 1..847: mol_type = genomic DNA
cgccgggctgttttcagccctgccctggcccaaggcagaaggagatactaggcgtggggccacccctactcttttttcttctttccttcttgaactcatttccagattcaagatccttaagcttttccgggccatttgcaaatcaatgcgagaaccgaggctgagtcgttagcagttacaccaatcaatcttgttcagcgaggagtttgggaagcagagcggggaagtgaaaatggaaaataagtaattaaaaaataagctccctccccctcacacactttttcccttcctccaccccatccccctttagcagtgtttgaagaagatattctttgccagatcccagttcttcttttggaggaaatgaagcaaaacctcacacgtccgtaactcgttttccataatgctagcagggtcatttggcaaagcgcaccgaagcaagactctctgcaggggtcagcatccggctgcctccgcagactgagctctttacgaggcaggcagggagtcgttttgcttggtggtagcagtgttcagagtgatttttatcgccatgcacggggatatatggggaaagggaagggttcccatcacctgtgaccacccagactggcttacagacgaatccttaactagcaacacctccctgctgaactggcactccaaggctgggcagctaacggagacatttgcgtcaggagtcactgatgttagtattctgccttaactctcaaaaccgactcggaaactgagagtgcaatagtttcaaccgcattttgaaacatcaataaaatgttagtcatttgcggatgaatgaaaacattttctttaccgtctggtatgctag

SEQ ID NO: 69909 - DNA, 30 bp, Homo sapiens
  misc_feature 1..30: note = chr1:7315042-7315072
  misc_feature 1..30: note = hypo
  source 1..30: mol_type = genomic DNA
gtttcacatacaatacgtatttctactttt

SEQ ID NO: 69910 - DNA, 30 bp, Homo sapiens
  misc_feature 1..30: note = chr1:7445788-7445818
  misc_feature 1..30: note = hypo
  source 1..30: mol_type = genomic DNA
tgattctggggtgcccgctccccagcactt

SEQ ID NO: 69911 - DNA, 30 bp, Homo sapiens
  misc_feature 1..30: note = chr1:7500700-7500730
  misc_feature 1..30: note = hypo
  source 1..30: mol_type = genomic DNA
tgaaggtgtggtccccggatcccagcacct

SEQ ID NO: 69912 - DNA, 15 bp, Homo sapiens
  misc_feature 1..15: note = chr1:75594000-75594015
  misc_feature 1..15: note = hyper
  source 1..15: mol_type = genomic DNA
cgtggccgttttatt

SEQ ID NO: 69913 - DNA, 164 bp, Homo sapiens
  misc_feature 1..164: note = chr1:75595334-75595498
  misc_feature 1..164: note = hyper
  source 1..164: mol_type = genomic DNA
cctatccccagaaaccgagaaaaccatctggtttttgcacttagataaagtttaactttcctgccacactggccgagttgggctttcagacatccctggggaagtgggaaaacggggatgtggaaggggaggagaagcctgaagggcctcggttccatcctctt

SEQ ID NO: 69914 - DNA, 26 bp, Homo sapiens
  misc_feature 1..26: note = chr1:75595733-75595759
  misc_feature 1..26: note = hyper
  source 1..26: mol_type = genomic DNA
cctccaaaccacaggcgtgcttaagg

SEQ ID NO: 69915 - DNA, 173 bp, Homo sapiens; identical to SEQ ID NO: 26389
  misc_feature 1..173: note = chr1:75595818-75595991
  misc_feature 1..173: note = hyper
  source 1..173: mol_type = genomic DNA

SEQ ID NO: 69916 - DNA, 249 bp, Homo sapiens; identical to SEQ ID NO: 26390
  misc_feature 1..249: note = chr1:75596135-75596384
  misc_feature 1..249: note = hyper
  source 1..249: mol_type = genomic DNA

SEQ ID NO: 69917 - DNA, 248 bp, Homo sapiens
  misc_feature 1..248: note = chr1:75596611-75596859
  misc_feature 1..248: note = hyper
  source 1..248: mol_type = genomic DNA
aattctgccagaatccgcaccttcttatgatcgcgaaagtctccccatcctccaccgcctcctacagtcctatggcccactgtacccttggcgctggagccctggaggtgggcggtgagggccgcgggccagggaaagctcgggtccgcaagagcagggctctgtttctgcgcctgcaggccgcccgggagtcctggatgcgcctcctttgaccacgttttctctcaggctccagctgtgcctcgccc

SEQ ID NO: 69918 - DNA, 655 bp, Homo sapiens
  misc_feature 1..655: note = chr1:75596929-75597584
  misc_feature 1..655: note = hyper
  source 1..655: mol_type = genomic DNA
cgggaatccgagtttccggagattgcctgagcaccgcagaacctccaggttaagttctctcaaacgtgtggttactcaccccgaggagctcagaggcaaagggttcaatagtcaagttggtggggactttccctacttaaagttataatttgctaattcggatctattgcttttaaatatcgagttccagagacctctgtcaatgcaggcttaatttcatcccactgatgaaggatgtttataaacggcgcctgcagtgcgagctgagtgtgaaaatatcagttttatgccttttgataagaattaccgaggcggaaggctcattagacgattacaaatttcgcagctgctcgcagcccaattaggcagctcttcgggtgagtggaagctgtgggggtcagggcgggttgatgttccctctctccagcccggacctccaatcaaggcctggctccacgggatctagaccccttccctgcccccatctgtttttagggagatacactcaaggcttcccttaagcaggagaggcacagcctgggacaggacgcactccgaagtctctcaggctgtctttcccatgggcttgcaaaaagccctgtggtccacggatgttggtagacaccttgggtgggcctgccgcctctgattttca

SEQ ID NO: 69919 - DNA, 981 bp, Homo sapiens
  misc_feature 1..981: note = chr1:75597825-75598806
  misc_feature 1..981: note = hyper
  source 1..981: mol_type = genomic DNA
gtaagaggcgtgacgcgagctccagggaaccgggccaccaggaagaagctataccttcgtacgcccacccctgacaaaaggtcagaaggtcgttggaccccagaccgacaggacgatcagccctgggattcatagcaaacacattcccctcttcttgcacactcgacccccagccaaaggcttataccgcccaggacatagaaattgactcaccgcccagaggcttacagctcaaggaggggtgcgcgcagctgcaccccgggacaggtcagcatcccacaaggcgcctggagtaaagcgaggccagaccaatctttcacgtcttctgctcctgtctgacgaccattcttcttccccaagcccagaaacctctaaaaatgaatcattttctccacttatgcagagatagacgctcttagatcaaggttagtattttgaaaacctgactgagagccgcctgattaggcgagggtgggtggaaagaccgcataaatgcccgcacccccgccctgcttccctaacacagctccagctctctctggatctccaaatgacccgcgcgataaattctcctcgatagtagccagacagtaccccagattcactttaaaccctaacacacacacacacacacacacacacacacactgtaattaaatatccaaaccggacctttatgtttaattccactttcaacgaaatcctgctctatacacgacctgatggcgccaatgttctgcacgactctgactttccattcggaagagcggtctccacaacgatgctatttcatggaaaatgcattatgtgaatttctccaccacccccaataccgatttctgcatttgatgaaaaacacaagtctttctggttcccacgcacaagttagctttttgaaaagtcagtccaccccaatctttcaattttctaagagggcacagattaattatatcgtcctcctcccttcgctcagtaaattta

SEQ ID NO: 69920 - DNA, 315 bp, Homo sapiens
  misc_feature 1..315: note = chr1:75599376-75599691
  misc_feature 1..315: note = hyper
  source 1..315: mol_type = genomic DNA
ctgaatacctccctccgccgcttccccgccccgcagtcagaacttgaggcagaagacaaggctgctcgggcttacattttgtctaggagatgaaagagcaatactcattagcaacatacttttgtctttcttgtagccttgatttcaaatctagtcgcaaatcataagcttttgtgttgctcagatgttccttctttatcttaatgagaaaacttttcggaaagggagcgcgaactgctagataagtcagctcccaggctgccaggagcggtggcattcctcggctacaccggacagctgcgagtttcaagagaa

SEQ ID NO: 69921 - DNA, 577 bp, Homo sapiens
  misc_feature 1..577: note = chr1:75600108-75600685
  misc_feature 1..577: note = hyper
  source 1..577: mol_type = genomic DNA
aaggaattttaagaacggttcatcagaaagtggtcaggccacagcggcctctttggacgaagacacacttgtagcattatccttctcggcatcagcttttattagtggatcggggcgggggaggggggagatcggcagacacggacagcctctgaccctctggagttggtatgtgataagcagccctagcagtgccatgtattggaagaacgatcagatgtttgtgtgtaaactagtagcaaaggacgtgccggagctggcagttccccctgagaaggtgagcgagccgacgcctggccagaccagctgaatcgcagtgtccttgaaactcgagttgtttgggctcctaaacaaggttcagaaactacctgtaacggcctcatcttcagacctggcaattttttttttttattacgtagtagcgttagtcagtaatcattgcactccctccccaaaagctcacttaacctgagacatggagactgtaatttgggagatgaagcctcgagcctaaggcgctctcaggtccatgtgagtcgtgcttttgttctatttgctgtggtgatcgtggcggtcc

SEQ ID NO: 69922 - DNA, 433 bp, Homo sapiens; identical to SEQ ID NO: 5565
  misc_feature 1..433: note = chr1:75600686-75601119
  misc_feature 1..433: note = hyper
  source 1..433: mol_type = genomic DNA

SEQ ID NO: 69923 - DNA, 89 bp, Homo sapiens; identical to SEQ ID NO: 5566
  misc_feature 1..89: note = chr1:75601187-75601276
  misc_feature 1..89: note = hyper
  source 1..89: mol_type = genomic DNA

SEQ ID NO: 69924 - DNA, 151 bp, Homo sapiens; identical to SEQ ID NO: 5567
  misc_feature 1..151: note = chr1:75601277-75601428
  misc_feature 1..151: note = hyper
  source 1..151: mol_type = genomic DNA

SEQ ID NO: 69925 - DNA, 1526 bp, Homo sapiens
  misc_feature 1..1526: note = chr1:75601633-75603159
  misc_feature 1..1526: note = hyper
  source 1..1526: mol_type = genomic DNA
aaagagctgctggctcggtttaatctgaagcattttcattcaaattgtcatcggaacaaacaccaggcttcttaaatcccgctgtaattagctttcaagtatcctattaaacctcttcacctttcgggctatcctattcaaaaagccccctttttaaaatatatatgtgtcttgctcttttaattgaggttattaaagaaatctagtttcttctcccaccccctcctcaatcctcttttcttctctcgcactccacctcccactgccccgcaccccctttagcccggtgttccccgctccgctatgattgacgtctggaaagaaagagctttgtgaggggatgattgttattaacttgttatccccggcgggggggcggggaaccgacgtgcccgggtgagcgccggagacccggagcccggggagcgcgggacgagctaccagcgctcgggtggcggccgccagcggccagcgaaggaggctgcgcgccagcccgcccgcggcgcccgggctcaggcgccgtgacggctgcacgcgctgccccgcactctgagggccttcattagctcgctccccgcgccgaggctggggcgggcagcacgctcggaacttctgatctgtttctccatactttctccccctcctactccgcagtgtcaggggctcatgtcagaggagtgcgggcggactacagccctggcggccgggaggactcgcaaaggcgccggggaagagggactggtgagtgcggaggggctcgcgtgctggcaagactggccgtggggaggcggcgcaggacgaagggccgctgtccccgcgctccttccagggcccagctggcccctcctgcagcagacagaggacggggcggagagggtctgggtggggtgggaagcttagctggcccgcgaggagggcagggccgcaagacttctggggtccgaataggtcaggggtcggcagccccagcgggtgcgtagccagagcttggactcggggaagagggcgagaatcgtgacctcaagaagctgggggtggggtggggtggccagggggaagggaggggaggcggtgggggcgcccttgtgggtaggtgggatgcgaaggggaggaggggtctagaaccgcctgcgcctcgcggtttcctgcaggtgagccccgagggagcgggggacgaggactcgtgctcctcctcggccccgctgtccccgtcgtcctcgccccggtccatggcctcgggctccggctgccctcctggcaagtgtgtgtgcaacagttgcggcctggagatcgtggacaaataccttctcaaggtaggatagggcctcgggtgcgaggcccaaggggagcgggcttagcgtgggagctctgggaaaagagtaatgttcctcccaccaacctttccgttcaagttctgggtgaaggttgtaggcttttgcagaaaatcagcccagtttagggcaactcatgcggtgggataaagtgagaagaaatcccagactcttctatgtcgttgcaaaacagct

SEQ ID NO: 69926 - DNA, 449 bp, Homo sapiens; identical to SEQ ID NO: 5570
  misc_feature 1..449: note = chr1:76080278-76080727
  misc_feature 1..449: note = hyper
  source 1..449: mol_type = genomic DNA

SEQ ID NO: 69927 - DNA, 325 bp, Homo sapiens; identical to SEQ ID NO: 26402
  misc_feature 1..325: note = chr1:76080728-76081053
  misc_feature 1..325: note = hyper
  source 1..325: mol_type = genomic DNA

SEQ ID NO: 69928 - DNA, 484 bp, Homo sapiens
  misc_feature 1..484: note = chr1:76081342-76081826
  misc_feature 1..484: note = hyper
  source 1..484: mol_type = genomic DNA
tcctgtcagtgtccccggaggccaggggaggtgcagcggcgccgcggtttcccccaccccctccccggacacggcaaactcttccccggcaggagccttccacttggccgcgcctggatgtaaacaggccggcccgaggggcagagggcgggtgagagaggggaggcggcgaggggaggagggagcgggactcacccttgatgctggggggctttctcttcttggccatcttctgtccccttccctcccccggaccccccacgcgcttcctccggctgccgcgcagctcccaggcgagccctcgccgcggctctcagctcagcgagctctttgttgctgtgatggcatctgcgagcagcagcggcggccgggctgcgcgctcagctcggctcggctcggctggggcgggcgccgccgcccctctgctctcggccgcgccgctggcccccctcttgcgctgctgtggacgcggtggctgctgcgg

SEQ ID NO: 69929 - DNA, 341 bp, Homo sapiens
  misc_feature 1..341: note = chr1:76082037-76082378
  misc_feature 1..341: note = hyper
  source 1..341: mol_type = genomic DNA
ggagctgctggggggcgcggagagaccgcggccatctggggccgggaaggagaaagccaggcagagtctgatggagtctgcctccggcctgccttcctctgggccttcgaagccccctctcaaaaggccaggacgcgctgggcccaagaaagacacccgtcttcacaggccaaccagaactctggccacctgcgggaggacggcactgtcccttgcgacccggcccaggagccgtcctcctccacagcctcctcgaggatagcgagcccgaattccacgcgggcgatgagccccgaagcgcgcggttgcctctgcccctcccgaaccgagaaggaaagagg

SEQ ID NO: 69930 - DNA, 30 bp, Homo sapiens; identical to SEQ ID NO: 39004
  misc_feature 1..30: note = chr1:76259201-76259231
  misc_feature 1..30: note = hypo
  source 1..30: mol_type = genomic DNA

SEQ ID NO: 69931 - DNA, 24 bp, Homo sapiens
  misc_feature 1..24: note = chr1:76354586-76354610
  misc_feature 1..24: note = hypo
  source 1..24: mol_type = genomic DNA
tttttttttttgagacggagtctc

SEQ ID NO: 69932 - DNA, 24 bp, Homo sapiens
  misc_feature 1..24: note = chr1:76354730-76354754
  misc_feature 1..24: note = hypo
  source 1..24: mol_type = genomic DNA
caacacgcccggctaggactggga

SEQ ID NO: 69933 - DNA, 44 bp, Homo sapiens
  misc_feature 1..44: note = chr1:76540206-76540250
  misc_feature 1..44: note = hyper
  source 1..44: mol_type = genomic DNA
gcagagcgcactctgcgcacgtcgagccgcgaaaggttcacaga

SEQ ID NO: 69934 - DNA, 78 bp, Homo sapiens
  misc_feature 1..78: note = chr1:76540496-76540574
  misc_feature 1..78: note = hyper
  source 1..78: mol_type = genomic DNA
tgcccctgacccaggcgcgcccgctgctcggtggcaggagggccggcggagcgccatggcctgcatcctgaaggtaac

SEQ ID NO: 69935 - DNA, 82 bp, Homo sapiens
  misc_feature 1..82: note = chr1:76540575-76540657
  misc_feature 1..82: note = hyper
  source 1..82: mol_type = genomic DNA
acttggatctgtggctcggacgcgtggttggccagccccttgctgctcagaggcacggagtcagccgcggtcccaccgcatc

SEQ ID NO: 69936 - DNA, 170 bp, Homo sapiens
  misc_feature 1..170: note = chr1:76955378-76955548
  misc_feature 1..170: note = hypo
  source 1..170: mol_type = genomic DNA
cacgggacttaggtgcgttctccgccctctccatgctgacctcttttctcacctgatctgcccagctcagggctggacaagaggtgggagggaagaaaagtggataggaccttagtctcactagttcttactcgctgttagttctctgagcctggcgtatagttccagtt

SEQ ID NO: 69937 - DNA, 221 bp, Homo sapiens
  misc_feature 1..221: note = chr1:7728823-7729044
  misc_feature 1..221: note = hypo
  source 1..221: mol_type = genomic DNA
gcagttctttgttcccggcagcagccccagcctcatgctagcagctgttgattgcggttattattttttccctttttctcacatggtaactgtctgtggccttttgaagtcactgctcttccacttcccaggatcctgggggatggtgccctgagctggccttctggtgcttccagacatcccaaagtcaggctccacctgtccgccggcactcttctcag

SEQ ID NO: 69938 - DNA, 293 bp, Homo sapiens
  misc_feature 1..293: note = chr1:77332866-77333159
  misc_feature 1..293: note = hyper
  source 1..293: mol_type = genomic DNA
tgtttttatcaacatcgcaaaacagaaaatttaggttgcagattttcacatggctatcacgttcagaatccaatcaggttctccttctttactacttgatgacttctttaaagataaataagcccgcggaccaagaagtgggtacactggctcggttaactctctctccccagaaatttcactactgaaaagattattatttgggggcggggaaggggatgtagaggtctttaggacccagcaggcggcggcaggcggcagttgtgtagatcgctgagagactacgagggtcc

SEQ ID NO: 69939 - DNA, 274 bp, Homo sapiens
  misc_feature 1..274: note = chr1:77333160-77333434
  misc_feature 1..274: note = hyper
  source 1..274: mol_type = genomic DNA
gttcagttttaattctgtctctaatctctgcaacagccgcgcttcccgggtcccgcggctcccgcgcgcgatctgccgcggccggctgctgggcaaaaatcagagccgcctccgccccattacccatcatggaaaccctccaggaaaaagtggccccggacgcgcgagcctgaggattctgcacaaaagaggtgcccaaaatgaagaccctgatggtgagtcagttgtggcaactccaccgggcaaagagggggatccccgggctcagggtcca

SEQ ID NO: 69940 - DNA, 161 bp, Homo sapiens
  misc_feature 1..161: note = chr1:77333763-77333924
  misc_feature 1..161: note = hyper
  source 1..161: mol_type = genomic DNA
caaacttgcaaggatcgcaaggatccagggccccaggaaaggaggggtgtgaaggactcaaaattccagcagcttggctggggtggctgcgccagacgggcccttccccaaagtgcaaacccacccctgtcctcggccccggcgcgctccctccctcagcc

SEQ ID NO: 69941 - DNA, 218 bp, Homo sapiens; identical to SEQ ID NO: 67
  misc_feature 1..218: note = chr1:77334168-77334386
  misc_feature 1..218: note = hyper
  source 1..218: mol_type = genomic DNA

SEQ ID NO: 69942 - DNA, 349 bp, Homo sapiens
  misc_feature 1..349: note = chr1:77334408-77334757
  misc_feature 1..349: note = hyper
  source 1..349: mol_type = genomic DNA
cggagtggcggaccacaaggtgacagcatgcccgccagcccgctcgccactcagcctggggatcccgcacacctgagccttccccctttcccggggctgggaggcgctgtgagtaggtgccgttcgaaggctggaggggagtggacccgctggggtagggtgggctagttccaacttggtatgaattcttatttggagaaagacacaaagttttgtagaaaataggggtgaggtgcgtggaccccaaagcctaatttcccagcagaaatcggccctggaactagaactccctgatccccagaattgcagctgcggatggaggtccggttcctgaagcctcgggtttggc

SEQ ID NO: 69943 - DNA, 119 bp, Homo sapiens
  misc_feature 1..119: note = chr1:77334795-77334914
  misc_feature 1..119: note = hyper
  source 1..119: mol_type = genomic DNA
cgcgggtaccagcctgagcgttcctctgacccggaaccggagggtgagcgcagccagcccgcggccactgctcgggatccagcgttcccctctgatctctccagcgcattgctttgggc

SEQ ID NO: 69944 - DNA, 44 bp, Homo sapiens
  misc_feature 1..44: note = chr1:7740637-7740681
  misc_feature 1..44: note = hyper
  source 1..44: mol_type = genomic DNA
aggaaggcctgagcccggccacccgcctccgagtgcgccgcacc

SEQ ID NO: 69945 - DNA, 201 bp, Homo sapiens
  misc_feature 1..201: note = chr1:7750833-7751034
  misc_feature 1..201: note = hypo
  source 1..201: mol_type = genomic DNA
acagtgagtgggtggcgcagagagtcacacacagcagtgcgaccccatcatccgctcttgacctctatgccatgtgaggcttctggagcctcttcctgttgcacctgcactactttggagctgcctcccagggctagagcctgtccttgcttcccggttattcacgacaaccgtcagtggagtacccgttaggtgccaggc

SEQ ID NO: 69946 - DNA, 39 bp, Homo sapiens
  misc_feature 1..39: note = chr1:7764052-7764091
  misc_feature 1..39: note = hyper
  source 1..39: mol_type = genomic DNA
ccccctccccaaagccggagccgccgccaccgtccccgc

SEQ ID NO: 69947 - DNA, 137 bp, Homo sapiens
  misc_feature 1..137: note = chr1:7764556-7764693
  misc_feature 1..137: note = hyper
  source 1..137: mol_type = genomic DNA
tccgcccgcaacctccggccgggcccccgccgtccagcgcggctcgggcgcagttccggcgcagtccccgcgccgagcggctccgcgccccgcaccagcctctgcccggctccgggtgacgtcgcatcctccgattg

SEQ ID NO: 69948 - DNA, 139 bp, Homo sapiens
  misc_feature 1..139: note = chr1:7765187-7765326
  misc_feature 1..139: note = hyper
  source 1..139: mol_type = genomic DNA
cgcgcgtttctggcgcgagtgggaagtgtggggatccggcgggcccggtgtgaggggcgtgtttctggggcgagagtggggagtgagtgtgaggagcaagggtgaggggctgcagggaggggtgcgtttggccgaggag

SEQ ID NO: 69949 - DNA, 83 bp, Homo sapiens; identical to SEQ ID NO: 26415
  misc_feature 1..83: note = chr1:77747299-77747382
  misc_feature 1..83: note = hyper
  source 1..83: mol_type = genomic DNA

SEQ ID NO: 69950 - DNA, 1443 bp, Homo sapiens
  misc_feature 1..1443: note = chr1:77747383-77748826
  misc_feature 1..1443: note = hyper
  source 1..1443: mol_type = genomic DNA
aaacggtcgcaggttcctacagaccccgaccctgttcccttggccacctggtccccggtagctgcatccctgggcggcgcacgcagtgaagcgtcgcgctctggcgccggtgccgcaccgaggggtatgactacgaccccttgcgcgtgcccgcccccacctccgcacctcgcgccagcccgcgcagcgtgaccggcagccgccgcagacccggctcggggaggcgcggagcgcggcgcgctgaaccggagaggcgggccggctgctgccttgcgttcgccacgctgtcctccctcctccgctccctgcgccccacccctggcggccgcgctgcctggcagcccgggaagccgcggcacagctgctcggcgcctgcagctccggctcgggggctggaaccgaagcgggggcggcgggagcgcggagaccacagcccccggggagaggcggagggggtccctggcctgggcggagaggctgagctgagtgcgcgtgagaaagagggctgcaccgctgctcggcgcggactctgccagccccagcttcagccccggctcaggtcgccgcagcccgggagcctccccgcttgcgccccaaggcacgcgcggcacagccatgaacaccaacgatgccaaggagtatctggcccggagggaaatccctcagctttttgaggtagggctagagctggccgacgggcggtagcatccggggactgcatctcaggggttcgggttgaggcagccgcgccccgtcccaccttccccacacggggcatgtaatgaaggggcttgtagaagcgcactcgcccgctcccccgagggtagtcgcctttcccgcgggttgccagggtccttgtcagaaggctgggcttagaagcctgcatctcacagatcaagtttcagtcttccagcagggttctgaaagcagcctgctcccatcgcgcccctcggatgtggacacccagggtgggctgcagaccgcggccgggccgcactctctgggggcgagggccaggtcaggtggctgcactgtcgcccagcagcgagtaaagactcgaaactgagggagccagagccctagtcactctgctggtcgagggtcggaacccctgggggaaagaggaaatgtggacgaaggcagcccttcctggagacagcttggaagagagggatgaagatgcaaaaagcaaaacccaacctatcaagtgccacctccccggtgacaggcccccagccttgctctgcgctttcgctgaatgaactcctgagcacgtttttcccgttgcctaggaagggttgggccgcaggtttcgccagtgctcgacaacccacctggagatagcgggtcggggagggagctgcgaggggggcggactcctgttgctcagtcttcagaccgcagcacagcatcatctgcaccgggacccgggaatggggggac

SEQ ID NO: 69951 - DNA, 22 bp, Homo sapiens
  misc_feature 1..22: note = chr1:78122948-78122970
  misc_feature 1..22: note = hypo
  source 1..22: mol_type = genomic DNA
gagccaccgcacccagcctaaa

SEQ ID NO: 69952 - DNA, 158 bp, Homo sapiens
  misc_feature 1..158: note = chr1:78244687-78244845
  misc_feature 1..158: note = hypo
  source 1..158: mol_type = genomic DNA
tgactgaagactgaacgtagaaacagtaccttgggttttgttgttgttattttttcctaacccggccccctattagtttactatgtattagaacctgagagaggtgactactctgccaataaattgccacattcaatattcttcggttgcctaattca

SEQ ID NO: 69953 - DNA, 927 bp, Homo sapiens
  misc_feature 1..927: note = chr1:78354035-78354962
  misc_feature 1..927: note = hyper
  source 1..927: mol_type = genomic DNA
gttagggggtcagctcgcgcacctagggccgggagacagacaaattctggcggaaagttggcagccacggtccccctcccctgcttttctcctcaactctccacccccactccgggtgataacggcggaggtggggggttgggggaactggccttgtgttttggaacagctgcagccggcgctgggcccgcctggaatgcgggaacaggctgcacaccaggacttttatggaaacttgctgctggagacggcggcggcggcggcggcagcggcagccagaggactcccagcggctggagcagaagtgttagcggccagagctcccagacccctacccacagccaggcgggacgcgcacagtccctccacgcggaaagaagtaccttcgccggtcaccggctcctgcagggtgagaagagttgggggaacgtgggctggggggagtggagacggaggtgtcgggtcccctggtgggggcgggggcgggaacggcggctgcagagaggcgctcggggtctgcggcttctggccgtgctccgctgcagctccggagggcgccgggcgccatacagctgtggtccgcgctggccccggcccgggcgaaccctgccttggagccgcatcctgcgggctcggcggggtgcctaccaggggctgccccagggtctgaaagtgtcggccggccttgggcttctggttgcaatgtctttgccctgctcccctgcgccttgtcggctgagtttcgggtgcgttccctactgtagggagggagccctctgtgagcggagtgggtgccgatccctcggctgaacccttggggtccttagggaagttcagtgccgtcccccaccacttgccccagccgcggtctccgtctctgccagcagtgccagttaagaaatcctttctgatcggtctctgtggaag

SEQ ID NO: 69954 - DNA, 40 bp, Homo sapiens
  misc_feature 1..40: note = chr1:7842867-7842907
  misc_feature 1..40: note = hypo
  source 1..40: mol_type = genomic DNA
ttctgtaccaggcagcgaagaggggcggcactctgcactg

SEQ ID NO: 69955 - DNA, 421 bp, Homo sapiens
  misc_feature 1..421: note = chr1:78511435-78511856
  misc_feature 1..421: note = hyper
  source 1..421: mol_type = genomic DNA
gtttgccttctaaggcgtattgttctgtagcgtcggcatcctcaggcgttcacgtaaatagagccattttttacaaggagtagggataaacctggtgataggatgagggactacgtaactttctttctctccagatccatcccgggggaggctgggcgggcgggcggctgctccggtccaggggtggaggtcggggccctgacccgacgcagccaggcggaagcgcggctgccattggaggctgcttttacctgcgcggggcccggggcgcaaagtccgaggcgccggggggaggaggcggcggacggcagcgcaggtgggcccgcgctctcggccctgcaagatgcccctgaagctgcgggggaagaagaaggccaagtccaaggagaccgccgggctggtggagggcgagccgacgggc

SEQ ID NO: 69956 - DNA, 527 bp, Homo sapiens; identical to SEQ ID NO: 26420
  misc_feature 1..527: note = chr1:78511857-78512384
  misc_feature 1..527: note = hyper
  source 1..527: mol_type = genomic DNA

SEQ ID NO: 69957 - DNA, 679 bp, Homo sapiens
  misc_feature 1..679: note = chr1:78956874-78957553
  misc_feature 1..679: note = hyper
  source 1..679: mol_type = genomic DNA
cgtcttctgctcctcagagagcccggctggcggcctgggatgacaaggtaccatccctccagaggctgatcccaatgcatcggcttcgcttatctagacccagatttaatcaactcaccccctgagacacccagccacagcttctgctggctgagcctgacactgagtttggaccagattccccaagctagggagacgcatagagaaagaagggtactcgagctaacccatccccattctgagctgctctgcgggggattgggtagaaagggtctcagaagagggaaatcggcacagattccgcttctcgccgttgcggggttccctgcgggcggcactgcgagttcctcacccgggcacgtcctcactccccgtgcccgggatgagggagaaaacagccctttggcgtttgagcaattgcagaaagtttcagcgagttcgttagtttggagggaatgttgcgaggccaggccgaagggcgggggggatagtaacgggcgaaagtcgaactgtgagtaagacctggagaaggcgaccgtcctgggggtagcctaggcagttccactcgggctgggcgcaggaaaggctggctccggaattcccagcctccgggaaagctagctgctcgggaaacgccaatcgaattagctcagagaagagtggccgtggccttgtgtat

SEQ ID NO: 69958 - DNA, 25 bp, Homo sapiens
  misc_feature 1..25: note = chr1:7908876-7908901
  misc_feature 1..25: note = hypo
  source 1..25: mol_type = genomic DNA
ttctgtacatcgttcaggtcaatgt

SEQ ID NO: 69959 - DNA, 222 bp, Homo sapiens
  misc_feature 1..222: note = chr1:79294494-79294716
  misc_feature 1..222: note = hypo
  source 1..222: mol_type = genomic DNA
tatagaatagaattccggaaggaatggaaattacctcaggtaaagggacagtggatttaagatattataataatgtaaacataaatataaatgactcctcacttttgccattgggttagcgaagcatgaggaagttttcagtgtcaacaacgtgtattaagccagtgtcaaggtggataaatagctcagaagttggagtcaggcttgcggtttaaggcctgg

SEQ ID NO: 69960 - DNA, 36 bp, Homo sapiens
  misc_feature 1..36: note = chr1:79472423-79472459
  misc_feature 1..36: note = hyper
  source 1..36: mol_type = genomic DNA
ggcgcggcagggtcccggatccgtcctccgtgacgc

SEQ ID NO: 69961 - DNA, 465 bp, Homo sapiens
  misc_feature 1..465: note = chr1:8002286-8002751
  misc_feature 1..465: note = hyper
  source 1..465: mol_type = genomic DNA
aggaggaggaggaggcggctgctccaggctgtagatgaacctgcccatcattgagcagctggagaacctcaggaaaaccaggggaactgtggctggggcaggcgtgggctggggaaggacatcgagagtagcttgggccgtcctcctgccccgcggttcccagcacgagctctcccgacagaagaggaaaacgcggcgcgactcggttgggggacagcgctgagatgcggacagatgcggacgttctgccgccgcctgcaggcagagggactcggagatcaggccgcagaagcagaagaaggcagacgggaaggaggaggaaggaaaggagccttgtggcttcgtgtccgaccctcccgcccttggcccgcgtgcctggagccagccccaccgcgcccgcgtttcctcccgcgggacttcccttggccctgggtctgcagcgggtcctgccgagcttccttccct

SEQ ID NO: 69962 - DNA, 30 bp, Homo sapiens
  misc_feature 1..30: note = chr1:8044661-8044691
  misc_feature 1..30: note = hypo
  source 1..30: mol_type = genomic DNA
gtaactgtcattcaccgacatctcccccaa

SEQ ID NO: 69963 - DNA, 77 bp, Homo sapiens
  misc_feature 1..77: note = chr1:80515982-80516059
  misc_feature 1..77: note = hypo
  source 1..77: mol_type = genomic DNA
acaggtgcacaactccgcttagcacaactccgcttattatgtaactacgccacgtgaggcgcattaggtgatcaccc

SEQ ID NO: 69964 - DNA, 309 bp, Homo sapiens
  misc_feature 1..309: note = chr1:8086092-8086401
  misc_feature 1..309: note = hyper
  source 1..309: mol_type = genomic DNA
cgccctccacgcccccgccctcgcgtcggggagccgcctggatcccggcgcccggcgcggggccccctgagggaacggagcgctgcgtggccctccccaccccctcagcgcgccaggccccttaccccggaggagcggcggctgccccgcggcgccctcccgcgcatgtccgtcccggctggctcagcgccgcgggctcaggggcccggacatcgcgcaggcgcctcttgctggctcgcgctcccgctagcactctgcctcgcaccggaccgccgtcgccgcggctgccgccgccgcctctatatatag

SEQ ID NO: 69965 - DNA, 30 bp, Homo sapiens
  misc_feature 1..30: note = chr1:8152862-8152892
  misc_feature 1..30: note = hypo
  source 1..30: mol_type = genomic DNA
tgtgaccgcacgtgccgtctttccaccccg

SEQ ID NO: 69966 - DNA, 35 bp, Homo sapiens; identical to SEQ ID NO: 26422
  misc_feature 1..35: note = chr1:82266147-82266182
  misc_feature 1..35: note = hyper
  source 1..35: mol_type = genomic DNA

SEQ ID NO: 69967 - DNA, 89 bp, Homo sapiens
  misc_feature 1..89: note = chr1:82266766-82266855
  misc_feature 1..89: note = hyper
  source 1..89: mol_type = genomic DNA
ttcgctcctcctccccgccgcttgggcgcacagccgcagcagctgctcaaatggagtggaaaacggccattgggcgacaatgagttata

SEQ ID NO: 69968 - DNA, 44 bp, Homo sapiens
  misc_feature 1..44: note = chr1:82267616-82267660
  misc_feature 1..44: note = hyper
  source 1..44: mol_type = genomic DNA
tctctcgaagagcggcgtgtgggaaactgcgggaaaatgttgac

SEQ ID NO: 69969 - DNA, 491 bp, Homo sapiens
  misc_feature 1..491: note = chr1:82267888-82268379
  misc_feature 1..491: note = hyper
  source 1..491: mol_type = genomic DNA
ccctcggggcgcgctcgcagacggaggtaagagccgcaggagcgaacaatgtgcctctgtgcccagcttcggagacctgtttgctttgcgcctccagtccgggggtggatgctggaggcgcagggagccgcgggttaatggggctcggctgttgctgttcggctggcccagggggagacccgcgctcgctcgggctgctcgctccctccccccaatctcctcttggaaatcgatccgcagaactctcagtccggtccagccggcttctccttttctcgtggagccattgtaacgctctccaggcatcagtctagttgccgggggcgctggcaagggggttaggatgaggctcccgtagccatgcattttttaatttcataaaagcttggggtcgcaaggttccgcccgtcctttcactgggggcctggggaggaggagtgtgaagcgcgtcctcggcggagcttatttgctccgggcgctggggcccgggg

SEQ ID NO: 69970 - DNA, 271 bp, Homo sapiens
  misc_feature 1..271: note = chr1:82268689-82268960
  misc_feature 1..271: note = hyper
  source 1..271: mol_type = genomic DNA
gggcagagagcctcccggagccgcagtgagagggcagcagcgggccgcgttgggcctgcgggagaagttacggagtgtatgctgctggagtggctgtggggcagggagcctcgggagcttggtttgtgggatgggggtgccactggggagtggcgacgagagaaaggcgtgggaggagcgcgagggaaggggagacccccgcgctgcccgagcgtgggctccttgattggctggggcgaccctcaggcagagggggcgagggcgagccaaa

SEQ ID NO: 69971 - DNA, 34 bp, Homo sapiens
  misc_feature 1..34: note = chr1:82269276-82269310
  misc_feature 1..34: note = hyper
  source 1..34: mol_type = genomic DNA
tgttgtctcagattccgaccgagggaatgttttc

SEQ ID NO: 69972 - DNA, 30 bp, Homo sapiens; identical to SEQ ID NO: 9
  misc_feature 1..30: note = chr1:8277113-8277143
  misc_feature 1..30: note = hyper
  source 1..30: mol_type = genomic DNA

SEQ ID NO: 69973 - DNA, 60 bp, Homo sapiens; identical to SEQ ID NO: 26045
  misc_feature 1..60: note = chr1:8277775-8277835
  misc_feature 1..60: note = hyper
  source 1..60: mol_type = genomic DNA

SEQ ID NO: 69974 - DNA, 30 bp, Homo sapiens
  misc_feature 1..30: note = chr1:834881-834911
  misc_feature 1..30: note = hypo
  source 1..30: mol_type = genomic DNA
cgtggcatggagccccgtggcagatatggg

SEQ ID NO: 69975 - DNA, 315 bp, Homo sapiens
  misc_feature 1..315: note = chr1:840707-841022
  misc_feature 1..315: note = hyper
  source 1..315: mol_type = genomic DNA
ggcgttggaccccctcgcgcattgtcggggcgggtgcagccgcggtgcaaaaggaccttcctcagaaagttgagcacgaagttcccacaggcccggaagttcccctcccgggcgctccccagagagctgaagactgggcgcgtgccggcggcaaatgttcacagcaaagggcggcccagtgcgcagctggaacatcagccccaggcggtcgctgcgacagggacgagcctgggaaacgtgaaaatgtccagaacagggaatccacagataaagaaaagacatcgtggttgccagagctcgcgggagggggcaaca

SEQ ID NO: 69976 - DNA, 30 bp, Homo sapiens; identical to SEQ ID NO: 26428
  misc_feature 1..30: note = chr1:84158496-84158526
  misc_feature 1..30: note = hyper
  source 1..30: mol_type = genomic DNA

SEQ ID NO: 69977 - DNA, 465 bp, Homo sapiens
  misc_feature 1..465: note = chr1:84464413-84464878
  misc_feature 1..465: note = hyper
  source 1..465: mol_type = genomic DNA
aaacctctcagggcacgaatggtgctgaatcatttgcacgaacgcagcagctccccgttccgcggctcccagcggggacggtgtccccagagcagtgacagtccggggatgggggcccggaaagagggccagggcggagcctttggggacgtggggacatggaagggggtcgggggaggatggcggcagcaggtactcacccgggtgaggaaagcccagcccgggtcctcgcgtccccgctgcaagcggtcccccaggtgctcccgcgcctcgcagcttccccgtgggcggccgccccgactcggcagcctgcactggtggtccggtgctctcctccgcccgcccaccgcccgtggcagccacggctcgggactccggtgctcgacgcggagtgcctggaacagctgtcgctgcccaagcgggtggcggctaccgacgggccagaccattcgcctgctgcggccg

SEQ ID NO: 69978 - DNA, 35 bp, Homo sapiens
  misc_feature 1..35: note = chr1:84543374-84543409
  misc_feature 1..35: note = hyper
  source 1..35: mol_type = genomic DNA
gcaaggaaaaccacccgagccgctgaacagtattc

SEQ ID NO: 69979 - DNA, 293 bp, Homo sapiens
  misc_feature 1..293: note = chr1:84544218-84544511
  misc_feature 1..293: note = hyper
  source 1..293: mol_type = genomic DNA
ccgaccccccagctccgcgttgagagctgaacgcgaagggccggatgtggggatcctgggaagagcgttccctgggattccctttctcactctagcgaggaggacttgcacacgttctggaacacttccccaaatatggtccgaggaaagaagtccctagtgccatcccacccctgctttcccccctcgccgactctttgggagctacaggtagtgctgtgggtaaggttggctcttctccctccatcacttgggtccgacccaaccttatcacaaggcgggggctgctagtc

SEQ ID NO: 69980 - DNA, 38 bp, Homo sapiens
  misc_feature 1..38: note = chr1:84944530-84944568
  misc_feature 1..38: note = hypo
  source 1..38: mol_type = genomic DNA
gcctgggcattaaagcaaggctccgtctcaaaaagatg

SEQ ID NO: 69981 - DNA, 282 bp, Homo sapiens
  misc_feature 1..282: note = chr1:85358311-85358593
  misc_feature 1..282: note = hyper
  source 1..282: mol_type = genomic DNA
tttcctaatcaccatcgatggcaatgagactgagtttggaaagaaccacgtgtgcaaaggcagacgcaacccgtgcggcgctctcctggcctctgcgcccagcccgccagccctcagcagcggacgcaacgccgattttgcatctagattgctttttgctcctagcggggaaaaaggtgggaaaagagcaagttgtgccatacacccgccgggagagtcttgtcccggggtttggagtgggtctggagcccaggcttgcacgccaggcaaccccgaaaagcc

SEQ ID NO: 69982 - DNA, 218 bp, Homo sapiens; identical to SEQ ID NO: 26431
  misc_feature 1..218: note = chr1:85358751-85358969
  misc_feature 1..218: note = hyper
  source 1..218: mol_type = genomic DNA

SEQ ID NO: 69983 - DNA, 178 bp, Homo sapiens
  misc_feature 1..178: note = chr1:85359170-85359348
  misc_feature 1..178: note = hyper
  source 1..178: mol_type = genomic DNA
agctccgtattagaacgcagtccctctgcccctctgtcctcagagatttgtttgaagtggctgcgggaagtgcagcccacacccaccacccccgtgggaggcaggctctactccaagcccgacctaacgctggaaacctcaaccccaaagctacccgagggtgcggacagcccccaga

SEQ ID NO: 69984 - DNA, 256 bp, Homo sapiens
  misc_feature 1..256: note = chr1:85463282-85463538
  misc_feature 1..256: note = hyper
  source 1..256: mol_type = genomic DNA
cacccaagtgcccaacgctgcggtacggcccgctttggctcggggtgtctgccggagaagcgccttacagagggacccgggcggtgggccctgcggcaaagtggcccacgcaccctccacaccgctcccgggcggccgcacctggcactcccggccctctggggttcctgcctttttcgggggggtggtggtgagaccgggtctcactctgtcgcctgacctgcgatcactgctgactgcagtcttgaactcctgg

SEQ ID NO: 69985 - DNA, 16 bp, Homo sapiens
  misc_feature 1..16: note = chr1:85463598-85463614
  misc_feature 1..16: note = hyper
  source 1..16: mol_type = genomic DNA
gcgcctggccccttct

SEQ ID NO: 69986 - DNA, 78 bp, Homo sapiens
  misc_feature 1..78: note = chr1:85463869-85463947
  misc_feature 1..78: note = hyper
  source 1..78: mol_type = genomic DNA
agatgttagaaagtgcgaccggcgcgcaaggaataggaaaagcgagttgccctgcgcccgcgtcgggatgaaaggcag

SEQ ID NO: 69987 - DNA, 37 bp, Homo sapiens
  misc_feature 1..37: note = chr1:85513662-85513699
  misc_feature 1..37: note = hyper
  source 1..37: mol_type = genomic DNA
ttgaaaggggccagccgagccgcgtcaaggccatctg

SEQ ID NO: 69988 - DNA, 30 bp, Homo sapiens; identical to SEQ ID NO: 26435
  misc_feature 1..30: note = chr1:85527927-85527957
  misc_feature 1..30: note = hyper
  source 1..30: mol_type = genomic DNA

SEQ ID NO: 69989 - DNA, 62 bp, Homo sapiens
  misc_feature 1..62: note = chr1:85774021-85774083
  misc_feature 1..62: note = hyper
  source 1..62: mol_type = genomic DNA
tccgcgctcaaaggccggctgagaaaacgcgagtgactacccgagggcgctgttactccaca

SEQ ID NO: 69990 - DNA, 49 bp, Homo sapiens
  misc_feature 1..49: note = chr1:860840-860889
  misc_feature 1..49: note = hyper
  source 1..49: mol_type = genomic DNA
gggacacagggggtgcggtgagcgccaggcgccgcggggagttaaaaag

SEQ ID NO: 69991 - DNA, 224 bp, Homo sapiens
  misc_feature 1..224: note = chr1:865391-865615
  misc_feature 1..224: note = hypo
  source 1..224: mol_type = genomic DNA
gccgtgcttggggctcggcctggggtgcgagaccagggcagacccccgggagatggaacggcccggtccagccccaccttcctctcctcctgccccaccttcctctcctcctgccccaccttcctctcctcctgccccaccagaaccgggggcggctggcagacaagaggacagtcgccctgcctgccgcccggaacctgaagaaggagcgaactcccagcttc

SEQ ID NO: 69992 - DNA, 682 bp, Homo sapiens
  misc_feature 1..682: note = chr1:86621263-86621945
  misc_feature 1..682: note = hyper
  source 1..682: mol_type = genomic DNA
gggaggtggggtgcccgtcaggacccgcccaaaacctccgcaggaggggcaggcccgcccccgtgtcctgctcccctccccagtccccgccgcgagtgccacttccccagtgacagggcaatgatcagggcgcagcctcggctcggatgggcaacgtttgttggccttctaaccagaggggattgcctctgagcccgtgggtaaaacaaccccccgacgcccgaggttctgcagccacccccttccccccgctggcgacccttcctcacgcctgagtccagtggtccaggctgcgcacactgaccctgggggacctctagcgtcacagcaatcgccaggctggacgccctgagaagcacctcggggaagcaggacctcgacagggccctgcgggaggagaaggggaggagggcgcgagggcggcgggagctggagccagagagatcgtcggagcccagctctggagcttagggagccgctgccctggacctcgggactcgcgccagcgagcttttcctctcgagccaaaagatcgctttagcataaactgtctgagatctgctggcacgaggcatcctttcaaacacggtattttgcaagctgagaagacaaggggaagataccgcgggtactcggccgctcctaaagccaaaaagtgccaaggagccggacttcagatctc

SEQ ID NO: 69993 - DNA, 362 bp, Homo sapiens
  misc_feature 1..362: note = chr1:86622190-86622552
  misc_feature 1..362: note = hyper
  source 1..362: mol_type = genomic DNA
accatgcttcaaacccgcaacaagaaaaaaaggaggggagggggtgaagtcgggaggaggtaggaaatagcacccgaaggggaggacaggcttcctagctctctggctcggtaacgaacgagcccagggttgcgctccccggggagggcgggcgaggaggtaaacctcactgggaggcctcggggcgccggcggcagcgggagccgggctgctagtgcagcactcaagttcacttgcggttcaaaggcgactctgtgactccagtggagtcctctgctttgggcctgggaggagaaaggggtgggggtagggaaggagatgaagtgggggaggaagtccttggaaacagcccgcgcccgaac

SEQ ID NO: 69994 - DNA, 221 bp, Homo sapiens
  misc_feature 1..221: note = chr1:86860814-86861035
  misc_feature 1..221: note = hypo
  source 1..221: mol_type = genomic DNA
cgcgcccggcccggtttgtttctttaaccttaactcagttgcacttaaaactccaagaacctcattcattcaaaaacacttgaaaccgtactatgcgttgcgtgatgaggaaactgtcttcgaaatagattttatccccaacagcagccccagtatggttattctcagtaaacaacaagcaccaccactcactaaccacctacattcggtgccaccttaat

SEQ ID NO: 69995 - DNA, 30 bp, Homo sapiens
  misc_feature 1..30: note = chr1:87229260-87229290
  misc_feature 1..30: note = hypo
  source 1..30: mol_type = genomic DNA
atatactaagtattccgtagtgaactcacg

SEQ ID NO: 69996 - DNA, 150 bp, Homo sapiens
  misc_feature 1..150: note = chr1:8742771-8742921
  misc_feature 1..150: note = hypo
  source 1..150: mol_type = genomic DNA
tttaacaagaaatgccggctctagtactataatgcagaataaaaattaggcaagtgatgactcatacttcacaggtatgccagcctcaatcaggttttcaacccagtctttattagaaatgacaagtgattctttcgcatgccttaattt

SEQ ID NO: 69997 - DNA, 30 bp, Homo sapiens
  misc_feature 1..30: note = chr1:87617400-87617430
  misc_feature 1..30: note = hyper
  source 1..30: mol_type = genomic DNA
ggggcagggaggatgcggggacccccagaa

SEQ ID NO: 69998 - DNA, 174 bp, Homo sapiens
  misc_feature 1..174: note = chr1:87617684-87617858
  misc_feature 1..174: note = hyper
  source 1..174: mol_type = genomic DNA
cctcagggcggtgctcgcctctgcccggcagcgagagagggacccggtgcgggcccgatgacagggtcgaccgctgggggtcaggataagcttgcagagtggccccgccgccgtcctgaactttctcgggaggggaaggcggctgtgtacagaacagcacgccctgggaagcaa

SEQ ID NO: 69999 - DNA, 30 bp, Homo sapiens
  misc_feature 1..30: note = chr1:885425-885455
  misc_feature 1..30: note = hypo
  source 1..30: mol_type = genomic DNA
tgagtggcatgtgcacgtgcaaagatgcat

SEQ ID NO: 70000 - DNA, 187 bp, Homo sapiens
  misc_feature 1..187: note = chr1:88928315-88928502
  misc_feature 1..187: note = hyper
  source 1..187: mol_type = genomic DNA
gactgcagcaggcggcggcgctgccctttctctgcgtgtctctgggcgcgtcctgcccgctccccgcgccgcccgcgctcctctcgccgcagctgccgctggggctgccgcgggcgccgctcagccggagcgcgcctccgcccggcccgcccgcgccccgcagcagcgcgctcgctccttaaccact

SEQ ID NO: 70001 - DNA, 53 bp, Homo sapiens
  misc_feature 1..53: note = chr1:895125-895178
  misc_feature 1..53: note = hyper
  source 1..53: mol_type = genomic DNA
accgggccagcgccacgaacaccacgcagggcgctccccgtccatggccctct

SEQ ID NO: 70002 - DNA, 30 bp, Homo sapiens
  misc_feature 1..30: note = chr1:89664391-89664421
  misc_feature 1..30: note = hyper
  source 1..30: mol_type = genomic DNA
cccgtgtgcagtctgcgcttgggaatttgt

SEQ ID NO: 70003 - DNA, 48 bp, Homo sapiens; identical to SEQ ID NO: 38688
  misc_feature 1..48: note = chr1:898728-898776
  misc_feature 1..48: note = hypo
  source 1..48: mol_type = genomic DNA

SEQ ID NO: 70004 - DNA, 62 bp, Homo sapiens
  misc_feature 1..62: note = chr1:90292117-90292179
  misc_feature 1..62: note = hypo
  source 1..62: mol_type = genomic DNA
aattttatagttgagcgtatccaggcacagggaggtgatgtgcttagcgtaagtttacacat

SEQ ID NO: 70005 - DNA, 55 bp, Homo sapiens
  misc_feature 1..55: note = chr1:90309435-90309490
  misc_feature 1..55: note = hyper
  source 1..55: mol_type = genomic DNA
gcagcttcacttgcccgccccccaccactggcttctcacccggggtctctgccaa

SEQ ID NO: 70006 - DNA, 124 bp, Homo sapiens
  misc_feature 1..124: note = chr1:90847612-90847736
  misc_feature 1..124: note = hypo
  source 1..124: mol_type = genomic DNA
atattcataatttagcgtacacctgaaaaatatgctgtgaaatatcggggggatcctttaatactggtgttccatttacagactgtcacatttataatgcgtctttaatcgtctagggtctgct

SEQ ID NO: 70007 - DNA, 30 bp, Homo sapiens
  misc_feature 1..30: note = chr1:908640-908670
  misc_feature 1..30: note = hypo
  source 1..30: mol_type = genomic DNA
cccgggagcaaggcccgggcagagggccgc

SEQ ID NO: 70008 - DNA, 748 bp, Homo sapiens
  misc_feature 1..748: note = chr1:91171967-91172715
  misc_feature 1..748: note = hyper
  source 1..748: mol_type = genomic DNA
ccctccagagccccccgagatgtgagagaagggccctgctctgtaggccatcccaagtaccgtccttgaaagcgtctggattcccgtcccaggcctatagagcccctgtcctgatgcgcccatgcctccctgaagcgctgtctgtacccgggcgcaggaactcgtggcggccgggcggtcctgaaggtggaggagcgcggggcccagctggggtacgcgccgagcaagaacccgcacggagccggcgcgccgcggctgggcttcaaggccgccgcgccaaatccctggctgcgacgtgtatgcgaatcgttaggaggaggcgggaggacagccacactgagggcctcttcactaaagaatgaagtctgacggcgggaatgggggtgggtgggggcgggaatccatcagctccacaaagtgacagggcccttttatcgtaaatcaagttcaatctcgctctcgcgaaggtcctcttttttcggcggagctcccgcaggggcgactcgctgtcccagaccagatagtagcaagagctgggagagacccaaatctgcagggagagggcgcgggctgagagccgcggtggggagcagggcctgggcccagcgcgacctgcagggctgctgcctcgggagcgcttctgctctgcctgcggtggccgaggcggcggctcgccgagcgcgctccgagctgtgcgaacagaggaagtatgtgccagttagaagggttccgccggccacctcgtcgc

SEQ ID NO: 70009 - DNA, 161 bp, Homo sapiens
  misc_feature 1..161: note = chr1:91172920-91173081
  misc_feature 1..161: note = hyper
  source 1..161: mol_type = genomic DNA
atcaggaaacgctgccggggaggttgctttgtaatcactttgcttacctccccccgggcgccgccgacccttcctagacgcctccgctgcggccgcctaggcttttacccggaacccgccagcccaggttacctagctccacccggcgccctgggagctgt

SEQ ID NO: 70010 - DNA, 208 bp, Homo sapiens
  misc_feature 1..208: note = chr1:91176389-91176597
  misc_feature 1..208: note = hyper
  source 1..208: mol_type = genomic DNA
aggaactccaggcatcgcagcacaacgaactcactaggacaagcggctccgcatggggctgggggctggacgcccgccgccagggactgagaaggcaacgatcaaagccgccacaagggtttgttagctggccctctccaagtcccccgggggcgtcctaattgctcgtcccacagcctcccgctcacaggctgtccgacctcgccgg

SEQ ID NO: 70011 - DNA, 262 bp, Homo sapiens; identical to SEQ ID NO: 26444
  misc_feature 1..262: note = chr1:91176691-91176953
  misc_feature 1..262: note = hyper
  source 1..262: mol_type = genomic DNA

SEQ ID NO: 70012 - DNA, 112 bp, Homo sapiens
  misc_feature 1..112: note = chr1:91177380-91177492
  misc_feature 1..112: note = hyper
  source 1..112: mol_type = genomic DNA
tttctctggggcagacggaatgtcctcggcaacgccctttgcctcagcacttgaggctgtccatatatagttcactctgcctgtgctgtttccgctccgtgcccttctttct

SEQ ID NO: 70013 - DNA, 417 bp, Homo sapiens; identical to SEQ ID NO: 69
  misc_feature 1..417: note = chr1:91177840-91178257
  misc_feature 1..417: note = hyper
  source 1..417: mol_type = genomic DNA

SEQ ID NO: 70014 - DNA, 90 bp, Homo sapiens
  misc_feature 1..90: note = chr1:91178931-91179021
  misc_feature 1..90: note = hyper
  source 1..90: mol_type = genomic DNA
gtctcctccctcccccgctgcacaccctgctaggaagaagagagcgggcgtttgctcaaataccttatgaaggaacgcagggctggtggg

SEQ ID NO: 70015 - DNA, 64 bp, Homo sapiens
  misc_feature 1..64: note = chr1:91179460-91179524
  misc_feature 1..64: note = hyper
  source 1..64: mol_type = genomic DNA
ttccttctccctgtccggatgcttggccagccgccgattctccaggctgcggctgccaaaccta

SEQ ID NO: 70016 - DNA, 231 bp, Homo sapiens
  misc_feature 1..231: note = chr1:91180075-91180306
  misc_feature 1..231: note = hyper
  source 1..231: mol_type = genomic DNA
tgcctcccttacctgcggttctggtaccaggtcttgacttgggtgtcagtgaggttgagcgctgcagccaggtccatgcgatcctgcacgctcaggtacttctgccgctcaaagctacgctccagttgattgagctggtggtcggaaaaagctgtccttgcttttcgaggcttcttggctctcacagggggactctcacggctactcgtaatctcccggtctccttcctcc

SEQ ID NO: 70017 - DNA, 1063 bp, Homo sapiens
  misc_feature 1..1063: note = chr1:91181807-91182870
  misc_feature 1..1063: note = hyper
  source 1..1063: mol_type = genomic DNA
catcccttttatcaacgaaaagtatttcctgtcggatgccctccgccgcccctcaacccccagtagattaaaattaaataaaacaaaggaaggagctggatggccgtgaaggttgtggggtagaacaataaacagaacttcgaggagtccccacatcgcacgcccaggcctcccttcagctgcagtcttttgaccgtcgcccagtcgcccgagaagctcctggaatcgctccccagcagagatctgctgaaggctgaaggggagattgggaaccaggaggacaagctagacggccgagagcgccgggtggcgggactcaccgtggcatttgatgtcgctctgggaatcctcccgcttgtcgagtttggtcttgctgtcctcctgctcgagctttggcctgaagctctcgtgcactgcgttgctctcctgcttcggggtgtggtggggagaggatacgctggtgctgtagggtgcacatgccgccagaggtttgctgtcgcccaagatgtccttaattaaaaaagaagacgtggaagtcctgggggccgaggcggccgagcccagctgctgggggggcggcggcggcggctgctgtggcggcagcggctgctgctgttggggcaaaggctgcaaactttgcgtcggggccgcggccggcggcggcggctgctggctgtggtggaggtggtgatgatgctgggtcgcgtctgctaccagatgcggctccgggggctccatggtgactgagataggagaagaaggcgccgtccctacggtatcaatctccgaacagggagatggggtggcctgactcctaaaatccgcggtcctggcctcaccgagcgggcggaaatctccattcatcatgcctgggctgcctgaactggcactggacaaaatcgtgtctattccaaaactcgacccgctggccccttccattgtcattgctacatgaggtccacgccactccgccgttcagcagccgccccgaaccagcgaagaaagctatcgatcgtaaaacaaaataaacaccaaacaatgttgccgccgcttaaaaaaaaaa

SEQ ID NO: 70018 - DNA, 109 bp, Homo sapiens
  misc_feature 1..109: note = chr1:91183087-91183196
  misc_feature 1..109: note = hyper
  source 1..109: mol_type = genomic DNA
aggcgaaggcgaaggcgaaggcgcaggcgaaggcgaaggcgcaggcggcgggaagctacgccaaagccgccgccgccgccgctgccggggtctgcccacagcctggcac

SEQ ID NO: 70019 - DNA, 269 bp, Homo sapiens
  misc_feature 1..269: note = chr1:91183250-91183519
  misc_feature 1..269: note = hyper
  source 1..269: mol_type = genomic DNA
gggcggccgcgcgccctcggaactcccccgcggctcccgaggtggcagccgcgcgccactcggcagccccgtagccgagtttctgaactttcttggaaagttgcggggcagacacggccgcagcggttgcggcaacccgaggaggaggaggaagaggaggacgacgagaaggagcaggcacagaaggaggaagcggcggagacgcgatgccgggcgactccggccgctgccgggcgcgttcgcttgtaatccggctgctggcgggcggc

SEQ ID NO: 70020 - DNA, 91 bp, Homo sapiens; identical to SEQ ID NO: 26451
  misc_feature 1..91: note = chr1:91183520-91183611
  misc_feature 1..91: note = hyper
  source 1..91: mol_type = genomic DNA

SEQ ID NO: 70021 - DNA, 218 bp, Homo sapiens
  misc_feature 1..218: note = chr1:91183775-91183993
  misc_feature 1..218: note = hyper
  source 1..218: mol_type = genomic DNA
cgagtccagtggtcccggtgtccacaatcacgagtgcgaggcaaagggagagggaggaagagatcagagggagaccagagaaagggaaccaaaggggagaaagaaaaaaaaaagtagcaaggattcgcccgttttcttaagtcagaagagagagagaagaggacgggaagggacttacctttaggctccagcgcggcggccctcgcagcctccccaaa

SEQ ID NO: 70022 - DNA, 219 bp, Homo sapiens
  misc_feature 1..219: note = chr1:91184194-91184413
  misc_feature 1..219: note = hyper
  source 1..219: mol_type = genomic DNA
tccgcgtccaccaggcgctctcggggaggacgaggcctgaggctccaagctggggaaccagcctggtctccagctggaaaaaatgcctggccagacgctttctcccgaacgggggagctaatgcccgaggcgttctctggtggcgagggcagccacggttcactgcggtgtcgggcgggcgcggggctcaggacccatagcggctggtctgcagcccgc

SEQ ID NO: 70023 - DNA, 651 bp, Homo sapiens
  misc_feature 1..651: note = chr1:91184414-91185065
  misc_feature 1..651: note = hyper
  source 1..651: mol_type = genomic DNA
cccctgccgcgccccgcggcagtccgtccacctctgtcccccggcccctttcggcgagcgctcatttggaaaggaaacagtcactgcggatccacttgggacccggagcatgactgtaacgcctcgttggagtgtatcaacttgcattattttctctaggacgtctccaacctgtctcatgttgaatgtcagagtaatgggaagtgccagtgacaagacggcgtattactcctgattaagtgccgtgtcaacctaattagcagagtaattataaggtgctaatgaatgattcaaagttctttgagttacattttactccaaattaccattttaagaaccctatgaatctgcgaggcgggcatcgcttccgtggctaggtctggaatgatgttcgagtggcctttaatgtctccaaaggctgggccgaaatctggagtttagttgcagttctggaggtcactttctgggccacagcttttatctgttgaggacgaagggaggggtgtcagggaggcaaatgacctcctgggacaagctcttgcctttcggtcggaactgcttctgtgtgagccctgggtccggaagcgggtagctgggcgactcatcctgcctgcgttttcctagggaaatcggtgtgtttgacccagaaaa

SEQ ID NO: 70024 - DNA, 184 bp, Homo sapiens
  misc_feature 1..184: note = chr1:91185125-91185309
  misc_feature 1..184: note = hyper
  source 1..184: mol_type = genomic DNA
cgtctcagtggcatttttcctagggctgttccgagagaacagcggggattgaagggacggaggcaaggagatgcacaatccgggcagctctcgctcttctcggaaggcgaagggagtttggcggagaagacggggttggtgagccgaggcggggactccggacgtgctccatcccggcaggggc

SEQ ID NO: 70025 - DNA, 649 bp, Homo sapiens
  misc_feature 1..649: note = chr1:91185347-91185996
  misc_feature 1..649: note = hyper
  source 1..649: mol_type = genomic DNA
cgggtgactgggccccgccgggtggggtcgggccactgtaggctggagcggggttggatcaaatgcctttggcgcgggaactgagtgctggcccgggagaccctccggagagctcgcgggctcggcctcggcctcggcctcggccttcggccgcggttaccgaaacacagacggtagacttgtggaggtggcttatccgaggccgcagggcccgacgctgcacagcttcgcagcctaaatatcctgcgcctctgtcacagttgaccgctgtggggaggacaggaagggctctagggctgcccgagactgcaggctgaccctacctactctaccctcttcaaatatcgattagggttcttcccattccaacatcatcatccaccaacttcccgaatatggtgcgttttctcctagccctgggaggttccaactcgaactcccctcgctgcatattcagggtgggaagtagggagggggagaaaacaaatttaaaatccagaactgacggcactgcacaaatcaattattctcgaccttgataaataattcatttaagcctgtttttgttttgttccgacgcctaaaatgactcaagagctcaaaaggctgatcgcacagcttgtgttgggcggttcgacagggtcttttt

SEQ ID NO: 70026 - DNA, 1966 bp, Homo sapiens
  misc_feature 1..1966: note = chr1:91188983-91190949
  misc_feature 1..1966: note = hyper
  source 1..1966: mol_type = genomic DNA
accaaaacctcagagcgctgagcaaagatgccaatcagagaaagagaaattcatttgcgatgttaattaacaagcggctaattaaaacggcactttgagtgctaatcaatcgccttattaagttacagccatcactggaacaaattgaaacctccccgccccgttttctgcctttggtgcaggcggggccgcgttcccagataccgtgagaggccttggggcgcggaggttgggggcagcctcggtcagctttctcagtctctcccaggtctacagaatacgccactggacaagtgcctaagcagcgacttctggtccagacacaccgcccggggagtaagtagttgcgtcgaagaacaactcattcagcagcagttaacaccgacgtttcctcctagaaagagctcccgcaaagcggggggatgtgacctgtgggcccccagcaggggtaggaggcagttcagcccgagagggggcgctctagggcctggatcctgcatccctatttcctggaacacacccaacgcctcattctgaaaaccctgcttaggccctggccctggtgccgctcagcaaccaggaaagagctggacctgccttcaggcagcaagaacaggactgccagcctcctgtggctctgtctcccgaggctccatgagaaggggatgggggtgcaagaagggaagagtgaggtggtgtgctgggcgtcggggacgaggacgcacgccagccaagacgtgcctcccacccagcccacgcgcgcttccccacccccctggccctccaaaatcggtaagagaattaagatttcgaatccctattttgaggagccttccgcatttcctaattgttaaattcctgcttttcaccaaattcccgggggagaaacatttggcaataagaagggactgtgaatttaaatgctaattgagtgggtcctttttccgcagctccacctgcctggcagcctctgttgaaaccaaacacactcggagcgcccagtgcaacattcttggggtgccgagtagaagcgcagtaaagagagaccctagcggactcctgtctggtttgctttttaccgactcttacagaaaaaaagagaatgccattggaagaagctcttttgcgtggtgggcgatgtgtgggtgggggacttgtggcatggcccacggtgttgtttctgtgcctgcgatgacacacgtatgtcttgagctgtgggctcgccttcctggaggtgcgcccgaccgcatctgctggtgggtctgagcgtgcttggggtgtcccaggagaactgagagaacggctcccacgtgcaaagttccaaagcattaatattttcatcatattatcattattcaatataataatatttgttcggttagcggcactaattaggccacattaaaaccgtagtgtgtccctaatggtgcgtaatgtgctcacactcacatttttctctctgaggatgggcggctgcaggctggtaggggaggagagacaggcaagcggcgggctggattagggcgtgacgccccccaccacgcacacaaacatacacagcccactggatgtctgccgggtgggagccgcaatctccgcgcggtcgatggggccctccgctgcgcactcggccctgcgccgagcaccctgcagcctcctcccgcgacacggcgctttgaactcggcggattgattttgcttcccttcccccttttgtgtgtgtttgcgttcaattggttaggtttttaagatttgggagggctggtgtgaaagaattaaaatactcttaactggagcccctccgccgagaactggaggtcccgcctcctagttcggcgctttcaggaccctcttcccagagggaatttctttcagaaattccagggtgggcttgtaaaagacgcttccgcagagcaggtcccgtcagggtctttttcctgttcctggtgccagcggtcggcccggg

SEQ ID NO: 70027 - DNA, 17 bp, Homo sapiens
  misc_feature 1..17: note = chr1:91190984-91191001
  misc_feature 1..17: note = hyper
  source 1..17: mol_type = genomic DNA
cggagagtgcccctccc

SEQ ID NO: 70028 - DNA, 233 bp, Homo sapiens; identical to SEQ ID NO: 1767
  misc_feature 1..233: note = chr1:91191002-91191235
  misc_feature 1..233: note = hyper
  source 1..233: mol_type = genomic DNA

SEQ ID NO: 70029 - DNA, 1288 bp, Homo sapiens
  misc_feature 1..1288: note = chr1:91191289-91192577
  misc_feature 1..1288: note = hyper
  source 1..1288: mol_type = genomic DNA
cgcggccggacagagcccatcagctacaacgcggaaggcctctgcacccccttgggggcgggaggaaagtactgccagtcctgcctgggggccgagggtaacaagcaccgagcctctcgctccacgcagggccagctgcccagctcagcgaagctcttgtgatctggtgcgtgtctctcgctcttccctccccatcaaagaagtaaactttctacctactccccctaatccgatcgtttagagctgctgttttccttttgtcagattcctcctccccgatcagtctgagtacacgatcagaactgctcagagagcaggaagcacattgatttcagcttgttctgtccacagacaggccctgacaaggttgttagaacagccggagaggtctatacaatcacttaattaccaaaactgtcagtcaggcgggacgcggatccgcgtcccgggctgcgctaggcattccagcactgggccgcgcgcgtgattgatcggtgctgatagcaccgcaaaataattacggcgaattttctgatgtgtgattttatcccaagttcatgcttcagagaggtaatcggagaatgagaagggtcagtgccatttcggattacctggaatctgcgagaaagggtaaaatgggggaaggagctccgaggaaaacgggagagatgggggtgcagagagagagggaagaagaaagcgagttatggattgctggagggactgcaagcaattcgtcaaactgtgcaagtgatttccttcagagccagcatatggcagattgattttgtccaacgtcggttttagccacatttaaaatgatccagcggttattactgcgattggcttaggaactgacaggcagttttaggcgcaaggagtatagatcctgtttaccggagatgtgttcgtaactgctgtcaaatacagttaagtaaatatcattagcgaagagctctgttaagagaaatgccaatccaataaatatgcttttcctccccgccctccgcatggctgcctgcgcttcctccagaggttctccttcctgctcctttgctgcttgggtcagacgtcccaggcatggtgctgactcccgccaccttggagccccgagctgagcctcgggcagaagatgacaggccagccgtggggcaaggaggccgcggaaacgcggaacggcttcggggagacggaagcgcccaatgagattcaccctgcagcccgggtccagcccaccttcctcggagattgccgcggccctcgaacccgggcctaggtcttcatgtcc

SEQ ID NO: 70030 - DNA, 136 bp, Homo sapiens; identical to SEQ ID NO: 26466
  misc_feature 1..136: note = chr1:91192681-91192817
  misc_feature 1..136: note = hyper
  source 1..136: mol_type = genomic DNA

SEQ ID NO: 70031 - DNA, 952 bp, Homo sapiens
  misc_feature 1..952: note = chr1:91194539-91195491
  misc_feature 1..952: note = hyper
  source 1..952: mol_type = genomic DNA
aaatgcttaaagttgcggatgtaatttcacatgcgtccgggttgatgtgatatgaccgtatcagggaaacaaagctaagtgcagtcaggatctgttagtacagtggcttttgatggaacagctgaggcacacatcgcccgtggcatggactccggggccgaacgctcacgaccaagacttttgcccttttgaaatgaaatagaaataggggagctgcaggaaaaccgaatcgcgcttagggtcaggagcaagacaggagctttcagcgaagatctgaacattcagaactggaacgggtaattagcagatagccaggaaaaaataaataaataaataaaaaagcctggatggacctctgtaaacaatcattaagaaaaataaaaatgaaccttcttattagcctgccttggaggtagtcagaaacaaacaaccaaagcaagagaggatgaagatttaaataaaataattatgtgcatcattaaaataatcatatatgtttgtacagacacgtatacaccaaggaacgtaatgggggctcctcgcacagtcccaggagatgcaggagcccaattggtgcccaggagctgcaggctcgggtccccagccaggcgggggactgcgggccgcccgcgctgcagggccgcgggtcaccgcagggggcgccggggcgctacgggtcctcgggcctggtcttttccggtccctgcccgagcccgcgcctttcccgcctttcgggggagaaacctgcctggacactggaactgggagaaagcagcagcctaattgctcttccgatcgtcgcttgggaaaggggggcttcacatttagaaacttctcgcacctttctctctcggtctctgccttttggtgcctgaaaaaccttcaaagatttgcttattttgattcctcgggcgttggagctgtattaggcagcactcgtagataatattga

SEQ ID NO: 70032 - DNA, 316 bp, Homo sapiens; identical to SEQ ID NO: 5622
  misc_feature 1..316: note = chr1:91195879-91196195
  misc_feature 1..316: note = hyper
  source 1..316: mol_type = genomic DNA

SEQ ID NO: 70033 - DNA, 295 bp, Homo sapiens
  misc_feature 1..295: note = chr1:91196225-91196520
  misc_feature 1..295: note = hyper
  source 1..295: mol_type = genomic DNA
cgcttaaagattttcgcaaaaagtgcactggggccaaaaatcaatcactctccctagcctgacccggtgaaaacagatgcataacatattcatgcgctgagcacgccgagcagcccagcgcggaacttttttttttttcttcttcttcttcttcttttaaataaagcgaggaggacttccgcggctcggcagtcctgctaaagctggcagatgcagcaaaactaatatgtgtaaatgctttaaagcaataatctgcttacagcgacacttccccgaacggcggcaggactgaggg

SEQ ID NO: 70034 - DNA, 1125 bp, Homo sapiens
  misc_feature 1..1125: note = chr1:91316237-91317362
  misc_feature 1..1125: note = hyper
  source 1..1125: mol_type = genomic DNA
aaagctaagaaccgccgtgcgatggccggctttgggcaccgggggtgggggctacgctacgcgtgaagggcctcagtcctcgggctttagttcaggaagaaaatgaaagctggaggtctcgtgggcgggactggaggcggccagataggcaagaacccgcaacaggagtagggacattttttcttcaaattccaatcccatccagcgatagacaggcgcgtgggtctccctcctccacgaccaccacacaatggcacacacttttgctggaaactgaaatcgaagtctctgaggcaggctggggcccaggccggcagcggggaggggcagggtccagccacctcggcgtggccttggcgagcgctccggggtcagaggccgtcgttctcgccgcgctccacagcgcgtcacccgctgccctagcgacccccgggcgaccccggcatcgcctggctgcgccgtcccggcgggccggccctctccacgccctctcctggggtttgcggtgggcacagctccctccagactgggtctctccactagcctcctccccaactgcaacgtgggaaccagagctatccgagtcacgagccccaagtgcacacaaagcccccaacggggccacggcgcctccacgcctcgctacctccagctccaggagcgcagaacgcagcgccctgggtcaccgcgtctgccctgcggagcagccccactgaggggaagcctcgggcaggaggtgagaccccgcgcacgcaagcacccccgccccaagcagggccctctgcccgagggagactctcacctcaaataaacgggcgctgccgcctccagggggaggacagcgggcggagaatactcacgctgggcccagccgcgcggggacttcgctgggaaccacgcgcgggctcccgccggggagcggagccccagcctgcagtcctgcgcccgccccagcaccgcctcctcggaagggaggcctctaccgtccggcggcggacctgcagccgccgcgggagacgctgccccgccccccggccccgcccttcggcccatccccgccccgctggcctccttttcccctgccccctccctccgctcctcaacgcccgccgggtgcaatctgct

SEQ ID NO: 70035 - DNA, 1282 bp, Homo sapiens
  misc_feature 1..1282: note = chr1:913503-914785
  misc_feature 1..1282: note = hypo
  source 1..1282: mol_type = genomic DNA
ggccgccccgggaaccgcctgcctccccctccaaccccaggaaccgcctgccccaccctaaccctgcacactcttggcctgggaactgcctgccccgcacacgcccgccccgggaaccgcctgccccagatacatccatcatgggacatgtctgtcctaagatacatttgtgctggacacgtctaccctggacacgtcttcccgaaacccctctgtcatggacacgtcttcctgagaactggttgccccgggaaccgcctgccccgggaaccgcccgccctggacgcgtctgtcggagtcacatcgcccccgtgcttcttctgcctgagatttgggtgacctggttgagttgggccagtttgggggaactgccagtggaggccccgtgttctggtctgtaaagcatctcccagaggacatcagtgtgagatgggcctcgtagagtgcctgaccctgaaggtagccaggcctgggcgggaaccctgccagaggctgggggagggacgccgccgtcacatgggcccgaacacagggcaacggcggcgcagagccaaccccctgaacaacccgggtgcttggactgggccgccccatctggactgtgtgctgggatgactgggggctggtccccaggctcccctgctaggggatgacccaagcccggcctgcccggcccctgcggccccctgcttggccaagatccctggacagtgtgtgcctgggatctggacgggctgtgggatccgagagcacgtacctgcccgtctaagagccaggtggagccgctctaccacggctggcttgaggggggtcccaggccccgccccctcggaggccgaccggggaggctccagggcctgcagtgggagcgggacagccggccccagcacgccctcaagcctgtcctccccgaagaagaagtgttcatagacctcagggatggagatgggcacggggtctccaggtatgggggccggcacaggatcagctctcgggagcggctccggggacccccgccgcctcgacctctgggctccaacgtctgggaagaagaactcgcacatgtccggccactggacgcctgccggatcctgaccggccgctgccgcctcagcctcttcgttctcctcgatggtgtcacagaagaagaactcgtaggcctccgggagggtcacggcaaagctgctcccgggcccgaccctcgtcacggcagagggaggggggcgaggcaggtgcttgaggatccgaggctggtggggccggggcccgacagccacagcct

SEQ ID NO: 70036 - DNA, 30 bp, Homo sapiens
  misc_feature 1..30: note = chr1:9174714-9174744
  misc_feature 1..30: note = hypo
  source 1..30: mol_type = genomic DNA
actaaagctacaaggcggtagatttcttct

SEQ ID NO: 70037 - DNA, 210 bp, Homo sapiens
  misc_feature 1..210: note = chr1:918367-918577
  misc_feature 1..210: note = hypo
  source 1..210: mol_type = genomic DNA
gtgtcctcgggcccacgccgtgctctggagacagctgccatgagggccgcgggcgactgcccgggcgggtgaggctgtcctgtgtgaacgtgccacgcggctgtgccgtttcccgtgggtggcgatgtgggtcgtttccagtttgcagctaccacacacggtgcggctgtgaatatctgggaacattcctttcggcgaacctctcacatt

SEQ ID NO: 70038 - DNA, 515 bp, Homo sapiens
  misc_feature 1..515: note = chr1:91869861-91870376
  misc_feature 1..515: note = hyper
  source 1..515: mol_type = genomic DNA
gaggccttagggccccgagagtggcacaagaacggggcgctggggcgcgtcactccaccccccgggtcccgtttcctcccaccgctgtgaaacccgcggctcagacagatgggtacgtcccccccagcgctcgctcagggggcgccacacaccggaacacaagacacaggaaccgaacaccaatcagccgactttaggggcgggccggacgcccagccggtcccacctcgcggggagctgggcccgccctgcgcccgagcgcgccgcaggcctcaccgctttctgactggaaatgcggctgaggcgctggcgcgggccggcggcctggagacgcctggtgaccaacaactcgccgcgcccgtccgctgcctgcccggcagacggctctagagatcgaccgctgcccggacggctcggctgggtccccacttccccgcgggcgtcgggcccccgtccccaccttccccgcgggcgtccgggcccctctcctcacctccctgcggacagctcctagg

SEQ ID NO: 70039 - DNA, 55 bp, Homo sapiens
  misc_feature 1..55: note = chr1:92048970-92049025
  misc_feature 1..55: note = hypo
  source 1..55: mol_type = genomic DNA
tgttttgacaaatagcgattccctagattattaaacagtgcgtaatctgagagaa

SEQ ID NO: 70040 - DNA, 130 bp, Homo sapiens
  misc_feature 1..130: note = chr1:9243203-9243333
  misc_feature 1..130: note = hyper
  source 1..130: mol_type = genomic DNA
aggctggggaccttgcgtggggcagggcttggctcagccgaggggccgcggctcagcccccctcaccggccttaaaggttcccagagacgcaaagtcggacgcgggtcctgagcgcggagctacaggggg

SEQ ID NO: 70041 - DNA, 48 bp, Homo sapiens
  misc_feature 1..48: note = chr1:92494924-92494972
  misc_feature 1..48: note = hypo
  source 1..48: mol_type = genomic DNA
ggactgtcactctcacggcttccagcccttcgacgaactctcaggtgt

SEQ ID NO: 70042 - DNA, 128 bp, Homo sapiens; identical to SEQ ID NO: 26473
  misc_feature 1..128: note = chr1:92495704-92495832
  misc_feature 1..128: note = hyper
  source 1..128: mol_type = genomic DNA

SEQ ID NO: 70043 - DNA, 1142 bp, Homo sapiens
  misc_feature 1..1142: note = chr1:92948324-92949466
  misc_feature 1..1142: note = hyper
  source 1..1142: mol_type = genomic DNA
ccgttagcatttctacgcccaaggtcgcgccaattcccccccagcactgccgggtccctgcagctcccgcccaagaggttcccagtgggttcctacctggagacgcggagggtgacgggggcctccagaagtcctcaaactccgagctccgttcgcagacgctgccttcgcagctgtctggggatgcggaggctctgtctggggcttcggtcagctgcgattcgggggacaaacggtcccggggctccgccttcgccccgcctgcatttgaagtgctgtctgcaaagaggaggcaggtgaggggctcaggctgggaccggttgagtctgagggtgctgaaggctcccccaatcccccgaccagggcagccgagcgtcttcccctctccacccagaccccggccgggaaccctctcggatccgagggcaggcgcagagaggccatggcacctaggagacaaacccggaggaaccaggacagtaggaaacaaaaacagcagcaaaagggacgttggggcagcccctcccagctccggactaatggtgtgccgaggtgcagtaggcatccgggggagcagccccgcctggcccgcgcgcgcctcgcacctgctcggctaggcgccggtacattctctaaacggagggaatagtctggtcctggggagcgcggctggtggtagctgtgagccttcttgcttttgacgagaaatgagcgcggcatggtggtccggcactttccccactgcgccccaagagtccctggagccgctgtcacccacggtcactccgagggcttgctcagccccagcccggaggagacctgagagggaaagaaaaccaggtggagacgtgggtcagtactctccggtgcggcggactgggcacccaggcggagggagagcgcgggccagggaggcgcgcagagggcccacgggaggaggggcttgaccctgctgcgccgcgcttaccaggtggcacttggacaggtggcgcgaacccgccgtcgttgccgccgccgccactgacacagctcagcggtaaaacctgtcccggggccctgtctcaggcccctttcctcctccctgcccacgccccccagctcctcccctttcctagcgaagctcgctccggcaatcaaactcc

SEQ ID NO: 70044 - DNA, 516 bp, Homo sapiens
  misc_feature 1..516: note = chr1:92949691-92950207
  misc_feature 1..516: note = hyper
  source 1..516: mol_type = genomic DNA
gataaaactgtggggcggcgggaggacagcagcagagggattggggacagcagaggccagagaaaggaggtgggagagcaaagggacaggaaagtgaggggaacaacagacgaccaacccccgccccaggagaaactcgcatctgggtgatcccactcgcccctcactagtgccccacgtaggagaaactttgcccttggactcccggctgcggcgggcaccggtcgaggctgcggcgagccatcccagaccatggagacctaacctcgggaatcaggtcccgggaaaaaagcactttccgttctgctcaccaaaaaatcttgtcctagggaggtggagcccgatccacgaacgttgactgggaaatgctaggtgtcccgagtcggtagtgcaccgacaatttagcagacaaaaaagacaggacgccagagcgcgcaggctgcattagcagagagcgggggtcgggcccgggcccgggagggaactagctgcccggggcgtcgctctcattaaccc

SEQ ID NO: 70045 - DNA, 2116 bp, Homo sapiens
  misc_feature 1..2116: note = chr1:92950434-92952550
  misc_feature 1..2116: note = hyper
  source 1..2116: mol_type = genomic DNA
ctgggaactctgggccggggcaggacctgcagtcctccggcttcgcgctgtttccactgccggactaggagcccctcggcttcctaggcaagatgcaggccacacagtctacgtctgtccgttggcgctctcagctcaaacgagtcctacaggccttggtccctgtagggtgcaggccccctgctccagatccccagccccattgtgtccccttctccggaggaatgggaatagacctgggagaaaagacgcctgggacgtgtcgcggggctcccgcgaagtttcccgctacccaagcgccagaatgcccctaggggtgagagtgccatccgcctccctccggggtggctcctagggctagagctttgtcgcttcctgcacttctcgtccgtacaattagacgccacaaaccccaaacccaattctttaaacagccacgaaactcggaagaaaagaaaaacggagtggcgttgtcccgagggtcccgctgcagcttggacccacgttggctgggagcgggacagatgggggcggggtaactgtcagcgccggagctgggtctgggctggcgccaccagagaccaggcggacgcggaggccgcctccccacccgggctgtaagcccacgcctctctcgcaccccggcccgctttgctggttcctgtggggagcgacagagtttggaggagataggggccccggggcctgggccgagcgcgtgggaaggcaaccccgcgctgcagctggcgcgggaggtggggcggcccctccgcgcgctcaggcctctcctcaccgtccgggcccaggaaggagggagccgagggcgctaagggggcgtcctcccgagcgcagctgccgccgcctccccaccagatgtttccttccctggtggatttggctcccctgccgaaccaccagaccgcctgctgcgcgcccccagctccagatttccagtcacactgcgcgggtcgcgccctaacccagctgccggagctctctgggctcccgcacggcggtccgcagcaggtgggaaaccgcccgcgccctctgatcgcccccgcagtgccagtgctctgcgagtccccgcggccgcccccaccagggcaggaggcgcagaacaggctcggcggacctacctgcggagtcacggcgcgggcaccgcgctaggagagttttcaaacggaatcttgctttcgggagagaccgctctatctctctgacttaaaaaaaaaaaaaattctccttccgagctcagcccccaaaaccacaagcttcacttcctgagcgttactgagtcgctcgcatagccctcccagacctgctcccaacccccgtcgggcggccgggcgcgctcctttgcgcaagtggccaggcggtggggggcctggcctttccagcccgtcccgcgcgccccttagtagtcctcccagttctctccctgtgggtcggcaggggatgggggaaattggaggtccggacacttaggcactagaaatgacttgaaagaaaatgaactattcttggctccagggagacttccgcagcgagagaagccacagattgaggacacagattgactggcgagagaggggtggggggcgccccgctccgaggaccctccccgcccctcaggcctcggtcacccgccccccccacccccgaccccgccgcctcctagggctgcaccacccccgggtcgggaccgtgaatcaccggcccgcggtgccgccggcctggagcccggcgagtggccacggcgtccgcagagcgaaacctgccccgcaggccccgaaatagcttgttgtggaaacacttggggataaatacgcccaacgaggctgaaaataccttgacacccaatccgagaggtttgctcatttcccttcggatttaggtaatggttaaatttggaagaggtgggcgagcgccgagcccccggcggagagggccctggcggcgcgtcccgcgggcgcccggcgggaccggtgggcgcaccctccctgcgcggagctcgccggctctcgaccgggtccgctcagccttcgactaatttccggtggtcggagctgcaaaattaaaggccgcgcgggggcagcgccggcggctgctaggctga

SEQ ID NO: 70046 - DNA, 156 bp, Homo sapiens; identical to SEQ ID NO: 39010
  misc_feature 1..156: note = chr1:93222691-93222847
  misc_feature 1..156: note = hypo
  source 1..156: mol_type = genomic DNA

SEQ ID NO: 70047 - DNA, 57 bp, Homo sapiens
  misc_feature 1..57: note = chr1:935070-935127
  misc_feature 1..57: note = hyper
  source 1..57: mol_type = genomic DNA
cctcttttctgagggcgtccaggatgagggttttgagctgagcgaggctctcgttaa

SEQ ID NO: 70048 - DNA, 18 bp, Homo sapiens
  misc_feature 1..18: note = chr1:93543647-93543665
  misc_feature 1..18: note = hypo
  source 1..18: mol_type = genomic DNA
gcccggctgcatctgctt

SEQ ID NO: 70049 - DNA, 105 bp, Homo sapiens
  misc_feature 1..105: note = chr1:936563-936668
  misc_feature 1..105: note = hyper
  source 1..105: mol_type = genomic DNA
agcctggcctgggcccgggtgtggagaccctcccgggctttcaatccgggcaggaggcagatggcagactcagcagtcacgtaagagaaccgaattaggtgggtg

SEQ ID NO: 70050 - DNA, 30 bp, Homo sapiens
  misc_feature 1..30: note = chr1:9379709-9379739
  misc_feature 1..30: note = hypo
  source 1..30: mol_type = genomic DNA
gtgcagaggatgctgcgggaggccaagcct

SEQ ID NO: 70051 - DNA, 19 bp, Homo sapiens
  misc_feature 1..19: note = chr1:9391674-9391693
  misc_feature 1..19: note = hypo
  source 1..19: mol_type = genomic DNA
tcaccgtgcctagccggca

SEQ ID NO: 70052 - DNA, 30 bp, Homo sapiens
  misc_feature 1..30: note = chr1:94045521-94045551
  misc_feature 1..30: note = hypo
  source 1..30: mol_type = genomic DNA
cctgtgagcactgcccgaggccatctggcc

SEQ ID NO: 70053 - DNA, 30 bp, Homo sapiens; identical to SEQ ID NO: 39011
  misc_feature 1..30: note = chr1:94048058-94048088
  misc_feature 1..30: note = hypo
  source 1..30: mol_type = genomic DNA

SEQ ID NO: 70054 - DNA, 82 bp, Homo sapiens
  misc_feature 1..82: note = chr1:94048417-94048499
  misc_feature 1..82: note = hypo
  source 1..82: mol_type = genomic DNA
ggctcagggcaggctcgcttcccgtcctgaacacaggtgagtttgggcaggggcttgtgtccacacccgaggactgaggtgg

SEQ ID NO: 70055 - DNA, 365 bp, Homo sapiens
  misc_feature 1..365: note = chr1:942313-942678
  misc_feature 1..365: note = hypo
  source 1..365: mol_type = genomic DNA
cctgagagtccagggcgccaagtcagccctgcacctggcccgggcctcggaccccgacggggctcacccacctgagatcaccctggctctgcgggaaggcaggaagctttggcatgatcctccacgggcgaggatcacgtagagacgtgtagagacgcgacgaagcacgaagacccgtgtttgacgggttgccaggtgcctacatcagagctcattaaattacacattaaatagatgcacgtgtgtgtgtcaagctcccctaattcaagttgtagaaaatcagactcagagttcttacactcgggggtgttttagcagctgcgcctcaagattctaaattcaaacgcacacggaataaaacattt

SEQ ID NO: 70056 - DNA, 37 bp, Homo sapiens
  misc_feature 1..37: note = chr1:94343568-94343605
  misc_feature 1..37: note = hypo
  source 1..37: mol_type = genomic DNA
aaatcaaaatttggccgggcgcggtggcttacggctg

SEQ ID NO: 70057 - DNA, 41 bp, Homo sapiens
  misc_feature 1..41: note = chr1:94345747-94345788
  misc_feature 1..41: note = hypo
  source 1..41: mol_type = genomic DNA
ttttttttttggagacggagtcttgctctgtcgcccagggt

SEQ ID NO: 70058 - DNA, 30 bp, Homo sapiens
  misc_feature 1..30: note = chr1:94490609-94490639
  misc_feature 1..30: note = hypo
  source 1..30: mol_type = genomic DNA
gcaatgagacacccacgttaattaccttgg

SEQ ID NO: 70059 - DNA, 30 bp, Homo sapiens
  misc_feature 1..30: note = chr1:94701656-94701686
  misc_feature 1..30: note = hyper
  source 1..30: mol_type = genomic DNA
gagctcatcctaaaacgatgattaaatctt

SEQ ID NO: 70060 - DNA, 55 bp, Homo sapiens
  misc_feature 1..55: note = chr1:94702935-94702990
  misc_feature 1..55: note = hyper
  source 1..55: mol_type = genomic DNA
cgcggccggagcaagcgccacctcctcacactcaccacggcgctccatctcgcgt

SEQ ID NO: 70061 - DNA, 33 bp, Homo sapiens
  misc_feature 1..33: note = chr1:94703324-94703357
  misc_feature 1..33: note = hyper
  source 1..33: mol_type = genomic DNA
cagcatcacgggctgcgtcggctgcccttttgg

SEQ ID NO: 70062 - DNA, 229 bp, Homo sapiens
  misc_feature 1..229: note = chr1:95007667-95007896
  misc_feature 1..229: note = hyper
  source 1..229: mol_type = genomic DNA
gcaggaaagggagggcgccttggaagaattcttcccttccatttggtgataaagtgggagaggcggcatttacaacatttaatagaaagcacgggctctgggctcccctcgggcagcggagggcatttcccggatgctttgcccacctggggcagaagctcgggacctgcagcgaagtaaacgtgtggctgtgagcagggccctctcccagccacggtggcttcttcta

SEQ ID NO: 70063 - DNA, 154 bp, Homo sapiens
  misc_feature 1..154: note = chr1:95071346-95071500
  misc_feature 1..154: note = hypo
  source 1..154: mol_type = genomic DNA
ttcttggatgtatgaaccatataattccttcttcaaaagtcataaaggcgagactccagccaacaattccacataaaaagagagcgccattttctcgctctcaggcttggtaatgattcctgctgtgaggcagtcattacggaaatgactcagt

SEQ ID NO: 70064 - DNA, 884 bp, Homo sapiens
  misc_feature 1..884: note = chr1:95391740-95392624
  misc_feature 1..884: note = hyper
  source 1..884: mol_type = genomic DNA
actcgcacagtggcgcgctcaggctttgtctccatttcccgcaaaagcaacagcagaagcagcagcagcaatctgcctccaaatgcctcccaggcaccgagatcggagactgtgatgggtcccggaccggcttccgttcctcggggcccctggggtcggcgggacattaggcggtctctctccccgtggggaggcgcggagtccgccagcacccggggcccgggcagatggcgggggctgcggcagcggctcgccgggtccctggccgcgcagacgggctccgcctaagggcgagtggccacgcaggagcgcccccttcccggagggcgcgttctgcagtcaccaaacggcccccgagacccccgcagccggaaaggctggcgccgcgggactccaggcgcccgggaacccaccgccagccactagtcctgtcccacggcgcgggaacaaagccaggcgggtgcccgggagccggccccgcaagcccggggactggacgcgaccgggacaggcagagacgctcgcgccgcctcgacggcccctctccaggaaaacggtgagccacagcgcgaagagcaaacgaagcacggcccagcgccaggccagcccaagggtgccccgggggcccccgcgcccgcccgagccaggcgtaccttgttcttgacttcggccgagagcccataggaagggcccttgttgaagtgggtcatggtggttcgggcggcgggaagagacagcgctggggtccggggtctctcgcacttcgcttccccgctcctggccccgaggagtggccgccgcgggggatgctcgaactccctcctctgggaggcgcaggagacggccgcggggcgcgggcggtgcctgggcgactgggtccaact

SEQ ID NO: 70065 - DNA, 72 bp, Homo sapiens
  misc_feature 1..72: note = chr1:95392995-95393067
  misc_feature 1..72: note = hyper
  source 1..72: mol_type = genomic DNA
gccggcggaggggagcggaagcccaccggggctggcccgccgctgacccgccgcctccgtctgcctcctccc

SEQ ID NO: 70066 - DNA, 151 bp, Homo sapiens
  misc_feature 1..151: note = chr1:95428423-95428574
  misc_feature 1..151: note = hyper
  source 1..151: mol_type = genomic DNA
gattttacaggttttcgatttatctcctcctctttttttttttttttccccatgcagagcaaagggaaaaacagctaagtgtttcctggctgaattttattttgctttcagtttctgccatttcagttcctgttatcgtgctttgaggtgc

SEQ ID NO: 70067 - DNA, 30 bp, Homo sapiens; identical to SEQ ID NO: 38692
  misc_feature 1..30: note = chr1:957607-957637
  misc_feature 1..30: note = hypo
  source 1..30: mol_type = genomic DNA

SEQ ID NO: 70068 - DNA, 30 bp, Homo sapiens
  misc_feature 1..30: note = chr1:9580479-9580509
  misc_feature 1..30: note = hypo
  source 1..30: mol_type = genomic DNA
tgaacaggtcagactcgtcagggacccacc

SEQ ID NO: 70069 - DNA, 83 bp, Homo sapiens
  misc_feature 1..83: note = chr1:9648276-9648359
  misc_feature 1..83: note = hypo
  source 1..83: mol_type = genomic DNA
ggattacaggcgtgagccaccgcgccctgcctggatctggcattctttctaatggttgcattatgttccgaactatggctgtc

SEQ ID NO: 70070 - DNA, 55 bp, Homo sapiens
  misc_feature 1..55: note = chr1:9661692-9661747
  misc_feature 1..55: note = hypo
  source 1..55: mol_type = genomic DNA
cctctgagccagccccgtgcacacccgctgtgggctgggccgggttgcctcctct

SEQ ID NO: 70071 - DNA, 67 bp, Homo sapiens
  misc_feature 1..67: note = chr1:9711452-9711519
  misc_feature 1..67: note = hyper
  source 1..67: mol_type = genomic DNA
tctcagcctttctcccgctcctgctgaaattctttcctgcgtgaaggcggagcgcttaaaggcgcct

SEQ ID NO: 70072 - DNA, 916 bp, Homo sapiens
  misc_feature 1..916: note = chr1:9712098-9713014
  misc_feature 1..916: note = hyper
  source 1..916: mol_type = genomic DNA
cccccgtgggcccgccgagaggggcgtgcgcagctccccggcgcctgcactgcgcgccttgcccgcctggcccggcagcggggtttcagctgcgctcacagcggcggtgcggcctccggtgcgccggctgaggcgcgaggatactggaagcgctcagcgcgtgcgcccgctccgagcgctgactagaggaccaggggcctcctctgtacggcagcggggtccacagagagcgcgctggtgatgtcgcccgagtgccctggcgcggagagagggctgcgcacagttcgccggcgcccgggtcctgtgcgcccttcccagcctgggcaagtggggagcggggctgcagaggggccggggtggaagttttcggggcttcctcccggctcgtggacccgcgccccgcctcccagtcccgggcctcccgcgttgctcgccgcgtttgctgcagcggcgcaggcgagatcagctccggatctgcggccgagccggggttacgccggcaaaaccgcccccagctttgcatttccggactttttaaaaaaatactcttacccgtaattcagcctgaatgaggctttttaaaaaaatcgagtttcctgtttttatttaggcttcctcatttgcacctcctcctttgaggtagagaagaggggaactgggacgacctttcgtgggcaccaggatgggggcgttgcagggcggggagacgggggtccagagaaccggggaagggccgctgggaggtcccgaaaagtgcgctgtgggtggggcgagggtgaagcaggtaggggcgagatttccggggtcgcgggtggggggcgccctggagcggccaaggtgcagggtcctcgcgtggcacccttgggatctgcccagtttgcggatggagcgcggggctgatcgggcaggtctcact

SEQ ID NO: 70073 - DNA, 34 bp, Homo sapiens
  misc_feature 1..34: note = chr1:97185220-97185254
  misc_feature 1..34: note = hypo
  source 1..34: mol_type = genomic DNA
tcaatcaatatcgatcgagcgaatgtggggaata

SEQ ID NO: 70074 - DNA, 30 bp, Homo sapiens
  misc_feature 1..30: note = chr1:9740821-9740851
  misc_feature 1..30: note = hypo
  source 1..30: mol_type = genomic DNA
gccccacagcaggaacgcggcagccatggg

SEQ ID NO: 70075 - DNA, 90 bp, Homo sapiens
  misc_feature 1..90: note = chr1:975817-975907
  misc_feature 1..90: note = hyper
  source 1..90: mol_type = genomic DNA
atccctggagaggcccggggctggcgggaatcctcggcgggcggggtctgcgaggggcagggccggtcctgtgagcgcacgcacgcgtgt

SEQ ID NO: 70076 - DNA, 30 bp, Homo sapiens
  misc_feature 1..30: note = chr1:979970-980000
  misc_feature 1..30: note = hypo
  source 1..30: mol_type = genomic DNA
acatttgtgcagctgcgtgtgtgggcgtgt

SEQ ID NO: 70077 - DNA, 30 bp, Homo sapiens
  misc_feature 1..30: note = chr1:9828369-9828399
  misc_feature 1..30: note = hypo
  source 1..30: mol_type = genomic DNA
gcggcaccatgggggcggagttctatgttg

SEQ ID NO: 70078 - DNA, 193 bp, Homo sapiens
  misc_feature 1..193: note = chr1:98338299-98338492
  misc_feature 1..193: note = hypo
  source 1..193: mol_type = genomic DNA
gactatagaacttttcgagaaaaaaatatttatcatcatcatcattgtcactactctgtggagaggtcctcagcatcatctcttggtacttttcttcatgctccagtctacgacttcagccatgcagtactgacaccgtttcaatcccttaacttcaatcagtatgctcccccatcttcggactttcagatac

SEQ ID NO: 70079 - DNA, 34 bp, Homo sapiens
  misc_feature 1..34: note = chr1:984367-984401
  misc_feature 1..34: note = hypo
  source 1..34: mol_type = genomic DNA
gctgtacaatggcaacgcccggggcaaggacttc

SEQ ID NO: 70080 - DNA, 70 bp, Homo sapiens
  misc_feature 1..70: note = chr1:984667-984737
  misc_feature 1..70: note = hypo
  source 1..70: mol_type = genomic DNA
ccgggccagtggcaccgcctggagctgtcccggcactggcgccggggcaccctctcggtggatggtgaga

SEQ ID NO: 70081 - DNA, 299 bp, Homo sapiens; identical to SEQ ID NO: 26480
  misc_feature 1..299: note = chr1:98510732-98511031
  misc_feature 1..299: note = hyper
  source 1..299: mol_type = genomic DNA

SEQ ID NO: 70082 - DNA, 836 bp, Homo sapiens
  misc_feature 1..836: note = chr1:98511032-98511868
  misc_feature 1..836: note = hyper
  source 1..836: mol_type = genomic DNA
cggggacccagcccccgggcccccgccccctccccatctcggccgccaagtctggttgcggagcagcgcggccggccgggggtggggctccggcaccgccccgggctcgggattcgcgaagtcacgcgcttccgcaggcttgcgggggcaccttcgcccacggacacgccctttctgcggaggcagcccccagcgaccctctgcccagcttcggcgcctcactcgcgacgctcccaaactgctcaaggcctttcagtcgttcccaactttagaaaatcgccccgtccgcgtctctccctccagccgcaccccaccgtggagaggagaggagcggactgggaacgccgaaccgccccgcaggctcggggaaacggacccccttccgctccccgcccatccccttcacctcgccccccgccccctgcgcgaacccattttccagtcctggtcaccagaggcgcagcgcacagcctttccggtggaaccagtgcgaaaacacccgaggaaatgaaaagaacaagaaagtgctaccttggcaaccacgggcgtttagtggccagctggtgggctggggagggcggccgctgcccccctgccgctggtactctcctcgactacgcgtattcttaagcaataacaacgtaatccgtattatccacccaagaatacccgtcaccgaagagagtcagaggaccaagctgccgctgccgctgctaccgctgccgctgctaccgctgccgctgctactgccgccgccgccgccaccagaactcttgctgctcgctgagcccgcccctgcctggggatgggctgagcttgaccgggaccataaatcc

SEQ ID NO: 70083 - DNA, 315 bp, Homo sapiens; identical to SEQ ID NO: 26483
  misc_feature 1..315: note = chr1:98513940-98514255
  misc_feature 1..315: note = hyper
  source 1..315: mol_type = genomic DNA

SEQ ID NO: 70084 - DNA, 247 bp, Homo sapiens
  misc_feature 1..247: note = chr1:98514484-98514731
  misc_feature 1..247: note = hyper
  source 1..247: mol_type = genomic DNA
cccatcccagttaatcgcttcgcaatttgcaaccaaaaatacataaagaaacgcgacaaagcaatgggtttgaggaaataagccaattaagctaaagctgaaatgcctctctctctctctctctctctctcccccccttctccctctttctcttcccccttgactccctccctctccctctctccttccctctcaagtagaaagggggaaacaccaaggagagagaaaaaatcgggaggagggtggt

SEQ ID NO: 70085 - DNA, 43 bp, Homo sapiens
  misc_feature 1..43: note = chr1:985145-985188
  misc_feature 1..43: note = hypo
  source 1..43: mol_type = genomic DNA
tccattgccagtgcccgcccggccgcgtcggtgagggtggggc

SEQ ID NO: 70086 - DNA, 19 bp, Homo sapiens
  misc_feature 1..19: note = chr1:98515068-98515087
  misc_feature 1..19: note = hyper
  source 1..19: mol_type = genomic DNA
cttgggaagggacctcggc

SEQ ID NO: 70087 - DNA, 289 bp, Homo sapiens
  misc_feature 1..289: note = chr1:98515088-98515377
  misc_feature 1..289: note = hyper
  source 1..289: mol_type = genomic DNA
cctcgcgctggctgtgccccagtgccttcgcgtggtggcggcttgctcatgcttccgaggagtcccaggcgatagccttcagctgatgcgagcttccagaaaggagtggggaagggaaaaaatcatctaatgcaatcaaatcgatctgatctacaccatctgtcgcctgccactatacacaaacgttaaaataggaaaacggaaaacactgacagccgagagggttggtctgcaaagagttcatttttagcagagcataattcgatatggtcggcgtacagttacaaaa

SEQ ID NO: 70088 - DNA, 675 bp, Homo sapiens
  misc_feature 1..675: note = chr1:98518986-98519661
  misc_feature 1..675: note = hyper
  source 1..675: mol_type = genomic DNA
ataccagagtgatctcggcgctcgcgcagttttgagagagggtcccgaaaaccgccggaggccaggtgtcgcggacgggccccgggctaaactctcgtctggcgaagtgaagagcgcaaagtctccaggcccagcgcgccttcgcggggcaggccggacaccctagccccgggccgggctcgctcttctctgaagccctggagcgggcaaggggcaccattctggccacaggaactctagtttcagcagccgcagcccgccagcgctggctcggaccggggcctcctctgggagagtaggagagcgaaaaaatcaaccaccaccttggatttcagatcgaggaaaggaagccaaagcaaaggtgtggttacacaggacatccatagacaaatcgttgcctctctaagtgggcctgagctttgcggctccagaagcgcgaggcgcggttggtgcggacgcgggggcgtgggagtcatcgctctccccgcagccctggccgagctctctgctgtcctcccgagtttgggccagagaccacggctcactccctaacgccctcgcaaggacggctgcccgtcgggccaagggcgccccgggctggaggccggagcaagacggccccgcgggactcgggagccttggtaaggcggaggctcagaccccgttcacgaaaac

SEQ ID NO: 70089 - DNA, 375 bp, Homo sapiens
  misc_feature 1..375: note = chr1:98519662-98520037
  misc_feature 1..375: note = hyper
  source 1..375: mol_type = genomic DNA
cctggctcctccaggatttgtcaggtcttaagcagctccgagaaggctccgctggctcttggggaaccccgctgtgcggctcacccccgtttgtctctctcaagctctcgccctcctcccctggtcctcccttctccagatcccctgccctgcccgaggtccgggccgcgcgggctgagcccaatacgcccggagaagagcgccggagccccctgctggccggacgcggcaggcgcggcggcccgctcggtcccctccgccccgcgggctctgcccagcccggacccgcctccaccctccagtgccctggcgctgggggcgtgctaaaagcaacagaaaacaaaacaaaaacaaacaaagcgccaaaccccactc

SEQ ID NO: 70090 - DNA, 404 bp, Homo sapiens
  misc_feature 1..404: note = chr1:986504-986908
  misc_feature 1..404: note = hypo
  source 1..404: mol_type = genomic DNA
tttctgtgtgattaacgctgccccctagataggcaatgggcgggtggggcgggtgcgtgcaggtgcctgggccctgggtctgcaccgtgggtgggctctgcacagccacttacctggcgtccccgcaggttccgcacaccgtcctcaacctgaaggagccgctctacgtagggggcgctcccgacttcagcaagctggcccgtgctgctgccgtgtcctctggcttcgacggtgccatccagctggtatgtgggggcggggcgtcccagcagggcctccggggcgggcggggtggcaggcgggacaaggccctcaccctgccctgcaggtctccctcggaggccgccagctgctgaccccggagcacgtgctgcggcaggtggacgtcacgtcctttgcaggtc

SEQ ID NO: 70091 - DNA, 30 bp, Homo sapiens
  misc_feature 1..30: note = chr1:9877098-9877128
  misc_feature 1..30: note = hypo
  source 1..30: mol_type = genomic DNA
gagaatcagacagaacgaaacagatggctg

SEQ ID NO: 70092 - DNA, 30 bp, Homo sapiens
  misc_feature 1..30: note = chr1:9897055-9897085
  misc_feature 1..30: note = hypo
  source 1..30: mol_type = genomic DNA
aggtccaattatgtgcgattagtggatttg

SEQ ID NO: 70093 - DNA, 32 bp, Homo sapiens
  misc_feature 1..32: note = chr1:9899160-9899192
  misc_feature 1..32: note = hypo
  source 1..32: mol_type = genomic DNA
gcaggggtggggccccgcgttgctgtctgtct

SEQ ID NO: 70094 - DNA, 30 bp, Homo sapiens
  misc_feature 1..30: note = chr1:9907045-9907075
  misc_feature 1..30: note = hypo
  source 1..30: mol_type = genomic DNA
ctgctgaagtgtccccgactcatttacgtg

SEQ ID NO: 70095 - DNA, 40 bp, Homo sapiens
  misc_feature 1..40: note = chr1:99127631-99127671
  misc_feature 1..40: note = hyper
  source 1..40: mol_type = genomic DNA
ggccgcacccggggccgcgtcgcctcggggcctcaaaccg

SEQ ID NO: 70096 - DNA, 136 bp, Homo sapiens
  misc_feature 1..136: note = chr1:99469561-99469697
  misc_feature 1..136: note = hyper
  source 1..136: mol_type = genomic DNA
gatcccctctctcctcgccggcccgcccgccgctgctcttcttccaggcacaatcgaagaggaggcagtgagcgagtcaaggccacagagtggatggaatcaaggttcacccccaaagctcacctcctttgcaacc

SEQ ID NO: 70097 - DNA, 303 bp, Homo sapiens
  misc_feature 1..303: note = chr1:99469759-99470062
  misc_feature 1..303: note = hyper
  source 1..303: mol_type = genomic DNA
cgctgaagccaccgcggggtgtgggggggtgacgtgtgggaagagctgggggcttccttcgcacccaccctcacgcgccctagaatgtcctctggggaaggggctgcccataacttggaggaacttagaaggcaaaacctactgcgccccaacccttagaggggcctcaaccccgaaggcgaggggcgagatcagggactcggcgacgagggcgagcgcccccgggcttaccacgagcacggggaccccggcggccagcgagtagaggagcacggggggcacggcgctgctgtcctccgggcc

SEQ ID NO: 70098 - DNA, 319 bp, Homo sapiens
  misc_feature 1..319: note = chr1:99470211-99470530
  misc_feature 1..319: note = hyper
  source 1..319: mol_type = genomic DNA
cgggcagcaggggcatgcacgcctcccgggccgggccgagccgagccgagcgggcggtcgacgcggtgggccccctccccggtccgccgaggcagccaccgggggcgcggcggcggaggcggcgggaggacgaggcacgggaggcgggatggagccgctggaggaagaggcggaggcaggtccgggcttcgaggcgccggcaggctgcagaggaggcggctacccccggacgagccccctctcccctgcccgccccctgcccgccgcaagcgccgcccgccccggcgcggggtcgcgagggagggcggggagtcccggg

SEQ ID NO: 70099 - DNA, 36 bp, Homo sapiens; identical to SEQ ID NO: 5642
  misc_feature 1..36: note = chr1:99470582-99470618
  misc_feature 1..36: note = hyper
  source 1..36: mol_type = genomic DNA

SEQ ID NO: 70100 - DNA, 228 bp, Homo sapiens
  misc_feature 1..228: note = chr1:99470619-99470847
  misc_feature 1..228: note = hyper
  source 1..228: mol_type = genomic DNA
ctgcgtgggcggacggggcggcagccggcgggacagcggcacctgtacccctcacagggcggacgctgtggggctggagaagctcctggcgggggtaaaatcaaaagggggggaggggaggcagtagagatggagcttccagaaactcttccgaggcaccagctgagaggtttaagaaacccgcacaacgcctgggaaaatggtgcgtggacgcgtcttccgagcgca

SEQ ID NO: 70101 - DNA, 89 bp, Homo sapiens
  misc_feature 1..89: note = chr1:99611990-99612079
  misc_feature 1..89: note = hypo
  source 1..89: mol_type = genomic DNA
gagccctgccctcctcggaagggctgcagctgcccaaattgcagttgtggatccagcctctctgtgctcttgggggcctgggggaacct

SEQ ID NO: 70102 - DNA, 88 bp, Homo sapiens
  misc_feature 1..88: note = chr1:99612139-99612227
  misc_feature 1..88: note = hypo
  source 1..88: mol_type = genomic DNA
cctgctggatcttagggcattgtcctgctgcgcgttgggggtgatgaacagcagcaggaggcagacagatttccggacagaaggggcg

SEQ ID NO: 70103 - DNA, 52 bp, Homo sapiens
  misc_feature 1..52: note = chr10:100027893-100027945
  misc_feature 1..52: note = hyper
  source 1..52: mol_type = genomic DNA
ggagcgcggacagtccggggctgggcgggcgccgcggcggagcagcgctaac

SEQ ID NO: 70104 - DNA, 30 bp, Homo sapiens
  misc_feature 1..30: note = chr10:100171013-100171043
  misc_feature 1..30: note = hypo
  source 1..30: mol_type = genomic DNA
ccattgcttgggaggcgcaagtgatggtgt

SEQ ID NO: 70105 - DNA, 84 bp, Homo sapiens
  misc_feature 1..84: note = chr10:100217160-100217244
  misc_feature 1..84: note = hypo
  source 1..84: mol_type = genomic DNA
atcctctccatgcctcgtaggaaaaatggggataacagtagtacccctttatcatggggttactaaggacgcaaagcaaaccat

SEQ ID NO: 70106 - DNA, 45 bp, Homo sapiens
  misc_feature 1..45: note = chr10:100504665-100504710
  misc_feature 1..45: note = hypo
  source 1..45: mol_type = genomic DNA
aaatacgttcattgccgggcgtggtggctcacgcctgtaattcca

SEQ ID NO: 70107 - DNA, 39 bp, Homo sapiens
  misc_feature 1..39: note = chr10:100991943-100991982
  misc_feature 1..39: note = hyper
  source 1..39: mol_type = genomic DNA
aaatctgccccaacgcgcgcgcgcgcatacacacacaca

SEQ ID NO: 70108 - DNA, 149 bp, Homo sapiens
  misc_feature 1..149: note = chr10:100992042-100992191
  misc_feature 1..149: note = hyper
  source 1..149: mol_type = genomic DNA
cacaaacacagcgggtgcttgcttccgctccccaaataaagaatggtaatcaagtttctcaccatcctcatagtttttgagatagtaatccgggcccgggcccccgcggcttttcgccgggttcctcaggttctggaactgcaggaagt

SEQ ID NO: 70109 - DNA, 426 bp, Homo sapiens; identical to SEQ ID NO: 33216
  misc_feature 1..426: note = chr10:100992221-100992647
  misc_feature 1..426: note = hyper
  source 1..426: mol_type = genomic DNA

SEQ ID NO: 70110 - DNA, 59 bp, Homo sapiens
  misc_feature 1..59: note = chr10:100992681-100992740
  misc_feature 1..59: note = hyper
  source 1..59: mol_type = genomic DNA
cgaccgttgccaaaaacttgtatgctgaaagccggcattgcctccgcagccccaggggc

SEQ ID NO: 70111 - DNA, 451 bp, Homo sapiens; identical to SEQ ID NO: 906
  misc_feature 1..451: note = chr10:100993487-100993938
  misc_feature 1..451: note = hyper
  source 1..451: mol_type = genomic DNA

SEQ ID NO: 70112 - DNA, 756 bp, Homo sapiens; identical to SEQ ID NO: 33219
  misc_feature 1..756: note = chr10:100993939-100994695
  misc_feature 1..756: note = hyper
  source 1..756: mol_type = genomic DNA

SEQ ID NO: 70113 - DNA, 980 bp, Homo sapiens
  misc_feature 1..980: note = chr10:100995730-100996710
  misc_feature 1..980: note = hyper
  source 1..980: mol_type = genomic DNA
gctcgctcgctcgttttgtttttttcttttttttttttaattttttttaattttttttttcagtgttttggtgctggtggagcgaactcacgcccctagccagccttccccgtgactcttgccaagagaactcgtacaccggcaccgcccctttaagagatttctactgcagacattttttaactttttaaaggtaaggggaggggagcaggcgggaaggaggagaaaagggtggcgttgtaccctcctaatttaaccctctagggtcaggaagcagagggaggaatccaaaccatgccgttgtaccgtctgggtacagagcaaagggtctcgtttttacgtccttccctgagaggctctggagggcggttcaagctccgactccgacccgaaagccccagcgccaacccgggacgcgctgggatagagttcccaccgacagcacgcttgtttctcctgacagcgtcaggcacttcgtccgctcagggcccttttctggttgaagcagcaataccaagggcggttaagttgcagaggggtcttgaggcggtgattcctgtcaaagcatagagccctgaaggacattccccgaagaggagccctgatctctgtgacgcgttggatagccacaccgaagcatcctctgacctccatagggcaaagagtagcaagaaggaaaaacatagtgacctggtcaagcagcttttccgatccgagggccaaaagggacatgcgccctcgctctgctctgctcttcccgcaaccgaggaataagcgtcttgggagcgtcaatacatgctggctttggccaagtcgaagctacctgagctgtgcttggatagtcagggcggctctgcgtccaactgtgccacttcttggccactctattctgctgcacaggtagagtcccccctccagaccctcctggaggtcaatcctatacttagccctcctgcagggaagtgcgcctttacagtgcc

SEQ ID NO: 70114 - DNA, 562 bp, Homo sapiens
  misc_feature 1..562: note = chr10:101088914-101089476
  misc_feature 1..562: note = hyper
  source 1..562: mol_type = genomic DNA
accgaagtgtgtacccgctacgcacagtgcggtgatgcctggccacctccagcctccagcggggacctcctgcccaggtggagtctgaatgcccaccgccaccagcccacgcgcgcagtgggcgtacacgtggtgacctgcctgcggctgggttcccagctccggctcctcctccctccagctctcgctcggcttcctgcagtatcacgtgcagctgcgctgggtgcaggatggcggcggccgcggcggcggcagcagcggtgggtgtcaggctccgggactgctgcagccgaggcgctgtgctcctgctcttcttttccctgtctcctcggcccccggccgccgccgcctggctgctgggcctgcggcccgaggacactgctggaggccgcgtgtccctggaggggggcaccctgcgcgccgccgaaggcaccagcttcctcctgcgtgtctatttccagccaggaccgccggccaccgccgcaccggtgccctcaccgaccctcaactcgggggagaatggcaccggcgactgggctccgcggctcgtgttcatcgagga

SEQ ID NO: 70115 - DNA, 561 bp, Homo sapiens
  misc_feature 1..561: note = chr10:101089801-101090362
  misc_feature 1..561: note = hyper
  source 1..561: mol_type = genomic DNA
ccccctgcgtggctgcgggcgctcggggcgctcctgctgctagccttgtcggccctgttcagcggcctgcgcctgagcctgctgtcgctggacccggtggagttacgggtgctgcggaacagcggctcggccgccgagcaggagcaggcgcgccgcgtgcaggccgttcgcggcagggggacccatctgctctgcaccctactcctgggccaagccggagccaacgcggccctggctggctggctgtacacctcgctgccgccgggcttcgggggcaccggggaagactacagcgaagaggggatccacttcccgtggctgccggcgctcgtgtgcaccggcgcggtattcctgggcgccgaaatctgcccctactcagtgtgttcgcggcacgggctggccatcgcctcgcacagcgtgtgcctgacccggcttctgatggcagccgccttccccgtgtgctacccgctgggccgcctgctggactgggcgctgcgccaggagataagcaccttctacacgcgggagaagttgctggagacgttgcgggccgcagacccc

SEQ ID NO: 70116 - DNA, 313 bp, Homo sapiens
  misc_feature 1..313: note = chr10:101280172-101280485
  misc_feature 1..313: note = hyper
  source 1..313: mol_type = genomic DNA
ctggcgggcgagcaccgttcccacataaatcaccagcgccagagtctcgggaaaaggcgcatttttcattgctggctgcagggcgactccagaccgcgaacgagaaacagaagttgtctttagataaaccgttcaccggagcgcgcgttgtggcagcagggtccgcagagcacagggcaacctgggtctggcgctgcgcccccgccaccgatcacctcccagaggccccgcaagaaacccagatcctctcaagggctggtaccacgtcctcctgccagagaggagatagggagccaagcgggaaggaaaagga

SEQ ID NO: 70117 - DNA, 312 bp, Homo sapiens
  misc_feature 1..312: note = chr10:101283181-101283493
  misc_feature 1..312: note = hyper
  source 1..312: mol_type = genomic DNA
atactgaatagaaagcgaaggacggaggtagggagaaaggaaactgctctggggggcggaggtgggggtacacgtaggagggaaggggagggggctagaggaggctccgccccaccgtccggcagtgtttattttcaaggcagcttcccgtcaatcctgtcaccggggcacattcttttcgggggctgtgaaccaccgtcagggctctgcaggaagatttgaggagggggagggctgtcgagtagggagcaggaattcgcagagtagagagaactgcgtctgggcaggcagtccctgcgtggcgcgggggaa

SEQ ID NO: 70118 - DNA, 44 bp, Homo sapiens; identical to SEQ ID NO: 33226
  misc_feature 1..44: note = chr10:101290117-101290161
  misc_feature 1..44: note = hyper
  source 1..44: mol_type = genomic DNA

SEQ ID NO: 70119 - DNA, 520 bp, Homo sapiens; identical to SEQ ID NO: 33227
  misc_feature 1..520: note = chr10:101290179-101290699
  misc_feature 1..520: note = hyper
  source 1..520: mol_type = genomic DNA

SEQ ID NO: 70120 - DNA, 443 bp, Homo sapiens; identical to SEQ ID NO: 910
  misc_feature 1..443: note = chr10:101290700-101291143
  misc_feature 1..443: note = hyper
  source 1..443: mol_type = genomic DNA

SEQ ID NO: 70121 - DNA, 27 bp, Homo sapiens
  misc_feature 1..27: note = chr10:101291230-101291257
  misc_feature 1..27: note = hyper
  source 1..27: mol_type = genomic DNA
cgccatcctgaccgccaaaaaatgctt

SEQ ID NO: 70122 - DNA, 1639 bp, Homo sapiens
  misc_feature 1..1639: note = chr10:101292333-101293972
  misc_feature 1..1639: note = hyper
  source 1..1639: mol_type = genomic DNA
gaagttttcctgccccgcgcagcagctgaaaaaaacacactcctggggcatccttccctggcgttggttcgtggacagcaagcctcccagaactggcctaggtcgggaaggtgcagccacgcgggaatcaatggttcaggaaccggatctgtgcagcctcgcccgcagcgtctcggacttcaggactctatactagtccttgtctatttctggtagagccgcaacatcccactcgcagagagcagggggcgtggcccacatgagccagaacctatagggagggaggttggggcgccagccccgcccccccaacgtgacgcaaatctcccggacagaggcttaggagcccgggccccagtccctgcagtggctgtaacaaaacccagacccccaggtcccggccaatggaggcgatttagactggagtgggaccgcgtctgtcaaaagcccgactcggcagcagcggcggagtccaggaggagagctggagccgccgcgctgcctccccgcccccgccgggatttattatttggactggacaattaagtggccctgatgatgttaccaagcccggtcacctccacccctttctcagtcaaagacattttgaatctggagcagcagcaccagcacttccatggtgcgcacttgcaggcggacttggagcaccacttccactctgcgccctgcatgctggccgccgctgaggggacgcaattttctgacggaggggaggaggacgaggaagacgagggcgagaaattgtcctatttgaactcactagccgcagcagacggccacggggattcagggctgtgtccccagggctatgtccacacggtcctgcgagactcgtgcagcgagcccaaggaacatgaagaggagcccgaggtcgtgagggaccggagccaaagtgagtagagggggaaagaaaacgcacccgcacacctggagcaatggcagagcgcacacaaacagcccacagaccttgccagcgcagctgcccatccctttaccctttggctggggccatgcctccgccctggtcaccgacagctccacaaagcgcaggtacctgcaagggagccggggtggagagacaaggacgaggtgaccctgacaactactccccccaaaagggggaaatgagggaagggaaggtggttactgctgccctgatgctgagaggcgacgtgggctcagcgcctgggtcctcataactggcagtatttttgctcttccccccgccccaaaaggctcttcccccaaaaagggcaggagcctggacctttttcgttttccctctagggtgagatgagttctcttagcccagggcagccaccccttcttctccgaaaagacagcccaagcagcctgtgtctctcgcacccgcaggggcaggaactttggtggaggccagctgggcggtttcctcccttctctgcttggagctcagcgtccttgaacccgtggcactcggtagagagagaggagatgatcggaaagtgcgtgggaacaatgtctattccgcgcgaccatagctctcacatccctaaggcgccagccttttttgaaaatccgtaacgttttgctttgtgtcccaggctgcgggcctaatagaaaacgcgccgaacttgag

SEQ ID NO: 70123 - DNA, 872 bp, Homo sapiens
  misc_feature 1..872: note = chr10:101294528-101295400
  misc_feature 1..872: note = hyper
  source 1..872: mol_type = genomic DNA
cacgaaacgcgcctccgcctgctaagggcgttctttgggtactggggctgtctcagggtcccacagcgccaggagccacaaacgttcccaaaagtccagccatttactaccgcacgctctgcgcagccaccaaaaagggtcacggtgctccaggacaggagccgcggtgcggccgggaacagctaaggacgctgttgtttgcttcttccgcagaaagctgccagctgaagaagtctctagagacggccggagactgcaaggcggcggaggagagcgagaggccgaagccacgcagccgccggaagccccgggtcctcttctcgcaagcccaggtcttcgagctggaacgcaggttcaagcagcagcggtacctgtcggcacccgagcgcgagcacctcgccagcagcctgaagctcacatccactcaggtgaaaatctggttccagaatcgcaggtacaagtgcaagagacagcggcaggacaagtctctggagcttggcgcacacgcgcccccgccgccgccgcgccgcgtggctgtcccggtgctggtgcgggacggcaagccgtgcgtcacgcccagcgcgcaggcctacggcgcgccctacagcgtgggcgccagcgcctactcctacaacagcttccccgcctacggctatgggaactcggccgcggccgccgccgccgccgccgccgccgccgcagcagcggcggcctacagcagcagctatggctgtgcgtacccggcgggcggcggcggcggcggcggcgggacctccgcggcgaccactgccatgcagcccgcctgcagcgcggccggaggcggcccctttgtgaacgtgagcaacctaggaggcttcggcagcggcggcagc

SEQ ID NO: 70124 - DNA, 202 bp, Homo sapiens
  misc_feature 1..202: note = chr10:101295401-101295603
  misc_feature 1..202: note = hyper
  source 1..202: mol_type = genomic DNA
cacagccgttgcaccagggtactgcagccggggccgcgtgcgctcagggcaccttgcagggcatccgggcctggtagggacggggcgggtcacgcggcgggcaccccagcgcagcctggcgccgcgggactgaagctcgagaagggcctgacctaaaggtcaggtcccctcgttaaaaaaatatgtacgtctagctcctcag

SEQ ID NO: 70125 - DNA, 153 bp, Homo sapiens
  misc_feature 1..153: note = chr10:101296564-101296717
  misc_feature 1..153: note = hyper
  source 1..153: mol_type = genomic DNA
agctgtatagacctgcgttcggtcaagtcttgcactctgccccacctcgagggtcgccagggaaaaggaagcctcgctcgcagtcccagctgttggccgcgcgaaggcggctccttccctggctgcagccagggctaccaacgcgcccggggg

SEQ ID NO: 70126 - DNA, 63 bp, Homo sapiens
  misc_feature 1..63: note = chr10:101296737-101296800
  misc_feature 1..63: note = hyper
  source 1..63: mol_type = genomic DNA
cggccgagctctcccccttggccgccctcccttctcccccggcggccgcggctttatgcggct

SEQ ID NO: 70127 - DNA, 66 bp, Homo sapiens
  misc_feature 1..66: note = chr10:101297064-101297130
  misc_feature 1..66: note = hyper
  source 1..66: mol_type = genomic DNA
cattgcttctcagagcgggggctttgtgcagcagtctgctcaacagagggacggagaaatgtgcgg

SEQ ID NO: 70128 - DNA, 30 bp, Homo sapiens
  misc_feature 1..30: note = chr10:101297437-101297467
  misc_feature 1..30: note = hyper
  source 1..30: mol_type = genomic DNA
ccgaagccctctgaccgcccaggatgcgac

SEQ ID NO: 70129 - DNA, 499 bp, Homo sapiens
  misc_feature 1..499: note = chr10:101300095-101300594
  misc_feature 1..499: note = hyper
  source 1..499: mol_type = genomic DNA
gggcgcggggggggtcgtgggaaacagggcggcacaaggaccgaaaaccccagctccgcgggcgcgtgtcaccacagagatccggcagagccattgcgggtaaacctgggacaggtggcgcccggcggggtctgcagggctttgatttcggctgcatctgggacattcgacagaaggggaaggtggaaggacgtttcctgggggaggttcgagtcctctctagcccaccactgcagggaggaaagggtaaggagtggaaacccggcccctctccgcggggcttctcccgggcccgcgcgcgccgccggagtgacttggggccgcgcctctgccagggtggggccgggtgggcaggggcttccctggagactcgcgcgggagaccgggaggtccaaggccccagtcgcagccgcccagttcctcgctttctggttcaggacgccagtggggacttcccgggcgcctcctcccaactccaggggcccgagccctggaagga

SEQ ID NO: 70130 - DNA, 30 bp, Homo sapiens
  misc_feature 1..30: note = chr10:101363437-101363467
  misc_feature 1..30: note = hypo
  source 1..30: mol_type = genomic DNA
aggcgtgagccaccacgcctggccgagaaa

SEQ ID NO: 70131 - DNA, 23 bp, Homo sapiens
  misc_feature 1..23: note = chr10:101493051-101493074
  misc_feature 1..23: note = hypo
  source 1..23: mol_type = genomic DNA
cgagactccgtctcaaaaaaata

SEQ ID NO: 70132 - DNA, 30 bp, Homo sapiens
  misc_feature 1..30: note = chr10:101780649-101780679
  misc_feature 1..30: note = hypo
  source 1..30: mol_type = genomic DNA
gcccctgcctgatcccgggccccaagagga

SEQ ID NO: 70133 - DNA, 175 bp, Homo sapiens
  misc_feature 1..175: note = chr10:101874977-101875152
  misc_feature 1..175: note = hyper
  source 1..175: mol_type = genomic DNA
ctgcggcgggcgccccggacccggccgggttcggacgacagctgcacggccgcgcctcggcccctgaacttttgcctgcaccggggccgccccgcaccccccgccaacccccagccccggcccggctgccgtcggggcgatgaggtcacccgcccttgcacgatatctgttgatt

SEQ ID NO: 70134 - DNA, 77 bp, Homo sapiens
  misc_feature 1..77: note = chr10:101988087-101988164
  misc_feature 1..77: note = hypo
  source 1..77: mol_type = genomic DNA
gttcacagcttttatcggtatatcaaaaaatacatgtcccaggcctggtgccgtggctcacgcctataatctctgca

SEQ ID NO: 70135 - DNA, 16 bp, Homo sapiens
  misc_feature 1..16: note = chr10:101988404-101988420
  misc_feature 1..16: note = hypo
  source 1..16: mol_type = genomic DNA
ccgtctcaaaaacaaa

SEQ ID NO: 70136 - DNA, 30 bp, Homo sapiens
  misc_feature 1..30: note = chr10:102282456-102282486
  misc_feature 1..30: note = hypo
  source 1..30: mol_type = genomic DNA
ggaatattcttataacggaaataagatcag

SEQ ID NO: 70137 - DNA, 270 bp, Homo sapiens
  misc_feature 1..270: note = chr10:102322032-102322302
  misc_feature 1..270: note = hyper
  source 1..270: mol_type = genomic DNA
tgggtggcaagaagacgcctgtggtgtggaagaacctcgcccgcagcccagcacgtgtagaatccagatgtggcttctgctggagccacgtgttccggcctgagcgacgtcgcacgtggcctcctggccgcagagcccatggcgcggggggccactcttctgacgcaagggtctgtggggccgcgcaagagcctggggcccccgaccttccgccgactggccgtgggctggccgcagcccagctcggctctgtctcgagttccttcgctg

SEQ ID NO: 70138 - DNA, 33 bp, Homo sapiens
  misc_feature 1..33: note = chr10:102332594-102332627
  misc_feature 1..33: note = hypo
  source 1..33: mol_type = genomic DNA
agatgtgcttttgaacgacgctggcttaagtgc

SEQ ID NO: 70139 - DNA, 64 bp, Homo sapiens
  misc_feature 1..64: note = chr10:102413884-102413948
  misc_feature 1..64: note = hyper
  source 1..64: mol_type = genomic DNA
ccttgatgaatgagccgcccggcccggccccgtccgtcaccgtcaccctcgcctcggcccgggc

SEQ ID NO: 70140 - DNA, 528 bp, Homo sapiens
  misc_feature 1..528: note = chr10:102414410-102414938
  misc_feature 1..528: note = hyper
  source 1..528: mol_type = genomic DNA
tgcataagattaagccgaggctctcagctgcgcagcgactcccctccggttcccatgttgtcgaggcatgctgggagtacaagttccgagcgcacggccaggtgaacgcgccgccgccgccgtcgccgcgcgactccccaccccccctagccccctcccgcgggtcccgactggcccaccccggcgggactggtgacgccggcgcggcctgcgcctcccggaaacccaggcagatagcccgggtggaagcggcccggccctggggtcaccatcgcccctcaccccggggttcgacggcggccctggacgtccccgggcccccgtcttcctcctgggccttctctctagtccctggcagctgggagcggccctcccgcccctgcactccttcctgtcgcgctgtggttctgccctctggttgtcgctcccctagccctcccctctttctctctgcagtgtttcttggggctgttgtctttctgtctgtcactctgcgtctcggtctctctggagtccttctgcctctgt

SEQ ID NO: 70141 - DNA, 594 bp, Homo sapiens
  misc_feature 1..594: note = chr10:102415092-102415686
  misc_feature 1..594: note = hyper
  source 1..594: mol_type = genomic DNA
cgcactgcagcgcggcaccagcagtctatgacaaaaacattatccttctgctgctaaacaatccaataaacctctccacagggagaaagttaacctcttgtctcttcggctgatgccttcccgcccacgtgactgctgccacagtaaattcaaatcattagtctcctcaccccatcaaaaaacttctattagtaatggagacctcgccggagaccttccgcggagagcgctgccttcccaattcccagtggaaaaattctgcgcgaaaaactaattctacttttaataatctgtcatcaggaccagaggcagtcataaattatatgggagcgcgtgcgagagcgcgccacaagagggaaatcagggcgaaaaatcaaagcccaagtttgacaaactttcctgaagataaataataacttacaaacaggattagttgtaaagtcacgctccggcgcgcagccaccgcggcaatcacgtctgccgagggccgccaccgcgaggcacctgtcaccggccgccaccgcttccgagccttcctcctcgtcctcctccttgcctgcctcccctcctcctcttcctcgccctccagccttc

SEQ ID NO: 70142 - DNA, 135 bp, Homo sapiens; identical to SEQ ID NO: 33243
  misc_feature 1..135: note = chr10:102419132-102419267
  misc_feature 1..135: note = hyper
  source 1..135: mol_type = genomic DNA

SEQ ID NO: 70143 - DNA, 448 bp, Homo sapiens; identical to SEQ ID NO: 10431
  misc_feature 1..448: note = chr10:102419399-102419847
  misc_feature 1..448: note = hyper
  source 1..448: mol_type = genomic DNA

SEQ ID NO: 70144 - DNA, 468 bp, Homo sapiens
  misc_feature 1..468: note = chr10:102430682-102431150
  misc_feature 1..468: note = hyper
  source 1..468: mol_type = genomic DNA
tactcctgacaggatcgccgggggcacggctgcgagataaccattagcgcagccgccgataaagcggggaggctgcatttccaaaggctccgcggccattacgggaaagttagtgtgaaacatgttaaattatccccaaagtggagggagcgggggaggcggcgggggagcgggcgcccgagagagccacgagacccgccgcctccgccggggccgggtgactgcgccgtgcccgacacgccgacgtccaccagggggcggccgcgtgcggcccgagcctcggtctgcgggtccggaggatgggctggcggcccgagccttcctcgcacctgcgggcgcggacccacccgaggccgccggctccggctccggctccctgcctggcccctctgcccagcaggagcagcccggcacccccggagagcgatagagaggcgggggcctgggtggggtcgccaagatcagccc

SEQ ID NO: 70145 - DNA, 163 bp, Homo sapiens
  misc_feature 1..163: note = chr10:102440854-102441017
  misc_feature 1..163: note = hyper
  source 1..163: mol_type = genomic DNA
gcggagacaattactcggatacgctccggctggccttcccgaggccccaggtcatttcagatctgggccccggtccttgggcagaagctgggccgagaagatctggagccggtgcctcagtttcccggatttccgcgagggaggaccgcggaaatcgccacag

SEQ ID NO: 70146 - DNA, 238 bp, Homo sapiens
  misc_feature 1..238: note = chr10:102470039-102470277
  misc_feature 1..238: note = hyper
  source 1..238: mol_type = genomic DNA
gcgcctgatgggaagcgacagctccgccccgcctccctccactcctgccctcccgcggctcctcccgggcgccgcgtcccgcgctcctgctgccagcccagccggcctggggcgccctagccgctggtcctggcccaacaagtagccaccgacccctcccatgtggcctaggacgggaggagcttctgcccggcagttgggggtgacaaggatggggtaaagaggggcgccgggcagg

SEQ ID NO: 70147 - DNA, 107 bp, Homo sapiens
  misc_feature 1..107: note = chr10:102470339-102470446
  misc_feature 1..107: note = hyper
  source 1..107: mol_type = genomic DNA
cgtgttgacatagaaatcagactggaaagaaagcaacatgtagaggggcttccccgggtgtgaggtgacaggtgggttttcctgtctttttgcggatctgtgtctcc

SEQ ID NO: 70148 - DNA, 433 bp, Homo sapiens
  misc_feature 1..433: note = chr10:102473283-102473716
  misc_feature 1..433: note = hyper
  source 1..433: mol_type = genomic DNA
tagaggcgggaactccggatgagaaagagacgagggggccaggatcccagggctggcagcgacaggaaggatgggaagaggtccgcaggcccgacgggtgcgggccagcctggccgcgcagggggagctgggagctgggtgggcggggtggggcggacgccaccaggcgtggcgcggggaacagagcagaatgaaatgcagatgcaaaacgtgctcataagagtttcctctctctccccatctgccaaagccgagattttaatctttaatccatgagcaatcagcgagcagcggcgaatggcacattacagatgttttactgtcgcgggcgctcgcagctttcgcgctcggcacaggcgcgccgggcgcccccgctccgcccgccccctcttctccccctctggttcttcttcctctcccctccccaggtccc

SEQ ID NO: 70149 - DNA, 250 bp, Homo sapiens; identical to SEQ ID NO: 10436
  misc_feature 1..250: note = chr10:102473759-102474009
  misc_feature 1..250: note = hyper
  source 1..250: mol_type = genomic DNA

SEQ ID NO: 70150 - DNA, 148 bp, Homo sapiens
  misc_feature 1..148: note = chr10:102475261-102475409
  misc_feature 1..148: note = hyper
  source 1..148: mol_type = genomic DNA
gagagagtgaatggccgcgtcagccgcaaagaggcccagacagatggacgcaggcaggaagacggacaggagagagagagagacaacgtgcgcccgaggctgaagagctgggtcaagaagagattcggcttccgggagcaggggcgtc

SEQ ID NO: 70151 - DNA, 23 bp, Homo sapiens
  misc_feature 1..23: note = chr10:102475555-102475578
  misc_feature 1..23: note = hyper
  source 1..23: mol_type = genomic DNA
ggagcgagaggcagcggagccgc

SEQ ID NO: 70152 - DNA, 381 bp, Homo sapiens
  misc_feature 1..381: note = chr10:102475579-102475960
  misc_feature 1..381: note = hyper
  source 1..381: mol_type = genomic DNA
tgtgtgtttttattattattatttctgattaaagaggaattcatctcgtatctgcctcctgccaggggccgaggctccgccattggggttaacggtgcggaagaatacaaaaaaatttcattgaggaggattataaaagttactagctggaacattaacagaagagtaacttgtaaaaaatgcaatattacaatattcacaaggacggcagagcgtggtaaagctataaaattcaacattaaaaccttccacagcctagataacctagttaacaaacatgggattggaactacttttctgtggagacaggaatacgcgccggggctggtcacacctcttccgcgggaggggcggggtcggcggccacggcctagccgcgcc

SEQ ID NO: 70153 - DNA, 46 bp, Homo sapiens; identical to SEQ ID NO: 33253
  misc_feature 1..46: note = chr10:102483750-102483796
  misc_feature 1..46: note = hyper
  source 1..46: mol_type = genomic DNA

SEQ ID NO: 70154 - DNA, 362 bp, Homo sapiens; identical to SEQ ID NO: 33254
  misc_feature 1..362: note = chr10:102483870-102484232
  misc_feature 1..362: note = hyper
  source 1..362: mol_type = genomic DNA

SEQ ID NO: 70155 - DNA, 13 bp, Homo sapiens
  misc_feature 1..13: note = chr10:102484233-102484246
  misc_feature 1..13: note = hyper
  source 1..13: mol_type = genomic DNA
ggccgcgggctag

SEQ ID NO: 70156 - DNA, 285 bp, Homo sapiens; identical to SEQ ID NO: 33256
  misc_feature 1..285: note = chr10:102484269-102484554
  misc_feature 1..285: note = hyper
  source 1..285: mol_type = genomic DNA

SEQ ID NO: 70157 - DNA, 30 bp, Homo sapiens; identical to SEQ ID NO: 33257
  misc_feature 1..30: note = chr10:102489083-102489113
  misc_feature 1..30: note = hyper
  source 1..30: mol_type = genomic DNA

SEQ ID NO: 70158 - DNA, 336 bp, Homo sapiens; identical to SEQ ID NO: 33258
  misc_feature 1..336: note = chr10:102489328-102489664
  misc_feature 1..336: note = hyper
  source 1..336: mol_type = genomic DNA

SEQ ID NO: 70159 - DNA, 164 bp, Homo sapiens; identical to SEQ ID NO: 33259
  misc_feature 1..164: note = chr10:102489700-102489864
  misc_feature 1..164: note = hyper
  source 1..164: mol_type = genomic DNA

SEQ ID NO: 70160 - DNA, 67 bp, Homo sapiens
  misc_feature 1..67: note = chr10:102490249-102490316
  misc_feature 1..67: note = hyper
  source 1..67: mol_type = genomic DNA
tctttctcactttttcgttctcccggcggccaccgtctggcgggcttgggtccggctcccccgccgc

SEQ ID NO: 70161 - DNA, 69 bp, Homo sapiens
  misc_feature 1..69: note = chr10:102490646-102490715
  misc_feature 1..69: note = hyper
  source 1..69: mol_type = genomic DNA
ggactcagattagcacgcaaacagtgagatgctcggcttgagtctacgcgcgggcgaagatgcctctgt

SEQ ID NO: 70162 - DNA, 113 bp, Homo sapiens
  misc_feature 1..113: note = chr10:102495028-102495141
  misc_feature 1..113: note = hyper
  source 1..113: mol_type = genomic DNA
aagttgggaagtaggcgagaagccaggctgtgggtctggaggggggcgtgtgacagtgaagaagagggggttgggtgagagggtgtgccggcgtctaggctgggctgcggtcc

SEQ ID NO: 70163 - DNA, 484 bp, Homo sapiens
  misc_feature 1..484: note = chr10:102495142-102495626
  misc_feature 1..484: note = hyper
  source 1..484: mol_type = genomic DNA
tgggcgcctcaggcagcgagggtggctgcttgcctgcggctggctggggcctcggtgcgtgtgcacgcgtgtgcgcggggcggagaacccgggctcctcggggtgccggagcctctgcgcggccgggagtgagagagcgggcgcgggcggagcacacagccgtggcggcgggcggctcgggttatctgagccgcttggtgttgggtggctgcgcccagatctccgggcggcggcggcggcgaaggcgagacgcgttgtcgggccgcggaggagcgggacagccagacccagccccaggacgcggcggccgcggggagcctagcatggaagagcgcgcgggtccggcaggtaagagcggcagagacccgtccgcgccgcaggcgaggactaggggagagggatgggggcggccatggccggggcgggctcctctcctctttcatccctgtgctcagtacccggcgggcgacgtgaaggctgggga

SEQ ID NO: 70164 - DNA, 27 bp, Homo sapiens
  misc_feature 1..27: note = chr10:102497149-102497176
  misc_feature 1..27: note = hyper
  source 1..27: mol_type = genomic DNA
cctgacgggttagggcggccgcttacc

SEQ ID NO: 70165 - DNA, 46 bp, Homo sapiens; identical to SEQ ID NO: 3599
  misc_feature 1..46: note = chr10:102497252-102497298
  misc_feature 1..46: note = hyper
  source 1..46: mol_type = genomic DNA

SEQ ID NO: 70166 - DNA, 510 bp, Homo sapiens; identical to SEQ ID NO: 33265
  misc_feature 1..510: note = chr10:102497299-102497809
  misc_feature 1..510: note = hyper
  source 1..510: mol_type = genomic DNA

SEQ ID NO: 70167 - DNA, 275 bp, Homo sapiens
  misc_feature 1..275: note = chr10:102498176-102498451
  misc_feature 1..275: note = hyper
  source 1..275: mol_type = genomic DNA
ctcccatctcagccccgcctggaacacagctgtctgcctatactaccttcgccaccccctggcactttttacacaccctcacaacactcaagcacactcctacgatcccctcatccagacgctcagcccccaaagagacacatcagaaattctccttaattgattcagaaattgaaaggggcttcctccctccatcagtttcttcaatgtattcgttatccgcgggtctagacctcccagcccgtctagacctagcggagcgaactcctggaacc

SEQ ID NO: 70168 - DNA, 41 bp, Homo sapiens
  misc_feature 1..41: note = chr10:102498723-102498764
  misc_feature 1..41: note = hyper
  source 1..41: mol_type = genomic DNA
ccttccccctttccccgagggcctaatccgtcgcgcgcgcg

SEQ ID NO: 70169 - DNA, 340 bp, Homo sapiens
  misc_feature 1..340: note = chr10:102498824-102499164
  misc_feature 1..340: note = hyper
  source 1..340: mol_type = genomic DNA
caactctcagcagcagccctagccccgacccgaggccccaagacggcgggccaggaacccctgggacgtcctggctccaggctggacgtaggcggaggtggcaggagtggacaaacccaggcgggtcccacgacgcccctttcctcgggtctctccttgtttcagccagccgctctcgcccctggtcccctctcccctgcgttcgggtcctttgtctccagccacctcgcagcctgtccccgcctcggcggccctgccctttgggcctcccagtctctctggcgggtccccctgccttaccagctcccggctgtggcgcgctctccgcctgctcctcaca

SEQ ID NO: 70170 - DNA, 39 bp, Homo sapiens; identical to SEQ ID NO: 33269
  misc_feature 1..39: note = chr10:102499518-102499557
  misc_feature 1..39: note = hyper
  source 1..39: mol_type = genomic DNA

SEQ ID NO: 70171 - DNA, 30 bp, Homo sapiens
  misc_feature 1..30: note = chr10:102500820-102500850
  misc_feature 1..30: note = hyper
  source 1..30: mol_type = genomic DNA
aagggctgggcaggtcgcaaagacctcttg

SEQ ID NO: 70172 - DNA, 174 bp, Homo sapiens; identical to SEQ ID NO: 33270
  misc_feature 1..174: note = chr10:102501247-102501421
  misc_feature 1..174: note = hyper
  source 1..174: mol_type = genomic DNA

SEQ ID NO: 70173 - DNA, 743 bp, Homo sapiens; identical to SEQ ID NO: 33271
  misc_feature 1..743: note = chr10:102501726-102502469
  misc_feature 1..743: note = hyper
  source 1..743: mol_type = genomic DNA

SEQ ID NO: 70174 - DNA, 739 bp, Homo sapiens
  misc_feature 1..739: note = chr10:102503828-102504567
  misc_feature 1..739: note = hyper
  source 1..739: mol_type = genomic DNA
ggcatcccaaaaacccgggtacaagacgcccagtagtagtagttaggctgagtcaggcaggtgcatctctccccatggtatctgccgcccaggctccggccagagggaggggagcgcgagtccgccgcgcttccgcggggcgcccggagctgcagacgggggctggaggaatctcggattcgggctgcaagagcgctgcgcaagcttcgccgagccgccctttcgcagacccagggaagcggggggagggagcgaaggagggagagagagttaaaacatcagctgaagtgccaagatgatttatgagacgagggaaaatatttcatgaagatctcccggatattctgtacttaaccagttaggagacaaagggcttcttctgcctggtgcgtgcgagcggaccccagcgagcaagggagctagtgccagagagagctgcggaggctccggcaggagtggggacgtccccgtggttgcgcctcctgcgctcgccccggatccaccgagctagcagcgggcggcgctcagccgcgtccgcagcctcctcttctccccagccggggagagccagcctcgtctcccacatcctctgccgccagcgacctgcagctccgcactgtttccctcccctgtacccccttcccagtcacccgagggttcagaaaccaagtcccccggctctcccgccatccgctgggtcccaccgaggcaggtgggtactcgccggaggtcttcagct

SEQ ID NO: 70175 - DNA, 42 bp, Homo sapiens
  misc_feature 1..42: note = chr10:102504907-102504949
  misc_feature 1..42: note = hyper
  source 1..42: mol_type = genomic DNA
agcccggcttcacagcgcagcgcgctccgaggccctctgtcg

SEQ ID NO: 70176 - DNA, 156 bp, Homo sapiens
  misc_feature 1..156: note = chr10:102505693-102505849
  misc_feature 1..156: note = hyper
  source 1..156: mol_type = genomic DNA
tggctgcagctgcagcgcgagccatgcgcccccagtgcaccccggcccggcccaccgccccggggccattctgctgaccgcccagccccgagccccgacagtggcaagttgcggctactgcagttgcaagctccggccaacccggaggagccccag

SEQ ID NO: 70177 - DNA, 43 bp, Homo sapiens; identical to SEQ ID NO: 33275
  misc_feature 1..43: note = chr10:102505873-102505916
  misc_feature 1..43: note = hyper
  source 1..43: mol_type = genomic DNA

SEQ ID NO: 70178 - DNA, 141 bp, Homo sapiens; identical to SEQ ID NO: 33276
  misc_feature 1..141: note = chr10:102507395-102507536
  misc_feature 1..141: note = hyper
  source 1..141: mol_type = genomic DNA

SEQ ID NO: 70179 - DNA, 226 bp, Homo sapiens
  misc_feature 1..226: note = chr10:102507767-102507993
  misc_feature 1..226: note = hyper
  source 1..226: mol_type = genomic DNA
ggtggactggtgggtgagacaccgcagcccgagtcggtgctggcggccgtggcgcattccaggcccgactcagcgccgactcgctgcagtcccccagccctggactcccgccgtgtccccttcccatccccaccccttagactggggctgaggggccgggccctgagcccggggaggctgaattattcatctttaatctgcccgcagctgccgccttttcataccg

SEQ ID NO: 70180 - DNA, 10 bp, Homo sapiens
  misc_feature 1..10: note = chr10:102508280-102508290
  misc_feature 1..10: note = hyper
  source 1..10: mol_type = genomic DNA
cagtccgggc

SEQ ID NO: 70181 - DNA, 1298 bp, Homo sapiens
  misc_feature 1..1298: note = chr10:102508341-102509639
  misc_feature 1..1298: note = hyper
  source 1..1298: mol_type = genomic DNA
cggctacgggttgatcgctctgggtgcaggatttctagactgctgtaggccagggagaatggggcacaggaagcaccctcaggcctggcacccagtggccgcctcggttccgagatcgggagcccgcgctggagccgggttggaaaccccgtgcccttctcttggccgaaagagcaaaagcccgagccgctcggtttcctgggggggctgccgaggtctgaggggtcaaagggactcgagtcgggtttgggtcggctacacagggcgccccgagagttattaactcgccagcgaggcctatgccgtgccacctgggcgagacggtgggccccaaccaggctctgcgaggcgcggcaggcaggcgagcccaagcagccggcattctctgcctgctgcctggagccgctctgcctccctgtctctgagcgcagcagaccccgggcccctgcctcatccgccttccttgctctacttcagatactaaggaggtgaaagagagatacggtccccctacagataaataacattagaaaaacttcccatcaaaaacaaacaacacaggaaagaggtagaaaaattccgattacaatttaatactttttaaagaagaggcagagagcaaaggggggtgtgtgtgtcaggcacttatcccctgtctgtgctaggagctcggataaacagtcagccgagcctcgacgcccccaaatcgtccgcctccaagccccgcacgcgcggacagctcccgggttgcctgcggcgcaggcgggatgctgcttcgcactagtccagtcctctgccaggcccttcctctcctcgctttcttacgccctttccgctggcatgaattcccctttggcattttctcccctctcccctcttttctgtcatctggtttctctccagtcccccctttgctttctaccttgcgtcgcaaggcctgagtcgccctctcgcccagcccccagtcttcagcccagcgtctgtgcttccagtccccactcctccgcgtggtcgtggaggtccaccacctttcttctcaagctcgggaacatgcccttccgccctgcctgcttccttcgcccgtcccgggccgcggaccctgactaatggccggtccctgctgtgtgtggggtgttgtgtttttttcttgtctctccccagcagggcacgggggtgtgaaccagctcgggggggtgtttgtgaacggccggcccctacccgacgtggtgaggcagcgcatcgtggagctggcccaccagggtgtgcggccctgtgacatctcccggcagctgcgggtc

SEQ ID NO: 70182 - DNA, 38 bp, Homo sapiens
  misc_feature 1..38: note = chr10:102585759-102585797
  misc_feature 1..38: note = hyper
  source 1..38: mol_type = genomic DNA
gagccgcagagagctcgtggtgtcgaggggggagtcgt

SEQ ID NO: 70183 - DNA, 352 bp, Homo sapiens
  misc_feature 1..352: note = chr10:102586054-102586406
  misc_feature 1..352: note = hyper
  source 1..352: mol_type = genomic DNA
acacaggagaaagggcgagggggaaacctggaggcctggcctttctcccgcagagggagggaggtagcttccgacgacggctcccaacccacgggccctccgctcaccgctagcggaccagcgggcagtccacctgcgccgcctccatcccctgccgcgtagcccacgcatccaacctcttgagggaaaggcgggagggcggtgtctcccaaaagagctcccacctcttgtgttggcactgcacattgatgccattcttaggactttctgggagaaaaatgtcccgaaggcctttcttcgccaccgccccccactcccatttccacccattaggggccatgcctcctagaac

SEQ ID NO: 70184 - DNA, 175 bp, Homo sapiens
  misc_feature 1..175: note = chr10:102588252-102588427
  misc_feature 1..175: note = hyper
  source 1..175: mol_type = genomic DNA
tcgcctgtcccttgacgccctgcatcctcctccctgactcgcagccccatcggacgctctcccgggaccgccgcaggaccagtttccatagactgcggactggggtcttcctccagcagttacttgatgccccctcccccgacacagactctcaatctgccggtggtaagaaccg

SEQ ID NO: 70185 - DNA, 1207 bp, Homo sapiens
  misc_feature 1..1207: note = chr10:102589250-102590457
  misc_feature 1..1207: note = hyper
  source 1..1207: mol_type = genomic DNA
gccctgcatgtctcctcacccgtggatcgtgacgactcgaaataacagaaacaaagtcaataaagtgaaaataaataaaaatccttgaacaaatccgaaaaggcttggagtcctcgcccagatctctctcccctgcgagccctttttatttgagaaggaaaaagagaaaagagaatcgtttaagggaacccggcgcccagccaggctccagtggcccgaacggggcggcgagggcggcgagggcgccgaggtccggcccatcccagtcctgtggggctggccgggcagagaccccggacccaggcccaggcctaacctgctaaatgtccccggacggttctggtctcctcggccactttcagtgcgtcggttcgttttgattctttttcttttgtgcacataagaaataaataataataataaataaagaataaaattttgtatgtcactccccatggctccaagtttgtctctccctgtctctgagatgggcctcccctccattggtcgatccccaaaagccccttcaatgatcctcccaactacactcccgctgccacctccaactcctttgccgagacccccttggcggcagctgaaccacggcgaaggccgagactagcctgccctttagtagccaccctcccccacgcaccccggccctggggacaggaagttcttactctccgaaacttcagaataactcctagttaggcgcctatactaggccaactctgtggtcctaccagtacacccgcacccagatttagggtgctggctctcagaacccgaagtctgaggccttctccacgtgggtggaggggtggtcgtctgtcctatctcctccctccgttccctatccagtgcagttgcgcgtgggcgcagcagcaattttatccccgaagtctgcaatgaaacgcgaagaccgcagacgcttgccgcaagtttcctcgctctgcgtttacttctgggcccgaagaatgccccgcagaggccctaggagctggttcatgggacttcacgcgcctccagtgtcttgcggagccccagccccagcaagcagcggctgaaattggtgcgccttgtgctgtggtctgggtgtgtcccggagagggcgcgcaggcgcctatgtctgtcgcggggcggtcggcgggttcctgcataggtatggctttctgttcatctatgtgttcgtctgtatgtccct

SEQ ID NO: 70186 - DNA, 149 bp, Homo sapiens
  misc_feature 1..149: note = chr10:102890870-102891019
  misc_feature 1..149: note = hyper
  source 1..149: mol_type = genomic DNA
ccgagtcttggtctccgtccctctatctctggctcctgcatctgtctcggcttctggccttcctctccccctcccctcccctccctcgcgctgtcattcaccccgctcctctccgcgcacagccaatggagagacccagtcgaaaccgc

SEQ ID NO: 70187 - DNA, 936 bp, Homo sapiens; identical to SEQ ID NO: 33284
  misc_feature 1..936: note = chr10:102891020-102891956
  misc_feature 1..936: note = hyper
  source 1..936: mol_type = genomic DNA

SEQ ID NO: 70188 - DNA, 159 bp, Homo sapiens; identical to SEQ ID NO: 33285
  misc_feature 1..159: note = chr10:102892090-102892249
  misc_feature 1..159: note = hyper
  source 1..159: mol_type = genomic DNA

SEQ ID NO: 70189 - DNA, 369 bp, Homo sapiens; identical to SEQ ID NO: 915
  misc_feature 1..369: note = chr10:102893583-102893952
  misc_feature 1..369: note = hyper
  source 1..369: mol_type = genomic DNA

SEQ ID NO: 70190 - DNA, 1199 bp, Homo sapiens; identical to SEQ ID NO: 33287
  misc_feature 1..1199: note = chr10:102894090-102895289
  misc_feature 1..1199: note = hyper
  source 1..1199: mol_type = genomic DNA

SEQ ID NO: 70191 - DNA, 716 bp, Homo sapiens; identical to SEQ ID NO: 33288
  misc_feature 1..716: note = chr10:102899140-102899856
  misc_feature 1..716: note = hyper
  source 1..716: mol_type = genomic DNA

SEQ ID NO: 70192 - DNA, 434 bp, Homo sapiens
  misc_feature 1..434: note = chr10:102900262-102900696
  misc_feature 1..434: note = hyper
  source 1..434: mol_type = genomic DNA
ggaggctggaggggaggggggctgcgagggtcacagtcaaggccaactactcacaacagaaagctcgaaactctccctctacctcccctgccggaaatgacccgtctctgttcaaaaatagaaaaagaacgatcggaataattgttcgcagaggtgccgggagagaaggggaattaacaaacctgcctgcgcggagaggtctgcttccttctttggcttcagaaccgacggcaatcaccaaattcctgcggccagcgagccctgcccctcagatctggccctctggttgagtgggtggcggcctgaggggccccaggaacccaggcagggatggggtcctagaggccctgtgcagtgcggtgggtggcacacagagaatctggctcaacctgttaactataatagcggctttgtgtggccgcatctgtgcttgg

SEQ ID NO: 70193 - DNA, 119 bp, Homo sapiens
  misc_feature 1..119: note = chr10:102905699-102905818
  misc_feature 1..119: note = hyper
  source 1..119: mol_type = genomic DNA
ccacaaggacttgtccgggccgggccgggctagatgccgagatgtaattcaccagatttgtgaaaagacgagaaatctgctctcattttgaagcgcagccccgccggcatccaggaggc

SEQ ID NO: 70194 - DNA, 138 bp, Homo sapiens
  misc_feature 1..138: note = chr10:102906332-102906470
  misc_feature 1..138: note = hyper
  source 1..138: mol_type = genomic DNA
accccttgcttttcccgacgggctcccggagtctcatttctagaatgaggtgggagacctcgtgactacgcggaggccgccccagggctccgagggcaccgcacagggcaccaggcccttcccagctcaacccgggcc

SEQ ID NO: 70195 - DNA, 57 bp, Homo sapiens
  misc_feature 1..57: note = chr10:102906524-102906581
  misc_feature 1..57: note = hyper
  source 1..57: mol_type = genomic DNA
cgctgggctgaagccgacccggcaccgcgcggcgcccggatccggagctgccagcag

SEQ ID NO: 70196 - DNA, 191 bp, Homo sapiens; identical to SEQ ID NO: 33291
  misc_feature 1..191: note = chr10:102975143-102975334
  misc_feature 1..191: note = hyper
  source 1..191: mol_type = genomic DNA

SEQ ID NO: 70197 - DNA, 325 bp, Homo sapiens
  misc_feature 1..325: note = chr10:102975555-102975880
  misc_feature 1..325: note = hyper
  source 1..325: mol_type = genomic DNA
tggctgcactgccaccgcgcaggcatggatcctgcctggccgccgtctgggaactcgagatccgaggaggggcaaaagccgccggcgccggggtcaggcctggtggacccgagctccttggtgagacctggacccaccgtcttctccttcaaaagcacagggtggcagcggggaaaggatacgttcccattgaaggggcgatggaaaactggaatcagagactgaaggaggcggggcatgggaccccggaagatgcctcccagacgttccaggcctgcttgcccggctccggaggtcttagcagcatcctcggaggttgccaaac

SEQ ID NO: 70198 - DNA, 255 bp, Homo sapiens
  misc_feature 1..255: note = chr10:102976414-102976669
  misc_feature 1..255: note = hyper
  source 1..255: mol_type = genomic DNA
gcaggatggattagccgagcaacgacctagagtctgagaaacgggcaggcacaaacgcttactcagaccaagggacccagaagtcccggacttccacaccagccccgcatccaagcgcgcgcctttgaaaccttcggcctctcctgccagccagagacccgccctgccgttgccatcgggacacgcgggatctttatttatacgctggggtgggtcttttccttcctcgcagaggaggagcgtcctctaaggcaa

SEQ ID NO: 70199 - DNA, 1297 bp, Homo sapiens
  misc_feature 1..1297: note = chr10:102976994-102978291
  misc_feature 1..1297: note = hyper
  source 1..1297: mol_type = genomic DNA
caaagccagatgcctcgggcccgcgaaccaaaagccttctttccaggaaatttcacaattaaaaatatttatcgggagcagatttacgtttctgggtttccagtctcggggcgtctgggtaggctattaagagtaattagcatcttttgcgcatgcagatttacttcgctcattgccacataactcatccctaaaagccggcgcaggcgaaagcaggcgccgccggcggagccgctgccacagctaccgccgctgcccgcccgagcccccctcccctcctgcgctgcccgctcccagtctctccggcccgaattgtccgctccaggccccagacgctgaacacggaacgaaaaggcttccatcctggagacctggagacgagtgacgccagagcgacctcgtgcggttggggaaggcccagactaggctctccaggctggggccgcgccgtctggaccccaggcattgcgaccacgcatgtgtgtgcaccaccgagtgggcgcttgtgtgtgtgcacgctcacgtgcgcgcgagtgcacaggagtatggttgctagtgcgcgttcctgagagggcgaaggggcgcgtggaaaacgagctgatcaccatcctccccttccctgcagcccaccggttcccaggacgacgctcaaacgtcagtcctaggccacccacctagggcactgagtttcagagggagactcgggcccctaccttgcctcgaattcccttctacagagccagttccatccagccaaacggcctggagcactcagcgcccagccgggggaactgggaggcccaacacccggctgcagccgagcgcatggctggcctggtaccggtgagaggccgccagagaaagcgcaggcggagccgggggtcactgaacagagactttcagggtcgctggggggcggctggagacgatgaggccacgcgactgaagggattggggggtgaggagtggtggtgggggcggacaaagggacaacgtggcggtggacgaaccagggccagagagggccgctgtggctcccgctcttcgggccgaagcacccaccacgggttcgttattaacgcgctgggaagtccgcaatccgcccaactttcttctctttaatgagcctagaagaggctgccctgaaggggtttgttcattaaagatgtagctggaggaatattgtctcattaattatctggttttaattacactcctaccctttgaatccagagatgggaaaagttgatttggtggcgccgcccccttgagcttaaagggtcggcctggctagggg

SEQ ID NO: 70200 - DNA, 433 bp, Homo sapiens
  misc_feature 1..433: note = chr10:102978742-102979175
  misc_feature 1..433: note = hyper
  source 1..433: mol_type = genomic DNA
tccaaggacatggctcggtttccagggtccccagagctgggacgccgccgggaaaccatggtcctggaggggagggagttatttgagggggtgcttgtccctgcctcgtcccttgtcaggccccgcgcggcgctaaagcgggggccgttttccctttaaatcgcggacactttgacaggggacattaaggacccggctgctcaggctgagcagatcataaaaccggacaggcaatttctgctcccgccaaatagccgggcaaactcgttctgcatctttggttttaatgcactaaactggcagctaagcagggagcgagcaaaaggggggtgggaagcccccccccccacatacacgggcgcacacaccggcacaggcgcaaacactccttcacacctttggaccccacaccccgccccggccctccaacacc

SEQ ID NO: 70201 - DNA, 863 bp, Homo sapiens
  misc_feature 1..863: note = chr10:102982194-102983057
  misc_feature 1..863: note = hyper
  source 1..863: mol_type = genomic DNA
aagcccaggtgcctccgggttcaggtgactggaaaagccagggcagggtgagtggacttccccggacttggcggctcagagggatggagaggtgggggggggggtccccgcggcgacgggaaggggcggagggtaggcgcgcggccccagctcgtccctttcaggggggactcatgcatcaaacttcaattttccggacgattgaattagtgattttttttctcctgaactaaaatacacttaagtctttgggattaattaccacgttctggtccctcagactggagtattacttatcggagctgcgtctgacaccggcccgacacctcgtaaaatagggaactgcgcctctctgcctcaccccgcgccgctcgccaggccaccaagccgggaaaggcggagcgaggggaagccgaacaagcgggatcggccgtccgcgcgcggaggggttcctagactggagagcagaaactacccgcgtcccgggacttggcaagccccgtcgagccccgggacacaacggggaagggagagacaaagccgagccgcctctcctggccagcccggaaccgaaagtgggtccgtagagagcccagagtcctgggggaacagatgggcaaagggctctaggaggtgatggaactcaggcccgaagggcaggcagcccacaggataccaagccttaacgaactacgccagaagaatgggcgtagggcccacagcccctcacacaacccaggccaagctccctcgtacactcagaccaggagaagaaacagacacgcaatacacaagccccgctcccttggagcctacacttgggcgaacacaccactgctgtttgcagtatcccgagacaggcc

SEQ ID NO: 70202 - DNA, 293 bp, Homo sapiens; identical to SEQ ID NO: 33297
  misc_feature 1..293: note = chr10:102983087-102983380
  misc_feature 1..293: note = hyper
  source 1..293: mol_type = genomic DNA

SEQ ID NO: 70203 - DNA, 533 bp, Homo sapiens
  misc_feature 1..533: note = chr10:102983434-102983967
  misc_feature 1..533: note = hyper
  source 1..533: mol_type = genomic DNA
cggctgggctccggaagcccacccggaacctgatggaggcagcgaattcctcagagcagaggacactgcggagaggctcgaatccacttcccacattgtgcgggaccgagcgcgcagggcgctctcgcgtggcctccttagctcgggttcagccgaggctctcacgtacacttcgttaccccttccccccgccgcagctctggtccttccttccactggctctcttctctggcctatggaaacaacgaactacttttcgcctttcaaggcccgggtcccaagccacctcctctgtgaagccgccaacaccctggtagctgcctctcagtgttttgcaactggcacggccctgtccctcggtccgcttctactagcgctgggggtgctgcgagtcttgcccactagactaggagctccttgagggcaggaaccgaatctgattcgtttccattttcccagcccccctgcgcggcctggcgcagaaaagacgcgcaataaacatttgctgaattgaattgcgttttctccttatt

SEQ ID NO: 70204 - DNA, 66 bp, Homo sapiens
  misc_feature 1..66: note = chr10:102984305-102984371
  misc_feature 1..66: note = hyper
  source 1..66: mol_type = genomic DNA
cccaaagggacccagcggggccaggcccagggccgcgaagcagagagcggccggaggtgccagggc

SEQ ID NO: 70205 - DNA, 29 bp, Homo sapiens
  misc_feature 1..29: note = chr10:102984512-102984541
  misc_feature 1..29: note = hyper
  source 1..29: mol_type = genomic DNA
cgaggaggcgcgcgcggggacctaatcca

SEQ ID NO: 70206 - DNA, 1857 bp, Homo sapiens
  misc_feature 1..1857: note = chr10:102985096-102986953
  misc_feature 1..1857: note = hyper
  source 1..1857: mol_type = genomic DNA
ctcacatcaattttgcggagaaagagagcccagcggcccggaggcgggaccccactccggtgacagcggctactcgccagcccagcgacaacaaaagcccggagagaaacccgctctgtccaggaaagtgaaagcggcctcagcccccgccccagccggccttggggcgccgcagacccgagagagtccttgcaagatccatacctctgcccccagcggtgtgccggggtgtggaggcagaattggttaatgttgccagaaattcacaccagctcccagacgcttgggcttacagttccaggtgcccacattgaaattcagcctggccttgatgcctttagcctttggcccccgactccccaaggatgaggccctcggggctagaatcgaaacttgggaacccaaggctccaccccgcgtctgactgagtgatacctgcagcgctcccggggctcagccctgttttcggggagtgcagggagaatgcccttgggtctggggtgggatgcaggaaatgcagggcaagaccccctcccaccctttgttcaacacaaattaatgttgtactgtggtgtgcccccacatacacaggcattttctcccagcatttcacggctcgttttttaccccgacctggcgaagcccgcttctctcccgatttagcagctgcctcaggtttatgggcaagaggcgcctcctcctgctgcttccccctcgcccttcactcttaagcctgtcctgaaaatcccccccaaatctccaaggctagggcgaccggcacgaagagcggcaagaagcccagcctgccgctgcttctcggaaacgggcccaccactcagacacggtcgccgccggttctagtaaaatggcaaagactttatttattggagaaagaggccttgggtacagtctagggaggagaggggaagggaggagcagggaaggggcactcgcagcccactcacatccagccaccctcctctggccaagtcgggtaggagtggggtgttcgaagtggcaagagagacccagagctgtggaggaggtgaggtgagggcttgggtcggcctcctctctgtctctgtcacatgcaaaaaaattctaaaaagagtacaaaataattatagggctttgggttctgttttcgatagttggttggttggatttccccctgcattgtccctaagagccggactccaacagtcagtccgaggaaatgcgggagggagggaggaatcttaaaaacagcattagtgggcattaggaggcagaaatggcatcgaaaacagacttttctctcagagggtggggaggaaagatcgattttgaaacttgcaagtcaggacctgactgcccacctcttcccctcccacatgaggaaaaaaggcccgaggaaatagaagtcaactgcaataaggccgagggaggcgaggaaggagcgggccggtgcattcgccacatgcagagaaaaatcaaaacagccggagctgccactcccctagaccgcagggttagtgttccccgccctggtttctgtctcgccctcagcaaacccggcagcccgagagctttgaaaacatcgaaatctccgagatttaaaaaataataataaaagaaaggaaaaatcaggctgcggtgggaagaacccgctatataggtttaaatatttatatagaagccatacagaattgcacggcgagggcttccggggcggcggaggccgctggtggcggccggcccggccggccagcctgggtttattgcttcgagagggaagaggcggctgccaggagccgagtccggggccggggacaggggaggaggcgggagttggcagaggaggtcccagctcccctc

SEQ ID NO: 70207 - DNA, 449 bp, Homo sapiens
  misc_feature 1..449: note = chr10:102987206-102987655
  misc_feature 1..449: note = hyper
  source 1..449: mol_type = genomic DNA
gccaccgccggctgtggcctccgagttctgctcgagttcggccagcgccacgatgtccatctgcccgctggggcccagtttcttggcggactctacgtcggccttcatctcctccaggtcccgcttgagcttagcgcgccgattctggaaccaggtgatgacttgcgcgttggtgaggcccagctgctgcgcgatttggtcgcgatcggcgggggacaggtacttctggtatagaaagcgcttttccaattcatagatctggtggttggtgaaggccgtgcgcgactttcgccgcttcttaggggtctgccgctgcccaaagatggtcataccgtcgcggcctgggaggaaaggacagtgtaggctcgcgttgggagagaggaagcccaccctggctctcgcccccgtaactccgtaacccacccaggcctgtccggcctgcagtctac

SEQ ID NO: 70208 - DNA, 418 bp, Homo sapiens
  misc_feature 1..418: note = chr10:102987947-102988365
  misc_feature 1..418: note = hyper
  source 1..418: mol_type = genomic DNA
tagccgggctaagagcgcccaggacactgggaacgcaagggagcccggcaaagcaagcagactgcggaaagagcttggccacccttctcctgccaccccccagctctggcctacccagaggtccctgggaaataaggattgggtcccgtcccacatatcttcactcccataagcagctgctcaggctggaaggccctggcggccggagagggcagaggcgagcagaggcataggggacgaagcgcgcagggcacagggcgcgaggcgctgggtgcaggggaacccagcagctgcgcctaccttcggctgcctgcagaacgctgacctccagccccttaaacgtcttgctggcgagctcctccagcgcgcacagcggcgaggtctgcgagagcagcgcgcggcccgccaggggcaagcc

SEQ ID NO: 70209 - DNA, 325 bp, Homo sapiens
  misc_feature 1..325: note = chr10:102988611-102988936
  misc_feature 1..325: note = hyper
  source 1..325: mol_type = genomic DNA
cgcggggacccagcccgcgggcagctcgggcgccggacggcgcgggcaggcagcggcgggtggaaaggaggccgcactgggcagggcgcgggccgggcgcggggccgattagcgcggcggctgaggaggggagaacagcgcggggccccgggaagagggcgctgacgcgggcgccgctgctgctggggcttccagcaatccggggccggagccggggcgcgctgcgcggggctccagtttcgccaaccccggtgctatttaaaggtgtcaggtggctcggcagtggctcctggccccgggtcctggcggccgcagttggaagagc

SEQ ID NO: 70210 - DNA, 1125 bp, Homo sapiens; identical to SEQ ID NO: 33305
  misc_feature 1..1125: note = chr10:102989172-102990297
  misc_feature 1..1125: note = hyper
  source 1..1125: mol_type = genomic DNA

SEQ ID NO: 70211 - DNA, 462 bp, Homo sapiens; identical to SEQ ID NO: 33306
  misc_feature 1..462: note = chr10:102996019-102996481
  misc_feature 1..462: note = hyper
  source 1..462: mol_type = genomic DNA

SEQ ID NO: 70212 - DNA, 231 bp, Homo sapiens
  misc_feature 1..231: note = chr10:102996596-102996827
  misc_feature 1..231: note = hyper
  source 1..231: mol_type = genomic DNA
cgccaggctcggatctgtgctcagagccgggatccctccgggctgcttcgtcctggccaggactttccttgccctgaagtgaggcgccagggaagctgcagggccctccgccctctctgaactcccacgtacttgggcctctcccagcctttcttggacctgtggaagcaattcctgcaggaccagactcccctgtctccccgcggccccctaggtacactccgtaacttc

SEQ ID NO: 70213 - DNA, 329 bp, Homo sapiens
  misc_feature 1..329: note = chr10:102996899-102997228
  misc_feature 1..329: note = hyper
  source 1..329: mol_type = genomic DNA
cgatcctgagggattgcattcatcccatctcacacccaccaacgctcaatccctccagttcctccccagccccttcacttccattaattaggtcgactcccttccttcgccgctccctcctgtccccactcagcctccctacacctatgcggcgagcctcgggccaagacctccgccctggctccgccagtcctgcgggggccggcatgcaccagacctcaaaagggatcttcacgggaattccgcatagccagatcccaagcctccagggaggccaccagccctcccccatcttcttcttcctcctccgtctcctttcctcttccctc

SEQ ID NO: 70214 - DNA, 303 bp, Homo sapiens; identical to SEQ ID NO: 3619
  misc_feature 1..303: note = chr10:102997281-102997584
  misc_feature 1..303: note = hyper
  source 1..303: mol_type = genomic DNA

SEQ ID NO: 70215 - DNA, 624 bp, Homo sapiens
  misc_feature 1..624: note = chr10:102998278-102998902
  misc_feature 1..624: note = hyper
  source 1..624: mol_type = genomic DNA
gcctctctctgagatcgggtcctcctcctgcagggcagcagagtggaagccagggcctgggaccctctggctgggcaaggagggactggagtccggctcccggtgaccccgtccccagtgccagcggtggggtcgcctgtggcggcccggacaggccacgggtccctctccccaagtcccattacgttgtatttatgtttcattttatagtttttttttcctcctcccttattattgtctcactctgggggaggcaaaggatataatatattcatctttattataccaaatctgtgtgaagcatttaataaaacgctgtttccacacagccagggatattagtgtgagctatccttaagttaatgctcctggactgagggcgccgctgccacagcgcctgctgccggcgggtcgcgggaagcgtaggccctggccgccgcgctccccgcgcgggtccaacgccctgggtgcccttctcgcctgcgccttgaagcccccacgcccatcctagcgcgtctctctgtgacctctcggccgccagcctgggaggaggggtttggaagagccgaattcaagcacccttcctctcccctgccacaccctgcatttcgaatccgctgtggg

SEQ ID NO: 70216 - skipped

SEQ ID NO: 70217 - DNA, 304 bp, Homo sapiens; identical to SEQ ID NO: 924
  misc_feature 1..304: note = chr10:103043924-103044228
  misc_feature 1..304: note = hyper
  source 1..304: mol_type = genomic DNA

SEQ ID NO: 70218 - DNA, 114 bp, Homo sapiens
  misc_feature 1..114: note = chr10:103044300-103044414
  misc_feature 1..114: note = hyper
  source 1..114: mol_type = genomic DNA
cgtgcctgcctcgcctccagcccggggtaaggagatccacggaggcctctgcgcctaaactcaggtggccagacagagttggggcgggaggcgggtatacggaaaggacaccct

SEQ ID NO: 70219 - DNA, 482 bp, Homo sapiens
  misc_feature 1..482: note = chr10:103051132-103051614
  misc_feature 1..482: note = hyper
  source 1..482: mol_type = genomic DNA
agcgcccgcgcagcacgcacagaaggacccttcgcgcaggatgtcccggagactcgtccacgctccctagccgggctgcgaaggcccagatctcccagcgcctccatgccgcgtcggccgcggccttgggggtcttccggggacagtggccagccctgggccggtgacctagcctttgggcgcttccccggggctctagggtcccagggcgccagggccaacaccaggaaagccagaaggttccttcctttggggcaggagttggggggagtcgccgtacgcccaccctgccacgcgggaggcctccgggagagggcagagggcgccgggcagggaccaatcatcggcggcgaccggtcactcgcgccccagcgaggagaccctgagatccgcggggagagcacagggtcgcgccgccccctggcggctcaatgacagagttgaggcccggcggctggcgactgcggcgtctggcagctcca

SEQ ID NO: 70220 - DNA, 129 bp, Homo sapiens
  misc_feature 1..129: note = chr10:103052311-103052440
  misc_feature 1..129: note = hyper
  source 1..129: mol_type = genomic DNA
ggaaatcattcagctcggcggcgcgccccagaaccaccccctacccccgctccggcccgcggccgcgcccgcgcccgccgcgcacacgcacgcgcgcacacggaaggcaggcgccgggtatataaatat

SEQ ID NO: 70221 - DNA, 95 bp, Homo sapiens
  misc_feature 1..95: note = chr10:103052659-103052754
  misc_feature 1..95: note = hyper
  source 1..95: mol_type = genomic DNA
ggcaggagctgtgaccgcatcactctgcctcccgtttccacggattgacacaggagcctcttgttggctccatccacgctcgcctcccctccccc

SEQ ID NO: 70222 - DNA, 144 bp, Homo sapiens
  misc_feature 1..144: note = chr10:103106119-103106263
  misc_feature 1..144: note = hypo
  source 1..144: mol_type = genomic DNA
gaatggataaatgaacgatgactcataattactcgttttattacttaaagtcacctagggcatgaacagagttatatttgagttccaatatacgattaataatattttggacagccttggtttagaacagggtttctcaacttc

SEQ ID NO: 70223 - DNA, 147 bp, Homo sapiens
  misc_feature 1..147: note = chr10:103198991-103199138
  misc_feature 1..147: note = hypo
  source 1..147: mol_type = genomic DNA
ggatgtgtgcctgagcgcttcatcctgggctgtaatttcatcttttagctaagaaccacaaggtacacgagcaaagcaccctgtaaacaataatactgtggaaaaaaaataaacaaggtcgtgtttctggtacgttgatccgatggt

SEQ ID NO: 70224 - DNA, 199 bp, Homo sapiens
  misc_feature 1..199: note = chr10:103326517-103326716
  misc_feature 1..199: note = hyper
  source 1..199: mol_type = genomic DNA
cgtcggggcccaagacgcccagaccgaggagccgtgaaaccacgcggcccttctcggcggaggaacaaagccctgcgctcagcggccgcagggggctcaccgggcgtctggcctgcctgcggccaggacgtgcagctgtgcacacacatggcctgcacacgcgccaggcgcctatatccttgtacggtgcacccgcagc

SEQ ID NO: 70225 - DNA, 30 bp, Homo sapiens
  misc_feature 1..30: note = chr10:103533282-103533312
  misc_feature 1..30: note = hyper
  source 1..30: mol_type = genomic DNA
ttacggcagctctcccgaccgggcttttgg

SEQ ID NO: 70226 - DNA, 15 bp, Homo sapiens
  misc_feature 1..15: note = chr10:103534562-103534577
  misc_feature 1..15: note = hyper
  source 1..15: mol_type = genomic DNA
cggctgtagagttgg

SEQ ID NO: 70227 - DNA, 600 bp, Homo sapiens; identical to SEQ ID NO: 33318
  misc_feature 1..600: note = chr10:103534896-103535496
  misc_feature 1..600: note = hyper
  source 1..600: mol_type = genomic DNA

SEQ ID NO: 70228 - DNA, 61 bp, Homo sapiens
  misc_feature 1..61: note = chr10:103535710-103535771
  misc_feature 1..61: note = hyper
  source 1..61: mol_type = genomic DNA
cgccgcgggaggacgcgctgagcagggcgcgagcggagagggtgcgggtgcgggaggccgg

SEQ ID NO: 70229 - DNA, 75 bp, Homo sapiens
  misc_feature 1..75: note = chr10:103535841-103535916
  misc_feature 1..75: note = hyper
  source 1..75: mol_type = genomic DNA
cgccgctgccggagccggtggccgctggctgctcgggagccggagcgggcgggagggtcacgggctggcggggtg

SEQ ID NO: 70230 - DNA, 130 bp, Homo sapiens
  misc_feature 1..130: note = chr10:103536127-103536257
  misc_feature 1..130: note = hyper
  source 1..130: mol_type = genomic DNA
cgggaggggcgggggcggccggtctgggcgcctccccctatccccggcctgtcccctcgcgcgctccccggtcccggacgcgcggggatgggggcgcctagggctgcaaactctgcgggccgggagaccc

SEQ ID NO: 70231 - DNA, 219 bp, Homo sapiens
  misc_feature 1..219: note = chr10:103536299-103536518
  misc_feature 1..219: note = hyper
  source 1..219: mol_type = genomic DNA
cgggtctgggtctccgcctccgggcccagccgcttccgccgccggctacgcagtggtctccgagccacctactgtgtgtcccgccgggcccctgggagcggccgctaaccatgcagcgaatggctgcgcacccggccctcgcgcagtgcgtgccggtgccacccggaccccgctcccctgtttcggccgcgtgccccgtcctgtcggtctctccagtct

SEQ ID NO: 70232 - DNA, 21 bp, Homo sapiens
  misc_feature 1..21: note = chr10:103548965-103548986
  misc_feature 1..21: note = hypo
  source 1..21: mol_type = genomic DNA
gaaaatgaggccaggcgcggt

SEQ ID NO: 70233 - DNA, 30 bp, Homo sapiens
  misc_feature 1..30: note = chr10:1035526-1035556
  misc_feature 1..30: note = hypo
  source 1..30: mol_type = genomic DNA
ttcaggtctcaaggacgggatgagcttgcc

SEQ ID NO: 70234 - DNA, 79 bp, Homo sapiens
  misc_feature 1..79: note = chr10:103579758-103579837
  misc_feature 1..79: note = hypo
  source 1..79: mol_type = genomic DNA
ctggatattgtggtccgttggggttgagaacacaattttttttttttttttttttttgtaagagaagaggtctcatttt

SEQ ID NO: 70235 - DNA, 90 bp, Homo sapiens
  misc_feature 1..90: note = chr10:103599532-103599622
  misc_feature 1..90: note = hyper
  source 1..90: mol_type = genomic DNA
agctggtagagggatcgcgctgcctgccccagcgggctccggcacctgcgggggcatcggttcatggtttggcggcgagctcggcgtcta

SEQ ID NO: 70236 - DNA, 35 bp, Homo sapiens
  misc_feature 1..35: note = chr10:103603249-103603284
  misc_feature 1..35: note = hyper
  source 1..35: mol_type = genomic DNA
cacccgtgagctggtcgtaggagccgtccaggtct

SEQ ID NO: 70237 - DNA, 30 bp, Homo sapiens; identical to SEQ ID NO: 42637
  misc_feature 1..30: note = chr10:103814237-103814267
  misc_feature 1..30: note = hypo
  source 1..30: mol_type = genomic DNA

SEQ ID NO: 70238 - DNA, 18 bp, Homo sapiens
  misc_feature 1..18: note = chr10:103818196-103818214
  misc_feature 1..18: note = hypo
  source 1..18: mol_type = genomic DNA
acacgaagagaaaaccca

SEQ ID NO: 70239 - DNA, 24 bp, Homo sapiens
  misc_feature 1..24: note = chr10:103897018-103897042
  misc_feature 1..24: note = hypo
  source 1..24: mol_type = genomic DNA
ccaggagaccgaacccatgagtgt

SEQ ID NO: 70240 - DNA, 139 bp, Homo sapiens
  misc_feature 1..139: note = chr10:103930132-103930271
  misc_feature 1..139: note = hypo
  source 1..139: mol_type = genomic DNA
gcaccgcgcccggccgagaagggaggttttctggtctctggtctgtactggttatccatgagaggttacctgatacctgaaagccagtggcaggcaacatggcttgtagaagattaatgttccccgtggaaccccaacc

SEQ ID NO: 70241 - DNA, 213 bp, Homo sapiens
  misc_feature 1..213: note = chr10:103986007-103986220
  misc_feature 1..213: note = hyper
  source 1..213: mol_type = genomic DNA
ggggcggagcagaggcgtatcttggtcgagattggatagcggcggggcgcaggaaagaggtcgcgccagcccgggcaggcagctttgcaagtccgcgttatatatcgcagtggctgcgcccgggatagctggctgcgccgccgcgcacatgcctaggttcgacgccctcctccctttgcccaggagttccttctgtcccggctctgttccgtc

SEQ ID NO: 70242 - DNA, 43 bp, Homo sapiens
  misc_feature 1..43: note = chr10:103991502-103991545
  misc_feature 1..43: note = hyper
  source 1..43: mol_type = genomic DNA
cctctggggagccgccgggcagcgaagccgaggccttttctga

SEQ ID NO: 70243 - DNA, 191 bp, Homo sapiens
  misc_feature 1..191: note = chr10:104000813-104001004
  misc_feature 1..191: note = hyper
  source 1..191: mol_type = genomic DNA
ccctactccctgcctcgcgaagcccctatcctggtttcaagtctccggcttcgttccggatcctctgagtctcccccttccctatcccctggttcttaccctgagtttcccttttcccaagtcctggccccaggtctgcagtccgccctcccattctcgacctgttcccaaggcaccggagttcagctgcc

SEQ ID NO: 70244 - DNA, 587 bp, Homo sapiens
  misc_feature 1..587: note = chr10:104001210-104001797
  misc_feature 1..587: note = hyper
  source 1..587: mol_type = genomic DNA
gcctctccgctcgggcgctcctggactctcggagggagtgagcctcaccgcgtactgccacccccagccggcgcccattcactttatggcagaccagggcgcccccagcccgccgcggcgagccgcgcgcgtcaggccccgcccctttccagctgccctgctggggctccgccctttccagctgtggatctccaggccccgcctttgagggaggggtctggccggcgagacgccaagaaccccgccctctggccaatcagaagcgctcttcagcaactcggccgcgcccctccccacgtggcagagaccgcgctccggctaggacgcttaggcagagccaagtgggcgagagtagagtggtcccggtagccacgggtaaaagggatcggctggcagcgaagtgggttgggccgctaccccgaggaaagtggatcggcgccaggtgggaaggcgcacggggccgccgggtctcagcgctcagacttctctgccactcaagtttcgccgattttctccacttgtcgctgtccgtctctcctcccttttgtctctgttccaatcctcccacgtctcgcctttctttcctc

SEQ ID NO: 70245 - DNA, 30 bp, Homo sapiens
  misc_feature 1..30: note = chr10:104086676-104086706
  misc_feature 1..30: note = hypo
  source 1..30: mol_type = genomic DNA
ggctttcatctggcacgtagcctgactacc

SEQ ID NO: 70246 - DNA, 83 bp, Homo sapiens
  misc_feature 1..83: note = chr10:104160053-104160136
  misc_feature 1..83: note = hypo
  source 1..83: mol_type = genomic DNA
tgatcacggggcagacgagtgtggtgagctttctgctgcgggtaggtgcagacccagctctgctggatcggcatggagactca

SEQ ID NO: 70247 - DNA, 114 bp, Homo sapiens
  misc_feature 1..114: note = chr10:104161655-104161769
  misc_feature 1..114: note = hypo
  source 1..114: mol_type = genomic DNA
cctcctgcgcagctacgaggtgggttggcctgtgccctgccccctccccagcctcctttcccgatctgagtccaggtgcctccttggccccagggctcccgagcacatgcccta

SEQ ID NO: 70248 - DNA, 276 bp, Homo sapiens
  misc_feature 1..276: note = chr10:104168609-104168885
  misc_feature 1..276: note = hyper
  source 1..276: mol_type = genomic DNA
cgccccgcaacctggcgtgggccgcggccccaacgccctcaccgcctttttcttcttgcggctctgcaggcggctgaccaccaggtcggtgtagagcacgggcttgaggctgcgcgagcgctgcggccagccgtagcacagggtctccgcgccgcggtgggtgcgcccgtagcgcacggagcacagcgagcgcgagcgcagccgcccggcgctgctgtggatgctgttgacgccgatcatgctggcccggccggcgcgccgcggcccccggccatg

SEQ ID NO: 70249 - DNA, 83 bp, Homo sapiens
  misc_feature 1..83: note = chr10:104169160-104169243
  misc_feature 1..83: note = hyper
  source 1..83: mol_type = genomic DNA
gcctggggaggccagcgtgggtggcagctccagggaggctgagagcaccgctaggcctggggctgtgacgctgggcggacccg

SEQ ID NO: 70250 - DNA, 226 bp, Homo sapiens
  misc_feature 1..226: note = chr10:104170037-104170263
  misc_feature 1..226: note = hyper
  source 1..226: mol_type = genomic DNA
gggccatggagctggcgcctgggaacgggacctgctcacagggagccagaaagcagtttctagctccagctttgcgctaactcgctgccagaccttggaaaagcttagtccctctcaggcccctctccctccgggttcctgcagcgcagcagcaccgggaaggtctttttggctgtccacgcggcgggggagcagtgtggagtgtacccccatccaatccctgtcc

SEQ ID NO: 70251 - DNA, 106 bp, Homo sapiens; identical to SEQ ID NO: 3625
  misc_feature 1..106: note = chr10:104170407-104170513
  misc_feature 1..106: note = hyper
  source 1..106: mol_type = genomic DNA

SEQ ID NO: 70252 - DNA, 287 bp, Homo sapiens; identical to SEQ ID NO: 3626
  misc_feature 1..287: note = chr10:104170514-104170801
  misc_feature 1..287: note = hyper
  source 1..287: mol_type = genomic DNA

SEQ ID NO: 70253 - DNA, 64 bp, Homo sapiens
  misc_feature 1..64: note = chr10:104416998-104417062
  misc_feature 1..64: note = hypo
  source 1..64: mol_type = genomic DNA
cccttcccagcctggcggtcagagactggcttgacgcctcccagcagcccggccaccaggattt

SEQ ID NO: 70254 - DNA, 115 bp, Homo sapiens
  misc_feature 1..115: note = chr10:104629233-104629348
  misc_feature 1..115: note = hyper
  source 1..115: mol_type = genomic DNA
ctggctgcgggagcccgccgtcctgagtcgcaggccgaggagacagtgagtgcgcgccctgagtcgcaggccgaggagacagtgagtgcgcgccctgagtcgcaggccgaggaga

SEQ ID NO: 70255 - DNA, 167 bp, Homo sapiens
  misc_feature 1..167: note = chr10:104679009-104679176
  misc_feature 1..167: note = hyper
  source 1..167: mol_type = genomic DNA
aggtgatcttcatttcgctgctgctgtgcctgtcgggcatgttcagcggcctcaacctggggctcatggccctggacccgatggagctgcgcatcgtgcagaactgcggcacggagaaggagaagaattacgccaagcgcatcgagccggtgcgcaggcagggcaac

SEQ ID NO: 70256 - DNA, 213 bp, Homo sapiens
  misc_feature 1..213: note = chr10:104758202-104758415
  misc_feature 1..213: note = hypo
  source 1..213: mol_type = genomic DNA
gttacagatccttcacgtatatatgcgaacttaaagtaaacaaatctaaggaactagaaaaacacaggcttgtctctgggcaaggtctttaaaattatcaatgtgattataatgaatgaataacatatagcccttcgaagggataaggtaaacaccaagattggaaaggcagacataaaactttattcacaggtgacacgatcttctatatag

SEQ ID NO: 70257 - DNA, 81 bp, Homo sapiens
  misc_feature 1..81: note = chr10:104812055-104812136
  misc_feature 1..81: note = hypo
  source 1..81: mol_type = genomic DNA
aaaaaacccaaaccgagtgtgtctgtatttctgtttgcccaggggtagtacttaccattaggaaggcgatttaccatttag

SEQ ID NO: 70258 - DNA, 124 bp, Homo sapiens
  misc_feature 1..124: note = chr10:104823124-104823248
  misc_feature 1..124: note = hypo
  source 1..124: mol_type = genomic DNA
aatactttgtgatggcgatttaaaaaacaagaaggtgagcgggagaccaggtggctgctcagcatgtggcgcatggggaagtcccgccttgagccgcatgcactgatcccgggttggcactgtt

SEQ ID NO: 70259 - DNA, 30 bp, Homo sapiens
  misc_feature 1..30: note = chr10:104835453-104835483
  misc_feature 1..30: note = hypo
  source 1..30: mol_type = genomic DNA
aagtgctgtcctctgcgtagcctacctttg

SEQ ID NO: 70260 - DNA, 30 bp, Homo sapiens
  misc_feature 1..30: note = chr10:104953416-104953446
  misc_feature 1..30: note = hypo
  source 1..30: mol_type = genomic DNA
cccccatggcaccctcgaatccccttgatg

SEQ ID NO: 70261 - DNA, 209 bp, Homo sapiens; identical to SEQ ID NO: 3627
  misc_feature 1..209: note = chr10:105036450-105036659
  misc_feature 1..209: note = hyper
  source 1..209: mol_type = genomic DNA

SEQ ID NO: 70262 - DNA, 163 bp, Homo sapiens; identical to SEQ ID NO: 3628
  misc_feature 1..163: note = chr10:105036700-105036863
  misc_feature 1..163: note = hyper
  source 1..163: mol_type = genomic DNA

SEQ ID NO: 70263 - DNA, 19 bp, Homo sapiens
  misc_feature 1..19: note = chr10:105036864-105036883
  misc_feature 1..19: note = hyper
  source 1..19: mol_type = genomic DNA
ccttaaaagccgggcgcac

SEQ ID NO: 70264 - DNA, 999 bp, Homo sapiens
  misc_feature 1..999: note = chr10:105036893-105037892
  misc_feature 1..999: note = hyper
  source 1..999: mol_type = genomic DNA
cgccctgcctgccgcacctctcctttcttctgtagctcgcgttgaagccgcacgtccggccccgatcccggcaccatgagcttcggctcggagcactacctgtgctcctcctcctcctaccgcaaggtgttcggggatggctctcgcctgtccgcccgcctctctggggccggcggcgcgggcggcttccgctcgcagtcgctgtcccgcagcaatgtggcctcctcggccgcctgctcctcggcctcgtcgctcggcctcggcctggcctatcgccggccgccggcgtccgacgggctggacctgagccaggcggcggcgcgcaccaacgagtacaagatcatccgcaccaacgagaaggagcagctgcagggcctcaacgaccgcttcgccgtgttcatcgagaaggtgcatcagctggagacgcagaaccgcgcgttggaggccgagctggccgcgctgcgacagcgccacgctgagccgtcgcgcgtcggcgagctcttccagcgcgagctgcgcgacctgcgcgcgcagctggaggaggccagctcggctcgctcgcaggccctgctggagcgcgacgggctggcggaggaggtgcagcggctgcgggcgcgctgcgaggaggagagccgcggacgcgaaggcgccgagcgcgccctgaaggcgcagcagcgcgacgtggacggcgccacgctggcccgcctggacctggagaagaaggtggagtcgctgctggacgagctggccttcgtacgccaggtgcacgacgaggaggtagccgagctgctggccacgctgcaggcgtcgtcgcaggccgcggccgaggtggacgtgactgtggctaaaccagacctgacctcggctctgagggagatccgcgcccagtatgagtccctggccgctaagaacctgcagtccgcggaagaatggtacaagtccaagtttgccaacctgaacgagcaggcggcgcgcagcaccgaggccatccgggccagc

SEQ ID NO: 70265 - DNA, 111 bp, Homo sapiens
  misc_feature 1..111: note = chr10:105037955-105038066
  misc_feature 1..111: note = hyper
  source 1..111: mol_type = genomic DNA
cgcggggccaacgagtccttggagaggcagatcctggagctggaggagcggcacagtgccgaggtagctggctaccaggtaagggccggggctgggcgtggggaggggtgc

SEQ ID NO: 70266 - DNA, 37 bp, Homo sapiens
  misc_feature 1..37: note = chr10:105038717-105038754
  misc_feature 1..37: note = hyper
  source 1..37: mol_type = genomic DNA
tcctccttaagaaagcgttcgccggttggcaaaacgt

SEQ ID NO: 70267 - DNA, 171 bp, Homo sapiens
  misc_feature 1..171: note = chr10:105041598-105041769
  misc_feature 1..171: note = hyper
  source 1..171: mol_type = genomic DNA
tcagacgagctaagacgatgctcagcgtttgtcttagctcctccaggagagaccccagctggagctgggcgtgccgctctccggttccctcaggctaagccggcagcagctgcgtggttgggggaggggacagactgcagcgctctgctcagatctcgagctggaggccat

SEQ ID NO: 70268 - DNA, 28 bp, Homo sapiens
  misc_feature 1..28: note = chr10:105119651-105119679
  misc_feature 1..28: note = hypo
  source 1..28: mol_type = genomic DNA
aaaattgaacacagccgggcgtggtggc

SEQ ID NO: 70269 - DNA, 40 bp, Homo sapiens
  misc_feature 1..40: note = chr10:105127036-105127076
  misc_feature 1..40: note = hypo
  source 1..40: mol_type = genomic DNA
taaatgtaatgtaatgcatgcagctcgattaacttttaca

SEQ ID NO: 70270 - DNA, 157 bp, Homo sapiens
  misc_feature 1..157: note = chr10:105155377-105155534
  misc_feature 1..157: note = hypo
  source 1..157: mol_type = genomic DNA
aatccttccgtgcctctctccacctgtgagatgggcactttattaaaggtccaaagtgaccagtagctcttgttactttctctgttcctcgatattgctattttcctttctaacttaacacctacctggaatggtgagatcacgaggtaaggaaggc

SEQ ID NO: 70271 - DNA, 332 bp, Homo sapiens
  misc_feature 1..332: note = chr10:105413585-105413917
  misc_feature 1..332: note = hypo
  source 1..332: mol_type = genomic DNA
cctccccacacagcccggagggcttgcctcaaggctcacccttctcagggagttctccggctcaccagcttcccgaggccccaccctcccacctcctgctgcccagctcccgcttttcttctgcttggggcacatagatgcatgcctgctttgcagtcgcagccccaccacgccctgtactcctcgctctgcctgtctaatcccttcattctcccagccctgctcaatgcctccaggaagccttctcgactatgcttgtcttcacccctgacacttcagctctgcaccatgcaacagggctactgagggaccatcagcgtggggttgtcatg

SEQ ID NO: 70272 - DNA, 56 bp, Homo sapiens
  misc_feature 1..56: note = chr10:105615662-105615718
  misc_feature 1..56: note = hyper
  source 1..56: mol_type = genomic DNA
ccagcgcgcagccagcggcctggcgcagcaccgggctagttcgctaggcacaaaaa

SEQ ID NO: 70273 - DNA, 30 bp, Homo sapiens
  misc_feature 1..30: note = chr10:105632567-105632597
  misc_feature 1..30: note = hypo
  source 1..30: mol_type = genomic DNA
agggcatggggagcacgaccttaacgttca

SEQ ID NO: 70274 - DNA, 38 bp, Homo sapiens
  misc_feature 1..38: note = chr10:105725883-105725921
  misc_feature 1..38: note = hypo
  source 1..38: mol_type = genomic DNA
tgagaagtgggggcccggcgcggtggctcacgccagta

SEQ ID NO: 70275 - DNA, 30 bp, Homo sapiens; identical to SEQ ID NO: 42647
  misc_feature 1..30: note = chr10:105796706-105796736
  misc_feature 1..30: note = hypo
  source 1..30: mol_type = genomic DNA

SEQ ID NO: 70276 - DNA, 30 bp, Homo sapiens
  misc_feature 1..30: note = chr10:105993190-105993220
  misc_feature 1..30: note = hypo
  source 1..30: mol_type = genomic DNA
tgagtgggacttaaacgcaggtctagctaa

SEQ ID NO: 70277 - DNA, 44 bp, Homo sapiens
  misc_feature 1..44: note = chr10:106014312-106014356
  misc_feature 1..44: note = hyper
  source 1..44: mol_type = genomic DNA
gagcgggtggtgcttcgaggtcagtgtcacgggagggaggtcag

SEQ ID NO: 70278 - DNA, 30 bp, Homo sapiens
  misc_feature 1..30: note = chr10:106030700-106030730
  misc_feature 1..30: note = hypo
  source 1..30: mol_type = genomic DNA
ttttcaaagcagatccgatcatatttcagg

SEQ ID NO: 70279 - DNA, 55 bp, Homo sapiens
  misc_feature 1..55: note = chr10:106034596-106034651
  misc_feature 1..55: note = hyper
  source 1..55: mol_type = genomic DNA
tggagcctgcggcagcggtggcgagccacagggcggcgaccgtgagctccgggag

SEQ ID NO: 70280 - DNA, 15 bp, Homo sapiens
  misc_feature 1..15: note = chr10:106113431-106113446
  misc_feature 1..15: note = hyper
  source 1..15: mol_type = genomic DNA
tgcccaggtgccagc

SEQ ID NO: 70281 - DNA, 30 bp, Homo sapiens
  misc_feature 1..30: note = chr10:106160593-106160623
  misc_feature 1..30: note = hypo
  source 1..30: mol_type = genomic DNA
gagatcaagaagcttcgccgggaaaagggg

SEQ ID NO: 70282 - DNA, 80 bp, Homo sapiens
  misc_feature 1..80: note = chr10:106348683-106348763
  misc_feature 1..80: note = hypo
  source 1..80: mol_type = genomic DNA
gattctttttgttcccggctcatgtgtgaggtctgggatggatacatctcactgtgggcctaggtcgtggtccaaggcct

SEQ ID NO: 70283 - DNA, 136 bp, Homo sapiens
  misc_feature 1..136: note = chr10:106398552-106398688
  misc_feature 1..136: note = hyper
  source 1..136: mol_type = genomic DNA
ctcctgctcagaggccgcgggaagctgcggggactggatggtgcacctccccagtgcgcataggacttgggagaccacactcctccgggctgtgtgagcctcgggtccgcccagatctcttatactgtggcacctc

SEQ ID NO: 70284 - DNA, 157 bp, Homo sapiens
  misc_feature 1..157: note = chr10:106398825-106398982
  misc_feature 1..157: note = hyper
  source 1..157: mol_type = genomic DNA
cgcgcccacctgggcctgcggcgctggaacttttcttaggaatacccgctactccctgtctttggaaacccacagatgccaggacccgcaccattctgggccggacgttgtcgctggcttggttctttggcccagcctcccccgctgctaattgcca

SEQ ID NO: 70285 - DNA, 1259 bp, Homo sapiens; identical to SEQ ID NO: 33338
  misc_feature 1..1259: note = chr10:106399306-106400565
  misc_feature 1..1259: note = hyper
  source 1..1259: mol_type = genomic DNA

SEQ ID NO: 70286 - DNA, 136 bp, Homo sapiens; identical to SEQ ID NO: 33339
  misc_feature 1..136: note = chr10:106400566-106400702
  misc_feature 1..136: note = hyper
  source 1..136: mol_type = genomic DNA

SEQ ID NO: 70287 - DNA, 215 bp, Homo sapiens; identical to SEQ ID NO: 33340
  misc_feature 1..215: note = chr10:106400703-106400918
  misc_feature 1..215: note = hyper
  source 1..215: mol_type = genomic DNA

SEQ ID NO: 70288 - DNA, 111 bp, Homo sapiens; identical to SEQ ID NO: 3633
  misc_feature 1..111: note = chr10:106401322-106401433
  misc_feature 1..111: note = hyper
  source 1..111: mol_type = genomic DNA

SEQ ID NO: 70289 - DNA, 681 bp, Homo sapiens; identical to SEQ ID NO: 3634
  misc_feature 1..681: note = chr10:106401510-106402191
  misc_feature 1..681: note = hyper
  source 1..681: mol_type = genomic DNA

SEQ ID NO: 70290 - DNA, 554 bp, Homo sapiens; identical to SEQ ID NO: 33343
  misc_feature 1..554: note = chr10:106402271-106402825
  misc_feature 1..554: note = hyper
  source 1..554: mol_type = genomic DNA

SEQ ID NO: 70291 - DNA, 61 bp, Homo sapiens
  misc_feature 1..61: note = chr10:106440762-106440823
  misc_feature 1..61: note = hyper
  source 1..61: mol_type = genomic DNA
taggaccccaccttccgcagagctccgcctcggttcccctctctcccgggaagaggaccag

SEQ ID NO: 70292 - DNA, 182 bp, Homo sapiens
  misc_feature 1..182: note = chr10:10767560-10767742
  misc_feature 1..182: note = hypo
  source 1..182: mol_type = genomic DNA
aggctgagagccagacggacttgttttctaatcccatttcttcctcatgggagcttgtcaacttgggccaataataccagctctgtgagcagcattttctaggtgtagtaaatacaggctatgatgatgactctcttggcgacgtgttataatcactaaatgcagaacgatattcgggttgc

SEQ ID NO: 70293 - DNA, 40 bp, Homo sapiens
  misc_feature 1..40: note = chr10:10769445-10769485
  misc_feature 1..40: note = hypo
  source 1..40: mol_type = genomic DNA
aaagaaaaacagggccgggcgcggtggctcatgcctgtaa

SEQ ID NO: 70294 - DNA, 30 bp, Homo sapiens; identical to SEQ ID NO: 42513
  misc_feature 1..30: note = chr10:10770967-10770997
  misc_feature 1..30: note = hypo
  source 1..30: mol_type = genomic DNA

SEQ ID NO: 70295 - DNA, 21 bp, Homo sapiens
  misc_feature 1..21: note = chr10:108522437-108522458
  misc_feature 1..21: note = hypo
  source 1..21: mol_type = genomic DNA
agccaccgtgcccagcctatt

SEQ ID NO: 70296 - DNA, 196 bp, Homo sapiens
  misc_feature 1..196: note = chr10:10854925-10855121
  misc_feature 1..196: note = hypo
  source 1..196: mol_type = genomic DNA
ataaaattgtatgatcgatgtaagatagaacagagaagtaccttcccatcggatcccgaatcccacctctgagtgataccatgaatccatctcctatactgcccagtttttctcacagcacagcaattctctttatattgatcctcattttctttcaaggctcttttattcccactccttccgtagagctgatgga

SEQ ID NO: 70297 - DNA, 27 bp, Homo sapiens
  misc_feature 1..27: note = chr10:108561564-108561591
  misc_feature 1..27: note = hypo
  source 1..27: mol_type = genomic DNA
ggcgtgagccaccgtgcccagctagta

SEQ ID NO: 70298 - DNA, 143 bp, Homo sapiens; identical to SEQ ID NO: 42649
  misc_feature 1..143: note = chr10:108578381-108578524
  misc_feature 1..143: note = hypo
  source 1..143: mol_type = genomic DNA

SEQ ID NO: 70299 - DNA, 36 bp, Homo sapiens
  misc_feature 1..36: note = chr10:10867457-10867493
  misc_feature 1..36: note = hypo
  source 1..36: mol_type = genomic DNA
ccaccgcgcccagctggataccgatgttttaagtgt

SEQ ID NO: 70300 - DNA, 20 bp, Homo sapiens
  misc_feature 1..20: note = chr10:108755052-108755072
  misc_feature 1..20: note = hypo
  source 1..20: mol_type = genomic DNA
cagagcgagactccatctca

SEQ ID NO: 70301 - DNA, 127 bp, Homo sapiens; identical to SEQ ID NO: 33344
  misc_feature 1..127: note = chr10:108923771-108923898
  misc_feature 1..127: note = hyper
  source 1..127: mol_type = genomic DNA

SEQ ID NO: 70302 - DNA, 115 bp, Homo sapiens; identical to SEQ ID NO: 33345
  misc_feature 1..115: note = chr10:108923945-108924060
  misc_feature 1..115: note = hyper
  source 1..115: mol_type = genomic DNA

SEQ ID NO: 70303 - DNA, 21 bp, Homo sapiens
  misc_feature 1..21: note = chr10:108924345-108924366
  misc_feature 1..21: note = hyper
  source 1..21: mol_type = genomic DNA
cgctggcggctgtggggggcc

SEQ ID NO: 70304 - DNA, 34 bp, Homo sapiens; identical to SEQ ID NO: 33347
  misc_feature 1..34: note = chr10:108924367-108924401
  misc_feature 1..34: note = hyper
  source 1..34: mol_type = genomic DNA

SEQ ID NO: 70305 - DNA, 41 bp, Homo sapiens
  misc_feature 1..41: note = chr10:108924769-108924810
  misc_feature 1..41: note = hyper
  source 1..41: mol_type = genomic DNA
ggtcgaccccgggctcccggagcagtcgatgtgtcgggagc

SEQ ID NO: 70306 - DNA, 30 bp, Homo sapiens
  misc_feature 1..30: note = chr10:10910269-10910299
  misc_feature 1..30: note = hypo
  source 1..30: mol_type = genomic DNA
aaagttggaagttgacgctggctgggagct

SEQ ID NO: 70307 - DNA, 27 bp, Homo sapiens
  misc_feature 1..27: note = chr10:109674181-109674208
  misc_feature 1..27: note = hyper
  source 1..27: mol_type = genomic DNA
ttcacactccctccccgcttcgctccc

SEQ ID NO: 70308 - DNA, 118 bp, Homo sapiens
  misc_feature 1..118: note = chr10:109674377-109674495
  misc_feature 1..118: note = hyper
  source 1..118: mol_type = genomic DNA
cgcccccagtcttcagggactttgcgctcccgcaggctcctgctcacctctcccatcgttgggcgctggtggcaccccaggaggagagaggagcagcaggagcccggtctcgcagtgc

SEQ ID NO: 70309 - skipped

SEQ ID NO: 70310 - DNA, 117 bp, Homo sapiens; identical to SEQ ID NO: 33352
  misc_feature 1..117: note = chr10:109674855-109674972
  misc_feature 1..117: note = hyper
  source 1..117: mol_type = genomic DNA

SEQ ID NO: 70311 - DNA, 30 bp, Homo sapiens
  misc_feature 1..30: note = chr10:109675175-109675205
  misc_feature 1..30: note = hyper
  source 1..30: mol_type = genomic DNA
gattgtgagcgtcagcgtatgtgtgtttag

SEQ ID NO: 70312 - DNA, 22 bp, Homo sapiens
  misc_feature 1..22: note = chr10:110168394-110168416
  misc_feature 1..22: note = hypo
  source 1..22: mol_type = genomic DNA
tttgtataaaattaacgggcgg

SEQ ID NO: 70313 - DNA, 22 bp, Homo sapiens
  misc_feature 1..22: note = chr10:110168716-110168738
  misc_feature 1..22: note = hypo
  source 1..22: mol_type = genomic DNA
aaattaacgggcaaaagtgcaa

SEQ ID NO: 70314 - DNA, 257 bp, Homo sapiens; identical to SEQ ID NO: 10516
  misc_feature 1..257: note = chr10:110225912-110226169
  misc_feature 1..257: note = hyper
  source 1..257: mol_type = genomic DNA

SEQ ID NO: 70315 - DNA, 233 bp, Homo sapiens
  misc_feature 1..233: note = chr10:110408434-110408667
  misc_feature 1..233: note = hypo
  source 1..233: mol_type = genomic DNA
gagaggggatattagcgtagaagggaactgatcagaaaaataagaggcagagtagcctcccaggtgtcctctttagtgatcactactccatttggtaagccattcaattctaattaagtaaatataaatacatatacacagaaacaaacaatattggtttaaataatctcttcttatgatcgggtcctttcacctatctgcctaggtctggcccttctcgcttttgctctgaa

SEQ ID NO: 70316 - DNA, 342 bp, Homo sapiens
  misc_feature 1..342: note = chr10:11059322-11059664
  misc_feature 1..342: note = hyper
  source 1..342: mol_type = genomic DNA
aaaaggcagtgccatcgtgcagagacaggtttgtcttccttagggcactgcgataagtccctaaatgtcacttgggtcatagatctgatctttattttgcctaaacctcctatatcctttcggtgatcgcccttagttcctgcccgggcaagcacaccacaccgaggagcatcgaagcgaaccctcgggctgctcgcctcccgcggctgggctctgggagcgcggctcgggtatggaagtggagcgggctttggcgcctgggtggccctaaacctactccgagcggccacggcggcctcttgccagggacccccgggcgggggagcagagccaggcggggag

SEQ ID NO: 70317 - DNA, 226 bp, Homo sapiens; identical to SEQ ID NO: 32886
  misc_feature 1..226: note = chr10:11059932-11060158
  misc_feature 1..226: note = hyper
  source 1..226: mol_type = genomic DNA

SEQ ID NO: 70318 - DNA, 121 bp, Homo sapiens; identical to SEQ ID NO: 10180
  misc_feature 1..121: note = chr10:11060314-11060435
  misc_feature 1..121: note = hyper
  source 1..121: mol_type = genomic DNA

SEQ ID NO: 70319 - DNA, 117 bp, Homo sapiens; identical to SEQ ID NO: 32888
  misc_feature 1..117: note = chr10:11060512-11060629
  misc_feature 1..117: note = hyper
  source 1..117: mol_type = genomic DNA

SEQ ID NO: 70320 - skipped

SEQ ID NO: 70321 - DNA, 237 bp, Homo sapiens
  misc_feature 1..237: note = chr10:110671647-110671884
  misc_feature 1..237: note = hyper
  source 1..237: mol_type = genomic DNA
gtgtcttactccttccgtccagggcattccgcagactcctgctcccttcttcctctccacttgctctcaatagagggcgcgctgggcgaagtaggggcgtggcaggagccccgctccgcggatccaggttgaaattcctccctcctggaatccgaccgtgagcatttctgagcggtggtgaggaggaggccaccaagacacctccctcccgctgtgcaaaggaacgcaggagcccgg

SEQ ID NO: 70322 - DNA, 504 bp, Homo sapiens
  misc_feature 1..504: note = chr10:110671929-110672433
  misc_feature 1..504: note = hyper
  source 1..504: mol_type = genomic DNA
cgccgctgtctgccaacctttcccagcttttcccacgattggagccaagagaggtccccggggatctcagttgggcaattgtaagggaaggagctcaggacactgacttcaagatgaagggggaggtcagcgaagacagttctagggtgggcggcggccgctgacagagcaggagccacagccaccggggcttggagataggagcaagtcgcaggcggagggggctgcgggctggctgcctgggcagcacaggacttgagggagctgcggggactcctggagtctcatcaggccttccagtcgctgtggggaccccggctgcgcgcggatcgcctgcgccactgtccccactgacccgcccgccgggtttgccaattaccagcgccacctggtcccgcacccaaccccacattttctctgtcaagggcttgtttccagggctccaggaactttcaaaatgttattggtgtgtgtcgggggggtggggggcgggggggttgtgtg

SEQ ID NO: 70323 - DNA, 228 bp, Homo sapiens
  misc_feature 1..228: note = chr10:111216345-111216573
  misc_feature 1..228: note = hyper
  source 1..228: mol_type = genomic DNA
agatgtgcagagagtcgcctgtcggagcaaatgtgacgctgattggcttcagctccccagctgcaaatgggtagctttgccggggtttctctcttgagctccaggcactctcaaggatccggttcatgtcttcgccctggcccgcttggtatagggggcgcacaggaagaggccaagaagtggaaagaacctcatctcgatgtcccaagtgacaaagcccccggggct

SEQ ID NO: 70324 - DNA, 194 bp, Homo sapiens
  misc_feature 1..194: note = chr10:111216610-111216804
  misc_feature 1..194: note = hyper
  source 1..194: mol_type = genomic DNA
cgcagacgcccggatgcggaggacccagagcgctgcgcagctgaggagcacctggggagccaccgccggcgccaacttttgccatcccgggagccatagcggcagagagggggtcccggacccgaggtggcagcgaggggctctgctttggcagctgtcggggctggagctcaggaccccaactccagccaagt

SEQ ID NO: 70325 - DNA, 74 bp, Homo sapiens; identical to SEQ ID NO: 33358
  misc_feature 1..74: note = chr10:111217161-111217235
  misc_feature 1..74: note = hyper
  source 1..74: mol_type = genomic DNA

SEQ ID NO: 70326 - DNA, 30 bp, Homo sapiens
  misc_feature 1..30: note = chr10:111610387-111610417
  misc_feature 1..30: note = hypo
  source 1..30: mol_type = genomic DNA
caagggggctgggtgcggtggctcaagctt

SEQ ID NO: 70327 - DNA, 23 bp, Homo sapiens
  misc_feature 1..23: note = chr10:111674541-111674564
  misc_feature 1..23: note = hypo
  source 1..23: mol_type = genomic DNA
cgagactccgtctcaaaaaaaaa

SEQ ID NO: 70328 - DNA, 143 bp, Homo sapiens
  misc_feature 1..143: note = chr10:111902760-111902903
  misc_feature 1..143: note = hypo
  source 1..143: mol_type = genomic DNA
ggttgtggcaatagccgtttgccactgagtcagaggcctctctgatttgtcttgccacatccacccaaataatgacctctcagttcactcctccaacctgcttccggagagaatggcttccttaggaccgtacctgtagcagc

SEQ ID NO: 70329 - DNA, 30 bp, Homo sapiens
  misc_feature 1..30: note = chr10:111912926-111912956
  misc_feature 1..30: note = hypo
  source 1..30: mol_type = genomic DNA
caggtgcatccttgccgaggtgttgtgagg

SEQ ID NO: 70330 - DNA, 30 bp, Homo sapiens
  misc_feature 1..30: note = chr10:111921592-111921622
  misc_feature 1..30: note = hypo
  source 1..30: mol_type = genomic DNA
gcctgtgctttgacccggcaattccacttc

SEQ ID NO: 70331 - DNA, 33 bp, Homo sapiens; identical to SEQ ID NO: 42652
  misc_feature 1..33: note = chr10:111946090-111946123
  misc_feature 1..33: note = hypo
  source 1..33: mol_type = genomic DNA

SEQ ID NO: 70332 - DNA, 23 bp, Homo sapiens
  misc_feature 1..23: note = chr10:111954352-111954375
  misc_feature 1..23: note = hypo
  source 1..23: mol_type = genomic DNA
tgttgtacttttggccgggcgcg

SEQ ID NO: 70333 - DNA, 32 bp, Homo sapiens; identical to SEQ ID NO: 42653
  misc_feature 1..32: note = chr10:111979836-111979868
  misc_feature 1..32: note = hypo
  source 1..32: mol_type = genomic DNA

SEQ ID NO: 70334 - DNA, 30 bp, Homo sapiens
  misc_feature 1..30: note = chr10:111988079-111988109
  misc_feature 1..30: note = hypo
  source 1..30: mol_type = genomic DNA
gtagcaagctgggaacgcttagaagaggga

SEQ ID NO: 70335 - DNA, 30 bp, Homo sapiens
  misc_feature 1..30: note = chr10:11201306-11201336
  misc_feature 1..30: note = hypo
  source 1..30: mol_type = genomic DNA
caaactctgccctgccgaaaggcagtcatg

SEQ ID NO: 70336 - DNA, 18 bp, Homo sapiens
  misc_feature 1..18: note = chr10:112030553-112030571
  misc_feature 1..18: note = hypo
  source 1..18: mol_type = genomic DNA
aaaaaaggtgttggccgg

SEQ ID NO: 70337 - DNA, 308 bp, Homo sapiens
  misc_feature 1..308: note = chr10:11207022-11207330
  misc_feature 1..308: note = hyper
  source 1..308: mol_type = genomic DNA
ggagagggagagaaatccagcagacatctagctctgcctttctttcccagccacagccagggtagggctgataaggcgctgatgcgttgatggcagccttgcagagctagacctgcacttaacttgcagctgcctcccgagcctccaagatgtccacgccctgggtgacaggcggcagggcgctgccccgtgctcccccggctctgctcgacagcagcacgcagtgagagcctcgccgccgccgaggagcaactcatggtgcctccgctttgttttagttcatcaaatttctacgactcattaggcac

SEQ ID NO: 70338 - DNA, 15 bp, Homo sapiens
  misc_feature 1..15: note = chr10:11207709-11207724
  misc_feature 1..15: note = hyper
  source 1..15: mol_type = genomic DNA
cgagcccccagcctg

SEQ ID NO: 70339 - DNA, 39 bp, Homo sapiens
  misc_feature 1..39: note = chr10:112079204-112079243
  misc_feature 1..39: note = hypo
  source 1..39: mol_type = genomic DNA
aaaaaaaagaaaaaagccgggggtcggaaagaaaactcc

SEQ ID NO: 70340 - DNA, 15 bp, Homo sapiens
  misc_feature 1..15: note = chr10:112257148-112257163
  misc_feature 1..15: note = hyper
  source 1..15: mol_type = genomic DNA
ctataccccacccct

SEQ ID NO: 70341 - DNA, 37 bp, Homo sapiens
  misc_feature 1..37: note = chr10:112257205-112257242
  misc_feature 1..37: note = hyper
  source 1..37: mol_type = genomic DNA
cggtagcgacgggaatccgttccggactcctctgggg

SEQ ID NO: 70342 - DNA, 169 bp, Homo sapiens
  misc_feature 1..169: note = chr10:112257809-112257978
  misc_feature 1..169: note = hyper
  source 1..169: mol_type = genomic DNA
cgtggacaccctggccgtgggcacccgcggggcgcgcggcgcggggccgctggccggcggcggcggcggcatgaaggtcacgtcgctcgacgggcgccagctgcgcaagatgctccgcaaggaggcggcggcgcgctgcgtggtgctcgactgccggccctatctggcc

SEQ ID NO: 70343 - DNA, 77 bp, Homo sapiens
  misc_feature 1..77: note = chr10:112258331-112258408
  misc_feature 1..77: note = hyper
  source 1..77: mol_type = genomic DNA
cctacaccctgggaccgggagagtcaccacctgcaggagtctgcaccctgtggcttgttgtgcgcttgggagggcac

SEQ ID NO: 70344 - DNA, 1047 bp, Homo sapiens
  misc_feature 1..1047: note = chr10:112402947-112403994
  misc_feature 1..1047: note = hyper
  source 1..1047: mol_type = genomic DNA
caggcacgcaaggcacgcttttctctacttcccggggacgctggcctcaggacttagaactcctgtatgccggacagccggtaaggtctactgggcggccgctttctctggtctttctctgctccgtagacatttctgtgtcaggtgcctcgcatattcgcacccacgcgccagggcattaagccgaaccttgcttggtggctctcagccttgaaaggccgcaggatgtccgcgtccacagctgtgaaccggtgagtgcaggtggacgggcgcacgcgggcgccagggtaattaacagggcttcagagggcgtgacggtgaccgtacgttgtcggcgaactctcttttcatcctttacatttccacggagatttggccaataaataacaagaataaaatgtacgcatggttttgtctttgcgctcgtggggtcgtggcggggtcttttaagtgaagagaaaaagaaaccagaaacccacggtggccccaccggctgcttccggggacacctgaaatcagcagctggaactgacaatttggagagccccggggatggtcatctgagacctgggttacaatacaagtctgacctcggggcgagtccaggctttcttcccctcagggtcgggtgcctcaagagccagtggcgctggccgggctccagccgcgagcagatgccaggcccggcacactttgcacgggcgatgcgcgcggacgtcccgggcgcgctcggtccgcccggcttggcaggagctgcgagaggccgcgcgcaccgtccccagggacagccggaggactcagggctcccgggtggagcgagagcgcggcggccgaccgcgggctgcgtgtgtcgccttcctcacgcggtatgctgcgccgtggaacgctgggctacggaccctgagggtgcactgtggcgggtggcgtacgccgcgctccctccccgcttcctgcgcccagggtcggcgggcagagttcctgggtccagcttggcgctgagcagcccccggccgcagagcagctcccgccggtcgggagacgccccct

SEQ ID NO: 70345 - DNA, 338 bp, Homo sapiens
  misc_feature 1..338: note = chr10:112404226-112404564
  misc_feature 1..338: note = hyper
  source 1..338: mol_type = genomic DNA
agccatgagccaggacgcggaccccagcggtccggagcagccggacagagttgcctgcagtgtgcctggtgcccgggcgtccccggcaccctccggcccgcgagggatgcagcagccgccgccgccgccccagccaccgcccccgccccaagccggcctaccccagatcatccaaaagtaagaagggagaagggaacagggaccacgggtgcgcctggggacacgccccgagagccccctttgtggcttcatttcccgtccctgctgaacttcgctcgccccccttgggtttgaagttttctcgtaccccctctgggcagagtcggtgtccttctggc

SEQ ID NO: 70346 - DNA, 253 bp, Homo sapiens; identical to SEQ ID NO: 33363
  misc_feature 1..253: note = chr10:112431872-112432125
  misc_feature 1..253: note = hyper
  source 1..253: mol_type = genomic DNA

SEQ ID NO: 70347 - DNA, 79 bp, Homo sapiens; identical to SEQ ID NO: 33364
  misc_feature 1..79: note = chr10:112432360-112432439
  misc_feature 1..79: note = hyper
  source 1..79: mol_type = genomic DNA

SEQ ID NO: 70348 - DNA, 30 bp, Homo sapiens
  misc_feature 1..30: note = chr10:112440386-112440416
  misc_feature 1..30: note = hypo
  source 1..30: mol_type = genomic DNA
tgtggtgcgctgtcacgcaatgcgtgtcac

SEQ ID NO: 70349 - DNA, 79 bp, Homo sapiens; identical to SEQ ID NO: 42655
  misc_feature 1..79: note = chr10:112524488-112524567
  misc_feature 1..79: note = hypo
  source 1..79: mol_type = genomic DNA

SEQ ID NO: 70350 - DNA, 161 bp, Homo sapiens
  misc_feature 1..161: note = chr10:112553605-112553766
  misc_feature 1..161: note = hypo
  source 1..161: mol_type = genomic DNA
aagaaattcaaagtacgatctcaactcgcatttttcaatgtaaagaataatgtttagccccctgcttcctgtggtattattacctttgaagacctttaagggcttataagagagcccgggttgggaattactgcgtagcatggtgacgcttgctcaagagc

SEQ ID NO: 70351 - DNA, 88 bp, Homo sapiens
  misc_feature 1..88: note = chr10:112582575-112582663
  misc_feature 1..88: note = hypo
  source 1..88: mol_type = genomic DNA
tgttttttacctgcacggatctgagtttccatggaaaccccgccgtgaaatgccttcttgttgctagagaaaccgtgaggcccaggct

SEQ ID NO: 70352 - DNA, 63 bp, Homo sapiens
  misc_feature 1..63: note = chr10:112590867-112590930
  misc_feature 1..63: note = hypo
  source 1..63: mol_type = genomic DNA
gctgttctacacgagcgaggagacagcaaagatgagccactgccgcagcgctgtccactacag

SEQ ID NO: 70353 - DNA, 77 bp, Homo sapiens
  misc_feature 1..77: note = chr10:112836722-112836799
  misc_feature 1..77: note = hyper
  source 1..77: mol_type = genomic DNA
ccggctgctcagcaacgcttgcttgatcctggggctataaaacgagtccaccgtgagcgcagcggagcagcagcagc

SEQ ID NO: 70354 - DNA, 32 bp, Homo sapiens
  misc_feature 1..32: note = chr10:112837138-112837170
  misc_feature 1..32: note = hyper
  source 1..32: mol_type = genomic DNA
agaggcggcagagtccgcgccccagccccggg

SEQ ID NO: 70355 - DNA, 30 bp, Homo sapiens
  misc_feature 1..30: note = chr10:11343824-11343854
  misc_feature 1..30: note = hypo
  source 1..30: mol_type = genomic DNA
gcgggaggtggagtgcgaggcccttgtcca

SEQ ID NO: 70356 - DNA, 30 bp, Homo sapiens; identical to SEQ ID NO: 42515
  misc_feature 1..30: note = chr10:11344374-11344404
  misc_feature 1..30: note = hypo
  source 1..30: mol_type = genomic DNA

SEQ ID NO: 70357 - DNA, 30 bp, Homo sapiens
  misc_feature 1..30: note = chr10:11344756-11344786
  misc_feature 1..30: note = hypo
  source 1..30: mol_type = genomic DNA
attttcacattgttccgctgtgctgcggac

SEQ ID NO: 70358 - DNA, 155 bp, Homo sapiens
  misc_feature 1..155: note = chr10:11357627-11357782
  misc_feature 1..155: note = hypo
  source 1..155: mol_type = genomic DNA
gattagcgtggagcccgtgaagtggtagctgtgccgcggcctcattgttttattccagttagaaccgcctccagctttgacttttccagcagccaagtaggagcctcactgccttgacccccatttccggtacagctcctcgctctgaccttgtc

SEQ ID NO: 70359 - DNA, 83 bp, Homo sapiens; identical to SEQ ID NO: 15387
  misc_feature 1..83: note = chr10:113623006-113623089
  misc_feature 1..83: note = hypo
  source 1..83: mol_type = genomic DNA

SEQ ID NO: 70360 - DNA, 30 bp, Homo sapiens
  misc_feature 1..30: note = chr10:11367015-11367045
  misc_feature 1..30: note = hypo
  source 1..30: mol_type = genomic DNA
ggcagcttaggagcacgcacctctccagcc

SEQ ID NO: 70361 - DNA, 45 bp, Homo sapiens
  misc_feature 1..45: note = chr10:113748400-113748445
  misc_feature 1..45: note = hypo
  source 1..45: mol_type = genomic DNA
aaccgggacatctcacgtggccagagcagacggaaatgagcaaag

SEQ ID NO: 70362 - DNA, 30 bp, Homo sapiens
  misc_feature 1..30: note = chr10:11381701-11381731
  misc_feature 1..30: note = hypo
  source 1..30: mol_type = genomic DNA
ggacatagaactaagcgcacatgaacagaa

SEQ ID NO: 70363 - DNA, 30 bp, Homo sapiens
  misc_feature 1..30: note = chr10:11405472-11405502
  misc_feature 1..30: note = hypo
  source 1..30: mol_type = genomic DNA
ggttacagatacagccggggctggtggtca

SEQ ID NO: 70364 - DNA, 30 bp, Homo sapiens
  misc_feature 1..30: note = chr10:11429024-11429054
  misc_feature 1..30: note = hypo
  source 1..30: mol_type = genomic DNA
gccaacgctcccggccgagaaacaaaacat

SEQ ID NO: 70365 - DNA, 57 bp, Homo sapiens
  misc_feature 1..57: note = chr10:11436196-11436253
  misc_feature 1..57: note = hypo
  source 1..57: mol_type = genomic DNA
ttctcgttctagtaacgtcttcccgcctcccatatttcccaccgtaaagagcttaaa

SEQ ID NO: 70366 - DNA, 39 bp, Homo sapiens
  misc_feature 1..39: note = chr10:114571159-114571198
  misc_feature 1..39: note = hypo
  source 1..39: mol_type = genomic DNA
aaggtgagtgcagaccgggcgcggtggctcacgcctgta

SEQ ID NO: 70367 - DNA, 39 bp, Homo sapiens
  misc_feature 1..39: note = chr10:114571498-114571537
  misc_feature 1..39: note = hypo
  source 1..39: mol_type = genomic DNA
gagaactggctattggagaacactcgtaatgcctgttcc

SEQ ID NO: 70368 - DNA, 346 bp, Homo sapiens
  misc_feature 1..346: note = chr10:114712100-114712446
  misc_feature 1..346: note = hyper
  source 1..346: mol_type = genomic DNA
ttttctttggcaacccgcagggccgcgagcgccctgggcgccgtggcgggctccgctgcccggcgcactggctgcgggctctcccgggccgcgcagggcagcagggctgagtggggcggggaggcccctgcggcccggattcttggtttgtgtgcagccggaatggactcctccaagcggacttgtgtatttctagggaattttggcgccttgggatgtatggcggggtcggcgctcgccagcttccgtgtaggcccgtcgtgggccccaggggggccagagaccagggtgtgcgggctcaaggaggtgcgggggccgagggaggctggggcgcctctccttcaag

SEQ ID NO: 70369 - DNA, 151 bp, Homo sapiens; identical to SEQ ID NO: 42517
  misc_feature 1..151: note = chr10:11472842-11472993
  misc_feature 1..151: note = hypo
  source 1..151: mol_type = genomic DNA

SEQ ID NO: 70370 - DNA, 43 bp, Homo sapiens
  misc_feature 1..43: note = chr10:114752064-114752107
  misc_feature 1..43: note = hypo
  source 1..43: mol_type = genomic DNA
gcatagattccattccgcacgccaccctcgcctccgcccccca

SEQ ID NO: 70371 - DNA, 30 bp, Homo sapiens
  misc_feature 1..30: note = chr10:11480033-11480063
  misc_feature 1..30: note = hypo
  source 1..30: mol_type = genomic DNA
tgggccagggatggccgtaccgcgcctggc

SEQ ID NO: 70372 - DNA, 213 bp, Homo sapiens; identical to SEQ ID NO: 42662
  misc_feature 1..213: note = chr10:114829478-114829691
  misc_feature 1..213: note = hypo
  source 1..213: mol_type = genomic DNA

SEQ ID NO: 70373 - DNA, 30 bp, Homo sapiens; identical to SEQ ID NO: 42518
  misc_feature 1..30: note = chr10:11486576-11486606
  misc_feature 1..30: note = hypo
  source 1..30: mol_type = genomic DNA

SEQ ID NO: 70374 - DNA, 30 bp, Homo sapiens; identical to SEQ ID NO: 42663
  misc_feature 1..30: note = chr10:115479125-115479155
  misc_feature 1..30: note = hypo
  source 1..30: mol_type = genomic DNA

SEQ ID NO: 70375 - DNA, 43 bp, Homo sapiens
  misc_feature 1..43: note = chr10:115585285-115585328
  misc_feature 1..43: note = hypo
  source 1..43: mol_type = genomic DNA
atagagtttgggggccgggcacacgcctgtaatcccagcactt

SEQ ID NO: 70376 - DNA, 165 bp, Homo sapiens
  misc_feature 1..165: note = chr10:1156723-1156888
  misc_feature 1..165: note = hypo
  source 1..165: mol_type = genomic DNA
atcgccaaggacatccgtgagcctccgatgggtgtccagcgtgttagcgcccagacccacagggcctggcaccctgataggtgggaatgttggcccagggccgggcctgaggcctgcaggactgcctgctcatccgggaagtagctctgccggttttacagggtg

SEQ ID NO: 70377 - DNA, 54 bp, Homo sapiens
  misc_feature 1..54: note = chr10:115803627-115803681
  misc_feature 1..54: note = hyper
  source 1..54: mol_type = genomic DNA
aacatgctgaagtcccggcggctcttccagcagcggcagcggctccagcagcag

SEQ ID NO: 70378 - DNA, 249 bp, Homo sapiens
  misc_feature 1..249: note = chr10:115804010-115804259
  misc_feature 1..249: note = hyper
  source 1..249: mol_type = genomic DNA
ctcgttgctgcctcccgccagcgaaagccccgagccgctgtctcagcagtggacagcgggcatgggtctgctgatggcgctcatcgtgctgctcatcgtggcgggcaatgtgctggtgatcgtggccatcgccaagacgccgcggctgcagacgctcaccaacctcttcatcatgtccctggccagcgccgacctggtcatggggctgctggtggtgccgttcggggccaccatcgtggtgtggggccg

SEQ ID NO: 70379 - DNA, 23 bp, Homo sapiens
  misc_feature 1..23: note = chr10:115804539-115804562
  misc_feature 1..23: note = hyper
  source 1..23: mol_type = genomic DNA
gacttcgtcaccaaccgggccta

SEQ ID NO: 70380 - DNA, 652 bp, Homo sapiens
  misc_feature 1..652: note = chr10:115804635-115805287
  misc_feature 1..652: note = hyper
  source 1..652: mol_type = genomic DNA
cgcgaggcccagaagcaggtgaagaagatcgacagctgcgagcgccgtttcctcggcggcccagcgcggccgccctcgccctcgccctcgcccgtccccgcgcccgcgccgccgcccggacccccgcgccccgccgccgccgccgccaccgccccgctggccaacgggcgtgcgggtaagcggcggccctcgcgcctcgtggccctgcgcgagcagaaggcgctcaagacgctgggcatcatcatgggcgtcttcacgctctgctggctgcccttcttcctggccaacgtggtgaaggccttccaccgcgagctggtgcccgaccgcctcttcgtcttcttcaactggctgggctacgccaactcggccttcaaccccatcatctactgccgcagccccgacttccgcaaggccttccagggactgctctgctgcgcgcgcagggctgcccgccggcgccacgcgacccacggagaccggccgcgcgcctcgggctgtctggcccggcccggacccccgccatcgcccggggccgcctcggacgacgacgacgacgatgtcgtcggggccacgccgcccgcgcgcctgctggagccctgggccggctgcaacggcggggcggcggcggacagcgactcgagcctggacgagc

SEQ ID NO: 70381 - DNA, 34 bp, Homo sapiens; identical to SEQ ID NO: 15388
  misc_feature 1..34: note = chr10:115844821-115844855
  misc_feature 1..34: note = hypo
  source 1..34: mol_type = genomic DNA

SEQ ID NO: 70382 - DNA, 147 bp, Homo sapiens
  misc_feature 1..147: note = chr10:115999036-115999183
  misc_feature 1..147: note = hyper
  source 1..147: mol_type = genomic DNA
ggaggctgggtgacccgcgtagaagtgaagtacttttttatttgcagacctgggccgatgccgctttaaaaaacgcgaggggctctatgcacctccctggcggtagttcctccgacctcagccgggtcgggtcgtgccgccctctcc

SEQ ID NO: 70383 - DNA, 44 bp, Homo sapiens
  misc_feature 1..44: note = chr10:116045978-116046022
  misc_feature 1..44: note = hypo
  source 1..44: mol_type = genomic DNA
cggcaggcggcagagcgtggcttcgggagcgccaccaggacagg

SEQ ID NO: 70384 - DNA, 162 bp, Homo sapiens
  misc_feature 1..162: note = chr10:116061168-116061330
  misc_feature 1..162: note = hypo
  source 1..162: mol_type = genomic DNA
ggctaggcaggccatcgatgtaagtgttgggctctgagaactttctctgcatcagtctggaaacagggcgaggtggcacacatgaagcagccggggcagggtggtgaaagcaccagactccaaggattcccagtgaggagtggttgccgtgaaagtggtggc

SEQ ID NO: 70385 - DNA, 30 bp, Homo sapiens
  misc_feature 1..30: note = chr10:116064482-116064512
  misc_feature 1..30: note = hyper
  source 1..30: mol_type = genomic DNA
gcttggccagctcctcgcccttgtggagga

SEQ ID NO: 70386 - DNA, 477 bp, Homo sapiens
  misc_feature 1..477: note = chr10:116163144-116163621
  misc_feature 1..477: note = hyper
  source 1..477: mol_type = genomic DNA
gggatcagagccctccgggagtgagattcctgggaatctgagcgttctctttttattactctctcccaggggaaaacaaatatagaagcagcatttcctcccgcaggtttggcggagaccggtccagcaaaagagaaggcaagaggcttttccaaagggaaggggtctgcaggaggatgggggaggggggagcgcccgcagggttcctcttaaggggcaactccctgtactcccttttcaaaagaaccgcaatcgagacttgtagaccagctccgaggctccgagtgtgggtgctaagctgggcgtccggcgcacccgggacggcccgcccaccggggtttggcggagatcctggcccccgccaaacccaaagctcgcccagctgcgcactgagctaagccctcgggtccggacgcctccaggagctccacctgccgggcactccattcggcccccgaccctcgcatccctcctttc

SEQ ID NO: 70387 - DNA, 30 bp, Homo sapiens
  misc_feature 1..30: note = chr10:116163889-116163919
  misc_feature 1..30: note = hyper
  source 1..30: mol_type = genomic DNA
ggtggagtggggtgccgggctcaccctctc

SEQ ID NO: 70388 - DNA, 238 bp, Homo sapiens
  misc_feature 1..238: note = chr10:116164126-116164364
  misc_feature 1..238: note = hyper
  source 1..238: mol_type = genomic DNA
cctagccctgccctccgcgtcgctgggcgaaagggagtgggtgtgcgccgcgcgaggaacccgcgccctcacctttgtaccgctccatcggggccacggagtgcgctcctcgcggctcggcttctgcgctgctctcccggcgctcggctcagcgcccaggccgccgcgctggcccctccccgtgaggtcacgctcgcggccggacctcctggcggggccgccgcgcccagggtcctcg

SEQ ID NO: 70389 - DNA, 80 bp, Homo sapiens
  misc_feature 1..80: note = chr10:116164574-116164654
  misc_feature 1..80: note = hyper
  source 1..80: mol_type = genomic DNA
ctctgggggaggctccgggaggccgggcttgggtgggcctccaagattgttcccacacccctgcccgctgcaaacccaat

SEQ ID NO: 70390 - DNA, 72 bp, Homo sapiens; identical to SEQ ID NO: 42665
  misc_feature 1..72: note = chr10:116331126-116331198
  misc_feature 1..72: note = hypo
  source 1..72: mol_type = genomic DNA

SEQ ID NO: 70391 - DNA, 87 bp, Homo sapiens
  misc_feature 1..87: note = chr10:116391726-116391813
  misc_feature 1..87: note = hyper
  source 1..87: mol_type = genomic DNA
ctctgggagtggaagcgcgcctcggcagacagatccgcgggcgctggggcagccaggagaagccccggcatccgcttgtgaggtccg

SEQ ID NO: 70392 - DNA, 41 bp, Homo sapiens
  misc_feature 1..41: note = chr10:116392017-116392058
  misc_feature 1..41: note = hyper
  source 1..41: mol_type = genomic DNA
ccaccttgtattcctcgcaccgaggacgggctatgaaaagc

SEQ ID NO: 70393 - DNA, 205 bp, Homo sapiens
  misc_feature 1..205: note = chr10:116675455-116675660
  misc_feature 1..205: note = hypo
  source 1..205: mol_type = genomic DNA
tctacaatggaaaagcgaaatgcagtatgatcaattacctgcttaatttgatgaatcaacaggccaggtttaaatattactttgaagcccgaaataacggattgggctgttattagcaggttaaagttcctaattctcccttcactgagtactgtttgactagtgcacagtttctcagcagtaacagtaccggtgttttggcctg

SEQ ID NO: 70394 - DNA, 195 bp, Homo sapiens; identical to SEQ ID NO: 33373
  misc_feature 1..195: note = chr10:116852246-116852441
  misc_feature 1..195: note = hyper
  source 1..195: mol_type = genomic DNA

SEQ ID NO: 70395 - DNA, 975 bp, Homo sapiens
  misc_feature 1..975: note = chr10:116852647-116853622
  misc_feature 1..975: note = hyper
  source 1..975: mol_type = genomic DNA
tttctgctgaagctgcgaagcctgtgtcgatctctcattcgtggggctcccggggcgcggggtgcgggtggggccggggtgcccgcaccggccggggggaagggcacgcgggccacacctggggggcctgtctccagtcagcgcgcgggccaggcggggtgggcgcgcgcgcgtgggggagtccccggtccctgtcaggggcggggcgagaccaaggcgccgggcctgtggggaggagtgtaggcgcgcgcgagggcggggggcggccccacgcatcgtgggctcccggcgctgccgctgcggccggctcgaggcaccggagacagaatggctgccggggcgcccttgaccgccgggcgggcgaggcggggctgaccgccgcctccttgatcgcccccttccacgttgggcgcgcccacttcggggcgcccgctcggcccccgccctcctgggcgcgcggcgctcggagccgaggcagttggcgcgggccgcgggcgaggcggggccgcgcgcggggtcccctcctcctcccggtcaggtcccctcaggagcgccgggcgcagtctgcgcctcccgctccccgcctccggccgggtccgggacgccgcggctgtggggtcggcccgctaaggacaaggtcgggagactgggtggcgatgcccgagtgcgactggaggcagccgagcggaggcgacggcggttgggatctgtccctcctgaccggggagcgggactcggacgggcgccggtgaggaggaggagaagcggcggcggagaggttttctgcggccggaattcccttcaacagcatccctgtcggcgcccgcgagcgcagtctcgccgggcaggggcgccggggaagatggagactgggggccgggcccgcactggtaccccgcagccagcggccccgggggtgtggagggctcggccggcgggcggcggcggcgggggcgcctcctcctggctgctgga

SEQ ID NO: 70396 - DNA, 353 bp, Homo sapiens
  misc_feature 1..353: note = chr10:116853672-116854025
  misc_feature 1..353: note = hyper
  source 1..353: mol_type = genomic DNA
cgcaggtgtcccagtccaagccgtgcgagaggaccggctcctgcttctcgggccgctgtgtcaactccacctgcctctgcgacccgggctgggtgggggaccagtgccagcactgccagggcaggttcaagtaagtgccttcgccggaccccgaacctccagccctgcctcgctcccgtcgcggccttccccgcccccctcgcggcctcccccgcccccgtcgctgcctctgatcccccggccgtgagtgaacctcagcgcgcggcgggagcgggcgagagtggggcccgcgccgcgccccctccagccccggggcgccccgggagagctcgggcccgcgcggagccctgacc

SEQ ID NO: 70397 - DNA, 71 bp, Homo sapiens
  misc_feature 1..71: note = chr10:11700944-11701015
  misc_feature 1..71: note = hypo
  source 1..71: mol_type = genomic DNA
gatgcatggctttgtcgccaggacctggcttcatcacccgggcagtcatacctgctcgtccagtatttgaa

SEQ ID NO: 70398 - DNA, 36 bp, Homo sapiens
  misc_feature 1..36: note = chr10:117011797-117011833
  misc_feature 1..36: note = hypo
  source 1..36: mol_type = genomic DNA
aggtcttatagattctttggtcgtatactctctttc

SEQ ID NO: 70399 - DNA, 30 bp, Homo sapiens
  misc_feature 1..30: note = chr10:117628246-117628276
  misc_feature 1..30: note = hypo
  source 1..30: mol_type = genomic DNA
gctcaaaagaggtttcggctccttttaaat

SEQ ID NO: 70400 - DNA, 97 bp, Homo sapiens
  misc_feature 1..97: note = chr10:11784135-11784232
  misc_feature 1..97: note = hyper
  source 1..97: mol_type = genomic DNA
caaacgccacattcccggtgttggtgcaaaaagaaatcatcctactcctcccctcgcttaaactttcccacaggccttgtcaaacaacccctggagc

SEQ ID NO: 70401 - DNA, 101 bp, Homo sapiens
  misc_feature 1..101: note = chr10:11784285-11784386
  misc_feature 1..101: note = hyper
  source 1..101: mol_type = genomic DNA
cggcgagccgggggcgggcctcgtgggggcggggcggggcgtgccggggcggggaggggcgtgccggggcggggcggggcgtgccggggcggggcgtagta

SEQ ID NO: 70402 - DNA, 108 bp, Homo sapiens
  misc_feature 1..108: note = chr10:118030598-118030706
  misc_feature 1..108: note = hyper
  source 1..108: mol_type = genomic DNA
gccgctcacttcggccgacaggagcaagtctgcggggcagaggggagggagcctgagtgcggcgggcggggaccccggccgcccctgctccgggcgagggcgcgcgcc

SEQ ID NO: 70403 - DNA, 247 bp, Homo sapiens
  misc_feature 1..247: note = chr10:118031302-118031549
  misc_feature 1..247: note = hyper
  source 1..247: mol_type = genomic DNA
aaaagcttcaggcagcgccgcgccgccaccgcctccctaacccggggattcgcgatcccattccccaaaaagacacttcttccttccacatccaccacacccgcgccccaattttggtgcggagggcggggtgggctgctgcaagcgaccctaggaaagactcagagggtaagaaagcccgcggcgggcctcgacttacccaagagcggcagcgcgaagtacagggtcgccaggaacatggtgccgg

SEQ ID NO: 70404 - DNA, 240 bp, Homo sapiens
  misc_feature 1..240: note = chr10:118031624-118031864
  misc_feature 1..240: note = hyper
  source 1..240: mol_type = genomic DNA
cgatccccggacagctgtgctgctctggccgcccaaagttcagctccatccagtgaaagaggaaactccgggtctggcagcagccaccgccgccggcgactcagctccgggatggcgagggcgggaggcggttccgcttttaggggttcaggtccgacccaacctggaagggagggcgcgctttgagatgagagcggagagcgccggagactccccccacagaaccctctcccctccccc

SEQ ID NO: 70405 - DNA, 365 bp, Homo sapiens; identical to SEQ ID NO: 33378
  misc_feature 1..365: note = chr10:118031865-118032230
  misc_feature 1..365: note = hyper
  source 1..365: mol_type = genomic DNA

SEQ ID NO: 70406 - DNA, 773 bp, Homo sapiens
  misc_feature 1..773: note = chr10:118032412-118033185
  misc_feature 1..773: note = hyper
  source 1..773: mol_type = genomic DNA
cgctcctctcacactctcgcccggtgcccaggactcgggcgcttccgcaccccagcccagggcgagcgcgccggcccgcagtcccggcgtgccccggcaggtgcagcccggcgccacgagcgccccccgggccctaaagttgggagacgccagcaaaaagaaaggggtggccggaggaggggggaagaaggagtggggaagagggacgggaagcggcaatgggttcccaaacagaacgaaaaaaactccaaatgccaccaacctggactcaaccgaccgcgtccagctgcggcgaggagccagtttgtttatttacttatttattctttcagggcaatggtgtccccgccccctccttccctttccgggctcactttatctgcgctaggaaaagaaaaaaaagaaaaaaaaatagatgcggtaatcttcgagagctcgaagggccgagttgggccaggacgatttccgagcagagccctcggctcggatgctcgttagggatgttagtggttattggaagcggcgcggagaatggcgtgttccgaggccagatttcttctggccagaggaccctcggcctgctcctgttcccgccgctccgcagctccagctccctcctaagctcgcccgccaggcagccgcagctgcacacgcccgcttgcggtgggacccgcggccggacccgtactcgcgcacaggacacgcagtgttctgcagccggccgcgggtgctgccagacacacacactctctctctctctctctctctctgtc

SEQ ID NO: 70407 - DNA, 749 bp, Homo sapiens
  misc_feature 1..749: note = chr10:118033245-118033994
  misc_feature 1..749: note = hyper
  source 1..749: mol_type = genomic DNA
acaagggctctttcttcttagggcaatcgagccagacccttcttcggaacacaaagttttcccccacgtcactagtggctgtgattcaagacttggtgctttcaagacacactcagacccaggacgctggagcggcgatcctgggatgcgcccatccgttcgtccacgccagcgcgtgcacactcacactcacacgcacacatgcacacgcagtctctacctctctcctggagctccgacaaggagacaaaagcggagcccccagcccactgcatttaaacccggccagacctggctttagaaaatttataagctgacctccattttggctgtttcgagagtaaattaacaacaacaaaaaaagcctaacatgtacacagcccttcgccccaacccctgggaccgctggttcccagtcgtgctgctcaccccccgccccccacgcctgacacacgctccccttcccgcacgccggggggcgcccggggcaccgaagtctacactgggtcgggagaccggtctaggagccagccggcagtgctcgggatctttgctgatgtccaagttcatctctcggggagaccgagtttgaatcaaatctgcgtgcgcccagctgtcaaatctgcaaacctatcacgccagacaatgggccgccgcggaggacagacaagaatggctcattttgatcgaggggggtaaattgaaaagggcacgggctttggttgaagtttgaggcccgggtgtcaggg

SEQ ID NO: 70408 - DNA, 26 bp, Homo sapiens
  misc_feature 1..26: note = chr10:118034142-118034168
  misc_feature 1..26: note = hyper
  source 1..26: mol_type = genomic DNA
cgccccaaacccgggggacatcctac

SEQ ID NO: 70409 - DNA, 30 bp, Homo sapiens
  misc_feature 1..30: note = chr10:11825336-11825366
  misc_feature 1..30: note = hypo
  source 1..30: mol_type = genomic DNA
taggatgctgagcagcgcccctgacctctc

SEQ ID NO: 70410 - DNA, 56 bp, Homo sapiens
  misc_feature 1..56: note = chr10:118547540-118547596
  misc_feature 1..56: note = hyper
  source 1..56: mol_type = genomic DNA
ctcgtgccacctccacgcaacgccgttaaattcagatgctacgctaaaagcagagg

SEQ ID NO: 70411 - DNA, 261 bp, Homo sapiens
  misc_feature 1..261: note = chr10:118608457-118608718
  misc_feature 1..261: note = hyper
  source 1..261: mol_type = genomic DNA
ggcccagccagcacacggctcggctcagagcaggtagttaataaacatgagccgaatgaaagaattcctgagatcgccaccgctcagtaaggatgccctgagcccctacatccctcccccaacagagtgggcctgcctggcacgggcggccttagcaacccggaggagctcactaacagcagagagcaagggggcgcgtggggagggcggggtggcccaagacgctgggccactgggacccgagcgcgcgaccccagccgg

SEQ ID NO: 70412 - DNA, 221 bp, Homo sapiens
  misc_feature 1..221: note = chr10:118890913-118891134
  misc_feature 1..221: note = hyper
  source 1..221: mol_type = genomic DNA
tgaactgtctgtgggcggctgctgtgatctcagcaaaaagcggagctcaaggctcagggactccgccgcccacactgtgccccgccttattttggatgcctccaacttcagcttcaggcacagtacacgagtaggggcagtaaggcctggctagggccggtgccgcacgggagctgcgggtccctgcaacacccaggtgtgcaggcgctacaagaaggagc

SEQ ID NO: 70413 - DNA, 483 bp, Homo sapiens
  misc_feature 1..483: note = chr10:118891179-118891662
  misc_feature 1..483: note = hyper
  source 1..483: mol_type = genomic DNA
cgctttagaagagcgtgtccggaagtgtcctccccggccctcctcgcttcccaagatttgtttgcaacgtctacacccgtcaccaccgcataagcaccagggtgaggaggtctctttgcaggaattaatatcgatttcagtctcctgctccttcaaagtttctctttgacgatggcgagacttatattctaagtcagaagaaaataaaaccttgcctattctgggcccatgattgcacaaaatccaaaatgctgccggcatgaagatgcagctggaagactctagaaacctagcattaggaggcagagactttatagtgcccagagatgagttcctaaataaactaagaattacgcagtgggaaattaaggaggagggtctgaggggccgacctcagagggacagatagagaaatcgagagcgaaacactcaaggaagtggaacaaatcgtcgtagccaggcgtctctgcctctccggaaacc

SEQ ID NO: 70414 - DNA, 59 bp, Homo sapiens; identical to SEQ ID NO: 930
  misc_feature 1..59: note = chr10:118891715-118891774
  misc_feature 1..59: note = hyper
  source 1..59: mol_type = genomic DNA

SEQ ID NO: 70415 - DNA, 444 bp, Homo sapiens; identical to SEQ ID NO: 931
  misc_feature 1..444: note = chr10:118892013-118892457
  misc_feature 1..444: note = hyper
  source 1..444: mol_type = genomic DNA

SEQ ID NO: 70416 - DNA, 1064 bp, Homo sapiens
  misc_feature 1..1064: note = chr10:118892517-118893581
  misc_feature 1..1064: note = hyper
  source 1..1064: mol_type = genomic DNA
cgccggctgcgcaggctaccgccggcagccgctttgctctttcctggaggagtgggaagctgtcggccaccgccccgaacaggctcggagaaaagattctgaatttcctttgattagcggcgttaccttttcctttgcttttcccccattaaattcctgtttaaagttacaacacccagaaccttaattttgcattgccctgtggggcattctgtatcctgaattttcttacaccttccaaatttcatcattggaagtatttaaaaactggttccacttcatctggttttacgtagcaattgcttttattgctgattagatcaaatttatcagtgtcgttgcctactacgacgtttgttactgtttcctggggtcgggggtggttgtgattggagttgccctaaaggggagaaaaaccgcaggatttgcccgccaggaagctgtgttgtgtaccgactatcccgagaggtccgcaaagcggggcccaggggctcccacaagccctggtttccctggcaagaggaaggaacgtcctccttttttggtctaaagaaacctggaagcccctggggtctgcgcgcagttttcctctttcaaatattcctaggaatagtcggcagcggcagcagccgcagcagccgcggatctagagcaaacgtcctgtgctttggagttagaaccagtcttttccctcctgggctgggcacggggtcagggcatcaggttgactaactcgggcatttttcccaattctttggatcgctcctggattcagaaggaagttgggggttggggaggaatctcagaggaaaggtagtagaaaaaaaaaatagcccgaatgagatgaaattggtagcagagtctagtgggaaaggagagctgtcagaggcctggtgggagccaggagcccagcgcaggagctctgggcacctaatgcgcgtgagtccataaatatcaccacaatagatactataaatataaatacagggaaacacttaaaatcagtccagcgcttttttctcggccccttctttattgttggtccgggagtaaggctcgaaggc

SEQ ID NO: 70417 - DNA, 147 bp, Homo sapiens
  misc_feature 1..147: note = chr10:118893679-118893826
  misc_feature 1..147: note = hyper
  source 1..147: mol_type = genomic DNA
cgagcagcgagggcaccggcaggctgaagaggctgtggcccgcggccggggcgcctgcgtgcaatccccccggcccggcgggcccgggacctggagcaccgcccacagccggcgggtgcggggatgcagcgcccgctgggcccgggg

SEQ ID NO: 70418 - DNA, 38 bp, Homo sapiens; identical to SEQ ID NO: 33391
  misc_feature 1..38: note = chr10:118894034-118894072
  misc_feature 1..38: note = hyper
  source 1..38: mol_type = genomic DNA

SEQ ID NO: 70419 - DNA, 23 bp, Homo sapiens
  misc_feature 1..23: note = chr10:118894477-118894500
  misc_feature 1..23: note = hyper
  source 1..23: mol_type = genomic DNA
ggaatttccggtggagggtgtga

SEQ ID NO: 70420 - DNA, 1242 bp, Homo sapiens
  misc_feature 1..1242: note = chr10:118896177-118897419
  misc_feature 1..1242: note = hyper
  source 1..1242: mol_type = genomic DNA
aggggagatgtcagccgccagaaccctcccgtccccctccacctccttggcccgagctggatttggggacacagtccccagaagcgtgcagttttggggatggggggcggggtgcggagcgcgaccacaaccaggtagcaaagacactgtgtggagggcaaggggcctaactccataccgctgaccgaaggagggaccacactttgtctttttgtagagtcctccagacaggggagagaaaaaaatccaatcaattccacataggcggacgtttcttccggcctgggggggcctcggctgagccttccgggtcccctgtagcctgagggtacccttgtcgccccgcccgggtcctgcgggccccagctctgggcttgccgaccagaccgtgatccagacgtccccacccccaccctcgagtctccttccctccggagtccgcgcggcggaaggaggagggactgagtcggggccggccgggcccggagatctgctgctggctggggcggcgccgggccggggcccggcctcgcagcctccgccgccggggctaagtgcacgccgcgccatccgagagcggcagagcagagcaccaaagcggcaaccgcggctccgtaaccaagcccagctgcctctcccggcggcagcggtcgggcaccgatcgcggccgtggggtcctcggcccagtgcactaactggcagggccgtagcccgcgatcggcagctgttctccggggctcgcgttcccccttgggtgcgctcagccctccagagcgcgggagtcccctggccggctcccggcaggtcgtccggcccttggagcgcgcacacctcctcccggagttttctgctcctttcccgggtcggaggccgcagcccgatgcccggccgcacccgcgcagcccctcatctccccccgcagcccggtcagcggggcccctccgggcgtggagggccgaggcccctggagagcgcaccggagagtcccaggcgcttgtccccagccggactcggggcggggagggccaacaactttctcccaagtcccagccggcactccttcccaccggcctgtgtcggcggcagcgcgcagctccggccccggagtcgaccccaaagaacgcgcctggcagccctgcccatccctacctcggaccaggatccggcggcagtaatccgggtccgctgcggaattggatttacttttgttacaatcctcagcagcgcccgacgctgagaagg

SEQ ID NO: 70421 - DNA, 369 bp, Homo sapiens
  misc_feature 1..369: note = chr10:118897478-118897847
  misc_feature 1..369: note = hyper
  source 1..369: mol_type = genomic DNA
cgactctccttgtgcgcgttcttcgagacccgggcagcctcggcgtccgagtggcatcgaacgtccattttgtctggtttcccgaacataggcaagaacaacaacaaaaacagaaaggaaaaaaaaagcaaaaaaaaaaaaaaggggggggggcggagaaggaaaaaaaaaagaggaaaaaggggacaaaacccccgacaacgcggcccgtacgcccggcccggcgacaggcaaggggcaagaatgaatgtccccgcggggaggcttcggcggccgcgcgcgggtcagcggcgacgggagagtggcgcgctcgccgagaggcggccagtctggtccaggatcctggtggagctgcggcgaggccgcctc

SEQ ID NO: 70422 - DNA, 307 bp, Homo sapiens; identical to SEQ ID NO: 33396
  misc_feature 1..307: note = chr10:118897848-118898155
  misc_feature 1..307: note = hyper
  source 1..307: mol_type = genomic DNA

SEQ ID NO: 70423 - DNA, 541 bp, Homo sapiens
  misc_feature 1..541: note = chr10:118898853-118899394
  misc_feature 1..541: note = hyper
  source 1..541: mol_type = genomic DNA
tgctccagcccttctcgtcaccttgccggggcagaagccctctccacgccgctctccccattcattcctttatgggaaatgcggagcaaaaggagtgaaagatggcaattatctaattggactattaacaaacagtcctctgagtgcggcggtctggcgtggctcctgggcgggggaagggccgtgttccctgccctcattcacaaagagtgcaggggccggggaggaaaggggttttttaaagggggtgggtggggggagaggagaggtgggaggtttggctgagaatttttccacacaattccaagaatggggcggaggcggggggaggggagggggttggggagggggtcgcggcgagcgggtgggaggaaggccgggagggggaggggtgcgagtgtgtgtggcgggcccctaggggctccagctcgcagcgacgcgcgcaccgtccgcacctcccgccccgccgccacctcccctgcctccgccgccaccccgcgggacccctctaccgtcccaagccaggagggggccccctgag

SEQ ID NO: 70424 - DNA, 21 bp, Homo sapiens
  misc_feature 1..21: note = chr10:118899582-118899603
  misc_feature 1..21: note = hyper
  source 1..21: mol_type = genomic DNA
cgggctgatcgcccctcagcc

SEQ ID NO: 70425 - DNA, 353 bp, Homo sapiens; identical to SEQ ID NO: 935
  misc_feature 1..353: note = chr10:118899892-118900245
  misc_feature 1..353: note = hyper
  source 1..353: mol_type = genomic DNA

SEQ ID NO: 70426 - DNA, 193 bp, Homo sapiens
  misc_feature 1..193: note = chr10:118900323-118900516
  misc_feature 1..193: note = hyper
  source 1..193: mol_type = genomic DNA
cgcccggtcaaagacctggaagaaagctttttaaaaaataaaaatggcccaacccattacattttcttttaggtagatgggggagctggggggcggggcgggggcagtcagggaacaaacagctgcccttagaaatgacacgccctgtgggcaatggcggcgctgggacgtctgcagccgcattcactgccac

SEQ ID NO: 70427 - DNA, 674 bp, Homo sapiens
  misc_feature 1..674: note = chr10:118922143-118922817
  misc_feature 1..674: note = hyper
  source 1..674: mol_type = genomic DNA
atttttgaaagctttcgggcctctctgagaaagccgttccaaatccaccccgtatcaatttgccttctagaagcggcaggataagcacacgggtttgggcagtgctcacattttgggtttattggcttgatggggttgtttggggcgctctcagttacaaactgcagaagagtgggggcgggggacaggatggggaggaaagggtgggcgaaggagccgagagtaagacaagccgaagggtggaaactgcgggagggagaggaaacgccgaaggcgatgtagagtcctgcgagggaccgggagaggtagggagggatccgagccgcagtcctgagggagagcgaccgcgcgccccgcagccgagctgggtcccttcgccccgcccggaatcccggcccccgcccgccccacgcaagtccccgtgccccctccgggaggtgggagtcgccgggactctgcgctccgccagcctccgtctgctggccgggtccgggatccgcacccggagaggctgaaccgaggctgaaccgaggcggacgcagccccgggtcggtggctcgcctggccgggtggggtgggagcgattttctggcggtggcgtttgcaggaggggaggagacagcgccacccagggcctccccgagcactgccggccaggccgggctcgggggccg

SEQ ID NO: 70428 - DNA, 544 bp, Homo sapiens
  misc_feature 1..544: note = chr10:118923031-118923575
  misc_feature 1..544: note = hyper
  source 1..544: mol_type = genomic DNA
cgcctcaacttcctgcgccgacggctggggacgcggagaaccctctccgagctggggtccccgcctgctgggcaacctcacctcaacgtctggcctggcctggggccgcttggactcggcagcggctgcactcctacagagcccagacgcgccttctcgctttttcctttctgggccggggccctaaactcccggaactcgccgcaagaggagcgttgaaaacaaaagggacagcccaagctgtcccgcccgctgcgcccgaggagcatccccttggcgctgcaggctgtcgcctcccccagcacctggcggggcgggtgccaggctgggcctctagacggtttcaccgctgcttatcatttctccttcattttgcaggggcaggggagctgcccctcccttcggagaaaggccgcgcctgcacccaaaggtaaccctcgggtgaccccgggagcggggctgtctggccttggtgcgagaccccgggcggggggtcagaggtttctgttgcatcagagaaacacggcagcgtcaaaaagaaaaa

SEQ ID NO: 70429 - DNA, 1704 bp, Homo sapiens
  misc_feature 1..1704: note = chr10:118924354-118926058
  misc_feature 1..1704: note = hyper
  source 1..1704: mol_type = genomic DNA
gatgaaattagacagcgacaaaatcattaccttgacttcccacaataaagacaaccttaaaagggggctattgatggtttcaaattacataacggtggtttatatgttcttcctctgcgctcacagaaagcaattttaaagtgtgaattcttcaaagaacgggcaaagcattcacacacagacatgcgtttttattttatgtattgcaaagcgctatgagagagagagagagaaaccaaaaacaaaaatcccagcaaaaggaggccgagtccaaagagaatatgtccggtttctatttcaccaagctcctggactcacatttggccccggagccgagtgctcggtctctttccccgggacgggacagggagtggagttcctagccccttgggtgggaaaagccccgcgcacgtcaccgggtcccgtctgctcactgcttctgcatattttaagcctggacacagcctcctttaggatagaaaggcatttcccaaacaacaccgattctgggggtgtagtgggcctggcgctgggtcctggagagaaggttcagccccccttctcatccctgtactttggggatggctcgtacttggacaggggtgggcctccgccttctccgccttctatcggacctttcttcggatggatttctacgtaaactcggaaggcgatcaaatgcaggcggccaacctccagcgcttttttttttcctctcaaaggcggcgcctgcatttttgggggctccagcccaggctgagaaagtcccctcaaacctctactctgaggttgctcacacggcctgcaaaaacccgacggggcaccccgccaccccaccttacgtttccctagggccaagtcagtggtcaaaaaccaacccggtggtagctgcctttaccaaggaaagacagccaggacgcccgcaccgacggcaacgcgcggacagagaggaccgtgccctctttcgcatgttacggggcgagggggctgttggcgtcaggagcgccctgggaggaacttcgtagcggattcgagagacagagggaattcagcaaacttgctgccccgggctgccggctggagcccggcagattcgctgcgcagcactgccccctggtatccagcgccgaaagtgcccccctccgcagctgcaaggctcctccctgggctgcgcgggacagattttttctcctttcctggctacacgcctaacagagaagctatcccgagggacctcaagaagtccccccaagccgtactcaaaagcctttctccctcctcctcaagcgctcacttccccaaagaggacccggacccctgactgcctgagccaggtccccagcatggtccgcaacccttctcgactccggcatccacctccaggctgacgtctacccgggagggggctggggacccaaggagacttcgactacaggcccaggcgaacggaaggaagaggcttgcgttcagagagacacgtttggagctgggactgttcattctttaaggaacaccagcttccagggcatctttcgttggcaccttggctttccagagaagaaaggaagtgggtatcagggccagcccctcctcgcaccccaggctggagaggtgccgaggtgcttagtcactcagtccaagggcacctgagagatgggggcaaacttggcaggagcttgagcacggaggcgtgatccgcggggg

SEQ ID NO: 70430 - DNA, 588 bp, Homo sapiens
  misc_feature 1..588: note = chr10:118927006-118927594
  misc_feature 1..588: note = hyper
  source 1..588: mol_type = genomic DNA
agagagccaagctctcgcccttcggtttccattcacgctaccctctctgagccgcaattctctctcctgcgttggcactggcagaagttgagacacgctcccaggaatcgcgggccgtggcgcgtacttccacgcaccccagctagttccagagactcagcttgttctgagatcctcttgtcgagcccccttggtcccggcgcccggcctgtgtggtgctcagatcagacttatccacccgagcaccacgcagaccagcgcctggaccaaggtcccgggaaggaagccctcctccccttctcctgtggcttagctcagcgatcagggaggagccagttaagaagtcacagtcgaagccatgactgctgtgtcccggggaggcagtggaaggcgaggagcacggagcggggataccgccggacaacccctccccgccgccccgtcggcgtcctcgctgcgcaggggctcccttgctgccccaatctaaaaggaagccgtcgcggcccagggcacggtaactaaaaggccgtcggggagggagacgggaatgagtgggcttggacttgaggtttccgagccagctgctcc

SEQ ID NO: 70431 - DNA, 74 bp, Homo sapiens
  misc_feature 1..74: note = chr10:118927889-118927963
  misc_feature 1..74: note = hyper
  source 1..74: mol_type = genomic DNA
cccggcgcctctagccgctccacccgcacccccagttcgcgctgcggcggccagcctcttccccgacggccgac

SEQ ID NO: 70432 - DNA, 40 bp, Homo sapiens; identical to SEQ ID NO: 33405
  misc_feature 1..40: note = chr10:118927999-118928039
  misc_feature 1..40: note = hyper
  source 1..40: mol_type = genomic DNA

SEQ ID NO: 70433 - DNA, 181 bp, Homo sapiens
  misc_feature 1..181: note = chr10:118928343-118928524
  misc_feature 1..181: note = hyper
  source 1..181: mol_type = genomic DNA
gcgccgcaaccttctcggcagtcacacctgtgtccccgatgccatctgcccacgtctgtgtgtgaagcaaaccccgctggcagacgggatggagagagatggctcctccaaaccagaattaggaggaaaaccccgctgagggcgtttcaaaaacccaacaggcgagcggggaaacctgcat

SEQ ID NO: 70434 - DNA, 172 bp, Homo sapiens
  misc_feature 1..172: note = chr10:119000420-119000592
  misc_feature 1..172: note = hyper
  source 1..172: mol_type = genomic DNA
ggtccccaaggcactcggccacgcgctgggtccggggaagaggcgcggccgcggccgaggcggggacagggaggcggcagcccctcctgcgcagcgacggcgcgggcgggcggaggccggggcgccccagccccccgcccccgctccctccggccgtgacgtcagagccgga

SEQ ID NO: 70435 - DNA, 466 bp, Homo sapiens; identical to SEQ ID NO: 33408
  misc_feature 1..466: note = chr10:119000689-119001155
  misc_feature 1..466: note = hyper
  source 1..466: mol_type = genomic DNA

SEQ ID NO: 70436 - DNA, 215 bp, Homo sapiens
  misc_feature 1..215: note = chr10:119001328-119001543
  misc_feature 1..215: note = hyper
  source 1..215: mol_type = genomic DNA
cgtgcggacagggcacccctgccccggcaccccagccccagcgccccttccccggcactccacttacccctgcgcggtcccggagctccgccaaggcccgggaaagttggagaactcgctttgcaaaaaagacatcccctccaggctgccgcgccggggctaggaggagccgcgttgtgtggcttcgctttcctgatgctcgggtcaaaaactgt

SEQ ID NO: 70437 - DNA, 30 bp, Homo sapiens
  misc_feature 1..30: note = chr10:119016775-119016805
  misc_feature 1..30: note = hypo
  source 1..30: mol_type = genomic DNA
ggtgcccttatgtaccgctgaaccccgccc

SEQ ID NO: 70438 - DNA, 31 bp, Homo sapiens
  misc_feature 1..31: note = chr10:119136226-119136257
  misc_feature 1..31: note = hypo
  source 1..31: mol_type = genomic DNA
tgaaaaccttcaagccggccgggcgtggtgg

SEQ ID NO: 70439 - DNA, 20 bp, Homo sapiens
  misc_feature 1..20: note = chr10:119292323-119292343
  misc_feature 1..20: note = hyper
  source 1..20: mol_type = genomic DNA
cgcatcgggcacccaggctg

SEQ ID NO: 70440 - DNA, 617 bp, Homo sapiens
  misc_feature 1..617: note = chr10:119294281-119294898
  misc_feature 1..617: note = hyper
  source 1..617: mol_type = genomic DNA
ggtgggaggacacttcgggcccagcgtagaggaggcctccgaggcccaagcgggcttcggctgctgcgagtccccagaggctccctcgggcctcactcgcggtgtctcctccagacgccaggggcaggccacgaagccgagggctccgcgtggccgtgggagaagcggggtgcacggagccttcccgcgcccagacgccgaggggatgcaaacaggggagccgggcctggtatggccaacctccaggatcgaggggccccagaatgtgcgtgtggccgggggcgggggcagctgcgggggccagaactagagtattccttcgctctcccctgggggccgggcccccacgagttgcagcagagcccgtctgtaattagggcctcctggtccggcaaagctgcggctgctcccagagagagttggggtcttctcagggcccgcgatgggggagtggtcgtggtcagacccccgtgagccccttcggaaggtcccagtccctgtccattcttctgtcccgcagctctctccgcgcaggcggggcagagccggggaagaagacgctggacgaggggtcttggggccgcctcgctggctgcggttggaagcacccgttttcc

SEQ ID NO: 70441 - DNA, 508 bp, Homo sapiens
  misc_feature 1..508: note = chr10:119294908-119295416
  misc_feature 1..508: note = hyper
  source 1..508: mol_type = genomic DNA
cgcaggcgctgctctgtggccaccagcagaggtttcccggccgctgtgagtcgcccacgcgagcgacgtggggatacggggcgcacggagtctcagctgccgccacgcagcgcttgccctgcccgagcttcggctcactggcagcggcgaggccaccgaccaccctccgccttccagtcctaaactcggggctggagaccgcaggagctaaaccaggaagaagaaagagggcagggcctgaggccgggaagagcggcccgggggtcaacggtgagcgggtgcatacgaggcaagagccagagtgacattaagtggggccgcccgggcaaaccttgcgcgtgcaccccggcccacctgcagggcattctcccctgccttttctccttggcttgagtgcgggcggctgactcctgtgggcggggaggagagggtggtcttcccagggctccaagtggagtgatcactgcacccatggccaggaggtgggggtgcgcggagtgatttttgt

SEQ ID NO: 70442 - DNA, 15 bp, Homo sapiens
  misc_feature 1..15: note = chr10:119296629-119296644
  misc_feature 1..15: note = hyper
  source 1..15: mol_type = genomic DNA
ggagccaggctgccc

SEQ ID NO: 70443 - DNA, 933 bp, Homo sapiens; identical to SEQ ID NO: 33412
  misc_feature 1..933: note = chr10:119296755-119297688
  misc_feature 1..933: note = hyper
  source 1..933: mol_type = genomic DNA

SEQ ID NO: 70444 - DNA, 505 bp, Homo sapiens; identical to SEQ ID NO: 33413
  misc_feature 1..505: note = chr10:119300923-119301428
  misc_feature 1..505: note = hyper
  source 1..505: mol_type = genomic DNA

SEQ ID NO: 70445 - DNA, 81 bp, Homo sapiens
  misc_feature 1..81: note = chr10:119301759-119301840
  misc_feature 1..81: note = hyper
  source 1..81: mol_type = genomic DNA
cggcgccggccagggactctgcagggaccggggtgccccggagggagtggtgctggtggaggaggaggcggtggctgaggg

SEQ ID NO: 70446 - DNA, 77 bp, Homo sapiens
  misc_feature 1..77: note = chr10:119301900-119301977
  misc_feature 1..77: note = hyper
  source 1..77: mol_type = genomic DNA
ggagaagaagaaactggaggaagaggaggaggcgaaggaggaggagaagccgcagcgggcgccgcaggagcgagtga

SEQ ID NO: 70447 - DNA, 1028 bp, Homo sapiens
  misc_feature 1..1028: note = chr10:119302693-119303721
  misc_feature 1..1028: note = hyper
  source 1..1028: mol_type = genomic DNA
cctcgccgcgggcagcgggcggcggaggcagcgtgcggcggtcgccaggagctgggagcccagggcgcccgctcctcggcgcagcatgttccagccggcgcccaagcgctgcttcaccatcgagtcgctggtggccaaggacagtcccctgcccgcctcgcgctccgaggaccccatccgtcccgcggcactcagctacgctaactccagccccataaatccgttcctcaacggcttccactcggccgccgccgccgccgccggtaggggcgtctactccaacccggacttggtgttcgccgaggcggtctcgcacccgcccaaccccgccgtgccagtgcacccggtgccgccgccgcacgccctggccgcccaccccctaccctcctcgcactcgccacaccccctattcgcctcgcagcagcgggatccgtccaccttctacccctggctcatccaccgctaccgatatctgggtcatcgcttccaaggtacgtgccacgtcgcggaactgcagcgcgccgctcccgccgcatccttcactgcccccggcctgctccgggtgggcgcttggcaaggcctgggcggaggttcctccggctcgcgggccagcgcgccctgttgggaaactaggcggcgcggggccgggcgtggtgtcgatccccagtctccgaagctacgactggtttggagtgatggcctgcgggccgcttgaccctttgggaaggggtgcgaacggagaagttgtcccccagtgcgctcgaatcagagcaggctgggctgtgcgtgcccggcgccgcggagcccagagcccgcgggatccccaggctcctggtaccctcggcaatgcccccaaccgtcctggctccgaggggcgcggacaggactcggccgccaggcttgctttcgactgcgttcgaccctgttcaccacccactttgcgccccttcagtccagacccgcggcttcttagtcttccaccctcttctggaggcgagaggatcctcgcgccccgggagaaaagtatg

SEQ ID NO: 70448 - DNA, 529 bp, Homo sapiens
  misc_feature 1..529: note = chr10:119303950-119304479
  misc_feature 1..529: note = hyper
  source 1..529: mol_type = genomic DNA
tgttttcatttcttgcgatattttttatttgtttgtttttctctgggtacggggtgggaggaggagagttaaaacttcagaaaaaggagtaattagtttacggattggagtcagtaaaagacctacctccggcggcagccgatcaatactccgcggcttgtccattcattaacccattgcgttcctgccggagcctagaatcgggtagatgtcacccccctccccatattttaaaaaatcaaaccaaaggaaaaaaaacccaaaaagccttttacccttaatcccgaactggatttgcctgcatcctgcctggactgtcggcttgtttttctttgtttgggttttcggtgaatcgatttcctatgctaatgagtgaacccaaaactctgaggctttgcttgaaaagtttagggctgcccttcctcattcgctatcagtcatgcttatggtcccctcaccagacccggagccgctgggatcttcctgcgttacagactgtcctggcggtgtctgcaagtcggtaaccccc

SEQ ID NO: 70449 - DNA, 328 bp, Homo sapiens
  misc_feature 1..328: note = chr10:119304501-119304829
  misc_feature 1..328: note = hyper
  source 1..328: mol_type = genomic DNA
cgtttctcttctagttctcgggagccgggagccccggagcccagttcgcgagaggcagcagcggctgtagccaagcacacccgccggccagatttctgtcccgatcgggcttcaacgactcgccccgcctctatacttttccggaggggcaataaaacaaataatttaaaaataaatctccatgaaaactctggagagcagcccgccgcctttccaccgtgggtcaaagttccccgagaggttagaaagaagagaaagtagtttcttcgggttgtgggcgccaatcccctggccaggctctgcggctccctcccctgcctccagcgcc

SEQ ID NO: 70450 - DNA, 136 bp, Homo sapiens; identical to SEQ ID NO: 33422
  misc_feature 1..136: note = chr10:119304850-119304986
  misc_feature 1..136: note = hyper
  source 1..136: mol_type = genomic DNA

SEQ ID NO: 70451 - DNA, 223 bp, Homo sapiens
  misc_feature 1..223: note = chr10:119305061-119305284
  misc_feature 1..223: note = hyper
  source 1..223: mol_type = genomic DNA
gggccagcccggctcgggagaagtgcgcggctccggtcagagcagccccccctaatgggatttctgctgtgctccccgcagggaacgacactagccccgagagtttccttttgcacaacgcgctggcccgaaagcccaagcggatccgaaccgccttctccccgtcccagcttctaaggctggaacacgcctttgagaagaatcactacgtggtgggcgccga

SEQ ID NO: 70452 - DNA, 71 bp, Homo sapiens
  misc_feature 1..71: note = chr10:119306116-119306187
  misc_feature 1..71: note = hyper
  source 1..71: mol_type = genomic DNA
ccgaggagggcctggcgggtttgtgcggagcccggcacaaggcgcggcccggctgatttctcctggacagc

SEQ ID NO: 70453 - DNA, 99 bp, Homo sapiens
  misc_feature 1..99: note = chr10:119306273-119306372
  misc_feature 1..99: note = hyper
  source 1..99: mol_type = genomic DNA
cgccttgggccagcgccggggagaaatgaaccgtcctccccctcaattagcaaactcaaagcaaattaaattcagccttgttcccgctcagcttttttc

SEQ ID NO: 70454 - DNA, 52 bp, Homo sapiens
  misc_feature 1..52: note = chr10:119307022-119307074
  misc_feature 1..52: note = hyper
  source 1..52: mol_type = genomic DNA
caggcaaaccctgatcgcctacccagggcccccgccacgaagaggagacgct

SEQ ID NO: 70455 - DNA, 68 bp, Homo sapiens
  misc_feature 1..68: note = chr10:119307830-119307898
  misc_feature 1..68: note = hyper
  source 1..68: mol_type = genomic DNA
aacaaaccgcatacacgttcaccgagaaagggagagggaatcggagggagcagcggaatgcggcgaag

SEQ ID NO: 70456 - DNA, 30 bp, Homo sapiens
  misc_feature 1..30: note = chr10:119310948-119310978
  misc_feature 1..30: note = hyper
  source 1..30: mol_type = genomic DNA
caacgccccccttcccggcccaaagaagga

SEQ ID NO: 70457 - DNA, 293 bp, Homo sapiens
  misc_feature 1..293: note = chr10:119311443-119311736
  misc_feature 1..293: note = hyper
  source 1..293: mol_type = genomic DNA
gtgggtcagattctgcgctccttctgggacacggagaactgtatgcacgttgccattgggtcctgcctgggacccctaatggggatgtaggatacaagtttgatccatgttccgtttccttgttaattacttgtggaccttccctgtgggaccccttggccaagcgcatgttcgggagaggcacgggttctccgtttgcgctgccctgagagggtcaaacggaatctaccaagcgcgtgtgccgcggctacgttctcctgcgaagtacacatgggttccgtgtgcgtttctcg

SEQ ID NO: 70458 - DNA, 30 bp, Homo sapiens
  misc_feature 1..30: note = chr10:119311979-119312009
  misc_feature 1..30: note = hyper
  source 1..30: mol_type = genomic DNA
cggctttggaaacctcggctcctccccgtc

SEQ ID NO: 70459 - DNA, 1163 bp, Homo sapiens
  misc_feature 1..1163: note = chr10:119312341-119313504
  misc_feature 1..1163: note = hyper
  source 1..1163: mol_type = genomic DNA
ctagctgtccttgtgcgtctagattgttttgagttagggccagcacgtgcagttgtgaggctgcagagtgcctatgacggtgtggaaatgcagtttattgaatgtgtgtgccgcggtctggttgcactgtgtatctgcgaattcgtctggagttgcacatctcagaagatgggggtggcctcggtgtgtgtggcttgcggggacgtttctcggtgtttggatgggggtccctgtgatggatgtccatgcccagccctagggcaacatctgtgtgtcttgggatcgaggcgtgtgtgtctagtgaggaggcttgggctggggtgtcgttccagcagcgccccactaactccggagtttggcaaacaacagccgttttgtgtaactgcgcatttttctagaccagtctttattattccagcaatcagcgctggaattactggggcgccgcctagaagcaaccgccggcggggcggcagaggatgccggcctccagcgtcgggggaccgcgcccgaaagccgggctgctttgtggggcctctcgcgcctcgcccgcagcttccggcccgcgccctccgctcgaccgccgattttctcgccccagccagccccgtagccagaggaaagtgggagttttgagaaccctctgaccccagccgtgacccctctccgggaggtggcttctcccgcaggacccggtgcgccagaaaactctaggcggcgccacgcttggaagcgcaaggtccattcatcagccgcgccccagcgtctaattggccttttgtttattagtgtctgttgcccggctgggagtctccggagggccccggagctgcgagtcggggtgccagaagcggacggcgggccagcgcccagagctggggtccgggtagggcagaggcgcgtcgcactcctctgagggggcgccagagcgcgccaaagatcacgcccacgtgcggagatgcgcgcatggaggctggactccaagtgctggagcctggtcctcccggctgctaacgccccaggcttcgcccctgcccccacctccacctgcagaccgagccctccccatctctccacaccctcaggatttcagacccgccttcctgcctctcctaagtacccatcccaggcgctggccttgtggctcggttccgctcacgtcc

SEQ ID NO: 70460 - DNA, 15 bp, Homo sapiens
  misc_feature 1..15: note = chr10:119313528-119313543
  misc_feature 1..15: note = hyper
  source 1..15: mol_type = genomic DNA
cgagttcattagtcg

SEQ ID NO: 70461 - DNA, 114 bp, Homo sapiens
  misc_feature 1..114: note = chr10:119469814-119469928
  misc_feature 1..114: note = hypo
  source 1..114: mol_type = genomic DNA
tacagatgaggaagccgaggctcagagacgtttcatggtttgcctgagactgcacagaccagtagagggcagagtgagggtttaagccccaatctatcgcgctccacagccagg

SEQ ID NO: 70462 - DNA, 42 bp, Homo sapiens; identical to SEQ ID NO: 33430
  misc_feature 1..42: note = chr10:119494127-119494169
  misc_feature 1..42: note = hyper
  source 1..42: mol_type = genomic DNA

SEQ ID NO: 70463 - DNA, 223 bp, Homo sapiens
  misc_feature 1..223: note = chr10:119494374-119494597
  misc_feature 1..223: note = hyper
  source 1..223: mol_type = genomic DNA
taggaagcctagggtcgccgatgttccaggatggaatgttctggtgtcaccgtgcgggggggtggggggtgtcacagagctgggaactcgctcagagccagggtctctgctggggtcagcgtctgtacgctaaagccagggcgcaaagtgcgtgggcactgcggacactagaggcttatggcgctggaaatacaaggccgagttgccggcgcaaagagttccc

SEQ ID NO: 70464 - DNA, 208 bp, Homo sapiens; identical to SEQ ID NO: 33432
  misc_feature 1..208: note = chr10:119494848-119495056
  misc_feature 1..208: note = hyper
  source 1..208: mol_type = genomic DNA

SEQ ID NO: 70465 - DNA, 30 bp, Homo sapiens
  misc_feature 1..30: note = chr10:119777112-119777142
  misc_feature 1..30: note = hypo
  source 1..30: mol_type = genomic DNA
taaaggttctgatgacgcattcctcaggcc

SEQ ID NO: 70466 - DNA, 181 bp, Homo sapiens
  misc_feature 1..181: note = chr10:119806950-119807131
  misc_feature 1..181: note = hypo
  source 1..181: mol_type = genomic DNA
cagaagacctggttccggccgcgcctctgccgctatcagtgtgtgtgaccttggccgagtcatttcacctccatgagcctcagtgttttcacgagtaaaaaagccagttctacctcatgtctaagactccatcacgactctatgggctcgacgtcaaaaggacccccgtggggactcacac

SEQ ID NO: 70467 - DNA, 38 bp, Homo sapiens
  misc_feature 1..38: note = chr10:120127513-120127551
  misc_feature 1..38: note = hypo
  source 1..38: mol_type = genomic DNA
ttacaggcgtgagccaccgcgcccggccccttgactct

SEQ ID NO: 70468 - DNA, 523 bp, Homo sapiens
  misc_feature 1..523: note = chr10:120353807-120354330
  misc_feature 1..523: note = hyper
  source 1..523: mol_type = genomic DNA
gcaccagcccaaaggcgtaagggtcgatggcgtgggggtcgaggtcccgcagcaggttgaagacgtgcagcggcagccagcagacggcgaacaccaccacgatcaccaccagcaagcagaaggtgcgccggcgccgagcgcggtcccagtcggcctggctctgggtcacgcagcccggcaccacgcggttgcggagcttcactgacacccggacgtaagacaggaggatgaccagcagagggagcaggtaggtgaccagcagcagcccccaggcgtagagctggcgctggcgctcctgggagccccagaactcctcgcagaggcgcacgtcgtgcggcttgagctccacgtgataggtgtgcacggcggcgggcagcgccagcaccgcggacagcgcccagatggccagcacagcgtaggcgctgaggcgcagcgagatgcgccgcctcagcgggtgcaccagcacgacgtagcggtccactgcgatggtggtgagcgtgaacaccgacacatagacggtgac

SEQ ID NO: 70469 - DNA, 147 bp, Homo sapiens
  misc_feature 1..147: note = chr10:120354368-120354515
  misc_feature 1..147: note = hyper
  source 1..147: mol_type = genomic DNA
cgaacacccagccgcgtggctcgaaggcataggccagcgtgagcggcacgcaggcggtgcacatgagcacgtcggacaaggccaggttgccgatgaggaagttcgtcacgttgtgcagccggcgcacccgcgcgatcaccagcacca

SEQ ID NO: 70470 - DNA, 166 bp, Homo sapiens; identical to SEQ ID NO: 33434
  misc_feature 1..166: note = chr10:120355260-120355426
  misc_feature 1..166: note = hyper
  source 1..166: mol_type = genomic DNA

SEQ ID NO: 70471 - DNA, 177 bp, Homo sapiens
  misc_feature 1..177: note = chr10:120355461-120355638
  misc_feature 1..177: note = hyper
  source 1..177: mol_type = genomic DNA
cgtcaggctatcgggaggagccggtgcagtcttaggagggaaggagcggggaaggaagtagcggtgggagattgcaatgcagctgggggcttgagagaggcacgactgacccgttcttaaaggctggatcctgcctagcggccaggttgcggagggcagagacgctagagggctcgg

SEQ ID NO: 70472 - DNA, 45 bp, Homo sapiens
  misc_feature 1..45: note = chr10:120355967-120356012
  misc_feature 1..45: note = hyper
  source 1..45: mol_type = genomic DNA
tggaggcagctgagccgggggcctgggggtcggagactcatgact

SEQ ID NO: 70473 - DNA, 126 bp, Homo sapiens
  misc_feature 1..126: note = chr10:120668218-120668344
  misc_feature 1..126: note = hypo
  source 1..126: mol_type = genomic DNA
ccaggagagggactgcgcaggcaagtggcagatggacgggagctggcgtttcagggtgcagagcacacaatctggagccagccatttgagtcctgtccaggctgtctgggccgctaaccaagacga

SEQ ID NO: 70474 - DNA, 30 bp, Homo sapiens
  misc_feature 1..30: note = chr10:1206813-1206843
  misc_feature 1..30: note = hypo
  source 1..30: mol_type = genomic DNA
cggccatgttagctgcgaggacaatgcttc

SEQ ID NO: 70475 - DNA, 420 bp, Homo sapiens
  misc_feature 1..420: note = chr10:120766813-120767233
  misc_feature 1..420: note = hypo
  source 1..420: mol_type = genomic DNA
atgtataaatgcatggcaaaaagcctggaattcctcacaaccacgccatgcagtagtattgttatccatttaagcttttgtgaggttaagtaacttgaacatatggcatagtaaatatggctattatatccagaccatatggaactggattatgataacaatcgctgagatttatatagcaaactttttttttaagaactgaagaatactcactaaacccattcattttactgtgtgcctggcactactcttgcctctggagataaagtgatgaaaaagtacaagtgaagtctctgccttcgtgacactaacactccagggtcacctccggggaggtaatgatagagagtgggagtcaaggagataaaggaaaatattatccttgtctataatgtttgaattattattattatttttttt

SEQ ID NO: 70476 - DNA, 42 bp, Homo sapiens; identical to SEQ ID NO: 42669
  misc_feature 1..42: note = chr10:120791236-120791278
  misc_feature 1..42: note = hypo
  source 1..42: mol_type = genomic DNA

SEQ ID NO: 70477 - DNA, 120 bp, Homo sapiens
  misc_feature 1..120: note = chr10:120841443-120841563
  misc_feature 1..120: note = hypo
  source 1..120: mol_type = genomic DNA
agccaccgcgcccagcccagaaggaaaatttagaaggcagcagtgaaatagattattgtcaatgtattacacatttaatagacgagatatgtgaattaatgaatgaggaaatcggccggg

SEQ ID NO: 70478 - DNA, 30 bp, Homo sapiens
  misc_feature 1..30: note = chr10:120863286-120863316
  misc_feature 1..30: note = hypo
  source 1..30: mol_type = genomic DNA
aattgaggcaggctgcggagactcaaggag

SEQ ID NO: 70479 - DNA, 52 bp, Homo sapiens; identical to SEQ ID NO: 42435
  misc_feature 1..52: note = chr10:1209169-1209221
  misc_feature 1..52: note = hypo
  source 1..52: mol_type = genomic DNA

SEQ ID NO: 70480 - DNA, 30 bp, Homo sapiens; identical to SEQ ID NO: 42670
  misc_feature 1..30: note = chr10:120922882-120922912
  misc_feature 1..30: note = hypo
  source 1..30: mol_type = genomic DNA

SEQ ID NO: 70481 - DNA, 30 bp, Homo sapiens
  misc_feature 1..30: note = chr10:121228977-121229007
  misc_feature 1..30: note = hypo
  source 1..30: mol_type = genomic DNA
ctatggagatgggcacgctgacctggttgc

SEQ ID NO: 70482 - DNA, 178 bp, Homo sapiens
  misc_feature 1..178: note = chr10:121249843-121250021
  misc_feature 1..178: note = hypo
  source 1..178: mol_type = genomic DNA
gtccagctggctgcccgtcgatcacgactcgaacgcggggtaacatcgtgtgcatgtgtgtgcgggggactggggggacagtgaaagagtcccaggcaaggatccaggagtcagacccggccgggatctgctacccttccctgcgcaccttaggcagaccacacgacctatccctggt

SEQ ID NO: 70483 - DNA, 43 bp, Homo sapiens; identical to SEQ ID NO: 42672
  misc_feature 1..43: note = chr10:121256846-121256889
  misc_feature 1..43: note = hypo
  source 1..43: mol_type = genomic DNA

SEQ ID NO: 70484 - DNA, 417 bp, Homo sapiens
  misc_feature 1..417: note = chr10:121301494-121301911
  misc_feature 1..417: note = hyper
  source 1..417: mol_type = genomic DNA
gctggcccaaagtgacggccaaggcgaatccttcgtaacgtcagaacttcgctggctcggaccgcagaagtgcccttctccatcctggggttccgccaccctcgcgatcccaccttttggctcctcgcggcagaagcgaaggcccccgacgccccaggcccaggggcccagtcggatgcccgggtccagccgtgctcccccgggcgctcggcatccttccacccacgcccgcagcggaggcggagagcgtcacggagggagaagcccgcgcgccgttccgctttcggaatctggagccccatgtcacctccaaagtttggagatttggggcgctcctttttctcccagaccatcactaaaaagaaaactgcggctgttcctctttcagccaaacttcctccccggggctcccggagg

SEQ ID NO: 70485 - DNA, 165 bp, Homo sapiens
  misc_feature 1..165: note = chr10:121307203-121307368
  misc_feature 1..165: note = hypo
  source 1..165: mol_type = genomic DNA
gcagaaagtttaatacgcaggagtaagagaaaggagaacagttctctctctagggagagagaggggcttccgaaaggaaagaccaacagtggtggggttcactggattttataggcagacttgagaaggcggtgaatgatttacatagggcccacagattggtta

SEQ ID NO: 70486 - DNA, 148 bp, Homo sapiens
  misc_feature 1..148: note = chr10:121354399-121354547
  misc_feature 1..148: note = hypo
  source 1..148: mol_type = genomic DNA
gctgggattacaggcgtgagccactgcgcccggcctgaaggacaaatttcaagtgtgtcccaattctttcttctagggagagaaggcagaaatggaagacaacacaaaacacaaagacgttctattaagcaggcgtttcattgaagca

SEQ ID NO: 70487 - DNA, 30 bp, Homo sapiens; identical to SEQ ID NO: 42519
  misc_feature 1..30: note = chr10:12139715-12139745
  misc_feature 1..30: note = hypo
  source 1..30: mol_type = genomic DNA

SEQ ID NO: 70488 - DNA, 30 bp, Homo sapiens; identical to SEQ ID NO: 42674
  misc_feature 1..30: note = chr10:121398024-121398054
  misc_feature 1..30: note = hypo
  source 1..30: mol_type = genomic DNA

SEQ ID NO: 70489 - DNA, 27 bp, Homo sapiens
  misc_feature 1..27: note = chr10:121718497-121718524
  misc_feature 1..27: note = hypo
  source 1..27: mol_type = genomic DNA
gggtgcggtggctcacgcctgtaatcc

SEQ ID NO: 70490 - DNA, 196 bp, Homo sapiens
  misc_feature 1..196: note = chr10:1218175-1218371
  misc_feature 1..196: note = hypo
  source 1..196: mol_type = genomic DNA
gaagttttgctgtgacgagggtgcgtcttcaggaagaggcttctgcagcatcatcctcagcttctcataaggcgacattggtcacgctattcttggttattccataaaatcttggcatcttgtgatgtgttggttgtttttttatatgtatgactaagcctagcatgccaggcccccgggacgctgatttacaggc

SEQ ID NO: 70491 - DNA, 645 bp, Homo sapiens
  misc_feature 1..645: note = chr10:122216112-122216757
  misc_feature 1..645: note = hyper
  source 1..645: mol_type = genomic DNA
ctcctgagagcaaagcgaagcccgcgagtgatctctggggaacttcctagaaaaaagaaagaatttcaggttcgaacggtgtagggagggccgaacacgggagcaaggttggccagggctgccctgagccctggagaatccccagagcgatcgtccactacatgcccacgtgcgtgcgtgtgccagggagcgagagcccggacagcgggagtcggaggcaggaccaggagctgcagaggggccgcgggcagagccccagcgagcgcgctgccctggcgcggagcccaggggccgcccactggcgggggaggcggggagcgcgcagggaggcggcggcggcggtggggcttccccgggcttcccctccccggtccgcgggtgcccggcgcgggcccaggaggcggaggcggctcctggggagagggatccgggagtccctgaggcggccccggctccgcactaggaggcggggtccgcagtatcgccagcggccggcgcggcttcccggagccccggagcccgaggcgcgaggtttaggctgagccctccccggcgcctgcccccgcccggcgcccgcctccgcccccgcccgcggcctggagcgcgcctccctcgcctcccagggtctggcgagccggcgccggc

SEQ ID NO: 70492 - DNA, 597 bp, Homo sapiens
  misc_feature 1..597: note = chr10:122216793-122217390
  misc_feature 1..597: note = hyper
  source 1..597: mol_type = genomic DNA
cgcgggagctgctccggccgcaccatgcgggagctggccattgagatcggggtgcgagccctgctcttcggagtcttcgtgtaagtagtggcgcaccgcgggcagggcgcactgacgcgggggaacaaccgaccaagcctctctgtgccctaacttagtttgcgcagccgcttcccactggggcctgggttcgaggtcccttccccgccaagtgcccgcaacgtgtcctacgggaccaagagagacccttcctctctccttcctgggaccctaggcgcggagcgaccaccgcgcgccgaggctgagacctgctcccgggtctcaccgggcccgcgcctgtcgccagccccgcaccacctgcccgggggatccagggctgcacctctaaacagggacgcgcaccctggcccgtgccctcgggaagtttctccttctgtgtgatctttgaggcccacgttggaagtctttacccctggccccgtctccgattcctccccgctgtgcccagggccagactccttccgtgtccctggctttagcgcccgcggtcctggcgagcgttttcccagcgggcgtttgcggcgcttctcctactga

SEQ ID NO: 70493 - DNA, 30 bp, Homo sapiens
  misc_feature 1..30: note = chr10:122222277-122222307
  misc_feature 1..30: note = hypo
  source 1..30: mol_type = genomic DNA
ggggctccttccatccgctgcctttgggaa

SEQ ID NO: 70494 - DNA, 92 bp, Homo sapiens
  misc_feature 1..92: note = chr10:122319368-122319460
  misc_feature 1..92: note = hypo
  source 1..92: mol_type = genomic DNA
gtacgtggcatcattcgcagtcaataaacttgaagctgcagtattaaatcacagctgcgtaagattaactgtagaatgcgctgcacttctgt

SEQ ID NO: 70495 - DNA, 31 bp, Homo sapiens
  misc_feature 1..31: note = chr10:122319520-122319551
  misc_feature 1..31: note = hypo
  source 1..31: mol_type = genomic DNA
ctaaaacaccgtgtggcgctgatcaccttca

SEQ ID NO: 70496 - DNA, 120 bp, Homo sapiens
  misc_feature 1..120: note = chr10:122379107-122379227
  misc_feature 1..120: note = hypo
  source 1..120: mol_type = genomic DNA
acaagaagttgctgaagaagtcaacgttgacccttctatggtcatttggcatttgaaacaaattgcaaagatgaaaaggttccataagtgagtgcctcatgagctgagcaaaaatttaaa

SEQ ID NO: 70497 - DNA, 30 bp, Homo sapiens; identical to SEQ ID NO: 42676
  misc_feature 1..30: note = chr10:122394238-122394268
  misc_feature 1..30: note = hypo
  source 1..30: mol_type = genomic DNA

SEQ ID NO: 70498 - DNA, 120 bp, Homo sapiens; identical to SEQ ID NO: 15393
  misc_feature 1..120: note = chr10:122492432-122492552
  misc_feature 1..120: note = hypo
  source 1..120: mol_type = genomic DNA

SEQ ID NO: 70499 - DNA, 265 bp, Homo sapiens
  misc_feature 1..265: note = chr10:122708495-122708760
  misc_feature 1..265: note = hyper
  source 1..265: mol_type = genomic DNA
atgatcctaaagggacgcagtggtcccgcccatcgccgcctctacagggagggagccgcggccccgagctggccacgcgatggcgctgtgcacccggccgcggagcccctgcacgtccggctcccgctcgcgctctcggctcgagctccggactccaggctcggagcaggggttcgggctacggttcccggctccgagggaccgcggggctctctgcctgggaaggaagcttgcgggcctcctcgggcctcgctgcagcccagct

SEQ ID NO: 70500 - DNA, 437 bp, Homo sapiens
  misc_feature 1..437: note = chr10:122738879-122739316
  misc_feature 1..437: note = hyper
  source 1..437: mol_type = genomic DNA
actggttacatagaccgggcttctcaaactactgcgcacacaagtcgcctagggaccgaattaacgtgcagccctgatgcagccgcctgagacccgcctttgcagcagcctgccaggaggtgcggatgctgccggcgcctggaccgcgcgttgagcagtgcaggtgaacagctcgcctaacgcacaagccacgcccacaccctttctacacgctttctcgttcacttctcattgcaactccttccgccgcgtggacaggttcagcactctcggagtcgatgtcattattcgccatcgacgcgaacctcggcaaagagacgggtcttaccggtctccgaatgttctcaggccctaagcgcgcagccccgcacccgggtgcagccggcgcggtcccacgtgtccctaccgcgagccgctccccgcgtccctgctgccgc

SEQ ID NO: 70501 - DNA, 150 bp, Homo sapiens
  misc_feature 1..150: note = chr10:1233090-1233240
  misc_feature 1..150: note = hypo
  source 1..150: mol_type = genomic DNA
ccttcaagtgattcacggtggcagctgccaccccgagagccgggagggacaatctggcccgttggccgctgtggctgtcctactaggcaggggccgcctgggcaggaggagccagccaccaaggccagggatgaccgggcactgggagag

SEQ ID NO: 70502 - DNA, 35 bp, Homo sapiens
  misc_feature 1..35: note = chr10:12331252-12331287
  misc_feature 1..35: note = hypo
  source 1..35: mol_type = genomic DNA
atcttagactgtgggcgccccgccccaggggcaac

SEQ ID NO: 70503 - DNA, 152 bp, Homo sapiens
  misc_feature 1..152: note = chr10:123356838-123356990
  misc_feature 1..152: note = hyper
  source 1..152: mol_type = genomic DNA
cgaactagaaaaagtcggtccagttcgccccctagccccaggcgcactgcgctccctccagcgccgacggcggctgcgggcgaggggcgcccaggcaccggagccgtcgcctccccagcagtgccacccctggccatcgccacccctacggg

SEQ ID NO: 70504 - DNA, 46 bp, Homo sapiens
  misc_feature 1..46: note = chr10:123357614-123357660
  misc_feature 1..46: note = hyper
  source 1..46: mol_type = genomic DNA
gcctcccgggcttcacgcgtaccccaggctgcggaggagcgcgggc

SEQ ID NO: 70505 - DNA, 63 bp, Homo sapiens
  misc_feature 1..63: note = chr10:123358268-123358331
  misc_feature 1..63: note = hyper
  source 1..63: mol_type = genomic DNA
tgagcgactgcgttacgttgttttatgtcaagttagaaaacaaatgaccgaaggctctaaccc

SEQ ID NO: 70506 - DNA, 30 bp, Homo sapiens
  misc_feature 1..30: note = chr10:1233724-1233754
  misc_feature 1..30: note = hypo
  source 1..30: mol_type = genomic DNA
cgagggaggcgctggcgggtgggctgcggg

SEQ ID NO: 70507 - DNA, 143 bp, Homo sapiens
  misc_feature 1..143: note = chr10:123820809-123820952
  misc_feature 1..143: note = hypo
  source 1..143: mol_type = genomic DNA
aaaaaaaaaaaaggagggagaaaagaatcgaggaagattcctgaagctttggcttgagtgactgggcaggtgggaccatatgctgagatgtgaaaagcactaaggtcaggtgtgtctgccgagttccacggccacagacctgg

SEQ ID NO: 70508 - DNA, 34 bp, Homo sapiens; identical to SEQ ID NO: 33445
  misc_feature 1..34: note = chr10:123873006-123873040
  misc_feature 1..34: note = hyper
  source 1..34: mol_type = genomic DNA

SEQ ID NO: 70509 - DNA, 79 bp, Homo sapiens
  misc_feature 1..79: note = chr10:123922604-123922683
  misc_feature 1..79: note = hyper
  source 1..79: mol_type = genomic DNA
gggagagccaggtgccgcagctctccctggtacagacttcagctgcctccaggacccggggcctgaaggaggcagaagc

SEQ ID NO: 70510 - DNA, 75 bp, Homo sapiens
  misc_feature 1..75: note = chr10:123923517-123923592
  misc_feature 1..75: note = hyper
  source 1..75: mol_type = genomic DNA
cgcccgggccgccccgagtctcccggggaggaggagaggatgcccgggctttgttagtgtcgcctttcctaatgc

SEQ ID NO: 70511 - DNA, 30 bp, Homo sapiens
  misc_feature 1..30: note = chr10:12398063-12398093
  misc_feature 1..30: note = hypo
  source 1..30: mol_type = genomic DNA
gattttgcagtgagccgagattgcaccact

SEQ ID NO: 70512 - DNA, 377 bp, Homo sapiens
  misc_feature 1..377: note = chr10:124133936-124134313
  misc_feature 1..377: note = hyper
  source 1..377: mol_type = genomic DNA
tgacatcagagaacccggagttctacctccgagccaagcccagtggtggtcaaaaactacgaataccaggaagcaccgcggcgcggcggcccagagctccgcgcgcaggcctccccggcgcgccgaggccgccgccgctggaaccaggaagacgccagaaactcggcccgccacgccgcagggacccgcgcggggcctgccgggactcgtagtctctgcgggctgggagcgcccgctccggaatctcagccgccgtctgagggctgaggcagcgtggggacgcgtgcgcagtgcgcgggctggccgtcgcggacgccgctccgggcagccgagcctctgtgggagccggggccgcggcggcgcgggtgctccgggcc

SEQ ID NO: 70513 - DNA, 100 bp, Homo sapiens
  misc_feature 1..100: note = chr10:124220556-124220656
  misc_feature 1..100: note = hyper
  source 1..100: mol_type = genomic DNA
ccgcggtcagggtcccgcgtgcggggtaccgggggcagaaccagcgcgtgaccggggtccgcggtgccgcaacgccccgggtctgcgcagaggcccctgc

SEQ ID NO: 70514 - DNA, 148 bp, Homo sapiens
  misc_feature 1..148: note = chr10:124220901-124221049
  misc_feature 1..148: note = hyper
  source 1..148: mol_type = genomic DNA
cgccgtgcccgggcgcgcccgccctgccccctccgcgggcggtcccggtccagccgcccgccctccctcccgccatccggccagcccccatcccgggcgccgtgcccgtccccaaggcggctcgtcaccgctgcgaggccaatgggct

SEQ ID NO: 70515 - DNA, 206 bp, Homo sapiens; identical to SEQ ID NO: 33449
  misc_feature 1..206: note = chr10:124221715-124221921
  misc_feature 1..206: note = hyper
  source 1..206: mol_type = genomic DNA

SEQ ID NO: 70516 - DNA, 30 bp, Homo sapiens
  misc_feature 1..30: note = chr10:12436198-12436228
  misc_feature 1..30: note = hypo
  source 1..30: mol_type = genomic DNA
aagagttgcatggggcgaggtgtagggtgg

SEQ ID NO: 70517 - DNA, 135 bp, Homo sapiens
  misc_feature 1..135: note = chr10:1245923-1246058
  misc_feature 1..135: note = hypo
  source 1..135: mol_type = genomic DNA
tgtgccggtaggaggcgggcagctggccgacaccctccatgcggtggctcatgacgcgtgcgaggtggcccgtgtggtgcaggctgcccaccacgatgctctgcaggtacacgggctccacgaagtgggacagga

SEQ ID NO: 70518 - DNA, 394 bp, Homo sapiens
  misc_feature 1..394: note = chr10:124639132-124639526
  misc_feature 1..394: note = hyper
  source 1..394: mol_type = genomic DNA
gagggcctgccagtgcgcatgctccgctctttagcgcttcctgagcaaagtttgaacgcctctcgagtccagttggcttatgcgcatgcgtttctctggtgcaggttctcaccaaatccagaagcggcgggcatttgaaatgatgtaagccgggagtcgctctgcctgcccgtttctgcgctgcactggccgacacttaagcactggaagagaggcctggcaggaggcggcgcagtggacacgcggtccgaggacgggggcctcacccgccgccccacgcttgcctcttcctgggatgccgcaggcggggccctaactcacagcctcctcacccgggctcgtgtctgcgcccgcgacttcgactgggaggagcttctggcgccacctgcgccac

SEQ ID NO: 70519 - DNA, 30 bp, Homo sapiens
  misc_feature 1..30: note = chr10:12464455-12464485
  misc_feature 1..30: note = hypo
  source 1..30: mol_type = genomic DNA
tgagaacaggtcttacgaggggatgcgatg

SEQ ID NO: 70520 - DNA, 30 bp, Homo sapiens
  misc_feature 1..30: note = chr10:124714138-124714168
  misc_feature 1..30: note = hyper
  source 1..30: mol_type = genomic DNA
tctttcccaaggggacgccagggccttttc

SEQ ID NO: 70521 - DNA, 119 bp, Homo sapiens
  misc_feature 1..119: note = chr10:12481458-12481577
  misc_feature 1..119: note = hypo
  source 1..119: mol_type = genomic DNA
gttattgtttgcctgcgttttagggcttggctgtgataacagctgtgggatttgctctcaccagtcctcctccctgctgtaggtagtgttgtcaatgtgcacatcggtgaagggtcccg

SEQ ID NO: 70522 - DNA, 30 bp, Homo sapiens; identical to SEQ ID NO: 42437
  misc_feature 1..30: note = chr10:1248527-1248557
  misc_feature 1..30: note = hypo
  source 1..30: mol_type = genomic DNA

SEQ ID NO: 70523 - DNA, 147 bp, Homo sapiens
  misc_feature 1..147: note = chr10:124892251-124892398
  misc_feature 1..147: note = hyper
  source 1..147: mol_type = genomic DNA
tttcctgagcacaagcgtttcgtccgctgatcggccggcggcgctgagtcctgggaagacgaatgaggcaggcccgttccctccttccctccccgagtccttcctggagaacacctagcctgaggttaggaccggcacctaaaggat

SEQ ID NO: 70524 - DNA, 275 bp, Homo sapiens
  misc_feature 1..275: note = chr10:124892918-124893193
  misc_feature 1..275: note = hyper
  source 1..275: mol_type = genomic DNA
acaagcacataacagcgcccctgcgcgcccctgggaggggagtcaaccggagaacttggggcgacaaccggaaagccgggatccggtagccgcacagcagggatgcgggcggctgtcccggactcttctcccgccacactgggcctgtcccctccccatctgagtctagcgctggagttgtgatcagccacgagtccccctccccagactgaaccctcagcattcccagtttaaagtcgactttcgtgcgtcagaactctagccaagtttgcatg

SEQ ID NO: 70525 - DNA, 1370 bp, Homo sapiens
  misc_feature 1..1370: note = chr10:124893237-124894607
  misc_feature 1..1370: note = hyper
  source 1..1370: mol_type = genomic DNA
cgccggggtctctccacgcatactcggccgcgtggcaggctgtgtgcaggcggtgcccacccaaccctcatagacctacgtgcatcgagctatttctgcggttgggggaaaatgacctctgggtatccagcagcgattgggcgacctaggcccagtttcctcctctctgggcgcgggtttccacttacaaaatccaagtatgagacccaccctgctggggtctcagggcagtgatccgttccaacccagattttggatggcgtagcgttttgcattccagtaaagccctgtgtaaactcaagggagtaataacagtaattgtttatggaagcgccatttacgtttccagatttccaaagcaaaaatggggttcgctgctgtagatgaatgcagaaagaaacattacatatgcccgtcgagatttggtgggggagggtctgacgccccaggaccgaaaaacaaaatctacctctcaagtggggaccccacacgatcacgtctgccaatgcagggcggccttgaattaggcgaggctcaatctaacgaaaaagaaagcggtggggaggtgaagggatcccaaaaagccctcgtgtgcgggagcttcaccagggtggaagagggtgaggccagtttgtcacctttctctgataagaaagctgtctctcgggaggggacctcacaaacaattctgatttacttgatgcttaaatcatgagtcttaaatgtctgcctcatgggcttctcgtgcgaaccggggagctgtttttaaagccagtggagtggaatgtcctttcactaagccgttctgcaaaggtccagtgtggttctctaaggacttcgctgccgtcgagacgcgcagcggatgccgctgcttgccgcggcggaggaagctacgccgctgcgccttcggttcaccttgcccccattaaagcgttagttagacagctccaaacgccagctggccggagagacttcctgggagaaagtgctgtcgtcggggtcacagactcggagttgatccgcgagccttgggcaccggcggccagagcagaggggtgcccttccgagagcagccgtcggtgccgagaagctgttgccccagcagccccaccgagtgacgcgcgggttttggccgggtcagcgcgcatacgcacacaggcacacccactcctggtcccgggggaaggctcactcttcggttttccagggctaaaggccaaggccacgcggatttctgagtccgaagacgcagtgcgaggacttacacctggattcccttactatcggctggatggtgggtggggaacccaaatccctctcttcttggcctcgcccttcctagcaggctttaggaaaaataccgaggtcgc

SEQ ID NO: 70526 - DNA, 826 bp, Homo sapiens; identical to SEQ ID NO: 33455
  misc_feature 1..826: note = chr10:124894870-124895696
  misc_feature 1..826: note = hyper
  source 1..826: mol_type = genomic DNA

SEQ ID NO: 70527 - DNA, 701 bp, Homo sapiens; identical to SEQ ID NO: 33456
  misc_feature 1..701: note = chr10:124895832-124896533
  misc_feature 1..701: note = hyper
  source 1..701: mol_type = genomic DNA

SEQ ID NO: 70528 - DNA, 759 bp, Homo sapiens
  misc_feature 1..759: note = chr10:124896937-124897696
  misc_feature 1..759: note = hyper
  source 1..759: mol_type = genomic DNA
ggagcgagccggcctggccgcgtccctgcacctcaccgagacgcaggtcaagatctggttccagaaccgccgcaacaagtggaagcggcagctggcggcggagctggaggcggccaacctgagccatgccgcggcgcagcgcatcgtgcgggtgcccatcctctaccacgagaactcggcggccgagggcgcggcggctgcagccgcgggggccccggtgccagtcagccagccgctgctcaccttcccgcaccccgtctactactcgcacccggtggtctcttccgtgccgctgctacggccggtctgaggccccagaggggtgggggagggagcgcccggcctccttgtccggaccccggaggagactgggccgggccgagggcgccgagaagtccagcggccttcaggaactggggcttgggcgcgcagcctctgcttcccctcccccagtcggtagcattttgtaagtatttgcaatgcattttcgtgcaattcatccctaatggattggaggcgcttcccctcttacttttggtttttggcttatattaagagaaagcaggaacaagacaaaattttcgggtcagagatttcggccgatagtttttgtaaaatgtgcagccctcccttccaaatttccattgcgcggtggctttttggttttatttttatagaaggaaaataagcgcaaaacctaaatccctctagtttattcttttctgcttttttttttttttccgagacggaatcttgctc

SEQ ID NO: 70529 - DNA, 37 bp, Homo sapiens
  misc_feature 1..37: note = chr10:124897936-124897973
  misc_feature 1..37: note = hyper
  source 1..37: mol_type = genomic DNA
tacaggcgtgagccactgcgcccggcctagtttattc

SEQ ID NO: 70530 - DNA, 152 bp, Homo sapiens
  misc_feature 1..152: note = chr10:124899035-124899187
  misc_feature 1..152: note = hyper
  source 1..152: mol_type = genomic DNA
taagtacaacctggacgcacaaccctgtattccgggaggcggtggagacagaggcggctttgttcgcgaccagaggcactctctcccctgtactttccgcggcctgaaacgcccagcgagcagggaagaatgctgggcggaaggggagtgga

SEQ ID NO: 70531 - DNA, 644 bp, Homo sapiens
  misc_feature 1..644: note = chr10:124899554-124900198
  misc_feature 1..644: note = hyper
  source 1..644: mol_type = genomic DNA
attcccggggcgactcgagcatgggcgcggtcctgatgtgctaagtgtgagggaacagaggctacctagctgctgcagctgcaacagagaagaccttgtctcttccgtgccaggctcttctctttcccctggcgcccaacacctcctgggcggcatctctagatccccgaccctgtcctggcagacgccgagaagcgtagcgctcaccacacccgcgcgctactgggttccaggccgccgcgctcttagtgagcagcctgcggaggcacagcgcgccggaaccgcctggaagggtgggtccgcccgacagaagcaggtgcctgggcgacactcgctggccgggtgtggccgcctgcctttaagctgggggtctgcacgtacaattcctggcggggcacctttgaagctggggagccgaaagggggagatgaggaacccagagggtgaaaaagattccagagagcagccatagggcgcgaccgctggggagcgcctgcacgcctctctttcctctcgcagtgcgttgctaggctcctcaaattcaatcgacacaattgattctactgtggctgaaacgtccagtatagttttctgttaatggaaaactgccctccgaataaaccgacatgcgtatttatggcaaa

SEQ ID NO: 70532 - DNA, 77 bp, Homo sapiens
  misc_feature 1..77: note = chr10:124901589-124901666
  misc_feature 1..77: note = hyper
  source 1..77: mol_type = genomic DNA
gaacatcctttggaccgggatgcctcgaagtccctcctcacaagccacctgggatacactagcggagcctgccacca

SEQ ID NO: 70533 - DNA, 155 bp, Homo sapiens; identical to SEQ ID NO: 33462
  misc_feature 1..155: note = chr10:124901892-124902047
  misc_feature 1..155: note = hyper
  source 1..155: mol_type = genomic DNA

SEQ ID NO: 70534 - DNA, 431 bp, Homo sapiens; identical to SEQ ID NO: 943
  misc_feature 1..431: note = chr10:124902138-124902569
  misc_feature 1..431: note = hyper
  source 1..431: mol_type = genomic DNA

SEQ ID NO: 70535 - DNA, 1400 bp, Homo sapiens
  misc_feature 1..1400: note = chr10:124902607-124904007
  misc_feature 1..1400: note = hyper
  source 1..1400: mol_type = genomic DNA
cgccctctcgctgtcccccaccccctaacccgggctttgaggtgtgagcgatcccttgcctctgggcctaggactctggaagtgtgcacggccgttgtgcagggtggatggtgttgaccttttgacctgaaaacagttgggggctggggagcggaggaaggatggcggaagagaggaaagagccacgagaacaactaggcgggatgtacttttgagccctgccgggtgtctccgatcggagtctggggttgagatttgggctgcacttgtccccggtgtgtctctccggcggagtaccctgaaggtgcacgaggtggggagcataggctgaggtgggtaatcgggtcctggatagaaacacaaccctcgtcctcactggggcccatgtatgcgcctgggattcctccccacccttccatttccaggacccctaagggtatcactccagcgacggggcggttctggagacccgagggaagggatagctggagactgcagcgcgccttctccgagagtcccctggaggtgcgcatgagttgtactagcgcagatctcttccttggctgctgctcctggcgatgcatctccgggggaaacttcccaaagtctgagttgccggggttccaaaaggatccctttgggtttaggcctgggagaggtatagagccagcgagagagcgcgttgcgcctatcactgaggcaggagcggtgaggtggagtcacctgctgtgcctcacccaagcgctaatgtcttaaagaaatataaagaatccccttctttcgtgagctccttcaccgccctcgcccccgttggtgatggagtgcacgcatcagattttcatcaaagttctattaagtgaaacataggttgcagggcaccctttgattgaaacagtttaaattttaattgtgtttttaatttgacatatagttgcagaaaggaatgacactgcgtcgccaaggggcggtcgattttcttaatttctcccagaggaattgatgagtctatcaggccactagattggaaacccattaaagctctctggttaggctgttaattggaacttgatggatgtgggggggtggggaggggggtggagagtgtcgggactcggctatgctgatccaatcttcatgactttctgttttccaataaattacacaattcattttccagcagcagattacataaattgtacacctctggggctctctttttcaaatagggagcccttttccccaaaagcctattgtgagatgtcatttgcaccaaagaacgaacagcagaggcccttgaacgaaaatcgaaacataatcaacgtttatacttagaaaatttattgagatcattttctctggtatttccttattttaaagtttggacgcgccatatatcataa

SEQ ID NO: 70536 - DNA, 30 bp, Homo sapiens; identical to SEQ ID NO: 33465
  misc_feature 1..30: note = chr10:124904318-124904348
  misc_feature 1..30: note = hyper
  source 1..30: mol_type = genomic DNA

SEQ ID NO: 70537 - DNA, 677 bp, Homo sapiens
  misc_feature 1..677: note = chr10:124904557-124905234
  misc_feature 1..677: note = hyper
  source 1..677: mol_type = genomic DNA
gggcgtctgggcctccgtgctcccggtgaagatccccatatgctagaaaggggcggcaaggaaggttgtttcttgtccctcccgtccttgcggtgtgacggctataggtgctggaggggcgggaggtccctcgggctatcaatcgaggggagctcaggggaactgcagtcagtcaggctgcagagctgggtctccaccacagccttccttgccccagccccgtgcccaccaccatctcttccctggtaaagtgcacgcactagtaggagctcagtgaacgtttgctgaatgaatgtgtgagtgtgcgcaggcgtttatgcaagtgccttcatgcgaattaatgcgtcctttgccgggtgtggcagcagaggaagtgcctcggtgaagatcagaccctcgaagcgattagagggacgggacagaggaaatacaaggcaagatggatctttttgacttcccaaactatccctaggggaaggagagatagggacgcaaggcttcataacttccttgtttagagtccgcaagccaggcttcttgcaagggtcgactccccagtctctcactgtttcagggcctgggagttgcttttccgaggcccacttcgaggtcccctgatctgacagagatcactccttgggctcttgccccacccatatacccgcccccgccatccc

SEQ ID NO: 70538 - DNA, 399 bp, Homo sapiens
  misc_feature 1..399: note = chr10:124905481-124905880
  misc_feature 1..399: note = hyper
  source 1..399: mol_type = genomic DNA
ttccagcatgttccccgcacgacatatttacagttcaggaaggttcgaccaactttccctgcctgcccccagctttcttccccagcggggtggctggcactgctccccgagttagctggccagttcccctcggggctgccttgaccctggctccggaggcagcgcctagctcaggatgtctgcgagaagcggatggttagtgagaatccgacgattctttcgctgaacctcccgcgtaccccccaacagcgcgggagcacgcgggacccgctgcgacgtggcccaggagcctgcgccgccgcggcgcagaggagaacgcacaaattgtatttcagcgccaggtccttccgggttaatgagctgacaccatgattaaagctgaccatttgtaatgtgtct

SEQ ID NO: 70539 - DNA, 191 bp, Homo sapiens
  misc_feature 1..191: note = chr10:124905919-124906110
  misc_feature 1..191: note = hyper
  source 1..191: mol_type = genomic DNA
cggaggccggcacctgcccctcgctggcctcccgggccgctgcgcgcaccccctggcccccgccccctcgcctgcccctgccccggctgcgcggccgactcctaatcaattagcccattaacgagcccctcgaggagttaagtagggaagagttctgccacgggcagggccgcagtcggtaactcaccgcg

SEQ ID NO: 70540 - DNA, 174 bp, Homo sapiens
  misc_feature 1..174: note = chr10:124906770-124906944
  misc_feature 1..174: note = hyper
  source 1..174: mol_type = genomic DNA
acaaaaacacagattcgcttaaaacacgggtgggccatgggctacccggccaggtttatggagtacctactatgcgctgctagtgcttcgaggcttttaatccctacctgaggcaatccgagaagttattttcaactatgagggcagagaggctttaatcggcatgagttgtgc

SEQ ID NO: 70541 - DNA, 1105 bp, Homo sapiens
  misc_feature 1..1105: note = chr10:124907268-124908373
  misc_feature 1..1105: note = hyper
  source 1..1105: mol_type = genomic DNA
caagcccctgggaggcgcggagacccgtcgcctgcggaggcgtcgagccactccagctccgagtcccgcaccgcccctgcctctggagagaagggtccaaggggtccaaggagtcggagttgccgcagccgccaggaacccgggctagaatctgcagctgctttcagccctggctgcccctggttagacgccgctgatgcccgccaggccctcggcgcgctctgggggcgcaccggtgctgtgtgcctggccggagcgttttgaaattttccggggccgctcggcggcgctgcgattggccgcgttcgggtaacctctatgcaaatgaggccgcgccgcctccgcgccgccggagacccggcgagttggcgggcgaggaaggggcatttgcaccggggctgggcgggcgcacccagagccaggcgggcaggaacccctgcgcagccatccggtgcctgcatgtccctggcgcggaagggacgcctcaccagcctcggcgccccctccccctagatttcctccccgcccctccccactgcctgcctgctgcaccaccttccacccagatcacccagatcgtctctaaagggagttcttggtttccttcgatttcttatgaacccaggatgggcagcaaagaagatgcgggcaaggggtgtccggcggccggtggcgtctccagcttcaccatccagtccatcctgggcgggggcccctcggaggcaccgcgggagcccgtcggctggccagccaggaagcgcagcctgtccgtgtcctcggaggaggaggagccggacgacggctggaaggcgcccgcctgcttctgcccagaccagcacggccctaaggagcagggccccaagcaccatccccccatcccttttccttgcctgggtaaggatcgcacgtcgccagtgtggcagcgagcgagcgcgaggggagggaggctgagcgccccgccaagactcccgcgccgggccccctctggccagagctgcggcagccgggggttcgggaccgcggggagaggggcgcgcactgtggtgcctcctccgcccggtgggcccctgggagcaggcgaacacagacccgtgccggcttgggc

SEQ ID NO: 70542 - DNA, 211 bp, Homo sapiens; identical to SEQ ID NO: 33472
  misc_feature 1..211: note = chr10:124908904-124909115
  misc_feature 1..211: note = hyper
  source 1..211: mol_type = genomic DNA

SEQ ID NO: 70543 - DNA, 286 bp, Homo sapiens; identical to SEQ ID NO: 33473
  misc_feature 1..286: note = chr10:124909252-124909538
  misc_feature 1..286: note = hyper
  source 1..286: mol_type = genomic DNA

SEQ ID NO: 70544 - DNA, 254 bp, Homo sapiens
  misc_feature 1..254: note = chr10:124910201-124910455
  misc_feature 1..254: note = hyper
  source 1..254: mol_type = genomic DNA
gtgggcttggttacccggcatgataacgcacggaaggttttcaggtttttcggtggaaagacttgcatgcgtctgtctgtggaagtttggctcgctccacgtggagggtgggaccggggtcaggggttaaaggtcgggaccttggcgccgcccagactgcacgtggctggagctgcccgcccactctccctcctaacgcccagaatcgtcgcgcgggctggggcgcaccccggctggaatccagctcaagagtc

SEQ ID NO: 70545 - DNA, 520 bp, Homo sapiens
  misc_feature 1..520: note = chr10:124910708-124911228
  misc_feature 1..520: note = hyper
  source 1..520: mol_type = genomic DNA
cgctgcgcccagctacccggccggtggcagagttatgtgtctcgcgcggagagggaactgggcgcggtgaggcagttctgcggctcaggagagatccgaggcccgggaccaggcaaagaaggtgagggaggcaaaggcgcttccctacactcttttgttgttaatagtttgcattggttcagcgtgtggctggatcaccggctagcacgcggccgcttgctctgaatggaaccttgacgcgcggcgggggcgcccacggacttcctcgccctgacacctgcggccgcgcaggggctgggagggcgctgcaccgagagaatagccgcgggagtatcatgcaaattgcagattctcgctcccaatagattgcagccacctgttcttggcaaaacctcggaaaaggaagcctgagcttggaggaagccggtggttcagcaccacctggggcgagctcctccggcctctggctgggcagagcggatgcaaaggagcctggagtccgcagcgctgaggccctatc

SEQ ID NO: 70546 - DNA, 30 bp, Homo sapiens
  misc_feature 1..30: note = chr10:124962095-124962125
  misc_feature 1..30: note = hypo
  source 1..30: mol_type = genomic DNA
gtgtgtgtagcctggcgtagagtggccatc

SEQ ID NO: 70547 - DNA, 43 bp, Homo sapiens
  misc_feature 1..43: note = chr10:1250432-1250475
  misc_feature 1..43: note = hypo
  source 1..43: mol_type = genomic DNA
gggtcccacagctctcgtgcctctgaagcgggcctggcttgct

SEQ ID NO: 70548 - DNA, 229 bp, Homo sapiens
  misc_feature 1..229: note = chr10:1252126-1252355
  misc_feature 1..229: note = hypo
  source 1..229: mol_type = genomic DNA
aatgtaaaattccttcgcacgagagtgaagaggatgatccccaggtgcgtctctccattcccgggtcctaacgattcctccttaagccggctacctgcgcgggggccacgctctcccactgggaggatggtttctgggacatgcggcgtctcctccttgtgcctgtgcgtctgagagaactggggcgtctccttgaactgggacgtctcctcctcgtgcctgtgtggtc

SEQ ID NO: 70549 - DNA, 30 bp, Homo sapiens
  misc_feature 1..30: note = chr10:125219999-125220029
  misc_feature 1..30: note = hypo
  source 1..30: mol_type = genomic DNA
cattggtgccagcagcgtcattcagtctca

SEQ ID NO: 70550 - DNA, 194 bp, Homo sapiens
  misc_feature 1..194: note = chr10:125252113-125252307
  misc_feature 1..194: note = hypo
  source 1..194: mol_type = genomic DNA
gggagagaccctgcacgtgtgggcagtcaaggagggcattggcttggtgaggacaggcctggtgagcctcatgggttgagggcacctgcgagctgtcagctgcttcccagtgggctagctgcagtgatttggtgcacctggctgggacagcgagtgtgttgaggcactttatccttcatcggctcttcctgtgg

SEQ ID NO: 70551 - DNA, 30 bp, Homo sapiens
  misc_feature 1..30: note = chr10:1252590-1252620
  misc_feature 1..30: note = hypo
  source 1..30: mol_type = genomic DNA
gcgcccatgagatgacgccttgtgactcag

SEQ ID NO: 70552 - DNA, 189 bp, Homo sapiens
  misc_feature 1..189: note = chr10:12531976-12532165
  misc_feature 1..189: note = hypo
  source 1..189: mol_type = genomic DNA
tggggcaggtgtgaacggggcaggcacactcacgggtctgggctctggatgtgttggtggctccttggctggagcaggggagggcaagggtgccacgtgggtgtgtctccagccactgctgtggggaaggttttcctgggtgcagtctccgagggcctctgagtgagagcaactcgccccctctaccca

SEQ ID NO: 70553 - DNA, 97 bp, Homo sapiens; identical to SEQ ID NO: 33476
  misc_feature 1..97: note = chr10:125425515-125425612
  misc_feature 1..97: note = hyper
  source 1..97: mol_type = genomic DNA

SEQ ID NO: 70554 - DNA, 259 bp, Homo sapiens; identical to SEQ ID NO: 33477
  misc_feature 1..259: note = chr10:125425689-125425948
  misc_feature 1..259: note = hyper
  source 1..259: mol_type = genomic DNA

SEQ ID NO: 70555 - DNA, 56 bp, Homo sapiens
  misc_feature 1..56: note = chr10:125426031-125426087
  misc_feature 1..56: note = hyper
  source 1..56: mol_type = genomic DNA
cgccgccaggcgccggcgctcttcaccctgaacctcacgtgcgggaacctgctgtg

SEQ ID NO: 70556 - DNA, 29 bp, Homo sapiens
  misc_feature 1..29: note = chr10:12554507-12554536
  misc_feature 1..29: note = hypo
  source 1..29: mol_type = genomic DNA
cctcagcagctgcccgttgggagactcgg

SEQ ID NO: 70557 - DNA, 414 bp, Homo sapiens; identical to SEQ ID NO: 33478
  misc_feature 1..414: note = chr10:125650749-125651163
  misc_feature 1..414: note = hyper
  source 1..414: mol_type = genomic DNA

SEQ ID NO: 70558 - DNA, 94 bp, Homo sapiens
  misc_feature 1..94: note = chr10:125651372-125651466
  misc_feature 1..94: note = hyper
  source 1..94: mol_type = genomic DNA
gcagaggcgcggggcgggcgcaggggggccggccccgcccttccttcttccctccctttcccggcgacccctccgaggccggtccttggaggca

SEQ ID NO: 70559 - DNA, 110 bp, Homo sapiens
  misc_feature 1..110: note = chr10:125732094-125732204
  misc_feature 1..110: note = hyper
  source 1..110: mol_type = genomic DNA
tgggagggagggatgcggcagcgatggggagaagggaggagcagggagaggagagaggtggaggagcgaagaggggatgaaggtgagcggcagggcggggatggagggac

SEQ ID NO: 70560 - DNA, 764 bp, Homo sapiens
  misc_feature 1..764: note = chr10:125851165-125851929
  misc_feature 1..764: note = hyper
  source 1..764: mol_type = genomic DNA
gccacacttcattcccgagaactcggtacaattaacttaaccaacgtgaacaaggcgaaggcgcccagctgtcacagcggctccgcgcacgcaggcagacgaagaagggcccccgcccccaggagctggtcccagcctccagcctggcagcctccttcgaagacttccctacactgggcgcggacctccagccgccagcagccggcaacccagccccagccttcctcctctatacccgccgtcccagccgcgccggccggccccgggcgcagggcgggcgggaacgtgggcacccggacagcgacggggaggtcaagcagctgtgcccaggacccgggcggctccgaagcctcaacacgcacacactcgcgcgcacgccggcccatcggttgcctggaggagtcgggaaggtgcttccacggctcttcattcattttcccaaaggcaaggttcccttcgccccggcgcctctatcctgccatcccagggggccaattgcgccacagcccgccacccagccacccacagccaccgcgtcctatctcccggcacacacaacccaacagactcgcattacatctccaccgccagcgtcgcctccgcgccccggccgctgccatccggctccccagcttcgccgccccgcagccccggctccccgcctctggcctcaccgcgcggctcagagctgcctcgctcggctcgccgcaccaaggccggccagagacgccgccaccgccgggaagcgccggcaactcccgagt

SEQ ID NO: 70561 - DNA, 366 bp, Homo sapiens
  misc_feature 1..366: note = chr10:125852132-125852498
  misc_feature 1..366: note = hyper
  source 1..366: mol_type = genomic DNA
ctccccgcccggaaccgccgcaaggctagagccagggttctggaagcgcatccgagctcgcaaccggggagagagtggcggatgcccacttacctgccccgggccgcgcctggaaacttccccaaagtgcgataggggtgtgggggcggagcgcaaggctggggggaatccccgtcccctaccgccaaacgacgcgcgctcacaccgtgaaagcactggtctgtccgtcggtcggtcccccgcctgcggctcccagagctgggcggtgcaggggcgccccgattccgactactgggctccttctcccggacagcccgccggtgcgttccacgcggcttgcgccccccgccggcctccggctatcca

SEQ ID NO: 70562 - DNA, 737 bp, Homo sapiens
  misc_feature 1..737: note = chr10:125852540-125853277
  misc_feature 1..737: note = hyper
  source 1..737: mol_type = genomic DNA
cggccgcgtcctctctgcgagggagggggcgtgtgtcgccgctgggtaacccttcccgcggggtcctcaagcgcgcagggcgcccggagcgcggccaggaccaatggcgaagggactcctcccgctggggatcgctgaagcctcggggaggccgggccaaggagcccggggcccaaacctgcctcggctcgtcgagctcgcaagttcattgtctgcctgggccgccgccgccaccgccaccgccaccaccgcgccgggagcgccgcggggagtgaggctgcgcgccgcctccgccggcccggactccctacgcccagccccggccgccgccggcgctgcctggcccgaacccgcggaggggcgccggagccccgagcccagggccagacctcctaccgccgctcctcgccgaccccacctcggcgtctggcacctaacttgtacctgagaagcctgagtccagcccgggagcctctgcggctccggctccgcgggagcgcgcccagccccgagcctctagccccgcatccagggcgcgtcaacctgactccccgagcgctgggaggaaaagtttgggagtgacgtgcagacggcgaatgaaacatccgaggagaaccctccccccgccccatgtcgcgctgacacacatcagctccagtctggaatgtgagatcaaggcgtgtgcgccgagcggtgggtttggcccctgccccctccccctccgagtcaacactgct

SEQ ID NO: 70563 - DNA, 198 bp, Homo sapiens
  misc_feature 1..198: note = chr10:125853693-125853891
  misc_feature 1..198: note = hyper
  source 1..198: mol_type = genomic DNA
ttaaggaacttggcggtctggagccagcccgtacattaatattcaaggccacagcgctggtgagttcggcgccctctgttgtatttttgcatcccgggaaggctggcccggctctttggcccggcgtgttttgcttccgcgggggaggtaaagctctgcaggaccccgatcgccacggcctgccgcagtggcctggag

SEQ ID NO: 70564 - DNA, 38 bp, Homo sapiens; identical to SEQ ID NO: 42679
  misc_feature 1..38: note = chr10:125919683-125919721
  misc_feature 1..38: note = hypo
  source 1..38: mol_type = genomic DNA

SEQ ID NO: 70565 - DNA, 221 bp, Homo sapiens; identical to SEQ ID NO: 42439
  misc_feature 1..221: note = chr10:1259797-1260018
  misc_feature 1..221: note = hypo
  source 1..221: mol_type = genomic DNA

SEQ ID NO: 70566 - DNA, 35 bp, Homo sapiens
  misc_feature 1..35: note = chr10:1260381-1260416
  misc_feature 1..35: note = hypo
  source 1..35: mol_type = genomic DNA
tgcacctgtacccagcgttgcgtgggtttgcccct

SEQ ID NO: 70567 - DNA, 58 bp, Homo sapiens
  misc_feature 1..58: note = chr10:126077654-126077712
  misc_feature 1..58: note = hyper
  source 1..58: mol_type = genomic DNA
cacgcccgggacagccgcccgcagtctacgcagggaggggccgcggggctctggtttc

SEQ ID NO: 70568 - DNA, 115 bp, Homo sapiens
  misc_feature 1..115: note = chr10:126083109-126083224
  misc_feature 1..115: note = hypo
  source 1..115: mol_type = genomic DNA
tttctaataggatcacgccacgcccctgcttcaacccctttcttcagtgaccccactgctcaccaaattaagcccaaaggccctcattgtcattggccaccgtctccacaactcc

SEQ ID NO: 70569 - DNA, 15 bp, Homo sapiens
  misc_feature 1..15: note = chr10:126135816-126135831
  misc_feature 1..15: note = hyper
  source 1..15: mol_type = genomic DNA
ggacactttgaagga

SEQ ID NO: 70570 - DNA, 846 bp, Homo sapiens; identical to SEQ ID NO: 33486
  misc_feature 1..846: note = chr10:126135877-126136723
  misc_feature 1..846: note = hyper
  source 1..846: mol_type = genomic DNA

SEQ ID NO: 70571 - DNA, 1885 bp, Homo sapiens
  misc_feature 1..1885: note = chr10:126137221-126139106
  misc_feature 1..1885: note = hyper
  source 1..1885: mol_type = genomic DNA
tgtgcggggccggatcgatagatgtcatctattaaaggtaagttttaatcgaacaatattaggatcagacagggaaagggggtttgaagtcggtacctgcaagctgcgggcaggagatatgcaggcgccagtaatagaatatcgatcacgagggtgggggaagggagggcggcccctcggagagaagatccgaacaattaccaggccgcctgcctgggcccaagtgcggccgccagaggcgccccgggccccaggcaatcaccgccaaacttggggaggggagcagggggctgcgcggcatccagcctcccccgatgacctgagcctctgaccctccagggagccgcctttccctgtctgatcccagcaggactcctgctgtcttccgtccttccttccagccacaaactttcctaaccccttcatcaggtgtccgccagcgttgggagtaattcagaaagggtttcgagaagaaagtaccgaaagcttcccaacactccatccgagccccgcccccagcccagtcccagttaacagttgagtctggggagcttgagcgcctggggcagcccagccccgcaggcgtctccgggtggcacctgacctcgctactcacgaagacccccggcgcaagccttagcgtcagctcccccatccataaaatggaggtgatgttaatgatgctgtccatctctcaggttccgaagttttcatcacctttatcccagcccttagcccaggtcctagcacgtggcaagcgcattaaatgcccgataaatgagtaagcctggcaagacaggcgccaggtaagtttccaccgcgagcatcagaactgtggtgcgggtgagcttggcgggtgagcagggatgcggcaaatccctgccctgtaatgcggggagcctcctctctgcctctatccaagtccgaggcgggggctacacttcgcacccggtcccgtgcgccttctctctgaggaagacgctgttaagggccactcaccgggcccggctgttcccccatacactccgcattgttggggctgaggcctcctggggccggggccgccttgcatcttaccaggggtctccagctgtcggacagggtccctggagctggcatctttccccgcttcgacctccgccaaacttttcctggcttcccggggagccgggcgcacggcagggagcgctgcgcgggtgaatttctgtgggtccaggatgtccaggacagagaaagaaatcttgtggtgggagggagccgccttggccccgccgtcctgccatgccagcatgcccgtcgcccacgggccggcggtcggcggcgcggggttggggatggcgccgctcgggcttgccttcggctgtggcttggcggtagctttccagccaggagccgggtccgcgctgccaagtgaagctggggaggggggcggggaggcggggcggggagagcgccgcggggggctgcgcgccgattggcaccggcgcagcccgggccagcctcgggactatcaggcgctgtgccgcggccgcttgcctgggctcggggaagcctccgcgcgcccggtgcgcgcgaccgcggggacagtgttgtcgtctccgcgcgcctccgcccaaccctctgggactctccgagggcgcgagggaggcttccatcccggggatccctcaccccgacacacacacctctgtgacttgagtttgttccctttctccggtgcacccgccttagacttggggatgcaactgaggccaggactgcttactcccaggcaatgctcagcgcatctccttccccgccagtgaattactgtaatagcttcagacccggttacctcggaggtaaaatccctcacgttctcacagtttagcgttcacaaagccct

SEQ ID NO: 70572 - DNA, 30 bp, Homo sapiens
  misc_feature 1..30: note = chr10:126184143-126184173
  misc_feature 1..30: note = hypo
  source 1..30: mol_type = genomic DNA
ggtgcccaggagtggcggagctggaggaag

SEQ ID NO: 70573 - DNA, 186 bp, Homo sapiens; identical to SEQ ID NO: 42680
  misc_feature 1..186: note = chr10:126198949-126199135
  misc_feature 1..186: note = hypo
  source 1..186: mol_type = genomic DNA

SEQ ID NO: 70574 - DNA, 30 bp, Homo sapiens
  misc_feature 1..30: note = chr10:126254787-126254817
  misc_feature 1..30: note = hypo
  source 1..30: mol_type = genomic DNA
tctccagattcttggcgccttcctgattgc

SEQ ID NO: 70575 - DNA, 30 bp, Homo sapiens
  misc_feature 1..30: note = chr10:126278930-126278960
  misc_feature 1..30: note = hypo
  source 1..30: mol_type = genomic DNA
cttgggctctgaaggcgcctctcatcctct

SEQ ID NO: 70576 - DNA, 216 bp, Homo sapiens
  misc_feature 1..216: note = chr10:126314006-126314222
  misc_feature 1..216: note = hypo
  source 1..216: mol_type = genomic DNA
ggattcgatgcagcccggtggtgtgcacacagcacaatcccctcaccacggcagagagctggagacggcgacccctgcacaacagccccaggttcctcaccggctcctggccaggcctggacgatggatcggcaaccaggatcctcgcctgcccctggccaggcctgggcgatggaccagcagctcccaaagcgaacctgccgcttgtgaggtgga

SEQ ID NO: 70577 - DNA, 209 bp, Homo sapiens
  misc_feature 1..209: note = chr10:126314738-126314947
  misc_feature 1..209: note = hypo
  source 1..209: mol_type = genomic DNA
tgttttctgtggcctcgcacgtgaacgcagcaggagcgcagcctgcgcaatcggacagacgccgcacagcgcttgtctgtgctcaccctctcggtcctgctcggagcttcccactgacctcctctggcataaggcgcaggtagcgggggtgcctaacttatggccaccatgattgtgtgggtctcggcactaaccgtggtgctacggtc

SEQ ID NO: 70578 - DNA, 159 bp, Homo sapiens
  misc_feature 1..159: note = chr10:126331927-126332086
  misc_feature 1..159: note = hypo
  source 1..159: mol_type = genomic DNA
tctccctattcacgacgcgcaggtggctgataaatttcccagggtttctcggcgcggtgattgcgcctggctctttcagcgtggctgcaggaatctatacaggtccacttaaatcagtctgaagctgtgaaagcctccatcactcgtcgcccgggcccg

SEQ ID NO: 70579 - DNA, 31 bp, Homo sapiens
  misc_feature 1..31: note = chr10:126479341-126479372
  misc_feature 1..31: note = hypo
  source 1..31: mol_type = genomic DNA
cttctttttttgagacggagtcacgctctgt

SEQ ID NO: 70580 - DNA, 31 bp, Homo sapiens
  misc_feature 1..31: note = chr10:126479612-126479643
  misc_feature 1..31: note = hypo
  source 1..31: mol_type = genomic DNA
taagccaccacgcacccggccctctgaatcc

SEQ ID NO: 70581 - DNA, 209 bp, Homo sapiens
  misc_feature 1..209: note = chr10:126697825-126698034
  misc_feature 1..209: note = hypo
  source 1..209: mol_type = genomic DNA
agagccaagcgattcacggcttcatcagcccctgtgacctgcaggtggcctgggaggcaggaggagcctaagcagccggtgtggctcccagcctcatgcacaatgatccaggaagaaagaggagacaaaaccacacaaactccagaggccggggcgggacagggagtgacccaacacagccgaacctgaggccccgcctgcctccaagg

SEQ ID NO: 70582 - DNA, 30 bp, Homo sapiens
  misc_feature 1..30: note = chr10:126710554-126710584
  misc_feature 1..30: note = hypo
  source 1..30: mol_type = genomic DNA
ggaatgtttttactacgcaggcatagatta

SEQ ID NO: 70583 - DNA, 90 bp, Homo sapiens
  misc_feature 1..90: note = chr10:126712034-126712124
  misc_feature 1..90: note = hypo
  source 1..90: mol_type = genomic DNA
gggagattgctggctcgcagccaccgccggagggctccgcgacttgtgccatagccggccaggtcagcctgagagcgacagccgacccca

SEQ ID NO: 70584 - DNA, 30 bp, Homo sapiens
  misc_feature 1..30: note = chr10:126744811-126744841
  misc_feature 1..30: note = hypo
  source 1..30: mol_type = genomic DNA
agaatgctccatgtgcgatgagaactattc

SEQ ID NO: 70585 - DNA, 87 bp, Homo sapiens; identical to SEQ ID NO: 42687
  misc_feature 1..87: note = chr10:126809890-126809977
  misc_feature 1..87: note = hypo
  source 1..87: mol_type = genomic DNA

SEQ ID NO: 70586 - DNA, 171 bp, Homo sapiens
  misc_feature 1..171: note = chr10:126814656-126814827
  misc_feature 1..171: note = hypo
  source 1..171: mol_type = genomic DNA
cctgtaccactagaccgcagtgcagcggtggcctgggagaggcccgctggacacacttcgcaatgggccagttcagctgctggtgctttcctgccttgtccaactatgtgacctcaggcaagtcacttagcctctcagaagctcacctggcagggtcgagaggaatgctac

SEQ ID NO: 70587 - DNA, 49 bp, Homo sapiens
  misc_feature 1..49: note = chr10:126847190-126847239
  misc_feature 1..49: note = hyper
  source 1..49: mol_type = genomic DNA
aaggattgtttaccccggacagggcaaggaagcccggtatgacgacgta

SEQ ID NO: 70588 - DNA, 48 bp, Homo sapiens
  misc_feature 1..48: note = chr10:126850174-126850222
  misc_feature 1..48: note = hyper
  source 1..48: mol_type = genomic DNA
accgtgccggagaggcggcgaccgctgtgggtgcgcagggaagggccc

SEQ ID NO: 70589 - DNA, 44 bp, Homo sapiens
  misc_feature 1..44: note = chr10:12685417-12685461
  misc_feature 1..44: note = hypo
  source 1..44: mol_type = genomic DNA
cggcaggtgagtgggcgaagctgcgtttgtatttacagctgctc

SEQ ID NO: 70590 - DNA, 30 bp, Homo sapiens
  misc_feature 1..30: note = chr10:126881168-126881198
  misc_feature 1..30: note = hypo
  source 1..30: mol_type = genomic DNA
cagtttacagtgtttcgtgtgctttgaaaa

SEQ ID NO: 70591 - DNA, 30 bp, Homo sapiens
  misc_feature 1..30: note = chr10:126914656-126914686
  misc_feature 1..30: note = hypo
  source 1..30: mol_type = genomic DNA
gtaagagcagagcagcgagaagtgggggga

SEQ ID NO: 70592 - DNA, 194 bp, Homo sapiens; identical to SEQ ID NO: 42689
  misc_feature 1..194: note = chr10:127380217-127380411
  misc_feature 1..194: note = hypo
  source 1..194: mol_type = genomic DNA

SEQ ID NO: 70593 - DNA, 30 bp, Homo sapiens
  misc_feature 1..30: note = chr10:127445232-127445262
  misc_feature 1..30: note = hypo
  source 1..30: mol_type = genomic DNA
attactacagatgtccgtccctctttgata

SEQ ID NO: 70594 - DNA, 108 bp, Homo sapiens
  misc_feature 1..108: note = chr10:127451959-127452067
  misc_feature 1..108: note = hypo
  source 1..108: mol_type = genomic DNA
tctggaaagaatcaacgttatcgtccacctgctgggccagcttgccgccggcagtgcagcgagcagcaatgccgttcagtgactgcacagagccgtgtcccagacacg

SEQ ID NO: 70595 - DNA, 134 bp, Homo sapiens
  misc_feature 1..134: note = chr10:127463291-127463425
  misc_feature 1..134: note = hypo
  source 1..134: mol_type = genomic DNA
gaggaggtaagaggtcgcgggggaggaagacgctccccccggccttgcggggcaggtcgcgcagggcaggtcgtgcggggcaggtggggggtgccaaggaagtccgggcgtggccacaccgcagagaaagccat

SEQ ID NO: 70596 - DNA, 36 bp, Homo sapiens
  misc_feature 1..36: note = chr10:127464167-127464203
  misc_feature 1..36: note = hypo
  source 1..36: mol_type = genomic DNA
atgtgcctgtgtgcacgtgcacgggcctgggggtat

SEQ ID NO: 70597 - DNA, 93 bp, Homo sapiens
  misc_feature 1..93: note = chr10:127475463-127475556
  misc_feature 1..93: note = hypo
  source 1..93: mol_type = genomic DNA
cctactcagccttcacgttctcaggaatctccagcccaattgccaaagcaagcccaggctcccgactcacgcaatcgtcgaggacactgcgcc

SEQ ID NO: 70598 - DNA, 30 bp, Homo sapiens
  misc_feature 1..30: note = chr10:127568161-127568191
  misc_feature 1..30: note = hypo
  source 1..30: mol_type = genomic DNA
tggttctgagtgctgcgtaattcatgagtc

SEQ ID NO: 70599 - DNA, 36 bp, Homo sapiens
  misc_feature 1..36: note = chr10:127582121-127582157
  misc_feature 1..36: note = hypo
  source 1..36: mol_type = genomic DNA
agactgtggacgagtaaagggcggagagatagacat

SEQ ID NO: 70600 - DNA, 35 bp, Homo sapiens
  misc_feature 1..35: note = chr10:127601472-127601507
  misc_feature 1..35: note = hypo
  source 1..35: mol_type = genomic DNA
ggattacaggcgtaagccatcgtgtccagcctatt

SEQ ID NO: 70601 - DNA, 36 bp, Homo sapiens
  misc_feature 1..36: note = chr10:127753348-127753384
  misc_feature 1..36: note = hypo
  source 1..36: mol_type = genomic DNA
atgccgagcttgtggcggccacgtacctggtcccca

SEQ ID NO: 70602 - DNA, 338 bp, Homo sapiens; identical to SEQ ID NO: 33489
  misc_feature 1..338: note = chr10:128075686-128076024
  misc_feature 1..338: note = hyper
  source 1..338: mol_type = genomic DNA

SEQ ID NO: 70603 - DNA, 619 bp, Homo sapiens
  misc_feature 1..619: note = chr10:128076244-128076863
  misc_feature 1..619: note = hyper
  source 1..619: mol_type = genomic DNA
tggggatattcactgcgggatagggccagcaagaggacccgacacgcatcgtcccgagtgacacgtgtaaatgtcaagatacagagacatctgcaaatgtcacccaagagggtgaggacgggggagcggtcccgaggctgtgccctccggggcaggtactggctcctgtggggctgcgggccaagtgtcgcccttccccaaggaattggcacctggggggggggggtcggtctcgccgcgctggaagcgcaagccccggggctccggagatgcgccggggcgcgtcgcccctcggggcagccctggacctcggcgcgcccaggcgcagcgtgcggtgccctcggcggggcgggcagcgagccgccctagttcggcgacttacctcgggcctcgcagggcgcgagcagagcaccggccagggcgagcaggagggcgcgggcgggggacacgggcagcgggcgcgctgccatcgtcgccggccttcagtgcagcagctctcgggcccggcggcgagcgctgcaccatcccacgcgggcgccgagccggggccgggcgtcgcgaccggagggatttcctgcctcggcgagtcagctccggagccctcgcgcagcgcccgcgc

SEQ ID NO: 70604 - DNA, 301 bp, Homo sapiens; identical to SEQ ID NO: 33491
  misc_feature 1..301: note = chr10:128076940-128077241
  misc_feature 1..301: note = hyper
  source 1..301: mol_type = genomic DNA

SEQ ID NO: 70605 - DNA, 14 bp, Homo sapiens
  misc_feature 1..14: note = chr10:128077431-128077445
  misc_feature 1..14: note = hyper
  source 1..14: mol_type = genomic DNA
ggcgcgcgaccccg

SEQ ID NO: 70606 - DNA, 38 bp, Homo sapiens
  misc_feature 1..38: note = chr10:12828013-12828051
  misc_feature 1..38: note = hypo
  source 1..38: mol_type = genomic DNA
atgttatattttccacgaatttccgtgagatgaaaaat

SEQ ID NO: 70607 - DNA, 30 bp, Homo sapiens; identical to SEQ ID NO: 42522
  misc_feature 1..30: note = chr10:12844882-12844912
  misc_feature 1..30: note = hypo
  source 1..30: mol_type = genomic DNA

SEQ ID NO: 70608 - DNA, 32 bp, Homo sapiens
  misc_feature 1..32: note = chr10:128593761-128593793
  misc_feature 1..32: note = hyper
  source 1..32: mol_type = genomic DNA
aactcaggagaaccccgcgggggtgcccgggt

SEQ ID NO: 70609 - DNA, 30 bp, Homo sapiens
  misc_feature 1..30: note = chr10:12872726-12872756
  misc_feature 1..30: note = hypo
  source 1..30: mol_type = genomic DNA
aatgcctcgagcccacgggggtgtcccggc

SEQ ID NO: 70610 - DNA, 30 bp, Homo sapiens
  misc_feature 1..30: note = chr10:12876451-12876481
  misc_feature 1..30: note = hypo
  source 1..30: mol_type = genomic DNA
caaacgctcagcatgcggctgccgagtctg

SEQ ID NO: 70611 - DNA, 203 bp, Homo sapiens
  misc_feature 1..203: note = chr10:128888576-128888779
  misc_feature 1..203: note = hypo
  source 1..203: mol_type = genomic DNA
caggtgtttgtcggtcgccgctggagaccattgtgtggatcagtcacatggtctgctgcagtgtgagtgacagacggtgacttgctatcagtatgcaaaggtcacccggtgactattccaagaagtgtcattttccagtggagaatgggactttttttttttcctgttaataatttatttcttaattgcggtaaaatacatat

SEQ ID NO: 70612 - DNA, 32 bp, Homo sapiens; identical to SEQ ID NO: 33492
  misc_feature 1..32: note = chr10:128993490-128993522
  misc_feature 1..32: note = hyper
  source 1..32: mol_type = genomic DNA

SEQ ID NO: 70613 - DNA, 902 bp, Homo sapiens
  misc_feature 1..902: note = chr10:128993580-128994482
  misc_feature 1..902: note = hyper
  source 1..902: mol_type = genomic DNA
cgttggttggtttcccacgcctgtcccggtctgactcgggctgccaggcaccgggaagccccgcggcgccgaccccaacccgcagccccgggaaggtgccaaccccagcgagtggaggagacgagcatttcacgtgggcatctgccttcactgctgctcgcgcctctcctcaacggccggcgtcagggcccctctgttccaactcatcccccccccgaagttaatcagccgtacttgtactttccagggcgctttagtttggaaaatacttaaaagcctcgaaaccttccggggagacggccgcccccagatctcccagttttgcctggctagggctgtcgggcgctcacgaagctgtggcgtctgtctggaacccacatcgcagaggcgcagccccgctcctccctgacgtcgccaaagttgccagacgcccctcagcgacccggtcgcgccagatgcagttgcataaccttgccccccacctgcgaccgcaccgggtccgctcccggctgcaccggggtgtcccggccccgggagccgccgagtttccggccaagccggtttggggccgagtgtgtgcgcccgaatcggggtcggcgcccgtcccagcggtgctctgcccgcggccaagtacgacgggcgcgggggcgcgggaggagggcacgcggggctccgcttaccttccgctgcttacagataagtcgaggtcgatgcagcgcctggctcgggcatgtctcgctgcggaccctggcaagcctggggcggcacggagcactccggacagggcatccgcggccagactcgccgcgctcacgcggaggaagcctcggctccggggacttggcccgctgcgcgcctgctgcccgccccctccaccgctgccggcccggccctgctggccc

SEQ ID NO: 70614 - DNA, 225 bp, Homo sapiens
  misc_feature 1..225: note = chr10:128994686-128994911
  misc_feature 1..225: note = hyper
  source 1..225: mol_type = genomic DNA
gccagggccaggaggcgggggcggggcagaggagggagcaggagggaagtcctttccgctgctccaggtcccagctactccgcggagccgggcggccagaggcgagggcgccccaagccgcgcgcctgccgcctgtgcgcccggctggcaccgaggcgggcggagccccgggccccgcggggcggaggtggggcgggggcggcgcggggccgggccgggccgggc

SEQ ID NO: 70615 - DNA, 455 bp, Homo sapiens
  misc_feature 1..455: note = chr10:129534992-129535447
  misc_feature 1..455: note = hyper
  source 1..455: mol_type = genomic DNA
cgccctctatccctagccccgagtcccgggtaacccaggggccccggcgaggcgagtttctttggggcgagatgtcccgagccgagcaaaggggccgcgcattggacggggctcccaagccacagccctgggggccttgaggagtcgtggtacggtccagggcagtcggggctgcggggcccgtgaagccagacgaggctacggacttagggtccctgcaaccaagaccgcgagcgactgtggactcgggacggatcgcacaaaggaggaagggggaatcagaggggcgtccggtccaggacgtgtcaggcctgggcggggcggaaaactgacaccagggcgaggacaaggatttcgctcctccagggctgccaggggaggggctcgccaccgtcactctccatgggctctggccccgacggtgtttaaagggcggagggctgggccgggctggt

SEQ ID NO: 70616 - DNA, 529 bp, Homo sapiens
  misc_feature 1..529: note = chr10:129535695-129536224
  misc_feature 1..529: note = hyper
  source 1..529: mol_type = genomic DNA
cgcttcgggtcccgggcctgcgccgccctacgcggccccgagctacggggctcccggcccgctcctcggcgccccgggcggcctggcgggcgccgacctcgcctggctgagcctctccggccagcaggagctgctgaggctggtgcggccgccctactcctactcggcgctcatcgccatggccatccagagcgcgccgctgcggaagctgacgctcagccagatctaccagtacgtggctggtaacttccctttctacaagcgcagcaaggcgggctggcagaactccatccgccacaacctgtcgctcaacgactgcttcaagaaggtgccccgcgacgaggacgacccaggtaacagcggcgcgccggctcgctccgtccaggactccccatcttcccgccgggccgcgggcactccgggggtgggagcaccttagacaacctaatttctccctgcgcggttggggatacccggggaggagggagaaggggaagaagtgcttgggcatggacaggttctcagacag

SEQ ID NO: 70617 - DNA, 64 bp, Homo sapiens
  misc_feature 1..64: note = chr10:129536258-129536322
  misc_feature 1..64: note = hyper
  source 1..64: mol_type = genomic DNA
cggcggtcccggggctctcaatctctgtgcgctccttcggaggaagaagcgggagagccagcaa

SEQ ID NO: 70618 - DNA, 30 bp, Homo sapiens
  misc_feature 1..30: note = chr10:129684716-129684746
  misc_feature 1..30: note = hypo
  source 1..30: mol_type = genomic DNA
aagcggtgcaggcctcggggtgcagcctcc

SEQ ID NO: 70619 - DNA, 402 bp, Homo sapiens
  misc_feature 1..402: note = chr10:129705629-129706031
  misc_feature 1..402: note = hyper
  source 1..402: mol_type = genomic DNA
gaggcccaagcaggccggggcgctgcctcggccgctgccgcgggagggaggggccgctccggggctcagagtccggaccccggccccgccgcccccgcggcgcgcccagtaccagcggctggggcccgtacgacccccgaccccggcctgtggcgcgtcccctcacccggagtccccagcccaacttggcgaccacagtggcagtgctcacgctccctctcggtaaacaggaggagggcgcgcgtgtctgcgggtggctacagtgcgcgggggccggcggcagggcggcgtacgtgaaagcgggcgacacagagagggggtgcaggccgcgcgtggggggctgcgcccactcgaggctggaggctggagcctttgaagaaagtggctcgagttgtgccaact

SEQ ID NO: 70620 - DNA, 30 bp, Homo sapiens
  misc_feature 1..30: note = chr10:129885942-129885972
  misc_feature 1..30: note = hypo
  source 1..30: mol_type = genomic DNA
gtcactcacccgggacgttgcacacctgag

SEQ ID NO: 70621 - DNA, 135 bp, Homo sapiens; identical to SEQ ID NO: 42695
  misc_feature 1..135: note = chr10:129888855-129888990
  misc_feature 1..135: note = hypo
  source 1..135: mol_type = genomic DNA

SEQ ID NO: 70622 - DNA, 30 bp, Homo sapiens
  misc_feature 1..30: note = chr10:129897051-129897081
  misc_feature 1..30: note = hypo
  source 1..30: mol_type = genomic DNA
cagtgttgggacagacgaggatagttgttc

SEQ ID NO: 70623 - DNA, 117 bp, Homo sapiens
  misc_feature 1..117: note = chr10:129914687-129914804
  misc_feature 1..117: note = hypo
  source 1..117: mol_type = genomic DNA
tttgccaatatgcttcgcaaagacctgatctttcaggattctggaacaaaacccaaccactactcaccagggtcagaagagaagctagatcttgagacacgacgtgctggctcctgt

SEQ ID NO: 70624 - DNA, 122 bp, Homo sapiens
  misc_feature 1..122: note = chr10:129925726-129925848
  misc_feature 1..122: note = hypo
  source 1..122: mol_type = genomic DNA
tacacaggattctatcggggtctgcttcagttgcgctggtggccatgtgggctcagtaggccacctggggtgaagtgaatggagcctaaacacgcttttggtgacaacggcctctctgcccc

SEQ ID NO: 70625 - DNA, 24 bp, Homo sapiens
  misc_feature 1..24: note = chr10:129947242-129947266
  misc_feature 1..24: note = hypo
  source 1..24: mol_type = genomic DNA
taggtgatgggtacacggggtttg

SEQ ID NO: 70626 - DNA, 211 bp, Homo sapiens
  misc_feature 1..211: note = chr10:129947985-129948196
  misc_feature 1..211: note = hyper
  source 1..211: mol_type = genomic DNA
ggatcaggtcaccttcgcaggcccagactccaccgtcagctgccgccgacggagcccacagaggaggctcgggcgcccgcgccccctgcgcagcggcccctccgcagcggccccagcccgcgtccccgcagcgccccttccgaagcgccccctccgaagcgcccacagcccgcgttcccgcccgcaccccagcccgcgccccctgcccggg

SEQ ID NO: 70627 - DNA, 30 bp, Homo sapiens; identical to SEQ ID NO: 33501
  misc_feature 1..30: note = chr10:129948725-129948755
  misc_feature 1..30: note = hyper
  source 1..30: mol_type = genomic DNA

SEQ ID NO: 70628 - DNA, 17 bp, Homo sapiens
  misc_feature 1..17: note = chr10:129953663-129953680
  misc_feature 1..17: note = hypo
  source 1..17: mol_type = genomic DNA
attatttttttgagacg

SEQ ID NO: 70629 - DNA, 379 bp, Homo sapiens; identical to SEQ ID NO: 33502
  misc_feature 1..379: note = chr10:130008498-130008877
  misc_feature 1..379: note = hyper
  source 1..379: mol_type = genomic DNA

SEQ ID NO: 70630 - DNA, 327 bp, Homo sapiens
  misc_feature 1..327: note = chr10:130008906-130009233
  misc_feature 1..327: note = hyper
  source 1..327: mol_type = genomic DNA
cggggcctttaggcgcccccgtttcctcgtcagtggggggcgcggtgccgcttctccgcgggctaaactgctgaggaaggggcgagttcctgcggcccctgcctgtcccggccacgccccacctccgccccgccgcgttgcgcgttcccgcggggccccgggcacccctggggccccggggatctctgacgcccccttccctccaacccccgctgcgatcccacaggtggggtgaacagcgcccctgctgtcccacggggcgtcttcgcgggtgatgcccacactctcagcctgaagagcaggacctgtccgcgggtggggcccacc

SEQ ID NO: 70631 - DNA, 53 bp, Homo sapiens
  misc_feature 1..53: note = chr10:130012130-130012183
  misc_feature 1..53: note = hypo
  source 1..53: mol_type = genomic DNA
gacctcgaggagggacgtggacattatctcactttccgcggagggggcagcag

SEQ ID NO: 70632 - DNA, 104 bp, Homo sapiens
  misc_feature 1..104: note = chr10:130065661-130065765
  misc_feature 1..104: note = hypo
  source 1..104: mol_type = genomic DNA
cgtgagccaccgcgcccggcccaaagcaggcatttttgtgagcctagcagcgaggtctggaggcttggtgtgctggagggtgaaagcagcgtcaggaggtcacc

SEQ ID NO: 70633 - DNA, 306 bp, Homo sapiens
  misc_feature 1..306: note = chr10:130084893-130085199
  misc_feature 1..306: note = hyper
  source 1..306: mol_type = genomic DNA
taccagcacctgggccgtagttgtctcctggctcctggggtccgcggagctctagatgtacctgcagctcctcccgagtcctgcaagccacccttgtccctcttctcccgctcaccccccggcccccccatctcttttgctattccggggaaggccacgcagggtgcaacccggacgcgcccccgggggaagcccgcgacgcagcagccacacccccagcctgcactggcgcccaccccatgacttcgccttcgcggtcgcgggcagggagcgcgcgtttccatcggttgattagaagcgggagtc

SEQ ID NO: 70634 - DNA, 76 bp, Homo sapiens; identical to SEQ ID NO: 947
  misc_feature 1..76: note = chr10:130085200-130085276
  misc_feature 1..76: note = hyper
  source 1..76: mol_type = genomic DNA

SEQ ID NO: 70635 - DNA, 83 bp, Homo sapiens; identical to SEQ ID NO: 33506
  misc_feature 1..83: note = chr10:130085355-130085438
  misc_feature 1..83: note = hyper
  source 1..83: mol_type = genomic DNA

SEQ ID NO: 70636 - DNA, 34 bp, Homo sapiens
  misc_feature 1..34: note = chr10:130166708-130166742
  misc_feature 1..34: note = hypo
  source 1..34: mol_type = genomic DNA
ttacaggcgtgagccaccgcgcctggtctgtttt

SEQ ID NO: 70637 - DNA, 232 bp, Homo sapiens
  misc_feature 1..232: note = chr10:130203334-130203566
  misc_feature 1..232: note = hypo
  source 1..232: mol_type = genomic DNA
tgcacaacatcagggcgggagttgatgtggcccacagtgtgaacggcgccctccaagatgagcagtgtgatgctccgcagagtcgtagacaggaaaagtggaggctgaagtgggaccggacagcactggcacggcttgactttggcaatggacaacagggaaaatggaggcgcaggtgagaaaggaaggcaggtgaagcgcccgactcactccaagccgggggtctgaatca

SEQ ID NO: 70638 - DNA, 36 bp, Homo sapiens
  misc_feature 1..36: note = chr10:130268452-130268488
  misc_feature 1..36: note = hypo
  source 1..36: mol_type = genomic DNA
agctcagggactggacgcaggcggcagagcgagtga

SEQ ID NO: 70639 - DNA, 53 bp, Homo sapiens
  misc_feature 1..53: note = chr10:130268909-130268962
  misc_feature 1..53: note = hypo
  source 1..53: mol_type = genomic DNA
agcctctgactggcacgtccagccaggccacggtatcccgttccaaatgggct

SEQ ID NO: 70640 - DNA, 76 bp, Homo sapiens
  misc_feature 1..76: note = chr10:13027839-13027915
  misc_feature 1..76: note = hypo
  source 1..76: mol_type = genomic DNA
ttaccaaaagacacacgtgataaaattgcatcgagttttttatttgtttgttttgggacggagttttgctctgtcg

SEQ ID NO: 70641 - DNA, 30 bp, Homo sapiens
  misc_feature 1..30: note = chr10:130299142-130299172
  misc_feature 1..30: note = hypo
  source 1..30: mol_type = genomic DNA
ccggggcgctgagctcggggttcacttcca

SEQ ID NO: 70642 - DNA, 176 bp, Homo sapiens
  misc_feature 1..176: note = chr10:130317077-130317253
  misc_feature 1..176: note = hypo
  source 1..176: mol_type = genomic DNA
ctgcctaattgctttcggtgaggcttcacttaagtgataaataaaaaattcattacttagttaatagttctttcatcaggaaaagtgttttaagatgaggctgtgagtcacggttgttttcttccctacctgcggactggtgtggaagagtcagacctttccgaatggcggctggt

SEQ ID NO: 70643 - DNA, 192 bp, Homo sapiens
  misc_feature 1..192: note = chr10:130338803-130338995
  misc_feature 1..192: note = hyper
  source 1..192: mol_type = genomic DNA
cggctccctgggcccccagctcacgatgcccgctaggagccggcgccggggcgccccaaggctgcctccccccgcagcgctgcgcagtgcgccctggtgggatggggacgctgcacccctgaacccccccaaatccggcaggcctagggctggaggcgcggaaaccctcactcctgccgagctcccgagcgg

SEQ ID NO: 70644 - DNA, 89 bp, Homo sapiens
  misc_feature 1..89: note = chr10:130339328-130339417
  misc_feature 1..89: note = hyper
  source 1..89: mol_type = genomic DNA
ggtggcccctgcccccgtgcaggccggcgtgacccggctcctaggtgaggctggagagaaggacctcgttttagcggattttttccttt

SEQ ID NO: 70645 - DNA, 16 bp, Homo sapiens
  misc_feature 1..16: note = chr10:130339653-130339669
  misc_feature 1..16: note = hyper
  source 1..16: mol_type = genomic DNA
tatgtgcataaccttc

SEQ ID NO: 70646 - DNA, 120 bp, Homo sapiens
  misc_feature 1..120: note = chr10:130339670-130339790
  misc_feature 1..120: note = hyper
  source 1..120: mol_type = genomic DNA
ctgtctcgctaaaggtcagcgcgcccctgctcatttcccgggctgccttttgggggcactctgatgccggggatttcctcgggtgttggggaaacaagacgtgctcgcctaacaaagact

SEQ ID NO: 70647 - DNA, 29 bp, Homo sapiens
  misc_feature 1..29: note = chr10:130402649-130402678
  misc_feature 1..29: note = hypo
  source 1..29: mol_type = genomic DNA
tggagtgcgatggcacgatctgagcgtgc

SEQ ID NO: 70648 - DNA, 15 bp, Homo sapiens
  misc_feature 1..15: note = chr10:13043120-13043135
  misc_feature 1..15: note = hyper
  source 1..15: mol_type = genomic DNA
cctggctctaggtaa

SEQ ID NO: 70649 - DNA, 726 bp, Homo sapiens
  misc_feature 1..726: note = chr10:13043175-13043901
  misc_feature 1..726: note = hyper
  source 1..726: mol_type = genomic DNA
cggcggcgccgccgggctcacctgaggaagaagaaataggagtagtcctggaccacggtgtgggagtggcacgagaagtagcccaggccggtgaggttgagcctggagccggcgggcacctccagcatgctgccccacgcctggtcgcacagcatctcgacctcggccgagtagaagaggcccccctggccggcgtggtactgccagggcaggtggttgtagaggccgggcgcctcggggtgcagcgccagcaccctggcgtacacgatggtctcggccagctcggcgcggcagccctcgctcaggggcctccactcggagggcagctggcaggcgcgcgcgggcgctgggggacccgccaggcagagcgcggcgagcagcagctggcgcagcatgccgggccctcccggggcgcacggggcggcggcggggagcccggggagcccgccggcccgggaagggcagccctgggcgctcggctgctcgggccgctcccgggagctgagcgcaccgctgtctccgccacggggctcggcatgcccggccctggcgcgccacgctttaaaagggtcccggggactggacgcgccgggcgcccgcctcccgccctgccccctgcggctggggcgtgggcgggggaggggcggggagtcgggcgggtcccggcgccggctggggcggggaccagggactcggagaacgcggggacgccgggacccagccctg

SEQ ID NO: 70650 - DNA, 30 bp, Homo sapiens
  misc_feature 1..30: note = chr10:130520011-130520041
  misc_feature 1..30: note = hypo
  source 1..30: mol_type = genomic DNA
acaagaggacagcaacggcagatcagacgc

SEQ ID NO: 70651 - DNA, 63 bp, Homo sapiens
  misc_feature 1..63: note = chr10:130546173-130546236
  misc_feature 1..63: note = hypo
  source 1..63: mol_type = genomic DNA
gttagtgagtctgcacgctgccttctcactgacacggagggagaagcccgtgtggactcagag

SEQ ID NO: 70652 - DNA, 243 bp, Homo sapiens
  misc_feature 1..243: note = chr10:130577739-130577982
  misc_feature 1..243: note = hypo
  source 1..243: mol_type = genomic DNA
agcctccgaggattccgcctgaggacacggccccatgagccggctcacgctcagaaggatggctgcctccacaaggctgccaatttgagcaccggccaaactgcaaccagaccccaggaaaggtaaaatagattgaaatgtattgcgcggtactcagattcactcctctgtctgcgagattattcttcttaaacacacacccacacagcgagcatctgcccacggccccgtggcgtgctggag

SEQ ID NO: 70653 - DNA, 20 bp, Homo sapiens
  misc_feature 1..20: note = chr10:130754356-130754376
  misc_feature 1..20: note = hypo
  source 1..20: mol_type = genomic DNA
gacgccgatgctcctgcaga

SEQ ID NO: 70654 - DNA, 22 bp, Homo sapiens
  misc_feature 1..22: note = chr10:130803707-130803729
  misc_feature 1..22: note = hypo
  source 1..22: mol_type = genomic DNA
agaactgaggccaggcgcggtg

SEQ ID NO: 70655 - DNA, 203 bp, Homo sapiens
  misc_feature 1..203: note = chr10:13081775-13081978
  misc_feature 1..203: note = hypo
  source 1..203: mol_type = genomic DNA
aatggtaggaccatccgtctccctcagtacttggaaatgcgggagaggtgggttctagttgttacaataactgtgacagacgtactggtgacatacagtgggcaggatctagaatgctgtttgtcctgcacagaaaggtttcacagaaaagatcttcctgcctgagctgcctatagcacctaggtgaccgctgacattggtaa

SEQ ID NO: 70656 - DNA, 30 bp, Homo sapiens
  misc_feature 1..30: note = chr10:130829116-130829146
  misc_feature 1..30: note = hypo
  source 1..30: mol_type = genomic DNA
agacttaactatttgcgtgtattttcccaa

SEQ ID NO: 70657 - DNA, 110 bp, Homo sapiens
  misc_feature 1..110: note = chr10:130829975-130830085
  misc_feature 1..110: note = hyper
  source 1..110: mol_type = genomic DNA
ccccccaggaggccacgggggggagctgtggctctgctcagggcggccacagccagtagcggggaggagagggcggaaaatatactgtagcaaagcgatggtggaagagg

SEQ ID NO: 70658 - DNA, 85 bp, Homo sapiens
  misc_feature 1..85: note = chr10:130855248-130855333
  misc_feature 1..85: note = hypo
  source 1..85: mol_type = genomic DNA
catgtacacacaggccgtgcacatgtggtcgtgtgtgcctatggctgtgtgcatctgtatatgtgtgtggcgcgtgtgcacttgt

SEQ ID NO: 70659 - DNA, 144 bp, Homo sapiens
  misc_feature 1..144: note = chr10:130855393-130855537
  misc_feature 1..144: note = hypo
  source 1..144: mol_type = genomic DNA
gtgcactctcatatgtgtgcattgtccctgtgcttgcattcccgtgaggcttcgggatatgcatctgagtgtttctagagaaacaccacgggacgcagggtcctggaagtgcctgggcaggaagctcggcgacccaacccagag

SEQ ID NO: 70660 - DNA, 30 bp, Homo sapiens
  misc_feature 1..30: note = chr10:130911792-130911822
  misc_feature 1..30: note = hypo
  source 1..30: mol_type = genomic DNA
acccgtccctcacctcggagcaactctctc

SEQ ID NO: 70661 - DNA, 152 bp, Homo sapiens
  misc_feature 1..152: note = chr10:130914837-130914989
  misc_feature 1..152: note = hypo
  source 1..152: mol_type = genomic DNA
cacctaggaggccaccgtgatgtgctgctggctgcaaggctttgtcctgacctgacccagagcatcattgcacagacacttgagatggcaagtgtgtaggccacgcagcgtagggagggaagttttgctatcgtgctcgattatagtgtgag

SEQ ID NO: 70662 - DNA, 41 bp, Homo sapiens
  misc_feature 1..41: note = chr10:130938219-130938260
  misc_feature 1..41: note = hypo
  source 1..41: mol_type = genomic DNA
tcctccaccattctccgagagaaactcgcatgtgtcatcct

SEQ ID NO: 70663 - DNA, 179 bp, Homo sapiens; identical to SEQ ID NO: 42702
  misc_feature 1..179: note = chr10:130946123-130946302
  misc_feature 1..179: note = hypo
  source 1..179: mol_type = genomic DNA

SEQ ID NO: 70664 - DNA, 134 bp, Homo sapiens
  misc_feature 1..134: note = chr10:131034780-131034914
  misc_feature 1..134: note = hypo
  source 1..134: mol_type = genomic DNA
attaaaactgccacccgaggattgcgattgcgagtctacagctgggatgttgtcaggaggcagcaactccagcagcttttaacgccatctccttacaggtggacctcgagtcccagcgccggaggaagcggcgg

SEQ ID NO: 70665 - DNA, 30 bp, Homo sapiens
  misc_feature 1..30: note = chr10:131058458-131058488
  misc_feature 1..30: note = hypo
  source 1..30: mol_type = genomic DNA
cctctctcccatcatcgcaatcagtgcatc

SEQ ID NO: 70666 - DNA, 208 bp, Homo sapiens; identical to SEQ ID NO: 42704
  misc_feature 1..208: note = chr10:131058908-131059116
  misc_feature 1..208: note = hypo
  source 1..208: mol_type = genomic DNA

SEQ ID NO: 70667 - DNA, 81 bp, Homo sapiens
  misc_feature 1..81: note = chr10:131146694-131146775
  misc_feature 1..81: note = hypo
  source 1..81: mol_type = genomic DNA
accagtccacccctccgagccggggcttccacggccctgggtgtacggctgaccaatccactcctccgagccagggctgcc

SEQ ID NO: 70668 - DNA, 30 bp, Homo sapiens
  misc_feature 1..30: note = chr10:131171764-131171794
  misc_feature 1..30: note = hypo
  source 1..30: mol_type = genomic DNA
aatggaaactctggacgttagttaccatta

SEQ ID NO: 70669 - DNA, 49 bp, Homo sapiens
  misc_feature 1..49: note = chr10:131265287-131265336
  misc_feature 1..49: note = hyper
  source 1..49: mol_type = genomic DNA
gggcatgcgccgacccggtcgggcgggaacaccccgcccctcccgggct

SEQ ID NO: 70670 - DNA, 23 bp, Homo sapiens
  misc_feature 1..23: note = chr10:13130732-13130755
  misc_feature 1..23: note = hypo
  source 1..23: mol_type = genomic DNA
tgaatattagctgggcgcagtgg

SEQ ID NO: 70671 - DNA, 47 bp, Homo sapiens
  misc_feature 1..47: note = chr10:131323870-131323917
  misc_feature 1..47: note = hypo
  source 1..47: mol_type = genomic DNA
cagaaaggtgctgtgcggtgcggggccggctccgatgacagtaataa

SEQ ID NO: 70672 - DNA, 30 bp, Homo sapiens
  misc_feature 1..30: note = chr10:1313323-1313353
  misc_feature 1..30: note = hypo
  source 1..30: mol_type = genomic DNA
gggcactgtcctccccgtcctcacagcctc

SEQ ID NO: 70673 - DNA, 75 bp, Homo sapiens
  misc_feature 1..75: note = chr10:13137668-13137743
  misc_feature 1..75: note = hypo
  source 1..75: mol_type = genomic DNA
agtactggttcaccacccggggtttggggacccctgctttattggacataattattaggtcgtgttctttttggt

SEQ ID NO: 70674 - DNA, 30 bp, Homo sapiens
  misc_feature 1..30: note = chr10:131377867-131377897
  misc_feature 1..30: note = hypo
  source 1..30: mol_type = genomic DNA
tctcagctgagtgtccgtgtttaaaggcga

SEQ ID NO: 70675 - DNA, 155 bp, Homo sapiens
  misc_feature 1..155: note = chr10:13140531-13140686
  misc_feature 1..155: note = hypo
  source 1..155: mol_type = genomic DNA
accccttacaggccccggggggacccttttctgccgatcccagggtacagctgtgacaccgtcttttctgcctggattatcccagtagataaacaaaaattagagatcgtcattccatttctctctgtatatatttttccaagcccttttcatga

SEQ ID NO: 70676 - DNA, 34 bp, Homo sapiens
  misc_feature 1..34: note = chr10:13140986-13141020
  misc_feature 1..34: note = hypo
  source 1..34: mol_type = genomic DNA
ttacaggcgtgagccaccgcgcctggccctcctg

SEQ ID NO: 70677 - DNA, 30 bp, Homo sapiens
  misc_feature 1..30: note = chr10:131456424-131456454
  misc_feature 1..30: note = hypo
  source 1..30: mol_type = genomic DNA
aactaaaatggaagacgggcttctggctcc

SEQ ID NO: 70678 - DNA, 30 bp, Homo sapiens
  misc_feature 1..30: note = chr10:131503379-131503409
  misc_feature 1..30: note = hypo
  source 1..30: mol_type = genomic DNA
acgcactgtagatgtcgcagacgcaggccc

SEQ ID NO: 70679 - DNA, 30 bp, Homo sapiens
  misc_feature 1..30: note = chr10:131510626-131510656
  misc_feature 1..30: note = hypo
  source 1..30: mol_type = genomic DNA
ctttaataattccttcgtcacagctattgg

SEQ ID NO: 70680 - DNA, 30 bp, Homo sapiens
  misc_feature 1..30: note = chr10:131592644-131592674
  misc_feature 1..30: note = hypo
  source 1..30: mol_type = genomic DNA
ttccataatgcttaacgtactgtttgtata

SEQ ID NO: 70681 - DNA, 213 bp, Homo sapiens
  misc_feature 1..213: note = chr10:131606675-131606888
  misc_feature 1..213: note = hypo
  source 1..213: mol_type = genomic DNA
gacttccctggagtccgcccggcccatgcagcacccggggctctgcaggggaccccactccaaagcagaatgagacacacaggggttttctgatggttctttcatcccctcagctcctctttcttcaaatcgcctttaacctcagtcagaatgccagtcttcgccaggttggcccagtgcccagcaccctcgcacccacgcagagattctggc

SEQ ID NO: 70682 - DNA, 36 bp, Homo sapiens
  misc_feature 1..36: note = chr10:131636273-131636309
  misc_feature 1..36: note = hypo
  source 1..36: mol_type = genomic DNA
tcccgccaacgctgacgcgggcggggctgcccttcc

SEQ ID NO: 70683 - DNA, 120 bp, Homo sapiens; identical to SEQ ID NO: 42706
  misc_feature 1..120: note = chr10:131641071-131641191
  misc_feature 1..120: note = hypo
  source 1..120: mol_type = genomic DNA

SEQ ID NO: 70684 - DNA, 218 bp, Homo sapiens; identical to SEQ ID NO: 42707
  misc_feature 1..218: note = chr10:131647719-131647937
  misc_feature 1..218: note = hypo
  source 1..218: mol_type = genomic DNA

SEQ ID NO: 70685 - DNA, 174 bp, Homo sapiens
  misc_feature 1..174: note = chr10:131739036-131739210
  misc_feature 1..174: note = hypo
  source 1..174: mol_type = genomic DNA
ggatgccaggggaaccgcgggggagtctgggcatgggaaggcagagggcaccgcccaccccggaaacctgtcaccagggctgccataaacatcccacactcgatcctcccatgttgggccacagcaaacaggactgcagcgtaaaaccaggtaggtccccggtcccccagcctc

SEQ ID NO: 70686 - DNA, 30 bp, Homo sapiens; identical to SEQ ID NO: 42709
  misc_feature 1..30: note = chr10:131739627-131739657
  misc_feature 1..30: note = hypo
  source 1..30: mol_type = genomic DNA

SEQ ID NO: 70687 - DNA, 22 bp, Homo sapiens
  misc_feature 1..22: note = chr10:131757029-131757051
  misc_feature 1..22: note = hyper
  source 1..22: mol_type = genomic DNA
gagcgcgggctcctccgcggcc

SEQ ID NO: 70688 - DNA, 308 bp, Homo sapiens
  misc_feature 1..308: note = chr10:131757545-131757853
  misc_feature 1..308: note = hyper
  source 1..308: mol_type = genomic DNA
cgggccgcggggagggcagggcgagggaggccggggccggggcgcaaggagcgagagcccgctggcaccgaccccggaacccggggctcccgggccccttcggcattccgcgccgccgccaggccgcgtcctcaggccattgtctacaacgagttccaatctgcatgttgggagaggccgatcagaacgccccgaggctaaagaagcagggaaggatggtcgcggcgcaggagcagtttgccaagggccgagggccgcgcccgccctgccctgcgcgctcccccggctctagcaagtctggcgccccg

SEQ ID NO: 70689 - DNA, 69 bp, Homo sapiens
  misc_feature 1..69: note = chr10:131758276-131758345
  misc_feature 1..69: note = hyper
  source 1..69: mol_type = genomic DNA
cgcgctcagcccggctccgccgctgggaacccgagctggggatcgggagccgcccgcccgggctgggcc

SEQ ID NO: 70690 - DNA, 2330 bp, Homo sapiens
  misc_feature 1..2330: note = chr10:131761007-131763337
  misc_feature 1..2330: note = hyper
  source 1..2330: mol_type = genomic DNA
tacttcaagccccaccggttaatcatgtgaagtgccatcgacttattgatcgtttatgttttgttttccttctatgccatgagaagatttcgtgtttacatccatgtcattttaatctcaaatctttatgtcctttcaccagcgcagaaaaggagagccagccgctgcaggggcggcgagcacgcagcaggcacttaccgttgctgtacaataactggagtttatagtggatgccgttgttggttttctcgttgtttggctcctgaaagtaacgataaataattgcatttagtgcgatcggtgtcaggcgcggccaccacgctcggtccccctccgcgaccgaggctctcggcctcacacatggcaggattcctagctcgaagcagcgcggtgatgtcactttcctgctggaagcccagcgttctcctcgccccgagtaagtccgagggcgcagagaagttgcccagccctcggcggtcccgggcggccgcacgtggcggcggcggggtggcctggcggagccgagcccgccgcctaggggggcactcgaacccccgcgcaccggcaccgcctgcctcccgcttctagaaagagagagggtgtgatcgtgtgtttgcacttactttctctttctccacaaagtccacaaaagcggtcctttcaatctccaccggctgcccctgcctatcgtagagcgccagcacgaagtggaagaaattggatttccggaggttggaaggcggctgcttctcgaagtgcgcccgcgccagccccacgccgctgcgggaggaaagagacagcggcccggtgaggagcgcggcgccggccggcggagggggccgggccgggccggggccggggccagggcgcgcgggggcggccggtacgtacctctgggcggccgtgttggcgtccaccacgcccgccgtgtgcatccacgagcgcaccgggttcatgccgctgcccagcggctcctccttcatggtcgtccccccgcgcggaatattctcctgaatcccaaacatgaaaactgctggcggcggccgcagctcccggccgaaagcgtttcctcgagcagcggcgctcggggcttggcggcaggcggctgccctggccgccctcgccctgctcggcgcctgcggtccggccccgccgccggcttcagcccgtcccgggcaggcgcgacatacaccagcggccgggcgctccggacggccaggggcgcggaggcggctccaccggcggcggcggcgcttcgaaggagcaggacgcggtggccgcggcggcgcttgttgttgttgttgtttgcaggcgcgctcaacgtggtgtcatcctagccaggcggcgtccgcggctgcaggacactgcgggatcgcccgcttctggcgcggcccgcctgctccaaagacaaataaacggggcagtgagtgctgcggcgcagtcccgggcgcaggcggggcgcggcggggcctggagcggcgcgcgcagcggacggaggcgcacaaaactcagccctctctccccgaggaatggaccctttcccgggagccaaaactcgaagcccccgggagcggcgctgtcagagggtgacgtcggggggcggtgcctgcgccatatatgggagcggccgcccctcgccgcgcccctcgccgccgccgccgccgcgctcgccgactgactgcctgacggcgccgcgagccggcccgagccccgcgagccccgcgagccccgccgccgccgagcgccaccgagcgccgccgccgccccccgccacgcaccgcggctcctcgcgtccagccgcggccaaggaagttactactcgcccaaataaatcttgaaaagaaacaaacgcagccactgcacaattgcagtttggccccttaatacctccctgcaaaacctgccacacagtcgaacacgatgggcggggcggggggctgtaaaatgctgaggcgccccaagttgcccagatgcatgcaataaatgcaaggggctgcagcttgtcctggggccgcccgaaggagaagtgggaagaggcaggtcgaccgcagggagggcgccggagggaggagcgggcaacggactgggaggaggggtgcccagggctccccggccaaggctggacgcgcagctcagcctgatttctaagcagacctaaggctgctgcagggccggccggtcccggtctgagccccgccaggtaccccaagcttcctaccccggcggaggccgccgagtgccgggcagggaatcacgtcggaggcagggtctgccagatgctccctctcccccggtggccgcggcagaccccggcccctggcctgttctta

SEQ ID NO: 70691 - DNA, 311 bp, Homo sapiens
  misc_feature 1..311: note = chr10:131763632-131763943
  misc_feature 1..311: note = hyper
  source 1..311: mol_type = genomic DNA
gggactccgcgcccaggagcgcggcccgcccaaaggacgtctgcgcgacacggagcagagacccaggggacgaccaggaactgtcctaggcacttccctgccaagagaaatcaggcccttttgattaaaagaaaaaaaaaaaaaagattgcagggcgcaagtgtgttgcagggcagcctcctcccgccgggtctggggcagcactcccttttcccgtgaattggcagcgtgtgtacgttaatattttaattaatcgggaaagtcgaagtccgattcacgttgtctggggacccccacgcctcttggaagga

SEQ ID NO: 70692 - DNA, 30 bp, Homo sapiens
  misc_feature 1..30: note = chr10:131767417-131767447
  misc_feature 1..30: note = hyper
  source 1..30: mol_type = genomic DNA
cccggggcaggtgtccgccccgggtcctgc

SEQ ID NO: 70693 - DNA, 243 bp, Homo sapiens; identical to SEQ ID NO: 33517
  misc_feature 1..243: note = chr10:131768685-131768928
  misc_feature 1..243: note = hyper
  source 1..243: mol_type = genomic DNA

SEQ ID NO: 70694 - DNA, 1401 bp, Homo sapiens
  misc_feature 1..1401: note = chr10:131768929-131770330
  misc_feature 1..1401: note = hyper
  source 1..1401: mol_type = genomic DNA
gcggccgggccggggagtccgtccgggtaattaactcagctccggcgactgcgacgatgaggccgggagggaaggaagagcataccgctcttggacagaaatgtgtcaagctctcctcccttccagcctgcataaaccctttcgcgcacattcgcgcgacttctaagggatccaagccagcggactgggtccagcagcgcgcggcggcgggacgcacccctcctctccccccaggaaggcgggtgcacgccggggctggaagggggagggtgcacctctggctacaaattcggccgcgaagagattctttaccaactctaagggtttgctgaatgtacagaccagaatgagtcccgttaaaaggaagctattcccacattaaacatgtgtgttttccatactaatggagtcacttaaagctgttgctaatttaactttttaaaaaggccacactgtggaaatttgcattttctttaggacattgaaatgaagagaaaactgctgggcggcaaggcggcccagggcatagctaggggccatgtagaaataaaaacagataaagaaaagaagaaagaaagaaaccggcttctcttctagactattaataagcaatttgtcccgctgaaatttacattgcaaagcggagggcgccggcagccgtggcggcgggcctggcgcgggctccgggggtgcgtcggcgcgggggcggggggggtcctccggccatccgggccgccctcgggggcgatccaccggcggctttgaactcggtgtccttgccgccgtgccgccgaccctcgcccgcacacgcgcgcatctgcacgccagggccccgcctgggctgcgcacccggaggccgggactggcgctgcgctagcgccacccgggctgagctgcagccttttgtggggggggcgggaatccctccgctcccagtgacgccttggactcgcggacccccatccgccccaaacgactgcccaggccttaaattaaaaatggcaacaataagcttaatttttttttcctccttagccgcgccgccccggtccaagtctaccgcaagcgtggagccccgagcgccgcgcccccgccggctctcccgcccgcgcgccgcccgacggagccgcggatcccgggcctagcgtggggccagggcgccatctacgggcgccgcgcggctccgggcggccgccgcctcctccctctcagcgtccagagcccgctcctcctcccgccgccgccgccctcgccccgcgccgcctgccacttatcacaattacccgacgctcccgtgccattttgcttatgaaacactgattgctagttatgcggacttttaagcactatattaaaactttcgaaatgaaggcgctctcctgcctgcgatttttaggtaca

SEQ ID NO: 70695 - DNA, 525 bp, Homo sapiens
  misc_feature 1..525: note = chr10:131770569-131771094
  misc_feature 1..525: note = hyper
  source 1..525: mol_type = genomic DNA
ttttggttgttaatccgaaaggaggagttttaattgcttcctgcgttgtcgtccaggcatctaggcgcttcgaccttccccatccctctctccaagggtctggcgtttgtactgggggaagacggagagtgaaaaacgcggggtccttcagctaaatcctcggaaccccggatcttcgcccgtgccggtacgcgcctcccccgcgccgagaatccctggcacgcgatcgcctccccgcaggcccgccgggaaggccgcgagcagaggccaacggaggcctcccaggcagtgctcgccaggaaccaagacgctgccagggcgcggcgcaaaagttcactgcgaggccaggcctgggcgcagctcatggtcaggggctcctgcctccacagtcccaccccgcgcctccgccgcagccccgcccgcgctcccgtaggcgagaggagcgcacccggctccggggccccggcaacccggcccccagcgttcagtgtccggcccgccacgcgcgaagttcaactttgctgg

SEQ ID NO: 70696 - DNA, 21 bp, Homo sapiens
  misc_feature 1..21: note = chr10:131771281-131771302
  misc_feature 1..21: note = hyper
  source 1..21: mol_type = genomic DNA
gggagagcccacgggcccggc

SEQ ID NO: 70697 - DNA, 43 bp, Homo sapiens
  misc_feature 1..43: note = chr10:131771415-131771458
  misc_feature 1..43: note = hyper
  source 1..43: mol_type = genomic DNA
cgtgccccggggccgcagctgcgcccagcgctagccacctgga

SEQ ID NO: 70698 - DNA, 315 bp, Homo sapiens
  misc_feature 1..315: note = chr10:131825216-131825531
  misc_feature 1..315: note = hypo
  source 1..315: mol_type = genomic DNA
ggttcccacacccaccgcccacctgctgccaggccctgggggagctctagtgagaaacgtccacgtactactgcccaacatgctcgccgctcctgaagagttttgtttgaatagaaatgtccccgtgtccacggccattttgctggaacagactccaggctgcacagaggcgccaacactgtccccagccggaggccaccgctgctgccctcacagctgccatctcacggtctccccctgccccacttcagggctctccccggggggccaaacaaggcccggcgatggggtggagccactcgcagcctcccccga

SEQ ID NO: 70699 - DNA, 786 bp, Homo sapiens
  misc_feature 1..786: note = chr10:131843979-131844765
  misc_feature 1..786: note = hypo
  source 1..786: mol_type = genomic DNA
agaaagtcacagccacgtcccgccacgcgggcgggaaaacgtggaagcaaatgcgattgcctcgactcgaggctcagctaaggagcagtcaggtccgtgtcacctgtggcttccactcccaggaagtctgatggctccggtcgtggctgttgtggggaatccgtcgtgtggagaacgtgcctgccacgtgcgggggagaaaggagccaccttccgagtacgcgacctcacctgccgggcgtgaggtgctggactgagaccagggtggggctctgggcatgggaggtggggctgggcgtggggcacgtggcacagagggatgcgcgtggtagggctcagggcagacggaacgtggaacagggagtggctcagggcatggggatggggcggggcgtgggacggggcgtggcgtggggcacaggaaggggcagggcacgaggagtggggcgagaggtgctaagtggggcctgagtggggcgcggggcgtggcgcggagtggggtggagcgggtggggcgaggctcggcgtgggacacgagggacgggacgcgggggcacggcaatgggtggcgcagggcgcactctcgggctccctgcaggtgggcagccccacctgtgcacgccgctcccccgcccagcgcctcccccgggacctgctccagaagcgccagttgcgggaccccacacggaaggcagtcttcggtggttctcactgcaattcctcttaattatgtgtgacataaaaagaccacctacagacgagacaatgctgccgtaagagtctcggg

SEQ ID NO: 70700 - DNA, 211 bp, Homo sapiens
  misc_feature 1..211: note = chr10:131845025-131845236
  misc_feature 1..211: note = hypo
  source 1..211: mol_type = genomic DNA
gcccgctcacctgcacgcggaggttcatttaatccgtgcgtctatgcagcgcctaggcctaactctcccaggaggcgccagtcacgttccccagggggagctccctgacctttctgggggtgacagagtggggaagtgggcagtgtgagcccacccctgaggcgtgtgtgtgtaagcgtgcacacttgctttttaacgttctgtattctag

SEQ ID NO: 70701 - DNA, 32 bp, Homo sapiens
  misc_feature 1..32: note = chr10:131851993-131852025
  misc_feature 1..32: note = hypo
  source 1..32: mol_type = genomic DNA
ggatgccagtgaaaccgcgtcttaagtggaac

SEQ ID NO: 70702 - DNA, 86 bp, Homo sapiens
  misc_feature 1..86: note = chr10:131936580-131936666
  misc_feature 1..86: note = hypo
  source 1..86: mol_type = genomic DNA
gtaaagtatcgggattacaggcttgagcccccgtgacctgccctgttgatctaaattgagtgaaattttgccgactgaatttgaat

SEQ ID NO: 70703 - DNA, 94 bp, Homo sapiens
  misc_feature 1..94: note = chr10:131937390-131937484
  misc_feature 1..94: note = hypo
  source 1..94: mol_type = genomic DNA
ttacaggcatgagccactgcgcccggccaaaatggataaaagtttaaatgtaagtaccatttggatgttgtatccttgccgctggcctgtactt

SEQ ID NO: 70704 - DNA, 39 bp, Homo sapiens
  misc_feature 1..39: note = chr10:131987277-131987316
  misc_feature 1..39: note = hypo
  source 1..39: mol_type = genomic DNA
cccgctgggttcttacggcggatccgttacctgggtctc

SEQ ID NO: 70705 - DNA, 30 bp, Homo sapiens
  misc_feature 1..30: note = chr10:131988259-131988289
  misc_feature 1..30: note = hypo
  source 1..30: mol_type = genomic DNA
gctttgctgccgctgcggccttgtgtgaat

SEQ ID NO: 70706 - DNA, 44 bp, Homo sapiens
  misc_feature 1..44: note = chr10:131988602-131988646
  misc_feature 1..44: note = hyper
  source 1..44: mol_type = genomic DNA
gcgcaagagtaagcccgcgggtgccggagcgcgcgccccgccgt

SEQ ID NO: 70707 - DNA, 262 bp, Homo sapiens
  misc_feature 1..262: note = chr10:132001274-132001536
  misc_feature 1..262: note = hypo
  source 1..262: mol_type = genomic DNA
cccacacagcacacacggtgcccgcacagcccacacggtgccctcacagcccgcacggtgcccacacagcacacacagcacacacggtgccctcacagcccgcacggtgcccgcacagcacacacagcacggtgcccacacagcccgcacagtgcccacacagcacacacagcacacatggtgcccacacagcccgcacggtgcctgcacagcacacacagcccgcacggtgccctcacagcccgcacggtgcccgcacagc

SEQ ID NO: 70708 - DNA, 35 bp, Homo sapiens
  misc_feature 1..35: note = chr10:132005005-132005040
  misc_feature 1..35: note = hypo
  source 1..35: mol_type = genomic DNA
atgggcagcaggcaccggcacgtggtgccctcagc

SEQ ID NO: 70709 - DNA, 75 bp, Homo sapiens
  misc_feature 1..75: note = chr10:132050760-132050835
  misc_feature 1..75: note = hypo
  source 1..75: mol_type = genomic DNA
agccatggagcttctcgagtgtgtggccctgaagtctgatctggacacagaaagatagagcgatggcgctggccg

SEQ ID NO: 70710 - DNA, 98 bp, Homo sapiens
  misc_feature 1..98: note = chr10:132229336-132229434
  misc_feature 1..98: note = hypo
  source 1..98: mol_type = genomic DNA
agtggcagcccagaccgacgcggagaccaaggttctttcgtgcactaccaggtgtccaccttgctgccacctgcagctgacatcgctgcctgctctga

SEQ ID NO: 70711 - DNA, 30 bp, Homo sapiens
  misc_feature 1..30: note = chr10:132237416-132237446
  misc_feature 1..30: note = hypo
  source 1..30: mol_type = genomic DNA
caccatcccccctcccgctgcctgttttgt

SEQ ID NO: 70712 - DNA, 30 bp, Homo sapiens
  misc_feature 1..30: note = chr10:132280529-132280559
  misc_feature 1..30: note = hypo
  source 1..30: mol_type = genomic DNA
gggaagtctgtttggcggagctcgagtcag

SEQ ID NO: 70713 - DNA, 30 bp, Homo sapiens
  misc_feature 1..30: note = chr10:132290329-132290359
  misc_feature 1..30: note = hypo
  source 1..30: mol_type = genomic DNA
gcactgacttccttgcgcatcctctcaaac

SEQ ID NO: 70714 - DNA, 30 bp, Homo sapiens
  misc_feature 1..30: note = chr10:132308764-132308794
  misc_feature 1..30: note = hypo
  source 1..30: mol_type = genomic DNA
tgctcctggcctgggcgtctgcaggggagt

SEQ ID NO: 70715 - DNA, 92 bp, Homo sapiens
  misc_feature 1..92: note = chr10:132317215-132317307
  misc_feature 1..92: note = hypo
  source 1..92: mol_type = genomic DNA
gagcaggcaagatggcgctggtcaaagtaaggagcaggcaagatggcgctggtcaaagtaaggagcaggcaagatggcgctggtcaaagtaa

SEQ ID NO: 70716 - DNA, 247 bp, Homo sapiens
  misc_feature 1..247: note = chr10:132365670-132365917
  misc_feature 1..247: note = hypo
  source 1..247: mol_type = genomic DNA
cccttgaggtggatgcggtgaggcgcgaacggagcgggtagaaatgagacggcgcaatggcggaaagcaaagcagaaatggcgtgacagccacatgtgcggggccggggaagtggaggctggctgctcctcacgggcactcgggtgaggctctctccacctcgcgcaggggctacccgctcgccgtgctgagcccttccagctctgccacgcgcaggaagccggtgcggtgacggcagcgcacgctc

SEQ ID NO: 70717 - DNA, 30 bp, Homo sapiens
  misc_feature 1..30: note = chr10:132447397-132447427
  misc_feature 1..30: note = hypo
  source 1..30: mol_type = genomic DNA
accatgtagctgacacgttgtcagcagcag

SEQ ID NO: 70718 - DNA, 174 bp, Homo sapiens; identical to SEQ ID NO: 42719
  misc_feature 1..174: note = chr10:132525800-132525974
  misc_feature 1..174: note = hypo
  source 1..174: mol_type = genomic DNA

SEQ ID NO: 70719 - DNA, 165 bp, Homo sapiens; identical to SEQ ID NO: 42720
  misc_feature 1..165: note = chr10:132586486-132586651
  misc_feature 1..165: note = hypo
  source 1..165: mol_type = genomic DNA

SEQ ID NO: 70720 - DNA, 30 bp, Homo sapiens
  misc_feature 1..30: note = chr10:132600977-132601007
  misc_feature 1..30: note = hypo
  source 1..30: mol_type = genomic DNA
gggcttcggaacagtcgactttgctccctt

SEQ ID NO: 70721 - DNA, 194 bp, Homo sapiens
  misc_feature 1..194: note = chr10:132609120-132609314
  misc_feature 1..194: note = hypo
  source 1..194: mol_type = genomic DNA
cccatcctgcgtgagcgcatcctggagtggggggtccttttgctgcttttcctgcgtggcgactgtttcatgactccgattatgacaggggagctggctctgagtgagcacagggcgtctgcggtgtgcatggaggtgacacctgcagagacaagctccccagcacccccacccgccaacgcccagctctctta

SEQ ID NO: 70722 - DNA, 30 bp, Homo sapiens
  misc_feature 1..30: note = chr10:13276800-13276830
  misc_feature 1..30: note = hypo
  source 1..30: mol_type = genomic DNA
gggtcatgctgacagcgaccagagaacacc

SEQ ID NO: 70723 - DNA, 150 bp, Homo sapiens
  misc_feature 1..150: note = chr10:132768174-132768324
  misc_feature 1..150: note = hypo
  source 1..150: mol_type = genomic DNA
gagggtccggtgctgcggggaaggaaagtgctcctcatggtatttgggggtggctgcacgaccatgtgcatttgtccaaactcacagaacctacccttccaaagggggattcctactgtgtgtaaactagtccgccgtacacctgacttg

SEQ ID NO: 70724 - DNA, 194 bp, Homo sapiens
  misc_feature 1..194: note = chr10:132811723-132811917
  misc_feature 1..194: note = hypo
  source 1..194: mol_type = genomic DNA
gtcagactctacccacgtcgaggtttcttgcggctggttggtgtatggggctggctctaaccggccatcttccatgttgacctctggaatccatgcttcctccaccaggatgccattcatctagggtgccagcatcttctcaggtccaagatccggacagcgcagtccgcccacacggacgtcattcccagctc

SEQ ID NO: 70725 - DNA, 164 bp, Homo sapiens; identical to SEQ ID NO: 42723
  misc_feature 1..164: note = chr10:132818146-132818310
  misc_feature 1..164: note = hypo
  source 1..164: mol_type = genomic DNA

SEQ ID NO: 70726 - DNA, 124 bp, Homo sapiens
  misc_feature 1..124: note = chr10:132859296-132859420
  misc_feature 1..124: note = hypo
  source 1..124: mol_type = genomic DNA
cttgattaaaagtgccgctcagccagcactgccctaagtactcatcacctttcctagtgagcgtgttcagctcttcaagactgacaccagactctacttaaaaatggctcgctataaaatatca

SEQ ID NO: 70727 - DNA, 35 bp, Homo sapiens
  misc_feature 1..35: note = chr10:132871489-132871524
  misc_feature 1..35: note = hypo
  source 1..35: mol_type = genomic DNA
gtccctgtcctgggtcggctcgtgctgcctgaacc

SEQ ID NO: 70728 - DNA, 141 bp, Homo sapiens
  misc_feature 1..141: note = chr10:132873732-132873873
  misc_feature 1..141: note = hypo
  source 1..141: mol_type = genomic DNA
cagagtctgggtctccgtgcagccttaggcctccttgcgctgggcgcacccgggtccgggctccggagtctgggtctgcgtgaagccttaggtctccgtgcactgggcgcacccgggtccgggctccggagtcaggatctg

SEQ ID NO: 70729 - DNA, 155 bp, Homo sapiens
  misc_feature 1..155: note = chr10:132893493-132893648
  misc_feature 1..155: note = hypo
  source 1..155: mol_type = genomic DNA
gacggccaaccccaccgggcgtcaaccccaccgggcggccaaccccacctggctaggacccagtccccggtagctgctctcccgagaggcgggcagggctggggctaggggctgtccaggagtgttctggactgtcccgtcgccaccattcccac

SEQ ID NO: 70730 - DNA, 182 bp, Homo sapiens
  misc_feature 1..182: note = chr10:132976493-132976675
  misc_feature 1..182: note = hypo
  source 1..182: mol_type = genomic DNA
acaagacagtgacagcggtgaccctgccaggtgcttggaggggacttccctggaaacaaggaagccgactagcgcggggccctggacgtacttttgaaacaagacgaggcaggtttgtatctgaatgtctcttgttcctctcagctgagctgtgacaaatggggtaacgagtatctcatgcc

SEQ ID NO: 70731 - DNA, 191 bp, Homo sapiens; identical to SEQ ID NO: 42726
  misc_feature 1..191: note = chr10:132977044-132977235
  misc_feature 1..191: note = hypo
  source 1..191: mol_type = genomic DNA

SEQ ID NO: 70732 - DNA, 97 bp, Homo sapiens
  misc_feature 1..97: note = chr10:133058323-133058420
  misc_feature 1..97: note = hypo
  source 1..97: mol_type = genomic DNA
gtggctcagtggagtcgggtcgatttgcagggtccgaagtcaagcaaagcccaaacggccccagccgaatgtttccctcaaccggagccgggcttca

SEQ ID NO: 70733 - DNA, 23 bp, Homo sapiens
  misc_feature 1..23: note = chr10:133089975-133089998
  misc_feature 1..23: note = hypo
  source 1..23: mol_type = genomic DNA
accgcgcccggcctccataaaca

SEQ ID NO: 70734 - DNA, 137 bp, Homo sapiens; identical to SEQ ID NO: 33522
  misc_feature 1..137: note = chr10:133109124-133109261
  misc_feature 1..137: note = hyper
  source 1..137: mol_type = genomic DNA

SEQ ID NO: 70735 - DNA, 121 bp, Homo sapiens; identical to SEQ ID NO: 3684
  misc_feature 1..121: note = chr10:133110064-133110185
  misc_feature 1..121: note = hyper
  source 1..121: mol_type = genomic DNA

SEQ ID NO: 70736 - DNA, 322 bp, Homo sapiens; identical to SEQ ID NO: 33524
  misc_feature 1..322: note = chr10:133110553-133110875
  misc_feature 1..322: note = hyper
  source 1..322: mol_type = genomic DNA

SEQ ID NO: 70737 - DNA, 15 bp, Homo sapiens
  misc_feature 1..15: note = chr10:133110966-133110981
  misc_feature 1..15: note = hyper
  source 1..15: mol_type = genomic DNA
cgccagcctcctccc

SEQ ID NO: 70738 - DNA, 183 bp, Homo sapiens
  misc_feature 1..183: note = chr10:133117656-133117839
  misc_feature 1..183: note = hypo
  source 1..183: mol_type = genomic DNA
ccacagtgtgtgctgcggatgggagcttagagcacaaagaataagagtggaagaggtattccttcagcagacccagctatcgacaggcctcatcaggccagggtgaagccctccctctgtgtgtgcaggagtccccaagagcttggtttaacatttggtcatgatatgcgcagatgaagggcc

SEQ ID NO: 70739 - DNA, 43 bp, Homo sapiens
  misc_feature 1..43: note = chr10:133226414-133226457
  misc_feature 1..43: note = hypo
  source 1..43: mol_type = genomic DNA
gcaggagactttgtgcgtggctgctgtccgaagctgaagaagc

SEQ ID NO: 70740 - DNA, 17 bp, Homo sapiens
  misc_feature 1..17: note = chr10:13345114-13345131
  misc_feature 1..17: note = hypo
  source 1..17: mol_type = genomic DNA
tttttttttttgagacg

SEQ ID NO: 70741 - DNA, 30 bp, Homo sapiens
  misc_feature 1..30: note = chr10:133495425-133495455
  misc_feature 1..30: note = hypo
  source 1..30: mol_type = genomic DNA
ccagggctgcactcccgcagcgtgccctgg

SEQ ID NO: 70742 - DNA, 192 bp, Homo sapiens
  misc_feature 1..192: note = chr10:133516016-133516208
  misc_feature 1..192: note = hypo
  source 1..192: mol_type = genomic DNA
tgtctatggcagacacgacctgccttcccgggacagacccgccccgacggcaagggcttctcatgcctgaggctcccagctccccgtatccagtaccagggaacgcgaaggcaggctgttggggatggcagcaggaatcctgtagagccaggagtaggaggtgggatcagaacaaagcgtatgcatgagtgc

SEQ ID NO: 70743 - DNA, 279 bp, Homo sapiens
  misc_feature 1..279: note = chr10:133530719-133530998
  misc_feature 1..279: note = hypo
  source 1..279: mol_type = genomic DNA
gcaggggtgtggacacgcacatgtgctcaggatactggaataacactgactttctgcacggcagcccgcaccgccacccttcttcaggtgtgcctgggctgggcacggcagcccccaccgccgctcttcaggtgcacctgggctgggctttttatcatccagtgaactttagaatctgctgtcagtgtcattaaacatcatttgggattctgataggaatcgcattgattttataaattcatctgagaagagctgccatctttacgctgtgtcaatcaa

SEQ ID NO: 70744 - DNA, 194 bp, Homo sapiens
  misc_feature 1..194: note = chr10:133532602-133532796
  misc_feature 1..194: note = hypo
  source 1..194: mol_type = genomic DNA
gtgtatgttgggagccgctccctcgccgccttggtggggcacacactccctttgactccctggatccaagccccaggccacctctgcctgctcccaggggcttcgacccacacaatgccttgggtatcagctttatttctgggccccagcaatgctaattttctctaacatgacggtagcgtttaattttcatt

SEQ ID NO: 70745 - DNA, 222 bp, Homo sapiens
  misc_feature 1..222: note = chr10:13355033-13355255
  misc_feature 1..222: note = hypo
  source 1..222: mol_type = genomic DNA
taccccgtgggtatacggccttgtggtggggagaataacggtcctccccaaagatgttcacgccctaatccctggaatctgtggctgttaccttacctggcaaaagggattttccaaatgtgattaacgttaaggactttgatagggggatcaccccgtattatctgggtgagcccactgcaatcatgagtcctgaaaatggagaaacgtttcctggatgta

SEQ ID NO: 70746 - DNA, 51 bp, Homo sapiens
  misc_feature 1..51: note = chr10:133555035-133555086
  misc_feature 1..51: note = hypo
  source 1..51: mol_type = genomic DNA
accgccgcagagcctcgggtgctgatgggccacaggcgagggtggctccct

SEQ ID NO: 70747 - DNA, 30 bp, Homo sapiens
  misc_feature 1..30: note = chr10:133589829-133589859
  misc_feature 1..30: note = hypo
  source 1..30: mol_type = genomic DNA
gtcaactgtatgacccggataaaatgtatt

SEQ ID NO: 70748 - DNA, 30 bp, Homo sapiens
  misc_feature 1..30: note = chr10:133590138-133590168
  misc_feature 1..30: note = hypo
  source 1..30: mol_type = genomic DNA
gcccggtcaataacacggctgattgggtgc

SEQ ID NO: 70749 - DNA, 30 bp, Homo sapiens
  misc_feature 1..30: note = chr10:133603524-133603554
  misc_feature 1..30: note = hypo
  source 1..30: mol_type = genomic DNA
acggtgcaggaaggtcgccacctccttgct

SEQ ID NO: 70750 - DNA, 30 bp, Homo sapiens
  misc_feature 1..30: note = chr10:133645234-133645264
  misc_feature 1..30: note = hypo
  source 1..30: mol_type = genomic DNA
gggagtggtgggtgacgtccccagccccca

SEQ ID NO: 70751 - DNA, 157 bp, Homo sapiens
  misc_feature 1..157: note = chr10:133783240-133783397
  misc_feature 1..157: note = hypo
  source 1..157: mol_type = genomic DNA
tagagccctcctccccgctgagaggctgggaccagcccgaggaggagccgttttggcttcccgctctggctcttcaccaccgctgcggcgaacgctcttcagaacccacagcggcgcctgcctggtctctgtgttttctgcagggtgagtgagtata

SEQ ID NO: 70752 - DNA, 515 bp, Homo sapiens; identical to SEQ ID NO: 33525
  misc_feature 1..515: note = chr10:133794727-133795242
  misc_feature 1..515: note = hyper
  source 1..515: mol_type = genomic DNA

SEQ ID NO: 70753 - DNA, 572 bp, Homo sapiens; identical to SEQ ID NO: 10641
  misc_feature 1..572: note = chr10:133795312-133795884
  misc_feature 1..572: note = hyper
  source 1..572: mol_type = genomic DNA

SEQ ID NO: 70754 - DNA, 84 bp, Homo sapiens; identical to SEQ ID NO: 10642
  misc_feature 1..84: note = chr10:133795975-133796059
  misc_feature 1..84: note = hyper
  source 1..84: mol_type = genomic DNA

SEQ ID NO: 70755 - DNA, 408 bp, Homo sapiens
  misc_feature 1..408: note = chr10:133806718-133807126
  misc_feature 1..408: note = hypo
  source 1..408: mol_type = genomic DNA
tggctgagcagcatccgttgtatggatgtgccaccatttgtttactgttcacctgttggacatttgggatgttttcagttcttgccgctggcaaatcgagctgctgggaacgttcacattcatgtgccagcgtttgtatcgacatgttctttcatttcttgcaggtaaatgccatggagtgcagcggctgggtcgtatggggagggtgtgcttagctttttaaggagctgccatcgtgttctccaaagtgctcgcacatgttactttcccagcagcaggagagtgccagtggctgaacacccacgccaactgtggtttagccgggctttttaattgtagccattctaatgggtgtgtgctgccgtctcgtgattttaacttgcatttccctatcgtgacatcttttca

SEQ ID NO: 70756 - DNA, 34 bp, Homo sapiens
  misc_feature 1..34: note = chr10:133836708-133836742
  misc_feature 1..34: note = hyper
  source 1..34: mol_type = genomic DNA
tggacgcttggcttccgctcgctggctcgccgac

SEQ ID NO: 70757 - DNA, 474 bp, Homo sapiens; identical to SEQ ID NO: 33528
  misc_feature 1..474: note = chr10:133849661-133850135
  misc_feature 1..474: note = hyper
  source 1..474: mol_type = genomic DNA

SEQ ID NO: 70758 - DNA, 683 bp, Homo sapiens; identical to SEQ ID NO: 33529
  misc_feature 1..683: note = chr10:133850156-133850839
  misc_feature 1..683: note = hyper
  source 1..683: mol_type = genomic DNA

SEQ ID NO: 70759 - DNA, 32 bp, Homo sapiens
  misc_feature 1..32: note = chr10:133858093-133858125
  misc_feature 1..32: note = hypo
  source 1..32: mol_type = genomic DNA
aggctggggtcctggcgcgggctcttcctcag

SEQ ID NO: 70760 - DNA, 61 bp, Homo sapiens
  misc_feature 1..61: note = chr10:133910786-133910847
  misc_feature 1..61: note = hypo
  source 1..61: mol_type = genomic DNA
gtggtgcagccacaccgtgggtcactctgcggcgagaagggtgaaccgtgggccactccgc

SEQ ID NO: 70761 - DNA, 139 bp, Homo sapiens
  misc_feature 1..139: note = chr10:133913329-133913468
  misc_feature 1..139: note = hypo
  source 1..139: mol_type = genomic DNA
gcaccccaaacccctcgcactgccacgctgtccgtctgcagctcccgtgctcaccctggtgatggtggtcttgagcagagtccacagtgtctggagggctcgtctgcatctgagattcacgctgcgttgctgtgattcc

SEQ ID NO: 70762 - DNA, 277 bp, Homo sapiens
  misc_feature 1..277: note = chr10:133913780-133914057
  misc_feature 1..277: note = hypo
  source 1..277: mol_type = genomic DNA
gtgcagagtgtgccacgtggggccgagcccttggcatgagccggctggacctcccgcatggctgaagcccatgccacacccaaggtgggggtgtctgggccaccaccagctgagatctcccactcccgcagcctttgggtctctctccagtcgccccgtctgcctcccaggagggtgtcaggaaggccacgagaagacgtattgaccagaacagcctcacacacccttgagactggatgattctctgcaccctggttccttacgagggttggggggt

SEQ ID NO: 70763 - DNA, 30 bp, Homo sapiens; identical to SEQ ID NO: 42732
  misc_feature 1..30: note = chr10:133921177-133921207
  misc_feature 1..30: note = hypo
  source 1..30: mol_type = genomic DNA

SEQ ID NO: 70764 - DNA, 32 bp, Homo sapiens
  misc_feature 1..32: note = chr10:133935358-133935390
  misc_feature 1..32: note = hypo
  source 1..32: mol_type = genomic DNA
caccctgaggacagtcgcgtctggcagggctg

SEQ ID NO: 70765 - DNA, 49 bp, Homo sapiens
  misc_feature 1..49: note = chr10:133935785-133935834
  misc_feature 1..49: note = hypo
  source 1..49: mol_type = genomic DNA
gccctgactgccccccggtcggctccccggctgtcggggccctgactgc

SEQ ID NO: 70766 - DNA, 128 bp, Homo sapiens
  misc_feature 1..128: note = chr10:133947267-133947395
  misc_feature 1..128: note = hypo
  source 1..128: mol_type = genomic DNA
gccctgtcaccctcccgtgggccccggcctcatcacccttctgctgcagttcatggcacttgctggcccggagtccggccctgggttggtgggaggaggctgtgctgggtatgcgctgccaccatctc

SEQ ID NO: 70767 - DNA, 307 bp, Homo sapiens
  misc_feature 1..307: note = chr10:133949128-133949435
  misc_feature 1..307: note = hypo
  source 1..307: mol_type = genomic DNA
catctgtcaatgggacgggactcacccccggggacgccgagcccagccctgagcttgggttcactagggcaccgggcgagcgggttcacctgggcactggacgagcaggttcaccagtgctctgggcaagtgggttcacccgggcgctgggccagtgggcaccacttggaggcgtggacttcccaagtagagggctggggactgcgttgttgcagcccaagctgtggtcagtcagccgactctgcgtggagacctgctggttctccgtcacttaaagaacaatcacatagtgcgttgtctttcagtt

SEQ ID NO: 70768 - DNA, 68 bp, Homo sapiens
  misc_feature 1..68: note = chr10:133949784-133949852
  misc_feature 1..68: note = hypo
  source 1..68: mol_type = genomic DNA
accttgcaaaggatgcggctgtggggcgtcccctccccaggcctgtttgcccacgtctcactcaaggg

SEQ ID NO: 70769 - DNA, 556 bp, Homo sapiens; identical to SEQ ID NO: 42735
  misc_feature 1..556: note = chr10:133951469-133952025
  misc_feature 1..556: note = hypo
  source 1..556: mol_type = genomic DNA

SEQ ID NO: 70770 - DNA, 144 bp, Homo sapiens
  misc_feature 1..144: note = chr10:133952229-133952373
  misc_feature 1..144: note = hypo
  source 1..144: mol_type = genomic DNA
tgcctgtgtagggtccgagtccccacgacctgtgggatgcacggctctgaggacgggcggctgaggctgctcacactcacccatcctggctgtgccacacaccccacgctcgcctgtcctgccgttcaccgtcctcggccacac

SEQ ID NO: 70771 - DNA, 85 bp, Homo sapiens
  misc_feature 1..85: note = chr10:133955427-133955512
  misc_feature 1..85: note = hypo
  source 1..85: mol_type = genomic DNA
tggccaaggaggagacggagctgaggttccggcagctgaccatggagtaccaggccctgcagcgtgcctacgctttgttgcagga

SEQ ID NO: 70772 - DNA, 228 bp, Homo sapiens
  misc_feature 1..228: note = chr10:133962619-133962847
  misc_feature 1..228: note = hypo
  source 1..228: mol_type = genomic DNA
actgagggatgtgcccgtgggctcagggtgggactgcccaggccacgtggccagagtgtgatgaactctgcccggcacatctggggtcagcgaatatacaggggcagtccttgtgggcaggtccaggtccagtgcagattctgccaccactgctgccgctgcggtttggttttcataaatgctgtgttgatccctggttccatggtcttggcccgtgttcctcaggcc

SEQ ID NO: 70773 - DNA, 65 bp, Homo sapiens
  misc_feature 1..65: note = chr10:133979162-133979227
  misc_feature 1..65: note = hypo
  source 1..65: mol_type = genomic DNA
attgccaggagagaccgggtccctctggacagcagtcgccttagacgggccgtgtgtcatcccac

SEQ ID NO: 70774 - DNA, 152 bp, Homo sapiens
  misc_feature 1..152: note = chr10:133982809-133982961
  misc_feature 1..152: note = hypo
  source 1..152: mol_type = genomic DNA
gcaggaggaggcttgcgggaaaagggagaaaccccgtaggtgcaatgaggccgctctccgagtgcgcctccctccgctgctcccgtgcacttgaacgtggacgccgccccacactcggccccggcacctgaggtgtccgctctggggaggcg

SEQ ID NO: 70775 - DNA, 201 bp, Homo sapiens
  misc_feature 1..201: note = chr10:133984033-133984234
  misc_feature 1..201: note = hypo
  source 1..201: mol_type = genomic DNA
ccccacagctgccctcggtgacatctgggacttggacatccatggacggcatccctggatggagccatttcctgggtactggacctggaggtgactcggagcttctcctgctcccagcgtgtgtccatgggggcggtcagggtagacaggccacaccgtcatcagggaggggcagccggccgccaacgtgcagactgtgtc

SEQ ID NO: 70776 - DNA, 277 bp, Homo sapiens
  misc_feature 1..277: note = chr10:133999776-134000053
  misc_feature 1..277: note = hyper
  source 1..277: mol_type = genomic DNA
cgaggtcccgcccaccaccgcgtcccggtccctggggagcgcgtgcgcctccttctgtctctctctctctctctctctgtcctattcgggcccctcctgccctccgtctctcgcggccagcgtggaacagcctcgcggggtcacagcctggcgctcggaccctggcccgggtcatctgcgaaggagccggctttggccaaggtgccttcctggacgggtgtggttcccagagcgtcgcggcccggggttgactggctcggaatcccggggccttggg

SEQ ID NO: 70777 - DNA, 16 bp, Homo sapiens
  misc_feature 1..16: note = chr10:134000108-134000124
  misc_feature 1..16: note = hyper
  source 1..16: mol_type = genomic DNA
cggggcctggcaggac

SEQ ID NO: 70778 - DNA, 301 bp, Homo sapiens
  misc_feature 1..301: note = chr10:134000125-134000426
  misc_feature 1..301: note = hyper
  source 1..301: mol_type = genomic DNA
tggccggactctctccctcgcctccccggggtgcaaaccccgcgcacatcagctggagcaggttgaaatccccacccagcgctcgtccgcgggtctgcgcgggggcccggggtgcagagatcagaccctgcagcggttccagcgctgggggggctttaaagcgaaggagtggctgagggcgggggcggggctgatgggcggggtgaggcggggctcgggctggggcgggccctatcgggggcggggcctgccgggggcggagccggggtgggggcggggcccagcgggggcgggaccggaa

SEQ ID NO: 70779 - DNA, 211 bp, Homo sapiens; identical to SEQ ID NO: 33533
  misc_feature 1..211: note = chr10:134000529-134000740
  misc_feature 1..211: note = hyper
  source 1..211: mol_type = genomic DNA

SEQ ID NO: 70780 - DNA, 150 bp, Homo sapiens
  misc_feature 1..150: note = chr10:134000798-134000948
  misc_feature 1..150: note = hyper
  source 1..150: mol_type = genomic DNA
cgcagacccccttaaggagcggggcgcccaggcccggcccggcccggccctgcccggccctgccgggccctgccgggccctgcccggccttgcccggccttgccggcttccgggagcctcggctgcgcccggggagaacccggggccggg

SEQ ID NO: 70781 - DNA, 286 bp, Homo sapiens; identical to SEQ ID NO: 33535
  misc_feature 1..286: note = chr10:134001139-134001425
  misc_feature 1..286: note = hyper
  source 1..286: mol_type = genomic DNA

SEQ ID NO: 70782 - DNA, 168 bp, Homo sapiens
  misc_feature 1..168: note = chr10:134010456-134010624
  misc_feature 1..168: note = hypo
  source 1..168: mol_type = genomic DNA
aggtatatcccaggccgctgctggtgcaggcgcagccccacccaggacgccaccacttctcttcccagatgtacgagatcttcagcatcatccgggacctgggggccttggcccaggtgcacgctgagaacggggacatcgtggaggaggtgccgtggggcagggctg

SEQ ID NO: 70783 - DNA, 354 bp, Homo sapiens
  misc_feature 1..354: note = chr10:134012163-134012517
  misc_feature 1..354: note = hypo
  source 1..354: mol_type = genomic DNA
cctacagcctgtacccgaggcccagaaggtggcgtgggcaggcccaggcactgagcccgaggctgggccgctcctactaggctgccctgagcctgggatcccatgggtgacacctgggcatccccattgcccacactggtctggagccccagggccctcgtgtggcctcatccctctcatctcgtccccaggtggaggctgaggcggtgtaccgagctgtcaccatcgccaagcaggcaaactgcccgctgtacgtcaccaaggtgatgagcaagggggcggccgacgccatcgctcaggccaagcgcagaggtgagcacccagccccgcctctgatgccgaggggccatggtc

SEQ ID NO: 70784 - DNA, 342 bp, Homo sapiens
  misc_feature 1..342: note = chr10:134014286-134014628
  misc_feature 1..342: note = hypo
  source 1..342: mol_type = genomic DNA
tgacctggcctctgccggctcaggaaggccaggaccctctgaccctggcttgtttccagcggggacctccaggtgacaggcagcgcccactgcaccttcaccactgcccagaaggctgtgggcaaggacaacttcgcgctgatccccgagggcaccaacggcattgaggagcgcatgtcgatggtctgggagaaatgtgtggtgagcacaggcctggccggggcacgccgtctggggagcggctgtgggcgggattgtgatggctggtcagaagggagcccatctaaccagtgcacactcgtgaaacagatcagagcacacgggctccggggtggcggattc

SEQ ID NO: 70785 - DNA, 341 bp, Homo sapiens
  misc_feature 1..341: note = chr10:134016098-134016439
  misc_feature 1..341: note = hypo
  source 1..341: mol_type = genomic DNA
actgttgggccccagcgtggaggcactggaccctcgggcctctctccccagaacgtggagtacaacatcttcgagggagtggagtgccggggagcgcctgccgtggtcataagtcagggccgagtggcgctggaggacgggaagatgtttgtcaccccgggggcgggccgcttcgtccctcggaaaacattcccggactttgtctacaagaggatcaaagctcgcaacagggtagggcggcacccgcaagggtgttgtgcaggtaggcaggtgggcgctgagttctaggcccagaacgcacccctggtcaacctggcccggcctcccgaggggtcaggaag

SEQ ID NO: 70786 - DNA, 152 bp, Homo sapiens
  misc_feature 1..152: note = chr10:134016763-134016915
  misc_feature 1..152: note = hypo
  source 1..152: mol_type = genomic DNA
tcaggagctcagccacgggagccccccccccatggccttccagtctcttactgtggtgacgccacgcttgcccggcatcatccgtgtctgacggtgcagcaggtgtggtctccccagaccaccaggtgcttcacacacgcacaggggcactc

SEQ ID NO: 70787 - DNA, 48 bp, Homo sapiens
  misc_feature 1..48: note = chr10:134018023-134018071
  misc_feature 1..48: note = hypo
  source 1..48: mol_type = genomic DNA
cagcctttcatcacccggaacccagagcagggacgaggcaggactggc

SEQ ID NO: 70788 - DNA, 30 bp, Homo sapiens; identical to SEQ ID NO: 42745
  misc_feature 1..30: note = chr10:134019334-134019364
  misc_feature 1..30: note = hypo
  source 1..30: mol_type = genomic DNA

SEQ ID NO: 70789 - DNA, 328 bp, Homo sapiens
  misc_feature 1..328: note = chr10:134022624-134022952
  misc_feature 1..328: note = hypo
  source 1..328: mol_type = genomic DNA
cgtgagcgtgggggacgctgtccaggttccgcccatgtcccctcaagtgagtgtctgggcatccccatcgggcctccacctgtggctttggatgacggcctctgggctattgaagtgccccggccctccagcagccagactgcccgggagctcgcatctctgcgggtgactcacccaagcccgaggatgccaaggcccagctcccttgcctctgggtggatggcttggacttgctccgtggggcctgcaggaccaggcagaagctgttctctgcgggactttgctggaaaccactcccttgccgggcctttcccgtctcataccgggt

SEQ ID NO: 70790 - DNA, 257 bp, Homo sapiens
  misc_feature 1..257: note = chr10:134040240-134040497
  misc_feature 1..257: note = hypo
  source 1..257: mol_type = genomic DNA
aggctgcttcagccccgcccacctcagcaggtacctgcgccgtctgccacgcacacacctgtggatgatgtgctggccgcgcaggtagtccagagccagtgccatctcgcagatgtacagcctcaccgtgtcctcggagaactgcacgttctgctgcaggtggtagcgcaggtccccgcccagtagcaggtccacgaccatgaacatgtcctcctcgtcctggaaggagtacctgtgggcaccgatggaaggcctgt

SEQ ID NO: 70791 - DNA, 29 bp, Homo sapiens
  misc_feature 1..29: note = chr10:13404822-13404851
  misc_feature 1..29: note = hypo
  source 1..29: mol_type = genomic DNA
gaaaagatctcaaaccggccgggcgcggt

SEQ ID NO: 70792 - DNA, 149 bp, Homo sapiens
  misc_feature 1..149: note = chr10:13405091-13405240
  misc_feature 1..149: note = hypo
  source 1..149: mol_type = genomic DNA
cctaggcaacgaagcaagtctccgtctcaaaaaacaaaaaacaaaaagatctcacaccactgcgcggtggcagaacggaggcaggagacaggacttgaactcagtctagacagcaacgcaagggggcatctatgcgattgaccatggcc

SEQ ID NO: 70793 - DNA, 41 bp, Homo sapiens
  misc_feature 1..41: note = chr10:134058780-134058821
  misc_feature 1..41: note = hypo
  source 1..41: mol_type = genomic DNA
tccacaacagagctgcgcgcagaagccggagggctaattcc

SEQ ID NO: 70794 - DNA, 63 bp, Homo sapiens
  misc_feature 1..63: note = chr10:134063725-134063788
  misc_feature 1..63: note = hypo
  source 1..63: mol_type = genomic DNA
tgtgtgtgaggcgcccgggacaggtcactgcagagaggagccccaccccgagggcaggtgtgt

SEQ ID NO: 70795 - DNA, 30 bp, Homo sapiens
  misc_feature 1..30: note = chr10:134064125-134064155
  misc_feature 1..30: note = hypo
  source 1..30: mol_type = genomic DNA
tgggtgtgaggtgcccgggacaggtcactg

SEQ ID NO: 70796 - DNA, 42 bp, Homo sapiens
  misc_feature 1..42: note = chr10:134066350-134066392
  misc_feature 1..42: note = hypo
  source 1..42: mol_type = genomic DNA
tcccgctaagtgacccgagcgtggggccgcctcctcccaggt

SEQ ID NO: 70797 - DNA, 849 bp, Homo sapiens
  misc_feature 1..849: note = chr10:134093628-134094477
  misc_feature 1..849: note = hypo
  source 1..849: mol_type = genomic DNA
tccactctgtgatcacgcccctgcactctgtgatcacgcccctgcactccgtgaccacgccacctgcgctccatgaccatgtccctgcactctgtgatcacgctgaggcctccacaccgtgaccacgcccctgcaccccgtgaccacgcccctgcaccccgtgaccacgcccctgcactccatgatcatgccactgcactccctgactatgctgaggcctccactccgtgaccatgcccctgcactccgtgatcacgacactccaccccgtgatcacgcacctccaccccctgatcacaccactgcactccgtgatcacgccactgcaccccatgatcacgcccctgcactccgtgatcatgccacctgtgctccatgaccatgtccctgcactccgtgatcacgctgaggcctccacaccgtgaccacgcccctgcaccccgtgaccacgcccctgcaccctgtgatcacgccactccactctgtgaccacgcccctgcactccgtgatcacgacactccactccatgatcaccacactccactccgtgatcacgcacctccactccgtgatcatgaacctccactccctgatcacacccctgcactcggtgatcacacccttgcattccatgatcactgaggcctccactctgtgatcacgccactgcaccccgtgatcacaccacctgcgctccatgaccatgtccctgcactccgtgatcacactgaggcctccatgccgtgaccacgcccctgcactccgtgaccacgcccctgcatcctgtgaccatgcccctgcactccatgatcacgccactgcactccctgactacgctgaggcctccat

SEQ ID NO: 70798 - DNA, 385 bp, Homo sapiens
  misc_feature 1..385: note = chr10:134095563-134095948
  misc_feature 1..385: note = hypo
  source 1..385: mol_type = genomic DNA
aggcagcagcccagccgctccgggggtgggggcgacaggtgctgggcggggaggcgctacattgtgtaacactcagcagccacgctacacttgggaagagcggatgtgctgaaaatgcccagtgcaggaccaaggtgcgccaaccagcccgcaccacgcccgagaggcttcgcagccgcccaccccggctctcacagcgcccatccctgccacacgccctgccagctgcgccagcttccccaggccgtccagagtcgctgctggaactggaataaagtcctctctgagacagctcctgggtggtttcctgcagttttctggtggctgatgaagagggcagtgccaggcgtcagctacccacctgtgcctgcgcccacctgtacct

SEQ ID NO: 70799 - DNA, 17 bp, Homo sapiens
  misc_feature 1..17: note = chr10:134099613-134099630
  misc_feature 1..17: note = hypo
  source 1..17: mol_type = genomic DNA
agcgagactctgtctca

SEQ ID NO: 70800 - DNA, 30 bp, Homo sapiens; identical to SEQ ID NO: 42751
  misc_feature 1..30: note = chr10:134118399-134118429
  misc_feature 1..30: note = hypo
  source 1..30: mol_type = genomic DNA

SEQ ID NO: 70801 - DNA, 132 bp, Homo sapiens
  misc_feature 1..132: note = chr10:134119982-134120114
  misc_feature 1..132: note = hypo
  source 1..132: mol_type = genomic DNA
cacaccatgaatccccggtgccgtctcccggaggaacggcggtgcacggccccacactcaccaacgccggcctgaggtcgtattactgtaatttcccataatgcttaaattatttatcgcaagtaaatagcc

SEQ ID NO: 70802 - DNA, 308 bp, Homo sapiens
  misc_feature 1..308: note = chr10:134120706-134121014
  misc_feature 1..308: note = hyper
  source 1..308: mol_type = genomic DNA
actgcaaagtacaaacgagcccgcacgtgggcccgagcggatcacggaaagcggaaagcagggctgccacgggcggtgggcggaggcgcgcgcaagcccggagacgccacagccgcgggggaccctcgccccgagggcccgggcccagcctgctcctcctgcggcgccgccactagaaacggaggacgcgggcgggcgcccagaactcgcgtggggccgcagccacccggcgcgagcttctccggaagccggggcgccccgggaagccgtcccggacaccgggggaacccctgcgggaaaaagccgcc

SEQ ID NO: 70803 - DNA, 658 bp, Homo sapiens
  misc_feature 1..658: note = chr10:134121693-134122351
  misc_feature 1..658: note = hyper
  source 1..658: mol_type = genomic DNA
atgggggctgtggttcgccgggacacggggaccacggctcagactagacggcgggtacgagagcgagggaggcagggagcgtccccacgggtatcctggggccccggaggtcggcgtccctggcacggggactgctgtgcccggcacggcggcgggaccttctcgcggtctccgggggcctccctcccctgccttcttcgtgaaaacagccggcgcgcgggcttccgccgcccagtgcggggagccctaaactccagccttctgctttgcgcagggtgaggccgggctgcaggcccgggatgcgggcggcgggaatctgccgggcagagcccggctcacggtcaggaggcggcaggctgagtccaagcgctgcgccagagggtggggtggggcagggcgggcctggctgcgcgcgcgcacacgcgggcgcctggggtgggcgctaagccctgagcacgtgcgcccgcgctctcgggcacccccgtgccatcctcgcgacccccgtccggcctgagaccgcgtgcccgagtcgcccagggtccccttgtccagatgcgacaggggcctcggcactcggcgtatttcggaggcctggggcgcggcttgacctccgggcacctctgcccctgcgcagggccaggcgcgaccttgcgcggaa

SEQ ID NO: 70804 - DNA, 230 bp, Homo sapiens; identical to SEQ ID NO: 42752
  misc_feature 1..230: note = chr10:134123040-134123270
  misc_feature 1..230: note = hypo
  source 1..230: mol_type = genomic DNA

SEQ ID NO: 70805 - DNA, 30 bp, Homo sapiens
  misc_feature 1..30: note = chr10:134126884-134126914
  misc_feature 1..30: note = hypo
  source 1..30: mol_type = genomic DNA
tccacacgggccacacgacagacatttgcc

SEQ ID NO: 70806 - DNA, 37 bp, Homo sapiens
  misc_feature 1..37: note = chr10:134209613-134209650
  misc_feature 1..37: note = hyper
  source 1..37: mol_type = genomic DNA
cccgcctccaggcctcgtcaggcgctgcaagtccggc

SEQ ID NO: 70807 - DNA, 30 bp, Homo sapiens
  misc_feature 1..30: note = chr10:134232907-134232937
  misc_feature 1..30: note = hypo
  source 1..30: mol_type = genomic DNA
gggaggagcacctggcggggagccttgggg

SEQ ID NO: 70808 - DNA, 24 bp, Homo sapiens
  misc_feature 1..24: note = chr10:13426145-13426169
  misc_feature 1..24: note = hypo
  source 1..24: mol_type = genomic DNA
cgcgcccagcggagtatggtagac

SEQ ID NO: 70809 - DNA, 237 bp, Homo sapiens
  misc_feature 1..237: note = chr10:134272641-134272878
  misc_feature 1..237: note = hypo
  source 1..237: mol_type = genomic DNA
ccagggcagggcagccgctttgcacacagtctgggagtctggccctccctgttcctggaagagcctgggctgtgaacttttaaactgggcaaggtgtgactggagggtgtgccgcagtgggagaggacacagggcagggtgtgactggagggtgtgccgcagtgagcgaggacacaggggtctcccattgatctcggcccccggcatggctccccgcaccaccgcagaccggccgtg

SEQ ID NO: 70810 - DNA, 30 bp, Homo sapiens
  misc_feature 1..30: note = chr10:134281135-134281165
  misc_feature 1..30: note = hypo
  source 1..30: mol_type = genomic DNA
aagccagcctctgcccgggccgaggctgcc

SEQ ID NO: 70811 - DNA, 145 bp, Homo sapiens
  misc_feature 1..145: note = chr10:134292484-134292629
  misc_feature 1..145: note = hypo
  source 1..145: mol_type = genomic DNA
gtgtcagcagggccacgctccctccgaagcctctgtccctcaggggggacccttccttgactctgccggctcccggtggctcctggcgttcctgggcgtgtgcctgcatcaccccagccatgccttctcacggactcctctctgt

SEQ ID NO: 70812 - DNA, 299 bp, Homo sapiens; identical to SEQ ID NO: 42755
  misc_feature 1..299: note = chr10:134301017-134301316
  misc_feature 1..299: note = hypo
  source 1..299: mol_type = genomic DNA

SEQ ID NO: 70813 - DNA, 30 bp, Homo sapiens
  misc_feature 1..30: note = chr10:134316646-134316676
  misc_feature 1..30: note = hypo
  source 1..30: mol_type = genomic DNA
aagggtcactgtgcacgagggcgtccgggg

SEQ ID NO: 70814 - DNA, 37 bp, Homo sapiens
  misc_feature 1..37: note = chr10:134341480-134341517
  misc_feature 1..37: note = hypo
  source 1..37: mol_type = genomic DNA
acaacagtgaccccccgccccccggggccatgggaag

SEQ ID NO: 70815 - DNA, 371 bp, Homo sapiens; identical to SEQ ID NO: 42758
  misc_feature 1..371: note = chr10:134481125-134481496
  misc_feature 1..371: note = hypo
  source 1..371: mol_type = genomic DNA

SEQ ID NO: 70816 - DNA, 36 bp, Homo sapiens
  misc_feature 1..36: note = chr10:134489067-134489103
  misc_feature 1..36: note = hypo
  source 1..36: mol_type = genomic DNA
ttccaggggccttgccgtgcccgggagagtgagggt

SEQ ID NO: 70817 - DNA, 205 bp, Homo sapiens
  misc_feature 1..205: note = chr10:134499328-134499533
  misc_feature 1..205: note = hypo
  source 1..205: mol_type = genomic DNA
tttgcaaagtgggcccgctatcagaattcagctcccgaaatcaagctaagtgacacggtgtggccatttatcacattaccggactccaattgaagttgagaggttgttttaatagcatttgtaaatactccatcttcactagccgcccctgtgagaggcactgagcccccatggtacgcagggttcgttgcgccctggtcgccag

SEQ ID NO: 70818 - DNA, 30 bp, Homo sapiens
  misc_feature 1..30: note = chr10:134516665-134516695
  misc_feature 1..30: note = hypo
  source 1..30: mol_type = genomic DNA
gacacctgtcccggtcgcttggtgattgca

SEQ ID NO: 70819 - DNA, 167 bp, Homo sapiens; identical to SEQ ID NO: 42760
  misc_feature 1..167: note = chr10:134518611-134518778
  misc_feature 1..167: note = hypo
  source 1..167: mol_type = genomic DNA

SEQ ID NO: 70820 - DNA, 60 bp, Homo sapiens; identical to SEQ ID NO: 42761
  misc_feature 1..60: note = chr10:134542152-134542212
  misc_feature 1..60: note = hypo
  source 1..60: mol_type = genomic DNA

SEQ ID NO: 70821 - DNA, 127 bp, Homo sapiens
  misc_feature 1..127: note = chr10:134557418-134557545
  misc_feature 1..127: note = hypo
  source 1..127: mol_type = genomic DNA
cagaccatggctgagcgtgtggtcccgaattccatccttggaacagaggaagtttttgttatgagaaagaactccagccacagcggatttgcacctgcaggtctgtgtcttgcgacacttaagggcc

SEQ ID NO: 70822 - DNA, 64 bp, Homo sapiens
  misc_feature 1..64: note = chr10:134562719-134562783
  misc_feature 1..64: note = hypo
  source 1..64: mol_type = genomic DNA
cgagcctgctggtgtcgcactggcttttgccccaaagcagctctgtgggcggcagcagctccgg

SEQ ID NO: 70823 - DNA, 30 bp, Homo sapiens
  misc_feature 1..30: note = chr10:134565567-134565597
  misc_feature 1..30: note = hypo
  source 1..30: mol_type = genomic DNA
gcgtctgggtggaggcgggtgcccaggagg

SEQ ID NO: 70824 - DNA, 196 bp, Homo sapiens
  misc_feature 1..196: note = chr10:134566161-134566357
  misc_feature 1..196: note = hypo
  source 1..196: mol_type = genomic DNA
tggaggggcacggggcgtggagggggtgcggcatggagggggtgcggcgtggaggcggtgcggcatggaggggtgtgtctagagcatctgggagcaattgtctttcatgtggatccaaagtcctccttttctctcagcattttgacacagagcacgcccctgctgtcggtagccaccataccgtacagtgtttcct

SEQ ID NO: 70825 - DNA, 142 bp, Homo sapiens
  misc_feature 1..142: note = chr10:134581976-134582118
  misc_feature 1..142: note = hypo
  source 1..142: mol_type = genomic DNA
ggtgagatcagcttccgctttcccgctgcgtctgccctggcggggggtcccgagtgcctctgcgtgccaggctcgtccacctgccgcctcacactcttccccgtgcagctctgcccctgtcaggacacgttggccttcctgt

SEQ ID NO: 70826 - DNA, 30 bp, Homo sapiens
  misc_feature 1..30: note = chr10:134589397-134589427
  misc_feature 1..30: note = hypo
  source 1..30: mol_type = genomic DNA
gagggagaactggttcggttccagcttcct

SEQ ID NO: 70827 - skipped

SEQ ID NO: 70828 - DNA, 167 bp, Homo sapiens
  misc_feature 1..167: note = chr10:134598367-134598534
  misc_feature 1..167: note = hyper
  source 1..167: mol_type = genomic DNA
ggggccgcccccggattctgcaaaaatagattcgcccccaccccgcgggtcctcacaaggcgtcccccgcgccgccgccgcacgggctgaccagcgccaagttcgagggtttgtgcttcttgagcagccgcgtgatcttctcgtcgtccgagttggggtccaggggc

SEQ ID NO: 70829 - DNA, 115 bp, Homo sapiens; identical to SEQ ID NO: 33540
  misc_feature 1..115: note = chr10:134599431-134599546
  misc_feature 1..115: note = hyper
  source 1..115: mol_type = genomic DNA

SEQ ID NO: 70830 - DNA, 309 bp, Homo sapiens
  misc_feature 1..309: note = chr10:134599708-134600017
  misc_feature 1..309: note = hyper
  source 1..309: mol_type = genomic DNA
gctgattggctgcggaccccgcggtccggccattggccggcgccccccccccgcccgcgcgcccccgccggccgcgcactccatgaagggcccattagcgcggcaggtgcctcccgggctgtaaattcgccccgatttatctccccggggacgaaataaatccagcttggatgggagtgtagttaggcaaaggttttcatgcgaaatcaggaaaaaatacgagaacgtattttattaacggaaagaatgcagatttgaggacccgcccgcgcgctcggagcgccccactcggggaagagtcccggcccg

SEQ ID NO: 70831 - DNA, 936 bp, Homo sapiens
  misc_feature 1..936: note = chr10:134600037-134600973
  misc_feature 1..936: note = hyper
  source 1..936: mol_type = genomic DNA
cgccgcccgtggctggggtgggtgtgagcggcagcggacgccggcggggaacgcgctccgggcaggtcggggccacaggagggcggaggacgcgggcctcgagtccacggaatccacgggcctcacggccgggcgaggctcgcacggagctgcctctggtttcgccgacacgcggccggcgcggtggaggagtgaggcaggcgggagcggggcggggaggcgggtcccgggaccacacgcgcggctcggcacttccccgtcatcggcctccaggtctcccgctgggggtcccccaggatgtgacctgggcccacgacttcgcccacgggccgcctctcgcgaatccccggccgggagaacagagaccaggacggcctcagcgcggaagccctgtccagggcccgaacgtgggtgcgggctgggggcgcagcggcagaaacgcggccttagacgcgcgcggggggccggtgtcccccccgcccccacggcaccgggagccgctcgctcatccatcccgcagaccgggcggtgagatgactccgagccccgcgcacggcggccgcgagcaaacgctccgacgtctgtggtgacgtctcgtattgatttagggacacggggcggctgtggctgtggcccacggctcgtggggagcccgagtctgtgcgcagggaacgccgctgcgtggcctctctcgggcctgtgccgcggaggaaggcggcgcccggggttcggggccggggtctcacgtccgccccctcgcccccctccagcgtccgttttcgttttgtgcaggtcgaggcggggacttggcgccgtcggccgctcctggatggcggcttggaaaagccacctgcggccaaactccggggcagtggtgcggccgccgggtgtgtgcgcgctcggggctgccccggcggcttccggctccactgaggt

SEQ ID NO: 70832 - DNA, 512 bp, Homo sapiens
  misc_feature 1..512: note = chr10:134601204-134601716
  misc_feature 1..512: note = hyper
  source 1..512: mol_type = genomic DNA
cccagcaccccaaggcgacggcgcccgcgcccaaggctcgggctctgagctgagacgcgggaactgcggggccggggggggcgggcagggggagttgggggcgggggctgctgtcgccctgggatcccccactctgcgcggccgggcagaccctgggcgggccgggaggggtgcgggtcgcccgaactgaggcccaggaggcgcgcgcgggcggaacggcgggaggaagccgcgctcgggacaggctctggctcttctcacagcctggaggggcggggcagggggcgtcgctagcgctgttttatggctgaggaaacatggacctggaggcgctgcgctgcggcccgataaaccctgggtctgtctgcgccccccggtcctccctgggctgccgagggaacgcgtggggtcgcgggtggggctggcgtgtcactggctgcggagcgcgcggctctccagggctcaggggcgcgggatgaggggccagggtgagttgggggcgcagaggagcc

SEQ ID NO: 70833 - DNA, 287 bp, Homo sapiens
  misc_feature 1..287: note = chr10:134602127-134602414
  misc_feature 1..287: note = hyper
  source 1..287: mol_type = genomic DNA
cggcgccgacgctccgcgctggaaaaccgagagcgcggggtttggcagaggccattcaagtttgttttactcgttcagcctgtatttgtggggctcctaccgcgcccgggctgtccggggggtgcaccgtgaacgcagcgggctccggcccgggcgcgggcgggtcagagcagcaaacgcgctcccccggcacccccgcggcgtctgcaggggagcgggcgacggggaggacggcgggggtgtcggcccggaaggagagccggcctaggccccggtgtccccgcgct

SEQ ID NO: 70834 - DNA, 364 bp, Homo sapiens
  misc_feature 1..364: note = chr10:134607832-134608196
  misc_feature 1..364: note = hypo
  source 1..364: mol_type = genomic DNA
agtggcctcggcagccgtgtctgcgtgacagaagccgagcgtgggacggctccagctcaggactgtctgagccccaccctgcgagggtgctctgagctctcagggcgttgcttctttgcccatttatcccgggtcttgggtgagttccagtggcggacagagctcagacaagagcagtgctcgcagcagcgccagcagggacagtggcaatacgagggtcacaggtgtgatcggaggccgccagcctgtgctgggtcaccgtgcggtgccagtgaaggtgccctctgcccaggagctgtgggggagccgggggtgccgccaggacgcagtgtgggtcgctgggaagacccgaaagaggggagga

SEQ ID NO: 70835 - DNA, 387 bp, Homo sapiens
  misc_feature 1..387: note = chr10:134610574-134610961
  misc_feature 1..387: note = hypo
  source 1..387: mol_type = genomic DNA
ccctcagcctcccaacgcccctgcgcccgttctcactggcacggctcagtgtccacaccgggccagcagcgcaggaactggaggctctgcttcgtgatttccgcagtggcagatgacaggaatcaggttcctgcgggtggcagcggatgggggtgcagaactgcctttttgctgtttgcctgtttaccctctttgtgcccgcgccaaggtgggagccgctacacccagggaggcgctggagcgtgtgcggaggtcagagcctgatgccgcctcggtctctgggtgccggggcagccattccttcaaacaatggggtgcttccaaaccggtgcctcgtgaggaattgggaaagacaggagattgtcatcatcacgagagacaaaaccc

SEQ ID NO: 70836 - DNA, 30 bp, Homo sapiens
  misc_feature 1..30: note = chr10:134611744-134611774
  misc_feature 1..30: note = hypo
  source 1..30: mol_type = genomic DNA
gatcctgaggtgggccgaggcggctgggct

SEQ ID NO: 70837 - DNA, 32 bp, Homo sapiens
  misc_feature 1..32: note = chr10:134613038-134613070
  misc_feature 1..32: note = hypo
  source 1..32: mol_type = genomic DNA
ctgagcccgggacaccgcgcctgagccaggga

SEQ ID NO: 70838 - DNA, 60 bp, Homo sapiens
  misc_feature 1..60: note = chr10:134621273-134621333
  misc_feature 1..60: note = hypo
  source 1..60: mol_type = genomic DNA
ccggccttcccatggcgagtcccaggctgaagaaacagccccacgcggccccacgcagag

SEQ ID NO: 70839 - DNA, 102 bp, Homo sapiens
  misc_feature 1..102: note = chr10:134623057-134623159
  misc_feature 1..102: note = hypo
  source 1..102: mol_type = genomic DNA
taagctcctggtgagcggtggatactgaaggcctctgggggaagccttcttagtcagggcagaccaccccctccgtgcaccgctgagcgcctcaactcaggg

SEQ ID NO: 70840 - DNA, 81 bp, Homo sapiens
  misc_feature 1..81: note = chr10:134624068-134624149
  misc_feature 1..81: note = hypo
  source 1..81: mol_type = genomic DNA
gatgccaggggcccacgcactttcccataagacgctggcccgcagcgcgttgtcctgcagcagcgtcggccactggtttgc

SEQ ID NO: 70841 - DNA, 42 bp, Homo sapiens
  misc_feature 1..42: note = chr10:134626641-134626683
  misc_feature 1..42: note = hypo
  source 1..42: mol_type = genomic DNA
acacccctactcgggcggggctcgctgcgggaaacgctagga

SEQ ID NO: 70842 - DNA, 142 bp, Homo sapiens
  misc_feature 1..142: note = chr10:134629717-134629859
  misc_feature 1..142: note = hypo
  source 1..142: mol_type = genomic DNA
cgtttctggcgttctcggttgctcttctctgtggcatctctgtttccctggcgtcttctgcatgttctcctctgctcacctggggatcattctgcctccttgctctgacttcttctttttttttttttttttttttgagacg

SEQ ID NO: 70843 - DNA, 37 bp, Homo sapiens
  misc_feature 1..37: note = chr10:134640686-134640723
  misc_feature 1..37: note = hypo
  source 1..37: mol_type = genomic DNA
agacacaaccccacacggtgctcgtcaggggaaggca

SEQ ID NO: 70844 - DNA, 123 bp, Homo sapiens
  misc_feature 1..123: note = chr10:134647633-134647756
  misc_feature 1..123: note = hypo
  source 1..123: mol_type = genomic DNA
gtcaggttatatattcgggtttaagaaacagagataacaaacgcttggaatataggcgacacctgctcagcctgtttcactctaaggcagcagcaccacgaatccccacgctcacttctgggg

SEQ ID NO: 70845 - DNA, 57 bp, Homo sapiens; identical to SEQ ID NO: 42767
  misc_feature 1..57: note = chr10:134648015-134648072
  misc_feature 1..57: note = hypo
  source 1..57: mol_type = genomic DNA

SEQ ID NO: 70846 - DNA, 30 bp, Homo sapiens
  misc_feature 1..30: note = chr10:134651763-134651793
  misc_feature 1..30: note = hypo
  source 1..30: mol_type = genomic DNA
tgggcagccctccatcgagctgtgaggctt

SEQ ID NO: 70847 - DNA, 74 bp, Homo sapiens
  misc_feature 1..74: note = chr10:134659532-134659606
  misc_feature 1..74: note = hypo
  source 1..74: mol_type = genomic DNA
aggttcagcggcatccgtgcccgcttaccttggacacggcggccagcctctgctccacacgggcgcccaggctg

SEQ ID NO: 70848 - DNA, 87 bp, Homo sapiens; identical to SEQ ID NO: 42768
  misc_feature 1..87: note = chr10:134662545-134662632
  misc_feature 1..87: note = hypo
  source 1..87: mol_type = genomic DNA

SEQ ID NO: 70849 - DNA, 55 bp, Homo sapiens
  misc_feature 1..55: note = chr10:134663367-134663422
  misc_feature 1..55: note = hypo
  source 1..55: mol_type = genomic DNA
ccccaggtccctgtgcggggcctggccagagccgctgctgcgggacacaccagtt

SEQ ID NO: 70850 - DNA, 193 bp, Homo sapiens
  misc_feature 1..193: note = chr10:134664613-134664806
  misc_feature 1..193: note = hypo
  source 1..193: mol_type = genomic DNA
caattaccaggccgacggaagtgtagtcactggtgttctgcagatagtccgccagcagcttctccagggacccctgctcactctgctgcccgtgggcctcctcccagatgaactggagcatgtccagagccatttccacgaggccgagcttgaggcgcgccagcttcctcatcaggggcgtgttgacgttctg

SEQ ID NO: 70851 - DNA, 406 bp, Homo sapiens
  misc_feature 1..406: note = chr10:134665007-134665413
  misc_feature 1..406: note = hypo
  source 1..406: mol_type = genomic DNA
atccccaaatctcttcgcgtcccctcatgttccctcccggtcacctagctgcctgccggcaccctgcattccttggcattttccagaaccgtacctaagtggaggcgcacagagtgctgtctttccgtctggttcattttcctcggtaaagtcaccgtgagactcccccacgcggctgcacgcatgctccttccctctcacagccggcgtcggtgcaccgtgtgcacgcgccacaccctgcttatctattcaaatattttatttccagttctggggctactaccaataaagctgctgccaacattcatgtgcaaggtatccacagatcctgatccacagacgtggtatgttcctccatttacttaggaattctcagatcctgatccacagacgtggtatgttcctc

SEQ ID NO: 70852 - DNA, 153 bp, Homo sapiens
  misc_feature 1..153: note = chr10:134671588-134671741
  misc_feature 1..153: note = hypo
  source 1..153: mol_type = genomic DNA
tgcaaggacaatgtacgacatccacagtaacagacacggctcaggtcagaccttgtggtgggttatgcttccctcgcgcaggcttctacacgcccgcactgggcccgccgtgtcgagacgcttgcgtgtggacaagtccgggggccataggtt

SEQ ID NO: 70853 - DNA, 128 bp, Homo sapiens
  misc_feature 1..128: note = chr10:134672396-134672524
  misc_feature 1..128: note = hypo
  source 1..128: mol_type = genomic DNA
ggcatgtgatcagaacgtgtgggtgaggcggcagccgagagcttcccaggggagggtcctgtggaccccgcgggggtgcagccggggtgagccaggcccagaaggcaggatggcgctgggcgtgttgt

SEQ ID NO: 70854 - DNA, 315 bp, Homo sapiens
  misc_feature 1..315: note = chr10:134676338-134676653
  misc_feature 1..315: note = hyper
  source 1..315: mol_type = genomic DNA
gagggtgaggaggggcgggaggggagggcagcacatggaggcaggctttctgtggtgtggatgtggctgagaagccagggtgagctgagggcaaagttgaggacgggaggtaggaggccttcaggcaagagggcgggaaagatcaaggaaacaaacaacttcctgtcagaagcgcctgctgtgaaacaaagtccctgcaaaacagcggctgcaggaaggagggtggcgaacccacgttcgcgggagtccagcacccatcacgtctgtcctgggtctgggctccaaggtccacggtggccccgggtatgaggcagg

SEQ ID NO: 70855 - DNA, 52 bp, Homo sapiens
  misc_feature 1..52: note = chr10:134679419-134679471
  misc_feature 1..52: note = hypo
  source 1..52: mol_type = genomic DNA
cctgctagagctgaacgctacagcccaagcttctgcccgcagtccctccact

SEQ ID NO: 70856 - DNA, 30 bp, Homo sapiens
  misc_feature 1..30: note = chr10:134679999-134680029
  misc_feature 1..30: note = hypo
  source 1..30: mol_type = genomic DNA
ccccttgccccacctcgtggtgccgaacaa

SEQ ID NO: 70857 - DNA, 230 bp, Homo sapiens
  misc_feature 1..230: note = chr10:134682617-134682847
  misc_feature 1..230: note = hypo
  source 1..230: mol_type = genomic DNA
acgacccaggagaaccggccacagccgtgtcccccaagtgctcactctccccagaggggcaggagtccagggaagagggtggccgcgcagctggctttcacctggccgcaccaagggcgagactcaaaccccaggcggcgcagggtgggacggcacacacctggcctgctccagctcgctgacgcacacctgcccgaccgcctcttcatggcgcgcggctgcttctctca

SEQ ID NO: 70858 - DNA, 56 bp, Homo sapiens
  misc_feature 1..56: note = chr10:134683657-134683713
  misc_feature 1..56: note = hypo
  source 1..56: mol_type = genomic DNA
gggcaccatcagccacgcccatatgagacggtgaactgagtcgataaatgtcccgt

SEQ ID NO: 70859 - DNA, 41 bp, Homo sapiens
  misc_feature 1..41: note = chr10:134684038-134684079
  misc_feature 1..41: note = hypo
  source 1..41: mol_type = genomic DNA
acgagaaggtggagccgcctcagtgccggtatgaaaaagtt

SEQ ID NO: 70860 - DNA, 65 bp, Homo sapiens
  misc_feature 1..65: note = chr10:134690483-134690548
  misc_feature 1..65: note = hypo
  source 1..65: mol_type = genomic DNA
aggatttacctgaaacggtggaggtgaaacagcagacacccccggcccaccggcatggctgtgca

SEQ ID NO: 70861 - DNA, 164 bp, Homo sapiens
  misc_feature 1..164: note = chr10:134692244-134692408
  misc_feature 1..164: note = hypo
  source 1..164: mol_type = genomic DNA
ttcctgctctgcccacggctgggcggtggccctcttgatcctgagatgccctatgggggctccgggcaaactcatcctcagaagaaaggcctgccatgcctggcgctgccctgctggggtgtagcctgcgggaggcctagacagacgcacggggaggcccccga

SEQ ID NO: 70862 - DNA, 183 bp, Homo sapiens
  misc_feature 1..183: note = chr10:134693583-134693766
  misc_feature 1..183: note = hypo
  source 1..183: mol_type = genomic DNA
gatggccctgctgtgcgcacgtgtgtgtgtgtgcatgtatgtgtgtgtgtgtgtgtggagtggccaccctagctgggctctgccggcctctgctcttcacggcaggactgccgagccaccccatgggactctccgtgcgcacctgcgctccccacagagtttctgccccgggtcaccctgggc

SEQ ID NO: 70863 - DNA, 60 bp, Homo sapiens
  misc_feature 1..60: note = chr10:134699346-134699406
  misc_feature 1..60: note = hypo
  source 1..60: mol_type = genomic DNA
gcacctgcacagcctcgtccagcaccttgaggccgccctcccagtcgtcctggtcggcat

SEQ ID NO: 70864 - DNA, 425 bp, Homo sapiens
  misc_feature 1..425: note = chr10:134699648-134700073
  misc_feature 1..425: note = hypo
  source 1..425: mol_type = genomic DNA
cccacagtggccacccgggatgccctttccgttgcaggaagcagctgtcttgtctccttgctgcctgtcactctccatctccttggagaattctgcgttcacaaacacagacctgtgtttccacgtattaaagattggcgagcaggacttggggtcctttcaggagttgcatggaaagctcccccgcggccgaggacacagcgccacgtgcacgctcgggagtcctcatgcttggtgcccgcagcacgggaacaatccccgagtctccacgcaggcagcggagccatgtgacacgcagaggcaaaggtgcctgccttcagggcacacacaaaaatcgcctgcctgccgggaggtgagccccacccagcctccatagggcgccctgtgggccatcagtgcccccaaatgcacgaagccagcagggt

SEQ ID NO: 70865 - DNA, 99 bp, Homo sapiens
  misc_feature 1..99: note = chr10:134720606-134720705
  misc_feature 1..99: note = hypo
  source 1..99: mol_type = genomic DNA
tgtgggaagatggggcgtgggcctggggcgctccttgcctccggcaggtgctgcccacgctggccatttggccacagaaaacatcgttacagcctttgg

SEQ ID NO: 70866 - DNA, 70 bp, Homo sapiens
  misc_feature 1..70: note = chr10:134726229-134726299
  misc_feature 1..70: note = hypo
  source 1..70: mol_type = genomic DNA
atttcctggacttctcggcagcctggactggaatccagctgatgatcaggcctcgcgccaaggtgttgca

SEQ ID NO: 70867 - DNA, 63 bp, Homo sapiens
  misc_feature 1..63: note = chr10:134729962-134730025
  misc_feature 1..63: note = hypo
  source 1..63: mol_type = genomic DNA
gggtgtccctccccacgccagcctgagtgcaggggacactctgacccacggccccgggcggtg

SEQ ID NO: 70868 - DNA, 170 bp, Homo sapiens
  misc_feature 1..170: note = chr10:134730580-134730750
  misc_feature 1..170: note = hypo
  source 1..170: mol_type = genomic DNA
catgtggcacagccccgtggccgccgctggctctggttctgccatgtggcctccggctccctgagcagagagttctgtgccgcttctcaccctgaccccagctgagggcatgggcctggcacctgggagccactcagcagacatactgcctaaatcggcaggtgccctgt

SEQ ID NO: 70869 - DNA, 30 bp, Homo sapiens
  misc_feature 1..30: note = chr10:134730962-134730992
  misc_feature 1..30: note = hypo
  source 1..30: mol_type = genomic DNA
gagtctctgagcctgcgtgggaggaacagg

SEQ ID NO: 70870 - DNA, 177 bp, Homo sapiens; identical to SEQ ID NO: 42783
  misc_feature 1..177: note = chr10:134731838-134732015
  misc_feature 1..177: note = hypo
  source 1..177: mol_type = genomic DNA

SEQ ID NO: 70871 - DNA, 1043 bp, Homo sapiens
  misc_feature 1..1043: note = chr10:134732792-134733835
  misc_feature 1..1043: note = hypo
  source 1..1043: mol_type = genomic DNA
acacactcgtgagggcgggtacgaacctcgccgcagcctcaacttcttcaccttgacgttgtcatacaggaggcagaagcggctcgccgtccgacagacgtcccacacgccttgtttccgggccactttggccagctctgcccaaatctgtatcctgctcaccgagaacccaaacgagtgaaaggtgagtagacaagtgtggttgctgaagttagaaaacacctgggctggctgcctgagaaaaggccactgtggctctgcagtttcaaggtggcaaggagcccggcactcgcgctgggtacggcctggcgggtgcatgtcccagggtcgggcgcagctctccgctctccctgccagccagctgtgcgcggcacctcccttccctgtggtgagaagaaaggccacacaatccactccccgggggagtgcacgggacaggcctcccggggatggtaccgaccgcagggtcggtaccaaaaatcagcctgctctggtcacaggcgctgcgtgtcctccgagtgacagcagtgacaggcgggacagggcagccgcacacctcataggccgtggctgtcatcacaggctggggggtcccgtctgtggcgggactcccaggcagggacctcgtcccaccatcctggagcaggtggcctggcgagtccccagacggccacatgcagggtcagctcagccgccacagacactggccctcgggctgagcgacccccgggctgagctgtgcgtggcgctctggccttttcctcactcacctctccttgtcgttttcgttgcccaggcgccgcaggtgcccggcagctttgtccacgctgacggtgtggtgccacgccttcgcacagaggtaggtgaaccggcccctgttcttcccggtggagactgagggcggaaatgcaaaggcaggtgttgcagctgctggccaagggccggggacgtgcccatcagtaaccaatgccctgcgccggcgccggggtggccacccacaggtagcggctccaggggccctagatccccggctcccagaagcc

SEQ ID NO: 70872 - DNA, 205 bp, Homo sapiens
  misc_feature 1..205: note = chr10:134734065-134734270
  misc_feature 1..205: note = hypo
  source 1..205: mol_type = genomic DNA
ggtttatccgcatgacgccagatgttccgaatcaccgctccttttcctggcaaataatcacgagcacccggaactcagctccacaccctggggggcctcctgtgcatgggcgaccccgggggctgggcctcccctggctggtgtccaccctctcggccagcacaggggttcaccttcaggagccactcaacggcatcctcccctg

SEQ ID NO: 70873 - DNA, 339 bp, Homo sapiens
  misc_feature 1..339: note = chr10:134734696-134735035
  misc_feature 1..339: note = hypo
  source 1..339: mol_type = genomic DNA
gtgctgggtgaaagccgccggctgctgggcactgagctggagggaggcctggcagcagcccccagcaggaccctcaggggaccagcgggaagggctcccaagccaggcccagcctggcccctgcactgggctggagagagtggggccgcctgcgttcccagagccactggcgagtgcccagagaagctcgggcagtgaggatgcaacacacctgccgaaccctggctcagtccccgcacatgggccgtacggccccgtgtcccattacccaaagccagctcagggtctccctgggacagatgtgatggcttcagctttgacccccgtgatccagggagc

SEQ ID NO: 70874 - DNA, 30 bp, Homo sapiens
  misc_feature 1..30: note = chr10:134735976-134736006
  misc_feature 1..30: note = hypo
  source 1..30: mol_type = genomic DNA
gcggcacctgctcaacggccatgatggcct

SEQ ID NO: 70875 - DNA, 543 bp, Homo sapiens; identical to SEQ ID NO: 42786
  misc_feature 1..543: note = chr10:134738145-134738688
  misc_feature 1..543: note = hypo
  source 1..543: mol_type = genomic DNA

SEQ ID NO: 70876 - DNA, 286 bp, Homo sapiens
  misc_feature 1..286: note = chr10:134739166-134739452
  misc_feature 1..286: note = hypo
  source 1..286: mol_type = genomic DNA
cagtcaaaaacctcccgcgagaagctcagccccacggaggcagacccaggagcaagtccacagcggcatcggcacccgccgggctgtgacacgtgtgccaggcagtgcgggctgaggatggatgcgttaggagtggggatggggaaggcctcccagctgccgtgctcatcccctgccacggcacctctggcactgacccgcacgcccctggctcctctgtacccagcggagcctcgcactgcctggctgacagggcctgagggttcccagccgaccctgtggcact

SEQ ID NO: 70877 - DNA, 37 bp, Homo sapiens
  misc_feature 1..37: note = chr10:134739723-134739760
  misc_feature 1..37: note = hypo
  source 1..37: mol_type = genomic DNA
catgggacgcgtggccgtcccccgtcctcccaggcag

SEQ ID NO: 70878 - DNA, 53 bp, Homo sapiens
  misc_feature 1..53: note = chr10:134740858-134740911
  misc_feature 1..53: note = hypo
  source 1..53: mol_type = genomic DNA
ggcggcagacgcctccgtcccggggagcaggtcctcggcggcagacgcctccg

SEQ ID NO: 70879 - DNA, 34 bp, Homo sapiens
  misc_feature 1..34: note = chr10:134754790-134754824
  misc_feature 1..34: note = hypo
  source 1..34: mol_type = genomic DNA
gcctgtgctccagcacgcccgccccaccccagct

SEQ ID NO: 70880 - DNA, 332 bp, Homo sapiens
  misc_feature 1..332: note = chr10:134755846-134756178
  misc_feature 1..332: note = hyper
  source 1..332: mol_type = genomic DNA
tgggatgagagggtccggggcctccccggggcgggggtcgtggcgggtcccggggcctccccggggcgggggtcgtggcgggcctggggtcaccttgctggctctcggcgcgggccagctcctgcgtgatgaccaggtccatggcgccggcgccctgctcgtccgctctctccggggtccgcggtgcgtcctgccgcccactgtcggttgggttctccagccgcgaggacccggccacggttgcctggagaccgaaagggacgcggacgcggggctacgggtcggcggcggggccacacttcggggaaggcgaacaacgccgcgcccccgcc

SEQ ID NO: 70881 - DNA, 30 bp, Homo sapiens; identical to SEQ ID NO: 42788
  misc_feature 1..30: note = chr10:134757661-134757691
  misc_feature 1..30: note = hypo
  source 1..30: mol_type = genomic DNA

SEQ ID NO: 70882 - DNA, 30 bp, Homo sapiens
  misc_feature 1..30: note = chr10:134771907-134771937
  misc_feature 1..30: note = hypo
  source 1..30: mol_type = genomic DNA
cctgtgggttgacagcgaggcccggagcac

SEQ ID NO: 70883 - DNA, 179 bp, Homo sapiens
  misc_feature 1..179: note = chr10:134772301-134772480
  misc_feature 1..179: note = hypo
  source 1..179: mol_type = genomic DNA
aggtgacaggctgtgcggagccgtggggccctccccctgggatacctgctgacaccaggctgggcagggcccttcggaaggcgagtgggaggacccaggagctcctgctcctgagcccagggtcacctttagggagcactttggggggtcagttgtgcaccttccggaaggaggcagcg

SEQ ID NO: 70884 - DNA, 30 bp, Homo sapiens
  misc_feature 1..30: note = chr10:134773161-134773191
  misc_feature 1..30: note = hypo
  source 1..30: mol_type = genomic DNA
agaccgacaggtgggcgctggaggcaacat

SEQ ID NO: 70885 - DNA, 147 bp, Homo sapiens
  misc_feature 1..147: note = chr10:134773880-134774027
  misc_feature 1..147: note = hypo
  source 1..147: mol_type = genomic DNA
aggtccctgggccctcgccatgccccaaactggcagccatacagaggacgccccgcatgcaggtggggacccacaatcaggcccccggggcaggtgggcacctgggtggaggccacggctttctcacctggacggggactaaggagg

SEQ ID NO: 70886 - DNA, 33 bp, Homo sapiens
  misc_feature 1..33: note = chr10:134777879-134777912
  misc_feature 1..33: note = hypo
  source 1..33: mol_type = genomic DNA
tcacagcccagcagccggcggcctgtccatgat

SEQ ID NO: 70887 - DNA, 90 bp, Homo sapiens
  misc_feature 1..90: note = chr10:134787026-134787116
  misc_feature 1..90: note = hypo
  source 1..90: mol_type = genomic DNA
gctcatgcccctgtccggaggcccagcccagcccagcacacacaaagccaggcgtcagggctcaggcacagagcacggccatggccagat

SEQ ID NO: 70888 - DNA, 87 bp, Homo sapiens
  misc_feature 1..87: note = chr10:134788030-134788117
  misc_feature 1..87: note = hypo
  source 1..87: mol_type = genomic DNA
cccgggagaggtggacgctgtctgcacctgcctctccccaacgcgccctgcccgggagaggtggatgccgcccgcacctgcctctcc

SEQ ID NO: 70889 - DNA, 30 bp, Homo sapiens
  misc_feature 1..30: note = chr10:134789538-134789568
  misc_feature 1..30: note = hypo
  source 1..30: mol_type = genomic DNA
ttccttcctggatttcgacaatgtggatgc

SEQ ID NO: 70890 - DNA, 36 bp, Homo sapiens
  misc_feature 1..36: note = chr10:134793932-134793968
  misc_feature 1..36: note = hypo
  source 1..36: mol_type = genomic DNA
cccgcaagtgcccagcgagtgcccggcgaatgccca

SEQ ID NO: 70891 - DNA, 98 bp, Homo sapiens
  misc_feature 1..98: note = chr10:134794346-134794444
  misc_feature 1..98: note = hypo
  source 1..98: mol_type = genomic DNA
gcccagcgagtgcccggtgagtgcccagcgaatggaggctcctcgggtaacacgcgtggacccaggcacaatacaaagtcaaccgcccggggctctag

SEQ ID NO: 70892 - DNA, 54 bp, Homo sapiens
  misc_feature 1..54: note = chr10:134794878-134794932
  misc_feature 1..54: note = hypo
  source 1..54: mol_type = genomic DNA
gctgcctgagaaaagcgaccacatctggggctgtgcccccgcccgacaagccca

SEQ ID NO: 70893 - DNA, 176 bp, Homo sapiens
  misc_feature 1..176: note = chr10:134795866-134796042
  misc_feature 1..176: note = hypo
  source 1..176: mol_type = genomic DNA
ctggaatgaaacccacgtgggcagtcccacgagcaacacgccagcgccccaaggctggccacgggcaggacgcagagacagacgcgtcattagagcatgggcgcggcgtgtccgtggcacgtgaggccccgggccctgcctttgctttcggtctctgtgcacgctgcctcctgacc

SEQ ID NO: 70894 - DNA, 161 bp, Homo sapiens
  misc_feature 1..161: note = chr10:134797569-134797730
  misc_feature 1..161: note = hypo
  source 1..161: mol_type = genomic DNA
ggctgctgaatctcacggcagctccgagtttaattctcggacgaggctctctgtcagtcgcgcgtgaccgcgtgggctcaggcgtctgtgcgagttgctgcgcgcgtgtgggtgtgcggccgacgtaagctcgtctgcgtccctcccgtttagtgcccggg

SEQ ID NO: 70895 - DNA, 41 bp, Homo sapiens
  misc_feature 1..41: note = chr10:134800646-134800687
  misc_feature 1..41: note = hypo
  source 1..41: mol_type = genomic DNA
cgtgatctgattctgcgaaaattacccgagaatgtcaggat

SEQ ID NO: 70896 - DNA, 30 bp, Homo sapiens
  misc_feature 1..30: note = chr10:134806473-134806503
  misc_feature 1..30: note = hypo
  source 1..30: mol_type = genomic DNA
ccccgaacgcagcctcgtgctgtgatgacc

SEQ ID NO: 70897 - DNA, 51 bp, Homo sapiens
  misc_feature 1..51: note = chr10:134807256-134807307
  misc_feature 1..51: note = hypo
  source 1..51: mol_type = genomic DNA
cagcgtcgcacactgcgtggacttttaactgcccgtcgggatgctttgcag

SEQ ID NO: 70898 - DNA, 54 bp, Homo sapiens
  misc_feature 1..54: note = chr10:134809821-134809875
  misc_feature 1..54: note = hypo
  source 1..54: mol_type = genomic DNA
ccctgattctttccacgacccctctgattttttcaacgccgacctcccctaggt

SEQ ID NO: 70899 - DNA, 30 bp, Homo sapiens
  misc_feature 1..30: note = chr10:134818621-134818651
  misc_feature 1..30: note = hypo
  source 1..30: mol_type = genomic DNA
gcctctagccccagacgaggctgcatcatc

SEQ ID NO: 70900 - DNA, 30 bp, Homo sapiens
  misc_feature 1..30: note = chr10:134823987-134824017
  misc_feature 1..30: note = hypo
  source 1..30: mol_type = genomic DNA
ctggaggtccctccccgaaggtctgtctca

SEQ ID NO: 70901 - DNA, 119 bp, Homo sapiens
  misc_feature 1..119: note = chr10:134826512-134826631
  misc_feature 1..119: note = hypo
  source 1..119: mol_type = genomic DNA
acccagggtgccccccgccgaccgttacccgccctttgccccaaggctgtctttgaggtcggtctttctggggctgtggcccaaatgaagtcaagagacagcatcgggcgttgactgtc

SEQ ID NO: 70902 - DNA, 37 bp, Homo sapiens
  misc_feature 1..37: note = chr10:134830634-134830671
  misc_feature 1..37: note = hypo
  source 1..37: mol_type = genomic DNA
cgctccccgtcgccacggtccccgtcgccacgctccc

SEQ ID NO: 70903 - DNA, 87 bp, Homo sapiens
  misc_feature 1..87: note = chr10:134832028-134832115
  misc_feature 1..87: note = hypo
  source 1..87: mol_type = genomic DNA
cacggatgccacatacgggtctagtaggacagcgggacccgcagggagcgtggtgacagagaccgtggtgaccgggaccgtgtgcag

SEQ ID NO: 70904 - DNA, 30 bp, Homo sapiens
  misc_feature 1..30: note = chr10:134833453-134833483
  misc_feature 1..30: note = hypo
  source 1..30: mol_type = genomic DNA
cagcacctgtccatgcgtcactaacccaag

SEQ ID NO: 70905 - DNA, 84 bp, Homo sapiens
  misc_feature 1..84: note = chr10:134834266-134834350
  misc_feature 1..84: note = hypo
  source 1..84: mol_type = genomic DNA
tgccacccttctgcccgaagggacagccaccttccccctcaagagacggcgaccttctcccccaggggacggccaccttctccc

SEQ ID NO: 70906 - DNA, 395 bp, Homo sapiens
  misc_feature 1..395: note = chr10:134834562-134834957
  misc_feature 1..395: note = hypo
  source 1..395: mol_type = genomic DNA
gtgcttctgtgggaacgcgtgtttccagttccaaaaagccaaccaaatgctcagaacctccccctgggctggttggtgtgattgagactggtcgctccagtctgcacctgtctgcggtgacggccgcccttcccgtcagcccctccgcggtcccggccccagccctgggttgagggagggctggggaggagcagggacagacgggcaggcaccaggacgctggctgctgcgtgaatgtcacctgtggtcacggccgacgcccggcgggcctgggcatggagtcaggaccggaaagcgaggccggcagcagcaccagctcctcagcaaggcccccgctgccgactgggcacgggcactccaaggggacgcctggcacgtgccgggatccacgcgcg

SEQ ID NO: 70907 - DNA, 30 bp, Homo sapiens
  misc_feature 1..30: note = chr10:134837231-134837261
  misc_feature 1..30: note = hypo
  source 1..30: mol_type = genomic DNA
tgttccaggccacagcggaaggaggtgggg

SEQ ID NO: 70908 - DNA, 103 bp, Homo sapiens
  misc_feature 1..103: note = chr10:134855666-134855769
  misc_feature 1..103: note = hypo
  source 1..103: mol_type = genomic DNA
ggaaggcagggtctgggaaggcagagtccggtaaggctgggtccgggaaggctggggtccgtggggatgggcagggtctgtggggacacgcagggtgtcccac

SEQ ID NO: 70909 - DNA, 30 bp, Homo sapiens
  misc_feature 1..30: note = chr10:134860784-134860814
  misc_feature 1..30: note = hypo
  source 1..30: mol_type = genomic DNA
acgtgtcctcccaggcgtccccccaggcat

SEQ ID NO: 70910 - DNA, 30 bp, Homo sapiens
  misc_feature 1..30: note = chr10:134863667-134863697
  misc_feature 1..30: note = hypo
  source 1..30: mol_type = genomic DNA
attcagcccagcttccggggccgtgatggc

SEQ ID NO: 70911 - DNA, 343 bp, Homo sapiens
  misc_feature 1..343: note = chr10:134875810-134876153
  misc_feature 1..343: note = hypo
  source 1..343: mol_type = genomic DNA
ctcagtgattcaacacgttaagtaacgtgtcacgtgcctgctggccaccaccgtccgctcctgggaagaacctgttgactcagctgccgttttacctggatcatccgtcatctttctctcgagatagagttctccaggctttctggacccggacacacatggcaacacgccctgcagacaacctttcccaaagccacggcttactttgtaactcatcatggtgccttttaataatcaaaaattcctaattttaatgaagtccaatattcctgatgtttctttacaaacagttctttttatgccttctttttaaaaatctttgtctttgcgagtcctcaaagat

SEQ ID NO: 70912 - DNA, 258 bp, Homo sapiens
  misc_feature 1..258: note = chr10:134886068-134886326
  misc_feature 1..258: note = hypo
  source 1..258: mol_type = genomic DNA
gccccatcactggagcgccccagtttggatgccaagtgccgagctcgcacgggtgactctacctcgctgagaactgacgaaccgtaagtggtgcattcacagaattcacacatcaagctttttaatttcatttccaatttaatatcatctatctcagtctgtttctcctgtaacacagtctttaaagttaagtgggcgcgacccacttaactgttcccaccccttccggcacggcaccggcaccgtcctgggcgcccc

SEQ ID NO: 70913 - DNA, 144 bp, Homo sapiens
  misc_feature 1..144: note = chr10:134886921-134887065
  misc_feature 1..144: note = hypo
  source 1..144: mol_type = genomic DNA
agtcctgataaagggcgacgtgtgtgcacacgcgtgcacggtgtgtgagtaaagtggcagaaagagtgtcatgaggcggtgacgctaccgtccccacagccagcctcatctcactgacgcctccctgtacgcattgctaaaaga

SEQ ID NO: 70914 - DNA, 38 bp, Homo sapiens
  misc_feature 1..38: note = chr10:134890001-134890039
  misc_feature 1..38: note = hypo
  source 1..38: mol_type = genomic DNA
agcccttgcagggcacgtgaaaccggtcactgtggacc

SEQ ID NO: 70915 - DNA, 30 bp, Homo sapiens
  misc_feature 1..30: note = chr10:134894556-134894586
  misc_feature 1..30: note = hypo
  source 1..30: mol_type = genomic DNA
cgcggacctgtcccacgttgagatcagggt

SEQ ID NO: 70916 - DNA, 165 bp, Homo sapiens
  misc_feature 1..165: note = chr10:134895279-134895444
  misc_feature 1..165: note = hypo
  source 1..165: mol_type = genomic DNA
tgggctcctggaggtcgtccacccacagaagccgtgttctgattatcaacacgccctctggcaggaccccctggagccagggctccctcggcagcaccgggcgctacaaccagacccgggcaccaggcagccagcagcaggggctgtgctcggatgcagctctac

SEQ ID NO: 70917 - DNA, 30 bp, Homo sapiens
  misc_feature 1..30: note = chr10:134897792-134897822
  misc_feature 1..30: note = hypo
  source 1..30: mol_type = genomic DNA
ggtcagtgttgaaggcgttaggatttgcgt

SEQ ID NO: 70918 - DNA, 354 bp, Homo sapiens
  misc_feature 1..354: note = chr10:134898266-134898620
  misc_feature 1..354: note = hypo
  source 1..354: mol_type = genomic DNA
tgtagatgcaatggccgtgaccagcacttggccgtctgcgctgtaggccaaggaggcctgcctgggcccacctggctgcagcggggagctgagcctccctgaggaggaaggaatcgcacctggggcagcaacagcagctcctgcctgggtccctcatggccgcgtgagccgcttcctcactgtaaagctcttcacctatgtaactatgtatcaatgtaaacaggaacgtatcctccgcctctgcatctctggtgaatccgggcgatacgtggtgagacaccttaataaacacctagatagaccctgccgtggtgagcacctgcctccaaggggcaagcacggggcattttcctg

SEQ ID NO: 70919 - DNA, 111 bp, Homo sapiens; identical to SEQ ID NO: 33549
  misc_feature 1..111: note = chr10:134901183-134901294
  misc_feature 1..111: note = hyper
  source 1..111: mol_type = genomic DNA

SEQ ID NO: 70920 - DNA, 830 bp, Homo sapiens
  misc_feature 1..830: note = chr10:134901295-134902125
  misc_feature 1..830: note = hyper
  source 1..830: mol_type = genomic DNA
gcggccgcccggctggaagagccatccccaccctgcggcaggagcccgcccgccgccatcgcccgccccggtccccatggttacgcgcctgcctccggccccgggtccccgctgtcgccgcgggaggtgcgcgcagaggcggcggcgctgctggccgggctgggccgctcgtgcgcggggctgtgactcaccggccggcgccgcagccccgcaatctgttgataactcggtcccagctcggccgctgccctcgcgaatggagagcgggtccccggcggggggagcgcagcgcgtctgtctccgggagcgcggcccggccgccccggcagccgcttcggccacagcaggtgggaaggacgcgcgggtctgggcggcgggagggacgcgcggggccgcggctcggcagaaaagctcgcgccccgaggtgacactggccgcgaggaaagcagctccgagtaactttcggctccgctggggcgggaggcgccacggataatccagggcccccgccccgcgcgcccggcccggagctcgagccacatccaggcagagcaggcgccgcggccgggctggggcgggcgggtcactcggtgccggttcccggtgcaaaccccccggcgcgcctctggctttgtgcagcccgagatggttgagtttggctccggagccgggagtggggcgcagattgatttttaaatatggagaaggagacgcatctgccgctggcgcgttcggtccgagccccccaccggtccccaccggcaccgcctccgccagccccaggcgcagcccccaggccgcccgcggaggggagggagcgacaggggccg

SEQ ID NO: 70921 - DNA, 74 bp, Homo sapiens
  misc_feature 1..74: note = chr10:134902187-134902261
  misc_feature 1..74: note = hyper
  source 1..74: mol_type = genomic DNA
cgctgaccgccgctgtcttcacagatgggagcagctcccggactgcgcccgccccgccgcggtcaccctgaggc

SEQ ID NO: 70922 - DNA, 91 bp, Homo sapiens
  misc_feature 1..91: note = chr10:134907606-134907697
  misc_feature 1..91: note = hypo
  source 1..91: mol_type = genomic DNA
cttgccgcctcagtccgtgtgaaacctcacagcttggccttcagacgagaagccccacacaaggcggcgtggccctcgctgtcactggagc

SEQ ID NO: 70923 - DNA, 218 bp, Homo sapiens
  misc_feature 1..218: note = chr10:134912118-134912336
  misc_feature 1..218: note = hypo
  source 1..218: mol_type = genomic DNA
gaaaccctcctttcccgtcccacagcgccatccgcatcagccgcaagggccggcacacgctcctgaatttctgcttccacgcggccctgaccttcactgtgttcgccggcggcatcaatcgcaccaagtaccccatcctgtgccaggcggtgagtgccggggcgccctcgttggctcctcccagaggggaactgcgtgagcgtcgtcttgtttactaa

SEQ ID NO: 70924 - DNA, 354 bp, Homo sapiens
  misc_feature 1..354: note = chr10:134913693-134914047
  misc_feature 1..354: note = hypo
  source 1..354: mol_type = genomic DNA
ccagcatggccccggcggaggagtcgctggcacgcacctgaaggtggctaaggtcagacgtacctcctgcctccttaatcattcctctggtaagctggaaacaaccacagcaagtgcccgggaaacgccattgacgtcccgcctgtaagtgcctgcgagaggccgtcaccatcacgtctgcactttgccaccaagtacgccccacactgggatgaagcctgctggatccgcgggtgaggccccccgagggccttcagcaaaccccgcccgcgccttcgggaacacctgccactgcttgcctggacggagctcctggggcccaggcctgcggtgacagctcggggcggatgctgg

SEQ ID NO: 70925 - DNA, 60 bp, Homo sapiens; identical to SEQ ID NO: 42804
  misc_feature 1..60: note = chr10:134916714-134916774
  misc_feature 1..60: note = hypo
  source 1..60: mol_type = genomic DNA

SEQ ID NO: 70926 - DNA, 30 bp, Homo sapiens
  misc_feature 1..30: note = chr10:134928644-134928674
  misc_feature 1..30: note = hypo
  source 1..30: mol_type = genomic DNA
cacctgggcctcaggcgatggatgaggtgc

SEQ ID NO: 70927 - DNA, 202 bp, Homo sapiens
  misc_feature 1..202: note = chr10:134930863-134931065
  misc_feature 1..202: note = hypo
  source 1..202: mol_type = genomic DNA
cccagcaaacacccacggaacagcctactgacggtgcatccagcctggagccccacagaggccaagcgctcagcgtggccacaccagacctgccccctgggaggtccggtgcactgtggacgtgggcagggcagagcccgggagactgcctgggccaggaggccccaggatcaggccctcactagcccgggcacctgctcag

SEQ ID NO: 70928 - DNA, 269 bp, Homo sapiens
  misc_feature 1..269: note = chr10:134937581-134937850
  misc_feature 1..269: note = hypo
  source 1..269: mol_type = genomic DNA
cttggcactgggtcacgtggtgatgcactcagggctggtcccaggctctgcaccctccccggccagcccaccctcttgggctctgcaccctccccggccaggccaccctcttgggctctgcaccctccccggctctgcaacctccccggccaagccaccctcttgggctctgcaccctccccggctctgcaccctccctggccaggccaccttccccgggctctgagcaatgtgctctgccgtgagtcagctcccgctttgcccctccg

SEQ ID NO: 70929 - DNA, 569 bp, Homo sapiens
  misc_feature 1..569: note = chr10:134940715-134941284
  misc_feature 1..569: note = hypo
  source 1..569: mol_type = genomic DNA
caacgccttcctccccggcaggttttacctcgtcagcggaggggtcccctttatcatctgtggggtcacggctgccacgaacatcaggaattacgggacagaggacgaggacacggcgtagtgagtaccgggcacccagaaccgggagctgggagcagcgggtgggctctgcctgaggtccctcccaggcacctgtggtggggaagcccaggacgaagcagcaaggcctgggcctggacctggggcttgccgagagctgcgcccctcccagctcgcacccccgaggagtgcgcagcgccccctcctctcccagggagtccaacctaatctttgcctttggacaaggcaggcctggtttgccttctatgggaggggcctggggacaaatagcgatttggcaacagcacagagctcagctgagaagggaaaccccatcgagtaggaacggcggtccagccatcagtgcccagagccagcctggaacctctcattcagggccctcagttccttctgcggccccaggatggcccgcccgtctgccctccgccttgccccgcccacccagctcc

SEQ ID NO: 70930 - DNA, 248 bp, Homo sapiens
  misc_feature 1..248: note = chr10:134941647-134941895
  misc_feature 1..248: note = hypo
  source 1..248: mol_type = genomic DNA
agggccaatagggcccggttcccatccacactctcagcgactctagaaacgcccaaggcccccaagccgcagctgtgcaaagccactcgctaggccgggtgggtgcagggccctttgctctgcagggggcgtcctgagtcctggccgtgctggccccgctgacactgacgtgcgtctccccacagctgctggatggcctgggagcccagcctgggcgccttctacggcccagccgccatcatcaccct

SEQ ID NO: 70931 - DNA, 687 bp, Homo sapiens
  misc_feature 1..687: note = chr10:134942452-134943139
  misc_feature 1..687: note = hypo
  source 1..687: mol_type = genomic DNA
ccagttgcctgtcaccggccaccccgtgctgcgccaagatgcactgcgagccactgacggcggacgaggcgcacgtgcacctgcaggaggagggcgccttcgggcacgacccccacctgcacgggtgccttcagggcagaactaagccgccctactttagccggcacccagcagaggagcccgagtacgcctaccacatcccatccagcctggatggcagcccccgcagctcgcgcacagacagcccccccagctctctggatggcccggcggggacacacacgctggcctgctgcacccagggcgaccccttccccatggtcacccagcccgagggcagtgatgggagccctgccctctacagctgccccacgcagccgggcagggaggcagcgctcgggcccggccacttggagatgctgcggaggacacagtccctgccctttggtggccccagccagaacgggctgcccaagggtaaattgctagaaggcctgccgtttggcaccgacgggaccggcaacatccgaacgggaccctggaaaaacgaaactactgtgtagatgggggcagaggacacggtgttcctggaggagcttcagagcagagtggggggcccatctgccacatgaggtcactgggggtaccgaagtgaccccgcctttcagaagccgttcacacccctgc

SEQ ID NO: 70932 - DNA, 64 bp, Homo sapiens
  misc_feature 1..64: note = chr10:134943548-134943612
  misc_feature 1..64: note = hypo
  source 1..64: mol_type = genomic DNA
tgtccccagcattctcgctctgggcagaaccctcgggaccctccgctgtcgtgtgtctgagcca

SEQ ID NO: 70933 - DNA, 201 bp, Homo sapiens
  misc_feature 1..201: note = chr10:134944571-134944772
  misc_feature 1..201: note = hypo
  source 1..201: mol_type = genomic DNA
gcagagcctccctaacgtgcacctccgagaagaggggtgtcggggagtgttcccagcacctgctcggtggaagggctctccggagactggcactcagtatctgagtatgaggagcctcacttcccggggtgtcggtaaacttgaccgtgactcagtaacccacagcgtgctcctcccagcaaaccccgtgtgtccttacag

SEQ ID NO: 70934 - DNA, 30 bp, Homo sapiens; identical to SEQ ID NO: 42811
  misc_feature 1..30: note = chr10:134945693-134945723
  misc_feature 1..30: note = hypo
  source 1..30: mol_type = genomic DNA

SEQ ID NO: 70935 - DNA, 150 bp, Homo sapiens
  misc_feature 1..150: note = chr10:134955035-134955185
  misc_feature 1..150: note = hypo
  source 1..150: mol_type = genomic DNA
gacggcacctgtggtcggcgagcaacaaggacacgcacagtcctgtaccgtccccttcccaggcccaggagccacccgcaggggctgagccctgggagcatcccagccgggctctaagggaatgtacagggggcccggtgacctgggctg

SEQ ID NO: 70936 - DNA, 52 bp, Homo sapiens
  misc_feature 1..52: note = chr10:134955660-134955712
  misc_feature 1..52: note = hypo
  source 1..52: mol_type = genomic DNA
cctccacagacaccccgtgcaggccgggacctgcacccgaggaggcacacac

SEQ ID NO: 70937 - DNA, 30 bp, Homo sapiens
  misc_feature 1..30: note = chr10:134968447-134968477
  misc_feature 1..30: note = hypo
  source 1..30: mol_type = genomic DNA
aaaactacaaaatatcgttgggagaacagg

SEQ ID NO: 70938 - DNA, 30 bp, Homo sapiens; identical to SEQ ID NO: 42813
  misc_feature 1..30: note = chr10:134970630-134970660
  misc_feature 1..30: note = hypo
  source 1..30: mol_type = genomic DNA

SEQ ID NO: 70939 - DNA, 383 bp, Homo sapiens
  misc_feature 1..383: note = chr10:134973889-134974272
  misc_feature 1..383: note = hyper
  source 1..383: mol_type = genomic DNA
tccatggagccagggcgcgcgtagccgagcccagcccagcccagccggaggccccgggggcggtgcgcggcgcggccgcaggatgcaggccatggacccggccgcggcggatctttacgaggaggacggcaaagacctggacttctacgacttcgagccgctgcccaccctccccgaggacgaggtgagcccccggccccactggggggccccttccgccgccgaggggtccgcggagagcgcccggggggaggacccgggaggggctgtgagctcccgcctccccaggcgccctccatggccgaggggttcccaccgccgttctcagcccccgcgttaggattttcacccggaggggacagcacccccgaatgcgcacggga

SEQ ID NO: 70940 - DNA, 147 bp, Homo sapiens
  misc_feature 1..147: note = chr10:134974307-134974454
  misc_feature 1..147: note = hyper
  source 1..147: mol_type = genomic DNA
cgcggtagctcctggtggaaaccctggcgggacagtgtgggggcagcaaggaggacggaggggggtctgcttactccctgccgggccccaggaggccagcggggtgcagagcagcagagtccaatcaggcgccgctcaggagctggg

SEQ ID NO: 70941 - DNA, 166 bp, Homo sapiens
  misc_feature 1..166: note = chr10:134980970-134981136
  misc_feature 1..166: note = hypo
  source 1..166: mol_type = genomic DNA
cctgtccatgcggagcgtggcccacgccgccatcttccagagcctgtgcatcacgcccgacaccctggccttcaacaccagcgggaacgtgtgtttcatggagcagctcagcggtgaggcggcggtggcggtggcggcggcggcgggcacgcggggtggaggtgcc

SEQ ID NO: 70942 - DNA, 107 bp, Homo sapiens
  misc_feature 1..107: note = chr10:134992393-134992500
  misc_feature 1..107: note = hypo
  source 1..107: mol_type = genomic DNA
cgtgagcagggctcccgctctcaggagagccgccctcatcgacgctgggcagccgcagcagacagtccctgtggacagagaggtgggaggctcgactccttctcttc

SEQ ID NO: 70943 - DNA, 651 bp, Homo sapiens; identical to SEQ ID NO: 42815
  misc_feature 1..651: note = chr10:134996258-134996909
  misc_feature 1..651: note = hypo
  source 1..651: mol_type = genomic DNA

SEQ ID NO: 70944 - DNA, 248 bp, Homo sapiens
  misc_feature 1..248: note = chr10:135001179-135001427
  misc_feature 1..248: note = hypo
  source 1..248: mol_type = genomic DNA
ttggtcccagctgtccgtgaggccttggagtggagagtggcctcccaggctgaacgcatgcctggtgtcacggtgtgtgtgtatgtgagaaaatgcaccgaacaaaagccaccacttcaaccctctgcaagagcacagctcagcggcattgggtgtgttcacgctgttgcacagctgtccccatcagcccacacgaaaccccaacccccgagcccgccccctgcaccccgtcccgccctccacctcca

SEQ ID NO: 70945 - DNA, 230 bp, Homo sapiens
  misc_feature 1..230: note = chr10:135001972-135002202
  misc_feature 1..230: note = hypo
  source 1..230: mol_type = genomic DNA
acatgcctctccaggcggcgggccctggcaaggggtgtccacactgacctcgccgctctcctgcccacagtgggtgtccctgcaggacctcctgtcccagctgggccggcccttccgggagtacgagctgtgggccctgtgcctggcctgcctccgcgcactgcagacacgccctgagcacccaggtgacgcacgcaccatcccatcccccccgccgtccccacccccca

SEQ ID NO: 70946 - DNA, 99 bp, Homo sapiens
  misc_feature 1..99: note = chr10:135002734-135002833
  misc_feature 1..99: note = hypo
  source 1..99: mol_type = genomic DNA
ccagtgtccgtccaccgtgagcccgtggctgccccgtgggccctgactcgggacggggcctgtgacacgggggcttcaagttaccgtgttctccctgcc

SEQ ID NO: 70947 - DNA, 23 bp, Homo sapiens
  misc_feature 1..23: note = chr10:135004548-135004571
  misc_feature 1..23: note = hypo
  source 1..23: mol_type = genomic DNA
taagccccaactggccgggcatg

SEQ ID NO: 70948 - DNA, 36 bp, Homo sapiens
  misc_feature 1..36: note = chr10:135008797-135008833
  misc_feature 1..36: note = hypo
  source 1..36: mol_type = genomic DNA
cagtcggggggctcccgggtccgtgaggtgggggct

SEQ ID NO: 70949 - DNA, 121 bp, Homo sapiens
  misc_feature 1..121: note = chr10:135010570-135010691
  misc_feature 1..121: note = hypo
  source 1..121: mol_type = genomic DNA
agctacctcctccagcgaggcatggacagccggaaaatccttgcccacctcagagcttccatctgccaggtgggctagaacagccaggccgccgcctcctccgccgcgcttagcttcctcc

SEQ ID NO: 70950 - DNA, 330 bp, Homo sapiens
  misc_feature 1..330: note = chr10:135011761-135012091
  misc_feature 1..330: note = hypo
  source 1..330: mol_type = genomic DNA
ctgggtgggatgagccggtggtgcggcacgtgctggggccactccgcccgcccacaccctcagccccctggctccccaggcttcctgccggtgaacagcgacaccgggcttgtggctgtgccagggcccgtgcccggccagcacccctgcggtgaagaagccacccagctgcctgcagcgttcacctccgaggccacgcacttcaagcccattgtcctcgcgcagaacgcaagtgtggccaggtgagcatcgtccccacaccccggagctgctgggtcccgggcgcaggcagcccctcctgagctctgctcctcccgtagggaccagcct

SEQ ID NO: 70951 - DNA, 398 bp, Homo sapiens
  misc_feature 1..398: note = chr10:135012320-135012718
  misc_feature 1..398: note = hypo
  source 1..398: mol_type = genomic DNA
cagagggggcctcatcggcagctcccggctctccagtccccgccccgcccacgaaggcatctgcgctgcccgtagagcaagggccggctgagccgatcccacctggagttgcttccgggggcctcaggcccgacgccctggggcccaccacggcccaccacggcccacgccacccgcccaagcccccacgaagcaaggccaccgagcgcccgggccaggagccagagggccccggggccacccctgccggggaacgtgatgaccagagtccagacagtgtcccagagaggccgcggcccgcagaccggaggctctgtctgccctgcgtggatgcctcgccactcccagggaggacggcctgcccgtcgctgcaggaggccacgcgcctcatccaggag

SEQ ID NO: 70952 - DNA, 716 bp, Homo sapiens
  misc_feature 1..716: note = chr10:135014688-135015404
  misc_feature 1..716: note = hypo
  source 1..716: mol_type = genomic DNA
tgatagcagagccagcgaggacagggcccggccccaccccggggcgagtacgagtttggaagcagtgagggcgcagagtggggctccatctggggagaggcctctctctgtcacccggccccgtgcggcagttcagggtcccagcatctcccctgcactgggaggcggcagccgtgcccggggggcgcccgtggtgggcgggtgcaagagagaagggcgtcgggtgtgcaagcaccaccggcctcccattaacagcctgcccgggctccgcccacaggagccactgtccacgtaacctgcgtctctttctttcaaggaaaagagaagccagccatggccaggaccagcagcagggccccctgctcacccacctcggtgtcggatgtggactcggacgcactgtcacggggaaacttcgaggtggggtttcggcctcagaggtccgtaaaagccgagagagcgcagcagcctgaggctggcgaggacagacggccagctggcggggcctcagacgtggaggcagtgacccgactggccaggtccaaaggggtcggcccagccttgtcccccggcccagccggattccagagctgcagccccggctggtgcagcgccttctacgaggccgactgcttcggggccgacgtccacaactacgtgaaggacctggggcggcagcaggcggacggggccctgcccgacgcccagagcccggt

SEQ ID NO: 70953 - DNA, 217 bp, Homo sapiens
  misc_feature 1..217: note = chr10:135016590-135016807
  misc_feature 1..217: note = hypo
  source 1..217: mol_type = genomic DNA
cactccacccccaaacgcacggcgtccagcggggagcactcggcccccaaacgcacggcgtccagcggggagcactcggcccccaaacgcacagagtccagcggggagcactcggcccccaaacgcacggcgtccagtggggagcactcggcccccaaacgcacagagtccagcggggagcactcggcccccaaactcacggcgtccagcggggagc

SEQ ID NO: 70954 - DNA, 563 bp, Homo sapiens
  misc_feature 1..563: note = chr10:135017049-135017612
  misc_feature 1..563: note = hypo
  source 1..563: mol_type = genomic DNA
atttcctcccttcagcgctgacccccacctactggtgccggccgtgtgtgctgggctcagcactgcgggtgccctggggctgtggagctggcatccgcgtctcctgctgttaaaacaagcgtggctcccagagtcagcgtggacagcactggtgtgggttcctcccccgtctgtctgcaccggtgaagcctggcctcgtgtttccctcctcactgccccacatgtggtgtggattttagttaccgtggatttattaaaatcagtcaagaccgtcctcctcatggagtccgcctgtggttcccgcgtgaggagcgcccccgacggacatcgagtctgactgtgaacggaggccgtggaggtgccggccagagaggagtctgcgtgagctgcactccagccaggcgggcatcgggctcgcaggcacccgcctccaggttcctggatgcgtcagggtacacagacctttcccaggagattttctcgacatcagcacctctgcaaatggatgggggtgagagggctggatggagcctggcgccggtgacctccgggggccggacgag

SEQ ID NO: 70955 - DNA, 35 bp, Homo sapiens
  misc_feature 1..35: note = chr10:135018010-135018045
  misc_feature 1..35: note = hypo
  source 1..35: mol_type = genomic DNA
cactgcccacactgccgtagcggggagcctggccc

SEQ ID NO: 70956 - DNA, 47 bp, Homo sapiens
  misc_feature 1..47: note = chr10:135018352-135018399
  misc_feature 1..47: note = hypo
  source 1..47: mol_type = genomic DNA
cctcacaggaggctgcgggccgagggctgccgcgcctctcacctctg

SEQ ID NO: 70957 - DNA, 167 bp, Homo sapiens
  misc_feature 1..167: note = chr10:135018825-135018992
  misc_feature 1..167: note = hypo
  source 1..167: mol_type = genomic DNA
gcatgaagcagtgcccggcggccctcgcccccagctcctgtgatcaggacctgcccgtctggcctcagtcctgcttccctcatggcgacagccctggggatgaggtccccggctccatctcgcaggcaggaactcagactctgggcaggttccggagaatcacaccc

SEQ ID NO: 70958 - DNA, 208 bp, Homo sapiens
  misc_feature 1..208: note = chr10:135020704-135020912
  misc_feature 1..208: note = hypo
  source 1..208: mol_type = genomic DNA
ccgcaccctgcgacacgctggacttcagccccctggacgagtcctcctcgctcatcttctacaacgtcaacaagcacccgggcggccggcagaaggcccgcatcctgcaggccggcacgccgctggggctcatggcctacctgtactccaggtgcgttgggagaaaagctcacccggaaaaggagacgtagcccggggtgctgagaag

SEQ ID NO: 70959 - DNA, 30 bp, Homo sapiens
  misc_feature 1..30: note = chr10:135022018-135022048
  misc_feature 1..30: note = hypo
  source 1..30: mol_type = genomic DNA
ccctctagagagggacgtggcccccccaac

SEQ ID NO: 70960 - DNA, 573 bp, Homo sapiens
  misc_feature 1..573: note = chr10:135023063-135023636
  misc_feature 1..573: note = hypo
  source 1..573: mol_type = genomic DNA
gtgtggctttgtccacgtgtgtggcgtgcgtgtctgtggttgtacagtttgtggcttgcatggcgtgagtgtgagtgctgtgcttccatggaaggagcgtctcctggccgtgatgtggtcacgaggggcttccccgctctgtggacctggtgggcgtcacctttgcagggcagcctggggctggggctgtggccacctgtgtcctcggaccccaggtgagtgggtgaccaggccccttgttccagggccacgccatctcctgcctgagactcctccagggtgggaggaggccttgccaggcctccgcttcctgaccgtggccgtcgggctcccaggacagtcccagacctgcaggcggggccctggtcagtgtctcctgagggtggcgcggtttcacccagtgaagacccagaacctttgagcgtgcagcattgcgcccggtcccgaggcaccagctccctcagcttcccgagctaacgggtcctgcgagtggagacgtcacaaagccctgcatagggctgcgttcagaaaggccctggtgttcagcagggcacggtggctcacgcctgtcat

SEQ ID NO: 70961 - DNA, 33 bp, Homo sapiens
  misc_feature 1..33: note = chr10:135025715-135025748
  misc_feature 1..33: note = hypo
  source 1..33: mol_type = genomic DNA
atatccacacctacacgtgtgcaccctcacgca

SEQ ID NO: 70962 - DNA, 30 bp, Homo sapiens
  misc_feature 1..30: note = chr10:135029314-135029344
  misc_feature 1..30: note = hypo
  source 1..30: mol_type = genomic DNA
agggtgggcaagagtcgtgcaggctcacac

SEQ ID NO: 70963 - DNA, 382 bp, Homo sapiens
  misc_feature 1..382: note = chr10:135030573-135030955
  misc_feature 1..382: note = hypo
  source 1..382: mol_type = genomic DNA
gggaagatggagagtcgcagacatgctgcacagtgtggatgtagttaacacggctgaaccgtgcactcagaaaaggctacaaaggtaaatcctctattacatactttttacaattaaaaatcaaaaggttaaaacaacagtgaaaaagtgtggcgaaatagttttatctcaaaattacatactttgcatctacttaaaccgatgaagaaacagactgagacgtcagcgtagaaagtgtatccggtaaacacttctcaagctcctctcaaggcgctcaggcaagagggctggggccgcagtcggggtgagcccaggatcacatgaggcgccttcagctgcacaggggccctgcagacaagagttgagcccgggggcaggcgcg

SEQ ID NO: 70964 - DNA, 62 bp, Homo sapiens
  misc_feature 1..62: note = chr10:135032634-135032696
  misc_feature 1..62: note = hypo
  source 1..62: mol_type = genomic DNA
aggccctctcctaaacgaactgctgtgcagagcctgccgcacccagacgcaggcaccacaga

SEQ ID NO: 70965 - DNA, 428 bp, Homo sapiens
  misc_feature 1..428: note = chr10:135035009-135035437
  misc_feature 1..428: note = hypo
  source 1..428: mol_type = genomic DNA
aatctcccaccctcccgtctcatctcatcgcctgccgttgtccacacacggtcaggtggaggctgcccaggccacggcggctccaccctcccccacggtagatggcctcacttggggagcaatgctcagcggaccaggtgcccatggatcctcagcctgataggtgaaggtccccttcttagatagccaccaatttaaaaacaataattataatatgccataaatgtatgcttatcgtaagagatcagaaaacccatgtcagcaaaagagaagttaaaaacttaaggtaggccagacgcggcggctcacgcctgtaaccctaggtaggccgggctgggtgcagccactcacgcctgtaaccctaggtgggcagggctgggtgcagccactcacgcctgtaaccctaggtaggccgggctgggtgcagc

SEQ ID NO: 70966 - DNA, 77 bp, Homo sapiens
  misc_feature 1..77: note = chr10:135037520-135037597
  misc_feature 1..77: note = hypo
  source 1..77: mol_type = genomic DNA
tcttcccggcgtgtgtgtgtgtgagagcccatccaggcttggcctttctttgccgtaatggacgcccctttctttgt

SEQ ID NO: 70967 - DNA, 464 bp, Homo sapiens
  misc_feature 1..464: note = chr10:135043162-135043626
  misc_feature 1..464: note = hyper
  source 1..464: mol_type = genomic DNA
gatgctggctgcagacgcgctgcagatggaagaagttcagattttaaaagctacttctgcgagcgcgtgaattccgacacccattcccgcggctggcgtggcttctcctcggacccatcccctggcctggcgactccccctgggacccgggtcggtcctccggacccctcgcgtgcaggtgctgagcccgggcgggggcggcgggggcgggggcagcactgggggccggacaagggggcgccagcgccttccggagcgggaggggctccgcacacacctcgacgggggcgggggtaggctcggcacaggctaaaaacgagcggagccgccggggcttaggcatcgcggcacctccgttgaacgggtctaagaacagaactcctgaggaccctccgtttccaaccgaagccagtctttgctctgcgtcttcccggccgcagcgccaggaccgaccccttaggacc

SEQ ID NO: 70968 - DNA, 565 bp, Homo sapiens; identical to SEQ ID NO: 33557
  misc_feature 1..565: note = chr10:135043826-135044391
  misc_feature 1..565: note = hyper
  source 1..565: mol_type = genomic DNA

SEQ ID NO: 70969 - DNA, 241 bp, Homo sapiens
  misc_feature 1..241: note = chr10:135044554-135044795
  misc_feature 1..241: note = hyper
  source 1..241: mol_type = genomic DNA
cggacgcctcccccgcccccggctccccgccagctcccgccccgaccgccctcgccacctgcatccccgaggaccgcgcgcccgtccgcggccccgggtccccgccgccacccccggcccgcgaagaccccgactcgccgcccggccgccccgaggactgcgcgccccctccggccgcgcccccgtcgctgaacaccgccctgctgcagaccctggggcacctgggcgacatcgcgaacat

SEQ ID NO: 70970 - DNA, 635 bp, Homo sapiens
  misc_feature 1..635: note = chr10:135048782-135049417
  misc_feature 1..635: note = hyper
  source 1..635: mol_type = genomic DNA
tggtcccagagtgctcggaggaggctcgggcgagtcgcgacggggccggcagcacgcgctgggcccggtgtctgtcctcaggccctggactcggggggagcgcgtttcggggactagctggactccgggctgtgcgtgggggcggtgctgtcggcctgggagtgacgcgggacttcctgcccagcgcaacccggcctggcccccgagggtgggggacagggcgacgcccgcggggaccacgctctggggcgtgcggggcgcaattcacggggctgggctgccccaggggctgggaggaaggaggcaggggggcgcccaagtctcctacccatggcagcgcatcagggcgcgtcccagagccgggggtggacggaggcttggaggcggaggctttggggacccccaagcctgggctagagcagcctcggcgggctctagagggagggtggagggaggggcccgggctgcaggaggcggggaggcctgagccacggtggtggggccgctgggcaggagagaggggctgcctgaccctgccgtgtgaaggtgaggttgtcttcgggcttggggggatcggagggggcggttcaggtggaggtggtggcggggggctgggaaaccggcaggaggggctc

SEQ ID NO: 70971 - DNA, 628 bp, Homo sapiens; identical to SEQ ID NO: 33560
  misc_feature 1..628: note = chr10:135049727-135050355
  misc_feature 1..628: note = hyper
  source 1..628: mol_type = genomic DNA

SEQ ID NO: 70972 - DNA, 554 bp, Homo sapiens
  misc_feature 1..554: note = chr10:135050356-135050910
  misc_feature 1..554: note = hyper
  source 1..554: mol_type = genomic DNA
tcctaccctcggcatggctgcctcccacccggtcacgtcggtccccgcgccccacgccgacgcgcaggcgacccggggacgcggagacgcagacagctcgggactcaggttcgtgggagcagcggccgcgcgtggctatgaccgtcccgggggcccgtgctcagggcgtccccgtgaggtttgggcgccacagtcaccggcggctctgcccgcgccctggccacagtggggacagcctggcttggcggggacgcaccagtcccgccgccgacgcggagttcctaccccgccgtgcgaggcagtggctccggcccttccagctcgggatggagtcagggagccgcccgcgcccgaatgcagaggctcctgcgatggccccggagtgagtcccccagaggagccggattagggctggaggcggccgagtcccccgagaggcccctcccgacattcccgcccccgcgcgccgctccccgggtcctccgcgtctctttcccgggaaagcctccctcggttcctgcgcggccgcacagcctggacgcagcgcacgcggg

SEQ ID NO: 70973 - DNA, 50 bp, Homo sapiens
  misc_feature 1..50: note = chr10:135064477-135064527
  misc_feature 1..50: note = hypo
  source 1..50: mol_type = genomic DNA
gaggagcccagggcccgtcttcctgctggccccatcggctggagcctggg

SEQ ID NO: 70974 - DNA, 30 bp, Homo sapiens
  misc_feature 1..30: note = chr10:135066354-135066384
  misc_feature 1..30: note = hypo
  source 1..30: mol_type = genomic DNA
gaaacctgtgtccaccgtgtgacctggcaa

SEQ ID NO: 70975 - DNA, 165 bp, Homo sapiens
  misc_feature 1..165: note = chr10:135069783-135069948
  misc_feature 1..165: note = hypo
  source 1..165: mol_type = genomic DNA
ttcctgcttgtaaaacgacacattgttatgatggagaattgtgagtactgcagaaaagaaataagttttgccaccaaaggcgatcactgtggatcatgccggttcctgcacacctgtggggtgctctgagcgtggactccccacgcgagccgtccagacgtgctc

SEQ ID NO: 70976 - DNA, 202 bp, Homo sapiens
  misc_feature 1..202: note = chr10:135076386-135076588
  misc_feature 1..202: note = hypo
  source 1..202: mol_type = genomic DNA
acacacacacgcacccgcaagcacacagctcatcccagcctggtgcctgcagacagctggggctacacgtggccaaggcggggagaaggaattggctgagggcgtggacagcaggagcctctcaggtagatgcattcctgaggttagaacagcagctgagcctgcaaagtcagggtctagggctgagcggcactagctggac

SEQ ID NO: 70977 - DNA, 81 bp, Homo sapiens
  misc_feature 1..81: note = chr10:135078929-135079010
  misc_feature 1..81: note = hypo
  source 1..81: mol_type = genomic DNA
tatttctgcaactcacgtacaagtctgaagttagttcaaataaaaagttaaaaaggaaagagagaaatagaaaatcactat

SEQ ID NO: 70978 - DNA, 47 bp, Homo sapiens
  misc_feature 1..47: note = chr10:135084770-135084817
  misc_feature 1..47: note = hypo
  source 1..47: mol_type = genomic DNA
ttgcagcagcggttccggcagtcctggggcgacggcaaaggccttgg

SEQ ID NO: 70979 - DNA, 90 bp, Homo sapiens
  misc_feature 1..90: note = chr10:135086744-135086834
  misc_feature 1..90: note = hypo
  source 1..90: mol_type = genomic DNA
caagggtgctcaccccgggccgaggcctgaagacggctgccgtccggggtcccaggaggctgcccaggctgtcgtcgctgaccccgcagg

SEQ ID NO: 70980 - DNA, 233 bp, Homo sapiens
  misc_feature 1..233: note = chr10:135087412-135087645
  misc_feature 1..233: note = hypo
  source 1..233: mol_type = genomic DNA
cagcccctacctgcccgcccagctgctccgcccgacccatacctgcccgcgaggctgctccgtcacctcggagccattggcagccgtataggtctctgtgtagccggagcccagcaggtccctggaaaagaagtgctgtgactgcctcggccccctcggtgcagagaggctggcccagaggctggacgccggggacaccagtgtgctggagccaggcccgggcaggggggccg

SEQ ID NO: 70981 - DNA, 205 bp, Homo sapiens
  misc_feature 1..205: note = chr10:135124038-135124243
  misc_feature 1..205: note = hypo
  source 1..205: mol_type = genomic DNA
gggtgtgggaatgagcgggcgcagcgcctccgcactcacacccctctgggccatgcctgtacctcctgcagcagtcggccgtggtcatccgcactcacacccctcggggccgtgtctgtacctcctgcagccgtcggccgtgctcacacatcatgcagccctggctttccttttgtcctggttggttgtgcgcatatgaacttga

SEQ ID NO: 70982 - DNA, 40 bp, Homo sapiens
  misc_feature 1..40: note = chr10:135133094-135133134
  misc_feature 1..40: note = hypo
  source 1..40: mol_type = genomic DNA
tcctgtctgtgtgtccgtgttcacacgctcacacacgtca

SEQ ID NO: 70983 - DNA, 810 bp, Homo sapiens
  misc_feature 1..810: note = chr10:135138920-135139730
  misc_feature 1..810: note = hyper
  source 1..810: mol_type = genomic DNA
gaagcctccggtggacgtgaaatctttacttagagaaaagcgacagagtcagagacccacgggggcggggctgcagcgagggcgcctggggacacgaacacggcggagagcatcgggagacgcgctggtcacaggagctggcggaggacgctgcggagacagagcccgagggttgagagcggcgacgcggccaggggctccccgcggaccccgcgtcacccggcgggctcggattcgcaacccccaaccccgaggttctggcgggccgggtcggagggaagaggaagggaagggtggcgggggtctttggctcagaagcggtggcgggaggccaggaagagacctgggcagagccggccggagccccgcggcgcgcacctaccccgggccgggctgcggggctggagacgtcactgcgcgggcgggggcgccgcgctcccggccgccttccgcgccgcctccttctccgccttggccgacggcttcccggggggttcggtggccgccgccgccgccccagcctgggtgggccccttgcgctcctccttggctgcgcggtagccgtccccccaggccgccggcgtctccgtgccgtgcttgcggctcagcgggtaggccccgatggccgccaggatgctgcggtggcgctcggggtccatctccgtgtagtacatctccagggtcagcggcgtgcagatcttgtgctgcgggaggggccgggtcagggtcggtggggctgagccctcctgtgcgccccgggcccaggccctcccgcttctgcggttggggacactgcggacagtttgtaat

SEQ ID NO: 70984 - DNA, 319 bp, Homo sapiens
  misc_feature 1..319: note = chr10:135148783-135149102
  misc_feature 1..319: note = hyper
  source 1..319: mol_type = genomic DNA
aagggggcgcagtcccgcaccagggcccgcagcgccatagggtagggccacgccccggagggcccgcgccaggagtctccgcccgaacccccgctcgggcaggacccccgccaggaggagctgcgcttgaggggtccccttcgagccaaacttcaaatccaactcctcggacggccaatttacgtcatcgcgggtttccatggcaacgcagacaggcccgagacgcgtcttcaggaagaaaaagccattgggggcccactggagcctcgcttctggttccgggcccagcgccccgggcggaatgcggggttggaaaggg

SEQ ID NO: 70985 - DNA, 253 bp, Homo sapiens
  misc_feature 1..253: note = chr10:135150325-135150578
  misc_feature 1..253: note = hyper
  source 1..253: mol_type = genomic DNA
gaaatagctcacaggcggctccactggcagctgctgcaggacgcggtcggggaggacgacgatgcggatgtggatgcggaggatgcggttccagacgcttcgcggccgggcggggcgggggctgcagctgcgagaccgaggctgtggtcgccatggaaacgcggctagaggcggggcctcgactctggtcccgcaccctctacccccacccaccgccccggctagggagccgcgcatgcgcccctcagaccct

SEQ ID NO: 70986 - DNA, 79 bp, Homo sapiens
  misc_feature 1..79: note = chr10:135159573-135159652
  misc_feature 1..79: note = hypo
  source 1..79: mol_type = genomic DNA
tcgggtggggtcaggcggagattggaattgtgtttttgttttacagggtgtgccagggacggctaaagaaggtggtcag

SEQ ID NO: 70987 - DNA, 30 bp, Homo sapiens; identical to SEQ ID NO: 42836
  misc_feature 1..30: note = chr10:135162912-135162942
  misc_feature 1..30: note = hypo
  source 1..30: mol_type = genomic DNA

SEQ ID NO: 70988 - DNA, 115 bp, Homo sapiens
  misc_feature 1..115: note = chr10:135170721-135170836
  misc_feature 1..115: note = hyper
  source 1..115: mol_type = genomic DNA
gcagatggaggaggccgggaagttcaagtccgcaagaactaaacagccgggaggacagcccgtgtcggcacctatccctgccctcggggtcggcgccgcccgtcctcccacccag

SEQ ID NO: 70989 - DNA, 43 bp, Homo sapiens
  misc_feature 1..43: note = chr10:135208594-135208637
  misc_feature 1..43: note = hypo
  source 1..43: mol_type = genomic DNA
gcccagattaagacccgtggaagggcccggcccggtggctcac

SEQ ID NO: 70990 - DNA, 345 bp, Homo sapiens; identical to SEQ ID NO: 33566
  misc_feature 1..345: note = chr10:135236927-135237272
  misc_feature 1..345: note = hyper
  source 1..345: mol_type = genomic DNA

SEQ ID NO: 70991 - DNA, 30 bp, Homo sapiens
  misc_feature 1..30: note = chr10:135269174-135269204
  misc_feature 1..30: note = hypo
  source 1..30: mol_type = genomic DNA
gagatgctcagagaccggagggtgagatcc

SEQ ID NO: 70992 - DNA, 80 bp, Homo sapiens
  misc_feature 1..80: note = chr10:13571373-13571453
  misc_feature 1..80: note = hyper
  source 1..80: mol_type = genomic DNA
gggcgccccggggcccgacgcgctgattttaagcaagttttagggggaaaaaacttacccatttgcgctctctctagaag

SEQ ID NO: 70993 - DNA, 30 bp, Homo sapiens
  misc_feature 1..30: note = chr10:1367578-1367608
  misc_feature 1..30: note = hypo
  source 1..30: mol_type = genomic DNA
tttagctgtttggggcgagggttcatatcc

SEQ ID NO: 70994 - DNA, 30 bp, Homo sapiens
  misc_feature 1..30: note = chr10:13706037-13706067
  misc_feature 1..30: note = hypo
  source 1..30: mol_type = genomic DNA
tgccattcaattaaccgggagaacacaccc

SEQ ID NO: 70995 - DNA, 40 bp, Homo sapiens
  misc_feature 1..40: note = chr10:13715561-13715601
  misc_feature 1..40: note = hypo
  source 1..40: mol_type = genomic DNA
gcacacatgtgcatgcgtgcgcgcgcgcacacacacacac

SEQ ID NO: 70996 - DNA, 30 bp, Homo sapiens
  misc_feature 1..30: note = chr10:13725649-13725679
  misc_feature 1..30: note = hypo
  source 1..30: mol_type = genomic DNA
ggtggaacccacagccgggagctaactggg

SEQ ID NO: 70997 - DNA, 149 bp, Homo sapiens; identical to SEQ ID NO: 42529
  misc_feature 1..149: note = chr10:13751257-13751406
  misc_feature 1..149: note = hypo
  source 1..149: mol_type = genomic DNA

SEQ ID NO: 70998 - DNA, 41 bp, Homo sapiens
  misc_feature 1..41: note = chr10:13771406-13771447
  misc_feature 1..41: note = hypo
  source 1..41: mol_type = genomic DNA
agagaacgataaatccgcggcgcactcggcagaacgtacac

SEQ ID NO: 70999 - DNA, 43 bp, Homo sapiens
  misc_feature 1..43: note = chr10:1383819-1383862
  misc_feature 1..43: note = hypo
  source 1..43: mol_type = genomic DNA
caccagagaacaacgtgccctgcaacggcgataatcagcatca

SEQ ID NO: 71000 - DNA, 30 bp, Homo sapiens
  misc_feature 1..30: note = chr10:13854970-13855000
  misc_feature 1..30: note = hypo
  source 1..30: mol_type = genomic DNA
gtcgctgatgaattacgaagtagaatgcaa

SEQ ID NO: 71001 - DNA, 161 bp, Homo sapiens; identical to SEQ ID NO: 42530
  misc_feature 1..161: note = chr10:13898478-13898639
  misc_feature 1..161: note = hypo
  source 1..161: mol_type = genomic DNA

SEQ ID NO: 71002 - DNA, 103 bp, Homo sapiens
  misc_feature 1..103: note = chr10:13933436-13933539
  misc_feature 1..103: note = hyper
  source 1..103: mol_type = genomic DNA
acagtatgtgccccacgtgggatttgcatttaaaaactgtaacatacgcgaaataaacgactccaggcccccagtaaagaagcagcggcgcgtcccttttccc

SEQ ID NO: 71003 - DNA, 339 bp, Homo sapiens; identical to SEQ ID NO: 3509
  misc_feature 1..339: note = chr10:13933596-13933935
  misc_feature 1..339: note = hyper
  source 1..339: mol_type = genomic DNA

SEQ ID NO: 71004 - DNA, 14 bp, Homo sapiens
  misc_feature 1..14: note = chr10:13933982-13933996
  misc_feature 1..14: note = hyper
  source 1..14: mol_type = genomic DNA
cgccaccgcccgcc

SEQ ID NO: 71005 - DNA, 129 bp, Homo sapiens; identical to SEQ ID NO: 3511
  misc_feature 1..129: note = chr10:13933997-13934126
  misc_feature 1..129: note = hyper
  source 1..129: mol_type = genomic DNA

SEQ ID NO: 71006 - DNA, 243 bp, Homo sapiens
  misc_feature 1..243: note = chr10:13934168-13934411
  misc_feature 1..243: note = hyper
  source 1..243: mol_type = genomic DNA
cggaggtccccaagcgggggacccctggctcccccacaaaacccacccaaagccaccgctcgaggccctctcctaccctgagagcccggagacagcagctcccttggctgaaggcacagctcttacccctcgatctagtccaattgtattgaattttaatctcccctcaactcttcaatggaagttgctgcaggataaccgaggcatgtggctattgtcaaggcttcgcgacaatgactggga

SEQ ID NO: 71007 - DNA, 45 bp, Homo sapiens
  misc_feature 1..45: note = chr10:14000240-14000285
  misc_feature 1..45: note = hypo
  source 1..45: mol_type = genomic DNA
ggaatgtaaaacagtcgcgtgaacaacagccatgaccattgtttt

SEQ ID NO: 71008 - DNA, 30 bp, Homo sapiens
  misc_feature 1..30: note = chr10:1406940-1406970
  misc_feature 1..30: note = hypo
  source 1..30: mol_type = genomic DNA
cggcttcccaggtatcgtgttattcactaa

SEQ ID NO: 71009 - DNA, 79 bp, Homo sapiens
  misc_feature 1..79: note = chr10:1416159-1416238
  misc_feature 1..79: note = hypo
  source 1..79: mol_type = genomic DNA
ttcctagtgaaaccgcgtggactccgtgcacctttcctagtgaaacccgcttccagtgagactccgtgggtggcatccc

SEQ ID NO: 71010 - DNA, 23 bp, Homo sapiens
  misc_feature 1..23: note = chr10:14166365-14166388
  misc_feature 1..23: note = hypo
  source 1..23: mol_type = genomic DNA
aaactgaagctcagacgaattta

SEQ ID NO: 71011 - DNA, 30 bp, Homo sapiens
  misc_feature 1..30: note = chr10:1418261-1418291
  misc_feature 1..30: note = hypo
  source 1..30: mol_type = genomic DNA
catgaacacacatcacgacacacacacaca

SEQ ID NO: 71012 - DNA, 242 bp, Homo sapiens
  misc_feature 1..242: note = chr10:14215671-14215913
  misc_feature 1..242: note = hyper
  source 1..242: mol_type = genomic DNA
ggtacttcctgcaaacgaacagctccgagggctgcacggccccaaagcaagagtgactggaaatcctgctaaaatatggctgtctaatcaaccgagaggcgaactcatttactgaggttcccattgtccacgctgacagatggctcgctcccctctctgctctccccttcccctcagatcgcgctgccgtgcaggcaagcctattctttgagagatccagttgcaatcgccagcctagttct

SEQ ID NO: 71013 - DNA, 106 bp, Homo sapiens; identical to SEQ ID NO: 32899
  misc_feature 1..106: note = chr10:14216190-14216296
  misc_feature 1..106: note = hyper
  source 1..106: mol_type = genomic DNA

SEQ ID NO: 71014 - DNA, 64 bp, Homo sapiens
  misc_feature 1..64: note = chr10:1438451-1438515
  misc_feature 1..64: note = hypo
  source 1..64: mol_type = genomic DNA
ccttgagagtgctgccggactgaacttcccatccctgtccccaccccctcggtgacccatcgca

SEQ ID NO: 71015 - DNA, 92 bp, Homo sapiens
  misc_feature 1..92: note = chr10:1443474-1443566
  misc_feature 1..92: note = hypo
  source 1..92: mol_type = genomic DNA
cccatgggaaggaggcgtgatgatggtaagcagcacagagccctgcggggaccagggttttggaacaccccggccttcggtcatgctgcggg

SEQ ID NO: 71016 - DNA, 38 bp, Homo sapiens
  misc_feature 1..38: note = chr10:1451436-1451474
  misc_feature 1..38: note = hypo
  source 1..38: mol_type = genomic DNA
gcgggctcccaccttcgtcgccccgccctgcctgacgg

SEQ ID NO: 71017 - DNA, 124 bp, Homo sapiens
  misc_feature 1..124: note = chr10:14966088-14966212
  misc_feature 1..124: note = hypo
  source 1..124: mol_type = genomic DNA
gacacacatcaagtacgaagcagagaaagatgtttccacacaaggtactgagctgccgcaggctgtgtgctcacgctaacgggagtgcttgctctctctcactcgcgtgcgctctctctcaata

SEQ ID NO: 71018 - DNA, 41 bp, Homo sapiens
  misc_feature 1..41: note = chr10:14996911-14996952
  misc_feature 1..41: note = hypo
  source 1..41: mol_type = genomic DNA
aacccagaacactttcgctttattttatttatttattcagt

SEQ ID NO: 71019 - DNA, 101 bp, Homo sapiens
  misc_feature 1..101: note = chr10:14997192-14997293
  misc_feature 1..101: note = hypo
  source 1..101: mol_type = genomic DNA
agtgctgggtgagccattgtacctggctttccaggcctccataacacttgaagtcccactttgtgcacagcactgtgacaaaccttcgggtagcattcaat

SEQ ID NO: 71020 - DNA, 24 bp, Homo sapiens
  misc_feature 1..24: note = chr10:15000601-15000625
  misc_feature 1..24: note = hypo
  source 1..24: mol_type = genomic DNA
aacatgtaaattggccgggcgcgg

SEQ ID NO: 71021 - DNA, 120 bp, Homo sapiens
  misc_feature 1..120: note = chr10:15003045-15003165
  misc_feature 1..120: note = hypo
  source 1..120: mol_type = genomic DNA
ataaataaaataacatgctcctcaatttaactatgggattatgtcccaatacacccatggtaggtcgaaaatgcatttaatgcacctagccaactttaaacgtcctcagaacacttagct

SEQ ID NO: 71022 - DNA, 141 bp, Homo sapiens
  misc_feature 1..141: note = chr10:15003225-15003366
  misc_feature 1..141: note = hypo
  source 1..141: mol_type = genomic DNA
tgtcatgtaacttactgaatactgaattcaaagtggaaaacagaatggttgcgtgggtactcgaattactgaatgcgtattgcttttgcaccatggtaaagtggagatatgagttgaaccattccacgggaccatctgtat

SEQ ID NO: 71023 - DNA, 30 bp, Homo sapiens
  misc_feature 1..30: note = chr10:15009037-15009067
  misc_feature 1..30: note = hypo
  source 1..30: mol_type = genomic DNA
ctctcatcttattaacggggagaggcccag

SEQ ID NO: 71024 - DNA, 19 bp, Homo sapiens
  misc_feature 1..19: note = chr10:15026279-15026298
  misc_feature 1..19: note = hypo
  source 1..19: mol_type = genomic DNA
tttccgaggagatttcgtc

SEQ ID NO: 71025 - DNA, 332 bp, Homo sapiens
  misc_feature 1..332: note = chr10:1506252-1506584
  misc_feature 1..332: note = hypo
  source 1..332: mol_type = genomic DNA
tggaggggccaggaccgccacacacatgcgctgggggcagtcacagcgggcagtgtgccggagaagagggtggacacacactcccccacacacgcgcggggggcagtcacagcgggcagtgcgccggagaagagggtggacacacactcccccacacacgcgctggggacagtcacagcgggcagtgcgccggagaagagggtggacacacactcccccacacacgcgctggggacagtcacagcaggcagcgcgccggagaagagggtggacacacactcccccacacacgcgcgggggccagtcacagcgggcagcgtgctggagaagag

SEQ ID NO: 71026 - DNA, 23 bp, Homo sapiens
  misc_feature 1..23: note = chr10:15131223-15131246
  misc_feature 1..23: note = hypo
  source 1..23: mol_type = genomic DNA
taaatatgtattggccgggcgcg

SEQ ID NO: 71027 - DNA, 120 bp, Homo sapiens
  misc_feature 1..120: note = chr10:15140508-15140628
  misc_feature 1..120: note = hypo
  source 1..120: mol_type = genomic DNA
cctcgccagccaacttatttcttttaatactgagatacctttctttactccatacttcctttggtaggcattgtttagatgtaggttaagaggtccggcccggcgcggtggctcacgcct

SEQ ID NO: 71028 - DNA, 24 bp, Homo sapiens
  misc_feature 1..24: note = chr10:15140868-15140892
  misc_feature 1..24: note = hypo
  source 1..24: mol_type = genomic DNA
atgagactccgtctcaaaaaaaaa

SEQ ID NO: 71029 - DNA, 30 bp, Homo sapiens
  misc_feature 1..30: note = chr10:15255450-15255480
  misc_feature 1..30: note = hypo
  source 1..30: mol_type = genomic DNA
caaggagacgaaccacgcccgggggtgcgg

SEQ ID NO: 71030 - DNA, 30 bp, Homo sapiens; identical to SEQ ID NO: 42535
  misc_feature 1..30: note = chr10:15255872-15255902
  misc_feature 1..30: note = hypo
  source 1..30: mol_type = genomic DNA

SEQ ID NO: 71031 - DNA, 51 bp, Homo sapiens
  misc_feature 1..51: note = chr10:15412536-15412587
  misc_feature 1..51: note = hyper
  source 1..51: mol_type = genomic DNA
cccggcgtggggagccgggagcgcgatcgggcggcgcgccctgggcggccc

SEQ ID NO: 71032 - DNA, 30 bp, Homo sapiens; identical to SEQ ID NO: 42536
  misc_feature 1..30: note = chr10:15484112-15484142
  misc_feature 1..30: note = hypo
  source 1..30: mol_type = genomic DNA

SEQ ID NO: 71033 - DNA, 82 bp, Homo sapiens
  misc_feature 1..82: note = chr10:15536670-15536752
  misc_feature 1..82: note = hypo
  source 1..82: mol_type = genomic DNA
ataatagcaatcatattgtgtatgctcacgacagtgtttgtatgcatttttttttaaatatgtgtttcggagatctttccat

SEQ ID NO: 71034 - DNA, 30 bp, Homo sapiens; identical to SEQ ID NO: 42442
  misc_feature 1..30: note = chr10:1555620-1555650
  misc_feature 1..30: note = hypo
  source 1..30: mol_type = genomic DNA

SEQ ID NO: 71035 - DNA, 29 bp, Homo sapiens
  misc_feature 1..29: note = chr10:15568455-15568484
  misc_feature 1..29: note = hypo
  source 1..29: mol_type = genomic DNA
tgagccaccgcacccggcccattataaga

SEQ ID NO: 71036 - DNA, 244 bp, Homo sapiens
  misc_feature 1..244: note = chr10:1558592-1558836
  misc_feature 1..244: note = hypo
  source 1..244: mol_type = genomic DNA
cctgcttgtgaccagcgtgcattctcgacatacacgcttcagaccaaatgtctgcttgttcacctgtgcgggctttgtgtgggctgctctgtgctatgcgggctgctctgtgcgggctgctctgtgctgtgtgggctgctctgctctgtgcgggctgctgtgtgctgtgcgggctgctctgtgcttgggaaaatgaaggttggcatgatttcctgcggcaatgccctcccgttttatgccttaa

SEQ ID NO: 71037 - DNA, 927 bp, Homo sapiens
  misc_feature 1..927: note = chr10:15760927-15761854
  misc_feature 1..927: note = hyper
  source 1..927: mol_type = genomic DNA
tgggcgccacaaaaccgtgcgcatgcaatgcagtctctgtaacctcctgcccggggacactggggcaggcgtggagggcatgaacgtatttatgatgaggaccgactgtcaaacttgatttcctcttggaaacgggggtccgcaacctggtttgcaagaatgcaaacggtcctgcttctctaggtggagctctgtgggtacagtgagatgagagaagggggtggggtaggaggaagccaaggacagagcccagctgctggtagccgacagctcttgcgcccagacgcaatggttacagactctgcataaacagacctcgctgtggtggcggttttaactggcttgggtcttctgggtcctgttctctcctttgtaggatgcgtgcgtcttggtacctggaacacccaggacttgcgtgttctatgcaagtggcatgtctctagctcaaaattcacaaggcacatctagcatggcaggggagagaaggggctggtggcggggagagggacgggaccccgggcaggcggcaggacggggatcccaggctgcggggggactccgcggcagagccgctgggacctgacccgggagcgccttcgtccccgcgcgcacctccccgggtcgggcgacttacgtgcgggcgtcgggtatgtggaagtccacggcgtagccgaagtagctgcccttggggccgctgtacactgtgagcttttccacgtccaggttgaacgcctgacaggcgggggaccacagcaacatccccagcgcggccgcggcgcagcagaggggcgcgatcagcggcgcctggcttccccggggaccgcggctggccccgggcgacatctccctccgccccggtgggtggctgctacccaggagcgcgagccgaggacccctgcggggcaaggggggctggtggaatctggc

SEQ ID NO: 71038 - DNA, 259 bp, Homo sapiens; identical to SEQ ID NO: 32901
  misc_feature 1..259: note = chr10:15761855-15762114
  misc_feature 1..259: note = hyper
  source 1..259: mol_type = genomic DNA

SEQ ID NO: 71039 - DNA, 30 bp, Homo sapiens
  misc_feature 1..30: note = chr10:15762409-15762439
  misc_feature 1..30: note = hyper
  source 1..30: mol_type = genomic DNA
tatacaagaaagcctcgagggttttttttt

SEQ ID NO: 71040 - DNA, 31 bp, Homo sapiens
  misc_feature 1..31: note = chr10:15783191-15783222
  misc_feature 1..31: note = hypo
  source 1..31: mol_type = genomic DNA
agccactatgcccggccgtgattattaaatg

SEQ ID NO: 71041 - DNA, 129 bp, Homo sapiens
  misc_feature 1..129: note = chr10:1585292-1585421
  misc_feature 1..129: note = hypo
  source 1..129: mol_type = genomic DNA
gattccaccctggggcggtgtggggtggcttccctgctctccctgctctctgcgttcccacggtgcaggatggcggcgttgagagccagaaacgaaaccctgagaagcagaagccgggcgtcctgcccg

SEQ ID NO: 71042 - DNA, 28 bp, Homo sapiens
  misc_feature 1..28: note = chr10:15932007-15932035
  misc_feature 1..28: note = hypo
  source 1..28: mol_type = genomic DNA
ctgtgaaatcacacgatgccaagcatta

SEQ ID NO: 71043 - DNA, 194 bp, Homo sapiens
  misc_feature 1..194: note = chr10:16086369-16086563
  misc_feature 1..194: note = hypo
  source 1..194: mol_type = genomic DNA
ttgttgggtctttttcgcttggaaaaagtagcaaatggcaatatctgaaagggacattttacttttttttcttttaataaagcaattcaagattgccggtgccatatattcaaatgctcaaatcacgcacacacccaaagcatccacagtggcttatatgacatattcaccaacaacatcgccatctccaattt

SEQ ID NO: 71044 - DNA, 30 bp, Homo sapiens
  misc_feature 1..30: note = chr10:1621521-1621551
  misc_feature 1..30: note = hypo
  source 1..30: mol_type = genomic DNA
catggttatgtgtgccgctgaatcatgtaa

SEQ ID NO: 71045 - DNA, 30 bp, Homo sapiens
  misc_feature 1..30: note = chr10:16468573-16468603
  misc_feature 1..30: note = hypo
  source 1..30: mol_type = genomic DNA
gaatcttgacttagccgtttattagctatg

SEQ ID NO: 71046 - DNA, 258 bp, Homo sapiens; identical to SEQ ID NO: 32902
  misc_feature 1..258: note = chr10:16562368-16562626
  misc_feature 1..258: note = hyper
  source 1..258: mol_type = genomic DNA

SEQ ID NO: 71047 - DNA, 46 bp, Homo sapiens; identical to SEQ ID NO: 3516
  misc_feature 1..46: note = chr10:16562627-16562673
  misc_feature 1..46: note = hyper
  source 1..46: mol_type = genomic DNA

SEQ ID NO: 71048 - DNA, 956 bp, Homo sapiens; identical to SEQ ID NO: 3517
  misc_feature 1..956: note = chr10:16562709-16563665
  misc_feature 1..956: note = hyper
  source 1..956: mol_type = genomic DNA

SEQ ID NO: 71049 - DNA, 354 bp, Homo sapiens
  misc_feature 1..354: note = chr10:16563690-16564044
  misc_feature 1..354: note = hyper
  source 1..354: mol_type = genomic DNA
cgcgtgggcccgggcgtcccccgggtgcgcccagcggcggcggcggcgggcacggtcggcacggcgaggctcagagctggggcggaggagcgagcgagcagcggcgagcgcctcacggccgggagcggagcgagagagagactgaaggcagaattctgcctgggtaccacctgccaggagaagaggaggctgacaaacgcgcgccggagcaatttataggcacccaaggcacagaggaaggggagccgctttggcatctcattgcagcatctgctctgctcatcccactcagagagagtttggcattactctgacaatgtgggatttttttttttttttcggcctctctttttt

SEQ ID NO: 71050 - DNA, 149 bp, Homo sapiens
  misc_feature 1..149: note = chr10:1669194-1669343
  misc_feature 1..149: note = hypo
  source 1..149: mol_type = genomic DNA
gtcccaccttttccccgggccccggcgcacccgctagcaccgctttctgcccaccctggcctggacgcctctccctccccacaggctcacacatcagtcacccactcgaactggagccgggccctcgggtgaatcgttagctcctcgag

SEQ ID NO: 71051 - DNA, 30 bp, Homo sapiens; identical to SEQ ID NO: 42540
  misc_feature 1..30: note = chr10:16714330-16714360
  misc_feature 1..30: note = hypo
  source 1..30: mol_type = genomic DNA

SEQ ID NO: 71052 - DNA, 49 bp, Homo sapiens
  misc_feature 1..49: note = chr10:16715583-16715632
  misc_feature 1..49: note = hypo
  source 1..49: mol_type = genomic DNA
atgtttcttgaagcacgtgatcatgcctgactggcgctggatgtccctg

SEQ ID NO: 71053 - DNA, 96 bp, Homo sapiens
  misc_feature 1..96: note = chr10:16928712-16928808
  misc_feature 1..96: note = hypo
  source 1..96: mol_type = genomic DNA
gaagatgaagatgaccgagatggagcagaagaaagaacgcccaatggtagtatttactaaaagcagggcacatatattaattttttctttttgaga

SEQ ID NO: 71054 - DNA, 30 bp, Homo sapiens
  misc_feature 1..30: note = chr10:17050934-17050964
  misc_feature 1..30: note = hypo
  source 1..30: mol_type = genomic DNA
atacatcatgatttacgtcttgcatttaac

SEQ ID NO: 71055 - DNA, 78 bp, Homo sapiens
  misc_feature 1..78: note = chr10:17079889-17079967
  misc_feature 1..78: note = hypo
  source 1..78: mol_type = genomic DNA
aaccacaacctctctcgactgctcttcccttggctcccatgacacagtcacctttttttttttttttagacagggtct

SEQ ID NO: 71056 - DNA, 38 bp, Homo sapiens
  misc_feature 1..38: note = chr10:1708651-1708689
  misc_feature 1..38: note = hypo
  source 1..38: mol_type = genomic DNA
ctgtgttcccccaatcgtgttcccgcaggaaagctgcc

SEQ ID NO: 71057 - DNA, 35 bp, Homo sapiens
  misc_feature 1..35: note = chr10:1714389-1714424
  misc_feature 1..35: note = hypo
  source 1..35: mol_type = genomic DNA
cacgggcactgccaacgccccgtctttcaacctcc

SEQ ID NO: 71058 - DNA, 186 bp, Homo sapiens
  misc_feature 1..186: note = chr10:1716294-1716480
  misc_feature 1..186: note = hypo
  source 1..186: mol_type = genomic DNA
ggaggccactgggaacggccccgtcggccgggggcccaggaatcagccctgtgcagagtgcattccgtaatgtgtgcaccttctctacttcagaaaaaaatattctttgaaagatccattttttaaagcctccaacccccttgtgagaaaattggcaactgtgggggcccccgcagcctcaaattt

SEQ ID NO: 71059 - DNA, 30 bp, Homo sapiens
  misc_feature 1..30: note = chr10:1725740-1725770
  misc_feature 1..30: note = hypo
  source 1..30: mol_type = genomic DNA
gtttgccctcagatccgcttgggtctttgt

SEQ ID NO: 71060 - DNA, 170 bp, Homo sapiens
  misc_feature 1..170: note = chr10:17270234-17270404
  misc_feature 1..170: note = hyper
  source 1..170: mol_type = genomic DNA
gatctgggaggcccacgtatggcgcctctccaaaggctgcagaagtttcttgctaacaaaaagtccgcacattcgagcaaagacaggctttagcgagttattaaaaacttaggggcgctcttgtcccccacagggcccgaccgcacacagcaaggcgatggcccagctgt

SEQ ID NO: 71061 - DNA, 602 bp, Homo sapiens
  misc_feature 1..602: note = chr10:17270653-17271255
  misc_feature 1..602: note = hyper
  source 1..602: mol_type = genomic DNA
cccccaacatctctccgccaaggcaagtcgatggacagaggcgcgggccggagcagcccccctttccaagcgggcggcgcgcgaggctgcggcgaggcctgagccctgcgttcctgcgctgtgcgcgcccccaccccgcgttccaatctcaggcgctctttgtttctttctccgcgacttcagatctgagggattccttactctttcctcttcccgctcctttgcccgcgggtctccccgcctgaccgcagccccgagaccgccgcgcacctcctcccacgcccctttggcgtggtgccaccggacccctctggttcagtcccaggcggacccccccctcaccgcgcgaccccgcctttttcagcaccccagggtgagcccagctcagactatcatccggaaagcccccaaaagtcccagcccagcgctgaagtaacgggaccatgcccagtcccaggccccggagcaggaaggctcgagggcgcccccaccccacccgcccaccctccccgcttctcgctaggtccctattggctggcgcgctccgcggctgggatggcagtgggaggggaccctctttcctaacggggttataaaaacag

SEQ ID NO: 71062 - DNA, 76 bp, Homo sapiens; identical to SEQ ID NO: 3520
  misc_feature 1..76: note = chr10:17271443-17271519
  misc_feature 1..76: note = hyper
  source 1..76: mol_type = genomic DNA

SEQ ID NO: 71063 - DNA, 465 bp, Homo sapiens
  misc_feature 1..465: note = chr10:17271520-17271985
  misc_feature 1..465: note = hyper
  source 1..465: mol_type = genomic DNA
tccacccgcacctacagcctgggcagcgcgctgcgccccagcaccagccgcagcctctacgcctcgtccccgggcggcgtgtatgccacgcgctcctctgccgtgcgcctgcggagcagcgtgcccggggtgcggctcctgcaggactcggtggacttctcgctggccgacgccatcaacaccgagttcaagaacacccgcaccaacgagaaggtggagctgcaggagctgaatgaccgcttcgccaactacatcgacaaggtgcgcttcctggagcagcagaataagatcctgctggccgagctcgagcagctcaagggccaaggcaagtcgcgcctgggggacctctacgaggaggagatgcgggagctgcgccggcaggtggaccagctaaccaacgacaaagcccgcgtcgaggtggagcgcgacaacctggccgaggacatcatgcgcctccgggagaag

SEQ ID NO: 71064 - DNA, 38 bp, Homo sapiens
  misc_feature 1..38: note = chr10:17347136-17347174
  misc_feature 1..38: note = hypo
  source 1..38: mol_type = genomic DNA
gatgtgtacaccccccgtgataccggttgcagtatcca

SEQ ID NO: 71065 - DNA, 96 bp, Homo sapiens; identical to SEQ ID NO: 15356
  misc_feature 1..96: note = chr10:17429165-17429261
  misc_feature 1..96: note = hypo
  source 1..96: mol_type = genomic DNA

SEQ ID NO: 71066 - DNA, 96 bp, Homo sapiens; identical to SEQ ID NO: 15357
  misc_feature 1..96: note = chr10:17429561-17429657
  misc_feature 1..96: note = hypo
  source 1..96: mol_type = genomic DNA

SEQ ID NO: 71067 - DNA, 54 bp, Homo sapiens
  misc_feature 1..54: note = chr10:17495392-17495446
  misc_feature 1..54: note = hyper
  source 1..54: mol_type = genomic DNA
gcccccccccaaccccgcgccctcttcaaacacacgcacactcttacactcact

SEQ ID NO: 71068 - DNA, 206 bp, Homo sapiens
  misc_feature 1..206: note = chr10:17495474-17495680
  misc_feature 1..206: note = hyper
  source 1..206: mol_type = genomic DNA
cgagtccaagccggtgcagccgcgccccatgcccggctcgcagctcccgagccccagtccgcccgcgctgggcgccgctgtacctgttagtggcgcgcggtaccgcggtcgccgggctccggagcgtcctcagcgctgcgggggtgccgtgggtggcctccctgctttcctccaccagaatcctgcacagccggggagaaaactta

SEQ ID NO: 71069 - DNA, 94 bp, Homo sapiens; identical to SEQ ID NO: 32911
  misc_feature 1..94: note = chr10:17496002-17496096
  misc_feature 1..94: note = hyper
  source 1..94: mol_type = genomic DNA

SEQ ID NO: 71070 - DNA, 300 bp, Homo sapiens; identical to SEQ ID NO: 10198
  misc_feature 1..300: note = chr10:17496544-17496844
  misc_feature 1..300: note = hyper
  source 1..300: mol_type = genomic DNA

SEQ ID NO: 71071 - DNA, 43 bp, Homo sapiens
  misc_feature 1..43: note = chr10:17505922-17505965
  misc_feature 1..43: note = hypo
  source 1..43: mol_type = genomic DNA
gccccattattagtccgtgtcctgttaggaccaggccacacag

SEQ ID NO: 71072 - DNA, 18 bp, Homo sapiens
  misc_feature 1..18: note = chr10:17531563-17531581
  misc_feature 1..18: note = hypo
  source 1..18: mol_type = genomic DNA
gagagaagtcttggccgg

SEQ ID NO: 71073 - DNA, 95 bp, Homo sapiens; identical to SEQ ID NO: 42544
  misc_feature 1..95: note = chr10:17579985-17580080
  misc_feature 1..95: note = hypo
  source 1..95: mol_type = genomic DNA

SEQ ID NO: 71074 - DNA, 165 bp, Homo sapiens
  misc_feature 1..165: note = chr10:1767764-1767929
  misc_feature 1..165: note = hypo
  source 1..165: mol_type = genomic DNA
accacccagaagagacgcccaggaccccacagcgggggaattacccacccacccggggcaacacccgagagagcagggagcaaagacattcacttccaggacagaaggccacgctgccgcactcgtatccgaagtttgaatgtcctcagccgcagatgcgttttt

SEQ ID NO: 71075 - DNA, 515 bp, Homo sapiens
  misc_feature 1..515: note = chr10:1778568-1779083
  misc_feature 1..515: note = hyper
  source 1..515: mol_type = genomic DNA
gagtttgtcagtggccgctgtcagccggctgcttttcctgctttcctggtttgcggtttttttctaccactaacaaaatatgatgcttctttctgttttcctgtattcatttctgcttatttctccaaggacgagccctgtgttctctttacgacccaatgtttacaaatcgacgggcaccacattgagtaaaaactgccagccaatttggagaggcgatcgcagggcttcgcctatcccttcctccgggacagtttggatgggagtagctggcgcgagggctcgttcccccgtttttgggtaattcctttggcactgggagacgagatggcctccggagggtggaaggcagtgccagcccggccggccactggggactgcggggcccggagacgcgcggggtccccggggagctcctcgccgccctcgccccacttcgtccgggtccctcaaacatgtcgcagcgtggctgctcactgtcccctctgggcaagaggaggccccagacatttcca

SEQ ID NO: 71076 - DNA, 724 bp, Homo sapiens; identical to SEQ ID NO: 32851
  misc_feature 1..724: note = chr10:1779111-1779835
  misc_feature 1..724: note = hyper
  source 1..724: mol_type = genomic DNA

SEQ ID NO: 71077 - DNA, 220 bp, Homo sapiens; identical to SEQ ID NO: 32852
  misc_feature 1..220: note = chr10:1779836-1780056
  misc_feature 1..220: note = hyper
  source 1..220: mol_type = genomic DNA

SEQ ID NO: 71078 - DNA, 41 bp, Homo sapiens
  misc_feature 1..41: note = chr10:1789225-1789266
  misc_feature 1..41: note = hypo
  source 1..41: mol_type = genomic DNA
gtgtcacatggattgcgtgacatgaacgtgactgtcacatg

SEQ ID NO: 71079 - DNA, 30 bp, Homo sapiens
  misc_feature 1..30: note = chr10:1829119-1829149
  misc_feature 1..30: note = hypo
  source 1..30: mol_type = genomic DNA
aaaggttgtcggcttcgcactcgtaggagg

SEQ ID NO: 71080 - DNA, 183 bp, Homo sapiens
  misc_feature 1..183: note = chr10:18349201-18349384
  misc_feature 1..183: note = hypo
  source 1..183: mol_type = genomic DNA
ttaacttagcgagcccgtatctggtttgtgtcctttcagtcatcacactgacattgtgtttgctattccttcatttagctgagtcaaaatgagctggagaagcgaaaatcagcacttcagcctgctctgcggagcagagcgcaggaaggttgccaagcctcccttgatcgcataatgcctctc

SEQ ID NO: 71081 - DNA, 38 bp, Homo sapiens
  misc_feature 1..38: note = chr10:18363159-18363197
  misc_feature 1..38: note = hypo
  source 1..38: mol_type = genomic DNA
acatccatcacaggccgggtgcggtggctcgcgcctgt

SEQ ID NO: 71082 - DNA, 30 bp, Homo sapiens
  misc_feature 1..30: note = chr10:18393639-18393669
  misc_feature 1..30: note = hypo
  source 1..30: mol_type = genomic DNA
caggcaggatggtctcgtaaacaagtagtt

SEQ ID NO: 71083 - DNA, 232 bp, Homo sapiens; identical to SEQ ID NO: 32913
  misc_feature 1..232: note = chr10:18429517-18429749
  misc_feature 1..232: note = hyper
  source 1..232: mol_type = genomic DNA

SEQ ID NO: 71084 - DNA, 401 bp, Homo sapiens
  misc_feature 1..401: note = chr10:18429750-18430151
  misc_feature 1..401: note = hyper
  source 1..401: mol_type = genomic DNA
tggctcccgcgggggcgctcggagccgccgcacaggtagcgagagcgcggcgccttctccttcctttgtgagccgccgggcagggcaccgacctcgggttctcccggcgcctccactgcagggatctctagcctcgcacctcctcccctcgtcgcctgcccaccctctgctcctctcctggcgccggggaccctgcccctttgcgccttttcctggctctgcctcggcttccatttttctctgcttccgaaaagccagtggggaagggcgggggagacctgccagtcctcccagacttctcccgggttgctccagctggccctcctcgccccttcccgggagaggcacatggagagacatgaatcaggggagtggactggacctgctgaagatcgtgagtc

SEQ ID NO: 71085 - DNA, 64 bp, Homo sapiens; identical to SEQ ID NO: 32916
  misc_feature 1..64: note = chr10:18430183-18430247
  misc_feature 1..64: note = hyper
  source 1..64: mol_type = genomic DNA

SEQ ID NO: 71086 - DNA, 90 bp, Homo sapiens; identical to SEQ ID NO: 42447
  misc_feature 1..90: note = chr10:1850230-1850320
  misc_feature 1..90: note = hypo
  source 1..90: mol_type = genomic DNA

SEQ ID NO: 71087 - DNA, 122 bp, Homo sapiens
  misc_feature 1..122: note = chr10:18672520-18672642
  misc_feature 1..122: note = hypo
  source 1..122: mol_type = genomic DNA
ctttcatattagcagcgaggggtaaaccataaataaatacataagtatgtagatggtgcaccagaaggttggggagatattaagcagagaagaggaatacagagtagcgaatagagtgccat

SEQ ID NO: 71088 - DNA, 30 bp, Homo sapiens
  misc_feature 1..30: note = chr10:1889085-1889115
  misc_feature 1..30: note = hypo
  source 1..30: mol_type = genomic DNA
ctcacgcattaataacggcataggggaagt

SEQ ID NO: 71089 - DNA, 30 bp, Homo sapiens
  misc_feature 1..30: note = chr10:18950336-18950366
  misc_feature 1..30: note = hypo
  source 1..30: mol_type = genomic DNA
ggctacttttatactcgcataattgttcag

SEQ ID NO: 71090 - DNA, 39 bp, Homo sapiens
  misc_feature 1..39: note = chr10:18979783-18979822
  misc_feature 1..39: note = hypo
  source 1..39: mol_type = genomic DNA
tataatggaacagaccgggcacggtggttcacacctgta

SEQ ID NO: 71091 - DNA, 30 bp, Homo sapiens
  misc_feature 1..30: note = chr10:1981745-1981775
  misc_feature 1..30: note = hypo
  source 1..30: mol_type = genomic DNA
gagtaacatctttcacgcagagaaaatgag

SEQ ID NO: 71092 - DNA, 30 bp, Homo sapiens
  misc_feature 1..30: note = chr10:19907854-19907884
  misc_feature 1..30: note = hypo
  source 1..30: mol_type = genomic DNA
ctgtttgtctacactcgctcactctctaat

SEQ ID NO: 71093 - DNA, 389 bp, Homo sapiens
  misc_feature 1..389: note = chr10:1994909-1995298
  misc_feature 1..389: note = hypo
  source 1..389: mol_type = genomic DNA
gagggtcctctgctgcgtccttgcggcctgttgtcttactcagcggccctgacacccggcatttatttaaagcctcgaggctggatgcggttgcgacagcagggcgtgttcagaggaaagaaggggctggagcccgggcactcgggttaggcaacgtcaaggggctcgggaggagagtgggctccgccaaggcggtggctgcaggggccacgtgtggcctcttggaacacggaggaaggaagcgctgaaggacgtaaggactgtctgtaaaatcctccctgacaagggaggtcagggtcgggatgtccccttggacgtggcgatgcggaggcctgagtgacctcaggagaggggctaggtggagatgacgctcacggagggtgactcgg

SEQ ID NO: 71094 - DNA, 76 bp, Homo sapiens
  misc_feature 1..76: note = chr10:20056020-20056096
  misc_feature 1..76: note = hypo
  source 1..76: mol_type = genomic DNA
actttgctaggaaaacgggagcataggagagccagagtgacatctttctttttttttgagatggaatctagctctg

SEQ ID NO: 71095 - DNA, 30 bp, Homo sapiens
  misc_feature 1..30: note = chr10:2005972-2006002
  misc_feature 1..30: note = hypo
  source 1..30: mol_type = genomic DNA
gtggaatgtaagtcccgtgagggaaaggac

SEQ ID NO: 71096 - DNA, 152 bp, Homo sapiens
  misc_feature 1..152: note = chr10:20069005-20069157
  misc_feature 1..152: note = hypo
  source 1..152: mol_type = genomic DNA
caataacatgctgtgcgatattgtagcctaggagcaacagactattcattccatataacctggatgtgtaggaggctctaccatctaggtttgtgtaagtacacccaaggatgtttgtcaacaacgaaatcacctatcgatgcatatctcag

SEQ ID NO: 71097 - DNA, 54 bp, Homo sapiens
  misc_feature 1..54: note = chr10:20104308-20104362
  misc_feature 1..54: note = hyper
  source 1..54: mol_type = genomic DNA
taagatatcaactaacgagagggccggcaagggttaacgcggaaacagatcccc

SEQ ID NO: 71098 - DNA, 237 bp, Homo sapiens
  misc_feature 1..237: note = chr10:20105418-20105655
  misc_feature 1..237: note = hyper
  source 1..237: mol_type = genomic DNA
ggctgcgagaaaggacgcgcgccctgcgtcgggcgaagaaaagaagcaaaacttgtcgggagggtttcgtcatcaacctccttcccgcaaacctaaacctcctgccggggccatccctagacagaggaaagttcctgcagagccgaccagccctagtggatctggggcaggcagcggcgctggctgtggaattagatctgttttgaacccagtggagcgcatcgctggggctcggaa

SEQ ID NO: 71099 - DNA, 243 bp, Homo sapiens
  misc_feature 1..243: note = chr10:20106451-20106694
  misc_feature 1..243: note = hyper
  source 1..243: mol_type = genomic DNA
aggctgtgtgctctccggctcctcctccttcctcgctgctggttaaactaagcgtgtgtggtatggggtgggtgggggacgttgtgaaagccagggattgcaggtctcccctctgcacgagaaaattccctgtggcagcaccttccttcccctggcgatccccactagctccgtctagtgacctgggccaagcgggcgctggaaggggggcggggtaaatgcggccggcgcagaggtggggag

SEQ ID NO: 71100 - DNA, 32 bp, Homo sapiens
  misc_feature 1..32: note = chr10:20106927-20106959
  misc_feature 1..32: note = hyper
  source 1..32: mol_type = genomic DNA
tggaaccctgcccaccgcgaactgggtgccta

SEQ ID NO: 71101 - DNA, 30 bp, Homo sapiens
  misc_feature 1..30: note = chr10:20754862-20754892
  misc_feature 1..30: note = hypo
  source 1..30: mol_type = genomic DNA
taaaaaaagaatagtcgtatagttcataga

SEQ ID NO: 71102 - DNA, 193 bp, Homo sapiens
  misc_feature 1..193: note = chr10:2094436-2094629
  misc_feature 1..193: note = hypo
  source 1..193: mol_type = genomic DNA
ctggtttgccctggccgcgtctccatctgttactcagtttctctcatggattcgcaacccacattcaactgccttttcaacttgcaaaagggtcttgttttttgcatgactctttatttttaatcataaaaagtaaccattttgtgtgctcgtttttctttgtcctacaaggatatagcgtactaacctttat

SEQ ID NO: 71103 - DNA, 336 bp, Homo sapiens
  misc_feature 1..336: note = chr10:21461963-21462299
  misc_feature 1..336: note = hyper
  source 1..336: mol_type = genomic DNA
caaatttccccagaacgcccctggctggtttcaactgtcagtcactccggatcgctcctgggtgtctctctcccgggctgttcatctccgtccctgcccgggaagggcagggggcagggctggaggggcccggctacagaactacttcccctggaattccccacccggtggattagacacccgtgggtccggcttgccgcgctgagccggagctctccagcagggattattcttagcaatgcggcagcggccgccccatgacatattaattactatttgcctctccccctcgccgcggtcacaggaggcgctgcgggtgggcggtgaggtgggatc

SEQ ID NO: 71104 - DNA, 53 bp, Homo sapiens
  misc_feature 1..53: note = chr10:21462618-21462671
  misc_feature 1..53: note = hyper
  source 1..53: mol_type = genomic DNA
ggtgccaaaacttctcgaagcaggtgcagcccctcgcccggcaggtccaggct

SEQ ID NO: 71105 - DNA, 60 bp, Homo sapiens
  misc_feature 1..60: note = chr10:21463573-21463633
  misc_feature 1..60: note = hyper
  source 1..60: mol_type = genomic DNA
cccaggcccaagggccgggagatccgcggggaacccggagacctgcgtcccagaggggcc

SEQ ID NO: 71106 - DNA, 63 bp, Homo sapiens; identical to SEQ ID NO: 32919
  misc_feature 1..63: note = chr10:21783695-21783758
  misc_feature 1..63: note = hyper
  source 1..63: mol_type = genomic DNA

SEQ ID NO: 71107 - DNA, 67 bp, Homo sapiens
  misc_feature 1..67: note = chr10:21784179-21784246
  misc_feature 1..67: note = hyper
  source 1..67: mol_type = genomic DNA
aataaacaaagcattcggacgagagtgggctgctgggggctcgggaggtgcgcgagacaaggttacc

SEQ ID NO: 71108 - DNA, 97 bp, Homo sapiens
  misc_feature 1..97: note = chr10:21789041-21789138
  misc_feature 1..97: note = hyper
  source 1..97: mol_type = genomic DNA
aaatgcacgaccccgcgcgccgcgcgcgacctccacgcacacttagagccgaggtgacaagggaaggcggcgggggtggagccgctctctggtggag

SEQ ID NO: 71109 - DNA, 269 bp, Homo sapiens
  misc_feature 1..269: note = chr10:21805094-21805363
  misc_feature 1..269: note = hyper
  source 1..269: mol_type = genomic DNA
tctcagataccctatcgttccttatctcagcgaaacaactccccaggctggccgggcagtacaccggagatgctttgggggcccagctctgcagattccactccgccggcgactccgctttgacactactcttgaggtcgggaagtctgccggcatcctcgaaagcagcgggtttggttgcagcggcggcggaggccagatggtacaagaagttggcctgcgcctgcacgctgggaggcttgcagaagctggtgcgcctgaatcggatg

SEQ ID NO: 71110 - DNA, 124 bp, Homo sapiens
  misc_feature 1..124: note = chr10:21810083-21810207
  misc_feature 1..124: note = hypo
  source 1..124: mol_type = genomic DNA
aggcacattgggggtcgatcccgataaaaagatctagcagaggcccctgagcgctcacacatgaaaggcaggggactttaagatggatttgcatgcacaccggggatttcgatcaatagctacc

SEQ ID NO: 71111 - DNA, 137 bp, Homo sapiens; identical to SEQ ID NO: 42546
  misc_feature 1..137: note = chr10:22033212-22033349
  misc_feature 1..137: note = hypo
  source 1..137: mol_type = genomic DNA

SEQ ID NO: 71112 - DNA, 30 bp, Homo sapiens
  misc_feature 1..30: note = chr10:22040753-22040783
  misc_feature 1..30: note = hypo
  source 1..30: mol_type = genomic DNA
acacctggggaagaacgtggcttggctgca

SEQ ID NO: 71113 - DNA, 40 bp, Homo sapiens
  misc_feature 1..40: note = chr10:22047461-22047501
  misc_feature 1..40: note = hypo
  source 1..40: mol_type = genomic DNA
aaggccaactacaaacggccacggccgtggaaagtaagcc

SEQ ID NO: 71114 - DNA, 41 bp, Homo sapiens; identical to SEQ ID NO: 42547
  misc_feature 1..41: note = chr10:22450029-22450070
  misc_feature 1..41: note = hypo
  source 1..41: mol_type = genomic DNA

SEQ ID NO: 71115 - DNA, 97 bp, Homo sapiens
  misc_feature 1..97: note = chr10:22465341-22465438
  misc_feature 1..97: note = hypo
  source 1..97: mol_type = genomic DNA
acacttcgcattagggttcataccctattagagtcgaatgccacaactgatctgacaggaggtggatctcaggtggagttcacggacagataccagt

SEQ ID NO: 71116 - DNA, 439 bp, Homo sapiens
  misc_feature 1..439: note = chr10:22518011-22518450
  misc_feature 1..439: note = hyper
  source 1..439: mol_type = genomic DNA
gaaatacatgcatttcggtggccccgttacatttcacgcgtcacgaagccgagcaagaccagcccgggccgccttccccgtgtacgcgcgggcctccggggacgcgcagagctggagcggcgggcgcgcgcggcaaacgggcccgcgcggcctctgcgcgtccccgctccagcaccctggcgaggcctagaccgccgtgaagaccccggggaaggagtggccgcgctcacctgcagccgggagaggacagcgggggagaggaggccgctctgcaccggccgaaagcgaagggctcgccggctggccgcgtagtgtaagggtcggtggtttctttgcttggtccctggaaatccaccccttcttatcccggaggcctgaactcgatttctgcaaaacttcccgcgaccagctcataaaaggagagcgcgtccctgggtgg

SEQ ID NO: 71117 - DNA, 18 bp, Homo sapiens
  misc_feature 1..18: note = chr10:22518510-22518528
  misc_feature 1..18: note = hyper
  source 1..18: mol_type = genomic DNA
cttcggtgtcattttccc

SEQ ID NO: 71118 - DNA, 1111 bp, Homo sapiens
  misc_feature 1..1111: note = chr10:22540740-22541851
  misc_feature 1..1111: note = hyper
  source 1..1111: mol_type = genomic DNA
cgggcgacgctcggctgatgggaccgggccgcgcaagcctcggatgcagccgggtggggggcaccaggcgctaggcgaaggagcgcaggaccaaaggagatgcttggctcctaagataacacctttaaaaagaagaagaagaaagaaagaaaaacaaacaaacaaactcgatacttagcctcacgatccttgccaccccctccctgctccgccacccacacacaaaataaagtgagccgggcgggggagtgcgcgccctgaaagggaacaagaagcaaggcgcctgtgacacaaaatggagaaagaggaaccgggagtggaaaggaagaaggaaaaccgagtaaaggaggttattcataagaacaggaaaggggccgaggggtagagaacacccgaaggaaagcgcaggaggccctcgtgagagggcaagggggaaaagatcgacgaagtaagagcgaaaagaggaaaggaaagaaagactttctagatgcggagtctccattttcagcagcgccatattcgcttttcctctcgccgcttttggctgggttttgtgtgcggcggtggacaggcgccagcacatttctgcagcttcagcagctctgctcagacacctggggagggccgcagggcccgggcgggggacgcgcgctcttggcccaggcccgggcgcggccccctccccggcctggcggttcctgcgcagcgccagccccgcgctcctctaggctgcaaagggggcctccgactcgggcccggcccggaggggacacctcactcggggccccgcggcagcccccaggggacgcgggccctctagtttcgcccacggtgtggctgggcatgcgtgccaaggggatgcgtaaccgagaaccgaaaaagacgaacttaaccttcggggaggaggagagggcgcacgctgcgggtaccggggcttgggggcgctcctggaggtgacggggtcacctccacctgcgcggggccactctctgggagccggcgatcgatgcccgccgcggcgcctggcccaggcccccaggcctctcgcggctcccggaaaaacgtccgaggtcggggctcggccgggagccccaagcgggtcccctggcct

SEQ ID NO: 71119 - DNA, 226 bp, Homo sapiens; identical to SEQ ID NO: 875
  misc_feature 1..226: note = chr10:22542024-22542250
  misc_feature 1..226: note = hyper
  source 1..226: mol_type = genomic DNA

SEQ ID NO: 71120 - DNA, 29 bp, Homo sapiens
  misc_feature 1..29: note = chr10:22542567-22542596
  misc_feature 1..29: note = hyper
  source 1..29: mol_type = genomic DNA
ggccccgggataatcggatcctcccagac

SEQ ID NO: 71121 - DNA, 25 bp, Homo sapiens
  misc_feature 1..25: note = chr10:22566939-22566964
  misc_feature 1..25: note = hypo
  source 1..25: mol_type = genomic DNA
tagcatggttgttaacggtggaggg

SEQ ID NO: 71122 - DNA, 84 bp, Homo sapiens
  misc_feature 1..84: note = chr10:22567324-22567408
  misc_feature 1..84: note = hypo
  source 1..84: mol_type = genomic DNA
cagagcgagactccatctcaaacaaacaaacaaaaaagaacgtacactccacagtgttcgagcgggcagcgggagtgagcatag

SEQ ID NO: 71123 - DNA, 284 bp, Homo sapiens
  misc_feature 1..284: note = chr10:22624022-22624306
  misc_feature 1..284: note = hyper
  source 1..284: mol_type = genomic DNA
gaggaggggtggctgcgcggcgggaatctcaagatctgggcaaaggctcgcgtctcgggacgcgaagtcgacgccaaaatgggtccccggacaaggcgaccctgggagtgccggcgcccccggccgggcagaggagcgggtgggccgaggctgggacatcgcctccgaaagctgccgggacgcggcggcttcctgcagagcctgcgcctgccggatccccagaacacagaagcttctcggacatgggagctccccgtgcgccctaaaaccaggagaggaaggga

SEQ ID NO: 71124 - DNA, 560 bp, Homo sapiens; identical to SEQ ID NO: 876
  misc_feature 1..560: note = chr10:22624561-22625121
  misc_feature 1..560: note = hyper
  source 1..560: mol_type = genomic DNA

SEQ ID NO: 71125 - DNA, 401 bp, Homo sapiens; identical to SEQ ID NO: 877
  misc_feature 1..401: note = chr10:22625382-22625783
  misc_feature 1..401: note = hyper
  source 1..401: mol_type = genomic DNA

SEQ ID NO: 71126 - DNA, 292 bp, Homo sapiens; identical to SEQ ID NO: 878
  misc_feature 1..292: note = chr10:22625811-22626103
  misc_feature 1..292: note = hyper
  source 1..292: mol_type = genomic DNA

SEQ ID NO: 71127 - DNA, 190 bp, Homo sapiens; identical to SEQ ID NO: 879
  misc_feature 1..190: note = chr10:22633985-22634175
  misc_feature 1..190: note = hyper
  source 1..190: mol_type = genomic DNA

SEQ ID NO: 71128 - DNA, 108 bp, Homo sapiens; identical to SEQ ID NO: 880
  misc_feature 1..108: note = chr10:22634324-22634432
  misc_feature 1..108: note = hyper
  source 1..108: mol_type = genomic DNA

SEQ ID NO: 71129 - skipped

SEQ ID NO: 71130 - DNA, 215 bp, Homo sapiens; identical to SEQ ID NO: 882
  misc_feature 1..215: note = chr10:22634440-22634655
  misc_feature 1..215: note = hyper
  source 1..215: mol_type = genomic DNA

SEQ ID NO: 71131 - DNA, 30 bp, Homo sapiens
  misc_feature 1..30: note = chr10:2264537-2264567
  misc_feature 1..30: note = hypo
  source 1..30: mol_type = genomic DNA
aacattcacaccagacgtctccttcacagc

SEQ ID NO: 71132 - DNA, 125 bp, Homo sapiens
  misc_feature 1..125: note = chr10:22725790-22725915
  misc_feature 1..125: note = hyper
  source 1..125: mol_type = genomic DNA
gcgcaggggcaaggccgcagcgggcagcggaggccgaaacagagaacacacacaacgcggaccgacagcagtcaccgcaggggtcgccggggcgcggctctataaagcctcggctctataaagcc

SEQ ID NO: 71133 - DNA, 1017 bp, Homo sapiens; identical to SEQ ID NO: 32936
  misc_feature 1..1017: note = chr10:22764573-22765590
  misc_feature 1..1017: note = hyper
  source 1..1017: mol_type = genomic DNA

SEQ ID NO: 71134 - DNA, 137 bp, Homo sapiens
  misc_feature 1..137: note = chr10:22823423-22823560
  misc_feature 1..137: note = hypo
  source 1..137: mol_type = genomic DNA
tccgtggcccggggtttggggacccctgctataatacatcagttgcattagaagaaaaatgagttatcagagcaagtgctatagacaagctgtctgtgttaacctggcaccaagtggaatgccgttaagtctgctat

SEQ ID NO: 71135 - DNA, 30 bp, Homo sapiens; identical to SEQ ID NO: 15322
  misc_feature 1..30: note = chr10:2283030-2283060
  misc_feature 1..30: note = hypo
  source 1..30: mol_type = genomic DNA

SEQ ID NO: 71136 - DNA, 48 bp, Homo sapiens
  misc_feature 1..48: note = chr10:22831077-22831125
  misc_feature 1..48: note = hypo
  source 1..48: mol_type = genomic DNA
gtggggcagcagaggcgccgggtgcctccttcacgatgctcttacact

SEQ ID NO: 71137 - DNA, 102 bp, Homo sapiens
  misc_feature 1..102: note = chr10:22832580-22832682
  misc_feature 1..102: note = hypo
  source 1..102: mol_type = genomic DNA
cctcccctagaatctcggcagctgccaggctgtgaggtgcacctggccgagatcacctggctgggatcatgtttgtgggggcggctgcggggagaaatctac

SEQ ID NO: 71138 - DNA, 64 bp, Homo sapiens
  misc_feature 1..64: note = chr10:22833946-22834010
  misc_feature 1..64: note = hypo
  source 1..64: mol_type = genomic DNA
caaggcagccccaaacggggctctaaggttttggctttcactgcattcccgaatcccggcaggc

SEQ ID NO: 71139 - DNA, 30 bp, Homo sapiens
  misc_feature 1..30: note = chr10:22869695-22869725
  misc_feature 1..30: note = hypo
  source 1..30: mol_type = genomic DNA
tttcactttcaaccacggtctacaagatgt

SEQ ID NO: 71140 - DNA, 138 bp, Homo sapiens
  misc_feature 1..138: note = chr10:22869936-22870074
  misc_feature 1..138: note = hypo
  source 1..138: mol_type = genomic DNA
ctgaacaatgctggccgtcccgtgtgtggctcagaaattaagagcacacaccagataagtgggcttattctcctgtgagagcacaggcagcatgaacacaataccgaagagtgttcctttcagcggctccttgagtag

SEQ ID NO: 71141 - DNA, 34 bp, Homo sapiens
  misc_feature 1..34: note = chr10:22949402-22949436
  misc_feature 1..34: note = hypo
  source 1..34: mol_type = genomic DNA
aaaataaaaaataaataaacgcttactgaatcct

SEQ ID NO: 71142 - DNA, 78 bp, Homo sapiens
  misc_feature 1..78: note = chr10:23001906-23001984
  misc_feature 1..78: note = hyper
  source 1..78: mol_type = genomic DNA
ctgtcatttccattacgctgaaaaggacatacagacatccatcgaaatcaaaagcagggaaagcgaacttacactttt

SEQ ID NO: 71143 - DNA, 30 bp, Homo sapiens
  misc_feature 1..30: note = chr10:23002198-23002228
  misc_feature 1..30: note = hyper
  source 1..30: mol_type = genomic DNA
cccgactgtgcgtgacgctaacctttccac

SEQ ID NO: 71144 - DNA, 18 bp, Homo sapiens
  misc_feature 1..18: note = chr10:23216825-23216843
  misc_feature 1..18: note = hyper
  source 1..18: mol_type = genomic DNA
ctggattcaggtaatcgc

SEQ ID NO: 71145 - DNA, 286 bp, Homo sapiens; identical to SEQ ID NO: 32939
  misc_feature 1..286: note = chr10:23216844-23217130
  misc_feature 1..286: note = hyper
  source 1..286: mol_type = genomic DNA

SEQ ID NO: 71146 - DNA, 242 bp, Homo sapiens
  misc_feature 1..242: note = chr10:23460221-23460463
  misc_feature 1..242: note = hyper
  source 1..242: mol_type = genomic DNA
tttttattacacacacgcgcgggcgtgcgcgcacacacaccctcccccccatccccccaacggaaacaagcacacacccgggacgggaggtattaaaaaggtgtgatccccttgcttttagatttgagcagatggcccatggtttgaggcggttgcctccgcaggctcggcctttaccttcagcaccaaggccagcgcacctggctccacgaggctcccagaaccttcgccattccgggact

SEQ ID NO: 71147 - DNA, 1322 bp, Homo sapiens
  misc_feature 1..1322: note = chr10:23461141-23462463
  misc_feature 1..1322: note = hyper
  source 1..1322: mol_type = genomic DNA
taccaactgtcaccacgatccgcagttcttcgcccctccctctgtcccaattatctagaaacaaaaagagtagaaaatcgaaaatgagatggaggtcggcaggggtgtgaggccacggatggctgctgcttccttgcttccttcttttgaagccagaatcgactctgctcttgctcgatgacagcccctcgccggaggcgcggctcctggcctctgcgggggtccgcgcaatccgggcgcctccagctgcccccctcctccgagggtcgcagccacagagcgcaggcccaagctggggcagaccaagggcggctggggtgctcatgccggtgccggcatcactgccggagccgccctgggcgcactgcacccagcgctgcttctctcgctggttctgtgccgctgctcctcccgatgcttgggggaccgcagggaggccgaatgacaaccggggagcctcggggccgcgcctgaggcccagagtctgggctgtgcagagcgcagagccccagcttccccagctccctcctggattaatgcttggtgccagggagaagcgcagggctctttccgcctcctccccaagtgcacccgggcgcgcttccatctgattagaatgtttcttccatcttattagaatgacagtagctttcaagtcattcattatgagaagaattttagtcttaaaagaaaaaagggagtcccactgtaattgtgagttgtaataaatgcaaacttctggtgccttcctctgcagcatggaagacagtaaaaaatgtgtctcgtccaaacgcaccccctctccaagcccattgtgaagtcagtcgccaacaaaggggacgtgtgaatattcaacaccgactctttcacttgttttttccggaatccctgagtcgactcaccccctctcctttttttttttttttaaatgggcgaatacctgtttaagttttaaaagcacatggaaattgcccgcgagcgaccatataatttgatttgccaggcaatctgcagagcgatcgcacgtcatttataatgttcattgagcattttgcctaattgtgtctgtctctgaaagggcagcgcaccccctcccgaccgctagcagcacaagtggcgacattcccatggagcggccgcgccgcagcttgccgcattcagcgcggacggcctggccgcgcgcttccccgcccggacgaccgggcgcgcctgacactaatagctcgcggctcaggtacgagcgggcgccgcatttgactcaattcaattcacaaccggccgcgcttgcaggtgtcgccttttgaaaccgccattcaggcggc

SEQ ID NO: 71148 - DNA, 130 bp, Homo sapiens; identical to SEQ ID NO: 32943
  misc_feature 1..130: note = chr10:23462485-23462615
  misc_feature 1..130: note = hyper
  source 1..130: mol_type = genomic DNA

SEQ ID NO: 71149 - DNA, 440 bp, Homo sapiens; identical to SEQ ID NO: 32944
  misc_feature 1..440: note = chr10:23462634-23463074
  misc_feature 1..440: note = hyper
  source 1..440: mol_type = genomic DNA

SEQ ID NO: 71150 - DNA, 588 bp, Homo sapiens; identical to SEQ ID NO: 3535
  misc_feature 1..588: note = chr10:23463266-23463854
  misc_feature 1..588: note = hyper
  source 1..588: mol_type = genomic DNA

SEQ ID NO: 71151 - DNA, 190 bp, Homo sapiens; identical to SEQ ID NO: 3536
  misc_feature 1..190: note = chr10:23463887-23464077
  misc_feature 1..190: note = hyper
  source 1..190: mol_type = genomic DNA

SEQ ID NO: 71152 - DNA, 821 bp, Homo sapiens
  misc_feature 1..821: note = chr10:23479876-23480697
  misc_feature 1..821: note = hyper
  source 1..821: mol_type = genomic DNA
ttggaatttgagaggcgtctgaatacccaacagaagcctctagtgagacaagtgcctgaaaaaggaagcggcccaggaggacgactcctttcagtcctctgtagagagaatacgcacgatggctgcgcttctgaactctcccggggtggaagctgcagcctggcttttaaccggaattgcccagaccttgaaagtgtttctttgttgctcttaaaaagaggaattcacgttgcatcgcagtctgtgataaagtctgtcttggggcagagctgcatacgttttgtgttttttttttttttcagaaaagaaaggtcgagaaagaaaaaaacaagtcattcagggatggtccctgtggccagtcggaaaggtgagagactcgggctttgaaaacgattcacattctgccctttaacttcaatgccttccctccggactgcgccggagcagacgattcaatggactccttttgtatccagtttattgctcagaatccctagggtctagatttgctctcagaagaaacgcgccccgctgagctgctctgggggctgcccctcccgtctccccattcctttctccgggccggggagggcaggggaggcagccactgagccgatgtcgctggggacccgcaccaggcaccacagccaggctccagagcggagtcccataggtgcgctcccagcccccgtgttgcgtctggaacgcagtgggagtgggcccggatcaccttccaatgacacccgcatatactctgcaaactgtgcaaaagcccttgaaaagtccagagatgggacagaagcccccagcagaacccaggc

SEQ ID NO: 71153 - DNA, 147 bp, Homo sapiens; identical to SEQ ID NO: 32948
  misc_feature 1..147: note = chr10:23480903-23481050
  misc_feature 1..147: note = hyper
  source 1..147: mol_type = genomic DNA

SEQ ID NO: 71154 - DNA, 82 bp, Homo sapiens; identical to SEQ ID NO: 10226
  misc_feature 1..82: note = chr10:23481303-23481385
  misc_feature 1..82: note = hyper
  source 1..82: mol_type = genomic DNA

SEQ ID NO: 71155 - DNA, 400 bp, Homo sapiens; identical to SEQ ID NO: 10227
  misc_feature 1..400: note = chr10:23481386-23481786
  misc_feature 1..400: note = hyper
  source 1..400: mol_type = genomic DNA

SEQ ID NO: 71156 - DNA, 446 bp, Homo sapiens; identical to SEQ ID NO: 32951
  misc_feature 1..446: note = chr10:23481787-23482233
  misc_feature 1..446: note = hyper
  source 1..446: mol_type = genomic DNA

SEQ ID NO: 71157 - DNA, 180 bp, Homo sapiens
  misc_feature 1..180: note = chr10:23482288-23482468
  misc_feature 1..180: note = hyper
  source 1..180: mol_type = genomic DNA
cgaaggctccggaggggctgggggagctgactgccaagcagacagtcggaccgacggattgtcggtgggcacggaaaaacttgaatgcgagctcgcgtttctcgtttttttttttttttttatttttctgccacgttgaccgcggctctcaagggcgcgcgtccccgccagacttgcagc

SEQ ID NO: 71158 - DNA, 1052 bp, Homo sapiens
  misc_feature 1..1052: note = chr10:23483566-23484618
  misc_feature 1..1052: note = hyper
  source 1..1052: mol_type = genomic DNA
agctagtgggctaagcgaatgggcctttctgcttccactggctgggaaaggggctactcttgagctgccctgtgaccaacctcttcggcagcaacagcatcaggtacctggaactcaggcttactcctcacaaaggagatgggacaggctacggtgccaaagcctagagaccactcggaggccactcaacaaaatccagggtcttttaggtaaggtaggaagaagccgcccgctacccctgccaccttcgcaacaggcttacttccaaaactgagttcgttttgccttcatcagaacttggccctcctcggccagcaacctggggagaaggcgagcctgaggcggggggcgtagggtagccccctagcgaaggggagaagagcgagggcgcggccgaggtcgcttagccagaaagcctgggagtccaggcttgggtttgtctcctttgtggccaagagcgcctcccgggctctcggggcgtcctcccctgcccgccagagccggggcgccggcactgggccctgaggcctggcgcgcgcgcagatggcgttggcgcgagcgcggactggagacgcgctcattgacgtggcaccgtagccccgtgcggcgcaggcctggcccaggcggggtgtggttccgtgggccgcagcggcctggtgggcgaaggtacaattgcggatagcctctaatactcacggccctgccgcaggacaatatgttggcagcatgctaattgctttaacctagtttcagacccaccgaggggttccccgcgcgccgcgggtgccatggacctcgtccaagagcaattaaagcgaggccgcgagcccgaccccgcagcgcggcctggccagacacgcggagattctgggtcgcaaggctcccgggagccccttggccgtggaccctctcaccccttttaagccttcgcgccctctccctccactcctcctaaaagaagatttcacactggagacagaatttcagaacgagagaaaataattcgattttgtcctttattagggcctcattaaacacgaaagttgcttttg

SEQ ID NO: 71159 - DNA, 30 bp, Homo sapiens
  misc_feature 1..30: note = chr10:23484874-23484904
  misc_feature 1..30: note = hyper
  source 1..30: mol_type = genomic DNA
atgaagcggaagaaccgagctgagcatgca

SEQ ID NO: 71160 - DNA, 207 bp, Homo sapiens
  misc_feature 1..207: note = chr10:23486207-23486414
  misc_feature 1..207: note = hyper
  source 1..207: mol_type = genomic DNA
aggctgggagcagagcgcataaaaggccttgttggaactcctgtgaaatcggctgagaatgcttcccaggaccgctcatctgccagccccaggattaacgcccctccgtggagagggtgtgaagcctcttaaatccataaactcatcccatttccattaatgggcctttgcggtggcaccgagtaccagctgcgaggttgaacaaac

SEQ ID NO: 71161 - DNA, 517 bp, Homo sapiens
  misc_feature 1..517: note = chr10:23487742-23488259
  misc_feature 1..517: note = hyper
  source 1..517: mol_type = genomic DNA
gcattactttcaagccgaacaaaggccagggccggggggaggcgggggaagggctcggctgtaatgaagcgcctctaaggcggaggtgctgccgtggaggctgaggcggcggcggagcgcgctgctgcgtttgtgcgcaagtgactctcctgtgccacacacaaaaggcctccctcttcccaccttctgccgcctttcagccctccggctcctgccgagcccgctcctgggactctgggggggatcctggctgcatccccagggcagcctgacctttgggacatccgccgctgccagggcaaacctcgccaaactttccccaaactccgcaggccggggagggaccctggccggaggcgcgcatgcgccccgcccgctgctccgcgttcccagggttccggagagccggggtggagtcggacgagtgtccccggaggcccgcctagcccttgctcccaggggcattcgggactcctgtgctgcctgtcttcgcttgaggctggaagtggctgcccga

SEQ ID NO: 71162 - DNA, 1713 bp, Homo sapiens
  misc_feature 1..1713: note = chr10:23488342-23490055
  misc_feature 1..1713: note = hyper
  source 1..1713: mol_type = genomic DNA
cgaacggccaaaaggagatccggggatgggaccccaggcttcttcggaggaggcccggggcaactacgccccgcggccgggagggaagccctcgggcggccgcctgtagagggccccgtggcccggggcgcaggttgtggcgagctggtttttgcctctgggccgaggcgccagcgctagcagcgacagcagcggggggcgcaggtttctagccagtccccactttcggacctctgggggtctgcccttgcttctcggggagtcttggcccttgactgatccccgcaacttaaggccaatcccatccctagctggccggcacctgttccaaacaacctgttgcgctgacatcgctttggagaggcgccggcgctttgctggtggaggcgggttgtgtggaggccccaagccttcaggaaatagtttagggttccgttgtggtgagaggcaccccctccccgcttcctgtggcatgtggggtgtttcacctctgcctgtgtcccaggaacccaaggcgtcctgggcacctctgcacctcgcccactctagggacttctcatgtagagctcggcagtttgggtggattagacaaagatgaggattagagacacaccgccggctaattaaatgggctcttctcctctcctcgtcccctccccgcaacccgcagccagataggactcttcggttccctacccccactcctaggccctatgtaagtgcggatggagaaagctagttacattagcccttctgtcttagaggtaccggcacctcggggcattctcgctcttaaagatgcgttttctgaattatttctagttttacaatttctcttcggtgactgcacaggatcccttctagctcttttcctgttggagtcgctggacgtctcccaaacagctagttagtcgcctatctctggagcgcaggccttcggaattggattcagggtatgagtctagctaggggatgtttctagaagttttataaaatccatttgggcaagcgttggcattcggattttaaaaatatagacgtgcactggcattgggcaactcaaaaaaaaatgtgtctcctggcgcttgtcagtgacatgctaattacaaattttaaaacaagccacttctaagcgaaggacgcctggctgcaaccccacaactcacaccggtgcatataataaaatattagggttcaacagttggcatatgtggcaatagcaaatgtgacacctcgaagcgattatctggaagtttttccgtacttttgaaaatacacttgccgcctcatttctctgatggccgctcaatagacactgggagatggtagctgggccacccctcccaagagttcttcttgcgtgcagcgctttcatccagggcttgaattgtgttgtcaaagtttagcagacaagaggagggggcatgagaacgggagggtgtcttgaaaagtcttggaaatcggtgtattttgcaggtgtagaagtgcctaataaccatggctagtgcgcgctccccaatggcgagggtatgacagggacagctggctcagttttcagtgtgaaaacaccccctcggtggaccaaacacaacgacactgacctttcttcggggggaaccagggatgtgcctttgactgaattagccataaagacgtcttgctatgacttttgttccccacgaaagcaaagaaatattgcgtttaatatgagaa

SEQ ID NO: 71163 - DNA, 76 bp, Homo sapiens
  misc_feature 1..76: note = chr10:23491161-23491237
  misc_feature 1..76: note = hyper
  source 1..76: mol_type = genomic DNA
acctagctagttctgcggacctctttgttccgcggcagaaagtcaaagaaaaaaggaaaagcgctgccagttgcca

SEQ ID NO: 71164 - DNA, 47 bp, Homo sapiens
  misc_feature 1..47: note = chr10:23632977-23633024
  misc_feature 1..47: note = hyper
  source 1..47: mol_type = genomic DNA
cggagtcgggaacccggcgtccgttgccatggcgactcccaggtaac

SEQ ID NO: 71165 - DNA, 123 bp, Homo sapiens; identical to SEQ ID NO: 32958
  misc_feature 1..123: note = chr10:23633374-23633497
  misc_feature 1..123: note = hyper
  source 1..123: mol_type = genomic DNA

SEQ ID NO: 71166 - DNA, 29 bp, Homo sapiens
  misc_feature 1..29: note = chr10:23708959-23708988
  misc_feature 1..29: note = hypo
  source 1..29: mol_type = genomic DNA
tacaaatgggccaggcgcggtggctcaca

SEQ ID NO: 71167 - DNA, 126 bp, Homo sapiens
  misc_feature 1..126: note = chr10:2374203-2374329
  misc_feature 1..126: note = hypo
  source 1..126: mol_type = genomic DNA
ctccataccccacaccgttcagtcacttagctcagccaccgtgggaacagtgcatgaattgcgacaaggctgctcagccaaggccctctctgaagatgaatcagtgatagacgctgtcttctggaa

SEQ ID NO: 71168 - DNA, 958 bp, Homo sapiens
  misc_feature 1..958: note = chr10:23982384-23983342
  misc_feature 1..958: note = hyper
  source 1..958: mol_type = genomic DNA
ctcgcagttaaaaaccgttgccactcgacggtggcaaaattgctggctgcactggagatcactgcagagcgctcctgatgcctcgatgctgacggcggatctggcgcgggctggggcgcattgcacattctgctccagccgggaggcggcgggcgggcaactccgggttggtcactcggcagccggcagaggtgcgcagaaggcgcacagaaccaggcactcagcctcaaggatgtctgggtctctgctaagggacaaacgctccaggaacaaggaacaacctctagccatcccagcaccacctaacgaaccttcgtttggctctctcgcagaaagtctcttctatttttggcccccaagacaatttcagagaaccagtaaagttgggtgacaacgtggatcgctttctagtgtaaggtcccggggaatggcaaaactcaaatgtagcctcactgatgagctcaaggaactctgcttggagttgtcacccctacgactgacctcagacccaggacccaagggcggggccctcttgcatctggaatccagcctcggccttgacccctttcgcttgttcggagtgctttcgcccagcttctggcggaggttcacgcagggaggggactcaggtggaaaaggctggcccctttgatctctttgcaggaacttagtagacaggggccccgggctggagatttgcttcgagtaggctagaggcgcccttggcgcaccgaagctggctgccttgctggaacctgccgcgggggtggaggttgaaaggactctgagctcttcttccccaagccgaactccctcctacaggagcgtggaaaccaactctcccacaccgtctatcccactcttcccccctaaacctctagcgcagctttttaaaggcatcctgtgcagcctccaactttggggaaagagaatgcccaactcccgctctccaactacc

SEQ ID NO: 71169 - DNA, 1158 bp, Homo sapiens
  misc_feature 1..1158: note = chr10:23983617-23984775
  misc_feature 1..1158: note = hyper
  source 1..1158: mol_type = genomic DNA
cgcggggtggggggtggtgggggtgacgtcaggactgcagtccagaagagagcggctggagagggctgcgcgcttctcgccaagcaagcgggaggcgcactggggccgccgccgttcccgcgctcctccctctcctctgcacccactgtcacgctacccgcccgcgggggagcctcgagagcctccaggtgaattgaaagtcgtttccgggggaggacggagagggtgctgcagtcctggcatgccctgaaactgcaagtcgggcagaaacgacccggcggaggagcagggcgcgcagcgccctgcgcagcatccccgggctgccagaagaggccaccactcggctggcagccgcgagcggcggccgaacctcggccccagactcgggcccccggcacgctcgcccgggagataccccttccccctcttgcgcatttcgcagctgcgctggtgtggggcatgagagcgaggtggctccaggtctccgcggagcagctgccagtgggagagcgaggagaggcgagggggcggcagcctcggcccgaagtaagtgcagcagaagtttgcgtcggttgccccgccgctcccccagcgcgagtgggaggcacatctcccctccttggataaggaaaccgaggggagacttacaagggagccttgcgcgggagagcaagtgagcgtttcgagagagggcaaggacccccccaggagggccaggccgggaggggtcccggtgcggtgatggggtgccaaaaggagaagacccccaactgggaggagggactggagaggaaccggaccccggggatctcagaaagggaaggatgtggggagagtgaaggtggaggcagtcacacctatcctggtgaccttggcgtgcccccctggagtggcgagccaggggcttatataggtgcgactaggatgttgcctcgtttttcactcggggctgcgaagagggcattgctctttctgatggctggaagacaggggcaaggagagagagaaccggccccgagacgggctggagggtggggacactggggagtttggagctgggggttcggagtgggaggtttgggtcttctgagacgctccagactctccggaggcggcagaggtcgaggcaggaggcgaatgtgacgcttagggtcgcta

SEQ ID NO: 71170 - DNA, 146 bp, Homo sapiens; identical to SEQ ID NO: 10240
  misc_feature 1..146: note = chr10:23984841-23984987
  misc_feature 1..146: note = hyper
  source 1..146: mol_type = genomic DNA

SEQ ID NO: 71171 - DNA, 145 bp, Homo sapiens
  misc_feature 1..145: note = chr10:24440378-24440523
  misc_feature 1..145: note = hypo
  source 1..145: mol_type = genomic DNA
gtatctagtatgcatcgggcatggttcaaggttctatgacaggcgctggaggaaggatgttccagccacatcatacacggcgttgtaagaattaatgtactctaggtgtgtgtgtgcttcagagttgatgcgtaagaattcagaa

SEQ ID NO: 71172 - DNA, 44 bp, Homo sapiens
  misc_feature 1..44: note = chr10:24497697-24497741
  misc_feature 1..44: note = hyper
  source 1..44: mol_type = genomic DNA
aatgttttccttcctcggctgcagagcctcggtggtttgcagca

SEQ ID NO: 71173 - DNA, 30 bp, Homo sapiens
  misc_feature 1..30: note = chr10:24498138-24498168
  misc_feature 1..30: note = hyper
  source 1..30: mol_type = genomic DNA
gccagaaatgtgagccgtgccttccttact

SEQ ID NO: 71174 - DNA, 102 bp, Homo sapiens; identical to SEQ ID NO: 42450
  misc_feature 1..102: note = chr10:2452926-2453028
  misc_feature 1..102: note = hypo
  source 1..102: mol_type = genomic DNA

SEQ ID NO: 71175 - DNA, 104 bp, Homo sapiens
  misc_feature 1..104: note = chr10:24841749-24841853
  misc_feature 1..104: note = hypo
  source 1..104: mol_type = genomic DNA
catctcctacctactcgccttgtttcaaaaataaaatacaatgtcctagtggcactataacaaaggtataattattaccgtgccatgcacgcacccatcagcag

SEQ ID NO: 71176 - DNA, 24 bp, Homo sapiens
  misc_feature 1..24: note = chr10:24842550-24842574
  misc_feature 1..24: note = hypo
  source 1..24: mol_type = genomic DNA
caggaaagggccaggcgaggtggc

SEQ ID NO: 71177 - DNA, 30 bp, Homo sapiens
  misc_feature 1..30: note = chr10:24860681-24860711
  misc_feature 1..30: note = hypo
  source 1..30: mol_type = genomic DNA
cgtattctttagctacggcaatgtcaggtg

SEQ ID NO: 71178 - DNA, 42 bp, Homo sapiens
  misc_feature 1..42: note = chr10:24908420-24908462
  misc_feature 1..42: note = hypo
  source 1..42: mol_type = genomic DNA
caaagaatcgccaggcggactggtactcgaggcttttctttc

SEQ ID NO: 71179 - DNA, 42 bp, Homo sapiens; identical to SEQ ID NO: 42555
  misc_feature 1..42: note = chr10:24988521-24988563
  misc_feature 1..42: note = hypo
  source 1..42: mol_type = genomic DNA

SEQ ID NO: 71180 - DNA, 51 bp, Homo sapiens
  misc_feature 1..51: note = chr10:25241140-25241191
  misc_feature 1..51: note = hyper
  source 1..51: mol_type = genomic DNA
gcagaagcgactccccgtggctcgcggggatggggacggctgggcgccggc

SEQ ID NO: 71181 - DNA, 274 bp, Homo sapiens
  misc_feature 1..274: note = chr10:25241730-25242004
  misc_feature 1..274: note = hyper
  source 1..274: mol_type = genomic DNA
gagcagctgccaagccgctaccgctccccctgagcgcgggccccggacgcgtcccttgcggccgccgctgtcgccgccgccccctgccggatggtcgcgtgcagcccccggccccgccgccaagccccgcggggactctggagcaggaagcccgcggcaggaagagaacgtgtcccccaggcccctgattcccagatccaccgtcccagccctcgggctaacaatctccttgactcctccctgccagatttcatgcacgcgattgtcccaagca

SEQ ID NO: 71182 - DNA, 42 bp, Homo sapiens
  misc_feature 1..42: note = chr10:25408449-25408491
  misc_feature 1..42: note = hypo
  source 1..42: mol_type = genomic DNA
gcgtgtgtgtttgcacgcatttaaacccgcctctgcaaatag

SEQ ID NO: 71183 - DNA, 452 bp, Homo sapiens
  misc_feature 1..452: note = chr10:25463441-25463893
  misc_feature 1..452: note = hyper
  source 1..452: mol_type = genomic DNA
acccacgcaggtttccgagtcatccggaacgcgagtgggtgcgaggactcggcaggctgcctcccgcgcccccgccgcccgcgggccgcctcgggttcagcactggacagctccctccccggccccacaaatggcagtcggctgattgacagaggagccgaccaaacagggaacaagacgacttgcagccgccctacaagggtttggttgcggccaagctgcctctttaaactggctttcctcccccgaggagggagcagggagagagggtggagtgtggtttgcggccaaacctaaaggctgcaattaaccagccgcccggccttcgctactccggacagacgaacgtcttaaaggacgtcttcgctcctcgggagtcgcggctgcgctcgcggtgcgggtctgggcgcgcgccccgcgcctccgggcgaagcggtcgaggaggagccagt

SEQ ID NO: 71184 - DNA, 299 bp, Homo sapiens
  misc_feature 1..299: note = chr10:25464520-25464819
  misc_feature 1..299: note = hyper
  source 1..299: mol_type = genomic DNA
tcggctccctggagccgctccaccgatggcaccatcttggcgcagaaactcgccgaggaggtgcccatggacgtggcctcttacctctacaccggggactcccaccagctgaagcgagccaactgctccggccgctacgagttggcgggcctgccggggaagtggccagccctggccagcgcgcacccctccttgcaccgggcgctggacacactgacacacgccaccaacttcctcaacgtgatgctgcagagcaataagtcgcgggagcagaacttgcaggacgacctggattggta

SEQ ID NO: 71185 - DNA, 249 bp, Homo sapiens
  misc_feature 1..249: note = chr10:25465101-25465350
  misc_feature 1..249: note = hyper
  source 1..249: mol_type = genomic DNA
gcgcaaggacgggctcggcggggacaagagccacttcaagtggtctccgccttatctggagtgcgagaacgggagttacaagcccgggtggctggttactctttcctctgccatctacgggttgcagcctaacctggtcccggaattcaggtagggagggccggggggcaggggggaaggcaaaagcgaagctttccttccggtcttgtgggtgggtgcacgtgtgaggaaggaacccttggctgtgac

SEQ ID NO: 71186 - DNA, 249 bp, Homo sapiens
  misc_feature 1..249: note = chr10:25465351-25465600
  misc_feature 1..249: note = hyper
  source 1..249: mol_type = genomic DNA
cgaacgcttctcaccctcagagtagagacccgggctgagggacaccccacgcgggcgcgggtgcttgggggcaagaagcgccccacgcccgtcagcttccggcgctcggcgaaagccattcattctctcggaccagtttccccgcactgggcgagggacaggcagcccttggcaggacggagacacccccgctgctctgtgcttccctccaattgtccggagagcagggaggggcgttccccaccgggg

SEQ ID NO: 71187 - DNA, 67 bp, Homo sapiens
  misc_feature 1..67: note = chr10:25465877-25465944
  misc_feature 1..67: note = hyper
  source 1..67: mol_type = genomic DNA
gggtgctccttctaccggtctcccctctccccgcaattgatctttccttcctcggtggccttttcct

SEQ ID NO: 71188 - DNA, 148 bp, Homo sapiens; identical to SEQ ID NO: 42556
  misc_feature 1..148: note = chr10:25592447-25592595
  misc_feature 1..148: note = hypo
  source 1..148: mol_type = genomic DNA

SEQ ID NO: 71189 - DNA, 183 bp, Homo sapiens; identical to SEQ ID NO: 32968
  misc_feature 1..183: note = chr10:26055811-26055994
  misc_feature 1..183: note = hyper
  source 1..183: mol_type = genomic DNA

SEQ ID NO: 71190 - DNA, 32 bp, Homo sapiens; identical to SEQ ID NO: 42557
  misc_feature 1..32: note = chr10:26127993-26128025
  misc_feature 1..32: note = hypo
  source 1..32: mol_type = genomic DNA

SEQ ID NO: 71191 - DNA, 30 bp, Homo sapiens
  misc_feature 1..30: note = chr10:2620590-2620620
  misc_feature 1..30: note = hypo
  source 1..30: mol_type = genomic DNA
ccagaaaagtcaccacgtctgcacaatgag

SEQ ID NO: 71192 - DNA, 30 bp, Homo sapiens; identical to SEQ ID NO: 42558
  misc_feature 1..30: note = chr10:26211012-26211042
  misc_feature 1..30: note = hypo
  source 1..30: mol_type = genomic DNA

SEQ ID NO: 71193 - DNA, 108 bp, Homo sapiens
  misc_feature 1..108: note = chr10:26222992-26223100
  misc_feature 1..108: note = hyper
  source 1..108: mol_type = genomic DNA
cgaggatgtggatggcgcggatggcgcggcctccacctgcgggcagtggagagagcggcgagaggaagaatattccccgcgagccgggataaggggccccttcggctc

SEQ ID NO: 71194 - DNA, 105 bp, Homo sapiens; identical to SEQ ID NO: 32970
  misc_feature 1..105: note = chr10:26223101-26223206
  misc_feature 1..105: note = hyper
  source 1..105: mol_type = genomic DNA

SEQ ID NO: 71195 - DNA, 672 bp, Homo sapiens
  misc_feature 1..672: note = chr10:26223425-26224097
  misc_feature 1..672: note = hyper
  source 1..672: mol_type = genomic DNA
ggaggacctgtgtgtttgtcggggcctggggtgagagaggggactcgaggggagaagtagagcgggaaaccaagagggggaatgtgaggcttgaacgagctggatgggagagctcgaggggaggagagggatgaacttgagggggaaacgggggcgggggtgaactcgagggggagccaggaggagggaacgggaagggtgaacctgaggggtggacttgagggaagatcttgtgggtgaacccgaggagggaacgcgaggggatagtgaggggggatctcgaggagggaacgtgaggaatgaacttgaggagggaacgggaggggtgaacgtgaagtggaaacaggaggagggaacgggaagggtggcgtaaggggtgaaggaagatctttaggggtgaacttgggaaggaaacgtaaggggaggacctcgaagagtaacgaggggcgagaactgagggggccctgcagggagactggagggaggaggcgccgagtctggcgggtgtcgcctcggagacctgtggcgcgcgcgggctttgcggcgccgcccacaggtggcgctgggtcggcccgtccctgagggaactgcgttccgggtgatttctcagaacaagcaggtcggtggagctgggctccctgcaaccccaaatgcatccgtaaaggagtttta

SEQ ID NO: 71196 - DNA, 30 bp, Homo sapiens
  misc_feature 1..30: note = chr10:26494015-26494045
  misc_feature 1..30: note = hypo
  source 1..30: mol_type = genomic DNA
agtaagagacaacagcgatggtgaactgag

SEQ ID NO: 71197 - DNA, 361 bp, Homo sapiens
  misc_feature 1..361: note = chr10:26500510-26500871
  misc_feature 1..361: note = hyper
  source 1..361: mol_type = genomic DNA
aagctttagttagcacgtatctaaacaccattaccaggctccaccagcccctctgctcctcagcttagaggagtttttaaaacctgttgagaattatcgcagatacgtttggccattatccagtcgtttcgattgtgcctttcctaaatgtccgcggttggcagaacgtgggaggaagaggacccgcctaactcggggtaggtggggacgcgctgctcactgtggtgaggttgacacttgggccctgggtttcacttgcaggtgctgggcggcggagagccccgagaaggaggaggagagagagccagcagccaacccctacgacttcaggaggctcctgcgcaaaacctcccagcgccgg

SEQ ID NO: 71198 - DNA, 136 bp, Homo sapiens; identical to SEQ ID NO: 32973
  misc_feature 1..136: note = chr10:26501026-26501162
  misc_feature 1..136: note = hyper
  source 1..136: mol_type = genomic DNA

SEQ ID NO: 71199 - DNA, 143 bp, Homo sapiens
  misc_feature 1..143: note = chr10:26501446-26501589
  misc_feature 1..143: note = hyper
  source 1..143: mol_type = genomic DNA
gtgccttggaaaacccgtggtttgcgtgactgatccctcattttcccctctagggcttctgaggggcttctgctataaggctgtgctggtgacgggcccaaggaggggcgttgaggtgccttcatcagcgaactcccagcacc

SEQ ID NO: 71200 - DNA, 451 bp, Homo sapiens
  misc_feature 1..451: note = chr10:26503693-26504144
  misc_feature 1..451: note = hyper
  source 1..451: mol_type = genomic DNA
tgagccctgagttttcgaccacccgggctcccacagcctggaacagacttcacctagcacgctcagtgccagccttcggcaggacgctatcaacgcccgactggtttcctgctctcatcctggcgcctgggcccagttgccatagtgtggatcccatgactcctcagggaacccctggactcaggcacgcgagaagaagacagcgctttgtggagagaattgaccagggacagttatgctcgagcacacaggacttgggcctgtatgcgtccagcatgggccccaggatgtcccttctaagcgagggtcgaggggtgctcgcccagacgggatccccgggtctctgctttgttagcagctttggtggctggttcaggaggtcagagaaataaaacgacttgtgaacacaatggaaatgacaggcgctctggccaggcgcggggaaggcagc

SEQ ID NO: 71201 - DNA, 694 bp, Homo sapiens; identical to SEQ ID NO: 3546
  misc_feature 1..694: note = chr10:26504190-26504884
  misc_feature 1..694: note = hyper
  source 1..694: mol_type = genomic DNA

SEQ ID NO: 71202 - DNA, 228 bp, Homo sapiens; identical to SEQ ID NO: 32977
  misc_feature 1..228: note = chr10:26505008-26505236
  misc_feature 1..228: note = hyper
  source 1..228: mol_type = genomic DNA

SEQ ID NO: 71203 - DNA, 62 bp, Homo sapiens; identical to SEQ ID NO: 32978
  misc_feature 1..62: note = chr10:26505441-26505503
  misc_feature 1..62: note = hyper
  source 1..62: mol_type = genomic DNA

SEQ ID NO: 71204 - DNA, 114 bp, Homo sapiens; identical to SEQ ID NO: 32979
  misc_feature 1..114: note = chr10:26505504-26505618
  misc_feature 1..114: note = hyper
  source 1..114: mol_type = genomic DNA

SEQ ID NO: 71205 - DNA, 640 bp, Homo sapiens; identical to SEQ ID NO: 32980
  misc_feature 1..640: note = chr10:26505713-26506353
  misc_feature 1..640: note = hyper
  source 1..640: mol_type = genomic DNA

SEQ ID NO: 71206 - DNA, 265 bp, Homo sapiens; identical to SEQ ID NO: 32981
  misc_feature 1..265: note = chr10:26506354-26506619
  misc_feature 1..265: note = hyper
  source 1..265: mol_type = genomic DNA

SEQ ID NO: 71207 - DNA, 528 bp, Homo sapiens
  misc_feature 1..528: note = chr10:26506902-26507430
  misc_feature 1..528: note = hyper
  source 1..528: mol_type = genomic DNA
cgtttctccatgcaacaggtaaagactcagcggggagccccggggcgcccctgcccctctctctgccccgcccaccgcggccggtgcgggtccggcgctgagagccggacaggggcgtcgaggtggcagcggaggcgggacctgccagaatcttcagataaaagcgagaaatgcgggacctgcccgctgggtccaagcccccgaacctggcctcggagctccaagagggctctgaggccgtggcgctcttcccccagcgcggcccttgggatggcgggtggccgacgatccaggcgctcgtgcgctcactgaatcgatgacggctggcttccctaggccgctggggcctcgggtgggactcagtttccaaataccgtgcccgagaattcagaattgcattttttttaggtctttagatcacgagagtgatttgtagctgcaattgcacaagagaacgattccattcacatgaaacccgcgcgccgagttttacccccgtgcacttacacaccgtctcccaaatgtacg

SEQ ID NO: 71208 - DNA, 36 bp, Homo sapiens
  misc_feature 1..36: note = chr10:26634123-26634159
  misc_feature 1..36: note = hypo
  source 1..36: mol_type = genomic DNA
acaggcatgagccactgcatccggctgcttttattt

SEQ ID NO: 71209 - DNA, 30 bp, Homo sapiens
  misc_feature 1..30: note = chr10:26634775-26634805
  misc_feature 1..30: note = hypo
  source 1..30: mol_type = genomic DNA
agattgtctggccctcgtgactatccctta

SEQ ID NO: 71210 - DNA, 139 bp, Homo sapiens
  misc_feature 1..139: note = chr10:26638399-26638538
  misc_feature 1..139: note = hypo
  source 1..139: mol_type = genomic DNA
gaaatattgggggcaggttcccccaatactggcatctataggaaatgtatatgagggatggaagagacgagaggtggggagaccagaaataacaaacagttcaggagagggatggaaaaggctgcggtgagaacagcgg

SEQ ID NO: 71211 - DNA, 32 bp, Homo sapiens
  misc_feature 1..32: note = chr10:26676768-26676800
  misc_feature 1..32: note = hypo
  source 1..32: mol_type = genomic DNA
cagaaatcttaaggccgggcgcggtggctcac

SEQ ID NO: 71212 - DNA, 33 bp, Homo sapiens
  misc_feature 1..33: note = chr10:26680701-26680734
  misc_feature 1..33: note = hyper
  source 1..33: mol_type = genomic DNA
acctgctggaaagctcgcagcagggcccgctcc

SEQ ID NO: 71213 - DNA, 171 bp, Homo sapiens; identical to SEQ ID NO: 32984
  misc_feature 1..171: note = chr10:26680960-26681131
  misc_feature 1..171: note = hyper
  source 1..171: mol_type = genomic DNA

SEQ ID NO: 71214 - DNA, 26 bp, Homo sapiens
  misc_feature 1..26: note = chr10:26699638-26699664
  misc_feature 1..26: note = hypo
  source 1..26: mol_type = genomic DNA
atgcacctgtcgtcccggctactagg

SEQ ID NO: 71215 - DNA, 85 bp, Homo sapiens
  misc_feature 1..85: note = chr10:26699784-26699869
  misc_feature 1..85: note = hypo
  source 1..85: mol_type = genomic DNA
atgtagtgtatacttgaaaatcactaacagcgtaaattttaagtgatctcactgcacataaaaataagcacgtgaggtaagacat

SEQ ID NO: 71216 - DNA, 201 bp, Homo sapiens
  misc_feature 1..201: note = chr10:26710933-26711134
  misc_feature 1..201: note = hypo
  source 1..201: mol_type = genomic DNA
tgatttatataaaatcgcacttgatcctcttactaactggcttttttcatgcagcctaattatttcgagattcatccatgttgtaccagaagtttacttcttattattgcagggtagcatttcaccatatgaatatcacacactttgttcatccatttacctattgatgtgcacttgggttgattccaattcagggctatt

SEQ ID NO: 71217 - DNA, 30 bp, Homo sapiens
  misc_feature 1..30: note = chr10:26716901-26716931
  misc_feature 1..30: note = hypo
  source 1..30: mol_type = genomic DNA
tatctcagagtttcacgaatttcatgctta

SEQ ID NO: 71218 - DNA, 30 bp, Homo sapiens; identical to SEQ ID NO: 42560
  misc_feature 1..30: note = chr10:26720842-26720872
  misc_feature 1..30: note = hypo
  source 1..30: mol_type = genomic DNA

SEQ ID NO: 71219 - DNA, 741 bp, Homo sapiens; identical to SEQ ID NO: 32985
  misc_feature 1..741: note = chr10:26727076-26727817
  misc_feature 1..741: note = hyper
  source 1..741: mol_type = genomic DNA

SEQ ID NO: 71220 - DNA, 241 bp, Homo sapiens
  misc_feature 1..241: note = chr10:26727867-26728108
  misc_feature 1..241: note = hyper
  source 1..241: mol_type = genomic DNA
cgggtccgacgccgggggcagctccaggatctggcctcgtgaacgcgtgcccccaggcgtggccctcgagcgcagcgggtccccagggtcccctccgctgatctccactctggacccggctcgcgagggtgggggtgtgagggtttggggttcgggtttgctttttcccgagctattgcaacagatttgacagatttcctgcccaggaaattgctgcaaggtcaaacggggaactgctatg

SEQ ID NO: 71221 - DNA, 162 bp, Homo sapiens
  misc_feature 1..162: note = chr10:26733284-26733446
  misc_feature 1..162: note = hypo
  source 1..162: mol_type = genomic DNA
aggattctgagaaggcgaataacatgatctgacttaaggctcactctgactgcttgagaataaacctgggggagcagaggtgaaagcaaggaacccatgacaaagcgttggattctgcgtatattttgaaggagagccaagatttcccgacagaaggaatgt

SEQ ID NO: 71222 - DNA, 30 bp, Homo sapiens; identical to SEQ ID NO: 15362
  misc_feature 1..30: note = chr10:26739045-26739075
  misc_feature 1..30: note = hypo
  source 1..30: mol_type = genomic DNA

SEQ ID NO: 71223 - DNA, 30 bp, Homo sapiens
  misc_feature 1..30: note = chr10:26746969-26746999
  misc_feature 1..30: note = hypo
  source 1..30: mol_type = genomic DNA
gaagttgtatggagccgaaagtgcaaggac

SEQ ID NO: 71224 - DNA, 93 bp, Homo sapiens
  misc_feature 1..93: note = chr10:26775009-26775102
  misc_feature 1..93: note = hypo
  source 1..93: mol_type = genomic DNA
aataatgtaaaaaaatataaataaattaaaaaataaaaggccccgaatgggacaaattaggaaggactttgaaagacacgctgagtgcctgaa

SEQ ID NO: 71225 - DNA, 23 bp, Homo sapiens
  misc_feature 1..23: note = chr10:26783462-26783485
  misc_feature 1..23: note = hypo
  source 1..23: mol_type = genomic DNA
aaaccaattctagaccgggcaca

SEQ ID NO: 71226 - DNA, 21 bp, Homo sapiens
  misc_feature 1..21: note = chr10:26791280-26791301
  misc_feature 1..21: note = hypo
  source 1..21: mol_type = genomic DNA
gtctcttgggccaggcgtggt

SEQ ID NO: 71227 - DNA, 39 bp, Homo sapiens; identical to SEQ ID NO: 42564
  misc_feature 1..39: note = chr10:26801561-26801600
  misc_feature 1..39: note = hypo
  source 1..39: mol_type = genomic DNA

SEQ ID NO: 71228 - DNA, 99 bp, Homo sapiens; identical to SEQ ID NO: 42565
  misc_feature 1..99: note = chr10:26801660-26801759
  misc_feature 1..99: note = hypo
  source 1..99: mol_type = genomic DNA

SEQ ID NO: 71229 - DNA, 30 bp, Homo sapiens
  misc_feature 1..30: note = chr10:26816959-26816989
  misc_feature 1..30: note = hypo
  source 1..30: mol_type = genomic DNA
gacatattcttcccacggtcaatgggaaga

SEQ ID NO: 71230 - DNA, 81 bp, Homo sapiens
  misc_feature 1..81: note = chr10:26832035-26832116
  misc_feature 1..81: note = hypo
  source 1..81: mol_type = genomic DNA
gaaagcactgaaggccgggagaaggctggatccgttcactcactcattcattcagtcatttaatgtttgttgaatgacggc

SEQ ID NO: 71231 - DNA, 207 bp, Homo sapiens
  misc_feature 1..207: note = chr10:26854203-26854410
  misc_feature 1..207: note = hypo
  source 1..207: mol_type = genomic DNA
cgcttactcctgacacgagcttcacaaccagctcaactcagaccaagaaaaaatgtatcccttcctatatgacgaggactctggtggcttggcttgagaaccaaggagtgaagtcatttggcttccattttgaaggaatgaatgagctgagggtggtttatagactgagccaaccccacaagagatataccacgaaagcccctttag

SEQ ID NO: 71232 - DNA, 30 bp, Homo sapiens
  misc_feature 1..30: note = chr10:26871319-26871349
  misc_feature 1..30: note = hypo
  source 1..30: mol_type = genomic DNA
tggcccagggctgctcgtgccagcaatgct

SEQ ID NO: 71233 - DNA, 60 bp, Homo sapiens
  misc_feature 1..60: note = chr10:26873385-26873445
  misc_feature 1..60: note = hypo
  source 1..60: mol_type = genomic DNA
tggctctcacatctacgagtgtgcagacagcgaaggcacaggctgcgatatacaggagaa

SEQ ID NO: 71234 - DNA, 197 bp, Homo sapiens
  misc_feature 1..197: note = chr10:26877695-26877892
  misc_feature 1..197: note = hypo
  source 1..197: mol_type = genomic DNA
gacagcaaagacacacgacacgatatacaggagcagaggcgcccagaacacgctgtcccccaatgccagccacaagcggggccagctcagggtgtagtgggtgaagccgtcctgcagctctgtgatccacaaggcggaggtggcagtagcacaggactccaccgctttggaggctgcccagtcgaatttgggagcca

SEQ ID NO: 71235 - DNA, 161 bp, Homo sapiens
  misc_feature 1..161: note = chr10:26902350-26902511
  misc_feature 1..161: note = hypo
  source 1..161: mol_type = genomic DNA
caataaaaggcaaaccgttttctgcactgttcattcaaaatggcaaagtcatccttacaaataaatatttataacacaatttcagatcaagaagaagcacaaatgtgaaactgattaaaagcttttatataatgtactaagaaaaaacccacaaaagaata

SEQ ID NO: 71236 - DNA, 24 bp, Homo sapiens
  misc_feature 1..24: note = chr10:26907325-26907349
  misc_feature 1..24: note = hypo
  source 1..24: mol_type = genomic DNA
caccgcacccggcccaaaaatatg

SEQ ID NO: 71237 - DNA, 45 bp, Homo sapiens; identical to SEQ ID NO: 42570
  misc_feature 1..45: note = chr10:26942249-26942294
  misc_feature 1..45: note = hypo
  source 1..45: mol_type = genomic DNA

SEQ ID NO: 71238 - DNA, 30 bp, Homo sapiens
  misc_feature 1..30: note = chr10:26964475-26964505
  misc_feature 1..30: note = hypo
  source 1..30: mol_type = genomic DNA
caccaccttccttctcggtccaccatcttt

SEQ ID NO: 71239 - DNA, 22 bp, Homo sapiens
  misc_feature 1..22: note = chr10:27004609-27004631
  misc_feature 1..22: note = hypo
  source 1..22: mol_type = genomic DNA
gccaccgcgcctgggcactcct

SEQ ID NO: 71240 - DNA, 30 bp, Homo sapiens; identical to SEQ ID NO: 42451
  misc_feature 1..30: note = chr10:2706731-2706761
  misc_feature 1..30: note = hypo
  source 1..30: mol_type = genomic DNA

SEQ ID NO: 71241 - DNA, 15 bp, Homo sapiens
  misc_feature 1..15: note = chr10:27542296-27542311
  misc_feature 1..15: note = hypo
  source 1..15: mol_type = genomic DNA
cgcagttggactcat

SEQ ID NO: 71242 - DNA, 812 bp, Homo sapiens
  misc_feature 1..812: note = chr10:27547520-27548332
  misc_feature 1..812: note = hyper
  source 1..812: mol_type = genomic DNA
ctgctaacttgtccccgaccccacaactgctcacgaccttcgtgaaggtcaacctttcctaccgcgtggagtgagttgggatgcatactggggagttgtataagagtgtctgagaaagggaaatgcagagttgaatgaaagtgtttcccgggaggggccgagtggaaagcagcaggtggccggcgcgggtggaacccagcgcgggcgcagagcgtctctggcgtgggcattcggtgcagcgagtccgcgggaatcttggatgcgcggaggtccccggaccgcggtgacggacggggctgcgatcgtggccggtgagactgggagcggagggctggggcggcgcccgagggagggcacaaacccgggaggcctcagccgacggcgcagctttacgcggccgtagggcgcccggggttgagtggtgtcctagcaacaggtgggcgccgactgcggcggggcagggcgctgcaggtgacttcggccgggggtccccaggcccaccccatgggggctctgcagccggccgcgtagatcgggaaaccggggccgctctccggccccgccgctgctgctctcgcctgcttccctttccctcccgggggccgagacctgccccctccccttttctctcccaggcccatctcgctccttcctccccgcgagaccctgcctcggccctcggttggggaccgtctgctcctcagtccctgcgcccctctctgcactaccctggacccatcacctcccggatcggttctccacttaccccgctgtttccctgtctctccttccgcgagcccatctttctcctt

SEQ ID NO: 71243 - DNA, 150 bp, Homo sapiens
  misc_feature 1..150: note = chr10:27548400-27548550
  misc_feature 1..150: note = hyper
  source 1..150: mol_type = genomic DNA
cgaatccattcttggaaacttagggtctcagctctgacgcccccttcttgtaacgagtctggtgggggccgtcatcccacactaggcttagctttgattttacttagggccctgttcatgccagttctaaaagttcgattttctgtaggt

SEQ ID NO: 71244 - DNA, 222 bp, Homo sapiens
  misc_feature 1..222: note = chr10:2758950-2759172
  misc_feature 1..222: note = hypo
  source 1..222: mol_type = genomic DNA
tgttttcatctttgccgtcggctgggatgcttgaaggagaggcccgtgactcatcgcgttctgtcactttggtgcctggaatacggtaaccactcaataaatattaattgccattataatgattaccattgctgttatcagtgttattcttctccactgtagcgtaatacttgctatgatccagatcaggtttttgaagcaacttcacgcttggcatttcag

SEQ ID NO: 71245 - DNA, 54 bp, Homo sapiens
  misc_feature 1..54: note = chr10:2775287-2775341
  misc_feature 1..54: note = hypo
  source 1..54: mol_type = genomic DNA
cccacttgaggaaagcgacatcccagagagagagacagacgtccccacagaggg

SEQ ID NO: 71246 - DNA, 17 bp, Homo sapiens
  misc_feature 1..17: note = chr10:27794496-27794513
  misc_feature 1..17: note = hypo
  source 1..17: mol_type = genomic DNA
atttattttttgagacg

SEQ ID NO: 71247 - DNA, 42 bp, Homo sapiens
  misc_feature 1..42: note = chr10:27846677-27846719
  misc_feature 1..42: note = hypo
  source 1..42: mol_type = genomic DNA
ttgaaagttgagagacggcggagcgtggtggctcacccctgt

SEQ ID NO: 71248 - DNA, 640 bp, Homo sapiens
  misc_feature 1..640: note = chr10:28030465-28031105
  misc_feature 1..640: note = hyper
  source 1..640: mol_type = genomic DNA
agcgacgcgtttgcccgcccggacgctccacgccccggccaagcccgggccccgcatccaaactgcgcattcctgccttgcgcccctgctttgcgcgcgcccagagtgtttgggagaggcaggaagtgggagccacacagtttctggatggggagatcatttcgataggtttatcttgaatagggggataccttgaacccaataccccaaggttagaggtttagaagacgaaggtcaagtgatttgaagaatactgctattccagtcgcgtatctgggcagcggggctaactgctacccttccctcacccgctggcgccgcaccctcgagtggccctggcctggcaggcctggcagggtatgcggctggctctcgaaacttccctcggggatctcttgtctgctcccagaggctttccgtcgcttgtggtcaggggaaaggtcgccgactggacatagggaataaagcaaaggagcattgccgccccggctctctttaagctatttcctttgatcttttaggaaaagggggaaactttctaaaggagttggtggtttgtggaggaaagctgcagaacccaaaaacaccgtcgggccgtttcccgactaagggagggttaaaagtacggcaagctctgtcc

SEQ ID NO: 71249 - DNA, 324 bp, Homo sapiens; identical to SEQ ID NO: 32990
  misc_feature 1..324: note = chr10:28031314-28031638
  misc_feature 1..324: note = hyper
  source 1..324: mol_type = genomic DNA

SEQ ID NO: 71250 - DNA, 881 bp, Homo sapiens; identical to SEQ ID NO: 32991
  misc_feature 1..881: note = chr10:28031863-28032744
  misc_feature 1..881: note = hyper
  source 1..881: mol_type = genomic DNA

SEQ ID NO: 71251 - DNA, 1139 bp, Homo sapiens
  misc_feature 1..1139: note = chr10:28032952-28034091
  misc_feature 1..1139: note = hyper
  source 1..1139: mol_type = genomic DNA
gatttgggggattttcgtgttttctagatcgtggatggtttggttgaaacccccgcatcttctgtccgccaaggtcccccggggtgaggttgggttcaaggacaggaaaaagttaagtggcgtcaggacgaaagcaccacttctcccccttctctcccagaatcttcctatcatcccccaacgcgccccgggaagtgcatggtcctaaggtccaaggcgccaggacccaggtccccagagccctcaatcagtgccattctcttccgcagcgcgggtgtcagccgcgagctcgtagcccctcgacacccgcctctctctggggtctccggggaccctttcagaggctgtaaaggtgtcagaagcccaaggcaggaggcagcttggtcggcgcacctcccgggccactgctgccactgtcggggagagccagcagctcacctctggggtcgcggaggccctgagcctctgcctgccgcgcaccggcgtcaggagcaagtccgcgcggccgcggagccgcagagttacagccccaaggcgcgcggcggacttcgcccgccccatctcctcgcctcgcgcctcgggacagctcccgtttcctccgagcggcctcagcttcgctgccagcgccccctttgcccgtccagccgcggcatgggctgctactccactaacacacgcgcgcgcgcatacacacacacacacacacacacacacacacacaccctttgcctcgccaagcgcccacactcgccaacgcccccgccccgcccttcggccaccgcagcagaggccacgcgtgacatttaggaccacgcgtgaccaccgcgatcaaacgacggctacggtctgtgttcgtagggaagtgaagtcagacctctgctggatgtcgtgtgtcccctaggactgcgtcctcccgcgcagacaggtacgtgcctggggtgtgcacatagcctcggtgataagtgtcaaagagaattttcgtgcttgcagcccctgttctacagtcaagactcgcgttggtgttttcttttaaaatcatgcccttagggatgtgtgttcatgctgctttatttgtacaagacacccttccccggcccggccttctccgagccaccccagcgcgtcctcctagatgcgac

SEQ ID NO: 71252 - DNA, 95 bp, Homo sapiens
  misc_feature 1..95: note = chr10:28034092-28034187
  misc_feature 1..95: note = hyper
  source 1..95: mol_type = genomic DNA
acgtgtttttcctagcgaagtcatcacgaggttagccacctcggacacttccccggcagccccaagcccacgcagagatcgcagacacagacacc

SEQ ID NO: 71253 - DNA, 230 bp, Homo sapiens
  misc_feature 1..230: note = chr10:28034326-28034556
  misc_feature 1..230: note = hyper
  source 1..230: mol_type = genomic DNA
cgcctcttctcaaatcacttaccccgattcactccagactgtggccggggaggtcactccctgcagaagtgtccccctcccccaacgccggcgaataattttaaagcaaaggaggcgcggccaggtgggctcccaagctccgcgcagacccttgggccagccttggccgctacccgagcgcctctccaccagaccttggagggaagttgggggaagggcgggagagcacc

SEQ ID NO: 71254 - DNA, 963 bp, Homo sapiens
  misc_feature 1..963: note = chr10:28034873-28035836
  misc_feature 1..963: note = hyper
  source 1..963: mol_type = genomic DNA
ggtatccacgttcccgggcgggtggagaggaagcgtccgcgcccgcccggccgcgggggctgctgttaacccctagcagaggagccgctgccggggagccccgggcccgccgagtcctccggagccgggcgcggctcccagatccgccggccttgcagtcgtggagcagacggggcttttcccttcgcactttaggagagaaattggagaagctgccgggagcgctcggctccggctccagaagctgagaggctgcggtgcaaatcccgtgtcttagctggcccgattgccggaaatttcactgcgcgtggctaggcgggagaggccactgtgacgcgccctgtattttcctctcgattagctggagggaagttagagctccgttttgcacctacagccctggagcgtattgcgggaagtgctagtgcccaggagcctcttttctgatgtcactgggcttctggggtcctagttgtctcagtcaaagccaggcacacattcacctccggggcaagggctggtgaggctgccctcgccgctgggtatagggatgggggaaagcaaggatgggatgagttcagcccaggtggccaacccgcggtggcccaagtgcagaagaggaagcgcgcccaaagccaaggatctgcacgcagcaaaggagatggaacttagaagaatcacaagctgggacacagggcaaagagagagaatggctaccagattctctgattgatgatactttgcttcctaacattaccgcaaatataagtagcgaaagcggcggtttaggtgcaactgcaagctcagagcttctggcagcccagaagatccccaaggtgccaacacgaagctgcctgcgctctcgccgaaggccctgtggtcctagcgaactttcgccctttttaaagaacaaacttagatttccccccaccaagcttaaagaaatagcgccatttgtccttt

SEQ ID NO: 71255 - DNA, 30 bp, Homo sapiens
  misc_feature 1..30: note = chr10:28036088-28036118
  misc_feature 1..30: note = hyper
  source 1..30: mol_type = genomic DNA
cggtttacatttttgcgcaccaggaagata

SEQ ID NO: 71256 - DNA, 137 bp, Homo sapiens
  misc_feature 1..137: note = chr10:28258201-28258338
  misc_feature 1..137: note = hypo
  source 1..137: mol_type = genomic DNA
tgtgaatcctgcacccgatgccttctactctaggtatgtatcgccgccaattatagttttctattttcttatcttccccacccaacgttgcaacagggcctgcacctggttttccaggtattcgcaggctttgcata

SEQ ID NO: 71257 - DNA, 15 bp, Homo sapiens
  misc_feature 1..15: note = chr10:28287365-28287380
  misc_feature 1..15: note = hyper
  source 1..15: mol_type = genomic DNA
cgggaggcagagctg

SEQ ID NO: 71258 - DNA, 429 bp, Homo sapiens
  misc_feature 1..429: note = chr10:28287777-28288206
  misc_feature 1..429: note = hyper
  source 1..429: mol_type = genomic DNA
cgcgggtcaacactgcgcgccctgcggccgcgcacgccggcgcccttgtgggaggcctacagggcccgtgccctcccccgggcgccgccgccgccgccttccgctcccagcctcacccggccgcgaccgcagcccagtccgttaccctggtctcgggacctccgcgcatccaagattcccgcggacccgttgcaccgtatgcccgcgccagagacgctctgcgcccgcgctgggttccacccgccccggccacctgctgctttccgctcggcccctcccgggaaacacttttattcaactttgcatctccctttctcaaacacttttatgcaactcccgagtgtgcaccctaactcactccacgcggtgggaaaggttgactttgacagaggtcgtgagcagttgcggggtcggcggcaagttagcaga

SEQ ID NO: 71259 - DNA, 30 bp, Homo sapiens
  misc_feature 1..30: note = chr10:28504430-28504460
  misc_feature 1..30: note = hypo
  source 1..30: mol_type = genomic DNA
cagggacagcgttctcgaggaagcgacaat
